US010212939B2

(12) United States Patent
Floro et al.

(10) Patent No.: US 10,212,939 B2
(45) Date of Patent: *Feb. 26, 2019

(54) METHYLOBACTERIUM COMPOSITIONS AND PLANTS, PLANT PARTS AND SEEDS COATED THEREWITH

(71) Applicant: NewLeaf Symbiotics, Inc., St. Louis, MO (US)

(72) Inventors: Rachel DiDonato Floro, St. Louis, MO (US); Justin Lee, St. Louis, MO (US); Gregg Bogosian, Clarkson Valley, MO (US)

(73) Assignee: NEWLEAF SYMBIOTICS, INC., St. Louis, MO (US)

( * ) Notice: Subject to any disclaimer, the term of this patent is extended or adjusted under 35 U.S.C. 154(b) by 0 days.

This patent is subject to a terminal disclaimer.

(21) Appl. No.: 15/101,374

(22) PCT Filed: Dec. 4, 2014

(86) PCT No.: PCT/US2014/068558
§ 371 (c)(1),
(2) Date: Jun. 2, 2016

(87) PCT Pub. No.: WO2015/085063
PCT Pub. Date: Jun. 11, 2015

(65) Prior Publication Data
US 2016/0302425 A1 Oct. 20, 2016

Related U.S. Application Data

(60) Provisional application No. 61/954,840, filed on Mar. 18, 2014, provisional application No. 61/911,516, filed on Dec. 4, 2013.

(51) Int. Cl.
A01N 63/00 (2006.01)

(52) U.S. Cl.
CPC .................... *A01N 63/00* (2013.01)

(58) Field of Classification Search
CPC ...................................... A01N 63/00
USPC ........................................ 504/117
See application file for complete search history.

(56) References Cited

U.S. PATENT DOCUMENTS

| 4,336,334 | A | 6/1982 | Powell et al. |
| 5,106,648 | A | 4/1992 | Williams |
| 5,302,525 | A | 4/1994 | Groleau et al. |
| 5,403,799 | A | 4/1995 | Miller et al. |
| 5,403,809 | A | 4/1995 | Miller et al. |
| 5,512,069 | A | 4/1996 | Holland et al. |
| 5,961,687 | A | 10/1999 | Joshi et al. |
| 6,107,067 | A | 8/2000 | Miller et al. |
| 6,174,837 | B1 | 1/2001 | Joshi et al. |
| 6,329,230 | B1 | 12/2001 | Matsuda |
| 7,214,509 | B2 | 5/2007 | Schnoor et al. |
| 7,435,878 | B2 | 10/2008 | Holland |
| 8,153,118 | B2 | 4/2012 | Holland et al. |
| 8,181,388 | B2 | 5/2012 | Berger |
| 8,778,660 | B2 | 7/2014 | Holland et al. |
| 9,181,541 | B2 | 11/2015 | Bogosian |
| 9,845,462 | B2 | 12/2017 | Bogosian |
| 2001/0001095 | A1 | 5/2001 | Joshi et al. |
| 2003/0211082 | A1 | 11/2003 | Holland |
| 2004/0175407 | A1* | 9/2004 | McDaniel ............... A62D 3/02 424/423 |
| 2005/0096225 | A1 | 5/2005 | Johnson |
| 2006/0150488 | A1 | 7/2006 | Pearce et al. |
| 2006/0228797 | A1* | 10/2006 | Holland ................ A01N 63/00 435/377 |
| 2007/0074451 | A1 | 4/2007 | Pearce et al. |
| 2010/0093538 | A1 | 4/2010 | Gnanamanickam |
| 2013/0324407 | A1* | 12/2013 | Bogosian ............... C12N 11/02 504/117 |
| 2015/0337256 | A1 | 11/2015 | Bogosian |
| 2016/0046925 | A1 | 2/2016 | Bogosian |
| 2016/0073641 | A1 | 3/2016 | Allen et al. |
| 2016/0120188 | A1 | 5/2016 | Bogosian |
| 2016/0295868 | A1 | 10/2016 | Jones et al. |
| 2016/0302423 | A1 | 10/2016 | Jones et al. |
| 2016/0302424 | A1 | 10/2016 | DiDonato et al. |
| 2017/0086464 | A1 | 3/2017 | Floro et al. |
| 2017/0135352 | A1 | 5/2017 | Breakfield et al. |

(Continued)

FOREIGN PATENT DOCUMENTS

| CA | 2183275 A1 | 2/1998 |
| CN | 101028008 A | 9/2007 |

(Continued)

OTHER PUBLICATIONS

ATCC Catalogue. ATCC Bacteria and Bacteriophages, 19th edition, 1996, pp. 231-214.*
ATCC Preservation Methods: Freezing and freeze-drying; Published by ATCC, 2nd edition, 1991, pp. 5-13.*
Wessman et al. (J Sci Food Agric 2011, 91, pp. 2518-2528).*
International Search Report and Written Opinion dated Apr. 28, 2015, issued in PCT Patent Application No. PCT/US2014/068558.
Joe et al., "Development of Alginate-Based Aggregate Inoculants of *Methylobacterium* sp. and Azospirillum Brasilence Tested Under In Vitro Conditions to Promote Plant Growth", Journal of Applied Microbiology, Nov. 22, 2013, pp. 408-423, vol. 116, Issue 2.
Madhaiyan et al., "Metal Tolerating Methylotrophic Bacteria Reduces Nickel and Cadmium Toxicity and Promotes Plant Growth of Tomato (*Lycopersicon esculentum* L.)", Chemosphere, May 23, 2007, pp. 220-228, vol. 69.

(Continued)

Primary Examiner — Johann R Richter
Assistant Examiner — Courtney A Brown
(74) Attorney, Agent, or Firm — Thompson Coburn LLP; Charles P. Romano

(57) ABSTRACT

The present invention provides both compositions comprising *Methylobacterium* and compositions comprising *Methylobacterium* that are depleted of substances that promote growth of resident microorganisms on a lettuce plant or seed. Also provided are methods for improving lettuce production, methods of making the compositions, and methods of treating a lettuce plant or seed with the compositions comprising *Methylobacterium*.

20 Claims, No Drawings
Specification includes a Sequence Listing.

(56) References Cited

U.S. PATENT DOCUMENTS

| | | | |
|---|---|---|---|
| 2017/0164618 | A1 | 6/2017 | Breakfield et al. |
| 2017/0238553 | A1 | 8/2017 | Jones et al. |

FOREIGN PATENT DOCUMENTS

| | | | | |
|---|---|---|---|---|
| EP | 0140723 | A1 | 5/1985 | |
| EP | 2390345 | A1 | 11/2011 | |
| KR | 100755509 | B1 | 9/2007 | |
| KR | 20070106867 | A | 11/2007 | |
| KR | 20070106868 | A | 11/2007 | |
| KR | 20070111915 | A | 11/2007 | |
| KR | 20080097568 | A | 11/2008 | |
| KR | 100953179 | B1 | 4/2010 | |
| KR | 10-1195899 | B1 | 10/2012 | |
| WO | 2000/060052 | A1 | 10/2000 | |
| WO | 2003046226 | A1 | 6/2003 | |
| WO | 2012012671 | A2 | 1/2012 | |
| WO | 2012/140212 | A2 | 10/2012 | |
| WO | 2012140207 | A2 | 10/2012 | |
| WO | WO 2012140212 | A2 * | 10/2012 | ............ A01N 63/00 |
| WO | 2013141815 | A1 | 9/2013 | |
| WO | WO-2013141815 | A1 * | 9/2013 | ............ A01N 63/00 |
| WO | 2013/181610 | A1 | 12/2013 | |
| WO | 2014194189 | A1 | 12/2014 | |
| WO | 2015/085117 | A1 | 6/2015 | |
| WO | 2015142393 | A1 | 9/2015 | |
| WO | 2016069564 | A1 | 5/2016 | |
| WO | 2016201284 | A2 | 12/2016 | |
| WO | 2018/106899 | | 6/2018 | |

OTHER PUBLICATIONS

Rastogi et al., "Leaf Microbiota in an Agroecosystem Spatiotemporal Variation in Bacterial Community Composition on Field-Grown Lettuce", The ISME Journal, Apr. 26, 2012. pp. 1812-1822, vol. 6.
Adams, "The Principles of Freeze-Drying", Methods in Molecular Biology, 2007, pp. 15-38, vol. 368.
Balachandar et al., "Genetic and Metabolic Diversity of Pink-Pigmented Facultative Methylotrophs in Phyllosphere of Tropical Plants", Brazilian Journal of Microbiology, 2008, pp. 68-73, vol. 39.
Chitra et al., "Multigeneric PGPR Coaggregates: A Novel Bioformulation and Delivery System for the Induction of Systemic Resistance in Rice—*Xanthomonas oryzae* Pathosystem Under Lowland Condition", Golden Research Thoughts, Oct. 2013, pp. 1-10, vol. 3, No. 4.
Chitra et al., "Multigeneric Microbial Coaggregates-Effect of Different Bioformulations of PGPR Cells on the Enhancement of PGPR Characteristics and Biocontrol Against *Xanthomonas oryzae* pv. oryzae in Rice Grown Under Lowland Condition", Journal of Applicable Chemistry, 2013, pp. 1132-1140, vol. 2, No. 5.
Corpe et al., "Methanol-Utilizing Bacteria Associated with Green Plants", Developments in Industrial Microbiology, 1982, pp. 483-493, vol. 23.
De Valdez et al., "Effect of Drying Medium on Residual Moisture Content and Viability of Freeze-Dried Lactic Acid Bacteria", Applied and Environmental Microbiology, Feb. 1985, pp. 413-415, vol. 49, No. 2.
GenBank entry FP103042, Nov. 5, 2010, retreived on Jan. 5, 2016 from http://www.ncbi.nlm.nih.gov/nuccore/254265931?sat=18&satkey-27964264.
Gomathy et al., "Impact of Biofertigation of Azophosmet on Cotton Yield under Dripirrigation", Research Journal of Agriculture and Biological Sciences, 2008, pp. 695-699, vol. 4, No. 6.
International Search Report and Written Opinion dated Feb. 16, 2016, issued in PCT Patent Application No. PCT/US2015/057521.
International Search Report and Written Opinion dated Feb. 20, 2015, issued in PCT Patent Application No. PCT/US2014/068657.
International Search Report and Written Opinion dated Feb. 23, 2015, issued in PCT Patent Application No. PCT/US2014/068663.
International Search Report and Written Opinion dated Mar. 2, 2015, issued in PCT Patent Application No. PCT/US2014/068660.
International Search Report and Written Opinion for PCT/US2013/043722 dated Aug. 23, 2013.
Jiang et al., "Methanotrophs: Multifunctional Bacteria with Promising Applications in Environmental Bioengineering", Biochemical Engineering Journal, May 15, 2010, pp. 277-288, vol. 49 No. 3.
Kongkhaem et al., "Silica-Immobilized *Methylobacterium* sp. NP3 and *Acinetobacter* sp. PK1 Degrade High Concentrations of Phenol", Letters in Applied Microbiology, May 2011, pp. 448-455, vol. 52 No. 5.
Leslie et al., "Trehalose and Sucrose Protect Both Membranes and Proteins in Intact Bacteria during Drying", Applied and Environmental Microbiology, Oct. 1995, pp. 3592-3597, vol. 61 No. 10.
Li et al., "2,4,5,-Trichlorophenol Degradation Using a Novel TiO2-Coated Biofilm Carrier: Roles of Adsorption, Photocatalysis, and Biodegradation", Environmental Science & Technology, Aug. 23, 2011, pp. 8359-8367. vol. 45. No. 19.
Ntsaluba et al., "Studies on Bioflocculant Production by *Methylobacterium* sp. Obi Isolated from a Freshwater Environment in South Africa", African Journal of Microbiology Research, Nov. 16, 2011, pp. 4533-4540, vol. 5 No. 26.
Poorniammal et al., "In Vitro Biocontrol Activity of Methylobacterium Extorquens Against Fungal Pathogens", International Journal of Plant Protection, 2009, pp. 59-62, vol. 2, No. 1.
Simoes et al., "Adhesion and Biofilm Formation on Polystyrene by Drinking Water-Isolated Bacteria", Antonie van Leeuwenhoek, Apr. 20, 2010, pp. 317-329, vol. 98 No. 3.
Sundaram et al., "Bioinoculants for Sustainable and Cost Effective Production of High Quality Fibre", TMC Annual Report, TMC-MMI-2.3, 2006, pp. 1-7, Retrieved from the internet, Apr. 2, 2014, http://www.tmc.cicr.org.in/PDF/22.3.pdf.
Verhoef et al., "*Methylobacterium* sp. Isolated from a Finnish Paper Machine Produces Highly Pyruvated Galactan Exopolysaccharide", Carbohydrate Research, 2003, pp. 1851-1859, vol. 338.
Vuilleumier et al., "Methylobacterium Genome Sequences: A Reference Blueprint to Investigate Microbial Metabolism of C1 Compounds from Natural and Industrial Sources", Public Library of Science One, May 18, 2009, pp. 1-16; vol. 4, No. 5.
Abanda-Nkpwatt et al., "Molecular Interaction Between Methylobacterium Extorquens and Seedlings: Growth Promotion, Methanol Consumption, and Localization of the Methanol Emission Site", Journal of Experimental Botany, Oct. 16, 2006, vol. 57 No. 15, pp. 4025-4032.
Corpe et al., "Ecology of the Methylotrophic Bacteria on Living Leaf Surfaces", FEMS Microbiology Ecology, 1989, vol. 62, pp. 243-250.
Green, "Methylobacterium", Prokaryotes, 2006, vol. 5, Chapter 3.1.13, pp. 257-265.
Holland, "Methylobacterium and Plants", Recent Research Developments in Plant Physiology, 1997, pp. 207-213, vol. 1.
Joe et al., Development of Alginate-Based Aggregate Inoculants of *Methylobacterium* sp. and Azospirillum Brasilense Tested Under in vitro Conditions to Promote Plant Growth, Journal of Applied Microbiology, Nov. 2012, pp. 1-46.
Lidstrom et al., "Plants in the Pink: Cytokinin Production by Methylbacterium", Journal of Bacteriology, Apr. 2002, p. 1818, vol. 184, No. 7.
Madhaiyan et al., "Growth promotion and induction of systemic resistance in rice cultivar Co-47 (*Oryza sativa* L.) by *Methylobacterium* spp.", Biology and Fertility of Soils, 2005, pp. 350-358, vol. 41.
Madhaiyan et al., "Pink-Pigmented Facultative Methylotrophic Bacteria Accelerate Germination, Growth and Yield of Sugarcane Clone Co86032 (*Saccharum officinarum* L.)", Biology and Fertility of Soils, 2005, pp. 350-358, vol. 41.
Omer et al., "Plant Colonization by Pink-Pigmented Facultative Methylotrophic Bacteria (PPFMs)", FEMS Microbiology Ecology, Mar. 2004, pp. 319-326, vol. 47 No. 3.
Sy, A. et al., "Methylotrophic Metabolism is Advantageous for Methylobacterium extorquens during Colonization of Medicago truncatula under Competitive Conditions", Applied and Environmental Microbiology, 2005, pp. 7245-7252, vol. 71, No. 11.

(56) References Cited

OTHER PUBLICATIONS

Vaidehi et al., "Adhesion of Methylobacterium Cells to Rice Roots: Active Metabolism of Miropartner Determines the Degree of Adsorption Level at Rhizosphere", International Journal of Research in Pure and Applied Microbiology, 2012, pp. 54-58, vol. 2, No. 4.
RD4AG Lettuce Field Trial Report dated May 31, 2015.
Pacific Ag Research, "Evaluation of Efficacy Using NLS Strains as Biostimulant in Direct Seeded Cool Season Lettuce Approach", Research and Development Project Report, Winter-Summer 2015.
RD4AG Lettuce Field Trial Report dated Jan. 30, 2015.
Ryu et al., "Plant Growth Substances Produced by *Methylobacterium* spp. and Their Effect on Tomato (*Lycopersicon esculentum* L.) and Red Pepper (*Capsicum annuum* L.) Growth", Journal of Microbiology and Biotechnology, Oct. 2006, pp. 1622-1628, vol. 16, No. 10.
Tani et al., "Methylobacterium Species Promoting Rice and Barley Growth and Interaction Specificity Revealed with Whole-Cell Matrix-Assisted Laser Desorption/Ionization-Time-of-Flight Mass Spectrometry (MALDI-TOF/MS) Analysis" PLOS ONE, Jun. 8, 2015, 15 pages.
TerrasymTM 402 Product Sheet; Jan. 2018.

\* cited by examiner

METHYLOBACTERIUM COMPOSITIONS AND PLANTS, PLANT PARTS AND SEEDS COATED THEREWITH

CROSS REFERENCE TO RELATED APPLICATIONS

This patent application is a 35 U.S.C. § 371 US national stage application of International Patent Application PCT/US2014/068558, filed Dec. 4, 2014 and incorporated herein by reference in its entirety, which claims the benefit of U.S. Provisional Patent Application No. 61/954,840, filed Mar. 18, 2014, and U.S. Provisional Patent Application No. 61/911,516, filed Dec. 4, 2013, which are each incorporated herein by reference.

SEQUENCE LISTING STATEMENT

A sequence listing containing the file named 53907-155282_SL.txt which is 15,167,357 bytes (measured in MS-Windows®) and created on Jun. 1, 2016, comprises 10,250 sequences, is provided herewith via the USPTO's EFS system, and is incorporated herein by reference in its entirety.

BACKGROUND

One-carbon organic compounds such as methane and methanol are found extensively in nature, and are utilized as carbon sources by bacteria classified as methanotrophs and methylotrophs. Methanotrophic bacteria include species in the genera *Methylobacter, Methylomonas, Methylomicrobium, Methylococcus, Methylosinus, Methylocystis, Methylosphaera, Methylocaldum*, and *Methylocella* (Lidstrom, 2006). Methanotrophs possess the enzyme methane monooxygenase, that incorporates an atom of oxygen from $O_2$ into methane, forming methanol. All methanotrophs are obligate one-carbon utilizers that are unable to use compounds containing carbon-carbon bonds. Methylotrophs, on the other hand, can also utilize more complex organic compounds, such as organic acids, higher alcohols, sugars, and the like. Thus, methylotrophic bacteria are facultative methylotrophs. Methylotrophic bacteria include species in the genera *Methylobacterium, Hyphomicrobium, Methylophilus, Methylobacillus, Methylophaga, Aminobacter, Methylorhabdus, Methylopila, Methylosulfonomonas, Marinosulfonomonas, Paracoccus, Xanthobacter, Ancylobacter* (also known as *Microcyclus*), *Thiobacillus, Rhodopseudomonas, Rhodobacter, Acetobacter, Bacillus, Mycobacterium, Arthobacter*, and *Nocardia* (Lidstrom, 2006).

Most methylotrophic bacteria of the genus *Methylobacterium* are pink-pigmented. They are conventionally referred to as PPFM bacteria, being pink-pigmented facultative methylotrophs. Green (2005, 2006) identified twelve validated species in the genus *Methylobacterium*, specifically *M. aminovorans, M. chloromethanicum, M. dichloromethanicum, M. extorquens, M. fujisawaense, M. mesophilicum, M. organophilum, M. radiotolerans, M. rhodesianum, M. rhodinum, M. thiocyanatum*, and *M. zatmanii*. However, *M. nidulans* is a nitrogen-fixing *Methylobacterium* that is not a PPFM (Sy et al., 2001). *Methylobacterium* are ubiquitous in nature, being found in soil, dust, fresh water, sediments, and leaf surfaces, as well as in industrial and clinical environments (Green, 2006).

SUMMARY

Provided herein are compositions comprising *Methylobacterium* that are depleted of substances that promote growth of resident bacteria on the plant or seed, compositions comprising a solid substance with adherent *Methylobacterium* grown thereon or an emulsion having *Methylobacterium* grown therein, compositions comprising certain *Methylobacterium* strains, methods of using the compositions to improve lettuce production, and methods of making the compositions. Such compositions are in certain instances referred to herein as simply "*Methylobacterium*-containing compositions". In certain embodiments, the *Methylobacterium* in the composition or that is used is strain NLS0020, NLS0066, NLS0017, NLS0065, NLS0089, NLS0042, or NLS0068. In certain embodiments, the *Methylobacterium* in the composition or that is used is *Methylobacterium* is selected from the group consisting of NLS0017 (NRRL B-50931), NLS0020 (NRRL B-50930), NLS0021 (NRRL B-50939), NLS0037 (NRRL B-50941), NLS0038 (NRRL B-50942), NLS0042 (NRRL B-50932), NLS0046 (NRRL B-50929), NLS0062 (NRRL B-50937), NLS0064 (NRRL B-50938), NLS0065 (NRRL B-50935), NLS0066 (NRRL B-50940), NLS0068 (NRRL B-50934), NLS0069 (NRRL B-50936), NLS0089 (NRRL B-50933), and derivatives thereof. In certain embodiments, the *Methylobacterium* in the composition or that is used is a *Methylobacterium* that has at least one gene encoding a protein that is orthologous to a protein having an amino acid sequence of SEQ ID NO: 1-5125. In certain embodiments, the *Methylobacterium* has at least one gene encoding a protein that is orthologous to a reference protein of Table 7. In certain embodiments, the *Methylobacterium* sp. can contain at least one gene encoding a protein that is orthologous to a reference protein having the amino acid sequence of 13, 14, 23, 27, 28, 30, 40, 43, 44, 51, 52, 57, 76, 85, 127, 197, 198, 199, 1094, 1100, 1106, 1114, 1116, 1117, 1120, 1180, 2180, 2190, 2463, 2467, 2468, 2471, 2510, 2515, 2676, 2971, 3357, 3370, 3372, 3394, 3427, 3429, 3430, 3950, 3952, 3968, 3987, 3996, 4004, 4006, and/or 4067 of Table 7. In certain embodiments the *Methylobacterium* has at least one gene encoding a protein that is orthologous to a reference protein is selected from the group consisting of SEQ ID NO: 13, 14, 23, 1094, 1100, 1106, 2467, 2468, 3357, 3370, and/or 3968. In certain embodiments the *Methylobacterium* has at least one gene encoding a protein that is orthologous to a reference protein is selected from the group consisting of SEQ ID NO: 1100, 1116, 2471 and/or 3950. In certain embodiments, the *Methylobacterium* in the composition or that is used is strain NLS0020, NLS0066, NLS0017, NLS0065, or NLS0089 and the composition is used to treat a lettuce seed.

Methods for improving lettuce production comprising applying a coating or partial coating of a composition comprising *Methylobacterium* to a lettuce plant, a part thereof, or to a lettuce seed, wherein said composition comprises: (a) a solid substance with adherent *Methylobacterium* grown thereon; (b) an emulsion having *Methylobacterium* grown therein; (c) certain *Methylobacterium* strains selected from the group consisting of NLS0017 (NRRL B-50931), NLS0020 (NRRL B-50930), NLS0021 (NRRL B-50939), NLS0037 (NRRL B-50941), NLS0038 (NRRL B-50942), NLS0042 (NRRL B-50932), NLS0046 (NRRL B-50929), NLS0062 (NRRL B-50937), NLS0064 (NRRL B-50938), NLS0065 (NRRL B-50935), NLS0066 (NRRL B-50940), NLS0068 (NRRL B-50934), NLS0069 (NRRL B-50936), NLS0089 (NRRL B-50933), and derivatives thereof and an agriculturally acceptable adjuvant, excipient, or combination thereof; or (d) a *Methylobacterium* that has at least one gene encoding at least one protein that is orthologous to a protein having an amino acid sequence of SEQ ID NO: 1-5125 and an agriculturally acceptable adjuvant, excipient, or combination thereof; and wherein said lettuce plant or lettuce plant grown from said seed exhibits a trait improvement selected from the group consisting of an increased rate of leaf growth, an increased rate of root growth, increased total biomass production, increased seed yield, decreased cycle time, and combinations thereof when compared to an untreated control lettuce plant or a control lettuce plant grown from an untreated seed are provided herein. In certain embodiments, the composition comprises *Methylobacterium* at a titer of about $1 \times 10^6$ CFU/gm to about $1 \times 10^{14}$ CFU/gm for a solid composition or at a titer of about $1 \times 10^6$ CFU/mL to about $1 \times 10^{11}$ CFU/mL for a liquid composition containing the solid substance or for the emulsion. In certain embodiments, the *Methylobacterium* has at least one gene encoding at least one protein that is orthologous to a protein having an amino acid sequence of SEQ ID NO: 1-5125. In certain embodiments, the *Methylobacterium* has at least one gene encoding a protein that is orthologous to a reference protein of Table 7. In certain embodiments, the *Methylobacterium* sp. can contain at least one gene encoding a protein that is orthologous to a reference protein having the amino acid sequence of 13, 14, 23, 27, 28, 30, 40, 43, 44, 51, 52, 57, 76, 85, 127, 197, 198, 199, 1094, 1100, 1106, 1114, 1116, 1117, 1120, 1180, 2180, 2190, 2463, 2467, 2468, 2471, 2510, 2515, 2676, 2971, 3357, 3370, 3372, 3394, 3427, 3429, 3430, 3950, 3952, 3968, 3987, 3996, 4004, 4006, and/or 4067 of Table 7. In certain embodiments the *Methylobacterium* has at least one gene encoding a protein that is orthologous to a reference protein is selected from the group consisting of SEQ ID NO: 13, 14, 23, 1094, 1100, 1106, 2467, 2468, 3357, 3370, and/or 3968. In certain embodiments the *Methylobacterium* has at least one gene encoding a protein that is orthologous to a reference protein is selected from the group consisting of SEQ ID NO: 1100, 1116, 2471 and/or 3950. In certain embodiments, the *Methylobacterium* in the composition or that is used is selected from the group consisting of NLS0017 (NRRL B-50931), NLS0020 (NRRL B-50930), NLS0021 (NRRL B-50939), NLS0037 (NRRL B-50941), NLS0038 (NRRL B-50942), NLS0042 (NRRL B-50932), NLS0046 (NRRL B-50929), NLS0062 (NRRL B-50937), NLS0064 (NRRL B-50938), NLS0065 (NRRL B-50935), NLS0066 (NRRL B-50940), NLS0068 (NRRL B-50934), NLS0069 (NRRL B-50936), NLS0089 (NRRL B-50933), and derivatives thereof. In certain embodiments, the *Methylobacterium* in the composition or that is used is selected from the group consisting of NLS0017, NLS0037, NLS0066, NLS0020, NLS0042, NLS0065, NLS0089, NLS0046, NLS0021. NLS0069, NLS0068, NLS0064, NLS0062, NLS0038, and derivatives thereof. In certain embodiments, the *Methylobacterium* has at least one polymorphic DNA element that is present in at least one *Methylobacterium* strain selected from the group consisting of NLS0020, NLS0066, NLS0017, NLS0065, NLS0089, NLS0042, and NLS0068 provided herein that improve lettuce production but that is absent from *Methylobacterium* sp. that do not improve lettuce production. In certain embodiments, the composition is applied to a lettuce seed and the least one polymorphic DNA element is present in at least one *Methylobacterium* strain selected from the group consisting of NLS0020, NLS0066, NLS0017, NLS0065, and NLS0089. In certain embodiments, the composition is applied to a lettuce seed and the *Methylobacterium* is selected from the group consisting of NLS0020, NLS0066, NLS0017, NLS0065, and NLS0089. In certain embodiments, the composition is applied to a lettuce plant or a part thereof and the least one polymorphic DNA element is present in at least one *Methylobacterium* strain selected from the group consisting of NLS0042, NLS0017, NLS0020, and NLS0068. In certain embodiments, the composition is applied to a lettuce plant or a part thereof and the *Methylobacterium* is selected from the group consisting of NLS0042, NLS0017, NLS0020, and NLS0068. In certain embodiments, the applied composition coats or partially coats said plant or a part thereof, or said seed. In certain embodiments, the methods further comprise: (i) growing said lettuce plant or lettuce plant grown from said seed; and/or (ii) harvesting leaves or seed from said lettuce plant or lettuce plant grown from said seed. In certain embodiments, the solid substance with adherent *Methylobacterium* is not a substance that promotes growth of resident microorganisms on the lettuce plant, the part thereof, or the lettuce seed. In certain embodiments, the composition comprises an agriculturally acceptable adjuvant and/or excipient. In certain embodiments of any of the aforementioned methods, the composition is depleted of substances that promote growth of resident microorganisms on said plant or seed. Also provided are lettuce plant parts or lettuce seeds obtained by any of the aforementioned methods and that are coated or partially coated with a composition comprising *Methylobacterium*.

Methods for improving lettuce plant production comprising applying a composition comprising *Methylobacterium* to a lettuce plant, a part thereof, or lettuce seed, wherein said composition is depleted of substances that promote growth of resident microorganisms on said plant or seed and wherein said plant or plant grown from said seed exhibits a trait improvement selected from the group consisting of an increased rate of leaf growth, an increased rate of root growth, increased total biomass production, increased seed yield, decreased cycle time, and combinations thereof when compared to an untreated control lettuce plant or a control lettuce plant grown from an untreated seed. In certain embodiments, the composition comprises a solid substance with adherent *Methylobacterium* grown thereon. In certain embodiments, the solid substance is not a substance that promotes growth of resident microorganisms on the lettuce plant, the part thereof, or the lettuce seed. In certain embodiments, the composition comprises *Methylobacterium* at a titer of about $1 \times 10^6$ CFU/gm to about $1 \times 10^{14}$ CFU/gm. In certain embodiments, the composition comprises a liquid, a solid substance with *Methylobacterium* adhered thereto in a liquid, a solid substance with *Methylobacterium* adhered thereto in an emulsion, or an emulsion. In certain embodiments, the composition comprises *Methylobacterium* at a titer of about $1 \times 10^6$ CFU/mL to about $1 \times 10^{11}$ CFU/mL. In certain embodiments, the methods further comprise: (i) growing said lettuce plant or lettuce plant grown from said seed; and/or (ii) harvesting leaves or seed from said lettuce plant or lettuce plant grown from said seed. In certain embodiments, the *Methylobacterium* has at least one gene encoding at least one protein that is orthologous to a protein having an amino acid sequence of SEQ ID NO: 1-5125. In certain embodiments, the *Methylobacterium* has at least one gene encoding a protein that is orthologous to a reference protein of Table 7. In certain embodiments, the *Methylobacterium* sp. can contain at least one gene encoding a protein that is orthologous to a reference protein having the amino acid sequence of 13, 14, 23, 27, 28, 30, 40, 43, 44, 51, 52, 57, 76, 85, 127, 197, 198, 199, 1094, 1100, 1106, 1114, 1116, 1117, 1120, 1180, 2180, 2190, 2463, 2467, 2468, 2471, 2510, 2515, 2676, 2971, 3357, 3370, 3372, 3394, 3427, 3429, 3430, 3950, 3952, 3968, 3987, 3996, 4004, 4006, and/or 4067 of Table 7. In certain embodiments the *Methylobacterium* has at least one gene encoding a protein that is orthologous to a reference protein is selected from the group consisting of SEQ ID NO: 13, 14, 23, 1094, 1100, 1106, 2467, 2468, 3357, 3370, and/or 3968. In certain embodiments the *Methylobacterium* has at least one gene encoding a protein that is orthologous to a reference protein is selected from the group consisting of SEQ ID NO: 1100, 1116, 2471 and/or 3950. In certain embodiments, the *Methylobacterium* in the composition or that is used is selected from the group consisting of NLS0017 (NRRL B-50931), NLS0020 (NRRL B-50930), NLS0021 (NRRL B-50939), NLS0037 (NRRL B-50941), NLS0038 (NRRL B-50942), NLS0042 (NRRL B-50932), NLS0046 (NRRL B-50929), NLS0062 (NRRL B-50937), NLS0064 (NRRL B-50938), NLS0065 (NRRL B-50935), NLS0066 (NRRL B-50940), NLS0068 (NRRL B-50934), NLS0069 (NRRL B-50936), NLS0089 (NRRL B-50933), and derivatives thereof. In certain embodiments, the *Methylobacterium* in the composition or that is used is selected from the group consisting of NLS0017, NLS0037, NLS0066, NLS0020, NLS0042, NLS0065, NLS0089, NLS0046, NLS0021. NLS0069, NLS0068, NLS0064, NLS0062, NLS0038, and derivatives thereof. In certain embodiments the reference protein is selected from the group consisting of SEQ ID NO: 11000, 1116, 2471 and/or 3950. In certain embodiments, the *Methylobacterium* has at least one polymorphic DNA element that is present in at least one *Methylobacterium* strain selected from the group consisting of NLS0020, NLS0066, NLS0017, NLS0065, NLS0089, NLS0042, and NLS0068 provided herein that improve lettuce production but that is absent from *Methylobacterium* sp. that do not improve lettuce production. In certain embodiments, the composition is applied to a lettuce seed and the least one polymorphic DNA element is present in at least one *Methylobacterium* strain selected from the group consisting of NLS0020, NLS0066, NLS0017, NLS0065, and NLS0089. In certain embodiments, the composition is applied to a lettuce seed and the *Methylobacterium* is selected from the group consisting of NLS0020, NLS0066, NLS0017, NLS0065, and NLS0089. In certain embodiments, the composition is applied to a lettuce plant or a part thereof and the least one polymorphic DNA element is present in at least one *Methylobacterium* strain selected from the group consisting of NLS0042, NLS0017, NLS0020, and NLS0068. In certain embodiments, the composition is applied to a lettuce plant or a part thereof and the *Methylobacterium* is selected from the group consisting of NLS0042, NLS0017, NLS0020, and NLS0068. In certain embodiments of any of the aforementioned methods, the composition coats or partially coats said plant or a part thereof, or said seed. Also provided are lettuce plant parts or lettuce seeds obtained by any of the aforementioned methods and that are coated or partially coated with a composition comprising *Methylobacterium*.

Compositions comprising: (i) a solid substance with adherent *Methylobacterium* grown thereon wherein said *Methylobacterium* has at least one gene encoding a protein that is orthologous to a protein having an amino acid sequence of SEQ ID NO: 1-5125; (ii) an emulsion with *Methylobacterium* grown therein wherein said *Methylobacterium* has at least one gene encoding a protein that is orthologous to a protein having an amino acid sequence of SEQ ID NO: 1-5125; or (iii) certain *Methylobacterium* strains selected from the group consisting of NLS0017 (NRRL B-50931), NLS0020 (NRRL B-50930), NLS0021 (NRRL B-50939), NLS0037 (NRRL B-50941), NLS0038 (NRRL B-50942), NLS0042 (NRRL B-50932), NLS0046 (NRRL B-50929), NLS0062 (NRRL B-50937), NLS0064 (NRRL B-50938), NLS0065 (NRRL B-50935), NLS0066 (NRRL B-50940), NLS0068 (NRRL B-50934), NLS0069 (NRRL B-50936), NLS0089 (NRRL B-50933), and derivatives thereof and an agriculturally acceptable adjuvant, excipient, or combination thereof are provided herein. Also provided herein are compositions comprising: (a) (i) a solid substance with adherent *Methylobacterium* grown thereon; (ii) an emulsion with *Methylobacterium* grown therein; or (iii) a *Methylobacterium* that has at least one gene encoding a protein that is orthologous to a protein having an amino acid sequence of SEQ ID NO: 1-5125; and (b) an agriculturally acceptable excipient, adjuvant, or combination thereof. In certain embodiments, the *Methylobacterium* has at least one gene encoding a protein that is orthologous to a reference protein of Table 7. In certain embodiments, the reference protein is selected from the group consisting of SEQ ID NO: 13, 14, 23, 1094, 1100, 1106, 2467, 2468, 3357, 3370, and/or 3968. In certain embodiments, the *Methylobacterium* is selected from the group consisting of NLS0017 (NRRL B-50931), NLS0020 (NRRL B-50930), NLS0037 (NRRL B-50941), NLS0042 (NRRL B-50932), NLS0065 (NRRL B-50935), NLS0066 (NRRL B-50940), and derivatives thereof. Also provided are compositions comprising: (i) a solid substance with adherent *Methylobacterium* grown thereon; or (ii) an emulsion with *Methylobacterium* grown therein, wherein said *Methylobacterium* has at least one polymorphic DNA element that is present in at least one *Methylobacterium* strain selected from the group consisting of NLS0020, NLS0066, NLS0017, NLS0065, NLS0089, NLS0042, and NLS0068 provided herein that improve lettuce production but that is absent from *Methylobacterium* sp. that do not improve lettuce production. In certain embodiments, the at least one polymorphic DNA element is present in at least one *Methylobacterium* strain selected from the group consisting of NLS0020, NLS0066, NLS0017, NLS0065, and NLS0089. In certain embodiments, the least one polymorphic DNA element is present in at least one *Methylobacterium* strain selected from the group consisting of NLS0042, NLS0017, NLS0020, and NLS0068. In certain embodiments, the *Methylobacterium* is selected from the group consisting of NLS0020, NLS0066, NLS0017, NLS0065, NLS0089, NLS0042, and NLS0068. In certain embodiments, the composition is depleted of substances that promote growth of resident microorganisms on a plant or seed. In certain embodiments, the substance that promotes growth of resident microorganisms on a plant or seed is selected from the group consisting of a carbon source, a nitrogen source, a phosphorous source, a sulfur source, a magnesium source, and combinations thereof. In certain embodiments, the compositions further comprise an agriculturally acceptable adjuvant and/or excipient. In certain embodiments, the solid substance with adherent *Methylobacterium* grown thereon has a *Methylobacterium* titer of at least about $5 \times 10^8$ CFU/gm to at least about $1 \times 10^{14}$ CFU/gm. In certain embodiments, the *Methylobacterium* is selected from the group consisting of NLS0020, NLS0066, NLS0017, NLS0065, and NLS0089. In certain embodiments, the aforementioned compositions are adapted for use in treating a plant or seed or is used to treat a plant or seed. Also provided herein is a lettuce plant part or lettuce seed that is coated or partially coated with any of the aforementioned the compositions. In certain embodiments, the coated or partially coated lettuce plant part or lettuce seed is obtained by any of the aforementioned methods.

Also provided is an isolated *Methylobacterium* selected from the group consisting of NLS0017 (NRRL B-50931), NLS0020 (NRRL B-50930), NLS0021 (NRRL B-50939), NLS0037 (NRRL B-50941), NLS0038 (NRRL B-50942), NLS0042 (NRRL B-50932), NLS0046 (NRRL B-50929), NLS0062 (NRRL B-50937), NLS0064 (NRRL B-50938), NLS0065 (NRRL B-50935), NLS0066 (NRRL B-50940), NLS0068 (NRRL B-50934), NLS0069 (NRRL B-50936), NLS0089 (NRRL B-50933), and derivatives thereof.

Also provided are compositions comprising: (i) an isolated *Methylobacterium* selected from the group consisting of NLS0017 (NRRL B-50931), NLS0020 (NRRL B-50930), NLS0021 (NRRL B-50939), NLS0037 (NRRL B-50941), NLS0038 (NRRL B-50942), NLS0042 (NRRL B-50932), NLS0046 (NRRL B-50929), NLS0062 (NRRL B-50937), NLS0064 (NRRL B-50938), NLS0065 (NRRL B-50935), NLS0066 (NRRL B-50940), NLS0068 (NRRL B-50934), NLS0069 (NRRL B-50936), NLS0089 (NRRL B-50933), derivatives thereof; and (ii) an agriculturally acceptable adjuvant, excipient, or combination thereof.

Also provided are plants, plant parts, and plant seeds that are coated or partially coated with any of the aforementioned compositions. In certain embodiments, a lettuce plant, plant part, or plant seed is coated or partially coated with the aforementioned compositions.

Also provided herein are methods of identifying compositions, plant parts, plant seeds, or processed plant products comprising *Methylobacterium* sp. NLS0017 (NRRL B-50931), NLS0020 (NRRL B-50930), NLS0037 (NRRL B-50941), NLS0042 (NRRL B-50932), NLS0065 (NRRL B-50935), or NLS0066 (NRRL B-50940) by assaying for the presence of nucleic acid sequences contained in SEQ ID NO: 5126-10250 in those materials. In certain embodiments, such methods can comprise subjecting a sample suspected of containing *Methylobacterium* sp. NLS0017 (NRRL B-50931), NLS0020 (NRRL B-50930), NLS0037 (NRRL B-50941), NLS0042 (NRRL B-50932), NLS0065 (NRRL B-50935), or NLS0066 (NRRL B-50940) to a nucleic acid analysis technique and determining that the sample contains one or more nucleic acid containing a sequence of at least about 20, 50, 100, 200, 500, or a 1000 nucleotides that is identical to at least one of SEQ ID NO: 5126-10250, wherein the presence of a sequence that is identical to at least one of SEQ ID NO: 5126-6211 is indicative of the presence of NLS017, wherein the presence of a sequence that is identical to at least one of SEQ ID NO: 6212-7301 is indicative of the presence of NLS020, wherein the presence of a sequence that is identical to at least one of SEQ ID NO: 7302-7586 is indicative of the presence of NLS037, wherein the presence of a sequence that is identical to at least one of SEQ ID NO: 7587-8472 is indicative of the presence of NLS042, wherein the presence of a sequence that is identical to at least one of SEQ ID NO: 8473-9074 is indicative of the presence of NLS065, and wherein the presence of a sequence that is identical to at least one of SEQ ID NO: 9075-10250 is indicative of the presence of NLS066. Such nucleic acid analyses include, but are not limited to, techniques based on nucleic acid hybridization, polymerase chain reactions, mass spectroscopy, nanopore based detection, branched DNA analyses, combinations thereof, and the like.

Also provided herein are methods of identifying *Methylobacterium* sp. that can confer useful traits to plants by assaying for the presence of nucleic acid sequences contained in SEQ ID NO: 5126-10250 in the *Methylobacterium* sp. In certain embodiments, such methods can comprise subjecting a candidate *Methylobacterium* sp. to a nucleic acid analysis technique and determining that the sample contains one or more nucleic acid containing a sequence of at least about 20, 50, 100, 200, 500, or a 1000 nucleotides that is identical to at least one of SEQ ID NO: 5126-10250 indicates that the candidate *Methylobacterium* sp. that can confer a useful traits to a plant. Such nucleic acid analyses include, but are not limited to, techniques based on nucleic acid hybridization, polymerase chain reactions, mass spectroscopy, nanopore based detection, branched DNA analyses, combinations thereof, and the like.

DESCRIPTION

Definitions

As used herein, the phrases "adhered thereto" and "adherent" refer to *Methylobacterium* that are associated with a solid substance by growing, or having been grown, on a solid substance.

As used herein, the phrase "agriculturally acceptable adjuvant" refers to a substance that enhances the performance of an active agent in a composition for treatment of plants and/or plant parts. In certain compositions, an active agent can comprise a mono-culture or co-culture of *Methylobacterium*.

As used herein, the phrase "agriculturally acceptable excipient" refers to an essentially inert substance that can be used as a diluent and/or carrier for an active agent in a composition for treatment of plants and/or plant parts. In certain compositions, an active agent can comprise a mono-culture or co-culture of *Methylobacterium*.

As used herein, the term "*Methylobacterium*" refers to bacteria that are facultative methylotrophs of the genus *Methylobacterium*. The term *Methylobacterium*, as used herein, thus does not encompass includes species in the genera *Methylobacter, Methylomonas, Methylomicrobium, Methylococcus, Methylosinus, Methylocystis, Methylosphaera, Methylocaldum,* and *Methylocella*, which are obligate methanotrophs.

As used herein, the phrase "co-culture of *Methylobacterium*" refers to a *Methylobacterium* culture comprising at least two strains of *Methylobacterium* or at least two species of *Methylobacterium*.

As used herein, the phrase "contaminating microorganism" refers to microorganisms in a culture, fermentation broth, fermentation broth product, or composition that were not identified prior to introduction into the culture, fermentation broth, fermentation broth product, or composition.

As used herein, the phrase "derivatives thereof", when used in the context of a *Methylobacterium* isolate, refers to any strain that is obtained from the *Methylobacterium* isolate. Derivatives of a *Methylobacterium* isolate include, but are not limited to, variants of the strain obtained by selection, variants of the strain selected by mutagenesis and selection, and a genetically transformed strain obtained from the *Methylobacterium* isolate.

As used herein, the term "emulsion" refers to a colloidal mixture of two immiscible liquids wherein one liquid is the continuous phase and the other liquid is the dispersed phase. In certain embodiments, the continuous phase is an aqueous liquid and the dispersed phase is liquid that is not miscible, or partially miscible, in the aqueous liquid.

As used herein, the phrase "essentially free of contaminating microorganisms" refers to a culture, fermentation broth, fermentation product, or composition where at least about 95% of the microorganisms present by amount or type in the culture, fermentation broth, fermentation product, or composition are the desired *Methylobacterium* or other desired microorganisms of pre-determined identity.

As used herein, the phrase "inanimate solid substance" refers to a substance which is insoluble or partially soluble in water or aqueous solutions and which is either non-living or which is not a part of a still-living organism from which it was derived.

As used herein, the phrase "mono-culture of *Methylobacterium*" refers to a *Methylobacterium* culture consisting of a single strain of *Methylobacterium*.

As used herein, the term "peptide" refers to any polypeptide of 50 amino acid residues or less.

As used herein, the term "lettuce" refers to *Lactuca* sp. plants. *Lactuca* sp. plants include, but are not limited to, *Lactuca biennis, Lactuca canadensis, Lactuca floridana, Lactuca graminifolia, Lactuca hirsuta, Lactuca indica, Lactuca ludoviciana, Lactuca saligna, Lactuca sativa, Lactuca serriola, Lactuca terse-novae, Lactuca virosa,* and *Lactuca* X *morssii* species.

As used herein, the term "protein" refers to any polypeptide having 51 or more amino acid residues.

As used herein, a "pesticide" refers to an agent that is insecticidal, fungicidal, nematocidal, bacteriocidal, or any combination thereof.

As used herein, the phrase "bacteriostatic agent" refers to agents that inhibit growth of bacteria but do not kill the bacteria.

As used herein, the phrase "pesticide does not substantially inhibit growth of said *Methylobacterium*" refers to any pesticide that when provided in a composition comprising a fermentation product comprising a solid substance wherein a mono-culture or co-culture of *Methylobacterium* is adhered thereto, results in no more than a 50% inhibition of *Methylobacterium* growth when the composition is applied to a plant or plant part in comparison to a composition lacking the pesticide. In certain embodiments, the pesticide results in no more than a 40%, 20%, 10%, 5%, or 1% inhibition of *Methylobacterium* growth when the composition is applied to a plant or plant part in comparison to a composition lacking the pesticide.

As used herein, the term "PPFM bacteria" refers without limitation to bacterial species in the genus *Methylobacterium* other than *M. nodulans*.

As used herein, the phrase "solid substance" refers to a substance which is insoluble or partially soluble in water or aqueous solutions.

As used herein, the phrase "solid phase that can be suspended therein" refers to a solid substance that can be distributed throughout a liquid by agitation.

As used herein, the term "non-regenerable" refers to either a plant part or processed plant product that cannot be regenerated into a whole plant.

As used herein, the phrase "substantially all of the solid phase is suspended in the liquid phase" refers to media wherein at least 95%, 98%, or 99% of solid substance(s) comprising the solid phase are distributed throughout the liquid by agitation.

As used herein, the phrase "substantially all of the solid phase is not suspended in the liquid phase" refers to media where less than 5%, 2%, or 1% of the solid is in a particulate form that is distributed throughout the media by agitation.

As used herein, the phrase "resident microorganism" refers to resident bacteria, fungi or yeast.

As used herein, the phrase "substance that promotes growth of resident microorganisms on a plant or seed" refers to a carbon source, a nitrogen source, a phosphorous source, and combinations thereof.

To the extent to which any of the preceding definitions is inconsistent with definitions provided in any patent or non-patent reference incorporated herein by reference, any patent or non-patent reference cited herein, or in any patent or non-patent reference found elsewhere, it is understood that the preceding definition will be used herein.

*Methylobacterium*-Containing Compositions Depleted of Substances that Promote Growth of Resident Bacteria on a Plant or Seed, Methods of their Use, and Methods of Making Compositions comprising *Methylobacterium* that are depleted of substances that promote growth of resident bacteria on a plant or seed, methods of using the compositions to improve lettuce production, and methods of making the compositions are provided herein. In certain embodiments of any of the aforementioned compositions, the composition comprises a solid substance wherein a mono-culture or co-culture of *Methylobacterium* is adhered thereto. In certain embodiments where the *Methylobacterium* is adhered to a solid substance, the composition comprises a colloid formed by the solid substance wherein a mono-culture or co-culture of *Methylobacterium* is adhered thereto and a liquid. In certain embodiments, the colloid is a gel. In certain embodiments of certain aforementioned compositions, composition is an emulsion that does not contain a solid substance.

Compositions that comprise a solid substance with adherent *Methylobacterium* grown thereon is provided. In certain embodiments, the adherent *Methylobacterium* can be at a titer of at least about $5 \times 10^8$ CFU/gm to at least about $5 \times 10^{13}$ CFU/gm or about $1 \times 10^{14}$ CFU/gm and the composition is depleted of substances that promote growth of resident microorganisms on a plant or seed.

In certain embodiments, the compositions containing *Methylobacterium* provided or used herein are depleted of substances that promote growth of the resident microorganisms when one or more of those substances are absent or are essentially absent. In certain embodiments, the composition is depleted of substances that promote growth of the resident microorganisms when those substances are present at a percentage of no more than about 5%, 2%, 1%, 0.5%, 0.2%, or 0.1% of the total mass, mass/total volume, or total volume of the composition. In certain embodiments, substance that promotes growth of resident microorganisms on a plant or seed is selected from the group consisting of a carbon source, a nitrogen source, a phosphorous source, a sulfur source, a magnesium source, and combinations thereof. Carbon sources include, but are not limited to, alcohols, monosaccharides, disaccharides, polysaccharides, lipids, fatty acids, and the like. Alcohols that are depleted include, but are not limited to, methanol, ethanol, glycerol, and the like. Nitrogen sources include, but are not limited to, ammonia and various compounds containing amino groups that can be metabolized by microorganisms. In certain embodiments, the substance that is depleted is a source of two or more of a carbon source, a nitrogen source, a phosphorous source, a sulfur source, and a magnesium source. For example, the composition that is depleted of amino acids or peptides and lacks other carbon or nitrogen sources is depleted for both a carbon and a nitrogen source. In certain embodiments, the composition comprises an agriculturally acceptable adjuvant and/or excipient.

Resident microorganisms on the plant or seed include, but are not limited to bacteria, fungi, and yeast. Substances that promote the growth of such microorganisms can be identified by methods including, but not limited to, assaying the plant or seed surface for the amount or number of microorganisms present prior to exposure of the plant or seed to the substance (or to a composition containing the substance), exposing the assayed plant or seed to the substance or composition in parallel with a control composition lacking the substance, and then re-assaying the plant or seed surface for the amount or number of microorganisms present after a suitable time interval and under suitable conditions of temperature to allow growth of the resident microorganisms. Assays for numbers of microorganisms include, but are not limited to, determinations of colony forming units per an amount of plant or seed exposed to the substance and the control.

Without seeking to be limited by theory, it is believed that the compositions containing *Methylobacterium* provided or used herein that are depleted of substances that promote growth of the resident microorganisms can result in superior results in comparison to other compositions containing such substances when applied to plants, plant parts, or seeds. Such superior results are believed to include, but are not limited to, improved plant yield, pathogen resistance, insect resistance, fruit ripening and the like. While not seeking to be limited by theory, it is believed that the compositions containing *Methylobacterium* that are depleted of substances that promote growth of the resident microorganisms allow for more efficient and or extensive colonization of the plant, part thereof, or seed as competition for one or more of space or nutrients by the resident microorganisms is reduced.

Also provided herein are methods for improving lettuce production that comprise applying any of the aforementioned compositions or *Methylobacterium* provided herein to a lettuce plant, lettuce plant part, or lettuce seed, and, optionally, growing the plant and/or harvesting leaves or seed from the plant or a plant grown from the seed. In certain embodiments, the composition coats or partially coats the lettuce plant, plant part, or seed. The treated lettuce plant or plant grown from the seed exhibits an increased rate of root growth, an increased rate of leaf growth, increased seed production, a decreased cycle time (from seed planting to seed production) and/or increased total biomass compared to an untreated control lettuce plant or control lettuce plant grown from untreated seed, thereby obtaining improved lettuce production. In certain embodiments, application of the composition provides for at least about a 5%, 10%, 15%, 20%, 30% or 40% increase in root growth rate, leaf growth rate, seed production, and/or increased total biomass in the lettuce plant, lettuce plant part, or a lettuce plant derived therefrom in comparison to an untreated control lettuce plant or control lettuce plant grown from an untreated seed. In certain embodiments, application of the composition provides for about a 5% or 10% to about a 15%, 20%, 25%, 30%, 35%, 40%, 45%, 50%, 60%, or 70% increase in root growth rate, leaf growth rate, seed production, and/or increased total biomass in the plant, plant part, or a plant derived therefrom in comparison to an untreated control lettuce plant or control lettuce plant grown from an untreated seed. In certain embodiments, application of the composition provides for at least about a 5%, 10%, 15%, 20%, 30% or 40% decrease in cycle time in the treated lettuce plant or a lettuce plant grown from a treated seed in comparison to the untreated control lettuce plant or control lettuce plant grown from an un-treated seed. In certain embodiments, application of the composition provides for about a 5% or 10% to about a 15%, 20%, 25%, 30%, 35%, 40%, 45%, or 50% decrease in cycle time in the treated lettuce plant or a lettuce plant grown from a treated seed in comparison to an untreated control lettuce plant or control lettuce plant grown from an untreated seed. In certain embodiments, the lettuce plant part is a leaf, a stem, a flower, a root, a tuber, or a seed. In certain embodiments, the method further comprises the steps of growing the plant and/or the step of harvesting at least one plant part selected from the group consisting of a leaf, a stem, a flower, a root, a tuber, or a seed from the lettuce plant or plant part. In certain embodiments of any of the aforementioned methods, the methods further comprise obtaining a processed food or feed composition from the plant or plant part. In certain embodiments, the processed food composition comprises chopped or cut lettuce leaves.

Also provided are methods of making a lettuce plant or plant seed treatment composition that comprises *Methylobacterium* and is depleted of substances that promote growth of resident bacteria on a plant or seed is provided herein. Such method comprises (i) growing a mono-culture or co-culture of *Methylobacterium* in media that comprises an aqueous phase, a liquid phase and a solid phase, or an emulsion, thereby obtaining a *Methylobacterium*-containing media; (ii) separating the *Methylobacterium* from at least one other portion of the *Methylobacterium*-containing media; and (iii) reconstituting the *Methylobacterium* in a matrix lacking substances that promote growth of resident bacteria on a plant or seed. In certain embodiments, the separation step is effected by centrifugation, filtration, or settling of the *Methylobacterium*-containing media and removal of excess liquid or emulsion therefrom. In certain embodiments, the substance that promotes growth of resident bacteria on a plant or seed is selected from the group consisting of a carbon source, a nitrogen source, a phosphorous source, and combinations thereof. In certain embodiments, the matrix is a liquid, an emulsion, or one or more solids, and comprises an agriculturally acceptable adjuvant and/or excipient. Still in certain embodiments; the *Methylobacterium* are grown in media comprising a liquid phase and a solid substance with adherent *Methylobacterium* grown thereon. The solid substance is separated from the liquid phase of the *Methylobacterium*-containing media, and the solid substance with adherent *Methylobacterium* grown thereon is reconstituted in the aforementioned matrix. In certain embodiments of the methods, the *Methylobacterium* sp., is selected from the group consisting of *M. aminovorans, M. extorquens, M. fujisawaense, M. mesophilicum, M. radiotolerans, M rhodesianum, M. nodulans, M. phyllosphaerae, M. thiocyanatum*, and *M. oryzae*. In certain embodiments of the methods, the *Methylobacterium* is not *M. radiotolerans* or *M. oryzae*. In certain embodiments of the methods, the *Methylobacterium* is adhered to a solid substance. In certain embodiments of the methods, the *Methylobacterium* is adhered to the solid substance is combined with a liquid to form a composition that is a colloid. In certain embodiments of the methods, the colloid is a gel. In certain embodiments of the methods, the *Methylobacterium* adhered to the solid substance is provided by culturing the *Methylobacterium* in the presence of the solid substance. In certain embodiments of the methods, the composition comprises an emulsion. In certain embodiments of the methods, the *Methylobacterium* is provided by culturing the *Methylobacterium* in an emulsion.

Methods where *Methylobacterium* are cultured in biphasic media comprising a liquid phase and a solid substance have been found to significantly increase the resultant yield of *Methylobacterium* relative to methods where the *Methylobacterium* are cultured in liquid media alone. In certain embodiments, the methods can comprise growing the *Methylobacterium* in liquid media with a particulate solid substance that can be suspended in the liquid by agitation under conditions that provide for *Methylobacterium* growth. In certain embodiments where particulate solid substances are used, at least substantially all of the solid phase can thus be suspended in the liquid phase upon agitation. Such particulate solid substances can comprise materials that are about 1 millimeter or less in length or diameter. In certain embodiments, the degree of agitation is sufficient to provide for uniform distribution of the particulate solid substance in the liquid phase and/or optimal levels of culture aeration. However, in other embodiments provided herein, at least substantially all of the solid phase is not suspended in the liquid phase, or portions of the solid phase are suspended in the liquid phase and portions of the solid phase are not suspended in the liquid phase. Non-particulate solid substances can be used in certain biphasic media where the solid phase is not suspended in the liquid phase. Such non-particulate solid substances include, but are not limited to, materials that are greater than about 1 millimeter in length or diameter. Such particulate and non-particulate solid substances also include, but are not limited to, materials that are porous, fibrous, or otherwise configured to provide for increased surface areas for adherent growth of the *Methylobacterium*. Biphasic media where portions of the solid phase are suspended in the liquid phase and portions of the solid phase are not suspended in the liquid phase can comprise a mixture of particulate and non-particulate solid substances. Such particulate and non-particulate solid substances used in any of the aforementioned biphasic media also include, but are not limited to, materials that are porous, fibrous, or otherwise configured to provide for increased surface areas for adherent growth of the *Methylobacterium*. In certain embodiments, the media comprises a colloid formed by a solid and a liquid phase. A colloid comprising a solid and a liquid can be pre-formed and added to liquid media or can be formed in media containing a solid and a liquid. Colloids comprising a solid and a liquid can be formed by subjecting certain solid substances to a chemical and/or thermal change. In certain embodiments, the colloid is a gel. In certain embodiments, the liquid phase of the media is an emulsion. In certain embodiments, the emulsion comprises an aqueous liquid and a liquid that is not miscible, or only partially miscible, in the aqueous liquid. Liquids that are not miscible, or only partially miscible, in water include, but are not limited to, any of the following: (1) liquids having a miscibility in water that is equal to or less than that of pentanol, hexanol, or heptanol at 25 degrees C.; (2) liquids comprising an alcohol, an aldehyde, a ketone, a fatty acid, a phospholipid, or any combination thereof; (3) alcohols selected from the group consisting of aliphatic alcohols containing at least 5 carbons and sterols; (4) an animal oil, microbial oil, synthetic oil, plant oil, or combination thereof; and/or, (5) a plant oil is selected from the group consisting of corn, soybean, cotton, peanut, sunflower, olive, flax, coconut, palm, rapeseed, sesame seed, safflower, and combinations thereof. In certain embodiments, the immiscible or partially immiscible liquid can comprises at least about 0.02% to about 20% of the liquid phase by mass. In certain embodiments, the methods can comprise obtaining a biphasic culture media comprising the liquid, the solid, and *Methylobacterium* and incubating the culture under conditions that provide for growth of the *Methylobacterium*. Biphasic culture medias comprising the liquid, the solid, and *Methylobacterium* can be obtained by a variety of methods that include, but are not limited to, any of: (a) inoculating a biphasic media comprising the liquid and the solid substance with *Methylobacterium*; (b) inoculating the solid substance with *Methylobacterium* and then introducing the solid substance comprising the *Methylobacterium* into the liquid media; (c) inoculating the solid substance with *Methylobacterium*, incubating the *Methylobacterium* on the solid substance, and then introducing the solid substance comprising the *Methylobacterium* into the liquid media; or (d) any combination of (a), (b), or (c). Methods and compositions for growing *Methylobacterium* in biphasic media comprising a liquid and a solid are disclosed in co-assigned U.S. patent application Ser. No. 13/907,161, filed May 31, 2013, which is incorporated herein by reference in its entirety, and in co-assigned International Patent Application PCT/US13/43722, filed May 31, 2013, which is incorporated herein by reference in its entirety.

Methods where *Methylobacterium* are cultured in media comprising an emulsion have also been found to significantly increase the resultant yield of *Methylobacterium* relative to methods where the *Methylobacterium* are cultured in liquid media alone. In certain embodiments, the methods for making the compositions provided herein can comprise growing the *Methylobacterium* agent in an emulsion under conditions that provide for *Methylobacterium* growth. Medias comprising the emulsion and *Methylobacterium* can be obtained by a variety of methods that include, but are not limited to, any of: (a) inoculating a media comprising the emulsion with *Methylobacterium*; (b) inoculating the aqueous liquid with the *Methylobacterium*, introducing the non-aqueous liquid, and mixing to form an emulsion; (c) inoculating the aqueous liquid with the *Methylobacterium*, introducing the non-aqueous liquid, and mixing to form an emulsion; or (d) any combination of (a), (b), or (c). In certain embodiments, the emulsion comprises an aqueous liquid and a liquid that is not miscible, or only partially miscible, in the aqueous liquid. Non-aqueous liquids that are not miscible, or only partially miscible, in water include, but are not limited to, any of the following: (1) liquids having a miscibility in water that is equal to or less than that of n-pentanol, n-hexanol, or n-heptanol at 25 degrees C.; (2) liquids comprising an alcohol, an aldehyde, a ketone, a fatty acid, a phospholipid, or any combination thereof; (3) alcohols is selected from the group consisting of aliphatic alcohols containing at least 5, 6, or 7 carbons and sterols; (4) an animal oil, microbial oil, synthetic oil, plant oil, or combination thereof; and/or, (5) a plant oil is selected from the group consisting of corn, soybean, cotton, peanut, sunflower, olive, flax, coconut, palm, rapeseed, sesame seed, safflower, and combinations thereof. In certain embodiments, the immiscible or partially immiscible non-aqueous liquid can comprise at least about 0.02% to about 20% of the emulsion by mass. In certain embodiments, the immiscible or partially immiscible non-aqueous liquid can comprise at least about any of about 0.05%, 0.1%, 0.5%, or 1% to about 3%, 5%, 10%, or 20% of the emulsion by mass. Methods and compositions for growing *Methylobacterium* in media comprising an emulsion are disclosed in co-assigned International Patent Application PCT/US2014/040218, filed May 30, 2014, which is incorporated herein by reference in its entirety.

In certain embodiments, the fermentation broth, fermentation broth product, or compositions that comprise *Methylobacterium* sp. can further comprise one or more introduced microorganisms of pre-determined identity other than *Methylobacterium*. Other microorganisms that can be added include, but are not limited to, microorganisms that are biopesticidal or provide some other benefit when applied to a plant or plant part. Biopesticidal or otherwise beneficial microorganisms thus include, but are not limited to, various *Bacillus* sp., *Pseudomonas* sp., *Coniothyrium* sp., *Pantoea* sp., *Streptomyces* sp., and *Trichoderma* sp. Microbial biopesticides can be a bacterium, fungus, virus, or protozoan. Particularly useful biopesticidal microorganisms include various *Bacillus subtilis, Bacillus thuringiensis, Bacillus pumilis, Pseudomonas syringae, Trichoderma harzianum, Trichoderma* vixens, and *Streptomyces lydicus* strains. Other microorganisms that are added can be genetically engineered or naturally occurring isolates that are available as pure cultures. In certain embodiments, it is anticipated that the bacterial or fungal microorganism can be provided in the fermentation broth, fermentation broth product, or composition in the form of a spore.

In certain embodiments, the liquid culture medium is prepared from inexpensive and readily available components, including, but not limited to, inorganic salts such as potassium phosphate, magnesium sulfate and the like, carbon sources such as glycerol, methanol, glutamic acid, aspartic acid, succinic acid and the like, and amino acid blends such as peptone, tryptone, and the like. Exemplary liquid media that can be used include, but are not limited to, ammonium mineral salts (AMS) medium (Whittenbury et al., 1970), Vogel-Bonner (VB) minimal culture medium (Vogel and Bonner, 1956), and LB broth ("Luria—Bertani Broth").

In general, the solid substance used in the methods and compositions that provide for the efficient growth of *Methylobacterium* can be any suitable solid substance which is insoluble or only partially soluble in water or aqueous solutions. Such suitable solid substances are also non-bacteriocidal or non-bacteriostatic with respect to *Methylobacterium* when the solid substances are provided in the liquid culture media. In certain embodiments, such suitable solid substances are also solid substances that are readily obtained in sterile form or rendered sterile. Solid substances used herein can be sterilized by any method that provides for removal of contaminating microorganisms and thus include, but are not limited to, methods such as autoclaving, irradiation, chemical treatment, and any combination thereof. These solid substances include natural substances of animal, plant, microbial, fungal, or mineral origin, manmade substances, or combinations of natural and manmade substances. In certain embodiments, the solid substances are inanimate solid substances. Inanimate solid substances of animal, plant, microbial, or fungal origin can be obtained from animals, plants, microbes, or fungi that are unviable (i.e. no longer living) or that have been rendered unviable. Diatom shells are thus inanimate solid substances when previously associated diatom algae have been removed or otherwise rendered inviable. Since diatom shells are inanimate solid substances, they are not considered to be photosynthetic organisms or photosynthetic microorganisms. In certain embodiments, solid substances include, but are not limited to, sand, silt, soil, clay, ash, charcoal, diatomaceous earth and other similar minerals, ground glass or glass beads, ground ceramic materials, ceramic beads, bentonite, kaolin, talc, perlite, mica, vermiculite, silicas, quartz powder, montmorillonite, and combinations thereof. In certain embodiments, the solid substance can be a polymer or polymeric beads. Polymers that can be used as a solid substance include, but are not limited to, various polysaccharides such as cellulosic polymers and chitinous polymers which are insoluble or only partially soluble in water or aqueous solutions, agar (i.e. galactans), and combinations thereof. In certain embodiments, the solid substance can be an insoluble or only partially soluble salt crystal. Salt crystals that can be used include, but are not limited to, insoluble or only partially soluble carbonates, chromates, sulfites, phosphates, hydroxides, oxides, and sulfides. In certain embodiments, the solid substance can be a microbial cell, fungal cell, microbial spore, or fungal spore. In certain embodiments, the solid substance can be a microbial cell or microbial spore wherein the microbial cell or microbial spore is not a photosynthetic microorganism. In certain embodiments, the microbial cell or microbial spore is not a photosynthetic microorganism, where the photosynthetic microorganism is selected from the group consisting of algae, cyanobacteria, diatoms, *Botryococcus braunii, Chlorella, Dunaliella tertiolecta, Gracilaria, Pleurochrysis camerae, Sargassum,* and *Ulva*. In still other embodiments, the solid substance can be an inactivated (i.e., unviable) microbial cell, fungal cell, microbial spore, or fungal spore. In still other embodiments, the solid substance can be a quiescent (i.e. viable but not actively dividing) microbial cell, fungal cell, microbial spore, or fungal spore. In still other embodiments, the solid substance can be cellular debris of microbial origin. In still other embodiments, the solid substance can be particulate matter from any part of a plant. Plant parts that can be used to obtain the solid substance include, but are not limited to, cobs, husks, hulls, leaves, roots, flowers, stems, barks, seeds, and combinations thereof. Products obtained from processed plant parts including, but not limited to, bagasse, wheat bran, soy grits, crushed seed cake, stover, and the like can also be used. Such plant parts, processed plants, and/or processed plant parts can be milled to obtain the solid material in a particulate form that can be used. In certain embodiments, wood or a wood product including, but not limited to, wood pulp, sawdust, shavings, and the like can be used. In certain embodiments, the solid substance can be a particulate matter from an animal(s), including, but not limited to, bone meal, gelatin, ground or powdered shells, hair, macerated hide, and the like.

In certain embodiments, the solid substance is provided in a particulate form that provides for distribution of the solid substance in the culture media. In certain embodiments, the solid substance is comprised of particle of about 2 microns to about 1000 microns in average length or average diameter. In certain embodiments, the solid substance is comprised of particle of about 1 microns to about 1000 microns in average length or average diameter. In certain embodiments, the solid substance is a particle of about 1, 2, 4, 10, 20, or 40 microns to any of about 100, 200, 500, 750, or 1000 microns in average length or average diameter. Desirable characteristics of particles used in the methods and compositions provided herein include suitable wettability such that the particles can be suspended throughout the media upon agitation.

In certain embodiments, the solid substance is provided in the media as a colloid wherein the continuous phase is a liquid and the dispersed phase is the solid. Suitable solids that can be used to form colloids in liquid media used to grow *Methylobacterium* include, but are not limited to, various solids that are referred to as hydrocolloids. Such hydrocolloids used in the media, methods and compositions provided herein can be hydrophilic polymers, of plant, animal, microbial, or synthetic origin. Hydrocolloid polymers used in the methods can contain many hydroxyl groups and/or can be polyelectrolytes. Hydrocolloid polymers used in the compositions and methods provided herein include, but are not limited to, agar, alginate, arabinoxylan, carrageenan, carboxymethylcellulose, cellulose, curdlan, gelatin, gellan, β-glucan, guar gum, gum arabic, locust bean gum, pectin, starch, xanthan gum, and mixtures thereof. In certain embodiments, the colloid used in the media, methods, and compositions provided herein can comprise a hydrocolloid polymer and one or more proteins.

In certain embodiments, the solid substance can be a solid substance that provides for adherent growth of *Methylobacterium* on the solid substance. *Methylobacterium* that are adhered to a solid substance are *Methylobacterium* that cannot be substantially removed by simply washing the solid substance with the adherent *Methylobacterium* with growth media whereas non-adherent *Methylobacterium* can be substantially removed by washing the solid substance with liquid growth media. In this context, "substantially removed" means that at least about 30%, 40%, 50%, 60%, 70%, or 80% the *Methylobacterium* present are removed when the solid substance is washed with three volumes of liquid growth media. Such washing can be effected by a variety of methods including, but not limited to, decanting liquid from a washed solid phase or passing liquid through a solid phase on a filter that permits flow through of bacteria in the liquid. In certain embodiments, the adherent *Methylobacterium* that are associated with the solid can include both *Methylobacterium* that are directly attached to the solid and/or *Methylobacterium* that are indirectly attached to the solid substance. *Methylobacterium* that are indirectly attached to the solid substance include, but are not limited to, *Methylobacterium* that are attached to another *Methylobacterium* or to another microorganism that is attached to the solid substance, *Methylobacterium* that are attached to the solid substance by being attached to another substance that is attached to the solid substance, and the like. In certain embodiments, at least 10%, 20%, 30%, 40%, 50%, 60%, 70%, 80%, 90%, 95%, 98%, 99%, 99.5% or 99.9% of the *Methylobacterium* in the fermentation broth, fermentation broth product, or compositions are *Methylobacterium* that are adhered to the solid substance. In certain embodiments, adherent *Methylobacterium* can be present on the surface of the solid substance in the fermentation broth, fermentation broth product, or composition at a density of at least about 1 *Methylobacterium*/20 square micrometers, of at least about 1 *Methylobacterium*/10 square micrometers, of at least about 1 *Methylobacterium*/10 square micrometers, of at least about 1 *Methylobacterium*/5 square micrometers, of at least about 1 *Methylobacterium*/2 square micrometers, or of at least about 1 *Methylobacterium*/square micrometer. In certain embodiments, adherent *Methylobacterium* can be present on the surface of the solid substance in the fermentation broth, fermentation broth product, or composition at a density of at least about 1 *Methylobacterium*/20 square micrometers to about 1 *Methylobacterium*/square micrometer, of at least about 1 *Methylobacterium*/10 square micrometers to about 1 *Methylobacterium*/square micrometer, of at least about 1 *Methylobacterium*/10 square micrometers to about 1 *Methylobacterium*/square micrometer, of at least about 1 *Methylobacterium*/5 square micrometers to about 1 *Methylobacterium*/square micrometer, or of at least about 1 *Methylobacterium*/2 square micrometers to about 1 *Methylobacterium*/square micrometer. In certain embodiments, adherent *Methylobacterium* can be present on the surface of the solid substance in the fermentation broth, fermentation broth product, or composition at a density of at least about 1 *Methylobacterium*/20 square micrometers to about 1 *Methylobacterium*/2 square micrometers, of at least about 1 *Methylobacterium*/10 square micrometers to about 1 *Methylobacterium*/2 square micrometers, of at least about 1 *Methylobacterium*/10 square micrometers to about 1 *Methylobacterium*/2 square micrometers, or of at least about 1 *Methylobacterium*/5 square micrometers to about 1 *Methylobacterium*/2 square micrometers. Biphasic fermentation broths provided herein can comprise a liquid phase that contains non-adherent *Methylobacterium*. In certain embodiments, titers of non-adherent *Methylobacterium* in the liquid phase can be less than about 100,000, 10,000, or 1,000 CFU/ml.

Biphasic culture methods provided can yield fermentation broths with *Methylobacterium* at a titer of greater than about $5 \times 10^8$ colony-forming units per milliliter, at a titer of greater than about $1 \times 10^9$ colony-forming units per milliliter, at a titer of greater than about $1 \times 10^{10}$ colony-forming units per milliliter, at a titer of at least about $3 \times 10^{10}$ colony-forming units per milliliter. In certain embodiments, fermentation broths provided herein can comprise *Methylobacterium* at a titer of at least about $5 \times 10^8$ colony-forming units per milliliter to at least about $3 \times 10^{10}$ colony-forming units per milliliter, at least about $5 \times 10^8$ colony-forming units per milliliter to at least about $4 \times 10^{10}$ colony-forming units per milliliter, or at least about $5 \times 10^8$ colony-forming units per milliliter to at least about $6 \times 10^{10}$ colony-forming units per milliliter. In certain embodiments, fermentation broths provided herein can comprise *Methylobacterium* at a titer of at least about $1 \times 10^9$ colony-forming units per milliliter to at least about $3 \times 10^{10}$ colony-forming units per milliliter, at least about $1 \times 10^9$ colony-forming units per milliliter to at least about $4 \times 10^{10}$ colony-forming units per milliliter, or at least about $1 \times 10^9$ colony-forming units per milliliter to at least about $6 \times 10^{10}$ colony-forming units per milliliter. In certain embodiments, fermentation broths provided herein will comprise *Methylobacterium* at a titer of at least about $1 \times 10^{10}$ colony-forming units per milliliter to at least about $3 \times 10^{10}$ colony-forming units per milliliter, at least about $1 \times 10^{10}$ colony-forming units per milliliter to at least about $4 \times 10^{10}$ colony-forming units per milliliter, or at least about $1 \times 10^{10}$ colony-forming units per milliliter to at least about $6 \times 10^{10}$ colony-forming units per milliliter. In certain embodiments, fermentation broths provided herein will comprise *Methylobacterium* at a titer of, at least about $3 \times 10^{10}$ colony-forming units per milliliter to at least about $4 \times 10^{10}$ colony-forming units per milliliter, or at least about $3 \times 10^{10}$ colony-forming units per milliliter to at least about $6 \times 10^{10}$ colony-forming units per milliliter.

Solid substances with adherent *Methylobacterium* can be obtained as fermentation products can be used to make various compositions useful for treating plants or plant parts to improve plant yield, plant insect resistance, plant fungal disease resistance, and/or to improve lettuce production. In certain embodiments, the composition comprises *Methylobacterium* and is depleted of substances that promote growth of resident bacteria. Compositions provided herein comprising *Methylobacterium*, solid substances with *Methylobacterium* grown thereon, or comprising emulsions with *Methylobacterium* grown therein can be used to treat plants or plant parts. Plants, plant parts, and, in particular, plant seeds that have been at least partially coated or coated with the fermentation broth products or compositions comprising *Methylobacterium* are thus provided. Also provided are processed plant products that contain the fermentation broth products or compositions with *Methylobacterium* or adherent *Methylobacterium*. Solid substances with adherent *Methylobacterium* can be used to make various compositions that are particularly useful for treating plant seeds. Seeds that have been at least partially coated with the fermentation broth products or compositions are thus provided. Also provided are processed seed products, including, but not limited to, meal, flour, feed, and flakes that contain the fermentation broth products or compositions provided herein. In certain embodiments, the processed plant product will be non-regenerable (i.e. will be incapable of developing into a plant). In certain embodiments, the solid substance used in the fermentation product or composition that at least partially coats the plant, plant part, or plant seed or that is contained in the processed plant, plant part, or seed product comprises a solid substance and associated or adherent *Methylobacterium* that can be readily identified by comparing a treated and an untreated plant, plant part, plant seed, or processed product thereof. Partial coating of a plant, a plant part, or a seed includes, but is not limited to coating at least about 5%, 10%, 20%, 30%, 40%, 50%, 60%, 70%, 80%, 90%, 95%, 98%, 99%, or about 99.5% of the surface area of the plant, plant part, or plant seed.

Methods of preparing a plant or plant seed treatment composition that comprises *Methylobacterium* and is depleted of substances that promote growth of resident bacteria on a plant or seed are also provided herein. Such methods can comprise (i) growing a mono-culture or co-culture of *Methylobacterium* in media that comprises: (a) an aqueous phase; (b) a liquid phase and a solid phase; or (c) an emulsion, thereby obtaining a *Methylobacterium*-containing media; (ii) separating the *Methylobacterium* from at least one other portion of the *Methylobacterium*-containing media; and (iii) reconstituting the *Methylobacterium* in a matrix lacking substances that promote growth of resident bacteria on a plant or seed. In certain embodiments, the separation step is effected by centrifugation, filtration, or settling of the *Methylobacterium*-containing media and removal of excess liquid or emulsion therefrom. In certain embodiments where the *Methylobacterium* are grown in the presence of a solid substance, the separation will provide a fraction containing *Methylobacterium* with adherent growth to the solid substance and some non-adherent *Methylobacterium* that can be reconstituted in the matrix. In certain embodiments, the substance that promotes growth of resident bacteria on a plant or seed is selected from the group consisting of a carbon source, a nitrogen source, a phosphorous source, a sulfur source, a magnesium source, and combinations thereof. In certain embodiments, the matrix is a liquid, an emulsion, or one or more solids, and comprises an agriculturally acceptable adjuvant and/or excipient. In certain embodiments; the *Methylobacterium* are grown in media comprising a liquid phase and a solid substance with adherent *Methylobacterium* grown thereon. The solid substance is separated from the liquid phase of the *Methylobacterium*-containing media, and the solid substance with adherent *Methylobacterium* grown thereon is reconstituted in the aforementioned matrix. In certain embodiments, the matrix can be a liquid including, but not limited to, water, and aqueous buffer depleted of substances that promote growth of resident bacteria on a plant or seed, or an aqueous solution depleted of substances that promote growth of resident bacteria on a plant or seed.

In certain embodiments, the *Methylobacterium* sp. that improve lettuce production can be identified by testing newly isolated candidate *Methylobacterium* sp. for the presence of polymorphic nucleic acid sequences that are present in exemplary *Methylobacterium* sp. provided herein that improve lettuce production and that are absent from *Methylobacterium* sp. provided herein that do not improve lettuce production. In certain embodiments, the polymorphic nucleic acid sequences that are present in the identified *Methylobacterium* sp. that improve lettuce production are also present in one or more of the exemplary *Methylobacterium* sp. isolates NLS0020, NLS0066, NLS0017, NLS0065, NLS0089, NLS0042, and NLS0068 provided herein that improve lettuce production but are absent from one or more of the *Methylobacterium* sp. isolates provided herein that do not improve lettuce production. In certain embodiments, the polymorphic nucleic acid sequences that are present in the identified *Methylobacterium* sp. that improve lettuce production are also present in one or more of the exemplary *Methylobacterium* sp. isolates NLS0020, NLS0066, NLS0017, NLS0065 and/or NLS0089 provided herein that improve lettuce production when applied as seed treatments but are absent from one or more of the *Methylobacterium* sp. isolates provided herein that do not improve lettuce production when applied as seed treatments. In certain embodiments, the polymorphic nucleic acid sequences that are present in the identified *Methylobacterium* sp. that improve lettuce production are also present in one or more of the exemplary *Methylobacterium* sp. isolates NLS0020, NLS0017, NLS0042, and NLS0068 provided herein that improve lettuce production when applied as foliar treatments but are absent from one or more of the *Methylobacterium* sp. isolates provided herein that do not improve lettuce production when applied as foliar treatments. In certain embodiments, the polymorphic nucleic acid sequences that are present in the identified *Methylobacterium* sp. that improve lettuce production are also present in two or more of the exemplary *Methylobacterium* sp. isolates NLS0020, NLS0066, NLS0017, NLS0065, NLS0089, NLS0042, and NLS0068 provided herein that improve lettuce production but are absent in two or more of the *Methylobacterium* sp. isolates provided herein that do not improve lettuce production. In certain embodiments, the polymorphic nucleic acid sequences that are present in the identified *Methylobacterium* sp. that improve lettuce production are also present in one or more of the exemplary *Methylobacterium* sp. isolates NLS0020, NLS0066, NLS0017, NLS0065, NLS0089, NLS0042, and/or NLS0068 provided herein that improve lettuce production but are absent from all of the *Methylobacterium* sp. isolates provided herein that do not improve lettuce production. In certain embodiments, the polymorphic nucleic acid sequences present in the identified *Methylobacterium* sp. that improve lettuce production are present in all of the exemplary *Methylobacterium* sp. isolates NLS0020, NLS0066, NLS0017, NLS0065, NLS0089, NLS0042, and NLS0068 provided herein that improve lettuce production but are absent in all of the *Methylobacterium* sp. isolates provided herein that do not improve lettuce production. Such nucleic acid polymorphisms that occur in the *Methylobacterium* sp. that improve lettuce production can include, but are not limited to, single nucleotide polymorphisms, RFLP, AFLP and/or other DNA variations such as repetitive sequences, insertion sequences, transposons, and genomic islands occurring as a result of insertions, deletions, and substitutions (Indels) in the bacterial genome which includes both the chromosomal DNA as well as any extrachromosomal nucleic acid elements that may be present in the *Methylobacterium* sp. that improve lettuce production. Such extrachromosomal nucleic acid elements include, but are not limited to, plasmids, bacteriophage DNA or RNA, and the like. Methods used to identify such nucleotide polymorphisms include, but are not limited to, single base extension (SBE) techniques, allele specific hybridization (ASH), real-time PCR detection (i.e. TaqMan™; U.S. Pat. Nos. 5,804, 375; 5,538,848; 5,487,972; and 5,210,015, which are each incorporated herein by reference in their entireties), combinations of ASH and RT-PCR (KASP™ detection systems, LGC Genomics, Middlesex, UK) and deep sequencing techniques (U.S. Patent Appl. No. 20120264632, incorporated herein by reference in its entirety).

Also provided herein are compositions, methods of making the compositions, and methods of using the compositions to improve lettuce production where the compositions or methods comprise or use any of the following *Methylobacterium* sp. isolates provided in the following Table 1 or derivatives of the isolates. In certain embodiments, such derivatives can include variants but are not limited to, variants of the isolates obtained by selection, variants of the isolates selected by mutagenesis and selection, and genetically transformed isolates obtained from the isolates.

TABLE 1

*Methylobacterium* sp. isolates

| NLS | USDA ARS NRRL No.[1] |
|---|---|
| NLS0017 | NRRL B-50931 |
| NLS0020 | NRRL B-50930 |
| NLS0021 | NRRL B-50939 |
| NLS0037 | NRRL B-50941 |
| NLS0038 | NRRL B-50942 |
| NLS0042 | NRRL B-50932 |
| NLS0046 | NRRL B-50929 |
| NLS0062 | NRRL B-50937 |
| NLS0064 | NRRL B-50938 |
| NLS0065 | NRRL B-50935 |
| NLS0066 | NRRL B-50940 |
| NLS0068 | NRRL B-50934 |
| NLS0069 | NRRL B-50936 |
| NLS0089 | NRRL B-50933 |

[1]Deposit number for strain to be deposited with the AGRICULTURAL RESEARCH SERVICE CULTURE COLLECTION (NRRL) of the National Center for Agricultural Utilization Research, Agricultural Research Service, U.S. Department of Agriculture, 1815 North University Street, Peoria, Illinois 61604 U.S.A. under the terms of the Budapest Treaty on the International Recognition of the Deposit of Microorganisms for the Purposes of Patent Procedure. Subject to 37 CFR §1.808(b), all restrictions imposed by the depositor on the availability to the public of the deposited material will be irrevocably removed upon the granting of any patent from this patent application.

Co-assigned patent applications that disclose additional specific uses of the *Methylobacterium* strains of Table 1 such as: (1) increasing corn yield (U.S. 61/911,780, filed Dec. 4, 2013; and International Application claiming benefit of the same filed on Dec. 4, 2014); (2) increasing soybean yield (U.S. 61/911,698, filed Dec. 4, 2013; and International Application claiming benefit of the same filed on Dec. 4, 2014); (3) improving tomato growth (U.S. 61/954,390, filed Mar. 17, 2014; and International Application claiming benefit of the same filed on Dec. 4, 2014); (4) improving fruit maturation (U.S. 61/911,577, filed Dec. 4, 2013; and International Application claiming benefit of the same filed on Dec. 4, 2014); (5) providing fungal disease resistance (U.S. 62/045,950, filed Sep. 4, 2014; U.S. 62/013,464, filed Jun. 17, 2014) and are each incorporated herein by reference in their entireties. Specifically incorporated herein by reference in their entireties are the amino acid and genomic nucleic acid sequences of NLS017 and NLS066 disclosed in the International Application for Compositions And Methods For Improved Tomato Growth, filed Dec. 4, 2014 and claiming benefit of U.S. 61/954,390, filed Mar. 17, 2014.

Also provided herein are *Methylobacterium* sp. that provide for improved lettuce production where the *Methylobacterium* sp. have any of: (i) at least one gene encoding at least one protein that is orthologous to a protein having an amino acid sequence of SEQ ID NO: 1-5125; or (ii) at least one gene encoding at least one protein that is orthologous to a reference protein of Table 7. A *Methylobacterium* sp. has at least one gene that is orthologous to a protein having an amino acid sequence of at least one of SEQ ID NO: 1-5125, or to the corresponding SEQ ID NO of a reference protein of Table 7, when a chromosome and/or any extrachromosomal DNA in that *Methylobacterium* sp. contains a gene encoding a protein that has at least 50%, at least 60%, at least 70%, at least 80%, at least 90%, at least 95%, at least 97%, at least 98%, at least 99%, or 100% sequence identity across the entire length of the amino acid sequence of at least one of SEQ ID NO: 1-5125. The *Methylobacterium* sp. can also have at least two, three, four, six, eight, 10, 15, or 20 genes encoding proteins that are orthologous to proteins having an amino acid sequence of SEQ ID NO: 1-5125 or encoding proteins that are orthologous to the corresponding SEQ ID NO of a reference protein of Table 7. In certain embodiments, the *Methylobacterium* sp. can contain at least one gene encoding a protein that is orthologous to a reference protein having the amino acid sequence of 13, 14, 23, 27, 28, 30, 40, 43, 44, 51, 52, 57, 76, 85, 127, 197, 198, 199, 1094, 1100, 1106, 1114, 1116, 1117, 1120, 1180, 2180, 2190, 2463, 2467, 2468, 2471, 2510, 2515, 2676, 2971, 3357, 3370, 3372, 3394, 3427, 3429, 3430, 3950, 3952, 3968, 3987, 3996, 4004, 4006, and/or 4067 of Table 7. In certain embodiments, the *Methylobacterium* sp. can contain at least one gene encoding a protein that is orthologous to reference protein having the amino acid sequence of SEQ ID NO: 13, 14, 23, 1094, 1100, 1106, 2467, 2468, 3357, 3370, and/or 3968 of Table 7. In certain embodiments, the *Methylobacterium* sp. can contain at least one gene encoding a protein that is orthologous to reference protein having the amino acid sequence of SEQ ID NO: 1100, 1116, 2471, 2971, and/or 3950 of Table 7. Examples of proteins that are orthologous to SEQ ID NO: 1094 include, but are not limited to, the orthologous proteins identified as transcriptional regulators that are provided in Table 7. Examples of proteins that are orthologous to SEQ ID NO: 23 include, but are not limited to, the orthologous proteins identified as transcriptional regulator XRE family proteins that are provided in Table 7. Examples of proteins that are orthologous to SEQ ID NO: 1100 include, but are not limited to, proteins having the amino acid sequence of SEQ ID NO: 17, 1110, 2179, 2484, and 3367 that are similar to proteins identified as ABC transporter-like proteins. Examples of proteins that are orthologous to SEQ ID NO: 1116 include, but are not limited to, proteins having the amino acid sequence of SEQ ID NO: 37, 1116, 2182, and 2521 that are similar to proteins identified as multidrug transporter MatE. Examples of proteins that are orthologous to SEQ ID NO: 2471 include, but are not limited to, proteins having the amino acid sequence of SEQ ID NO: 10, 2471, 3356, and 3958 that are similar to proteins identified as arsenite efflux pump ACR proteins. Examples of proteins that are orthologous to SEQ ID NO: 2971 include, but are not limited to, proteins having the amino acid sequence of SEQ ID NO: 250, 1309, 2263, and 2971 that are similar to proteins identified as members of the LysR family transcriptional regulators. In certain embodiments, the *Methylobacterium* sp. has at least one gene that is orthologous to a protein having an amino acid sequence of at least one of SEQ ID NO: 1-5125, or to the corresponding SEQ ID NO of a reference protein of Table 7, with the proviso that the gene is not found in *M. extorquens* AM1, *M. extorquens* PA1, or *M. extorquens* ME4. Compositions comprising any of the aforementioned *Methylobacterium* sp. and an agriculturally acceptable excipient, adjuvant, or combination thereof are also provided along with lettuce seeds or leaves that are at least partially coated with such compositions and methods of using such compositions as seed or foliar treatments to improve lettuce production.

A *Methylobacterium* sp. can be determined to contain a gene encoding a protein that is orthologous to a protein having an amino acid sequence of SEQ ID NO: 1-5125 by a variety of different techniques. In certain embodiments, a *Methylobacterium* sp. can be determined to contain a gene encoding a protein that is orthologous to a protein having an amino acid sequence of SEQ ID NO: 1-5125 by assembling a complete electronic genomic sequence comprising chromosomal and extrachromosomal DNA sequences present in that *Methylobacterium* sp. with a computer and associated software, and determining if any of the open reading frames (ORF) present in that DNA sequence encode a protein having the aforementioned percent sequence identity. In such embodiments, the ORF can be identified by performing a six-way translation of the electronically assembled sequence and querying the translated with an amino acid sequence of SEQ ID NO: 1-5125 or the corresponding SEQ ID NO: of a reference protein of Table 7. In other embodiments, the present or absence of a given sequence within a *Methylobacterium* sp. an amino acid sequence of SEQ ID NO: 1-5125 or the corresponding SEQ ID NO: of a reference protein of Table 7 can be determined by a nucleic acid analysis or protein analysis technique. Examples of nucleic acid sequences that encode the proteins of SEQ ID NO:1-5125 include, but are not limited to, SEQ ID NO: 5126-10250, respectively. Such nucleic acid analyses include, but are not limited to, techniques based on nucleic acid hybridization, polymerase chain reactions, mass spectroscopy, nanopore based detection, combinations thereof, and the like. Protein analysis techniques include, but are not limited to, immuno-detection, mass spectroscopy, combinations thereof, and the like.

Compositions provided herein that are useful for treating lettuce plants or plant parts that comprise *Methylobacterium*, and/or are depleted of substances that promote growth of resident bacteria on a plant or seed, contain a solid substance with adherent *Methylobacterium* grown thereon, or that comprise emulsions with *Methylobacterium* grown therein can also further comprise an agriculturally acceptable adjuvant or an agriculturally acceptable excipient. An agriculturally acceptable adjuvant or an agriculturally acceptable excipient is typically an ingredient that does not cause undue phytotoxicity or other adverse effects when exposed to a plant or plant part. In certain embodiments, the solid substance can itself be an agriculturally acceptable adjuvant or an agriculturally acceptable excipient so long as it is not bacteriocidal or bacteriostatic to the *Methylobacterium*. In other embodiments, the composition further comprises at least one of an agriculturally acceptable adjuvant or an agriculturally acceptable excipient. Any of the aforementioned compositions can also further comprise a pesticide. Pesticides used in the composition include, but are not limited to, an insecticide, a fungicide, a nematocide, and a bacteriocide. In certain embodiments, the pesticide used in the composition is a pesticide that does not substantially inhibit growth of the *Methylobacterium*. As *Methylobacterium* are gram negative bacteria, suitable bacteriocides used in the compositions can include, but are not limited to, bacteriocides that exhibit activity against gram positive bacteria but not gram negative bacteria. Compositions provided herein can also comprise a bacteriostatic agent that does not substantially inhibit growth of the *Methylobacterium*. Bacteriostatic agents suitable for use in compositions provided herein include, but are not limited to, those that exhibit activity against gram positive bacteria but not gram negative bacteria. Any of the aforementioned compositions can also be an essentially dry product (i.e. having about 5% or less water content), a mixture of the composition with an emulsion, or a suspension. Any of the compositions provided herein can be used to coat or partially coat a plant, plant, part, or plant seed. Partial coating of a plant, a plant part, or a seed includes, but is not limited to coating at least about 5%, 10%, 20%, 30%, 40%, 50%, 60%, 70%, 80%, 90%, 95%, 98%, 99%, or about 99.5% of the surface area of the plant, plant part, or plant seed.

Agriculturally acceptable adjuvants used in the compositions that comprise *Methylobacterium* include, but are not limited to, components that enhance product efficacy and/or products that enhance ease of product application. Adjuvants that enhance product efficacy can include various wetters/spreaders that promote adhesion to and spreading of the composition on plant parts, stickers that promote adhesion to the plant part, penetrants that can promote contact of the active agent with interior tissues, extenders that increase the half-life of the active agent by inhibiting environmental degradation, and humectants that increase the density or drying time of sprayed compositions. Wetters/spreaders used in the compositions can include, but are not limited to, non-ionic surfactants, anionic surfactants, cationic surfactants, amphoteric surfactants, organo-silicate surfactants, and/or acidified surfactants. Stickers used in the compositions can include, but are not limited to, latex-based substances, terpene/pinolene, and pyrrolidone-based substances. Penetrants can include mineral oil, vegetable oil, esterified vegetable oil, organo-silicate surfactants, and acidified surfactants. Extenders used in the compositions can include, but are not limited to, ammonium sulphate, or menthene-based substances. Humectants used in the compositions can include, but are not limited to, glycerol, propylene glycol, and diethyl glycol. Adjuvants that improve ease of product application include, but are not limited to, acidifying/buffering agents, anti-foaming/de-foaming agents, compatibility agents, drift-reducing agents, dyes, and water conditioners. Anti-foaming/de-foaming agents used in the compositions can include, but are not limited to, dimethopolysiloxane. Compatibility agents used in the compositions can include, but are not limited to, ammonium sulphate. Drift-reducing agents used in the compositions can include, but are not limited to, polyacrylamides, and polysaccharides. Water conditioners used in the compositions can include, but are not limited to, ammonium sulphate.

Methods of treating plants and/or plant parts with the fermentation broths, fermentation broth products, and compositions comprising *Methylobacterium* are also provided herein. Treated plants, and treated plant parts obtained therefrom, include, but are not limited to, a pepper, tomato, berry, or banana plant. Plant parts that are treated include, but are not limited to, leaves, stems, flowers, roots, seeds, fruit, tubers, coleoptiles, and the like. Seeds or other propagules of any of the aforementioned plants can be treated with the fermentation broths, fermentation broth products, fermentation products, and/or compositions provided herein.

In certain embodiments, plants and/or plant parts are treated by applying the fermentation broths, fermentation broth products, fermentation products, and compositions that comprise *Methylobacterium* as a spray. Such spray applications include, but are not limited to, treatments of a single plant part or any combination of plant parts. Spraying can be achieved with any device that will distribute the fermentation broths, fermentation broth products, fermentation products, and compositions to the plant and/or plant part(s). Useful spray devices include a boom sprayer, a hand or backpack sprayer, crop dusters (i.e. aerial spraying), and the like. Spraying devices and or methods providing for application of the fermentation broths, fermentation broth products, fermentation products, and compositions to either one or both of the adaxial surface and/or abaxial surface can also be used. Plants and/or plant parts that are at least partially coated with any of a biphasic fermentation broth, a fermentation broth product, fermentation product, or compositions that comprise a solid substance with *Methylobacterium* adhered thereto are also provided herein. Also provided herein are processed plant products that comprise a solid substance with *Methylobacterium* adhered thereto. Any of the compositions provided herein can be used to coat or partially coat a plant, plant, part, or plant seed. Partial coating of a plant, a plant part, or a seed includes, but is not limited to coating at least about 5%, 10%, 20%, 30%, 40%, 50%, 60%, 70%, 80%, 90%, 95%, 98%, 99%, or about 99.5% of the surface area of the plant, plant part, or plant seed In certain embodiments, lettuce seeds are treated by exposing the seeds to the fermentation broths, fermentation broth products, fermentation products, and compositions that comprise *Methylobacterium*. Seeds can be treated with the fermentation broths, fermentation broth products, and compositions provided herein by methods including, but not limited to, imbibition, coating, spraying, and the like. In certain embodiments, surface sterilized seeds are treated with a composition comprising *Methylobacterium*. In certain embodiments, non-sterilized seeds (i.e. seeds that have not been subjected to surface sterilization) are treated with a composition comprising *Methylobacterium* that has been depleted of substances that promote growth of resident microorganisms on the seed. Seed treatments can be effected with both continuous and/or a batch seed treaters. In certain embodiments, the coated seeds may be prepared by slurrying seeds with a coating composition containing a fermentation broth, fermentation broth product, or compositions that comprise the solid substance with *Methylobacterium* and air drying the resulting product. Air drying can be accomplished at any temperature that is not deleterious to the seed or the *Methylobacterium*, but will typically not be greater than 30 degrees Centigrade. The proportion of coating that comprises a solid substance and *Methylobacterium* includes, but is not limited to, a range of 0.1 to 25% by weight of the seed, 0.5 to 5% by weight of the seed, and 0.5 to 2.5% by weight of seed. Partial coating of a seed can includes, but is not limited to coating at least about 5%, 10%, 20%, 30%, 40%, 50%, 60%, 70%, 80%, 90%, 95%, 98%, 99%, or about 99.5% of the surface area of the seed. In certain embodiments, a solid substance used in the seed coating or treatment will have *Methylobacterium* adhered thereon. In certain embodiments, a solid substance used in the seed coating or treatment will be associated with *Methylobacterium* and will be a fermentation broth, fermentation broth product, or composition obtained by the methods provided herein. Various seed treatment compositions and methods for seed treatment disclosed in U.S. Pat. Nos. 5,106,648, 5,512,069, and 8,181,388 are incorporated herein by reference in their entireties and can be adapted for use with an active agent comprising the fermentation broths, fermentation broth products, or compositions provided herein. In certain embodiments, the composition used to treat the seed can contain agriculturally acceptable excipients that include, but are not limited to, woodflours, clays, activated carbon, diatomaceous earth, fine-grain inorganic solids, calcium carbonate and the like. Clays and inorganic solids that can be used with the fermentation broths, fermentation broth products, or compositions provided herein include, but are not limited to, calcium bentonite, kaolin, china clay, talc, perlite, mica, vermiculite, silicas, quartz powder, montmorillonite and mixtures thereof. Agriculturally acceptable adjuvants that promote sticking to the seed that can be used include, but are not limited to, polyvinyl acetates, polyvinyl acetate copolymers, hydrolyzed polyvinyl acetates, polyvinylpyrrolidone-vinyl acetate copolymer, polyvinyl alcohols, polyvinyl alcohol copolymers, polyvinyl methyl ether, polyvinyl methyl ether-maleic anhydride copolymer, waxes, latex polymers, celluloses including ethylcelluloses and methylcelluloses, hydroxy methylcelluloses, hydroxypropylcellulose, hydroxymethylpropylcelluloses, polyvinyl pyrrolidones, alginates, dextrins, maltodextrins, polysaccharides, fats, oils, proteins, karaya gum, jaguar gum, tragacanth gum, polysaccharide gums, mucilage, gum arabics, shellacs, vinylidene chloride polymers and copolymers, soybean-based protein polymers and copolymers, lignosulfonates, acrylic copolymers, starches, polyvinylacrylates, zeins, gelatin, carboxymethylcellulose, chitosan, polyethylene oxide, acrylamide polymers and copolymers, polyhydroxyethyl acrylate, methylacrylamide monomers, alginate, ethylcellulose, polychloroprene and syrups or mixtures thereof. Other useful agriculturally acceptable adjuvants that can promote coating include, but are not limited to, polymers and copolymers of vinyl acetate, polyvinylpyrrolidone-vinyl acetate copolymer and water-soluble waxes. Various surfactants, dispersants, anticaking-agents, foam-control agents, and dyes disclosed herein and in U.S. Pat. No. 8,181,388 can be adapted for use with an active agent comprising the fermentation broths, fermentation broth products, or compositions provided herein.

Provided herein are compositions that comprise *Methylobacterium* that provide improved lettuce production relative to untreated plants that have not been exposed to the compositions. In certain embodiments, plant parts, including, but not limited to, a seed, a leaf, a fruit, a stem, a root, a tuber, or a coleoptile can be treated with the compositions provided herein to improve lettuce production. Treatments or applications can include, but are not limited to, spraying, coating, partially coating, immersing, and/or imbibing the plant or plant parts with the compositions provided herein. In certain embodiments, a seed, a leaf, a fruit, a stem, a root, a tuber, or a coleoptile can be immersed and/or imbibed with a liquid, semi-liquid, emulsion, or slurry of a composition provided herein. Such seed immersion or imbibition can be sufficient to provide for improved lettuce production in a treated plant or plant part in comparison to an untreated plant or plant part. Improved lettuce production includes, but is not limited, to increased root growth, increased leaf growth, increased seed production, and/or increased total biomass relative to untreated plants. In certain embodiments, plant seeds can be immersed and/or imbibed for at least 1, 2, 3, 4, 5, or 6 hours. Such immersion and/or imbibition can, in certain embodiments, be conducted at temperatures that are not deleterious to the plant seed or the *Methylobacterium*. In certain embodiments, the seeds can be treated at about 15 to about 30 degrees Centigrade or at about 20 to about 25 degrees Centigrade. In certain embodiments, seed imbibition and/or immersion can be performed with gentle agitation.

Compositions provided herein comprising *Methylobacterium* are therefore expected to be useful in improving lettuce production.

In certain embodiments, an amount of a composition provided herein that is sufficient to provide for improved lettuce production can be a composition with *Methylobacterium* at a titer of at least about $1 \times 10^6$ colony-forming units per milliliter, at least about $5 \times 10^6$ colony-forming units per milliliter, at least about $1 \times 10^7$ colony-forming units per milliliter, at least about $5 \times 10^8$ colony-forming units per milliliter, at least about $1 \times 10^9$ colony-forming units per milliliter, at least about $1 \times 10^{10}$ colony-forming units per milliliter, or at least about $3 \times 10^{10}$ colony-forming units per milliliter. In certain embodiments, an amount of a composition provided herein that is sufficient to provide for improving lettuce production can be a composition with *Methylobacterium* at a titer of about least about $1 \times 10^6$ colony-forming units per milliliter, at least about $5\times10^6$ colony-forming units per milliliter, at least about $1\times10^7$ colony-forming units per milliliter, or at least about $5\times10^8$ colony-forming units per milliliter to at least about $6\times10^{10}$ colony-forming units per milliliter of a liquid or an emulsion. In certain embodiments, an amount of a composition provided herein that is sufficient to provide for improving lettuce production can be a fermentation broth product with a *Methylobacterium* titer of a solid phase of that product is at least about $5\times10^8$ colony-forming units per milliliter to at least about $5\times10^{13}$ colony-forming units of *Methylobacterium* per gram of the solid phase. In certain embodiments, an amount of a composition provided herein that is sufficient to provide for improving lettuce production can be a composition with a *Methylobacterium* titer of at least about $1\times10^6$ colony-forming units per gram, at least about $5\times10^6$ colony-forming units per gram, at least about $1\times10^7$ colony-forming units per gram, or at least about $5\times10^8$ colony-forming units per gram to at least about $6\times10^{10}$ colony-forming units of *Methylobacterium* per gram of particles in the composition containing the particles that comprise a solid substance wherein a mono-culture or co-culture of *Methylobacterium* is adhered thereto. In certain embodiments, an amount of a composition provided herein that is sufficient to provide for improving lettuce production can be a composition with a *Methylobacterium* titer of at least about $1\times10^6$ colony-forming units per mL, at least about $5\times10^6$ colony-forming units per mL, at least about $1\times10^7$ colony-forming units per mL, or at least about $5\times10^8$ colony-forming units per ml, to at least about $6\times10^{10}$ colony-forming units of *Methylobacterium* per mL in a composition comprising an emulsion wherein a mono-culture or co-culture of a *Methylobacterium* adhered to a solid substance is provided therein or grown therein. In certain embodiments, an amount of a composition provided herein that is sufficient to provide for improving lettuce production can be a composition with a *Methylobacterium* titer of at least about $1\times10^6$ colony-forming units per mL, at least about $5\times10^6$ colony-forming units per mL, at least about $1\times10^7$ colony-forming units per mL, or at least about $5\times10^8$ colony-forming units per mL to at least about $6\times10^{10}$ colony-forming units of *Methylobacterium* per mL of in a composition comprising an emulsion wherein a mono-culture or co-culture of a *Methylobacterium* is provided therein or grown therein.

In certain embodiments, an amount of a composition provided herein that is sufficient to provide for improved lettuce production can be a composition with a *Methylobacterium* sp. at a titer of at least about $1\times10^4$ colony-forming units per milliliter, at least about $1\times10^5$ colony-forming units per milliliter, at least about $1\times10^6$ colony-forming units per milliliter, at least about $5\times10^6$ colony-forming units per milliliter, at least about $1\times10^7$ colony-forming units per milliliter, at least about $5\times10^8$ colony-forming units per milliliter, at least about $1\times10^9$ colony-forming units per milliliter, at least about $1\times10^{10}$ colony-forming units per milliliter, or at least about $3\times10^{10}$ colony-forming units per milliliter. In certain embodiments, an amount of a composition provided herein that is sufficient to provide for improved lettuce production can be a composition with *Methylobacterium* sp. at a titer of at least about $1\times10^4$ colony-forming units per milliliter, at least about $1\times10^5$ colony-forming units per milliliter, about least about $1\times10^6$ colony-forming units per milliliter, at least about $5\times10^6$ colony-forming units per milliliter, at least about $1\times10^7$ colony-forming units per milliliter, or at least about $5\times10^8$ colony-forming units per milliliter to at least about $6\times10^{10}$ colony-forming units per milliliter of a liquid or an emulsion. In certain embodiments, an amount of a composition provided herein that is sufficient to provide for improved lettuce production can be a fermentation broth product with a *Methylobacterium* sp. titer of a solid phase of that product is at least about $1\times10^4$ colony-forming units per gram, at least about $1\times10^5$ colony-forming units per gram, at least about $1\times10^6$ colony-forming units per gram, at least about $5\times10^6$ colony-forming units per gram, at least about $1\times10^7$ colony-forming units per gram, at least about $5\times10^8$ colony-forming units per gram, at least about $1\times10^9$ colony-forming units per gram, or at least about $5\times10^9$ colony-forming units per gram to at least about $6\times10^{10}$ colony-forming units of *Methylobacterium* per gram, at least about $1\times10^{11}$ colony-forming units of *Methylobacterium* per gram, at least about $1\times10^{12}$ colony-forming units of *Methylobacterium* per gram, at least about $1\times10^{13}$ colony-forming units of *Methylobacterium* per gram, or at least about $5\times10^{13}$ colony-forming units of *Methylobacterium* per gram of the solid phase. In certain embodiments, an amount of a composition provided herein that is sufficient to provide for improved lettuce production can be a composition with a *Methylobacterium* titer of at least about $1\times10^6$ colony-forming units per gram, at least about $5\times10^6$ colony-forming units per gram, at least about $1\times10^7$ colony-forming units per gram, at least about $5\times10^8$ colony-forming units per gram, at least about $1\times10^9$ colony-forming units per gram, or at least about $5\times10^9$ colony-forming units per gram to at least about $6\times10^{10}$ colony-forming units of *Methylobacterium* per gram, at least about $1\times10^{11}$ colony-forming units of *Methylobacterium* per gram, at least about $1\times10^{12}$ colony-forming units of *Methylobacterium* per gram, at least about $1\times10^{13}$ colony-forming units of *Methylobacterium* per gram, or at least about $5\times10^{13}$ colony-forming units of *Methylobacterium* per gram of particles in the composition containing the particles that comprise a solid substance wherein a mono-culture or co-culture of *Methylobacterium* sp. is adhered thereto. In certain embodiments, an amount of a composition provided herein that is sufficient to provide for improved lettuce production can be a composition with a *Methylobacterium* titer of at least about $1\times10^6$ colony-forming units per mL, at least about $5\times10^6$ colony-forming units per mL, at least about $1\times10^7$ colony-forming units per mL, or at least about $5\times10^8$ colony-forming units per mL to at least about $6\times10^{10}$ colony-forming units of *Methylobacterium* per mL in a composition comprising an emulsion wherein a mono-culture or co-culture of a *Methylobacterium* sp. adhered to a solid substance is provided therein or grown therein. In certain embodiments, an amount of a composition provided herein that is sufficient to provide for improved lettuce production can be a composition with a *Methylobacterium* titer of at least about $1\times10^6$ colony-forming units per mL, at least about $5\times10^6$ colony-forming units per mL, at least about $1\times10^7$ colony-forming units per mL, or at least about $5\times10^8$ colony-forming units per mL to at least about $6\times10^{10}$ colony-forming units of *Methylobacterium* per mL of in a composition comprising an emulsion wherein a mono-culture or co-culture of a *Methylobacterium* sp. is provided therein or grown therein.

In certain embodiments, compositions with a *Methylobacterium* sp. at a titer of at least about $1\times10^4$ colony-forming units per milliliter, at least about $1\times10^5$ colony-forming units per milliliter, at least about $1\times10^6$ colony-forming units per milliliter, at least about $5\times10^6$ colony-forming units per milliliter, at least about $1\times10^7$ colony-forming units per milliliter, at least about $5\times10^8$ colony-forming units per milliliter, at least about $1\times10^9$ colony-forming units per milliliter, at least about $1\times10^{10}$ colony-forming units per milliliter, or at least about $3\times10^{10}$ colony-forming units per milliliter are provided or used. In certain embodiments, compositions with *Methylobacterium* sp. at a titer of at least about $1\times10^4$ colony-forming units per milliliter, at least about $1\times10^5$ colony-forming units per milliliter, about least about $1\times10^6$ colony-forming units per milliliter, at least about $5\times10^6$ colony-forming units per milliliter, at least about $1\times10^7$ colony-forming units per milliliter, or at least about $5\times10^8$ colony-forming units per milliliter to at least about $6\times10^{10}$ colony-forming units per milliliter of a liquid or an emulsion are provided. In certain embodiments, fermentation broth products with a *Methylobacterium* sp. titer of a solid phase of that product is at least about $1\times10^4$ colony-forming units per gram, at least about $1\times10^5$ colony-forming units per gram, at least about $1\times10^6$ colony-forming units per gram, at least about $5\times10^6$ colony-forming units per gram, at least about $1\times10^7$ colony-forming units per gram, at least about $5\times10^8$ colony-forming units per gram, at least about $1\times10^9$ colony-forming units per gram, or at least about $5\times10^9$ colony-forming units per gram to at least about $6\times10^{10}$ colony-forming units of *Methylobacterium* per gram, at least about $1\times10^{11}$ colony-forming units of *Methylobacterium* per gram, at least about $1\times10^{12}$ colony-forming units of *Methylobacterium* per gram, at least about $1\times10^{13}$ colony-forming units of *Methylobacterium* per gram, or at least about $5\times10^{13}$ colony-forming units of *Methylobacterium* per gram of the solid phase are provided. In certain embodiments, compositions with a *Methylobacterium* titer of at least about $1\times10^6$ colony-forming units per gram, at least about $5\times10^6$ colony-forming units per gram, at least about $1\times10^7$ colony-forming units per gram, at least about $5\times10^8$ colony-forming units per gram, at least about $1\times10^9$ colony-forming units per gram, or at least about $5\times10^9$ colony-forming units per gram to at least about $6\times10^{10}$ colony-forming units of *Methylobacterium* per gram, at least about $1\times10^{11}$ colony-forming units of *Methylobacterium* per gram, at least about $1\times10^{12}$ colony-forming units of *Methylobacterium* per gram, at least about $1\times10^{13}$ colony-forming units of *Methylobacterium* per gram, or at least about $5\times10^{13}$ colony-forming units of *Methylobacterium* per gram of particles in the composition containing the particles that comprise a solid substance wherein a mono-culture or co-culture of *Methylobacterium* sp. is adhered thereto are provided. In certain embodiments, compositions with a *Methylobacterium* titer of at least about $1\times10^6$ colony-forming units per mL, at least about $5\times10^6$ colony-forming units per mL, at least about $1\times10^7$ colony-forming units per mL, or at least about $5\times10^8$ colony-forming units per mL to at least about $6\times10^{10}$ colony-forming units of *Methylobacterium* per mL in a composition comprising an emulsion wherein a mono-culture or co-culture of a *Methylobacterium* sp. adhered to a solid substance is provided therein or grown therein are provided. In certain embodiments, compositions with a *Methylobacterium* titer of at least about $1\times10^6$ colony-forming units per mL, at least about $5\times10^6$ colony-forming units per mL, at least about $1\times10^7$ colony-forming units per mL, or at least about $5\times10^8$ colony-forming units per mL to at least about $6\times10^{10}$ colony-forming units of *Methylobacterium* per mL of in a composition comprising an emulsion wherein a mono-culture or co-culture of a *Methylobacterium* sp. is provided therein or grown therein is provided. In certain embodiments of any of the aforementioned compositions, the *Methylobacterium* sp. is selected from the group consisting of NLS0017 (NRRL B-50931), NLS0020 (NRRL B-50930), NLS0021 (NRRL B-50939), NLS0037 (NRRL B-50941), NLS0038 (NRRL B-50942), NLS0042 (NRRL B-50932), NLS0046 (NRRL B-50929), NLS0062 (NRRL B-50937), NLS0064 (NRRL B-50938), NLS0065 (NRRL B-50935), NLS0066 (NRRL B-50940), NLS0068 (NRRL B-50934), NLS0069 (NRRL B-50936), NLS0089 (NRRL B-50933), and derivatives thereof. In certain embodiments of any of the aforementioned compositions, the composition can further comprise an agriculturally acceptable adjuvant, an agriculturally acceptable excipient, or combination thereof. In certain embodiments of any of the aforementioned compositions, the *Methylobacterium* sp. is selected from the group consisting of NLS0017 (NRRL B-50931), NLS0020 (NRRL B-50930), NLS0021 (NRRL B-50939), NLS0037 (NRRL B-50941), NLS0038 (NRRL B-50942), NLS0042 (NRRL B-50932), NLS0046 (NRRL B-50929), NLS0062 (NRRL B-50937), NLS0064 (NRRL B-50938), NLS0065 (NRRL B-50935), NLS0066 (NRRL B-50940), NLS0068 (NRRL B-50934), NLS0069 (NRRL B-50936), NLS0089 (NRRL B-50933), derivatives thereof; and also comprises an agriculturally acceptable adjuvant, excipient, or combination thereof.

EXAMPLES

The following examples are included to demonstrate preferred embodiments of the invention. It will be appreciated by those of skill in the art that the techniques disclosed in the following examples represent techniques discovered by the Applicants to function well in the practice of the invention, and thus can be considered to constitute preferred modes for its practice. However, those of skill in the art should, in light of the instant disclosure, appreciate that many changes can be made in the specific embodiments that are disclosed, while still obtaining like or similar results, without departing from the scope of the invention**.

Example 1. Culturing of PPFM Strains in a Liquid Growth Media Supplemented with a Solid Substance The liquid growth medium used to culture the PPFM cultures was a base salts medium supplemented with glycerol, peptone, and diatomaceous earth. The base salts medium used was ammonium mineral salts (AMS) medium. AMS medium contains, per liter, 700 milligrams of dibasic potassium phosphate anhydrous, 540 milligrams of monobasic potassium phosphate anhydrous, one gram of magnesium sulfate heptahydrate, 500 milligrams of ammonium chloride anhydrous, and 200 milligrams of calcium chloride dihydrate.

AMS base medium was prepared from three stock solutions, listed below:

Stock Solution I: For One Liter at 50× Concentration

| | |
|---|---|
| dibasic potassium phosphate, anhydrous | 35 grams |
| monobasic potassium phosphate, anhydrous | 27 grams |

Stock Solution II: For One Liter at 50× Concentration

| | |
|---|---|
| magnesium sulfate heptahydrate | 50 grams |
| ammonium chloride, anhydrous | 25 grams |

Stock Solution III: For One Liter at 50× Concentration

| | |
|---|---|
| calcium chloride dihydrate | 10 grams |

Stock solutions I, II, and III were autoclaved separately.

To prepare one liter of liquid AMS medium with glycerol, peptone, and diatomaceous earth, the following were added to 920 ml of distilled water:
  20 ml of stock solution I
  20 ml of stock solution II 20 ml of stock solution III
20 ml of a 50% glycerol stock solution
10 grams of peptone
2 grams of diatomaceous earth The resulting solution with suspended diatomaceous earth was sterilized by autoclaving.

Two liters of the above AMS medium were placed into a four-liter flask. Two milliliters of liquid culture PPFMs were added to the media to inoculate. The flask was then placed in an incubated shaker set to 240 RPM and 30 degrees Celsius. The cultures were grown for six days and then stored at 4 degrees Celsius for future use.

Example 2. Seed Inoculation of 'Rex' Lettuce to Identify PPFMs that Enhance Root and Shoot Growth Seeding A 104 cell Oasis HorticubeXL™ (bottom grooved, single dibble; Smithers-Oasis North America, Kent, Ohio, USA) was placed into a 1020 flat without holes. Four cubes were removed in the center of grid to allow for bottom watering. The Oasis HorticubeXL™ was watered in so that it was fully saturated, the shower setting with tempered water was used. One seed was placed in each cell for a total of 100 seeds per group.

Inoculation of Lettuce Seeds

The PPFM strains to be tested were grown as described in Example 1 in a liquid medium supplemented with a solid substance. In the biohood, the desired amount of PPFM solution was pipetted into conical tubes (make sure to swirl/shake bottle vigorously before pipetting to suspend particulates). A centrifuge was used to spin down at 3500 RPM for 15 minutes at 23° C. While tubes were spun, a volume of tepid tap water was measured out to bring the volume of each sample up to total volume.

Liquid was carefully poured off from each tube, careful to keep the pellet intact. The appropriate volume of tap water was added to each tube to match its initial volume of PPFM solution. Water re-suspended PPFMS were used as quickly as possible.

100 microliters of solution (PPFM solution for treated groups and tap water for control groups) was pipetted onto the top of each seed. After every 3 rows, the tube was capped and shaken to resuspend any PPFMs that may have settled to the bottom. Pipette tips were changed between each group to avoid cross contamination. Tags were labeled and dated for each flat and clear humidity domes place on top of flat. The flat were placed in a growth chamber with temperature settings at 20 C and 12 hour days with 200 micromole lighting.

Growth

After five to six days, domes were removed after seeds were germinated. Flats were bottom watered only and fertilized with Jack's™ 15-16-17 (JR PETERS, Inc. Allentown, Pa., USA) at every watering (approximately every other day).

Daily repositioning of the flats was carried out to prevent potential effects on growth due to variations of light conditions in the growth chamber.

Processing

Flats were harvested between two and three weeks. Clear humidity domes were placed on each flat to prevent evapotranspiration during transport. Domes were left in place until flat was being processed. Each plant was cut directly below the cotyledons and immediately weighed on an analytical balance.

Observations

It was observed that some strains repeatedly showed an increase in shoot biomass of Lettuce seedlings when a seed was treated at the time of planting. Visual observations of root mass and development were also made, treated groups showed more growth at the time of harvest. Due to the natural variance of biological systems all samples sizes were 98-100 plants minimum and anything below 12% difference was not considered significant.

Conclusion

It was apparent that strains NLS0017, NLS0020, NLS0066, NLS0065, and NLS0089 show an increase in wet weight of lettuce seedlings following seed treatment. Strains NLS0069, NLS0037, NLS0038, and NLS0062 exhibited negligible increases in wet weight in comparison to the controls. Also noted along with an increase in shoot biomass is a corresponding increase in root development.

TABLE 2

Effects of seed treatments on lettuce growth

| strain | titer | seedling wet weight (mg) control | experimental | difference (%) | confidence interval |
|---|---|---|---|---|---|
| NLS0017 | 2.7E+08 | 226.18 | 306.36 | 35.45% | 0.000 |
| NLS0017 | 1.4E+08 | 298.27 | 353.34 | 18.46% | 0.012 |
| NLS0017 | 2.7E+08 | 169.56 | 176.68 | 4.20% | 0.567 |
| NLS0017 | 1.1E+09 | 98.92 | 167.51 | 69.34% | 0.000 |
| NLS0020 | 7.2E+08 | 226.18 | 274.46 | 21.35% | 0.027 |
| NLS0020 | 1.2E+09 | 98.92 | 157.11 | 58.83% | 0.000 |
| NLS0020 | 1.2E+09 | 462.20 | 614.72 | 33.00% | 0.000 |
| NLS0021 | ND[2] | 462.20 | 539.39 | 16.70% | 0.008 |
| NLS0037 | 3.0E+08 | 226.18 | 258.68 | 14.37% | 0.085 |
| NLS0038 | 5.2E+07 | 462.20 | 514.99 | 11.42% | 0.070 |
| NLS0042 | 2.1E+08 | 226.18 | 310.85 | 37.44% | 0.000 |
| NLS0042 | 1.1E+08 | 169.56 | 189.46 | 11.73% | 0.105 |
| NLS0046 | 1.8E+09 | 462.20 | 511.78 | 10.73% | 0.084 |
| NLS0062 | 1.8E+08 | 169.56 | 187.62 | 10.65% | 0.121 |
| NLS0064 | ND[2] | 169.56 | 157.67 | −7.01% | 0.275 |
| NLS0065 | 1.2E+08 | 169.56 | 211.92 | 24.98% | 0.001 |
| NLS0065 | 9.1E+07 | 98.92 | 132.35 | 33.80% | 0.000 |
| NLS0066 | 5.9E+08 | 56.15 | 69.57 | 23.91% | 0.000 |
| NLS0066 | 4.2E+08 | 546.61 | 665.46 | 21.74% | 0.000 |
| NLS0066 | 1.2E+08 | 98.92 | 129.81 | 31.23% | 0.000 |
| NLS0068 | 3.1E+08 | 213.52 | 234.95 | 10.04% | 0.029 |
| NLS0069 | 5.6E+07 | 226.18 | 244.25 | 7.99% | 0.307 |
| NLS0069 | 5.6E+07 | 298.27 | 332.53 | 11.49% | 0.144 |
| NLS0089 | 1.5E+08 | 98.92 | 146.99 | 48.60% | 0.000 |
| NLS0089 | ND[2] | 462.20 | 600.82 | 29.99% | 0.000 |

[1]Each line represents data obtained from a separate flats of plants obtained from treated seed versus control seed.
[2]ND: not determined.

Example 3. Foliar Application of 'Rex' Lettuce to Observe how PPFMs Effect Root and Shoot Growth Seeding A 104 cell Oasis HorticubeXL (bottom grooved, single dibble) was placed into a 1020 flat without holes. Four cubes were removed in the center of grid to allow for bottom watering. Oasis was watered in so that it was fully saturated, the shower setting with tempered water was used. One seed was placed in each cell for a total of 100 seeds per group. Tags were labeled and dated for each flat and clear humidity domes place on top of flat. The flat were placed in a growth chamber with temperature settings at 20 C and 12-hour days with 200 micromole lighting.

Inoculation of Lettuce Seedlings

After five to six days, domes were removed after seeds had germinated. Plants were inoculated at this time, when only the cotyledons had emerged. The PPFM strains to be tested were grown as described in Example 1 in a liquid medium supplemented with a solid substance. The PPFM strains to be tested were grown as described in Example 1 in a liquid medium supplemented with a solid substance. In the biohood, the desired amount of PPFM solution was pipetted into conical tubes (make sure to swirl/shake bottle vigorously before pipetting to suspend particulates). A centrifuge was used to spin down at 3500 RPM for 15 minutes at 23° C. While tubes were spun, a volume of tepid tap water was measured out to bring the volume of each sample up to total volume.

Liquid was carefully poured off from each tube, careful to keep the pellet intact. The appropriate volume of tap water was added to each tube to match its initial volume of PPFM solution. Water re-suspended PPFMS were used as quickly as possible.

100 mL of PPFM solution (tap water for control) was poured into a 1 L Solo™ Handheld Sprayer (Solo™, Newport News, Va., USA). The flat was removed from the group to avoid cross contamination. The finest mist setting was used and an even coat of solution was sprayed over the top of the seedlings, ensuring even coverage across the entire flat. For each group this was repeated, using appropriate treatment.

Growth

Flats were bottom watered only and fertilized with Jack's™ 15-16-17 (JR PETERS, Inc. Allentown, Pa., USA) at every watering (approximately every other day). Daily repositioning of the flats was carried out to prevent potential effects on growth due to variations of light conditions in the growth chamber.

Processing

Flats were harvested between two and three weeks. Clear humidity domes were placed on each flat to prevent evapotranspiration during transport. Domes were left in place until flat was being processed. Each plant was cut directly below the cotyledons and immediately weighed on an analytical balance.

Observations

It was been observed that some strains repeatedly show an increase in shoot biomass of Lettuce seedlings when the seedling was treated at the cotyledon stage. Visual observations of root mass and development were also made, that treated groups showed more growth at the time of harvest. Due to the natural variance of biological systems all samples sizes were a 98-100 plants minimum and anything below 12% difference was not considered significant.

Conclusion

It is apparent that strains NLS0042, NLS0017, NLS0020, and NLS0068 show an increase in wet weight of lettuce seedlings following foliar application. Strains NLS0069, NLS0037, NLS0038, and NLS0062 exhibited negligible increases in wet weight in comparison to the controls. Also noted along with an increase in shoot biomass is a corresponding increase in root development.

TABLE 3

Effects of foliar treatments on lettuce growth

| strain | titers | seedling wet weight (mg) control | seedling wet weight (mg) experimental | difference (%) | confidence interval |
|---|---|---|---|---|---|
| NLS0017 | 1.4E+08 | 197.04 | 213.76 | 8.49% | 0.075 |
| NLS0017 | 1.1E+09 | 157.72 | 211.03 | 33.81% | 0.000 |
| NLS0020 | 2.2E+08 | 104.41 | 145.95 | 39.79% | 0.000 |
| NLS0020 | 7.2E+08 | 205.34 | 247.12 | 20.34% | 0.030 |
| NLS0020 | 1.2E+09 | 280.84 | 260.95 | −7.08% | 0.224 |
| NLS0021 | 1.6E+07 | 157.72 | 178.46 | 13.15% | 0.021 |
| NLS0037 | ND[2] | 197.04 | 198.93 | 0.96% | 0.846 |
| NLS0038 | 7.4E+07 | 197.04 | 186.04 | −5.58% | 0.250 |
| NLS0042 | 9.3E+07 | 103.36 | 127.05 | 22.92% | 0.000 |
| NLS0042 | 2.1E+08 | 205.34 | 235.92 | 14.89% | 0.095 |
| NLS0042 | 6.4E+07 | 298.27 | 331.62 | 11.18% | 0.138 |
| NLS0042 | 1.1E+08 | 157.72 | 196.12 | 24.35% | 0.000 |
| NLS0046 | 1.8E+09 | 157.72 | 195.03 | 23.66% | 0.000 |
| NLS0062 | ND[2] | 280.84 | 243.09 | −13.44% | 0.018 |
| NLS0064 | ND[2] | 205.34 | 240.47 | 17.10% | 0.042 |
| NLS0064 | ND[2] | 298.27 | 306.88 | 2.89% | 0.691 |
| NLS0065 | 4.2E+08 | 197.04 | 214.59 | 8.91% | 0.077 |
| NLS0066 | 5.9E+08 | 205.34 | 241.92 | 17.81% | 0.035 |
| NLS0066 | 1.2E+08 | 280.84 | 166.98 | −40.54% | 0.000 |
| NLS0068 | 1.7E+08 | 104.41 | 204.26 | 95.65% | 0.000 |
| NLS0068 | 1.6E+08 | 205.34 | 288.46 | 40.47% | 0.000 |
| NLS0068 | 3.1E+08 | 298.27 | 296.68 | −0.53% | 0.944 |
| NLS0068 | 3.1E+08 | 280.84 | 264.65 | −5.76% | 0.337 |
| NLS0068 | 3.1E+08 | 157.72 | 183.84 | 16.56% | 0.010 |
| NLS0069 | 4.5E+07 | 99.85 | 103.54 | 3.70% | 0.711 |
| NLS0089 | 1.3E+09 | 280.84 | 282.94 | 0.75% | 0.896 |

[1]Each line represents data obtained from a separate flat of treated versus control plants.
[2]ND: not determined.

Example 4. Identification of Nucleic Acid Polymorphisms Present in *Methylobacterium* that Improve Lettuce Production Whole genome sequencing libraries for the Illumina™ high-throughput sequencing platform are generated for *Methylobacterium* sp. isolates provided in Table 1 using Illumina TRUSEQ™ or NEXTERA™ DNA sample preparation kits (described on the internet sites res.illumina.com/documents/products/datasheets/datasheet_truseq_dna_sample_prep_kits.pdf and res.illumina.com/documents/products/datasheets/datasheet_nextera_dna_sample_prep.pdf) using the methods described by the manufacturer. The resultant libraries are then subjected to pyrosequencing (Siqueira J F et al. J Oral Microbiol. 2012; 4: 10.3402/jom.v4i0.10743). Raw pyrosequencing-generated genomic sequence data are subjected to adaptor- and quality-based trimming for quality control. Whole-genome Shotgun Sequence Assembly (1) is achieved by assembling quality-passed data using the de novo assembler Velvet (2). For gene finding and annotation, reference training data is leveraged from TIGRFAM (9), Pfam, COG (10), and UniRef100 (11). The rRNAs are identified with RNAmmer (5), protein-coding genes are identified with Glimmer (3) or Maker (6), and tRNAs are identified with tRNAscan-SE (4). Gene functions are assigned with blastx (7), blastp (7), HMMER (8), and InterProScan against comprehensive protein databases described above (Reference Data).

Detection of polymorphisms (SNP or other DNA variations occurring as a result of insertions, deletions, and substitutions (Indels)) in the *Methylobacterium* sp. isolates of Table 1 is performed with BWA (12) and the Samtools suite (on the internet at samtools.sourceforge.net/), structural variation is identified with BreakDancer (on the internet at breakdancer.sourceforge.net/) and CoGE (on the internet at genomevolution.org/CoGe/). Polymorphisms diagnostic for *Methylobacterium* that provide for improved lettuce production are identified by comparisons of the sequences of exemplary *Methylobacterium* isolates NLS0020, NLS0066, NLS0017, NLS0065, NLS0089, NLS0042, and/or NLS0068 that improve lettuce production but that are absent from one or more *Methylobacterium* isolates that do not improve lettuce production. Polymorphisms present in exemplary *Methylobacterium* isolates NLS0020, NLS0066, NLS0017, NLS0065, NLS0089, NLS0042, and/or NLS0068 that improve lettuce production but that are absent in exemplary *Methylobacterium* isolates that do not improve lettuce production are then used to identify other *Methylobacterium* isolates that improve lettuce production.

REFERENCES FOR EXAMPLE 4

1. Miller J R, Koren S, Sutton G (2010) Assembly algorithms for next-generation sequencing data. Genomics 95: 315-327.
2. Zerbino D R, Birney E (2008) Velvet: algorithms for de novo short read assembly using de Bruijn graphs. Genome Res 18: 821-829.
3. Delcher A L, Bratke K A, Powers E C, Salzberg S L (2007) Identifying bacterial genes and endosymbiont DNA with Glimmer. Bioinformatics 23: 673-679.
4. Lowe T M, Eddy S R (1997) tRNAscan-SE: a program for improved detection of transfer RNA genes in genomic sequence. Nucleic Acids Res 25: 955-964.
5. Lagesen K, Hallin P, Rodland E A, Staerfeldt H H, Rognes T, et al. (2007) RNAmmer: consistent and rapid annotation of ribosomal RNA genes. Nucleic Acids Res 35: 3100-3108.
6. Cantarel B, Korf I, Robb S, et al. (2008) MAKER: An easy-to-use annotation pipeline designed for emerging model organism genomes. Genome Research 18: 188-196.
7. Altschul S F, Madden T L, Schaffer A A, Zhang J, Zhang Z, et al. (1997) Gapped BLAST and PSI-BLAST: a new generation of protein database search programs. Nucleic Acids Res 25: 3389-3402.
8. Eddy S R (2009) A new generation of homology search tools based on probabilistic inference. Genome Inform 23: 205-211.
9. Haft D H, Selengut J D, White O (2003) The TIGRFAMs database of protein families. Nucleic Acids Res 31: 371-373.
10. Tatusov R L, Fedorova N D, Jackson J D, Jacobs A R, Kiryutin B, et al. (2003) The COG database: an updated version includes eukaryotes. BMC Bioinformatics 4: 41.
11. Suzek B E, Huang H, McGarvey P, Mazumder R, Wu C H (2007) UniRef: comprehensive and non-redundant UniProt reference clusters. Bioinformatics 23: 1282-1288.
12. Li H. and Durbin R. (2009) Fast and accurate short read alignment with Burrows-Wheeler Transform. Bioinformatics, 25:1754-60.

Example 5. Seed Inoculation of 'Flandria' Lettuce with PPFMs Increases Shoot and Root Biomass Seeding A 276 cell sheet of Oasis HORTICUBES® (1-inch Thin-Cut; Smithers-Oasis North America, Kent, Ohio, USA) was placed into a 1020 mesh flat. The flat was divided in half with a piece of plastic to allow for two groups per flat. The Oasis HORTICUBES® were watered to full saturation. Flandria lettuce seed from Rijk Zwaan USA (Salinas, Calif., USA) was used. One seed was placed in each cell for a total of 132 or 144 seeds per group.

Inoculation of Lettuce Seeds

The PPFM strains to be tested were grown as described in Example 1 in a liquid medium supplemented with diatomaceous earth at 2 grams/liter. At the bench, the desired amount of PPFM solution was pipetted into conical tubes (making sure to swirl/shake bottle vigorously before pipetting to suspend particulates). A centrifuge was used to pellet the cells at 7500 RPM for 5 minutes at 23° C. The supernatant was discarded, and the PPFM pellets were resuspended in an equal volume of water.

100 microliters of solution (PPFM solution for treated groups and tap water for control groups) were pipetted onto the top of each seed. The tube was shaken periodically to keep the PPFM cells in suspension. Clear humidity domes were placed over each flat. The flats were placed in a greenhouse with temperature settings of 30° C. during the day, 28° C. at night and with a 16-hour day length attained with using supplemental light as necessary.

Growth

After two to three days after planting, the seeds had germinated, and the humidity domes were removed. The flats were top watered and fertilized with Jack's™ 15-16-17 (JR PETERS, Inc. Allentown, Pa., USA) at every watering. Daily repositioning of the flats was carried out to prevent potential effects on growth due to variations of light conditions in the growth chamber.

Processing

The lettuce seedlings were harvested at 10 days after planting. Each plant was cut directly below the cotyledons and immediately weighed on an analytical balance.

Observations

It was observed that some strains repeatedly showed an increase in shoot biomass of the lettuce seedlings following seed treatment. Visual observations of root mass and development were also made, and it was noted that treated groups showed more growth at the time of harvest. The outside row of each group was not harvested in order to eliminate any edge effects in the flats.

Conclusion

It was apparent that PPFM strains NLS0017, NLS0020, NLS0066 and NLS0068 showed a reproducible and statistically significant increase in the wet weight of lettuce seedlings following seed treatment. Also noted along with an increase in shoot biomass was a corresponding increase in root development.

TABLE 4

Results for Seed inoculation of 'Flandria' Lettuce

| | | seedling wet weight | | | |
|---|---|---|---|---|---|
| Strain | Titer (CFU/mL) | Control (Water) | Experimental (PPFM) | Difference (%) | confidence interval |
| NLS0017 | 1.1E+09 | 103.38 | 152.14 | 47.16% | 0.000 |
| NLS0017 | 1.1E+09 | 90.98 | 174.23 | 91.51% | 0.000 |
| NLS0017 | 1.1E+09 | 45.47 | 80.74 | 77.57% | 0.000 |
| NLS0017 | 1.1E+09 | 101.46 | 174.29 | 71.78% | 0.000 |
| NLS0017 | 1.1E+09 | 265.34 | 296.75 | 11.84% | 0.000 |
| NLS0020 | 1.2E+09 | 103.38 | 123.00 | 18.98% | 0.000 |
| NLS0020 | 1.2E+09 | 90.98 | 174.92 | 92.27% | 0.000 |
| NLS0020 | 1.2E+09 | 45.47 | 72.21 | 58.80% | 0.000 |
| NLS0020 | 1.2E+09 | 41.85 | 62.27 | 48.79% | 0.000 |
| NLS0020 | 1.2E+09 | 195.98 | 232.44 | 18.60% | 0.000 |
| NLS0020 | 1.2E+09 | 89.68 | 121.69 | 35.68% | 0.000 |
| NLS0020 | 1.2E+09 | 136.75 | 171.62 | 25.50% | 0.000 |
| NLS0020 | 1.2E+09 | 69.18 | 141.55 | 104.59% | 0.000 |

TABLE 4-continued

Results for Seed inoculation of 'Flandria' Lettuce

| Strain | Titer (CFU/mL) | Control (Water) | Experimental (PPFM) | Difference (%) | confidence interval |
|---|---|---|---|---|---|
| seedling wet weight | | | | | |
| NLS0020 | 1.2E+09 | 38.38 | 63.65 | 65.84% | 0.000 |
| NLS0020 | 1.2E+09 | 49.53 | 85.78 | 73.18% | 0.000 |
| NLS0037 | not determined | 183.18 | 199.05 | 8.67% | 0.008 |
| NLS0037 | 1.8E+08 | 68.26 | 136.58 | 100.08% | 0.000 |
| NLS0038 | 5.2E+07 | 183.18 | 201.56 | 10.03% | 0.007 |
| NLS0038 | 5.2E+07 | 68.26 | 108.01 | 58.23% | 0.000 |
| NLS0038 | 5.2E+07 | 129.32 | 154.95 | 19.82% | 0.000 |
| NLS0042 | 1.1E+08 | 59.84 | 110.04 | 83.90% | 0.000 |
| NLS0042 | 1.1E+08 | 183.18 | 186.49 | 1.81% | 0.650 |
| NLS0042 | 1.1E+08 | 68.26 | 99.76 | 46.15% | 0.000 |
| NLS0062 | 3.6E+07 | 129.32 | 156.18 | 20.77% | 0.000 |
| NLS0062 | 3.6E+07 | 140.95 | 190.36 | 35.06% | 0.000 |
| NLS0064 | 4.5E+08 | 129.32 | 158.58 | 22.63% | 0.000 |
| NLS0064 | 4.5E+08 | 140.95 | 231.99 | 64.60% | 0.000 |
| NLS0065 | 3.7E+07 | 140.95 | 211.13 | 49.80% | 0.000 |
| NLS0066 | 1.2E+08 | 103.38 | 180.71 | 74.80% | 0.000 |
| NLS0066 | 1.2E+08 | 90.98 | 163.37 | 79.57% | 0.000 |
| NLS0066 | 1.2E+08 | 45.47 | 96.07 | 111.28% | 0.000 |
| NLS0066 | 1.2E+08 | 91.32 | 114.02 | 24.86% | 0.000 |
| NLS0066 | 1.2E+08 | 209.04 | 279.74 | 33.83% | 0.000 |
| NLS0068 | 2.1E+08 | 68.26 | 98.67 | 44.55% | 0.000 |
| NLS0068 | 1.7E+08 | 129.32 | 181.12 | 40.06% | 0.000 |
| NLS0068 | 1.7E+08 | 140.95 | 217.89 | 54.59% | 0.000 |
| NLS0069 | 1.6E+08 | 59.84 | 113.78 | 90.15% | 0.000 |
| NLS0069 | 5.6E+07 | 68.26 | 75.17 | 10.12% | 0.095 |
| NLS0069 | 1.5E+08 | 129.32 | 164.10 | 26.89% | 0.000 |
| NLS0089 | 3.0E+07 | 140.95 | 225.72 | 60.14% | 0.000 |

REFERENCES

1. Abanda-Nkpwatt, D., M. Musch, J. Tschiersch, M. Boettner, and W. Schwab. 2006. Molecular interaction between *Methylobacterium extorquens* and seedlings: growth promotion, methanol consumption, and localization of the methanol emission site. J. Exp. Bot. 57: 4025-4032.
2. Broekaert W F, Terras F R, Cammue B P, Vanderleyden J (1990) An automated quantitative assay for fungal growth inhibition. FEMS Microbiology Letters 69: 55-60.
3. Cao, Y-R, Wang, Q., Jin, R-X., Tang, S-K., He, W-X., Lai, H-X, Xu, L-H., and C-L Jiang. 2011. *Methylobacterium soli* sp. nov. a methanol-utilizing bacterium isolated from the forest soil. Antonie van Leeuwenhoek (2011) 99:629-634.
4. Corpe, W. A., and D. V. Basile. 1982. Methanol-utilizing bacteria associated with green plants. Devel. Industr. Microbiol. 23: 483-493.
5. Corpe, W. A., and S. Rheem. 1989. Ecology of the methylotrophic bacteria on living leaf surfaces. FEMS Microbiol. Ecol. 62: 243-250.
6. Green, P. N. 2005. *Methylobacterium*. In Brenner, D. J., N. R. Krieg, and J. T. Staley (eds.). "Bergey's Manual of Systematic Bacteriology. Volume two, The Proteobacteria. Part C, The alpha-, beta-, delta-, and epsilonproteobacteria." Second edition. Springer, New York. Pages 567-571.
7. Green, P. N. 2006. *Methylobacterium*. In Dworkin, M., S. Falkow, E. Rosenberg, K.-H. Schleifer, and E. Stackebrandt (eds.). "The Prokaryotes. A Handbook on the Biology of Bacteria. Volume 5. Proteobacteria: Alpha and Beta Subclasses." Third edition. Springer, New York. Pages 257-265.
8. Holland, M. A. 1997. *Methylobacterium* and plants. Recent. Res. Devel. in Plant Physiol. 1: 207-213.
9. Holland, M. A., and J. C. Polacco. 1994. PPFMs and other covert contaminants: Is there more to plant physiology than just plant? Annu Rev. Plant Physiol. Plant Mol. Biol. 45: 197-209.
10. Kutschera, U. 2007. Plant-associated methylobacteria as co-evolved phytosymbionts. A hypothesis. Plant Signal Behav. 2: 74-78.
11. Lidstrom, M. E. 2006. Aerobic methylotrophic prokaryotes. In Dworkin, M., S. Falkow, E. Rosenberg, K.-H. Schleifer, and E. Stackebrandt (eds.). "The Prokaryotes. A Handbook on the Biology of Bacteria. Volume 2. Ecophysiology and biochemistry." Third edition. Springer, New York. Pages 618-634.
12. Madhaiyan, M., S. Poonguzhali, H. S. Lee, K. Hari, S. P. Sundaram, and T. M. Sa. 2005. Pink-pigmented facultative methylotrophic bacteria accelerate germination, growth and yield of sugarcane clone Co86032 (*Saccharum officinarum* L.) Biol. Fertil. Soils 41: 350-358.
13. Madhaiyan, M., S. Poonguzhali, M. Senthilkumar, S. Seshadri, H. Chung, J. Yang, S. Sundaram, and T. Sa. 2004. Growth promotion and induction of systemic resistance in rice cultivar C0-47 (*Oryza sativa* L.) by *Methylobacterium* spp. Bot. Bull. Acad. Sin. 45: 315-324.
14. Madhaiyan, M., S. Poonguzhali, and T. Sa. 2007. Influence of plant species and environmental conditions on epiphytic and endophytic pink-pigmented facultative methylotrophic bacterial populations associated with field-grown rice cultivars. J Microbiol Biotechnol. 2007 October; 17(10): 1645-54.
15. Stanier, R. Y., N. J. Palleroni, and M. Doudoroff. 1966. The aerobic pseudomonads: A taxonomic study. J. Gen. Microbiol. 43: 159-271.
16. Sy, A., Giraud, E., Jourand, P., Garcia, N., Willems, A., De Lajudie, P., Prin, Y., Neyra, M., Gillis, M., Boivin-Masson, C., and Dreyfus, B. 2001. Methylotrophic *Methylobacterium* Bacteria Nodulate and Fix Nitrogen in Symbiosis with Legumes. Jour. Bacteriol. 183(1):214-220,
17. Sy, A., A. C. J. Timmers, C. Knief, and J. A. Vorholt. 2005. Methylotrophic metabolism is advantageous for *Methylobacterium extorquens* during colonization of *Medicago truncatula* under competitive conditions. Appl. Environ. Microbiol. 71: 7245-7252.
18. Vogel, H. J., and D. M. Bonner. 1956. Acetylornithinase of *Escherichia coli*: Partial purification and some properties. J. Biol. Chem. 218: 97-106.
19. Vogel, H. J. 1956. A convenient growth medium for *Neurospora* (Medium N). Microbial Genet Bull 13: 42-43
20. Whittenbury, R., S. L. Davies, and J. F. Wilkinson. 1970. Enrichment, isolation and some properties of methane-utilizing bacteria. J. Gen. Microbiol. 61: 205-218.
21. Vuilleumier S, Chistoserdova L, Lee M C, Bringel F, Lajus A, Zhou Y, Gourion B, Barbe V, Chang J, Cruveiller S, Dossat C, Gillett W, Gruffaz C, Haugen E, Hourcade E, Levy R, Mangenot S, Muller E, Nadalig T, Pagni M, Penny C, Peyraud R, Robinson D G, Roche D, Rouy Z, Saenampechek C, Salvignol G, Vallenet D, Wu Z, Marx C J, Vorholt J A, Olson M V, Kaul R, Weissenbach J, Médigue C, Lidstrom M E. *Methylobacterium* genome sequences: a reference blueprint to investigate microbial metabolism of C1 compounds from natural and industrial sources. PLoS One. 2009; 4(5):e5584. doi: 10.1371/journal.pone.0005584. Epub 2009 May 18. PubMed PMID: 19440302; PubMed Central PMCID: PMC2680597.
22. Marx C J, Bringel F, Chistoserdova L, Moulin L, Farhan Ul Haque M, Fleischman D E, Gruffaz C, Jourand P, Knief C, Lee M C, Muller E E, Nadalig T, Peyraud R, Roselli S, Russ L, Goodwin L A, Ivanova N, Kyrpides N, Lajus A, Land M L, Médigue C, Mikhailova N, Nolan M, Woyke T, Stolyar S, Vorholt J A, Vuilleumier S. Complete genome sequences of six strains of the genus *Methylobacterium*. J Bacteriol. 2012 September; 194(17):4746-8. doi: 10.1128/JB.01009-12. PubMed PMID: 22887658; PubMed Central PMCID: PMC3415506.

23. Knief C, Frances L, Vorholt J A. Competitiveness of diverse *Methylobacterium* strains in the phyllosphere of *Arabidopsis thaliana* and identification of representative models, including *M. extorquens* PA1. Microb Ecol. 2010 August; 60(2):440-52. doi: 10.1007/s00248-010-9725-3. Epub 2010 Aug. 11. PubMed PMID: 20700590.

Example 6. Seed Inoculation of 'Rex' Lettuce with PPFMs Increases Shoot and Root Biomass Seeding A 276 cell sheet of Oasis HORTICUBES® (1-inch Thin-Cut; Smithers-Oasis North America, Kent, Ohio, USA) was placed into a 1020 mesh flat. The flat was divided in half with a piece of plastic to allow for two groups per flat. The Oasis HORTICUBES® were watered to full saturation. Rex lettuce seed was used. One seed was placed in each cell for a total of 132 or 144 seeds per group.

Inoculation of Lettuce Seeds

The PPFM strains to be tested were grown as described in Example 1 in a liquid medium supplemented with diatomaceous earth at 2 grams/liter. At the bench, the desired amount of PPFM solution was pipetted into conical tubes (making sure to swirl/shake bottle vigorously before pipetting to suspend particulates). A centrifuge was used to pellet the cells at 7500 RPM for 5 minutes at 23° C. The supernatant was discarded, and the PPFM pellets were resuspended in an equal volume of water.

100 microliters of solution (PPFM solution for treated groups and tap water for control groups) were pipetted onto the top of each seed. The tube was shaken periodically to keep the PPFM cells in suspension. Clear humidity domes were placed over each flat. The flats were placed in a greenhouse with temperature settings of 30° C. during the day, 28° C. at night and with a 16-hour day length attained with using supplemental light as necessary.

Growth

After two to three days after planting, the seeds had germinated, and the humidity domes were removed. The flats were top watered and fertilized with Jack's™ 15-16-17 (JR PETERS, Inc. Allentown, Pa., USA) at every watering. Daily repositioning of the flats was carried out to prevent potential effects on growth due to variations of light conditions in the growth chamber.

Processing

The lettuce seedlings were harvested at 10 days after planting. Each plant was cut directly below the cotyledons and immediately weighed on an analytical balance.

Observations

It was observed that some strains repeatedly showed an increase in shoot biomass of the lettuce seedlings following seed treatment. Visual observations of root mass and development were also made, and it was noted that treated groups showed more growth at the time of harvest. The outside row of each group was not harvested in order to eliminate any edge effects in the flats. The results are as shown in the following Table.

TABLE 5

| Strain | avg % Increase in Shoot Biomass in comparison to control | # of tests |
| --- | --- | --- |
| NLS0062 | 44.00% | 3 |
| NLS0020 | 37.73% | 3 |
| NLS0042 | 33.82% | 4 |
| NLS0046 | 30.86% | 3 |
| NLS0068 | 30.83% | 3 |
| NLS0038 | 29.43% | 3 |
| NLS0089 | 29.16% | 3 |
| NLS0017 | 28.53% | 5 |
| NLS0021 | 28.27% | 3 |
| NLS0037 | 26.02% | 3 |
| NLS0066 | 25.63% | 3 |
| NLS0065 | 23.35% | 3 |
| NLS0064 | 21.88% | 3 |
| NLS0069 | 4.87% | 3 |

Conclusion

It was apparent that PPFM strains NLS0017, NLS0020, NLS21, NLS0037, NLS0038, NLS42, NLS46, NLS62, NLS64, NLS0065, NLS0066, NLS0068, and NLS0089 showed a reproducible and statistically significant increase in the wet weight of lettuce seedlings following seed treatment. Also noted along with an increase in shoot biomass was a corresponding increase in root development.

Example 7. Flandria Seed Tests

Flandria lettuce seed were treated with the indicated PPFM isolates essentially as described in Example 5 to yield the following results.

TABLE 6

| strain | wet weight (mg) | | difference | CI |
| --- | --- | --- | --- | --- |
| | control | experimental | | |
| NLS0017 | 103.38 | 152.14 | 47.16% | 0.000 |
| NLS0017 | 90.98 | 174.23 | 91.51% | 0.000 |
| NLS0017 | 45.47 | 80.74 | 77.57% | 0.000 |
| NLS0017 | 101.46 | 174.29 | 71.78% | 0.000 |
| NLS0017 | 265.34 | 296.75 | 11.84% | 0.000 |
| NLS0017 | 99.82 | 163.01 | 63.30% | 0.000 |
| NLS0020 | 103.38 | 123.00 | 18.98% | 0.000 |
| NLS0020 | 90.98 | 174.92 | 92.27% | 0.000 |
| NLS0020 | 45.47 | 72.21 | 58.80% | 0.000 |
| NLS0020 | 41.85 | 62.27 | 48.79% | 0.000 |
| NLS0020 | 195.98 | 232.44 | 18.60% | 0.000 |
| NLS0020 | 89.68 | 121.69 | 35.68% | 0.000 |
| NLS0020 | 136.75 | 171.62 | 25.50% | 0.000 |
| NLS0020 | 69.18 | 141.55 | 104.59% | 0.000 |
| NLS0020 | 38.38 | 63.65 | 65.84% | 0.000 |
| NLS0020 | 49.53 | 85.78 | 73.18% | 0.000 |
| NLS0037 | 59.84 | 109.56 | 83.10% | 0.000 |
| NLS0037 | 183.18 | 199.05 | 8.67% | 0.008 |
| NLS0037 | 68.26 | 136.58 | 100.08% | 0.000 |
| NLS0037 | 97.72 | 156.97 | 60.63% | 0.000 |
| NLS0037 | 91.74 | 130.58 | 42.34% | 0.000 |
| NLS0037 | 99.08 | 108.96 | 9.97% | 0.030 |
| NLS0037 | 61.72 | 120.61 | 95.41% | 0.000 |
| NLS0042 | 59.84 | 110.04 | 83.90% | 0.000 |
| NLS0042 | 183.18 | 184.47 | 0.70% | 0.650 |
| NLS0042 | 68.26 | 99.76 | 46.15% | 0.000 |
| NLS0042 | 61.72 | 109.42 | 77.28% | 0.000 |
| NLS0065 | 140.95 | 211.13 | 49.80% | 0.000 |
| NLS0065 | 61.72 | 109.38 | 77.22% | 0.000 |
| NLS0065 | 86.75 | 154.51 | 78.11% | 0.000 |
| NLS0065 | 97.67 | 99.42 | 1.79% | 0.691 |
| NLS0066 | 103.38 | 180.71 | 74.80% | 0.000 |

TABLE 6-continued

| strain | wet weight (mg) | | | |
|---|---|---|---|---|
| | control | experimental | difference | CI |
| NLS0066 | 90.98 | 163.37 | 79.57% | 0.000 |
| NLS0066 | 45.47 | 96.07 | 111.28% | 0.000 |
| NLS0066 | 91.32 | 114.02 | 24.86% | 0.000 |
| NLS0066 | 209.04 | 279.74 | 33.83% | 0.000 |
| NLS0066 | 99.82 | 101.20 | 1.38% | 0.920 |
| NLS0135 | 223.15 | 227.21 | 1.82% | 0.588 |
| NLS0135 | 90.94 | 111.89 | 23% | 0.000 |
| NLS0135 | 145.2 | 118.14 | −19% | 0.000 |
| NLS0071 | 223.15 | 220.13 | −1.35% | 0.716 |
| NLS0071 | 90.94 | 107.2 | 18% | 0.000 |
| NLS0071 | 145.2 | 129.62 | −11% | 0.002 |
| NLS0109 | 223.15 | 215.45 | −3.45% | 0.316 |
| NLS0109 | 90.94 | 109.91 | 21% | 0.000 |
| NLS0109 | 145.2 | 126.9 | −13% | 0.001 |
| NLS0142 | 223.15 | 197.98 | −11.28% | 0.002 |
| NLS0142 | 90.94 | 94.89 | 4% | 0.324 |
| NLS0142 | 145.2 | 121.09 | −17% | 0.000 |

It was evident that the PPFM strains NLS0017, NLS0037, NLS0066, NLS0020, NLS0042, NLS0065, NLS0089, NLS0046, NLS0021. NLS0069, NLS0068, NLS0064, NLS0062, and NLS0038 could provide for increased lettuce biomass relative to control treatments.

Example 8. Identification of Orthologous Genes Present in *Methylobacterium* sp. that can Improve Lettuce Production The PPFM strains listed in Table 1 were grown on solid agar media comprising Ammonium Mineral Salts (AMS) plus glycerol and peptone at 30° C. for 5 days, essentially as described in co-assigned U.S. Patent Application Publication No. US20130324407 and incorporated herein by reference in its entirety. Genomic DNA was extracted using MO-BIO (Carlsbad, Calif.) Ultra Clean Microbial DNA Isolation kit, and 1 µg of high quality DNA was used for Illumina Nextera XT library preparation followed by Illumina 2×100 paired-end sequencing on a HiSeq2000 system. Raw Illumina genomic sequence data were subjected to adaptor- and quality-based trimming for quality control. Whole-genome Shotgun Sequence Assembly was achieved by assembling quality-passed data using the de novo assembler SPADES (33). For gene finding and annotation, reference training data was leveraged from TIGRFAM (9), Pfam, COG (10), and UniRef100 (11). The rRNAs were identified with RNAmmer (5), protein-coding genes were identified with Glimmer (3) and Maker (6), and tRNAs were identified with tRNAscan-SE (4). Gene functions were assigned with blastx (7), blastp (7), HMMER (8), and InterProScan against comprehensive protein databases described above (Reference Data). Detection of polymorphisms (SNP or other DNA variations occurring as a result of insertions, deletions, and substitutions (Indels)) in the *Methylobacterium* sp. isolates was performed with BWA (12) and the Samtools suite (on the internet at samtools.sourceforge.net/) and the Genome Analysis Toolkit (GATK, on the world wide web internet site "broadinstitute.org/gatk/"), structural variation was identified with BreakDancer (on the internet at breakdancer.sourceforge.net/) and CoGE (on the internet at genomevolution.org/CoGe/).

Genes that encoded open reading frames were predicted from the assembled whole genomic sequences of NLS0017, NLS0020, NLS0037, NLS0042, NLS0065, NLS0066, NLS0135, NLS0071, NLS0109, and NLS0142 essentially as described above. Within and between genome orthologous genes were clustered using OrthoMCL (available on the world wide web internet site "orthomcl.org/orthomcl/"). Putative functional annotations were assigned to gene products using BLASTP (available on the internet site "blast.ncbi.nlm.nih.gov/Blast.cgi") against the UniProt database (available on the world wide web internet site "uniprot.org/"). Genes present in individual genomes of NLS0017, NLS0020, NLS0037, NLS0042, NLS0065, and NLS0066 that could improve lettuce production (as shown in Example 7) but absent in the whole set of genomes of NLS0135, NLS0071, NLS0109, and NLS0142 that did not improve lettuce production (as shown in Example 7) were identified in OrthoMCL clusters using custom software. The encoded proteins found in the *Methylobacterium* NLS0017, NLS0020, NLS0037, NLS0042, NLS0065, and NLS0066 that could improve lettuce production are provided in the sequencing listing as SEQ ID NO: 1-5125. The nucleic acid sequences that encode the proteins of SEQ ID NO: 1-5125 are SEQ ID NO: 5126-10250, respectively. The proteins encoded by genes present in NLS0017 but absent from NLS0135, NLS0071, NLS0109, and NLS0142 are provided as SEQ ID NO: 1-1086. The proteins encoded by genes present in NLS0020 but absent from NLS0135, NLS0071, NLS0109, and NLS0142 are provided as SEQ ID NO: 1087-2176. The proteins encoded by genes present in NLS0037 but absent from NLS0135, NLS0071, NLS0109, and NLS0142 are provided as SEQ ID NO: 2177-2461. The proteins encoded by genes present in NLS0042 but absent from NLS0135, NLS0071, NLS0109, and NLS0142 are provided as SEQ ID NO: 2462-3347. The proteins encoded by genes present in NLS0065 but absent from NLS0135, NLS0071, NLS0109, and NLS0142 are provided as SEQ ID NO: 3348-3949. The proteins encoded by genes present in NLS0066 but absent from NLS0135, NLS0071, NLS0109, and NLS0142 are provided as SEQ ID NO: 3950-5125. Orthologous gene groups representing genes encoding proteins found in the genomes of at least two individual genomes of NLS0017, NLS0020, NLS0037, NLS0042, NLS0065, and/or NLS0066 that could improve lettuce production (as shown in Example 7) but that are absent in the whole set of genomes of NLS0135, NLS0071, NLS0109, and NLS0142 that did not improve lettuce production are provided in Table 7. In Table 7, groups of orthologous genes are provided in each row, where the longest sequence and associated unique Seq ID Number are designated as a reference sequence to represent the ortholog cluster (Column 3 of Table 7). The ortholog group identification number is provided in column 1 of Table 7, the closest gene identity based on database comparisons is provided in column 2 of Table 7, and the reference sequence for each ortholog cluster is provided in column 3 of Table 7. Examples of ortholog sequences found in NLS0017, NLS0020, NLS0037, NLS0042, NLS0065, and NLS0066 are provided as SEQ ID NO: in Table 7, columns 4, 5, 6, 7, 8, and 9, respectively.

TABLE 7

Orthologous Gene Groups

| Unique Ortholog Group Identifier | Annotation | Reference. Ortholog SEQ ID NO: | NLS0017 Ortholog SEQ ID NO: | NLS0020 Ortholog SEQ ID NO: | NLS0037 Ortholog SEQ ID NO: | NLS0042 Ortholog SEQ ID NO: | NLS0065 Ortholog SEQ ID NO: | NLS0066 Ortholog SEQ ID NO: |
|---|---|---|---|---|---|---|---|---|
| 4678v20141116 | hypothetical protein Mpop_4447 | 2467 | 8 | 1091 | NA | 2467 | 3352 | 3954 |
| 4682v20141116 | hypothetical protein Mchl_0132 | 2468 | 9 | 1092 | NA | 2468 | 3353 | 3955 |
| 4747v20141116 | histidine kinase | 3357 | 11 | 1093 | NA | 2472 | 3357 | 3959 |
| 4748v20141116 | transcriptional regulator | 1094 | 12 | 1094 | NA | 2473 | 3358 | 3960 |
| 4749v20141116 | histidine kinase | 13 | 13 | 1095 | NA | 2474 | 3359 | 3961 |
| 4809v20141116 | saccharopine dehydrogenase | 14 | 14 | 1097 | NA | 2481 | 3365 | 3966 |
| 4837v20141116 | ABC transporter-like protein | 1100 | 17 | 1100 | 2179 | 2484 | 3367 | NA |
| 4841v20141116 | hypothetical protein Mpop_0734 | 3968 | 19 | 1102 | NA | 2486 | 3368 | 3968 |
| 4904v20141116 | HlyD family type I secretion membrane fusion protein | 3370 | 22 | 1103 | NA | 2491 | 3370 | 3972 |
| 4905v20141116 | Transcriptional regulator XRE family | 23 | 23 | 1104 | NA | 2492 | 3371 | 3973 |
| 4942v20141116 | type I secretion system ATPase | 1106 | 25 | 1106 | NA | 2494 | 3373 | 3974 |
| 3799v20141116 | hypothetical protein | 3950 | 1 | 1088 | NA | 2462 | NA | 3950 |
| 4369v20141116 | hypothetical protein METDI0048 | 3952 | 6 | 1090 | 2177 | NA | NA | 3952 |
| 4454v20141116 | FAD-dependent pyridine nucleotide-disulfide oxidoreductase | 2463 | 7 | NA | 2178 | 2463 | 3348 | NA |
| 4740v20141116 | arsenite efflux pump ACR3 | 2471 | 10 | NA | NA | 2471 | 3356 | 3958 |
| 4926v20141116 | LysR family transcriptional regulator | 3372 | 24 | 1105 | NA | 2493 | 3372 | NA |
| 4948v20141116 | hypothetical protein Mchl_1383 | 2180 | 26 | NA | 2180 | 2495 | 3374 | NA |
| 5012v20141116 | COG3293: Transposase and inactivated derivatives | 27 | 27 | 1107 | NA | 2500 | 3377 | NA |
| 5041v20141116 | hypothetical protein | 28 | 28 | 1108 | NA | 2502 | 3378 | NA |
| 5096v20141116 | hypothetical protein | 30 | 30 | 1109 | NA | 2504 | 3380 | NA |
| 5122v20141116 | hypothetical protein Mchl_3038 | 2510 | 31 | 1110 | NA | 2510 | 3385 | NA |
| 5202v20141116 | hypothetical protein Mext_4122 | 2515 | 33 | 1113 | NA | 2515 | 3387 | NA |
| 5212v20141116 | hypothetical protein | 1114 | 35 | 1114 | NA | 2516 | 3388 | NA |
| 5238v20141116 | OmpA/MotB domain-containing protein | 3987 | 36 | 1115 | NA | NA | 3392 | 3987 |
| 5246v20141116 | multidrug transporter MatE | 1116 | 37 | 1116 | 2182 | 2521 | NA | NA |
| 5258v20141116 | hypothetical protein | 1117 | 38 | 1117 | NA | 2522 | 3393 | NA |
| 5263v20141116 | porin | 3394 | 39 | 1118 | NA | 2523 | 3394 | NA |
| 5363v20141116 | hypothetical protein | 40 | 40 | 1119 | NA | 2533 | 3401 | NA |
| 5374v20141116 | cytochrome P450 | 1120 | 41 | 1120 | NA | 2534 | NA | 3992 |
| 5433v20141116 | peptidase C14 | 3996 | 42 | 1121 | NA | NA | 3412 | 3996 |
| 5434v20141116 | hypothetical protein | 43 | 43 | 1122 | NA | NA | 3413 | 3997 |
| 5497v20141116 | ATPase | 44 | 44 | NA | NA | 2561 | 3425 | 4003 |
| 5506v20141116 | hypothetical protein | 4004 | 45 | 1123 | NA | NA | 3426 | 4004 |
| 5507v20141116 | hypothetical protein | 3427 | 46 | 1124 | NA | NA | 3427 | 4005 |
| 5508v20141116 | hypothetical protein Mpop_0725 | 4006 | 47 | 1125 | NA | NA | 3428 | 4006 |
| 5509v20141116 | hypothetical protein | 3429 | 48 | 1126 | NA | NA | 3429 | 4007 |
| 5510v20141116 | hypothetical protein | 3430 | 49 | 1127 | NA | NA | 3430 | 4008 |
| 5585v20141116 | hypothetical protein Mpop_0722 | 51 | 51 | 1128 | NA | NA | 3443 | 4012 |
| 5586v20141116 | hypothetical protein Mpop_0723 | 52 | 52 | 1129 | NA | NA | 3444 | 4013 |
| 5790v20141116 | hypothetical protein | 57 | 57 | 1134 | NA | 2619 | 3476 | NA |
| 5984v20141116 | Penicillin-binding protein | 2676 | 60 | 1136 | NA | 2676 | 3502 | NA |
| 6022v20141116 | plasmid stabilization protein ParE | 2190 | NA | 1139 | 2190 | 2680 | NA | 4021 |
| 6819v20141116 | short-chain dehydrogenase | 76 | 76 | 1155 | 2201 | NA | 3542 | NA |

TABLE 7-continued

Orthologous Gene Groups

| Unique Ortholog Group Identifier | Annotation | Reference. Ortholog SEQ ID NO: | NLS0017 Ortholog SEQ ID NO: | NLS0020 Ortholog SEQ ID NO: | NLS0037 Ortholog SEQ ID NO: | NLS0042 Ortholog SEQ ID NO: | NLS0065 Ortholog SEQ ID NO: | NLS0066 Ortholog SEQ ID NO: |
|---|---|---|---|---|---|---|---|---|
| 7006v20141116 | binding-protein-dependent transport system inner membrane protein | 4067 | 84 | 1163 | NA | 2796 | NA | 4067 |
| 7040v20141116 | hypothetical protein | 85 | 85 | 1164 | NA | 2799 | NA | 4069 |
| 7299v20141116 | glycosyltransferase family 2 | 1180 | 105 | 1180 | 2206 | NA | NA | 4087 |
| 7707v20141116 | metal-dependent phosphohydrolase | 127 | 127 | 1203 | 2214 | NA | NA | 4111 |
| 8313v20141116 | GDP-L-fucose synthase | 197 | 197 | 1264 | 2237 | NA | NA | 4171 |
| 8314v20141116 | NAD-dependent epimerase/dehydratase | 198 | 198 | 1265 | 2238 | NA | NA | 4172 |
| 8315v20141116 | NAD-dependent epimerase/dehydratase | 199 | 199 | 1266 | 2239 | NA | NA | 4173 |
| 8898v20141116 | Transcriptional regulator LysR family | 2971 | 250 | 1309 | 2263 | 2971 | NA | NA |
| 4353v20141116 | transposase partial | 5 | 5 | 1089 | NA | NA | NA | 3951 |
| 4597v20141116 | peroxiredoxin | 2464 | NA | NA | NA | 2464 | 3350 | 3953 |
| 4733v20141116 | acyl-CoA dehydrogenase type 2 domain | 3956 | NA | NA | NA | 2469 | 3354 | 3956 |
| 4734v20141116 | ABC transporter | 3355 | NA | NA | NA | 2470 | 3355 | 3957 |
| 4782v20141116 | ABC transporter inner membrane protein | 2475 | NA | NA | NA | 2475 | 3360 | 3962 |
| 4783v20141116 | twin-arginine translocation pathway signal | 2476 | NA | NA | NA | 2476 | 3361 | 3963 |
| 4792v20141116 | COG3293: Transposase and inactivated derivatives | 1096 | NA | 1096 | NA | 2477 | 3362 | NA |
| 4797v20141116 | hypothetical protein METDI2339 | 3364 | NA | NA | NA | 2480 | 3364 | 3964 |
| 4829v20141116 | diguanylate cyclase | 3366 | NA | NA | NA | 2482 | 3366 | 3967 |
| 4831v20141116 | hypothetical protein | 16 | 16 | 1098 | NA | 2483 | NA | NA |
| 4839v20141116 | hypothetical protein | 2485 | 18 | 1101 | NA | 2485 | NA | NA |
| 4901v20141116 | OmpW family protein | 3971 | NA | NA | NA | 2490 | 3369 | 3971 |
| 5103v20141116 | hypothetical protein METDI2906 | 3381 | NA | NA | NA | 2506 | 3381 | 3977 |
| 5118v20141116 | aminoglycoside phosphotransferase | 2508 | NA | NA | NA | 2508 | 3383 | 3978 |
| 5144v20141116 | hypothetical protein | 1111 | NA | 1111 | 2181 | NA | NA | 3980 |
| 5183v20141116 | ABC transporter | 2513 | 32 | 1112 | NA | 2513 | NA | NA |
| 5217v20141116 | hemolysin | 2517 | NA | NA | NA | 2517 | 3389 | 3985 |
| 5283v20141116 | BadM/Rrf2 family transcriptional regulator | 3988 | NA | NA | NA | 2525 | 3396 | 3988 |
| 5391v20141116 | 5'-nucleotidase | 2543 | NA | NA | NA | 2543 | 3407 | 3994 |
| 5420v20141116 | virulence-associated protein D | 3411 | NA | NA | NA | 2547 | 3411 | 3995 |
| 5471v20141116 | hypothetical protein Mpop__1169 | 3416 | NA | NA | NA | 2550 | 3416 | 3998 |
| 5473v20141116 | hypothetical protein Mpop__3884 | 2551 | NA | NA | NA | 2551 | 3417 | 3999 |
| 5487v20141116 | hypothetical protein | 2558 | NA | NA | NA | 2558 | 3422 | 4002 |
| 5513v20141116 | hypothetical protein Mext__2210 | 3431 | 50 | NA | NA | 2563 | 3431 | NA |
| 5566v20141116 | hypothetical protein METDI0649 | 4010 | NA | NA | NA | 2572 | 3439 | 4010 |
| 5669v20141116 | hypothetical protein | 53 | 53 | 1130 | NA | NA | 3458 | NA |
| 5675v20141116 | GreA/GreB family elongation factor | 54 | 54 | 1131 | NA | NA | 3460 | NA |
| 5683v20141116 | RND family efflux transporter MFP subunit | 2590 | NA | NA | 2183 | 2590 | 3462 | NA |
| 5728v20141116 | permease of ABC transporter | 2603 | NA | NA | 2184 | 2603 | NA | 4016 |
| 5782v20141116 | hypothetical protein METDI1995 | 2617 | 56 | NA | NA | 2617 | 3474 | NA |
| 5850v20141116 | hypothetical protein | 4018 | NA | NA | NA | 2631 | 3485 | 4018 |
| 5911v20141116 | hypothetical protein MexAM1_META1p1120 | 2647 | NA | NA | NA | 2647 | 3497 | 4019 |

TABLE 7-continued

Orthologous Gene Groups

| Unique Ortholog Group Identifier | Annotation | Reference. Ortholog SEQ ID NO: | NLS0017 Ortholog SEQ ID NO: | NLS0020 Ortholog SEQ ID NO: | NLS0037 Ortholog SEQ ID NO: | NLS0042 Ortholog SEQ ID NO: | NLS0065 Ortholog SEQ ID NO: | NLS0066 Ortholog SEQ ID NO: |
|---|---|---|---|---|---|---|---|---|
| 5989v20141116 | hypothetical protein | 61 | 61 | 1137 | NA | 2677 | NA | NA |
| 6009v20141116 | TetR family transcriptional regulator | 1138 | 62 | 1138 | NA | 2679 | NA | NA |
| 6028v20141116 | UDP-glucose 6-dehydrogenase | 63 | 63 | 1140 | NA | NA | 3504 | NA |
| 6091v20141116 | DNA topoisomerase III | 64 | 64 | 1141 | NA | NA | NA | 4024 |
| 6093v20141116 | Fe—S type tartrate/fumarate subfamily hydro-lyase subunit alpha | 65 | 65 | 1142 | NA | NA | NA | 4025 |
| 6183v20141116 | PAS/PAC sensor hybrid histidine kinase | 2697 | NA | NA | NA | 2697 | 3513 | 4028 |
| 6196v20141116 | hypothetical protein | 67 | 67 | NA | 2191 | 2700 | NA | NA |
| 6235v20141116 | hypothetical protein | 1144 | 70 | 1144 | NA | NA | NA | 4031 |
| 6301v20141116 | hypothetical protein Mchl_1527 | 2709 | NA | NA | NA | 2709 | 3517 | 4032 |
| 6437v20141116 | Sel1 domain-containing protein | 3521 | 72 | 1146 | NA | NA | 3521 | NA |
| 6442v20141116 | fumarate hydratase | 2724 | 73 | 1147 | NA | 2724 | NA | NA |
| 6618v20141116 | hypothetical protein Mpop_4203 | 2745 | NA | NA | 2199 | 2745 | NA | 4045 |
| 6687v20141116 | peptide ABC transporter substrate-binding protein | 75 | 75 | 1152 | NA | NA | 3534 | NA |
| 6785v20141116 | hydrolase alpha/beta hydrolase fold family protein | 2763 | NA | NA | NA | 2763 | 3540 | 4052 |
| 6823v20141116 | thioesterase superfamily protein | 77 | 77 | 1157 | NA | NA | 3543 | NA |
| 7042v20141116 | arginine ABC transporter ATP-binding protein | 86 | 86 | 1165 | NA | NA | NA | 4070 |
| 7043v20141116 | glyoxalase/bleomycin resistance protein/dioxygenase | 2800 | 87 | 1166 | NA | 2800 | NA | NA |
| 7048v20141116 | glyoxalase | 89 | 89 | 1167 | NA | NA | NA | 4071 |
| 7189v20141116 | hypothetical protein VOLCADRAFT_119358 | 1172 | 97 | 1172 | NA | NA | NA | 4077 |
| 7290v20141116 | succinate dehydrogenase and fumarate reductase iron-sulfur protein | 4080 | 98 | 1173 | NA | NA | NA | 4080 |
| 7291v20141116 | succinate dehydrogenase membrane anchor | 99 | 99 | 1174 | NA | NA | NA | 4081 |
| 7292v20141116 | succinate dehydrogenase cytochrome b subunit | 100 | 100 | 1175 | NA | NA | NA | 4082 |
| 7293v20141116 | L(+)-tartrate or fumarate dehydratase subunit beta | 101 | 101 | 1176 | NA | NA | NA | 4083 |
| 7294v20141116 | fumarate reductase | 102 | 102 | 1177 | NA | NA | NA | 4084 |
| 7295v20141116 | YCII-like protein | 103 | 103 | 1178 | NA | NA | NA | 4085 |
| 7297v20141116 | TRAP-type transport system periplasmic component-like protein | 104 | 104 | 1179 | NA | NA | NA | 4086 |
| 7310v20141116 | ABC transporter substrate-binding protein | 4088 | 106 | 1183 | NA | NA | NA | 4088 |
| 7311v20141116 | glutathione ABC transporter permease GsiD | 107 | 107 | 1184 | NA | NA | NA | 4089 |
| 7312v20141116 | oligopeptide/dipeptide ABC transporter ATPase | 1185 | 108 | 1185 | NA | NA | NA | 4090 |
| 7313v20141116 | ABC transporter-like protein | 109 | 109 | 1186 | NA | NA | NA | 4091 |
| 7338v20141116 | acyl-CoA dehydrogenase domain-containing protein | 113 | 113 | 1188 | 2208 | NA | NA | NA |

TABLE 7-continued

Orthologous Gene Groups

| Unique Ortholog Group Identifier | Annotation | Reference. Ortholog SEQ ID NO: | NLS0017 Ortholog SEQ ID NO: | NLS0020 Ortholog SEQ ID NO: | NLS0037 Ortholog SEQ ID NO: | NLS0042 Ortholog SEQ ID NO: | NLS0065 Ortholog SEQ ID NO: | NLS0066 Ortholog SEQ ID NO: |
|---|---|---|---|---|---|---|---|---|
| 7341v20141116 | hypothetical protein M446_1279 | 4094 | 114 | 1189 | NA | NA | NA | 4094 |
| 7508v20141116 | hypothetical protein | 2856 | NA | 1193 | NA | 2856 | NA | 4104 |
| 7536v20141116 | FAD-binding monooxygenase | 121 | 121 | 1194 | NA | NA | 3583 | NA |
| 7711v20141116 | 2-hydroxyacid dehydrogenase | 4112 | 128 | 1204 | NA | NA | NA | 4112 |
| 7729v20141116 | amino acid ABC transporter | 4113 | 130 | 1206 | NA | NA | NA | 4113 |
| 7730v20141116 | GntR family transcriptional regulator | 131 | 131 | 1207 | NA | NA | NA | 4114 |
| 7750v20141116 | alpha-amylase | 135 | 135 | 1209 | NA | NA | NA | 4115 |
| 7844v20141116 | hypothetical protein | 139 | 139 | 1214 | NA | 2890 | NA | NA |
| 7845v20141116 | FAD-dependent oxidoreductase | 2216 | 140 | 1215 | 2216 | NA | NA | NA |
| 7868v20141116 | hypothetical protein | 143 | 143 | 1217 | NA | NA | NA | 4126 |
| 7877v20141116 | hypothetical protein Mchl_0532 | 4127 | 145 | 1220 | NA | NA | NA | 4127 |
| 7885v20141116 | binding-protein-dependent transport system inner membrane protein | 146 | 146 | 1221 | NA | NA | NA | 4128 |
| 7890v20141116 | taurine ABC transporter permease | 1223 | 148 | 1223 | NA | NA | NA | 4129 |
| 7907v20141116 | regulator | 3602 | 151 | 1225 | NA | NA | 3602 | NA |
| 7912v20141116 | Asp/Glu/hydantoin racemase | 1226 | 153 | 1226 | 2218 | NA | NA | NA |
| 7913v20141116 | D-lactate dehydrogenase | 154 | 154 | 1227 | NA | NA | NA | 4130 |
| 8031v20141116 | hypothetical protein | 155 | 155 | 1231 | 2221 | NA | NA | NA |
| 8053v20141116 | acetyltransferase | 158 | 158 | 1234 | NA | NA | NA | 4143 |
| 8056v20141116 | amidohydrolase | 159 | 159 | 1235 | 2222 | NA | NA | NA |
| 8057v20141116 | ABC transporter | 160 | 160 | 1236 | 2223 | NA | NA | NA |
| 8058v20141116 | ABC transporter permease | 161 | 161 | 1237 | 2224 | NA | NA | NA |
| 8059v20141116 | putative ABC transporter periplasmic substrate-binding protein | 162 | 162 | 1238 | 2225 | NA | NA | NA |
| 8080v20141116 | hypothetical protein | 163 | 163 | 1239 | NA | NA | NA | 4145 |
| 8083v20141116 | N-ethylammeline chlorohydrolase | 164 | 164 | 1240 | 2226 | NA | NA | NA |
| 8084v20141116 | hydantoin racemase | 165 | 165 | 1241 | 2227 | NA | NA | NA |
| 8095v20141116 | glucose-methanol-choline oxidoreductase | 2228 | 169 | 1242 | 2228 | NA | NA | NA |
| 8099v20141116 | Asp/Glu/hydantoin racemase | 2229 | 172 | 1244 | 2229 | NA | NA | NA |
| 8114v20141116 | polysaccharide deacetylase | 175 | 175 | 1245 | NA | NA | NA | 4150 |
| 8273v20141116 | ABC transporter permease | 2234 | 186 | 1255 | 2234 | NA | NA | NA |
| 8289v20141116 | hypothetical protein | 2235 | 188 | 1257 | 2235 | NA | NA | NA |
| 8300v20141116 | Holliday junction DNA helicase RuvB | 191 | 191 | 1259 | NA | NA | NA | 4168 |
| 8303v20141116 | amidase | 1260 | 193 | 1260 | 2236 | NA | NA | NA |
| 8310v20141116 | monooxygenase | 195 | 195 | 1262 | NA | NA | NA | 4170 |
| 8318v20141116 | hypothetical protein | 200 | 200 | 1267 | NA | NA | NA | 4174 |
| 8331v20141116 | hypothetical protein | 202 | 202 | 1268 | NA | NA | NA | 4175 |
| 8335v20141116 | hypothetical protein | 4176 | 205 | 1271 | NA | NA | NA | 4176 |
| 8475v20141116 | hypothetical protein | 210 | 210 | 1276 | 2249 | NA | NA | NA |
| 8524v20141116 | oxidoreductase | 215 | 215 | 1280 | NA | NA | NA | 4190 |
| 8538v20141116 | dehydrogenase | 218 | 218 | 1283 | 2250 | NA | NA | NA |
| 8539v20141116 | AraC family transcriptional regulator | 2251 | 219 | 1284 | 2251 | NA | NA | NA |
| 8573v20141116 | alkanal monooxygenase | 221 | 221 | 1286 | NA | NA | NA | 4191 |
| 8579v20141116 | hypothetical protein | 223 | 223 | 1287 | NA | NA | NA | 4192 |
| 8592v20141116 | hydroxymethylglutaryl-CoA lyase | 226 | 226 | 1289 | 2255 | NA | NA | NA |
| 8593v20141116 | hypothetical protein | 3631 | 227 | 1290 | NA | NA | 3631 | NA |
| 8599v20141116 | hypothetical protein | 2939 | 229 | 1292 | NA | 2939 | NA | NA |

TABLE 7-continued

Orthologous Gene Groups

| Unique Ortholog Group Identifier | Annotation | Reference. Ortholog SEQ ID NO: | NLS0017 Ortholog SEQ ID NO: | NLS0020 Ortholog SEQ ID NO: | NLS0037 Ortholog SEQ ID NO: | NLS0042 Ortholog SEQ ID NO: | NLS0065 Ortholog SEQ ID NO: | NLS0066 Ortholog SEQ ID NO: |
|---|---|---|---|---|---|---|---|---|
| 8603v20141116 | GntR family transcriptional regulator | 232 | 232 | 1294 | 2256 | NA | NA | NA |
| 8642v20141116 | binding-protein-dependent transport system inner membrane protein | 235 | 235 | 1297 | 2257 | NA | NA | NA |
| 8643v20141116 | ABC transporter permease | 2258 | 236 | 1298 | 2258 | NA | NA | NA |
| 8644v20141116 | ABC transporter substrate-binding protein | 237 | 237 | 1299 | 2259 | NA | NA | NA |
| 8867v20141116 | hypothetical protein | 244 | 244 | 1305 | NA | 2969 | NA | NA |
| 8906v20141116 | methylcrotonoyl-CoA carboxylase | 254 | 254 | 1312 | 2265 | NA | NA | NA |
| 8907v20141116 | TetR family transcriptional regulator | 2266 | 255 | 1313 | 2266 | NA | NA | NA |
| 8922v20141116 | response regulator receiver protein | 4206 | 257 | 1315 | NA | NA | NA | 4206 |
| 8932v20141116 | transthyretin | 266 | 266 | 1319 | 2267 | NA | NA | NA |
| 8957v20141116 | hypothetical protein | 274 | 274 | 1327 | NA | NA | 3647 | NA |
| 9274v20141116 | hypothetical protein Mrad2831_4275 | 2278 | 291 | 1350 | 2278 | NA | NA | NA |
| 9275v20141116 | 3-methylcrotonyl-CoA carboxylase subunit alpha | 2279 | 292 | 1351 | 2279 | NA | NA | NA |
| 9277v20141116 | transposase | 293 | 293 | 1352 | NA | NA | NA | 4244 |
| 9280v20141116 | glycosyltransferase | 2990 | 295 | 1354 | NA | 2990 | NA | NA |
| 9320v20141116 | hydrolase | 314 | 314 | 1365 | 2283 | NA | NA | NA |
| 9324v20141116 | hypothetical protein | 316 | 316 | 1367 | NA | NA | 3664 | NA |
| 9342v20141116 | hypothetical protein | 2284 | NA | 1372 | 2284 | NA | 3665 | NA |
| 9755v20141116 | hypothetical protein | 362 | 362 | 1419 | 2290 | NA | NA | NA |
| 9774v20141116 | ATPase | 1424 | 374 | 1424 | NA | NA | 3678 | NA |
| 9781v20141116 | UDP-glucosyltransferase | 2292 | 376 | 1426 | 2292 | NA | NA | NA |
| 10245v20141116 | acetolactate synthase | 393 | 393 | 1448 | 2303 | NA | NA | NA |
| 10246v20141116 | GntR family transcriptional regulator | 2304 | 394 | 1449 | 2304 | NA | NA | NA |
| 10263v20141116 | hypothetical protein | 409 | 409 | 1463 | 2305 | NA | NA | NA |
| 10329v20141116 | fatty acid--CoA ligase | 456 | 456 | 1507 | 2309 | NA | NA | NA |
| 10348v20141116 | None | 469 | 469 | 1517 | NA | NA | 3694 | NA |
| 11120v20141116 | hypothetical protein | 577 | 577 | 1629 | 2319 | NA | NA | NA |
| 15411v20141116 | NAD-binding 6-phosphogluconate dehydrogenase | 925 | 925 | 2062 | 2369 | NA | NA | NA |
| 4672v20141116 | heme peroxidase with hemolysin-type calcium-binding domain | 3351 | NA | NA | NA | 2466 | 3351 | NA |
| 4897v20141116 | elongation factor Tu | 2489 | NA | NA | NA | 2489 | NA | 3970 |
| 5002v20141116 | thiol-disulfide oxidoreductase | 2498 | NA | NA | NA | 2498 | 3375 | NA |
| 5040v20141116 | AraC family transcriptional regulator | 2501 | NA | NA | NA | 2501 | NA | 3976 |
| 5079v20141116 | flagellar hook-length control protein | 3379 | NA | NA | NA | 2503 | 3379 | NA |
| 5117v20141116 | hypothetical protein | 3382 | NA | NA | NA | 2507 | 3382 | NA |
| 5119v20141116 | multidrug ABC transporter ATP-binding protein | 3384 | NA | NA | NA | 2509 | 3384 | NA |
| 5147v20141116 | hypothetical protein Mpop_1464 | 2511 | NA | NA | NA | 2511 | NA | 3981 |
| 5180v20141116 | glycoside hydrolase family 3 | 3386 | NA | NA | NA | 2512 | 3386 | NA |
| 5184v20141116 | hypothetical protein | 2514 | NA | NA | NA | 2514 | NA | 3982 |
| 5205v20141116 | DNA invertase gene rlgA | 34 | 34 | NA | NA | NA | NA | 3984 |

TABLE 7-continued

Orthologous Gene Groups

| Unique Ortholog Group Identifier | Annotation | Reference. Ortholog SEQ ID NO: | NLS0017 Ortholog SEQ ID NO: | NLS0020 Ortholog SEQ ID NO: | NLS0037 Ortholog SEQ ID NO: | NLS0042 Ortholog SEQ ID NO: | NLS0065 Ortholog SEQ ID NO: | NLS0066 Ortholog SEQ ID NO: |
|---|---|---|---|---|---|---|---|---|
| 5219v20141116 | hypothetical protein MexAM1_META1p0208 | 3986 | NA | NA | NA | 2518 | NA | 3986 |
| 5228v20141116 | ABC transporter permease | 3390 | NA | NA | NA | 2519 | 3390 | NA |
| 5233v20141116 | membrane protein | 3391 | NA | NA | NA | 2520 | 3391 | NA |
| 5275v20141116 | gamma-glutamyltransferase | 2524 | NA | NA | NA | 2524 | 3395 | NA |
| 5284v20141116 | hypothetical protein MexAM1_META1p3378 | 2526 | NA | NA | NA | 2526 | 3397 | NA |
| 5287v20141116 | FAD linked oxidase domain-containing protein | 2527 | NA | NA | NA | 2527 | 3398 | NA |
| 5289v20141116 | Siderophore synthetase component | 2528 | NA | NA | NA | 2528 | 3399 | NA |
| 5318v20141116 | hypothetical protein Mpop_4361 | 2529 | NA | NA | NA | 2529 | NA | 3989 |
| 5335v20141116 | AraC family transcriptional regulator | 3990 | NA | NA | NA | 2531 | NA | 3990 |
| 5337v20141116 | hypothetical protein Mpop_4929 | 2532 | NA | NA | NA | 2532 | 3400 | NA |
| 5379v20141116 | hypothetical protein MexAM1_META1p2104 | 2535 | NA | NA | NA | 2535 | 3402 | NA |
| 5381v20141116 | 4Fe—4S ferredoxin | 3403 | NA | NA | NA | 2537 | 3403 | NA |
| 5382v20141116 | hypothetical protein METDI4726 | 3404 | NA | NA | NA | 2538 | 3404 | NA |
| 5383v20141116 | hypothetical protein Mext_3764 | 2539 | NA | NA | NA | 2539 | 3405 | NA |
| 5384v20141116 | N-acetyltransferase GCN5 | 3406 | NA | NA | NA | 2540 | 3406 | NA |
| 5390v20141116 | hypothetical protein | 3993 | NA | NA | NA | 2541 | NA | 3993 |
| 5392v20141116 | hypothetical protein Mext_3467 | 3408 | NA | NA | NA | 2544 | 3408 | NA |
| 5398v20141116 | hypothetical protein Mchl_3886 | 2545 | NA | NA | NA | 2545 | 3409 | NA |
| 5419v20141116 | diguanylate cyclase | 3410 | NA | NA | NA | 2546 | 3410 | NA |
| 5437v20141116 | hypothetical protein Mpop_2189 | 2548 | NA | NA | NA | 2548 | 3414 | NA |
| 5466v20141116 | hypothetical protein Mpop_0206 | 2549 | NA | NA | NA | 2549 | 3415 | NA |
| 5475v20141116 | conserved hypothetical protein | 2552 | NA | NA | NA | 2552 | NA | 4000 |
| 5476v20141116 | hypothetical protein AZOLI_p40379 | 4001 | NA | NA | NA | 2553 | NA | 4001 |
| 5477v20141116 | HAD-superfamily hydrolase | 2554 | NA | NA | NA | 2554 | 3418 | NA |
| 5480v20141116 | hypothetical protein METDI4261 | 3419 | NA | NA | NA | 2555 | 3419 | NA |
| 5482v20141116 | hypothetical protein MexAM1_META1p3862 | 2556 | NA | NA | NA | 2556 | 3420 | NA |
| 5483v20141116 | hypothetical protein | 3421 | NA | NA | NA | 2557 | 3421 | NA |
| 5488v20141116 | fatty acid desaturase; membrane protein | 2559 | NA | NA | NA | 2559 | 3423 | NA |
| 5490v20141116 | hypothetical protein MexAM1_META1p1300 | 2560 | NA | NA | NA | 2560 | 3424 | NA |
| 5524v20141116 | hypothetical protein | 3432 | NA | NA | NA | 2564 | 3432 | NA |
| 5525v20141116 | hypothetical protein Mpop_5158 | 2565 | NA | NA | NA | 2565 | 3433 | NA |
| 5526v20141116 | hypothetical protein Mext_4623 | 2566 | NA | NA | NA | 2566 | 3434 | NA |
| 5530v20141116 | Bacterial extracellular solute-binding protein family 3 | 4009 | NA | NA | NA | 2567 | NA | 4009 |
| 5536v20141116 | hypothetical protein | 2568 | NA | NA | NA | 2568 | 3435 | NA |
| 5543v20141116 | xylose isomerase domain-containing protein | 2569 | NA | NA | NA | 2569 | 3436 | NA |
| 5546v20141116 | hypothetical protein MexAM1_META1p0483 | 3437 | NA | NA | NA | 2570 | 3437 | NA |
| 5556v20141116 | diguanylate cyclase | 3438 | NA | NA | NA | 2571 | 3438 | NA |
| 5568v20141116 | protein transcription factor | 3440 | NA | NA | NA | NA | 3440 | 4011 |

TABLE 7-continued

Orthologous Gene Groups

| Unique Ortholog Group Identifier | Annotation | Reference. Ortholog SEQ ID NO: | NLS0017 Ortholog SEQ ID NO: | NLS0020 Ortholog SEQ ID NO: | NLS0037 Ortholog SEQ ID NO: | NLS0042 Ortholog SEQ ID NO: | NLS0065 Ortholog SEQ ID NO: | NLS0066 Ortholog SEQ ID NO: |
|---|---|---|---|---|---|---|---|---|
| 5577v20141116 | hypothetical protein Mpop__1561 | 2573 | NA | NA | NA | 2573 | 3441 | NA |
| 5578v20141116 | sodium:solute symporter | 2574 | NA | NA | NA | 2574 | 3442 | NA |
| 5610v20141116 | hypothetical protein Mchl__2392 | 2575 | NA | NA | NA | 2575 | 3445 | NA |
| 5612v20141116 | hypothetical protein MexAM1__META1p5060 | 2576 | NA | NA | NA | 2576 | 3446 | NA |
| 5618v20141116 | hypothetical protein | 3447 | NA | NA | NA | 2577 | 3447 | NA |
| 5619v20141116 | hypothetical protein MexAM1__META1p2965 | 3448 | NA | NA | NA | 2578 | 3448 | NA |
| 5625v20141116 | hypothetical protein Mchl__4383 | 2580 | NA | NA | NA | 2580 | 3449 | NA |
| 5626v20141116 | hypothetical protein Mext__3503 | 3450 | NA | NA | NA | 2581 | 3450 | NA |
| 5627v20141116 | protein-L-isoaspartate O-methyltransferase | 2582 | NA | NA | NA | 2582 | 3451 | NA |
| 5628v20141116 | hypothetical protein | 2583 | NA | NA | NA | 2583 | 3452 | NA |
| 5635v20141116 | hypothetical protein Mext__4188 | 2584 | NA | NA | NA | 2584 | 3453 | NA |
| 5636v20141116 | hypothetical protein Mpop__4705 | 2585 | NA | NA | NA | 2585 | 3454 | NA |
| 5642v20141116 | hypothetical protein METDI0650 | 4014 | NA | NA | NA | NA | 3455 | 4014 |
| 5650v20141116 | ATPase | 2586 | NA | NA | NA | 2586 | 3456 | NA |
| 5657v20141116 | two component LuxR family transcriptional regulator | 2587 | NA | NA | NA | 2587 | 3457 | NA |
| 5672v20141116 | hypothetical protein MexAM1__META1p1076 | 2588 | NA | NA | NA | 2588 | 3459 | NA |
| 5679v20141116 | acetate kinase | 2589 | NA | NA | NA | 2589 | 3461 | NA |
| 5684v20141116 | hypothetical protein | 2591 | NA | NA | NA | 2591 | NA | 4015 |
| 5686v20141116 | EAL domain-containing protein | 2592 | NA | NA | NA | 2592 | 3463 | NA |
| 5689v20141116 | AsnC family transcriptional regulator | 2593 | NA | NA | NA | 2593 | 3464 | NA |
| 5691v20141116 | hypothetical protein Mchl__3961 | 2594 | NA | NA | NA | 2594 | 3465 | NA |
| 5692v20141116 | two-component LuxR family transcriptional regulator | 2595 | NA | NA | NA | 2595 | 3466 | NA |
| 5693v20141116 | hypothetical protein Mpop__0877 | 2596 | NA | NA | NA | 2596 | 3467 | NA |
| 5695v20141116 | secretion protein HlyD | 2598 | NA | NA | NA | 2598 | 3468 | NA |
| 5698v20141116 | hypothetical protein Mext__0717 | 3469 | NA | NA | NA | 2599 | 3469 | NA |
| 5699v20141116 | transcriptional regulator | 2600 | NA | NA | NA | 2600 | 3470 | NA |
| 5712v20141116 | HlyD family type I secretion membrane fusion protein | 2602 | NA | NA | NA | 2602 | 3471 | NA |
| 5735v20141116 | integrase catalytic subunit | 55 | 55 | 1132 | NA | NA | NA | NA |
| 5737v20141116 | putative transposase | 2185 | NA | 1133 | 2185 | NA | NA | NA |
| 5745v20141116 | hypothetical protein Mpop__0065 | 4017 | NA | NA | NA | 2606 | NA | 4017 |
| 5752v20141116 | hypothetical protein Mpop__0858 | 2610 | NA | NA | NA | 2610 | 3472 | NA |
| 5756v20141116 | hypothetical protein Mext__1191 | 2612 | NA | NA | NA | 2612 | 3473 | NA |
| 5783v20141116 | rhizobiocin secretion protein rspD | 2618 | NA | NA | NA | 2618 | 3475 | NA |
| 5802v20141116 | hypothetical protein Mext__3619 | 3477 | NA | NA | NA | 2620 | 3477 | NA |
| 5803v20141116 | NADP-dependent alcohol dehydrogenase | 2621 | NA | NA | NA | 2621 | 3478 | NA |
| 5812v20141116 | Urease accessory protein UreD | 2625 | NA | NA | NA | 2625 | 3479 | NA |
| 5813v20141116 | urea transporter | 2626 | NA | NA | NA | 2626 | 3480 | NA |
| 5814v20141116 | ammonium transporter | 2627 | NA | NA | NA | 2627 | 3481 | NA |

TABLE 7-continued

Orthologous Gene Groups

| Unique Ortholog Group Identifier | Annotation | Reference. Ortholog SEQ ID NO: | NLS0017 Ortholog SEQ ID NO: | NLS0020 Ortholog SEQ ID NO: | NLS0037 Ortholog SEQ ID NO: | NLS0042 Ortholog SEQ ID NO: | NLS0065 Ortholog SEQ ID NO: | NLS0066 Ortholog SEQ ID NO: |
|---|---|---|---|---|---|---|---|---|
| 5822v20141116 | hypothetical protein MexAM1_META1p3379 | 2628 | NA | NA | NA | 2628 | 3482 | NA |
| 5845v20141116 | hypothetical protein Mpop_0716 | 2630 | NA | NA | 2186 | 2630 | NA | NA |
| 5859v20141116 | hemolysin-type calcium-binding protein | 3486 | NA | NA | NA | 2632 | 3486 | NA |
| 5866v20141116 | hypothetical protein Mchl_1323 | 3487 | NA | NA | NA | 2633 | 3487 | NA |
| 5872v20141116 | hypothetical protein Mpop_3121 | 2636 | NA | NA | NA | 2636 | 3488 | NA |
| 5881v20141116 | hypothetical protein Mpop_1945 | 2187 | NA | NA | 2187 | 2638 | NA | NA |
| 5884v20141116 | urease subunit gamma | 3489 | NA | NA | NA | 2640 | 3489 | NA |
| 5885v20141116 | urease subunit beta | 2641 | NA | NA | NA | 2641 | 3490 | NA |
| 5886v20141116 | camphor resistance protein CrcB | 2642 | NA | NA | NA | 2642 | 3491 | NA |
| 5887v20141116 | UreE urease accessory domain-containing protein | 3492 | NA | NA | NA | 2643 | 3492 | NA |
| 5888v20141116 | urease accessory protein UreF | 2644 | NA | NA | NA | 2644 | 3493 | NA |
| 5889v20141116 | urease accessory protein UreG | 3494 | NA | NA | NA | 2645 | 3494 | NA |
| 5890v20141116 | hypothetical protein | 3495 | NA | NA | NA | 2646 | 3495 | NA |
| 5934v20141116 | carbon monoxide dehydrogenase subunit G | 58 | 58 | 1135 | NA | NA | NA | NA |
| 5937v20141116 | hypothetical protein | 59 | 59 | NA | NA | 2662 | NA | NA |
| 5952v20141116 | nucleotidyltransferase | 4020 | NA | NA | NA | 2664 | NA | 4020 |
| 5958v20141116 | hypothetical protein Mpop_2489 | 3498 | NA | NA | NA | 2668 | 3498 | NA |
| 5963v20141116 | camphor resistance CrcB protein | 3499 | NA | NA | NA | 2670 | 3499 | NA |
| 5964v20141116 | acid-resistance protein | 2671 | NA | NA | NA | 2671 | 3500 | NA |
| 5970v20141116 | hypothetical protein | 3501 | NA | NA | NA | 2672 | 3501 | NA |
| 5976v20141116 | hypothetical protein Mext_2198 | 2188 | NA | NA | 2188 | 2673 | NA | NA |
| 6008v20141116 | chloride channel protein | 2678 | NA | NA | NA | 2678 | 3503 | NA |
| 6037v20141116 | hypothetical protein Mext_2029 | 2681 | NA | NA | NA | 2681 | NA | 4022 |
| 6040v20141116 | diguanylate cyclase | 2682 | NA | NA | NA | 2682 | 3505 | NA |
| 6045v20141116 | hypothetical protein Mpop_3879 | 3506 | NA | NA | NA | NA | 3506 | 4023 |
| 6100v20141116 | N-acetyltransferase GCN5 | 2684 | NA | NA | NA | 2684 | 3507 | NA |
| 6123v20141116 | TetR family transcriptional regulator | 66 | 66 | 1143 | NA | NA | NA | NA |
| 6155v20141116 | hypothetical protein Mext_0184 | 3508 | NA | NA | NA | 2690 | 3508 | NA |
| 6156v20141116 | hypothetical protein MexAM1_META1p2841 | 2691 | NA | NA | NA | 2691 | 3509 | NA |
| 6179v20141116 | hypothetical protein METDI1994 | 2694 | NA | NA | NA | 2694 | 3510 | NA |
| 6180v20141116 | oleate hydratase | 2695 | NA | NA | NA | 2695 | 3511 | NA |
| 6182v20141116 | hypothetical protein Mext_4657 | 2696 | NA | NA | NA | 2696 | 3512 | NA |
| 6187v20141116 | hypothetical protein Mpop_4217 | 2699 | NA | NA | NA | 2699 | NA | 4029 |
| 6198v20141116 | hypothetical protein Mchl_4111 | 2701 | NA | NA | NA | 2701 | NA | 4030 |
| 6211v20141116 | LysR family transcriptional regulator | 2702 | 69 | NA | NA | 2702 | NA | NA |
| 6228v20141116 | MucR family transcriptional regulator | 2704 | NA | NA | NA | 2704 | 3514 | NA |
| 6266v20141116 | hypothetical protein Mpop_4875 | 2707 | NA | NA | NA | 2707 | 3515 | NA |
| 6267v20141116 | hypothetical protein Mpop_0711 | 2708 | NA | NA | NA | 2708 | 3516 | NA |

TABLE 7-continued

Orthologous Gene Groups

| Unique Ortholog Group Identifier | Annotation | Reference. Ortholog SEQ ID NO: | NLS0017 Ortholog SEQ ID NO: | NLS0020 Ortholog SEQ ID NO: | NLS0037 Ortholog SEQ ID NO: | NLS0042 Ortholog SEQ ID NO: | NLS0065 Ortholog SEQ ID NO: | NLS0066 Ortholog SEQ ID NO: |
|---|---|---|---|---|---|---|---|---|
| 6302v20141116 | hypothetical protein Mext_4665 | 2710 | NA | NA | NA | 2710 | 3518 | NA |
| 6316v20141116 | hypothetical protein | 1145 | 71 | 1145 | NA | NA | NA | NA |
| 6323v20141116 | hypothetical protein Mchl_1272 | 2712 | NA | NA | NA | 2712 | NA | 4034 |
| 6355v20141116 | hypothetical protein MexAM1_META1p2729 | 2713 | NA | NA | 2192 | 2713 | NA | NA |
| 6403v20141116 | hypothetical protein | 4036 | NA | NA | 2194 | NA | NA | 4036 |
| 6404v20141116 | hypothetical protein | 4037 | NA | NA | 2195 | NA | NA | 4037 |
| 6405v20141116 | hypothetical protein | 2196 | NA | NA | 2196 | NA | NA | 4038 |
| 6409v20141116 | hypothetical protein | 3519 | NA | NA | NA | 2718 | 3519 | NA |
| 6410v20141116 | putative 2 4 dihydroxyhept-2-ene-1 7-dioic acid aldolase | 3520 | NA | NA | NA | 2719 | 3520 | NA |
| 6412v20141116 | amidohydrolase | 2720 | NA | NA | NA | 2720 | NA | 4039 |
| 6451v20141116 | integrase family protein | 74 | 74 | NA | NA | NA | 3522 | NA |
| 6472v20141116 | hypothetical protein FBFL15_0362 | 2197 | NA | 1148 | 2197 | NA | NA | NA |
| 6475v20141116 | hypothetical protein | 3523 | NA | 1149 | NA | NA | 3523 | NA |
| 6566v20141116 | hypothetical protein Mchl_1240 | 2738 | NA | NA | NA | 2738 | NA | 4040 |
| 6568v20141116 | hypothetical protein Mchl_4341 | 2740 | NA | NA | NA | 2740 | NA | 4041 |
| 6571v20141116 | hypothetical protein MexAM1_META1p4650 | 3524 | NA | NA | NA | NA | 3524 | 4042 |
| 6576v20141116 | hypothetical protein | 2741 | NA | NA | NA | 2741 | NA | 4043 |
| 6587v20141116 | hypothetical protein METDI5212 | 3525 | NA | NA | NA | 2743 | 3525 | NA |
| 6615v20141116 | hypothetical protein | 1151 | NA | 1151 | NA | NA | 3526 | NA |
| 6616v20141116 | hypothetical protein | 3527 | NA | NA | NA | NA | 3527 | 4044 |
| 6649v20141116 | hypothetical protein | 2748 | NA | NA | NA | 2748 | 3530 | NA |
| 6655v20141116 | hypothetical protein | 3531 | NA | NA | NA | 2751 | 3531 | NA |
| 6656v20141116 | hypothetical protein Mext_0808 | 2753 | NA | NA | NA | 2753 | 3532 | NA |
| 6665v20141116 | hypothetical protein | 2754 | NA | NA | NA | 2754 | NA | 4048 |
| 6670v20141116 | ubiE/COQ5 methyltransferase family enzyme | 2756 | NA | NA | NA | 2756 | 3533 | NA |
| 6713v20141116 | cytochrome C biogenesis protein CcsA | 3535 | NA | NA | NA | NA | 3535 | 4049 |
| 6749v20141116 | hypothetical protein | 1153 | NA | 1153 | NA | NA | 3537 | NA |
| 6750v20141116 | hypothetical protein | 1154 | NA | 1154 | NA | NA | 3538 | NA |
| 6777v20141116 | hypothetical protein | 2200 | NA | NA | 2200 | NA | NA | 4051 |
| 6778v20141116 | choloylglycine hydrolase | 3539 | NA | NA | NA | 2759 | 3539 | NA |
| 6824v20141116 | transposase of ISMex3 IS256 family | 78 | 78 | 1158 | NA | NA | NA | NA |
| 6829v20141116 | hypothetical protein | 2765 | NA | NA | NA | 2765 | 3544 | NA |
| 6832v20141116 | HEPN domain-containing protein | 4055 | NA | NA | NA | 2766 | NA | 4055 |
| 6833v20141116 | regulatory protein LysR | 3546 | NA | NA | NA | 2767 | 3546 | NA |
| 6835v20141116 | hypothetical protein Mchl_5553 | 2202 | NA | NA | 2202 | NA | NA | 4056 |
| 6876v20141116 | fermentative D-lactate dehydrogenase NAD-dependent | 2774 | NA | NA | NA | 2774 | 3553 | NA |
| 6881v20141116 | hypothetical protein | 2777 | NA | NA | NA | 2777 | NA | 4057 |
| 6892v20141116 | hypothetical protein | 2778 | NA | NA | NA | 2778 | NA | 4059 |
| 6923v20141116 | Hypothetical protein | 1159 | 82 | 1159 | NA | NA | NA | NA |
| 6941v20141116 | hypothetical protein Mext_1123 | 2779 | 83 | NA | NA | 2779 | NA | NA |
| 6946v20141116 | hypothetical protein | 1161 | NA | 1161 | NA | NA | NA | 4061 |
| 6982v20141116 | hypothetical protein Mext_1327 | 2790 | NA | NA | NA | 2790 | 3558 | NA |
| 7002v20141116 | esterase | 2794 | NA | NA | NA | 2794 | 3559 | NA |
| 7004v20141116 | hypothetical protein Mpop_1856 | 2795 | NA | NA | NA | 2795 | NA | 4065 |

TABLE 7-continued

Orthologous Gene Groups

| Unique Ortholog Group Identifier | Annotation | Reference. Ortholog SEQ ID NO: | NLS0017 Ortholog SEQ ID NO: | NLS0020 Ortholog SEQ ID NO: | NLS0037 Ortholog SEQ ID NO: | NLS0042 Ortholog SEQ ID NO: | NLS0065 Ortholog SEQ ID NO: | NLS0066 Ortholog SEQ ID NO: |
|---|---|---|---|---|---|---|---|---|
| 7028v20141116 | hypothetical protein | 2797 | NA | NA | NA | 2797 | NA | 4068 |
| 7057v20141116 | hypothetical protein | 3560 | NA | 1169 | NA | NA | 3560 | NA |
| 7068v20141116 | xylose isomerase domain-containing protein | 2801 | NA | NA | NA | 2801 | NA | 4072 |
| 7077v20141116 | NADPH-dependent FMN reductase | 2203 | NA | NA | 2203 | 2802 | NA | NA |
| 7083v20141116 | glutathione S-transferase | 2204 | NA | NA | 2204 | NA | NA | 4073 |
| 7096v20141116 | diguanylate cyclase | 2808 | NA | NA | NA | 2808 | 3563 | NA |
| 7116v20141116 | transposase mutator type | 1170 | 90 | 1170 | NA | NA | NA | NA |
| 7127v20141116 | hypothetical protein Mnod_6985 | 4074 | 94 | NA | NA | NA | NA | 4074 |
| 7149v20141116 | hypothetical protein | 4075 | NA | NA | NA | NA | 3564 | 4075 |
| 7158v20141116 | short-chain dehydrogenase/reductase SDR | 3565 | NA | NA | NA | 2816 | 3565 | NA |
| 7238v20141116 | methyl-accepting chemotaxis sensory transducer | 4078 | NA | NA | NA | NA | 3568 | 4078 |
| 7242v20141116 | flagellar hook length determination protein | 2817 | NA | NA | NA | 2817 | 3570 | NA |
| 7272v20141116 | hypothetical protein MexAM1_META1p0887 | 4079 | NA | NA | NA | 2823 | NA | 4079 |
| 7303v20141116 | glycosyl hydrolase | 2827 | NA | 1182 | NA | 2827 | NA | NA |
| 7316v20141116 | hypothetical protein Mpop_4411 | 4092 | NA | NA | 2207 | NA | NA | 4092 |
| 7318v20141116 | hypothetical protein Mrad2831_3608 | 110 | 110 | 1187 | NA | NA | NA | NA |
| 7330v20141116 | short-chain dehydrogenase/reductase SDR | 2831 | NA | NA | NA | 2831 | NA | 4093 |
| 7334v20141116 | hypothetical protein | 112 | 112 | NA | NA | 2832 | NA | NA |
| 7364v20141116 | IclR family transcriptional regulator | 2833 | NA | NA | NA | 2833 | NA | 4095 |
| 7384v20141116 | hypothetical protein Mpop_4088 | 4096 | NA | NA | NA | NA | 3576 | 4096 |
| 7388v20141116 | hypothetical protein Mpop_4204 | 2834 | NA | NA | NA | 2834 | NA | 4097 |
| 7389v20141116 | peptidase M24 | 2835 | NA | NA | NA | 2835 | NA | 4098 |
| 7390v20141116 | thiamine pyrophosphate protein central region | 2836 | NA | NA | NA | 2836 | NA | 4099 |
| 7399v20141116 | hypothetical protein | 3577 | NA | NA | NA | 2842 | 3577 | NA |
| 7418v20141116 | hypothetical protein | 2209 | NA | NA | 2209 | 2843 | NA | NA |
| 7420v20141116 | hypothetical protein Mchl_5174 | 2844 | NA | NA | NA | 2844 | 3578 | NA |
| 7422v20141116 | hypothetical protein Mext_4882 | 2845 | NA | NA | NA | 2845 | 3579 | NA |
| 7435v20141116 | hypothetical protein | 2852 | NA | NA | NA | 2852 | NA | 4101 |
| 7437v20141116 | hypothetical protein LILAB_22195 | 4102 | NA | NA | NA | NA | 3581 | 4102 |
| 7465v20141116 | hypothetical protein | 3582 | NA | NA | 2210 | NA | 3582 | NA |
| 7482v20141116 | phage putative protein | 1190 | 117 | 1190 | NA | NA | NA | NA |
| 7484v20141116 | hypothetical protein | 119 | 119 | 1191 | NA | NA | NA | NA |
| 7489v20141116 | enoyl-CoA hydratase/isomerase | 120 | 120 | 1192 | NA | NA | NA | NA |
| 7517v20141116 | inner-membrane translocator | 2857 | NA | NA | NA | 2857 | NA | 4105 |
| 7518v20141116 | branched chain amino acid ABC transporter substrate-binding protein | 4106 | NA | NA | NA | 2858 | NA | 4106 |
| 7558v20141116 | hypothetical protein | 3584 | NA | NA | 1195 | NA | 3584 | NA |
| 7562v20141116 | integrase catalytic subunit | 123 | 123 | 1196 | NA | NA | NA | NA |
| 7586v20141116 | hypothetical protein | 3586 | NA | 1198 | NA | NA | 3586 | NA |
| 7587v20141116 | hypothetical protein | 3587 | NA | 1199 | NA | NA | 3587 | NA |

TABLE 7-continued

Orthologous Gene Groups

| Unique Ortholog Group Identifier | Annotation | Reference. Ortholog SEQ ID NO: | NLS0017 Ortholog SEQ ID NO: | NLS0020 Ortholog SEQ ID NO: | NLS0037 Ortholog SEQ ID NO: | NLS0042 Ortholog SEQ ID NO: | NLS0065 Ortholog SEQ ID NO: | NLS0066 Ortholog SEQ ID NO: |
|---|---|---|---|---|---|---|---|---|
| 7588v20141116 | hypothetical protein | 1200 | NA | 1200 | NA | NA | 3588 | NA |
| 7589v20141116 | hypothetical protein | 1201 | NA | 1201 | NA | NA | 3589 | NA |
| 7590v20141116 | hypothetical protein Mrad2831_2637 | 2211 | NA | NA | 2211 | NA | NA | 4107 |
| 7624v20141116 | N-acetyltransferase GCN5 | 2212 | NA | NA | 2212 | 2861 | NA | NA |
| 7699v20141116 | hypothetical protein | 126 | 126 | 1202 | NA | NA | NA | NA |
| 7713v20141116 | hypothetical protein | 129 | 129 | 1205 | NA | NA | NA | NA |
| 7734v20141116 | hypothetical protein Mnod_8620 | 2215 | 132 | NA | 2215 | NA | NA | NA |
| 7748v20141116 | hypothetical protein | 1208 | 133 | 1208 | NA | NA | NA | NA |
| 7749v20141116 | integrase | 134 | 134 | NA | NA | 2875 | NA | NA |
| 7751v20141116 | integrase catalytic subunit | 1210 | 136 | 1210 | NA | NA | NA | NA |
| 7782v20141116 | hypothetical protein | 2878 | NA | NA | NA | 2878 | 3597 | NA |
| 7783v20141116 | GntR family transcriptional regulator | 4116 | NA | NA | NA | 2879 | NA | 4116 |
| 7813v20141116 | None | 2883 | NA | NA | NA | 2883 | NA | 4118 |
| 7814v20141116 | hypothetical protein | 2884 | NA | NA | NA | 2884 | NA | 4119 |
| 7815v20141116 | RNA polymerase subunit sigma-24 | 2885 | NA | NA | NA | 2885 | NA | 4120 |
| 7829v20141116 | hypothetical protein | 1213 | 138 | 1213 | NA | NA | NA | NA |
| 7855v20141116 | hypothetical protein | 141 | 141 | 1216 | NA | NA | NA | NA |
| 7856v20141116 | hypothetical protein | 4125 | 142 | NA | NA | NA | NA | 4125 |
| 7869v20141116 | hypothetical protein Mchl_2588 | 144 | 144 | 1218 | NA | NA | NA | NA |
| 7889v20141116 | hypothetical protein Mnod_5347 | 147 | 147 | 1222 | NA | NA | NA | NA |
| 7899v20141116 | hypothetical protein | 150 | 150 | 1224 | NA | NA | NA | NA |
| 7909v20141116 | hypothetical protein Mpop_3836 | 2217 | 152 | NA | 2217 | NA | NA | NA |
| 7919v20141116 | hypothetical protein | 2895 | NA | 1230 | NA | 2895 | NA | NA |
| 7926v20141116 | hypothetical protein | 3604 | NA | NA | NA | NA | 3604 | 4133 |
| 7931v20141116 | None | 3605 | NA | NA | NA | NA | 3605 | 4134 |
| 7981v20141116 | transposase IS3/IS911 family protein | 2909 | NA | NA | NA | 2909 | NA | 4141 |
| 8024v20141116 | short-chain dehydrogenase/reductase SDR | 3609 | NA | NA | 2220 | NA | 3609 | NA |
| 8042v20141116 | Hypothetical protein | 156 | 156 | 1232 | NA | NA | NA | NA |
| 8052v20141116 | MFS transporter | 157 | 157 | 1233 | NA | NA | NA | NA |
| 8092v20141116 | ABC transporter inner membrane protein | 4146 | 166 | NA | NA | NA | NA | 4146 |
| 8093v20141116 | ABC transporter | 167 | 167 | NA | NA | NA | NA | 4147 |
| 8094v20141116 | nitrate/sulfonate/bicarbonate ABC transporter | 4148 | 168 | NA | NA | NA | NA | 4148 |
| 8098v20141116 | hypothetical protein | 170 | 170 | 1243 | NA | NA | NA | NA |
| 8113v20141116 | adenylate/guanylate cyclase | 4149 | 174 | NA | NA | NA | NA | 4149 |
| 8115v20141116 | integrase family protein | 2910 | 176 | NA | NA | 2910 | NA | NA |
| 8116v20141116 | ISGsu7 transposase OrfA | 177 | 177 | 1246 | NA | NA | NA | NA |
| 8117v20141116 | hypothetical protein Mrad2831_5711 | 178 | 178 | 1247 | NA | NA | NA | NA |
| 8124v20141116 | Mobile element protein | 3611 | NA | 1249 | NA | NA | 3611 | NA |
| 8136v20141116 | hypothetical protein Mpop_2878 | 2230 | NA | NA | 2230 | 2911 | NA | NA |
| 8171v20141116 | hypothetical protein | 4155 | NA | NA | NA | 2912 | NA | 4155 |
| 8179v20141116 | response regulator receiver | 2232 | NA | NA | 2232 | NA | NA | 4156 |
| 8180v20141116 | None | 2233 | NA | NA | 2233 | NA | NA | 4157 |
| 8205v20141116 | hypothetical protein | 2917 | NA | NA | NA | 2917 | NA | 4160 |
| 8206v20141116 | rhodanese | 4161 | NA | NA | NA | 2918 | NA | 4161 |
| 8237v20141116 | integrase family protein | 2919 | NA | NA | NA | 2919 | 3619 | NA |
| 8258v20141116 | hypothetical protein | 180 | 180 | NA | NA | NA | 3620 | NA |
| 8267v20141116 | porin | 181 | 181 | 1250 | NA | NA | NA | NA |
| 8268v20141116 | hypothetical protein Mrad2831_0222 | 182 | 182 | 1251 | NA | NA | NA | NA |

TABLE 7-continued

Orthologous Gene Groups

| Unique Ortholog Group Identifier | Annotation | Reference. Ortholog SEQ ID NO: | NLS0017 Ortholog SEQ ID NO: | NLS0020 Ortholog SEQ ID NO: | NLS0037 Ortholog SEQ ID NO: | NLS0042 Ortholog SEQ ID NO: | NLS0065 Ortholog SEQ ID NO: | NLS0066 Ortholog SEQ ID NO: |
|---|---|---|---|---|---|---|---|---|
| 8269v20141116 | hypothetical protein | 183 | 183 | 1252 | NA | NA | NA | NA |
| 8270v20141116 | two component transcriptional regulator | 184 | 184 | 1253 | NA | NA | NA | NA |
| 8271v20141116 | RND family efflux transporter MFP subunit | 185 | 185 | 1254 | NA | NA | NA | NA |
| 8284v20141116 | thiamine pyrophosphate binding domain-containing protein | 187 | 187 | 1256 | NA | NA | NA | NA |
| 8299v20141116 | hypothetical protein | 190 | 190 | 1258 | NA | NA | NA | NA |
| 8301v20141116 | None | 4169 | 192 | NA | NA | NA | NA | 4169 |
| 8308v20141116 | hypothetical protein | 194 | 194 | 1261 | NA | NA | NA | NA |
| 8311v20141116 | enoyl-CoA hydratase | 196 | 196 | 1263 | NA | NA | NA | NA |
| 8332v20141116 | hypothetical protein BJ6T_24320 | 203 | 203 | 1269 | NA | NA | NA | NA |
| 8334v20141116 | hypothetical protein | 204 | 204 | 1270 | NA | NA | NA | NA |
| 8339v20141116 | ATP-hydrolyzing enzyme | 1272 | NA | 1272 | 2240 | NA | NA | NA |
| 8361v20141116 | plasmid stability protein StbC | 3621 | NA | NA | 2243 | NA | 3621 | NA |
| 8411v20141116 | methyltransferase type 11 | 4180 | NA | NA | NA | NA | 3627 | 4180 |
| 8412v20141116 | oxidoreductase FAD/NAD(P)-binding domain-containing protein | 3628 | NA | NA | NA | NA | 3628 | 4181 |
| 8413v20141116 | hypothetical protein Mchl_5368 | 2929 | NA | NA | NA | 2929 | NA | 4182 |
| 8445v20141116 | integrase family protein | 2937 | NA | NA | NA | 2937 | 3629 | NA |
| 8450v20141116 | hypothetical protein GDI_3938 | 4188 | NA | NA | 2246 | NA | NA | 4188 |
| 8463v20141116 | linear gramicidin synthetase subunit C | 1274 | 208 | 1274 | NA | NA | NA | NA |
| 8468v20141116 | hypothetical protein | 209 | 209 | 1275 | NA | NA | NA | NA |
| 8477v20141116 | hypothetical protein | 211 | 211 | 1277 | NA | NA | NA | NA |
| 8478v20141116 | ABC transporter-like protein | 212 | 212 | 1278 | NA | NA | NA | NA |
| 8479v20141116 | acetamidase | 213 | 213 | 1279 | NA | NA | NA | NA |
| 8535v20141116 | C4-dicarboxylate ABC transporter | 216 | 216 | 1281 | NA | NA | NA | NA |
| 8536v20141116 | nitrate ABC transporter substrate-binding protein | 217 | 217 | 1282 | NA | NA | NA | NA |
| 8572v20141116 | replication protein C | 220 | 220 | 1285 | NA | NA | NA | NA |
| 8583v20141116 | putative radical SAM domain protein | 224 | 224 | NA | 2254 | NA | NA | NA |
| 8588v20141116 | 4-carboxy muconolactone decarboxylase | 225 | 225 | 1288 | NA | NA | NA | NA |
| 8598v20141116 | LysR family transcriptional regulator | 228 | 228 | 1291 | NA | NA | NA | NA |
| 8601v20141116 | hypothetical protein | 231 | 231 | 1293 | NA | NA | NA | NA |
| 8607v20141116 | hypothetical protein | 233 | 233 | 1295 | NA | NA | NA | NA |
| 8631v20141116 | hypothetical protein | 234 | 234 | 1296 | NA | NA | NA | NA |
| 8716v20141116 | hypothetical protein | 3638 | NA | NA | NA | NA | 3638 | 4196 |
| 8826v20141116 | phage integrase | 2960 | NA | NA | 2262 | 2960 | NA | NA |
| 8844v20141116 | transposase ISDvu2 | 239 | 239 | 1300 | NA | NA | NA | NA |
| 8857v20141116 | alpha/beta hydrolase | 241 | 241 | 1302 | NA | NA | NA | NA |
| 8858v20141116 | putative chemotaxis phosphatase CheZ | 242 | 242 | 1303 | NA | NA | NA | NA |
| 8862v20141116 | hypothetical protein Swoo_4771 | 243 | 243 | 1304 | NA | NA | NA | NA |
| 8870v20141116 | methionine gamma-lyase | 246 | 246 | 1306 | NA | NA | NA | NA |
| 8871v20141116 | CoA-binding domain-containing protein | 247 | 247 | NA | NA | 2970 | NA | NA |
| 8892v20141116 | metal dependent phosphohydrolase | 248 | 248 | 1307 | NA | NA | NA | NA |
| 8894v20141116 | hypothetical protein | 249 | 249 | 1308 | NA | NA | NA | NA |

TABLE 7-continued

Orthologous Gene Groups

| Unique Ortholog Group Identifier | Annotation | Reference. Ortholog SEQ ID NO: | NLS0017 Ortholog SEQ ID NO: | NLS0020 Ortholog SEQ ID NO: | NLS0037 Ortholog SEQ ID NO: | NLS0042 Ortholog SEQ ID NO: | NLS0065 Ortholog SEQ ID NO: | NLS0066 Ortholog SEQ ID NO: |
|---|---|---|---|---|---|---|---|---|
| 8900v20141116 | mercuric reductase | 252 | 252 | 1310 | NA | NA | NA | NA |
| 8903v20141116 | MFS transporter | 253 | 253 | 1311 | NA | NA | NA | NA |
| 8908v20141116 | hypothetical protein Mrad2831_1442 | 1314 | 256 | 1314 | NA | NA | NA | NA |
| 8923v20141116 | hypothetical protein Mrad2831_5910 | 258 | 258 | 1316 | NA | NA | NA | NA |
| 8924v20141116 | Xaa-Pro aminopeptidase | 259 | 259 | 1317 | NA | NA | NA | NA |
| 8925v20141116 | hypothetical protein | 260 | 260 | 1318 | NA | NA | NA | NA |
| 8933v20141116 | multi-sensor signal transduction histidine kinase | 267 | 267 | 1320 | NA | NA | NA | NA |
| 8938v20141116 | endoribonuclease L-PSP | 268 | 268 | 1321 | NA | NA | NA | NA |
| 8940v20141116 | hypothetical protein | 269 | 269 | 1322 | NA | NA | NA | NA |
| 8941v20141116 | hypothetical protein | 1323 | 270 | 1323 | NA | NA | NA | NA |
| 8947v20141116 | hypothetical protein | 1324 | 271 | 1324 | NA | NA | NA | NA |
| 8949v20141116 | hypothetical protein Mnod_5935 | 272 | 272 | 1325 | NA | NA | NA | NA |
| 8963v20141116 | ATPase AAA | 4207 | NA | 1328 | NA | NA | NA | 4207 |
| 8968v20141116 | None | 4208 | NA | 1330 | NA | NA | NA | 4208 |
| 8975v20141116 | two component LuxR family transcriptional regulator | 1333 | NA | 1333 | NA | NA | NA | 4209 |
| 9009v20141116 | LysR family transcriptional regulator | 2270 | NA | NA | 2270 | NA | 3651 | NA |
| 9033v20141116 | cobyrinic acid ac-diamide synthase | 2975 | NA | NA | NA | 2975 | NA | 4211 |
| 9049v20141116 | hypothetical protein Mrad2831_5209 | 2272 | NA | NA | 2272 | 2977 | NA | NA |
| 9054v20141116 | hypothetical protein MexAM1_META1p1280 | 3656 | NA | NA | NA | NA | 3656 | 4213 |
| 9082v20141116 | None | 2273 | NA | NA | 2273 | NA | NA | 4214 |
| 9083v20141116 | hypothetical protein | 2274 | NA | NA | 2274 | NA | NA | 4215 |
| 9087v20141116 | short-chain dehydrogenase | 4216 | NA | NA | 2275 | NA | NA | 4216 |
| 9112v20141116 | hypothetical protein | 4221 | NA | NA | NA | NA | 3659 | 4221 |
| 9113v20141116 | hypothetical protein | 3660 | NA | NA | NA | NA | 3660 | 4222 |
| 9114v20141116 | tricarboxylate transporter | 4223 | NA | NA | NA | NA | 3661 | 4223 |
| 9117v20141116 | hypothetical protein Mchl_5371 | 2981 | NA | NA | NA | 2981 | NA | 4225 |
| 9125v20141116 | hypothetical protein Mchl_0715 | 2986 | NA | NA | NA | 2986 | 3662 | NA |
| 9136v20141116 | hypothetical protein Mnod_6346 | 3663 | NA | NA | NA | NA | 3663 | 4235 |
| 9205v20141116 | hypothetical protein | 276 | 276 | 1334 | NA | NA | NA | NA |
| 9230v20141116 | acetyl-CoA acetyltransferase | 278 | 278 | 1336 | NA | NA | NA | NA |
| 9241v20141116 | hypothetical protein | 279 | 279 | 1338 | NA | NA | NA | NA |
| 9245v20141116 | family 1 extracellular solute-binding protein | 281 | 281 | 1339 | NA | NA | NA | NA |
| 9247v20141116 | two-component sensor histidine kinase | 282 | 282 | 1340 | NA | NA | NA | NA |
| 9254v20141116 | carboxymethylenebutenolidase | 283 | 283 | 1342 | NA | NA | NA | NA |
| 9257v20141116 | hypothetical protein | 284 | 284 | 1343 | NA | NA | NA | NA |
| 9260v20141116 | beta-lactamase domain-containing protein | 285 | 285 | 1344 | NA | NA | NA | NA |
| 9261v20141116 | nucleotide sugar dehydrogenase | 286 | 286 | 1345 | NA | NA | NA | NA |
| 9268v20141116 | carbon monoxide dehydrogenase | 287 | 287 | 1346 | NA | NA | NA | NA |
| 9269v20141116 | hypothetical protein | 288 | 288 | 1347 | NA | NA | NA | NA |
| 9270v20141116 | peptidase M19 | 289 | 289 | 1348 | NA | NA | NA | NA |
| 9271v20141116 | hypothetical protein | 1349 | 290 | 1349 | NA | NA | NA | NA |
| 9278v20141116 | hypothetical protein | 294 | 294 | 1353 | NA | NA | NA | NA |
| 9281v20141116 | glycosyl transferase family 1 | 296 | 296 | 1355 | NA | NA | NA | NA |
| 9282v20141116 | substrate-binding protein | 297 | 297 | NA | 2280 | NA | NA | NA |

TABLE 7-continued

Orthologous Gene Groups

| Unique Ortholog Group Identifier | Annotation | Reference. Ortholog SEQ ID NO: | NLS0017 Ortholog SEQ ID NO: | NLS0020 Ortholog SEQ ID NO: | NLS0037 Ortholog SEQ ID NO: | NLS0042 Ortholog SEQ ID NO: | NLS0065 Ortholog SEQ ID NO: | NLS0066 Ortholog SEQ ID NO: |
|---|---|---|---|---|---|---|---|---|
| 9283v20141116 | integral membrane sensor hybrid histidine kinase | 1356 | 298 | 1356 | NA | NA | NA | NA |
| 9284v20141116 | acyltransferase 3 | 299 | 299 | 1357 | NA | NA | NA | NA |
| 9290v20141116 | diguanylate cyclase | 300 | 300 | NA | NA | NA | NA | 4245 |
| 9291v20141116 | hypothetical protein | 301 | 301 | NA | 2281 | NA | NA | NA |
| 9292v20141116 | hypothetical protein | 302 | 302 | NA | 2282 | NA | NA | NA |
| 9295v20141116 | hypothetical protein | 303 | 303 | 1358 | NA | NA | NA | NA |
| 9297v20141116 | hypothetical protein | 1359 | 304 | 1359 | NA | NA | NA | NA |
| 9298v20141116 | hypothetical protein Mrad2831_0240 | 306 | 306 | 1360 | NA | NA | NA | NA |
| 9300v20141116 | nitrate ABC transporter ATP-binding protein | 307 | 307 | 1361 | NA | NA | NA | NA |
| 9309v20141116 | XRE family transcriptional regulator | 4246 | 310 | NA | NA | NA | NA | 4246 |
| 9311v20141116 | Hypothetical protein | 311 | 311 | 1362 | NA | NA | NA | NA |
| 9313v20141116 | hypothetical protein | 1363 | 312 | 1363 | NA | NA | NA | NA |
| 9315v20141116 | hypothetical protein | 313 | 313 | 1364 | NA | NA | NA | NA |
| 9321v20141116 | nucleotidyltransferase | 315 | 315 | 1366 | NA | NA | NA | NA |
| 9331v20141116 | PadR family transcriptional regulator | 317 | 317 | 1368 | NA | NA | NA | NA |
| 9347v20141116 | ABC transporter inner membrane protein | 2994 | NA | 1373 | NA | 2994 | NA | NA |
| 9348v20141116 | hypothetical protein | 4247 | NA | 1374 | NA | NA | NA | 4247 |
| 9467v20141116 | hypothetical protein | 2287 | NA | NA | 2287 | NA | NA | 4253 |
| 9504v20141116 | hypothetical protein Mnod_4882 | 3674 | NA | NA | NA | 3007 | 3674 | NA |
| 9669v20141116 | Hypothetical protein | 1376 | 319 | 1376 | NA | NA | NA | NA |
| 9675v20141116 | conserved hypothetical protein | 3017 | NA | NA | NA | 3017 | 3676 | NA |
| 9680v20141116 | NUDIX hydrolase | 322 | 322 | 1377 | NA | NA | NA | NA |
| 9687v20141116 | polysaccharide biosynthesis protein | 323 | 323 | 1378 | NA | NA | NA | NA |
| 9689v20141116 | fumarylacetoacetate (FAA) hydrolase | 324 | 324 | 1380 | NA | NA | NA | NA |
| 9690v20141116 | hypothetical protein Mrad2831_3421 | 325 | 325 | 1381 | NA | NA | NA | NA |
| 9692v20141116 | muconolactone delta-isomerase | 327 | 327 | 1382 | NA | NA | NA | NA |
| 9693v20141116 | shkimate dehydrogenase | 328 | 328 | 1383 | NA | NA | NA | NA |
| 9694v20141116 | alcohol dehydrogenase | 329 | 329 | 1384 | NA | NA | NA | NA |
| 9695v20141116 | TadE family protein | 330 | 330 | 1385 | NA | NA | NA | NA |
| 9696v20141116 | hypothetical protein | 331 | 331 | 1386 | NA | NA | NA | NA |
| 9698v20141116 | hypothetical protein | 332 | 332 | 1388 | NA | NA | NA | NA |
| 9701v20141116 | membrane protein | 333 | 333 | 1389 | NA | NA | NA | NA |
| 9702v20141116 | MFS transporter | 334 | 334 | 1390 | NA | NA | NA | NA |
| 9703v20141116 | Transcriptional regulator GntR family | 335 | 335 | 1391 | NA | NA | NA | NA |
| 9707v20141116 | hypothetical protein | 336 | 336 | 1392 | NA | NA | NA | NA |
| 9708v20141116 | phosphate ABC transporter substrate-binding protein | 337 | 337 | 1393 | NA | NA | NA | NA |
| 9709v20141116 | ferredoxin | 338 | 338 | 1394 | NA | NA | NA | NA |
| 9710v20141116 | hypothetical protein Mrad2831_0220 | 339 | 339 | 1395 | NA | NA | NA | NA |
| 9712v20141116 | hypothetical protein | 340 | 340 | 1396 | NA | NA | NA | NA |
| 9717v20141116 | GntR family transcriptional regulator | 1397 | 342 | 1397 | NA | NA | NA | NA |
| 9718v20141116 | hypothetical protein | 1398 | 343 | 1398 | NA | NA | NA | NA |
| 9719v20141116 | monooxygenase FAD-binding protein | 344 | 344 | 1400 | NA | NA | NA | NA |
| 9720v20141116 | hypothetical protein Mrad2831_1283 | 345 | 345 | 1401 | NA | NA | NA | NA |
| 9725v20141116 | hypothetical protein | 1402 | 347 | 1402 | NA | NA | NA | NA |
| 9727v20141116 | hypothetical protein | 348 | 348 | 1403 | NA | NA | NA | NA |
| 9728v20141116 | hypothetical protein | 349 | 349 | 1404 | NA | NA | NA | NA |
| 9730v20141116 | hypothetical protein | 350 | 350 | 1405 | NA | NA | NA | NA |
| 9731v20141116 | amidase | 351 | 351 | 1406 | NA | NA | NA | NA |
| 9732v20141116 | hypothetical protein | 352 | 352 | 1407 | NA | NA | NA | NA |

TABLE 7-continued

Orthologous Gene Groups

| Unique Ortholog Group Identifier | Annotation | Reference. Ortholog SEQ ID NO: | NLS0017 Ortholog SEQ ID NO: | NLS0020 Ortholog SEQ ID NO: | NLS0037 Ortholog SEQ ID NO: | NLS0042 Ortholog SEQ ID NO: | NLS0065 Ortholog SEQ ID NO: | NLS0066 Ortholog SEQ ID NO: |
|---|---|---|---|---|---|---|---|---|
| 9735v20141116 | hypothetical protein | 353 | 353 | 1408 | NA | NA | NA | NA |
| 9736v20141116 | methyl-accepting chemotaxis protein | 1409 | NA | 1409 | NA | NA | NA | 4279 |
| 9739v20141116 | hypothetical protein | 354 | 354 | 1410 | NA | NA | NA | NA |
| 9744v20141116 | hypothetical protein | 355 | 355 | 1411 | NA | NA | NA | NA |
| 9745v20141116 | alpha/beta hydrolase fold protein | 356 | 356 | 1413 | NA | NA | NA | NA |
| 9749v20141116 | hypothetical protein Mrad2831_1349 | 357 | 357 | 1414 | NA | NA | NA | NA |
| 9750v20141116 | carbon monoxide dehydrogenase | 358 | 358 | 1415 | NA | NA | NA | NA |
| 9751v20141116 | hypothetical protein | 1416 | 359 | 1416 | NA | NA | NA | NA |
| 9752v20141116 | glyoxalase | 360 | 360 | 1417 | NA | NA | NA | NA |
| 9754v20141116 | hypothetical protein | 1418 | 361 | 1418 | NA | NA | NA | NA |
| 9759v20141116 | hypothetical protein | 366 | 366 | NA | 2291 | NA | NA | NA |
| 9761v20141116 | UDP-glucose 6-dehydrogenase | 367 | 367 | 1420 | NA | NA | NA | NA |
| 9763v20141116 | Hypothetical protein | 369 | 369 | 1421 | NA | NA | NA | NA |
| 9766v20141116 | LysR family transcriptional regulator | 370 | 370 | 1422 | NA | NA | NA | NA |
| 9769v20141116 | glutathione S-transferase | 371 | 371 | 1423 | NA | NA | NA | NA |
| 9776v20141116 | hypothetical protein Msil_2170 | 4282 | NA | NA | NA | 3019 | NA | 4282 |
| 9778v20141116 | peptidase S8 | 1425 | 375 | 1425 | NA | NA | NA | NA |
| 9787v20141116 | LuxR family transcriptional regulator | 377 | 377 | 1427 | NA | NA | NA | NA |
| 9789v20141116 | hypothetical protein | 378 | 378 | 1428 | NA | NA | NA | NA |
| 9790v20141116 | hypothetical protein | 379 | 379 | 1429 | NA | NA | NA | NA |
| 9791v20141116 | hypothetical protein | 380 | 380 | 1430 | NA | NA | NA | NA |
| 9796v20141116 | cyclic nucleotide-binding protein | 1431 | 382 | 1431 | NA | NA | NA | NA |
| 9802v20141116 | hypothetical protein Mrad2831_5170 | 3679 | NA | 1432 | NA | NA | 3679 | NA |
| 9804v20141116 | Holliday junction ATP-dependent DNA helicase | 4283 | NA | 1433 | NA | NA | NA | 4283 |
| 9989v20141116 | Hypothetical protein | 2297 | NA | NA | 2297 | NA | NA | 4288 |
| 10005v20141116 | Hypothetical protein | 4289 | NA | NA | NA | NA | 3684 | 4289 |
| 10053v20141116 | hypothetical protein Mchl_4474 | 3033 | NA | NA | NA | 3033 | 3690 | NA |
| 10058v20141116 | hypothetical protein Mnod_7738 | 3039 | NA | NA | NA | 3039 | NA | 4296 |
| 10065v20141116 | NAD-dependent malic enzyme mitochondrial | 4302 | NA | NA | NA | NA | 3691 | 4302 |
| 10194v20141116 | RTX toxins and related Ca2+-binding protein | 385 | 385 | NA | NA | NA | NA | 4331 |
| 10195v20141116 | hypothetical protein | 386 | 386 | 1440 | NA | NA | NA | NA |
| 10216v20141116 | hypothetical protein | 388 | 388 | 1442 | NA | NA | NA | NA |
| 10219v20141116 | hypothetical protein | 390 | 390 | 1443 | NA | NA | NA | NA |
| 10247v20141116 | hypothetical protein | 395 | 395 | 1450 | NA | NA | NA | NA |
| 10250v20141116 | hypothetical protein | 1451 | 397 | 1451 | NA | NA | NA | NA |
| 10251v20141116 | hypothetical protein | 398 | 398 | 1452 | NA | NA | NA | NA |
| 10252v20141116 | hypothetical protein | 399 | 399 | 1453 | NA | NA | NA | NA |
| 10253v20141116 | histidine kinase | 400 | 400 | 1454 | NA | NA | NA | NA |
| 10254v20141116 | hypothetical protein Mnod_1661 | 401 | 401 | 1455 | NA | NA | NA | NA |
| 10255v20141116 | peroxidase | 402 | 402 | 1456 | NA | NA | NA | NA |
| 10256v20141116 | sn-glycerol-3-phosphate transporter | 1457 | 403 | 1457 | NA | NA | NA | NA |
| 10257v20141116 | hypothetical protein | 1458 | 404 | 1458 | NA | NA | NA | NA |
| 10258v20141116 | acyl-CoA dehydrogenase | 405 | 405 | 1459 | NA | NA | NA | NA |
| 10259v20141116 | IclR family transcriptional regulator | 406 | 406 | 1460 | NA | NA | NA | NA |
| 10260v20141116 | aldehyde dehydrogenase | 407 | 407 | 1461 | NA | NA | NA | NA |
| 10261v20141116 | Dihydrodipicolinate synthase | 408 | 408 | 1462 | NA | NA | NA | NA |
| 10264v20141116 | hypothetical protein | 410 | 410 | 1464 | NA | NA | NA | NA |

TABLE 7-continued

Orthologous Gene Groups

| Unique Ortholog Group Identifier | Annotation | Reference. Ortholog SEQ ID NO: | NLS0017 Ortholog SEQ ID NO: | NLS0020 Ortholog SEQ ID NO: | NLS0037 Ortholog SEQ ID NO: | NLS0042 Ortholog SEQ ID NO: | NLS0065 Ortholog SEQ ID NO: | NLS0066 Ortholog SEQ ID NO: |
|---|---|---|---|---|---|---|---|---|
| 10265v20141116 | None | 411 | 411 | 1465 | NA | NA | NA | NA |
| 10266v20141116 | hypothetical protein | 412 | 412 | 1466 | NA | NA | NA | NA |
| 10268v20141116 | hypothetical protein Atu3845 | 413 | 413 | 1467 | NA | NA | NA | NA |
| 10269v20141116 | hypothetical protein | 414 | 414 | 1468 | NA | NA | NA | NA |
| 10272v20141116 | hypothetical protein | 1469 | 415 | 1469 | NA | NA | NA | NA |
| 10277v20141116 | TetR family-transcriptional regulator | 417 | 417 | 1470 | NA | NA | NA | NA |
| 10278v20141116 | hypothetical protein | 418 | 418 | 1471 | NA | NA | NA | NA |
| 10280v20141116 | hypothetical protein MexAM1_META2p1146 | 1473 | 420 | 1473 | NA | NA | NA | NA |
| 10282v20141116 | hypothetical protein Mrad2831_4849 | 421 | 421 | 1474 | NA | NA | NA | NA |
| 10283v20141116 | citrate synthase | 422 | 422 | 1475 | NA | NA | NA | NA |
| 10284v20141116 | oxidoreductase | 423 | 423 | 1476 | NA | NA | NA | NA |
| 10285v20141116 | hypothetical protein | 424 | 424 | 1477 | NA | NA | NA | NA |
| 10286v20141116 | hypothetical protein | 1478 | 425 | 1478 | NA | NA | NA | NA |
| 10287v20141116 | major facilitator superfamily protein | 426 | 426 | 1479 | NA | NA | NA | NA |
| 10290v20141116 | hypothetical protein | 1480 | 427 | 1480 | NA | NA | NA | NA |
| 10291v20141116 | MFS transporter | 428 | 428 | 1481 | NA | NA | NA | NA |
| 10292v20141116 | aldehyde dehydrogenase | 429 | 429 | 1482 | NA | NA | NA | NA |
| 10293v20141116 | GntR family transcriptional regulator | 430 | 430 | 1483 | NA | NA | NA | NA |
| 10294v20141116 | thioesterase | 431 | 431 | 1484 | NA | NA | NA | NA |
| 10295v20141116 | hypothetical protein | 432 | 432 | 1485 | NA | NA | NA | NA |
| 10296v20141116 | hypothetical protein | 433 | 433 | 1486 | NA | NA | NA | NA |
| 10298v20141116 | hypothetical protein | 1487 | 434 | 1487 | NA | NA | NA | NA |
| 10299v20141116 | hypothetical protein | 435 | 435 | 1488 | NA | NA | NA | NA |
| 10300v20141116 | MFS transporter | 436 | 436 | 1489 | NA | NA | NA | NA |
| 10301v20141116 | crotonase | 437 | 437 | 1490 | NA | NA | NA | NA |
| 10302v20141116 | AMP-dependent synthetase and ligase | 438 | 438 | 1491 | NA | NA | NA | NA |
| 10303v20141116 | (2Fe—2S)-binding domain-containing protein | 439 | 439 | 1492 | NA | NA | NA | NA |
| 10304v20141116 | transcriptional regulator | 440 | 440 | 1493 | NA | NA | NA | NA |
| 10305v20141116 | hydrolase | 441 | 441 | 1494 | NA | NA | NA | NA |
| 10306v20141116 | twin-arginine translocation pathway signal | 1495 | 442 | 1495 | NA | NA | NA | NA |
| 10307v20141116 | hypothetical protein | 443 | 443 | 1496 | NA | NA | NA | NA |
| 10309v20141116 | hypothetical protein | 444 | 444 | 1497 | NA | NA | NA | NA |
| 10310v20141116 | hypothetical protein | 445 | 445 | 1498 | NA | NA | NA | NA |
| 10313v20141116 | hypothetical protein | 446 | 446 | 1499 | NA | NA | NA | NA |
| 10315v20141116 | hypothetical protein | 1500 | 447 | 1500 | NA | NA | NA | NA |
| 10316v20141116 | group 1 glycosyl transferase | 448 | 448 | 1501 | NA | NA | NA | NA |
| 10317v20141116 | group 1 glycosyl transferase | 449 | 449 | 1502 | NA | NA | NA | NA |
| 10318v20141116 | non-specific protein-tyrosine kinase | 450 | 450 | 1503 | NA | NA | NA | NA |
| 10319v20141116 | hypothetical protein | 1504 | 451 | 1504 | NA | NA | NA | NA |
| 10323v20141116 | AraC family transcriptional regulator | 452 | 452 | NA | 2306 | NA | NA | NA |
| 10324v20141116 | hypothetical protein | 2307 | 453 | NA | 2307 | NA | NA | NA |
| 10326v20141116 | aminotransferase class I/II | 2308 | 454 | NA | 2308 | NA | NA | NA |
| 10328v20141116 | hypothetical protein | 455 | 455 | 1506 | NA | NA | NA | NA |
| 10331v20141116 | acyl-CoA dehydrogenase | 458 | 458 | 1508 | NA | NA | NA | NA |
| 10334v20141116 | hypothetical protein | 459 | 459 | 1509 | NA | NA | NA | NA |
| 10335v20141116 | hypothetical protein Mnod_7733 | 460 | 460 | NA | NA | NA | NA | 4342 |
| 10337v20141116 | hypothetical protein | 1510 | 462 | 1510 | NA | NA | NA | NA |
| 10341v20141116 | glyoxalase/bleomycin resistance protein/dioxygenase | 463 | 463 | 1511 | NA | NA | NA | NA |

TABLE 7-continued

Orthologous Gene Groups

| Unique Ortholog Group Identifier | Annotation | Reference. Ortholog SEQ ID NO: | NLS0017 Ortholog SEQ ID NO: | NLS0020 Ortholog SEQ ID NO: | NLS0037 Ortholog SEQ ID NO: | NLS0042 Ortholog SEQ ID NO: | NLS0065 Ortholog SEQ ID NO: | NLS0066 Ortholog SEQ ID NO: |
|---|---|---|---|---|---|---|---|---|
| 10343v20141116 | CitMHS family citrate/H+ symporter | 1512 | 464 | 1512 | NA | NA | NA | NA |
| 10344v20141116 | ABC transporter substrate-binding protein | 465 | 465 | 1513 | NA | NA | NA | NA |
| 10345v20141116 | beta-lactamase | 466 | 466 | 1514 | NA | NA | NA | NA |
| 10346v20141116 | endoribonuclease L-PSP | 1515 | 467 | 1515 | NA | NA | NA | NA |
| 10347v20141116 | hypothetical protein Mrad2831_4429 | 1516 | 468 | 1516 | NA | NA | NA | NA |
| 10349v20141116 | hypothetical protein | 1518 | 470 | 1518 | NA | NA | NA | NA |
| 10350v20141116 | hypothetical protein | 1519 | 471 | 1519 | NA | NA | NA | NA |
| 10354v20141116 | Hypothetical protein | 4343 | 472 | NA | NA | NA | NA | 4343 |
| 10356v20141116 | Hypothetical protein | 473 | 473 | 1520 | NA | NA | NA | NA |
| 10358v20141116 | hypothetical protein | 474 | 474 | NA | NA | NA | NA | 4345 |
| 10361v20141116 | hypothetical protein Mrad2831_5665 | 1522 | NA | 1522 | NA | NA | NA | 4346 |
| 10655v20141116 | hypothetical protein | 2312 | NA | NA | 2312 | 3049 | NA | NA |
| 10656v20141116 | hypothetical protein Mrad2831_5208 | 2313 | NA | NA | 2313 | 3050 | NA | NA |
| 10675v20141116 | transposase | 3697 | NA | NA | 2314 | NA | 3697 | NA |
| 10688v20141116 | None | 2316 | NA | NA | 2316 | NA | NA | 4354 |
| 10941v20141116 | hypothetical protein | 1529 | 475 | 1529 | NA | NA | NA | NA |
| 10942v20141116 | peptidoglycan-binding protein | 478 | 478 | 1530 | NA | NA | NA | NA |
| 10980v20141116 | hypothetical protein | 1534 | 479 | 1534 | NA | NA | NA | NA |
| 10994v20141116 | hypothetical protein | 1535 | 480 | 1535 | NA | NA | NA | NA |
| 10999v20141116 | hypothetical protein | 482 | 482 | 1536 | NA | NA | NA | NA |
| 11000v20141116 | hypothetical protein | 483 | 483 | 1537 | NA | NA | NA | NA |
| 11001v20141116 | ABC transporter permease | 484 | 484 | 1538 | NA | NA | NA | NA |
| 11002v20141116 | hypothetical protein | 485 | 485 | 1539 | NA | NA | NA | NA |
| 11003v20141116 | 3-ketoacyl-ACP reductase | 486 | 486 | 1540 | NA | NA | NA | NA |
| 11004v20141116 | branched-chain amino acid ABC transporter ATP-binding protein | 487 | 487 | 1541 | NA | NA | NA | NA |
| 11005v20141116 | NADPH quinone oxidoreductase | 488 | 488 | 1542 | NA | NA | NA | NA |
| 11006v20141116 | hypothetical protein | 489 | 489 | 1543 | NA | NA | NA | NA |
| 11007v20141116 | hypothetical protein | 490 | 490 | 1544 | NA | NA | NA | NA |
| 11008v20141116 | aliphatic amidase expression-regulating protein AmiC | 491 | 491 | 1545 | NA | NA | NA | NA |
| 11009v20141116 | hypothetical protein | 492 | 492 | 1546 | NA | NA | NA | NA |
| 11010v20141116 | short-chain dehydrogenase/reductase SDR | 493 | 493 | 1547 | NA | NA | NA | NA |
| 11013v20141116 | hypothetical protein | 494 | 494 | 1548 | NA | NA | NA | NA |
| 11014v20141116 | hypothetical protein | 495 | 495 | 1549 | NA | NA | NA | NA |
| 11015v20141116 | hypothetical protein | 496 | 496 | 1550 | NA | NA | NA | NA |
| 11016v20141116 | ECF subfamily RNA polymerase sigma-24 factor | 497 | 497 | 1551 | NA | NA | NA | NA |
| 11019v20141116 | major facilitator transporter | 498 | 498 | 1552 | NA | NA | NA | NA |
| 11022v20141116 | hypothetical protein Mrad2831_2880 | 499 | 499 | 1553 | NA | NA | NA | NA |
| 11023v20141116 | hypothetical protein | 1554 | 500 | 1554 | NA | NA | NA | NA |
| 11024v20141116 | hypothetical protein | 501 | 501 | 1555 | NA | NA | NA | NA |
| 11025v20141116 | hypothetical protein | 502 | 502 | 1556 | NA | NA | NA | NA |
| 11026v20141116 | None | 503 | 503 | 1557 | NA | NA | NA | NA |
| 11027v20141116 | helicase | 504 | 504 | 1558 | NA | NA | NA | NA |
| 11029v20141116 | Hypothetical protein | 1559 | 506 | 1559 | NA | NA | NA | NA |
| 11030v20141116 | Hypothetical protein | 1560 | 507 | 1560 | NA | NA | NA | NA |
| 11031v20141116 | hypothetical protein Mrad2831_3995 | 508 | 508 | 1561 | NA | NA | NA | NA |
| 11032v20141116 | hypothetical protein | 509 | 509 | 1562 | NA | NA | NA | NA |
| 11033v20141116 | hypothetical protein | 510 | 510 | 1563 | NA | NA | NA | NA |
| 11034v20141116 | hypothetical protein | 511 | 511 | 1564 | NA | NA | NA | NA |

TABLE 7-continued

Orthologous Gene Groups

| Unique Ortholog Group Identifier | Annotation | Reference. Ortholog SEQ ID NO: | NLS0017 Ortholog SEQ ID NO: | NLS0020 Ortholog SEQ ID NO: | NLS0037 Ortholog SEQ ID NO: | NLS0042 Ortholog SEQ ID NO: | NLS0065 Ortholog SEQ ID NO: | NLS0066 Ortholog SEQ ID NO: |
|---|---|---|---|---|---|---|---|---|
| 11035v20141116 | fatty acid hydroxylase | 512 | 512 | 1565 | NA | NA | NA | NA |
| 11036v20141116 | DNA-binding two-component response regulator | 513 | 513 | 1566 | NA | NA | NA | NA |
| 11037v20141116 | hypothetical protein | 514 | 514 | 1567 | NA | NA | NA | NA |
| 11038v20141116 | hypothetical protein | 515 | 515 | 1568 | NA | NA | NA | NA |
| 11040v20141116 | hypothetical protein Mrad2831_4848 | 516 | 516 | 1569 | NA | NA | NA | NA |
| 11041v20141116 | hypothetical protein Mrad2831_4850 | 517 | 517 | 1570 | NA | NA | NA | NA |
| 11042v20141116 | AraC family transcriptional regulator | 518 | 518 | 1571 | NA | NA | NA | NA |
| 11043v20141116 | MucR family transcriptional regulator | 1572 | 519 | 1572 | NA | NA | NA | NA |
| 11044v20141116 | hypothetical protein | 520 | 520 | 1573 | NA | NA | NA | NA |
| 11045v20141116 | hypothetical protein | 521 | 521 | 1574 | NA | NA | NA | NA |
| 11046v20141116 | hypothetical protein | 522 | 522 | 1575 | NA | NA | NA | NA |
| 11047v20141116 | hypothetical protein Mrad2831_4872 | 523 | 523 | 1576 | NA | NA | NA | NA |
| 11048v20141116 | MucR family transcriptional regulator | 524 | 524 | 1577 | NA | NA | NA | NA |
| 11049v20141116 | hypothetical protein | 525 | 525 | 1578 | NA | NA | NA | NA |
| 11050v20141116 | hypothetical protein | 526 | 526 | 1579 | NA | NA | NA | NA |
| 11051v20141116 | hypothetical protein | 1580 | 527 | 1580 | NA | NA | NA | NA |
| 11053v20141116 | hypothetical protein | 528 | 528 | 1581 | NA | NA | NA | NA |
| 11055v20141116 | hypothetical protein | 529 | 529 | 1582 | NA | NA | NA | NA |
| 11056v20141116 | hypothetical protein | 530 | 530 | 1583 | NA | NA | NA | NA |
| 11058v20141116 | CDP-diacylglycerol diphosphatase | 531 | 531 | 1584 | NA | NA | NA | NA |
| 11059v20141116 | hypothetical protein | 532 | 532 | 1585 | NA | NA | NA | NA |
| 11060v20141116 | hypothetical protein | 533 | 533 | 1586 | NA | NA | NA | NA |
| 11062v20141116 | hypothetical protein | 534 | 534 | 1587 | NA | NA | NA | NA |
| 11065v20141116 | hypothetical protein Mrad2831_4173 | 1588 | 535 | 1588 | NA | NA | NA | NA |
| 11066v20141116 | hypothetical protein | 536 | 536 | 1589 | NA | NA | NA | NA |
| 11067v20141116 | hypothetical protein | 1590 | 537 | 1590 | NA | NA | NA | NA |
| 11068v20141116 | hypothetical protein | 538 | 538 | 1591 | NA | NA | NA | NA |
| 11069v20141116 | hypothetical protein | 539 | 539 | 1592 | NA | NA | NA | NA |
| 11071v20141116 | hypothetical protein | 540 | 540 | 1593 | NA | NA | NA | NA |
| 11072v20141116 | hypothetical protein | 541 | 541 | 1594 | NA | NA | NA | NA |
| 11073v20141116 | hypothetical protein | 542 | 542 | 1595 | NA | NA | NA | NA |
| 11074v20141116 | hypothetical protein Mrad2831_2451 | 543 | 543 | 1596 | NA | NA | NA | NA |
| 11075v20141116 | hypothetical protein | 1597 | 544 | 1597 | NA | NA | NA | NA |
| 11077v20141116 | hypothetical protein Mrad2831_4594 | 545 | 545 | 1598 | NA | NA | NA | NA |
| 11078v20141116 | hypothetical protein Mrad2831_4604 | 546 | 546 | 1599 | NA | NA | NA | NA |
| 11079v20141116 | hypothetical protein | 547 | 547 | 1600 | NA | NA | NA | NA |
| 11082v20141116 | hypothetical protein | 548 | 548 | 1601 | NA | NA | NA | NA |
| 11083v20141116 | hypothetical protein | 549 | 549 | 1602 | NA | NA | NA | NA |
| 11085v20141116 | hypothetical protein | 550 | 550 | 1603 | NA | NA | NA | NA |
| 11086v20141116 | methyl-accepting chemotaxis sensory transducer | 1604 | 551 | 1604 | NA | NA | NA | NA |
| 11087v20141116 | hypothetical protein | 1605 | 552 | 1605 | NA | NA | NA | NA |
| 11090v20141116 | hypothetical protein | 1606 | 553 | 1606 | NA | NA | NA | NA |
| 11091v20141116 | hypothetical protein | 554 | 554 | 1607 | NA | NA | NA | NA |
| 11092v20141116 | putative transmembrane protein | 555 | 555 | 1608 | NA | NA | NA | NA |
| 11093v20141116 | hypothetical protein Mrad2831_5620 | 556 | 556 | 1609 | NA | NA | NA | NA |
| 11094v20141116 | hypothetical protein | 557 | 557 | 1610 | NA | NA | NA | NA |
| 11095v20141116 | hypothetical protein Mrad2831_5792 | 558 | 558 | 1611 | NA | NA | NA | NA |
| 11096v20141116 | hypothetical protein | 559 | 559 | 1612 | NA | NA | NA | NA |
| 11097v20141116 | hypothetical protein | 560 | 560 | 1613 | NA | NA | NA | NA |
| 11098v20141116 | hypothetical protein | 561 | 561 | 1614 | NA | NA | NA | NA |
| 11099v20141116 | hypothetical protein | 562 | 562 | 1615 | NA | NA | NA | NA |

TABLE 7-continued

Orthologous Gene Groups

| Unique Ortholog Group Identifier | Annotation | Reference. Ortholog SEQ ID NO: | NLS0017 Ortholog SEQ ID NO: | NLS0020 Ortholog SEQ ID NO: | NLS0037 Ortholog SEQ ID NO: | NLS0042 Ortholog SEQ ID NO: | NLS0065 Ortholog SEQ ID NO: | NLS0066 Ortholog SEQ ID NO: |
|---|---|---|---|---|---|---|---|---|
| 11100v20141116 | hypothetical protein | 563 | 563 | 1616 | NA | NA | NA | NA |
| 11101v20141116 | hypothetical protein | 564 | 564 | 1617 | NA | NA | NA | NA |
| 11102v20141116 | hypothetical protein | 565 | 565 | 1618 | NA | NA | NA | NA |
| 11103v20141116 | HxlR family transcriptional regulator | 566 | 566 | 1619 | NA | NA | NA | NA |
| 11105v20141116 | hypothetical protein Mrad2831_1263 | 567 | 567 | 1620 | NA | NA | NA | NA |
| 11106v20141116 | hypothetical protein Mrad2831_1264 | 568 | 568 | 1621 | NA | NA | NA | NA |
| 11108v20141116 | hypothetical protein | 569 | 569 | 1622 | NA | NA | NA | NA |
| 11109v20141116 | type III effector Hrp-dependent protein | 570 | 570 | 1623 | NA | NA | NA | NA |
| 11110v20141116 | hypothetical protein | 1624 | 571 | 1624 | NA | NA | NA | NA |
| 11114v20141116 | hypothetical protein | 573 | 573 | 1625 | NA | NA | NA | NA |
| 11117v20141116 | hypothetical protein | 574 | 574 | 1626 | NA | NA | NA | NA |
| 11118v20141116 | hypothetical protein | 575 | 575 | 1627 | NA | NA | NA | NA |
| 11119v20141116 | hypothetical protein | 1628 | 576 | 1628 | NA | NA | NA | NA |
| 11121v20141116 | hypothetical protein | 578 | 578 | 1630 | NA | NA | NA | NA |
| 11125v20141116 | hypothetical protein | 581 | 581 | 1631 | NA | NA | NA | NA |
| 11126v20141116 | hypothetical protein Mrad2831_4291 | 582 | 582 | 1632 | NA | NA | NA | NA |
| 11127v20141116 | hypothetical protein | 583 | 583 | 1633 | NA | NA | NA | NA |
| 11128v20141116 | putative aldo/keto reductase protein | 1634 | 584 | 1634 | NA | NA | NA | NA |
| 11129v20141116 | hypothetical protein Mrad2831_1223 | 585 | 585 | 1635 | NA | NA | NA | NA |
| 11130v20141116 | hypothetical protein | 586 | 586 | 1636 | NA | NA | NA | NA |
| 11131v20141116 | hypothetical protein | 587 | 587 | 1637 | NA | NA | NA | NA |
| 11134v20141116 | hypothetical protein | 589 | 589 | 1638 | NA | NA | NA | NA |
| 11136v20141116 | hypothetical protein Mrad2831_4454 | 590 | 590 | 1639 | NA | NA | NA | NA |
| 11137v20141116 | phosphoglycolate phosphatase | 1640 | 591 | 1640 | NA | NA | NA | NA |
| 11138v20141116 | substrate-binding protein | 592 | 592 | 1641 | NA | NA | NA | NA |
| 11139v20141116 | hypothetical protein | 1642 | 593 | 1642 | NA | NA | NA | NA |
| 11140v20141116 | FAD-dependent pyridine nucleotide-disulfide oxidoreductase | 1643 | 594 | 1643 | NA | NA | NA | NA |
| 11141v20141116 | hypothetical protein | 1644 | 595 | 1644 | NA | NA | NA | NA |
| 11142v20141116 | 5-oxopent-3-ene-1 2 5-tricarboxylate decarboxylase | 596 | 596 | 1645 | NA | NA | NA | NA |
| 11143v20141116 | hypothetical protein Mrad2831_1904 | 1646 | 597 | 1646 | NA | NA | NA | NA |
| 11149v20141116 | hypothetical protein | 600 | 600 | 1647 | NA | NA | NA | NA |
| 11150v20141116 | hypothetical protein Mrad2831_1911 | 601 | 601 | 1648 | NA | NA | NA | NA |
| 11151v20141116 | hypothetical protein | 602 | 602 | 1649 | NA | NA | NA | NA |
| 11152v20141116 | hypothetical protein | 603 | 603 | 1650 | NA | NA | NA | NA |
| 11153v20141116 | hypothetical protein | 604 | 604 | 1651 | NA | NA | NA | NA |
| 11154v20141116 | hypothetical protein | 605 | 605 | 1652 | NA | NA | NA | NA |
| 11155v20141116 | hypothetical protein | 606 | 606 | 1653 | NA | NA | NA | NA |
| 11156v20141116 | methyl-accepting chemotaxis sensory transducer | 1654 | 607 | 1654 | NA | NA | NA | NA |
| 11157v20141116 | hypothetical protein | 608 | 608 | 1655 | NA | NA | NA | NA |
| 11161v20141116 | MucR family transcriptional regulator | 610 | 610 | 1656 | NA | NA | NA | NA |
| 11162v20141116 | hypothetical protein | 611 | 611 | 1657 | NA | NA | NA | NA |
| 11164v20141116 | hypothetical protein | 612 | 612 | 1658 | NA | NA | NA | NA |
| 11165v20141116 | MarR family transcriptional regulator | 613 | 613 | 1659 | NA | NA | NA | NA |
| 11167v20141116 | capsule polysaccharide transporter | 614 | 614 | 1660 | NA | NA | NA | NA |
| 11168v20141116 | hypothetical protein | 615 | 615 | 1661 | NA | NA | NA | NA |
| 11169v20141116 | hypothetical protein | 616 | 616 | 1662 | NA | NA | NA | NA |

TABLE 7-continued

Orthologous Gene Groups

| Unique Ortholog Group Identifier | Annotation | Reference. Ortholog SEQ ID NO: | NLS0017 Ortholog SEQ ID NO: | NLS0020 Ortholog SEQ ID NO: | NLS0037 Ortholog SEQ ID NO: | NLS0042 Ortholog SEQ ID NO: | NLS0065 Ortholog SEQ ID NO: | NLS0066 Ortholog SEQ ID NO: |
|---|---|---|---|---|---|---|---|---|
| 11171v20141116 | hypothetical protein | 617 | 617 | 1663 | NA | NA | NA | NA |
| 11172v20141116 | hypothetical protein Mrad2831_1654 | 618 | 618 | 1664 | NA | NA | NA | NA |
| 11176v20141116 | hypothetical protein | 619 | 619 | 1665 | NA | NA | NA | NA |
| 11177v20141116 | hypothetical protein | 620 | 620 | 1666 | NA | NA | NA | NA |
| 11178v20141116 | hypothetical protein | 621 | 621 | 1667 | NA | NA | NA | NA |
| 11180v20141116 | hypothetical protein | 624 | 624 | 1668 | NA | NA | NA | NA |
| 11181v20141116 | hypothetical protein | 625 | 625 | 1669 | NA | NA | NA | NA |
| 11182v20141116 | hypothetical protein | 626 | 626 | 1670 | NA | NA | NA | NA |
| 11183v20141116 | hypothetical protein | 627 | 627 | 1671 | NA | NA | NA | NA |
| 11184v20141116 | hypothetical protein | 1672 | 628 | 1672 | NA | NA | NA | NA |
| 11185v20141116 | hypothetical protein | 1673 | 629 | 1673 | NA | NA | NA | NA |
| 11186v20141116 | hypothetical protein | 630 | 630 | 1674 | NA | NA | NA | NA |
| 11187v20141116 | hypothetical protein | 631 | 631 | 1675 | NA | NA | NA | NA |
| 11188v20141116 | GntR family transcriptional regulator | 1676 | 633 | 1676 | NA | NA | NA | NA |
| 11189v20141116 | hypothetical protein Mrad2831_2999 | 634 | 634 | 1677 | NA | NA | NA | NA |
| 11190v20141116 | hypothetical protein | 635 | 635 | 1678 | NA | NA | NA | NA |
| 11191v20141116 | Hypothetical protein | 1679 | 636 | 1679 | NA | NA | NA | NA |
| 11193v20141116 | haloacid dehalogenase | 637 | 637 | 1680 | NA | NA | NA | NA |
| 11196v20141116 | hypothetical protein | 1681 | 638 | 1681 | NA | NA | NA | NA |
| 11197v20141116 | Holliday junction DNA helicase RuvB | 639 | 639 | 1682 | NA | NA | NA | NA |
| 11198v20141116 | hypothetical protein partial | 640 | 640 | 1683 | NA | NA | NA | NA |
| 11199v20141116 | hypothetical protein | 641 | 641 | 1684 | NA | NA | NA | NA |
| 11200v20141116 | hypothetical protein | 642 | 642 | 1685 | NA | NA | NA | NA |
| 11201v20141116 | hypothetical protein | 643 | 643 | 1686 | NA | NA | NA | NA |
| 11203v20141116 | hypothetical protein Mrad2831_5411 | 1687 | 644 | 1687 | NA | NA | NA | NA |
| 11204v20141116 | hypothetical protein | 645 | 645 | 1688 | NA | NA | NA | NA |
| 11206v20141116 | glycosyl transferase family protein | 1689 | 646 | 1689 | NA | NA | NA | NA |
| 11207v20141116 | hypothetical protein | 1690 | 647 | 1690 | NA | NA | NA | NA |
| 11213v20141116 | hypothetical protein Mchl_1645 | 3075 | NA | 1692 | NA | 3075 | NA | NA |
| 11233v20141116 | None | 1706 | NA | 1706 | NA | NA | NA | 4407 |
| 11447v20141116 | None | 3088 | NA | NA | NA | 3088 | 3711 | NA |
| 11497v20141116 | None | 2323 | NA | NA | 2323 | NA | NA | 4420 |
| 11506v20141116 | amidase | 2324 | NA | NA | 2324 | NA | NA | 4422 |
| 11507v20141116 | ABC transporter ATP-binding protein | 4423 | NA | NA | 2325 | NA | NA | 4423 |
| 11508v20141116 | nitrate/sulfonate/bicarbonate ABC transporter periplasmic protein | 4424 | NA | NA | 2326 | NA | NA | 4424 |
| 11511v20141116 | None | 4425 | NA | NA | 2327 | NA | NA | 4425 |
| 11576v20141116 | hypothetical protein | 3103 | NA | NA | NA | 3103 | NA | 4436 |
| 12016v20141116 | hypothetical protein | 1708 | 651 | 1708 | NA | NA | NA | NA |
| 12018v20141116 | hypothetical protein | 653 | 653 | 1709 | NA | NA | NA | NA |
| 12020v20141116 | hypothetical protein | 654 | 654 | 1710 | NA | NA | NA | NA |
| 12021v20141116 | transcriptional regulator | 655 | 655 | 1711 | NA | NA | NA | NA |
| 12022v20141116 | hypothetical protein Mrad2831_0355 | 656 | 656 | 1712 | NA | NA | NA | NA |
| 12025v20141116 | hypothetical protein | 658 | 658 | 1713 | NA | NA | NA | NA |
| 12026v20141116 | hypothetical protein | 659 | 659 | 1714 | NA | NA | NA | NA |
| 12027v20141116 | hypothetical protein | 660 | 660 | 1715 | NA | NA | NA | NA |
| 12028v20141116 | hypothetical protein | 661 | 661 | 1716 | NA | NA | NA | NA |
| 12029v20141116 | hypothetical protein | 662 | 662 | 1717 | NA | NA | NA | NA |
| 12030v20141116 | hypothetical protein | 663 | 663 | 1718 | NA | NA | NA | NA |
| 12031v20141116 | hypothetical protein | 664 | 664 | 1719 | NA | NA | NA | NA |
| 12032v20141116 | hypothetical protein | 665 | 665 | 1720 | NA | NA | NA | NA |
| 12033v20141116 | hypothetical protein | 666 | 666 | 1721 | NA | NA | NA | NA |
| 12034v20141116 | MFS transporter | 667 | 667 | 1722 | NA | NA | NA | NA |
| 12035v20141116 | 3-hydroxyisobutyrate dehydrogenase | 668 | 668 | 1723 | NA | NA | NA | NA |
| 12036v20141116 | gamma-carboxymuconolactone decarboxylase | 669 | 669 | 1724 | NA | NA | NA | NA |
| 12037v20141116 | None | 670 | 670 | 1725 | NA | NA | NA | NA |

TABLE 7-continued

Orthologous Gene Groups

| Unique Ortholog Group Identifier | Annotation | Reference. Ortholog SEQ ID NO: | NLS0017 Ortholog SEQ ID NO: | NLS0020 Ortholog SEQ ID NO: | NLS0037 Ortholog SEQ ID NO: | NLS0042 Ortholog SEQ ID NO: | NLS0065 Ortholog SEQ ID NO: | NLS0066 Ortholog SEQ ID NO: |
|---|---|---|---|---|---|---|---|---|
| 12039v20141116 | hypothetical protein | 671 | 671 | 1726 | NA | NA | NA | NA |
| 12040v20141116 | hypothetical protein | 1727 | 672 | 1727 | NA | NA | NA | NA |
| 12041v20141116 | None | 673 | 673 | 1728 | NA | NA | NA | NA |
| 12043v20141116 | None | 674 | 674 | 1729 | NA | NA | NA | NA |
| 12044v20141116 | None | 675 | 675 | 1730 | NA | NA | NA | NA |
| 12045v20141116 | None | 676 | 676 | 1731 | NA | NA | NA | NA |
| 12046v20141116 | None | 677 | 677 | 1732 | NA | NA | NA | NA |
| 12047v20141116 | None | 678 | 678 | 1733 | NA | NA | NA | NA |
| 12048v20141116 | None | 679 | 679 | 1734 | NA | NA | NA | NA |
| 12049v20141116 | hypothetical protein | 680 | 680 | 1735 | NA | NA | NA | NA |
| 12050v20141116 | hypothetical protein | 681 | 681 | 1736 | NA | NA | NA | NA |
| 12051v20141116 | None | 682 | 682 | 1737 | NA | NA | NA | NA |
| 12052v20141116 | None | 683 | 683 | 1738 | NA | NA | NA | NA |
| 12053v20141116 | hypothetical protein | 684 | 684 | 1739 | NA | NA | NA | NA |
| 12054v20141116 | None | 685 | 685 | 1740 | NA | NA | NA | NA |
| 12055v20141116 | hypothetical protein | 1741 | 686 | 1741 | NA | NA | NA | NA |
| 12056v20141116 | hypothetical protein | 687 | 687 | 1742 | NA | NA | NA | NA |
| 12057v20141116 | acetyltransferase GNAT family | 688 | 688 | 1743 | NA | NA | NA | NA |
| 12058v20141116 | hypothetical protein Msil_3108 | 689 | 689 | 1744 | NA | NA | NA | NA |
| 12059v20141116 | hypothetical protein | 690 | 690 | 1745 | NA | NA | NA | NA |
| 12060v20141116 | hypothetical protein | 691 | 691 | 1746 | NA | NA | NA | NA |
| 12061v20141116 | None | 692 | 692 | 1747 | NA | NA | NA | NA |
| 12062v20141116 | hypothetical protein | 693 | 693 | 1748 | NA | NA | NA | NA |
| 12063v20141116 | hypothetical protein | 694 | 694 | 1749 | NA | NA | NA | NA |
| 12064v20141116 | hypothetical protein | 695 | 695 | 1750 | NA | NA | NA | NA |
| 12065v20141116 | None | 696 | 696 | 1751 | NA | NA | NA | NA |
| 12066v20141116 | hypothetical protein | 697 | 697 | 1752 | NA | NA | NA | NA |
| 12067v20141116 | hypothetical protein AZOLI_2591 | 698 | 698 | 1753 | NA | NA | NA | NA |
| 12068v20141116 | None | 699 | 699 | 1754 | NA | NA | NA | NA |
| 12071v20141116 | None | 702 | 702 | NA | NA | NA | NA | 4635 |
| 12073v20141116 | hypothetical protein | 703 | 703 | 1755 | NA | NA | NA | NA |
| 12074v20141116 | hypothetical protein | 704 | 704 | 1756 | NA | NA | NA | NA |
| 12076v20141116 | hypothetical protein | 1757 | 705 | 1757 | NA | NA | NA | NA |
| 12077v20141116 | cystathionine beta-lyase | 706 | 706 | 1758 | NA | NA | NA | NA |
| 12078v20141116 | hypothetical protein | 707 | 707 | 1759 | NA | NA | NA | NA |
| 12079v20141116 | hypothetical protein | 708 | 708 | 1760 | NA | NA | NA | NA |
| 12080v20141116 | None | 709 | 709 | 1761 | NA | NA | NA | NA |
| 12081v20141116 | prevent-host-death protein | 710 | 710 | 1762 | NA | NA | NA | NA |
| 12082v20141116 | hypothetical protein | 711 | 711 | 1763 | NA | NA | NA | NA |
| 12083v20141116 | ABC transporter permease | 712 | 712 | 1764 | NA | NA | NA | NA |
| 12085v20141116 | None | 713 | 713 | 1765 | NA | NA | NA | NA |
| 12086v20141116 | hypothetical protein | 1766 | 714 | 1766 | NA | NA | NA | NA |
| 12087v20141116 | hypothetical protein | 715 | 715 | 1767 | NA | NA | NA | NA |
| 12089v20141116 | histone acetyltransferase | 716 | 716 | 1768 | NA | NA | NA | NA |
| 12091v20141116 | TetR family transcriptional regulator | 717 | 717 | 1769 | NA | NA | NA | NA |
| 12092v20141116 | None | 718 | 718 | 1770 | NA | NA | NA | NA |
| 12093v20141116 | hypothetical protein | 1771 | 719 | 1771 | NA | NA | NA | NA |
| 12095v20141116 | hypothetical protein | 720 | 720 | 1772 | NA | NA | NA | NA |
| 12097v20141116 | hypothetical protein | 722 | 722 | 1773 | NA | NA | NA | NA |
| 12099v20141116 | hypothetical protein Mrad2831_4561 | 723 | 723 | 1774 | NA | NA | NA | NA |
| 12100v20141116 | hypothetical protein | 724 | 724 | 1775 | NA | NA | NA | NA |
| 12103v20141116 | endo-1 3-beta-glucanase | 725 | 725 | 1776 | NA | NA | NA | NA |
| 12104v20141116 | hypothetical protein | 726 | 726 | 1777 | NA | NA | NA | NA |
| 12105v20141116 | hypothetical protein | 727 | 727 | 1778 | NA | NA | NA | NA |
| 12106v20141116 | hypothetical protein | 728 | 728 | 1779 | NA | NA | NA | NA |
| 12107v20141116 | hypothetical protein | 729 | 729 | 1780 | NA | NA | NA | NA |
| 12108v20141116 | hypothetical protein | 730 | 730 | 1781 | NA | NA | NA | NA |
| 12110v20141116 | hypothetical protein | 1782 | 731 | 1782 | NA | NA | NA | NA |
| 12111v20141116 | hypothetical protein | 732 | 732 | 1783 | NA | NA | NA | NA |
| 12112v20141116 | hypothetical protein | 733 | 733 | 1784 | NA | NA | NA | NA |
| 12113v20141116 | hypothetical protein | 734 | 734 | 1785 | NA | NA | NA | NA |
| 12115v20141116 | hypothetical protein | 735 | 735 | 1786 | NA | NA | NA | NA |

TABLE 7-continued

Orthologous Gene Groups

| Unique Ortholog Group Identifier | Annotation | Reference. Ortholog SEQ ID NO: | NLS0017 Ortholog SEQ ID NO: | NLS0020 Ortholog SEQ ID NO: | NLS0037 Ortholog SEQ ID NO: | NLS0042 Ortholog SEQ ID NO: | NLS0065 Ortholog SEQ ID NO: | NLS0066 Ortholog SEQ ID NO: |
|---|---|---|---|---|---|---|---|---|
| 12116v20141116 | hypothetical protein | 736 | 736 | 1787 | NA | NA | NA | NA |
| 12117v20141116 | hypothetical protein Mrad2831_2464 | 737 | 737 | 1788 | NA | NA | NA | NA |
| 12118v20141116 | hypothetical protein | 738 | 738 | 1789 | NA | NA | NA | NA |
| 12119v20141116 | hypothetical protein Mrad2831_4587 | 739 | 739 | 1790 | NA | NA | NA | NA |
| 12121v20141116 | hypothetical protein Mrad2831_4596 | 740 | 740 | 1791 | NA | NA | NA | NA |
| 12122v20141116 | aldehyde dehydrogenase | 741 | 741 | 1792 | NA | NA | NA | NA |
| 12123v20141116 | hypothetical protein | 742 | 742 | 1793 | NA | NA | NA | NA |
| 12124v20141116 | hypothetical protein | 743 | 743 | 1794 | NA | NA | NA | NA |
| 12125v20141116 | transcriptional regulator | 744 | 744 | 1795 | NA | NA | NA | NA |
| 12126v20141116 | hypothetical protein | 745 | 745 | 1796 | NA | NA | NA | NA |
| 12127v20141116 | hypothetical protein | 746 | 746 | 1797 | NA | NA | NA | NA |
| 12129v20141116 | hypothetical protein | 747 | 747 | 1798 | NA | NA | NA | NA |
| 12130v20141116 | coenzyme PQQ biosynthesis protein A | 748 | 748 | 1799 | NA | NA | NA | NA |
| 12132v20141116 | hypothetical protein | 749 | 749 | 1800 | NA | NA | NA | NA |
| 12133v20141116 | None | 750 | 750 | 1801 | NA | NA | NA | NA |
| 12134v20141116 | hypothetical protein | 751 | 751 | 1802 | NA | NA | NA | NA |
| 12135v20141116 | hypothetical protein | 752 | 752 | 1803 | NA | NA | NA | NA |
| 12136v20141116 | hypothetical protein | 753 | 753 | 1804 | NA | NA | NA | NA |
| 12137v20141116 | hypothetical protein | 754 | 754 | 1805 | NA | NA | NA | NA |
| 12138v20141116 | hypothetical protein | 755 | 755 | 1806 | NA | NA | NA | NA |
| 12140v20141116 | hypothetical protein | 1807 | 756 | 1807 | NA | NA | NA | NA |
| 12141v20141116 | Hypothetical protein | 757 | 757 | 1808 | NA | NA | NA | NA |
| 12142v20141116 | hypothetical protein | 758 | 758 | 1809 | NA | NA | NA | NA |
| 12143v20141116 | hypothetical protein | 759 | 759 | 1810 | NA | NA | NA | NA |
| 12144v20141116 | hypothetical protein | 760 | 760 | 1811 | NA | NA | NA | NA |
| 12145v20141116 | hypothetical protein | 761 | 761 | 1812 | NA | NA | NA | NA |
| 12146v20141116 | deaminase reductase | 762 | 762 | 1813 | NA | NA | NA | NA |
| 12147v20141116 | hypothetical protein | 763 | 763 | 1814 | NA | NA | NA | NA |
| 12149v20141116 | hypothetical protein | 765 | 765 | 1815 | NA | NA | NA | NA |
| 12151v20141116 | histidine kinase | 767 | 767 | 1816 | NA | NA | NA | NA |
| 12152v20141116 | hypothetical protein | 768 | 768 | 1817 | NA | NA | NA | NA |
| 12153v20141116 | hypothetical protein | 769 | 769 | 1818 | NA | NA | NA | NA |
| 12154v20141116 | hypothetical protein | 770 | 770 | 1819 | NA | NA | NA | NA |
| 12155v20141116 | hypothetical protein | 771 | 771 | 1820 | NA | NA | NA | NA |
| 12160v20141116 | hypothetical protein | 772 | 772 | 1821 | NA | NA | NA | NA |
| 12161v20141116 | hypothetical protein MexAM1_META1p3214 | 4637 | 773 | NA | NA | NA | NA | 4637 |
| 12162v20141116 | putative transmembrane protein | 774 | 774 | 1822 | NA | NA | NA | NA |
| 12164v20141116 | hypothetical protein | 775 | 775 | 1823 | NA | NA | NA | NA |
| 12165v20141116 | ABC transporter substrate-binding protein family 5 | 776 | 776 | NA | 2328 | NA | NA | NA |
| 12166v20141116 | signal peptide protein | 1824 | 777 | 1824 | NA | NA | NA | NA |
| 12167v20141116 | hypothetical protein | 778 | 778 | 1825 | NA | NA | NA | NA |
| 12168v20141116 | hypothetical protein | 779 | 779 | 1826 | NA | NA | NA | NA |
| 12169v20141116 | hypothetical protein | 780 | 780 | 1827 | NA | NA | NA | NA |
| 12170v20141116 | hypothetical protein | 781 | 781 | 1828 | NA | NA | NA | NA |
| 12171v20141116 | hypothetical protein | 782 | 782 | 1829 | NA | NA | NA | NA |
| 12172v20141116 | hypothetical protein | 783 | 783 | 1830 | NA | NA | NA | NA |
| 12173v20141116 | hypothetical protein | 784 | 784 | 1831 | NA | NA | NA | NA |
| 12174v20141116 | adenylate cyclase | 785 | 785 | 1832 | NA | NA | NA | NA |
| 12175v20141116 | hypothetical protein | 786 | 786 | 1833 | NA | NA | NA | NA |
| 12176v20141116 | hypothetical protein | 787 | 787 | 1834 | NA | NA | NA | NA |
| 12177v20141116 | hypothetical protein Mrad2831_3657 | 788 | 788 | 1835 | NA | NA | NA | NA |
| 12178v20141116 | hypothetical protein | 789 | 789 | 1836 | NA | NA | NA | NA |
| 12179v20141116 | hypothetical protein | 790 | 790 | 1837 | NA | NA | NA | NA |
| 12180v20141116 | hypothetical protein | 791 | 791 | 1838 | NA | NA | NA | NA |
| 12185v20141116 | None | 793 | 793 | 1839 | NA | NA | NA | NA |
| 12186v20141116 | hypothetical protein | 1840 | 794 | 1840 | NA | NA | NA | NA |
| 12187v20141116 | hypothetical protein | 1841 | 795 | 1841 | NA | NA | NA | NA |
| 12189v20141116 | hypothetical protein | 796 | 796 | 1843 | NA | NA | NA | NA |
| 12190v20141116 | hypothetical protein | 797 | 797 | 1844 | NA | NA | NA | NA |
| 12191v20141116 | hypothetical protein | 1845 | 798 | 1845 | NA | NA | NA | NA |
| 12192v20141116 | oxidoreductase | 799 | 799 | 1846 | NA | NA | NA | NA |

TABLE 7-continued

Orthologous Gene Groups

| Unique Ortholog Group Identifier | Annotation | Reference. Ortholog SEQ ID NO: | NLS0017 Ortholog SEQ ID NO: | NLS0020 Ortholog SEQ ID NO: | NLS0037 Ortholog SEQ ID NO: | NLS0042 Ortholog SEQ ID NO: | NLS0065 Ortholog SEQ ID NO: | NLS0066 Ortholog SEQ ID NO: |
|---|---|---|---|---|---|---|---|---|
| 12193v20141116 | hypothetical protein | 800 | 800 | 1847 | NA | NA | NA | NA |
| 12194v20141116 | hypothetical protein | 801 | 801 | 1848 | NA | NA | NA | NA |
| 12195v20141116 | hypothetical protein | 1849 | 802 | 1849 | NA | NA | NA | NA |
| 12196v20141116 | hypothetical protein | 803 | 803 | 1850 | NA | NA | NA | NA |
| 12197v20141116 | hypothetical protein | 1851 | 804 | 1851 | NA | NA | NA | NA |
| 12198v20141116 | porin | 1852 | 805 | 1852 | NA | NA | NA | NA |
| 12200v20141116 | hypothetical protein | 1853 | 806 | 1853 | NA | NA | NA | NA |
| 12202v20141116 | hypothetical protein Mrad2831_3327 | 807 | 807 | 1854 | NA | NA | NA | NA |
| 12207v20141116 | hypothetical protein | 809 | 809 | 1855 | NA | NA | NA | NA |
| 12208v20141116 | hypothetical protein | 810 | 810 | 1856 | NA | NA | NA | NA |
| 12209v20141116 | hypothetical protein | 811 | 811 | 1857 | NA | NA | NA | NA |
| 12210v20141116 | hypothetical protein | 812 | 812 | 1858 | NA | NA | NA | NA |
| 12212v20141116 | hypothetical protein | 813 | 813 | 1859 | NA | NA | NA | NA |
| 12214v20141116 | None | 814 | 814 | 1860 | NA | NA | NA | NA |
| 12217v20141116 | hypothetical protein | 816 | 816 | 1861 | NA | NA | NA | NA |
| 12218v20141116 | hypothetical protein | 817 | 817 | 1862 | NA | NA | NA | NA |
| 12219v20141116 | hypothetical protein | 818 | 818 | 1863 | NA | NA | NA | NA |
| 12220v20141116 | RNA polymerase sigma factor SigJ | 819 | 819 | 1864 | NA | NA | NA | NA |
| 12221v20141116 | hypothetical protein | 820 | 820 | 1865 | NA | NA | NA | NA |
| 12222v20141116 | hypothetical protein | 1866 | 821 | 1866 | NA | NA | NA | NA |
| 12223v20141116 | hypothetical protein | 822 | 822 | 1867 | NA | NA | NA | NA |
| 12226v20141116 | hypothetical protein | 823 | 823 | 1868 | NA | NA | NA | NA |
| 12227v20141116 | hypothetical protein | 824 | 824 | 1869 | NA | NA | NA | NA |
| 12228v20141116 | None | 825 | 825 | 1870 | NA | NA | NA | NA |
| 12230v20141116 | hypothetical protein | 1871 | 826 | 1871 | NA | NA | NA | NA |
| 12231v20141116 | hypothetical protein | 1872 | 827 | 1872 | NA | NA | NA | NA |
| 12232v20141116 | None | 828 | 828 | 1873 | NA | NA | NA | NA |
| 12233v20141116 | hypothetical protein | 1874 | 829 | 1874 | NA | NA | NA | NA |
| 12234v20141116 | PAS domain-containing protein | 830 | 830 | 1875 | NA | NA | NA | NA |
| 12235v20141116 | hypothetical protein | 1876 | 831 | 1876 | NA | NA | NA | NA |
| 12236v20141116 | hypothetical protein | 832 | 832 | 1877 | NA | NA | NA | NA |
| 12237v20141116 | None | 833 | 833 | 1878 | NA | NA | NA | NA |
| 12239v20141116 | hypothetical protein | 834 | 834 | 1879 | NA | NA | NA | NA |
| 12240v20141116 | None | 835 | 835 | 1880 | NA | NA | NA | NA |
| 12241v20141116 | hypothetical protein | 836 | 836 | 1881 | NA | NA | NA | NA |
| 12242v20141116 | hypothetical protein | 837 | 837 | 1882 | NA | NA | NA | NA |
| 12244v20141116 | AraC family transcriptional regulator | 838 | 838 | 1883 | NA | NA | NA | NA |
| 12245v20141116 | hypothetical protein | 839 | 839 | 1884 | NA | NA | NA | NA |
| 12246v20141116 | hypothetical protein | 1885 | 840 | 1885 | NA | NA | NA | NA |
| 12248v20141116 | hypothetical protein | 1886 | 842 | 1886 | NA | NA | NA | NA |
| 12251v20141116 | hypothetical protein | 844 | 844 | 1887 | NA | NA | NA | NA |
| 12252v20141116 | porin | 845 | 845 | 1888 | NA | NA | NA | NA |
| 12270v20141116 | hypothetical protein | 4642 | NA | 1900 | NA | NA | NA | 4642 |
| 12282v20141116 | carbohydrate-selective porin OprB | 3725 | NA | 1905 | NA | NA | 3725 | NA |
| 13420v20141116 | hypothetical protein Mchl_5363 | 3739 | NA | NA | NA | 3131 | 3739 | NA |
| 14119v20141116 | hypothetical protein BBta_6573 | 848 | 848 | NA | NA | 3156 | NA | NA |
| 14131v20141116 | hypothetical protein CcrKarma_gp008 | 853 | 853 | 1912 | NA | NA | NA | NA |
| 14132v20141116 | None | 854 | 854 | 1913 | NA | NA | NA | NA |
| 14133v20141116 | None | 855 | 855 | 1914 | NA | NA | NA | NA |
| 14134v20141116 | None | 856 | 856 | 1915 | NA | NA | NA | NA |
| 14136v20141116 | None | 857 | 857 | 1916 | NA | NA | NA | NA |
| 14137v20141116 | None | 858 | 858 | 1917 | NA | NA | NA | NA |
| 14138v20141116 | None | 859 | 859 | 1918 | NA | NA | NA | NA |
| 14139v20141116 | hypothetical protein | 860 | 860 | 1919 | NA | NA | NA | NA |
| 14152v20141116 | glycosyl transferase family protein | 867 | 867 | 1920 | NA | NA | NA | NA |
| 14156v20141116 | None | 869 | 869 | 1921 | NA | NA | NA | NA |
| 14168v20141116 | integrase catalytic region (modular protein) | 1923 | 871 | 1923 | NA | NA | NA | NA |
| 14170v20141116 | hypothetical protein | 1925 | 872 | 1925 | NA | NA | NA | NA |
| 14172v20141116 | Fis family transcriptional regulator | 873 | 873 | NA | NA | NA | NA | 4875 |

TABLE 7-continued

Orthologous Gene Groups

| Unique Ortholog Group Identifier | Annotation | Reference. Ortholog SEQ ID NO: | NLS0017 Ortholog SEQ ID NO: | NLS0020 Ortholog SEQ ID NO: | NLS0037 Ortholog SEQ ID NO: | NLS0042 Ortholog SEQ ID NO: | NLS0065 Ortholog SEQ ID NO: | NLS0066 Ortholog SEQ ID NO: |
|---|---|---|---|---|---|---|---|---|
| 14174v20141116 | hypothetical protein Mrad2831_5180 | 874 | 874 | 1926 | NA | NA | NA | NA |
| 14176v20141116 | hypothetical protein | 1927 | 875 | 1927 | NA | NA | NA | NA |
| 14181v20141116 | magnesium chelatase | 878 | 878 | 1929 | NA | NA | NA | NA |
| 14182v20141116 | hypothetical protein | 879 | 879 | 1930 | NA | NA | NA | NA |
| 14189v20141116 | hypothetical protein | 884 | 884 | 1931 | NA | NA | NA | NA |
| 14190v20141116 | None | 1932 | 885 | 1932 | NA | NA | NA | NA |
| 14196v20141116 | WGR domain-containing protein | 1934 | 889 | 1934 | NA | NA | NA | NA |
| 14200v20141116 | hypothetical protein | 893 | 893 | 1935 | NA | NA | NA | NA |
| 14291v20141116 | hypothetical protein | 2020 | NA | 2020 | 2342 | NA | NA | NA |
| 14320v20141116 | membrane protein | 3160 | NA | 2046 | NA | 3160 | NA | NA |
| 14649v20141116 | dienelactone hydrolase | 3173 | NA | NA | NA | 3173 | 3768 | NA |
| 14657v20141116 | hypothetical protein | 3180 | NA | NA | NA | 3180 | NA | 4881 |
| 15376v20141116 | transcriptional regulator | 2058 | 904 | 2058 | NA | NA | NA | NA |
| 15391v20141116 | hypothetical protein | 916 | 916 | 2059 | NA | NA | NA | NA |
| 15392v20141116 | None | 917 | 917 | 2060 | NA | NA | NA | NA |
| 15394v20141116 | RluA family pseudouridine synthase | 918 | 918 | 2061 | NA | NA | NA | NA |
| 15437v20141116 | PAS sensor protein | 2063 | 938 | 2063 | NA | NA | NA | NA |
| 15441v20141116 | integrase catalytic subunit | 940 | 940 | 2064 | NA | NA | NA | NA |
| 15442v20141116 | hypothetical protein | 2370 | 941 | NA | 2370 | NA | NA | NA |
| 15451v20141116 | hypothetical protein | 946 | 946 | 2065 | NA | NA | NA | NA |
| 15452v20141116 | molecular chaperone GroES | 947 | 947 | 2066 | NA | NA | NA | NA |
| 15460v20141116 | epimerase | 952 | 952 | 2067 | NA | NA | NA | NA |
| 15489v20141116 | hypothetical protein | 2371 | NA | 2085 | 2371 | NA | NA | NA |
| 15815v20141116 | hypothetical protein | 3787 | NA | NA | 2393 | NA | 3787 | NA |
| 17689v20141116 | None | 993 | 993 | 2112 | NA | NA | NA | NA |
| 17695v20141116 | hypothetical protein | 999 | 999 | 2113 | NA | NA | NA | NA |
| 17705v20141116 | None | 1006 | 1006 | 2114 | NA | NA | NA | NA |
| 17706v20141116 | hypothetical protein | 2406 | NA | NA | 2406 | 3251 | NA | NA |
| 17707v20141116 | hypothetical protein | 1007 | 1007 | 2115 | NA | NA | NA | NA |
| 17708v20141116 | None | 1008 | 1008 | 2116 | NA | NA | NA | NA |
| 17709v20141116 | None | 1009 | 1009 | 2117 | NA | NA | NA | NA |
| 17710v20141116 | None | 1010 | 1010 | 2118 | NA | NA | NA | NA |
| 17731v20141116 | integrase catalytic subunit | 3252 | 1024 | NA | NA | 3252 | NA | NA |
| 17732v20141116 | putative aspartate racemase | 2407 | 1025 | NA | 2407 | NA | NA | NA |
| 17757v20141116 | None | 2119 | 1041 | 2119 | NA | NA | NA | NA |
| 17759v20141116 | hypothetical protein | 2120 | 1042 | 2120 | NA | NA | NA | NA |
| 17795v20141116 | hypothetical protein Mrad2831_4255 | 1073 | 1073 | 2122 | NA | NA | NA | NA |
| 17807v20141116 | glycosyl transferase | 1085 | 1085 | NA | 2409 | NA | NA | NA |
| 17808v20141116 | hypothetical protein | 2123 | 1086 | 2123 | NA | NA | NA | NA |
| 17857v20141116 | polar amino acid ABC transporter permease | 2164 | NA | 2164 | 2410 | NA | NA | NA |
| 18264v20141116 | hypothetical protein Rleg2_4164 | 3258 | NA | NA | 2416 | 3258 | NA | NA |

REFERENCES FOR EXAMPLE 8

1. Miller J R, Koren S, Sutton G (2010) Assembly algorithms for next-generation sequencing data. Genomics 95: 315-327.
2. Zerbino D R, Birney E (2008) Velvet: algorithms for de novo short read assembly using de Bruijn graphs. Genome Res 18: 821-829.
3. Delcher A L, Bratke K A, Powers E C, Salzberg S L (2007) Identifying bacterial genes and endosymbiont DNA with Glimmer. Bioinformatics 23: 673-679.
4. Lowe T M, Eddy S R (1997) tRNAscan-SE: a program for improved detection of transfer RNA genes in genomic sequence. Nucleic Acids Res 25: 955-964.
5. Lagesen K, Hallin P, Rodland E A, Staerfeldt H H, Rognes T, et al. (2007) RNAmmer: consistent and rapid annotation of ribosomal RNA genes. Nucleic Acids Res 35: 3100-3108.
6. Cantarel B, Korf I, Robb S, et al. (2008) MAKER: An easy-to-use annotation pipeline designed for emerging model organism genomes. Genome Research 18: 188-196.
7. Altschul S F, Madden T L, Schaffer A A, Zhang J, Zhang Z, et al. (1997) Gapped BLAST and PSI-BLAST: a new generation of protein database search programs. Nucleic Acids Res 25: 3389-3402.
8. Eddy S R (2009) A new generation of homology search tools based on probabilistic inference. Genome Inform 23: 205-211.

9. Haft D H, Selengut J D, White O (2003) The TIGRFAMs database of protein families. Nucleic Acids Res 31: 371-373.
10. Tatusov R L, Fedorova N D, Jackson J D, Jacobs A R, Kiryutin B, et al. (2003) The COG database: an updated version includes eukaryotes. BMC Bioinformatics 4: 41.
11. Suzek B E, Huang H, McGarvey P, Mazumder R, Wu C H (2007) UniRef: comprehensive and non-redundant UniProt reference clusters. Bioinformatics 23: 1282-1288.
12. Li H. and Durbin R. (2009) Fast and accurate short read alignment with Burrows-Wheeler Transform. Bioinformatics, 25:1754-60

The inclusion of various references herein is not to be construed as any admission by the Applicants that the references constitute prior art. Applicants expressly reserve their right to challenge any allegations of unpatentability of inventions disclosed herein over the references included herein.

Having illustrated and described the principles of the present invention, it should be apparent to persons skilled in the art that the invention can be modified in arrangement and detail without departing from such principles.

Although the materials and methods of this invention have been described in terms of various embodiments and illustrative examples, it will be apparent to those of skill in the art that variations can be applied to the materials and methods described herein without departing from the concept, spirit and scope of the invention. All such similar substitutes and modifications apparent to those skilled in the art are deemed to be within the spirit, scope and concept of the invention as defined by the appended claims.

SEQUENCE LISTING (10250 sequences)

SEQ ID NO: 1 - protein, 67 aa, Methylobacterium sp.
ETINGLFKAEVIHRRGPWRSFEAVEFATLEWVDWFNTRRLLEPIGNVPPAEAEARYCARAEVRALAA

SEQ ID NO: 2 - protein, 302 aa, Methylobacterium sp.
MAEIRRVYEANFRVYGVRKVWRQLAREGIVVARCTVARLMRTMGLAGVVRARRVRTTIPDPTGACPLDRVNRQFKAACPNRLWVADFTYVATWGGFIYAAFVIDVFARRIVGWRVSRSALADFVLDALEQALHERRPFAGSGLVCHSDRGSQYVSLRYTERLADAGIEPSVGSVGDSYDNALAETVIGLFKTEVIHRRGPWRSFEAVEYATFEWVDWFNQRRMLEVRRILYTTNAIEALNATLRRAVRARGHFPTDEAALKLLYLVLNRSEKAWKMGPREWVMAKAQFAVIFGERFTRAMAA

SEQ ID NO: 3 - protein, 72 aa, Methylobacterium sp.
VWWIAETIIGLFKAEVIHRRGPWRSFEAVEYATLEWVDWFNHRRLLEPIGNMPPAEAEARYYAQAEVQALAA

SEQ ID NO: 4 - protein, 224 aa, Methylobacterium sp.
STYHAHAARRVDPGKLPARARSDAAIMVEIRRVFEENFHVYGVRKVWRQLGREGIAVARCTVARLMRVMGLKGVRGKKVRTTIPDPAAACPLDRVNRQFKAPRPNALWVSDFTYVATWAGFIYVAFVIDAYARRIVGWRVSRTAHVAFVLDALEQALHERRPLWGGGLVHHSDRGSQYLALRYTERLAEAGVEPSVGSVGDSYDNLWTPPAARYSSATTTALGA

SEQ ID NO: 5 - protein, 93 aa, Methylobacterium sp.
MTKRSTPFSPEVRERAVRMVFDHQGEHGSQYGAIRSIAAKIGCSGETLRNWVRQAERDQGQRPGPTTDERERIKALERENRELRQANEILRKA

SEQ ID NO: 6 - protein, 81 aa, Methylobacterium sp.
MILSLQAVQVATGSDDAESQLVFADGFLVAILVRLSAQHGADAGKWFLEAGFGPIDPLAPPLFADLPAARAWIMRQLIAAA

SEQ ID NO: 7 - protein, 301 aa, Methylobacterium sp.
MPFDVIVVGGSFAGLAAATYIARGRRSVCVVDAGSPRNRFAAASHGFLGQDGSDPRAMLAQARAQLAAYRQATFVEGEAVDVRAGRGFTVTLASGAILDAARLVLAYGITDVLPEIPGLAERWGRSVLHCPYCHGYEFADRKLGVLAVSPLSAHQAMLIAEWGPTTLYLNGGDMPDEETCARLASRGVGIEPAAVAALVGEGGTLSGLMLGDGRTAAVEALYLAPRSRMNSPLAERLGCALDEGPFGPVIRTDASKLTTVVGVYAAGDIARAPHSVSWAVADGVTAGVSAHQSLVFASLAA

SEQ ID NO: 8 - protein, 85 aa, Methylobacterium sp.
MKVTSLAIAALLAAAIPATAAENAGSATSRSGTANSTGPSDAGSGSTPGAAGSGPSTGSMSRSGTTNSTGPNDAGSGSKPPAGGR

SEQ ID NO: 9 - protein, 82 aa, Methylobacterium sp.
MPRTLITWTQDETAGVPLPRFVGRVGTVVVGICAYDGSSRFWTWWSPLAEDVWGHGQDAEGARQGCEAWLRGWLENFRPFFT

SEQ ID NO: 10 - protein, 305 aa, Methylobacterium sp.
FQAIGSAEVAQVNLPVAVLIWLMVIPMLLKIDFAALGQVGRHWRGIGVTLLVNWAVKPFSMAVLGWLFVGWLFRPYLPGDQIDSYIAGLIILAAAPCTAMVFVWSNLTKGEPHFTLSQVALNDTIMVVAFAPIVGLLLGLSAITVPWSTLVLSVVLYIVLPVIVAQLVRRSLLASGGQAALDRLLKVLGPVSLVALLATLVLLFGFQGEQIIAQPLVIALLAVPILIQVYFNAGLAYLLNRIAGEQHCVAGPSALIGASNFFELAVAAAISLFGFHSGAALATVVGVLIEVPVMLTVVWIVNRSQ

SEQ ID NO: 11 - protein, 584 aa, Methylobacterium sp.
MDDDTLTLIPDDLDEAQPTAGAWVIAVIDDDPAVHDGTRYALASYTLDGRGLEILTARSAAEARVLLAERRDVAVVLLDVVMETDNAGLELVDYIRRELRQETVRIILRTGQPGQAPERRIIVDYDINDYKAKTELTADKLFTSLTAALRAHQQLKRLDETRRGLEIIIDAAPMLLDHKSMQRLAEGVLTQVASLLNVACAGILVLRETAAPQERFCVLAGSGCYGHYAGREPCWPLEERVQPLVERAFAERRHSFGEHWSTLYLHTASGSEIVALIEADRQLSETDRSLIALFTSRLSIAFDNVILYERLQLTNADLERRVVERTAELIRANRRLDLQRSDLRRANSLKTEILGTIAHDLKNPLAVILGRAEMLSDLIDMQGDREQMRAQVQHVRTSAKGLTAMIDSLMADAMNDALDISLRREPVDLAGLAREVCEADRPLADAKDQTLVCEGPDELFLCGDAERLREALDNLVSNAIKYSPVGGAITVRVSREPGPRGAELICAVADHGPGLSPEDSARVFGRFQRLSAKPTGGENSTGLGLSIVRRIAELHGGRATAESAGPGLGAVFAIRFPEESVGLI

SEQ ID NO: 12 - protein, 253 aa, Methylobacterium sp.
MTIPDSPAPGAARGGAAIPSIAVVDDEAATREMVGDYLKLHGFSVVLCDGGRSLREHLAGHSPDLIVLDLNMPEEDGLSIVRDLKARTAIPIIMLTATASAIDRVVGLELGADDYLPKPCELRELVARVRSVLRRVQTPTAAPAPIPMSGRRIRFGTKWLELDALRLSDDAGLEQALTRSEFDLLKAFADNPRRALSRERLLDLADARDPDAFDRAIDVRINRIRKKVEPDPGNPRYIRTVRGLGYIFRPEGD

SEQ ID NO: 13 - protein, 775 aa, Methylobacterium sp.
MRVGPKIALVGGVPILAAGAIAMAGWLLLAQEERARRGAVLAADVYHDIATARLVRDQYAAADAQDRPAYAERFASLTARAEAGLGRLAGFARIDEQRARTASVERALARYRGEMDAFVRRTRENDGLIREMTQRADTLIDLTDRARLRQQASNADLARSTAEKVEALRVARGLVARLNALRARSAESAVLAAQAAARSEAPAAGTAGAALSESDGPRAQGLFRAASRDLAAALRADGRDADAEALDALTAEAAGWKPDLRAKLDAWIERTLKIETSGQESLHDEVAQLLAYSVEANEIERATQNVAIGTLKLGPRTAGALLHRDAALAERMRDEGERLARSAASLPISPLIQAEMVQALDGWRGRLTTTIGGLRQQNAMIVAMDGLAATMIDSAKALNDAFVEDADRSGIVIQRILLAGAAGLLLFGALVVILVARSILVPLRALQGDMVMLTGNPAGAAVRGTARRDELGDIARATAVFVSEITRREGALRRAKDQADVALVELRRTQDNLVRAEKLASLGQLVAGVAHEINTPLGIALTTGTLMSDEARAFRTGLSAGTLSRSRLNHFVERVEEGATLLCTNLTRAADLVQGFKQVAVDRVSDESRSVVLATWLDDLLTSLRPMLRKGGHVVERACPADLVIDTNPGVLAQIVTNLIANAVVHGFRAAEPGRITVDVSEREGGLVRMEVRDTGQGIPPEHLDRIFDPFFTTARSAGSTGLGMHIVHNLVTAKLGGRIAVSSEPGQGTVVQVDFPAQGAGAAARPRTGAIRTP

SEQ ID NO: 14 - protein, 608 aa, Methylobacterium sp.
VSTVLVFGGYGGFGARLSRRFAAAGHDVVVAGRRSARAEAFCAAHPPCRPLQADRNGAVAPLLERVRPDLVIDAAGPFQGSGYDLPRACIAAAIPYLDLADGRAFVTGIGQLDAAARAAGVAILAGASSVPALSGAVARRLAQGMDAVTAVEIAISASNRATAGTSVAAAILSYVGRPIRLWRGQRWSAAVGWQELRRERFALSDGASLGRRWLALADVPDLNLLPGRLPGRPAVSFRAGTELAVQTIGLWCASWPVRWGWIPSLQGLARGLLLAQRLTARWGSDRSGMVVRMFGSAEGRRVERRWTLLAADGHGPEIPVLPAAILAERILAGAIAPGARDAGTALDLSDFEPSFARLSIHHDVRESGQADALYARVLGPRFAELAPRVAALHGVLREAGAHGRAVVRRGRHPVARGLAALLGLPVAGAHDLHVGFSETRGVERWTRAFSGRRFTSAFSEERGCVVERFGPLRFRFDLAPEGGGLRMVLRGWSVARLPLPLALAPRTAAREWEEAGLFHFDVSIALPRVGLVVHYRGWLDTDDRAGRRSGFVPDAEPTAPPRSGHPAQRPSRPSSGDPGPETALPIASSRARAPSRSGHGPEPRHGRV

SEQ ID NO: 15 - protein, 114 aa, Methylobacterium sp.
LAAATLSAKRRSLDRQLGAILATPSRCDLTRELQAKISRARDQLLVFLAYPGKVEPTNNGSERLLRPAVVQRKVTNGYRAMWAAEGEAAIRTVVDTARITGSSPFSTVLKTIGA

SEQ ID NO: 16 - protein, 322 aa, Methylobacterium sp.
MGRSDLERLSREELIELVLRLQRPEKTSRTSSKPPATDRKEQREHSKPGGAKPGHEGHSRVVSDDPDAVVEHRPEACACCGASLHAALPAEVVSVAEQIELPAVAPVVTQHQRLAVRCPRCGERVVAPVPEAARGTPFGPRLHAVATYLKTFQALSYERLQAALSDLFGLTLSQGGLMNLLRRAQGCFRPGRDAAIATLRRAEVVACDETGVRIEGSNAYHWLFHSAQAVVHTASPTRGAVVVREMMDGHRPAVWISDRYTAQQGHADEHQTCLAHLARDVAYVVEVSDDPVPWRLQLWLKSVFALAERVTHLAAATLSAKR

SEQ ID NO: 17 - protein, 595 aa, Methylobacterium sp.
MSLSSPRKADAVRRVLAFVVRSWRRRWPLVAGLTGAITLATLAEVLLPLFAGRLVDALSGSDRRAALDAAWPAFLAMTGLGLATALLRHVAWSLVVPLSLRTMSDIVGNGFARVQRFSTEWHANTFSGSTVRKISRGMWAIDGLNDTLLLSLLPALVVLVGTALVLGLHWPALGATVAIGAGAYVGATALLATRVIAPAAALSNALDTRLGGALSDAIGNNAVVKAFGAEAREEARLGRLLAKWQRRTRRTWMIVTWGGTGQLGLLLVLRTAIVAIALWLWWRERASPGDVAYVLTATFVVHGYLRDIGGHINHLQRAINEMEELVALEAEPVGVADRPGAVPLAVAGGAIRFETVRFHYGDHTRPLYDGLTVTIPAGQRVGLVGRSGSGKTTFVKLIQRLYDVSGGRVTIDGQDVASASQASLRAQVAIVPQEPVLFHRSLAENIAYARPGASAHDIERAARLANAHDFIARLPKGYATLVGERGVKLSGGERQRVALARAFLADAPILILDEATSSLDSESEALVQEAMARLMRGRTAIVIAHRLSTVRALDRILVFDRGRIVEDGPHAALLRRPNGAYRALFERQADFAESA

SEQ ID NO: 18 - protein, 73 aa, Methylobacterium sp.
MFAITGHGQAYAQTRPPDGNLDFLCNFLGDCPARVAPGGPDRDARPFSNSLGRPCAWRDRPTPEGVRRVRVCW

SEQ ID NO: 19 - protein, 470 aa, Methylobacterium sp.
MRFTFRRTAALLGLGVAAVPLSSLATPVTATLARAQATEVEGPALPYASTSDLRAATVARAVRDQRATNPIAAAETARELARHDYDSIFRGFLDGTPLRPDDAGDVLTAFIALQWMVANDATVEPSAAALRAIRTRFVAPMAERPPLSQPAARAAFAEQVKLRAVLHHAGWQAAKRLGVLPRFLAGLSSEFIPVATLRTLALTEDGLVPKGRAGRAAPKPPPVAERPPVPDARPAPSPAPSVPDAAGPPRHAANWDSVEGVYFRSTTGFGVGGLMTIDFEPLIFLRDGTYYEIADTALEDVDLAAERAARPKRFGRWTAKGAGFVLTDARGRANDYALGDGSFFRAFPAAANERVARAYRRLSGGGNTALGGDVAIAVESRYDFHADGSYGRGGSVGATNSGASTGVGTAIARRRAPEGGRYALDRHTLTLTTADGRTRRLFFAYGSQKDPPEIDREMIFVGDDVFSPAD

SEQ ID NO: 20 - protein, 156 aa, Methylobacterium sp.
MEAKLCFIGHALMENRSALIVDTCLTSADGHAERIAALAMIEPRADRPKAISVGADKAYDAEDFVNELRSMNVRAHVAQNTSGRRSSIDRRTTRHVGYGMSQKIRKRIEEGFGWIKTVGGQRKTRFRGRDRVGWAFAFTAAAYNLVRLPKLLGALA

SEQ ID NO: 21 - protein, 215 aa, Methylobacterium sp.
MRGSDQRSGRLFSYVDLEARVRPDHPLRTIRQLTDVALAALSGDFSVLYAARMGRPSIPPEMLLRAMLLQAFYSIRSERQLMERLEFDLLFRWFVGLGVDDPAWDHSSFSKNRDRLLAGEIAAKFLAAVLAQPRVKRLLSSDHFSVDGTLIEAWASMKSVKPKDQSGDQAPPPAGGRNAEVDFKGQKRSNEPTPKPGSTARARAWRPSSASSAMP

SEQ ID NO: 22 - protein, 454 aa, Methylobacterium sp.
MTVTRAAIPSPSPVRRRSDRDRSGSADLTNWRAYAVAGYALIVATFGVVGTWAAVARLDRAVISPGVVVAEGSRKVVQHLEGGIVQEVLVRDGQAVRAGDVLLRIDPVQSRASNDLLRGQLDGALILEARLRAEQGQAQDLLLPPEIAERRAEPAVAGLIDDQASQLSERRASFQAQLGLIEARVTQLKTEISGLTVEKASGEQQVALIQQELEGLRGLQEKNLIPLSRVLMMEREHARLRGVIGRSVAETAKAQNGINEAGMQTAQLKQKLQESLTAQLLDTRQKIAELREKLIVARDVLRRHEVRASHQGVIQGLKVYTIGQVVRSGEPLMEIVPTNDRLVISVQFAPNDLEAVHAGMRAEVKFPAFQTRRMSAIFGTLTMVSRDRLIDDGTKQAYFAGTVEIDDHQLPDDVRPRLLAGLPAEVVVSAGERTALDYLVAPFFDALGRSFHER

SEQ ID NO: 23 - protein, 108 aa, Methylobacterium sp.
VYAHQQRLDSEEVLELRREGGRYLKELREARGLSQRQLAALVGADYYTFISQLETGRGRIPPDRYRAWAEALAIEPRTFVRNVMRFYDPITHEILFGDRSAKPEGNEA

SEQ ID NO: 24 - protein, 289 aa, Methylobacterium sp.
MIGNLNIELLRSFLAVVESRSFTAAAQALGLRQSTVSGHIARLEQALGRALLTRDTHRVAPTPDGQAMIGFARDVVDAQDRLRAFFSPEGLRGRIRLGVSEDYTLSTLAQVLARFADRHDAVDLQITVGLSRALYQGYDAGELDVIFCKRRRGDPRGTLAWAEDLIWTGRPGLVPDPAKPLPLVLYPPPSMTRTLALDALEAVGRSWRVACTSGSLMGLRAAVEAGLGIAPHSAKILPPGLAAISEAAGLPPLGAVEFVVLGPGRHHTAATALQETILASTGELQGATR

SEQ ID NO: 25 - protein, 577 aa, Methylobacterium sp.
LTNGLRSLRPVLATAVVFGLFINLLLFVSPLYMLQIYDRVIPSRSETTLAGITLIAAFGLAVYAMLEMLRARLLVRGGVVFDRKIATPIFDAAHRGTLLRPGAQHDTALRDVDVLREFLTGSGMLAFCDLPWIPIFLLACFILHPWFGWMALVGGGTILGLTLLNEVATRRTLDAASQASREAGQNAATVFRNGEVLQAMGMVASMRGLWGRRHDDVLLLQARASDRAGLIVAGTKFVRMLLQTLVLGIGAYLAIHREISAGSMIAASIIIGRTLAPIEAVVGNWKGFTAARASYRRLADLVAVAGSETRRLVLPRPRGLIEAETISVAAPGATRPILKAVSVRLEPGSVVGIIGPSAAGKSTLVRALTGVWPLLEGTVRIDGSDLNHWDSALLGQHVGYLPQDVELFDGTVAQNIARFADRDDARVIEVARRAGCHELIQSLPEGYNTVIGRGGHGLSGGQRQRIALARALYGEPSLVVLDEPNASLDQPGEAALMRAVADLKRSGTTVVLVTHKVSLLEEADRILLMSEGRVQLSGTPEQVLAHVTGQRPVPTLVPPVGPAASQSRSSDEQRSAG

SEQ ID NO: 26 - protein, 138 aa, Methylobacterium sp.
MTRAGNDARLSLDYVSVEDLNAALRVFRRLPLDLLGFLVLLPIVLIGLSRLGTALNPPYGLYIFGWDLVTWGLLLMLALLFGLLWWRGRQVGRLLNDRDILASPVMSLLSVPSVLARRAQTIGMEWTGFYGPLRPTRK

SEQ ID NO: 27 - protein, 123 aa, Methylobacterium sp.
VIADGAGRAIAFRIAPGQAHELPHALPLLGHLPGIPQWVVADRGYSSQRFRQQLREVGATPAIPSKSNEAPERCPDWIYTNRNVVERLWARLKEWRAVATRYEKTASSFTGVLCLAAALDHLR

SEQ ID NO: 28 - protein, 123 aa, Methylobacterium sp.
MGALLDPVLGPAFASGRIVDGILLLVAAEALALAWLARRVGLPLPSLLANLASGAALMLALRAALVGAGWSAVAGWMLAGLVAHLADLVLRVRAATAQRRSAAPAGTTPATAAFTRVTSFKQL

SEQ ID NO: 29 - protein, 444 aa, Methylobacterium sp.
MAKVFRAWDVDQGWLLPPSLHEFVPPGHMAHFVRDTVREALDLSAILDTYTEERGYPPYHPGMMVALLLYGYSRGLYSSRQLARACEERVDVMAVTGLNRPDFRTIADFRKRHLVALSDLFVQVLRLCRAAGLVEFAHVAVDGTKLKANASRHKAMSYGRMKTAEPALTAEVQAWLDRAGEADAAEDQAHGASRRGDETPDWMADKQRRLEAIRAAKAALEAEAADPPDPEDESGPGASSGMRWQGRPLRGEDGSPPDRAQRNFTDPDSRILPTRDGFVQGYNGQVAVDAAHQVIVAYRLVTNSADHRALVPLVDGLRAHLGRKPREVSGDAGFANEANLAALKERGITGYLAPGRARHGEADAAGRRRLTKMPLMSAMAARLKRAGRRSRYRLRKQVVEPVFGQIKQARGFRQFLMRGLDQVRGEWAMICTAHNLLKLAQSGR

SEQ ID NO: 30 - protein, 73 aa, Methylobacterium sp.
MPDYRLRGAVRGEDGEIGAPRVDEVLTAADAKEAVRLANRRSLTIEDDAVNALWLVDAHGTLLWSLRRADREP

SEQ ID NO: 31 - protein, 107 aa, Methylobacterium sp.
VRILFVCGRARARSPTAEQIFARLPGIETASAGVSPDADEPVDADHLAWAEIVVVMERAHRRKLMRRFGAALRGTRLVCLDIPDVHDFMAPALVTLLDARAGRFLPR

SEQ ID NO: 32 - protein, 891 aa, Methylobacterium sp.
MDQAKPRRETTIARAGAGRTGYVTVRGAREHNLRDIDVEMPRDALVVFTGVSGSGKSSLAFGTLYAEAQRRYFESVAPYARRMIDQVGVPDVDAIEGLPPAVALQQQRGTPSARSSVGSVTTLSSLVRLMYSRAGTYPPGQPMLYAEDFSPNTPQGACPSCGGLGRVYQATEASMVPDPSLTIRERAVAAWPQAWGGQNLRDILVSRGVDVDTPWKALPRKLRDWILFTDEQPQEPVYAGLSPDQTRLARRRGLEPSYMGTFTSARRHVLGTFTNSQSALMRRRAARYLVSEDCPACHGKRLKPEALSVTFAGLDIGALSRMPLSALAEALRPAAEDRQPEAEAAPAILDRAVGRKDRAERAASGGSAHAGAPDVRVTPNLSIEKRLAAQRLASDLIARIGTLADLGLGYLSLDRVTTTLSSGELQRLRLATQLRSQLFGVVYVLDEPTAGLHPADGDAMHDALAGLLAAGNSLFVVEHDIGTMRRADWLVDVGPEAGENGGTILYSGPPEGLRDIAASRTRLYLFGLAEAPPRPSREPAGWLRLEGIVRNNLKGVSVPFPIGCLTAVTGVSGSGKSSLVSQALLELVGERLGRPVQTEDEPDDPLDEVPGPSEGRIAGGMDGIGRLVRVDQKPIGRTPRSNLATYTGLFDAVRKLFAATPEARRRRYDAGRFSFNVAKGRCPACEGEGFVSVELLFMPSVYAPCPTCHGTRYAPETLGVTWNGLSIADVLALTVDRACAAFADEPSVLRPLTVLRDLGLGYLRLGQPATELSGGEAQRIKLATELQRGQRGGTLYVLDEPTTGLHPTDVDRLMVQLNGLVDAGNTVVMVEHDMRVVAQADHVIDMGPGGGDQGGTVVAAGRPEIVAAAAAGRTAHYLREELATVRTRPPG

SEQ ID NO: 33 - protein, 86 aa, Methylobacterium sp.
MHQFIGLFAIFVTLAGVLHTWGAPRWAIAGLCLIGLLGVSAAVVGIQPKVAPSPVSQAQSLNDAMQPVFEGVWDPLRPGRLLTTSR

SEQ ID NO: 34 - protein, 190 aa, Methylobacterium sp.
MLVGYARTSTLEQGAGLEAQVRDLKALGCERLFQEQVSSVGTRPQLAAALDFVRDGDTLVVTKLDRLARSVSHLGTILDALAAKGVALRIVSLGVDTSTPTGKLMLNVLGGVAQFEREMMLERQREGIAKAKAEGAYKGRKPTARARTAEIEALAATGLSMAAIAAQLGIGKGSVHRAIGKARPAPAKMG

SEQ ID NO: 35 - protein, 330 aa, Methylobacterium sp.
MIRPAAALLAAGLLGAPARANDSAAELNAGGLVLLREPGIALVSEDLSIARDRIDVSYLFRNQVQEARTVRIAFPLPPIDGRELSFSALALPRPDSPNFVGFTVTVNGKPLEPELEERAFVGEREVTDLLRRHGLPLNPLRFDAIGAAAKRIGAPEWAALVKAGLFPDVPDTPDRMTEGLWRGEAKFHWLQTFPPGQEVRIAHSYAPVTGFHLLEPKAASRAAYRATYCLDEAGLAAIRRLHAKAPDPGGYLRATVVPYIVTTARNWAAPIGRFTLTVDKGSPEAVVSFCRTDIRKTGPTTFRWEARDYVPDQDLRVLIVQPASATPGTR

SEQ ID NO: 36 - protein, 271 aa, Methylobacterium sp.
MRTHDLPRAARARLGRSGLLLAVGLALALVAPARANPLTEVPGARSSQPDEAPPPRDPAAERAETEEARAANPGATAIIRSLAPFADGNPGAPARPLAISPDDGGPAVRVVPARSIDLTVFFAYDSARLTPEARIQLEPLGEALRAEPLAGHGFLIAGHTDAAGGRAYNRRLSLARARAVKAHLVETYGIAPERLRVHGWGPARPKDPDAPLSRVNRRVEVSLIAPARSGALRFVLPVADRTCTDLADPRLRTDLDLDDFGAAPTPRPCAE

SEQ ID NO: 37 - protein, 49 aa, Methylobacterium sp.
MFVALSAGFVAMGLFNAAAFATGRMFPAEPAPSASPVPPGLTAAADSGR

SEQ ID NO: 38 - protein, 66 aa, Methylobacterium sp.
VTTLFVGGLMAIPTLGKWATQVTEVLASLLAIATVLVAILYLCDRWPDYFANPRMPVGLTATPFAD

SEQ ID NO: 39 - protein, 39 aa, Methylobacterium sp.
MKSMLRVTTALAGVAFAGSAFAADLPRRAAPPPVFTPVP

SEQ ID NO: 40 - protein, 654 aa, Methylobacterium sp.
MRTGWVLAGALGCALGVTPTQARITQIEVVTVEPFADGAEFGPAGAYERVIGAARGELDPADPANAGIVDIALAPRNARGMVEYRTDLFILRPKDPARGSGTLLFEVLNRGRKFLFNWVLDAPAQGAQAVNDPRNAVDAGTGLVLRRGDTIVWSGWEADALRQQGGMAIDVPVASRNGKPIVEIVRDELVSATRGPPEAPFYLTFKAASPDKAGTQLTVRRREADPPRPVPEEAWHYATPRQLELLPKGTKPLPGSIYQFTYRATEPKVLGIGFAATRDVVAYLRGDAAGGANPAGGAIRHAVALGISQSGRYLRDFIAQGFNRDEAGRRVFDGVLSHIAGIGGVFLNARFGQPSRTNTQHEDHLYPENAFPFSAAAQHDPVTGRTGALLRDDGFDPLLIEVNTGTEYWQKGASLLATDPLGRTDLALPDTTRVYLVSSGFHYGRAGLTSSRGPCANMRSTLNPAPALRALLVALEDWVTLGTPPPDSRIPRLSDGTLVEPAEAGYPFIVGVPVPTAPNTIARFSTYVDPKPESGPQYRPLVPRVDADGNDVAGIRLPAVAAPRATFTGWNLYADPFPAGALCDREGSQLPFARTRAEREANGDPRPSLEERYPDPDAYLAAVTESVDALVRDRLLLREDGDRLVRAARQESAP

SEQ ID NO: 41 - protein, 453 aa, Methylobacterium sp.
MPAVGTFRVCAPGRPPFAAAVAEGVAEAVALPSVLVTMLGSLIEAWPRQIYTQPLVTTRFLGQRTTYVCDPGHIRSLMVDQAEALEREPFMLRALAPALGAGVLTADGDHWRRQRRTATPMFRPDRVRSFVPAMARAAAATRARWRDADPAGSERDILREMMRTTFDVIVATMVSGDPHLEVGPFGAAMDAYLGQTSWKIALEMLRAPAWVPHPGSRAGAEAVRYLRGEVARTIARRRARGEPGSDLLGLLLQARDPETGAPLTEASLVDNLLTFVSAGHETTALALAWTFRVLAEHPEVEGRVVAEMARLGADPAAGPESDPDPVDRLPYTRQVLLEVMRLYPPAPLIVRRTRAPVRLGDTVVPAGQSVHVPVYALHRHALLWDRPEAFDPGRFAPERAAARDRYAYLPFGAGPRVCIGMGLALTECLVVLATLLPAFRLRPVTAEMPAAQF

SEQ ID NO: 42 - protein, 697 aa, Methylobacterium sp.
LPRANPVSALRRAARTALILLGMTCLAPLAPARAAPDPAAFADNADAVAVVIGNRSYKQTVPVDYAHNDADAIRAYLIERLGYRESNVFLLKDATLNEFNQVFGTERNPQSGRLWRSVREGRSNVFVYYSGHGVPDLATKQPFLLPEDGNPNQGESGYALETLYRNLELVKRKIGADHQLVVMVDACFTGETGRKGESLLAVSAPGFAPARPKTEGGIVRLVATSGATPANWDEANKLGLLTSRFLMGVSGLADARDHQGDGDGLVQWTELKRYLRREVEDAARRASGREQVPEIDEAPIVLKASLPVAAVAKGVEAIRDEAAWRRAEALGTREGFEAYIGACGETCLYRPQAMDRLLAGRRRDAAVIDQENWAKFGTQRQYQAYLDSCGEVCAYRSLAEGYLGGKNPSADPRVKRCDELAAGTDDPDRPSGVAGVKLGRIEPAAAIDACRGAAAAYPDLRRLSYQLGRAYDRADRYKEAFAAYDRAAKAGSISALNNLAALYENGQGVKRQQAEAFRLYRQAGEGGNVVALANAARMLEYGNGIPKDEAQAVALYRRAVAGGDVASISKLVPHYATGAYGFPKDLRQGFDLFRQAADRGDPVAMATMATLIDNGFGRYFPGVRSADMVLRALKHGELGAASVSATDTAAQKLKPETIRSVQRAIKDADYYTGALDGRFNPVFVRALDQYARANETE

SEQ ID NO: 43 - protein, 105 aa, Methylobacterium sp.
MAIRTMARPSPSRRRLRVILILLLITWLPVVPFALGLALTSLTGCTVNEAGTHPCPVAGHDIGGLLYTLTMTGWLLIPFLPFMALTLLLTVVQGLLMILRAWLRR

SEQ ID NO: 44 - protein, 505 aa, Methylobacterium sp.
MHKLLSRLGLRFENPIEERAFVARFTLDDLHRTQAAMLLGAFIYCAFAVWDWILDPAHWIETLFLRLAVAVAALLPATAALSWPAARLWAEEIYLSYCVVPGCVLSLIYLRLEPGFDHAAAGMIIVILFVSTLLPLRLPSLAAFCGLTWLCFAVCEILAERERPGMRFVNNFEIGMAYALSLYAVGAREVRARRQFQTEEALRLETERSEAALSELRDAQAHLVQSEKLTALGQLVAGVAHEINTPIGLALTTSTAAESDLKHLQCAIESGQLRRSELTQGLTRLSEGMRLLFANLTRAADLVHSFKQVAVDQANEERRIFELQSWLEDLMRTLGPLARRKGHAVRIRCEDKIALDSYPGALAQVLSNLALNAIVHGYPDGRSGVLDVTVSRFGADRLHIIVADDGIGIPPENLLKVFDPFFTTRRGKGSTGLGLHIVFNLVTSTLQGQITLSSNEGRGACFTIDLPVSIDEGEARDPPKPHRANHVSAPVQSSPSLEPDTNGWK

SEQ ID NO: 45 - protein, 85 aa, Methylobacterium sp.
MTKTKILVLAASLLCAAGPALAQEAAPQHGNQEFLGVDLDNGGVYYNGRNSGRYCVYRTVEVYNRYTGYFEARRARRCGRGLYLP

SEQ ID NO: 46 - protein, 170 aa, Methylobacterium sp.
VSDAARLLAEIHAARALVRDAAATARPDHAGLWAHATRAPDGPVDLATVRAIRGDPATARRYRTMLGALALAHAPLAAAASDGAILRRRVGAFALEILEAADGAPPLLVLRGESGQMPRVIEAWLGDETVRLDLGPAIEGAAVLALDPAVPEAALMGRMLRDPACAVFLL

SEQ ID NO: 47 - protein, 376 aa, Methylobacterium sp.
MTRPAILVVVPTTRGPLVLRGLRPRPGLPAPAAFADGDYRPLPWSADYARLCGAAGPLARWAGRTPEPHELRLSGSFDAGRSWEVPVCLAHGLAEGGHPLAAAPEEADLILWATGAVDLDLAVLPGDYALLDKVERSTAMIAEAPDAALAVLLPDGPERAQAEAVFRGMGRNVRILPSHSVPEALAALTALRDPERAETPPARRWQRLALPAGAVAAAGLAGVLALGATRPDPISEPRPEAPAGPAGPHPGAEARIAPPIHVSELRAPAGSSCRRVAFGADPPERRPVPAESGDHLAASRLTPDLCGLAIGVEPGLRAQVGPELRDAALPAVRLADGALGYFLREGARQNLVYTVQAVPEAGTGAVAGRLVHTLVR

SEQ ID NO: 48 - protein, 326 aa, Methylobacterium sp.
MISMRRRGPLLLGTACALIVLGRGDAARAQSVGFDPADYGRAQLPLRQTTGDAAAYVDQNKGAFEPVSELDPKDGLAALARPIGRVDIVLQNGRTGQQVGASCTGTLLPGDYVLTNHHCLPQSGDLRPVKASILMDYLTLDGKGSRRFEIDPKPVEFDARLDFALARVAGNPTATYGAARLSGEPVTANRSMLVIHHPLGRPKVMSRFRCFAMKDQAEGPDLRHRCDTLGGSSGSLMFDASVAGIALHKEGGLDPKDPTSFNSATRLSAILGRSPTLARIAAAQGRPVAAADPGTRPVAPSPTPQPKPATDGPLDPAGMNAILRGR

SEQ ID NO: 49 - protein, 317 aa, Methylobacterium sp.
MPLVRTTAFRAACLAVLALGSAYAAPARAQTKPNVVVMGEDADEDAVPRGNRIFQRVIHELSETMNLRGYNVYDETAVAMGFTQANRVRRRDAELIEVARAVQNPPLDVVAVFQIYASASKSAYSDIVRPEIRIPGRLLNVRTGQSLGSFEVAGLQLPPLPQGCDRECLLERVGAEAKTVAADLAAALTAKLDGVIAPRRGADAGAAPPDAAPVGGAVAAAPGGESCGGLPSAYVVRLSGFSAQEVQAAEEYMAAFRCYEHHRPVRASGASTEYWYETRSDSARLGRNLRLMLEHMSAPGQVQFSGNTFVISRVATR

SEQ ID NO: 50 - protein, 83 aa, Methylobacterium sp.
MIRTPTLILLGTLTLAGGTLGSTSAALADPPWARGERGFRHGGPPPWAPAHGYRRHREFGGYGRRDARFYEGRRYGGYRYDRY

SEQ ID NO: 51 - protein, 444 aa, Methylobacterium sp.
MRRLLLAALLLAPAAARADPATQALTPFLDAVAACTGRPDLTLAVVGVEPGQTALSREQSEEVRLAVETRLQATGRVRLAAAADVVRIKALHEGTTGLSGAEAEAQIRSAFAGDAAVFLVEPRRAGETASVRLQAVTQSAACKATSDPLVVPIHVGAGVADVDAVMDGAVKAFAQAAPNAGAVEVCPFVAEGGHSTCAGALTDRLVIALDAEARSANRMLRGARLDVRRRPPGTACAGTVTARGRFRTDHDRQSWMEVEFQREGAVLAPTGRRRIATEGLGCDPVPRPFLDHLAATARTDAGRLSVAAAATPFAAGQRLEMRIESRVAQNLYCWVVAADETAFVALPVRDNAASQLALKPGDSRRYPRGYGLDEIVAGEPFENLFACFGVPGGLPPELAARWLAAAPGADGEARLLQPPDVLDLLDRIRATPGVTEAAARVVVR

SEQ ID NO: 52 - protein, 463 aa, Methylobacterium sp.
MTGGYDERCAADLANVGDGRDLSRADRAWLARVVTGAVRPNRDKPLWDLAHALAALAGAAGARDGRDLITLALDPGLARPAALSARFSGGPAVDDRGPVLGTAWSTGWAGLARLLALAEFVLTAEDLAQFATVAGWLDELAAAPDAESAAILAKRLARHLAAYRNAHLPLAPLERRFRALLTFLGGRRSVADDDILDFWRAEMATGERPGFRIVAEHFVTFEAAGRLLEGLDALSAPAALDAHAGWEERLDAALGDLAAAEPAAALATVLADWPEGPKILTGAEREDLADFLRLEPYHRTRPLTTLRAVSFGRVQSGIANRLRRGGGGAAIAERATCLEAESYAELRTRAGLLAAHLGRMLRIAAALRIADRDALPEAVRAALEAAEADLRRVRRAGFDDREGLSAGFAAAEPALLRLAEAAADLERSLDGLARHRPLDALFPADRDVFAVAFAAAYAGEAAA

SEQ ID NO: 53 - protein, 101 aa, Methylobacterium sp.
LPPVRLSERFIDTRNSIAMPVRLITTALLLSVGATAALAAPMSADDKAALQQQCMGDFTTFCGGMPPDDGPETQACFEKNMAKLSPGCQGAIQSYKQGKKG

SEQ ID NO: 54 - protein, 140 aa, Methylobacterium sp.
MDTTKRAVGGLSLPKIKVTAEDRERLAGLASAAMDRMPDLAGYLSDELDRAQLVRAGRSAVGFVRMGSEVEFRDDTTGKVQVVSLVYPGEADIGLGRISVLTPVGAALLGLSGGQSIAWVTRTGAAKRLTVLDVREPAFA

SEQ ID NO: 55 - protein, 108 aa, Methylobacterium sp.
MAKTRREFTPEFKREAVALLESSGRPQMQVAAELGIQPSMLRQWRATLNGASPRPRPAGSTGSAPPSPVASPSDQAAEIARLRRELDRTRMERDVLKKAIGIFAEMPK

SEQ ID NO: 56 - protein, 91 aa, Methylobacterium sp.
MAQPLSAAPVKPAGAAPRLPADAQAYVTRRRGCNHWGGEDAYDEARGREIAAAAKALRCDAIDADEARLRRRYGKDPAVLKAFDRADGESG

SEQ ID NO: 57 - protein, 318 aa, Methylobacterium sp.
LKAMVLTKFGGPDSFELRELPDPRPGPRQVRVAVHATSINPLDCQIRRGDYADQVALPAIIGHDVSGVVDEVGSDVTEFRAGDEVYYTPRIFGGPGSYAEYHVADTGIVARKPDNLTHSEAASVSLVGVTVWEGLVERARLQVTETVLVHGGAGGVGAIAVQVAKAIGARILATARGSDVARVERLGASAVIDFEREDYVDAVDRLTGGRGVDVVLDTIGRDTLARSPRILREDGRVVTLVDTATPQNLIDAWGRNATYHFVFSRQNGRKLDAVTRLLERGLVVPRVGLEFPLDEVASAHARSEEGRLGGKIMLRVRS

SEQ ID NO: 58 - protein, 158 aa, Methylobacterium sp.
MDIAGAYRIPVAREAVWAALNDPEVLARCIPGCKELVQASPEEMTAKVALKVGPVSATFAGTVRLEDMRPPEGYSLVGQGNGGMAGFAKGRAAVSLAAEGGETLLTYTAKAEVGGKIATLGGRLMQATARKLADEFFGKFAAELGATGDSAAPRAAEA

SEQ ID NO: 59 - protein, 212 aa, Methylobacterium sp.
VKLWTWVKRGSTASLLALTFAQGGGAAAETAPRSGRYGSLVLAVRGGSVSGVFADVRGGINGMPSFSCIFLLRGTLSGPRAALETWYPGEAERIAGTLTFTAEGAELRLVEDHGGCSMTTGSMVDKPYTLPREVPEGGARPENWRGVGLVTARRAALRTEFGQAPRRIPYLVADDAVVVLERREGWVRALYQGGKAPIVGWLPATDLAVEEP

SEQ ID NO: 60 - protein, 518 aa, Methylobacterium sp.
MQRARSRRRLVGACLALGLIAAGPGAGSAGTLTRAQVEAQLPALEALAQRAVDAGAVPGLAVAVVLGDETLLLKGYGLRQAGKPEPVGPDTVFQIASLSKPVTATIVAALVGDGVVDWDSRVADLDPAFQLHEPYPTAQVTVRDFLNHRSGLPGTAGDDLEAIGFGRDAILHRLRLAPPASSFRAGYAYSNFGFTEGAVAAAKPTGQPWEAVARDRLFRPLGMTATGTTHADFLSRPDRAALHVRAGGVWTAKIERDPDAQAPAGGVSSDVRDLSRWLQLVIGKGRFEGAQRVAAQALAQTHVPLMARGRNPVTGGASFYGLGWNVEYGRHGLVWGHAGAFSVGAQTLVSIHPEAGLGILVLTNAFPSGVPEGLADSFADLVFDGRVGRDWVTAWGAAYENLFAPGIAADKAAYGTPPAPPAAPLALSAYAGRYASAYVGEAVVAEADGALTLTVGPAGARRYPLRHFDRDLFLSFPDAEAPDRPSAVRFAIGSDGRAAAVTVDALDASGLGTLARRD

SEQ ID NO: 61 - protein, 108 aa, Methylobacterium sp.
MDQSAAARTDHPATEQDPLAELPAGDFVRRWRQITGEPPAILLSSRSEMIALLVESVPMAPLTPQGEIPGTAESAETPFQDRGSDGPDGAASGSSARSEQRSASHGPA

SEQ ID NO: 62 - protein, 231 aa, Methylobacterium sp.
VGKEDRGVTVTEIERAEAGPRRGGRPTRAEAARREAHLIAVATTLFLERGFDATSIDAVAEAAGMSKPTVYARYRDKRALFEAVLRERIAAWLAPLSAAAEAQAAQGGSDDVETALEDLSRTLLAHGQSPGAAMLKRNLVAQALQFPELARLAHEEGWLRGVRAVAQLLDAFARRGRIAVADPEIAADLFLSLVLGRSSQATLYGIATDPEAQERRRQAAVRLFLDGVRPR

SEQ ID NO: 63 - protein, 118 aa, Methylobacterium sp.
DAGAVVRAYDPEGMEQARPLLPGVAFAEDAYHCAEGADALVLVTEWDAFRALDLDRLRAAMQRPVLVDLRNVYRAADVRAHGFAYSSVGRPDEPGDQPGDESGIPPVLPPADAVAGTA

SEQ ID NO: 64 - protein, 794 aa, Methylobacterium sp.
MSSPSSGRTLFFFEKPSAMRQLQRFFRSPSTVCVAAEGHLLSAEEPGSIRPEWKPWRFDLLPIVLPTIPVGYGTNRSGQSHAPKIAAIRQALSGVDRVIIATDPGREGSMIAWEVLEHLGWSGRVDRLKLGALDEVSIRRAFAALAKDPDSGERDYAAYLEALCRQYEDYHLGLNGTRAISLRLRPPAFREPWRFGGVQTPTLAILADLEERIRSFVPQDFFKVALHLTSDAGAAITLWHAPKDRILDAETAETIRSAAATWSGPLAVAHRDVRRAPPRLFSKDTLARRCAKRFGWDPQHTAGVAQDLYDQGYLSYPRTESEHLPEGQAGDAAAIISAVTTVLTDLSAIVPRDAAPLIRRGLKGHYVADPGEHHAIVPLRKAPARGRLGTDQFRLWELVAKAYLAAHLPDGVDARTSVTADVATPLGVKRFAVSGSVVRAPGWRALYGSEAELEADAVPGKTKREAEATATRLPLVTDGEGASAVAAEIATAMTEPPRRITRGELPVVMGRLIDQVDDPAAKRALENPANPNEPKGLGTAATRDTILPKLLRSRYITLSTGKDPAIEVTEVGLTFVRAVRSVFPAYGDPVGRAMFEAELAEIGRAATRAEAVARATAFRQRTRARLDELIAAIAQAPTVRLDPSLIPAGQGDQRPPTPAMMAFAVSLSERKGVTLPRGCRSSISVCRAFLDTHAGPRAGQEDDAGRADGRRSPSAAMVGYARSLAQQRGIPCPPDAETDFDACRRFLDAHAARPGQGRDEASAGGATSKRSAEREKRRGRVTRTPRPAAARRRA

SEQ ID NO: 65 - protein, 290 aa, Methylobacterium sp.
MDLDIREFEEVCRDLYVRALKILPPDIKAGFADLQRAETSATGRAILDTMVENVAVAERTKNILCQDTGIPIYNVVIGADVRFDGAALKAAIRRGCERATKEFSLRSSVVHPITRKNEQTSCGIRVPIIHVDFDDRPETVAVEMIPKGSGSENGSFLQMLLPSDGIGAAKRFVIDRVIELGGRVCPPTIVGVGLGGTSDLCMHLAKVAATRPLRSVCSDPEGARIEAELSRAVNELGIGPQGLGGRSTSFAVHVELAATHITQNPVAVNIQCHSARRARATLTPGGIAFD

SEQ ID NO: 66 - protein, 218 aa, Methylobacterium sp.
VPTGRRLTPEARERQIVEGAVAYFAEVGLDGHTRELARRLGITQPLLFRYFPTKAALIERIYEEVYLRRWDPGWEATVRDPALPVLERFRRFEIDYQRRIDDYAWLRIFVSAGLKGFDLPSRYLGMVRARIFAPLLAGMRAESNLPDPEVQPLAADEFELLFGIHGALVYVGLRSRVYGMDGTADRDAVRAAMLDAALPGLLATHRRVVTAARSSGAL

SEQ ID NO: 67 - protein, 151 aa, Methylobacterium sp.
MPDLPARFAELILAFAPLFVHRSWRHAQLLLIGAILTPGRRTVASALRIMGRAQDRRFVDVHRILNRAAWSPRAGGRILLGLLIAAFAPRGPVVLALDDTIERRRGKRIAAKGIYRDPVRSSDSHFVKASGLRWMSLMVLAPIPWAGRVWA

SEQ ID NO: 68 - protein, 307 aa, Methylobacterium sp.
WMSLMVLAPIPWAGRVWALPFLTALVPSERACRERGRRHKPLLDVGRQVALQARRWLRARDLVVVGDSGFSALLFLDAMRRARITTITRLRLDASLYEPAPPRPPGTIGRPRTKGARLPTLAAILAAKDTRWHAVVVLGWYEAGERTLEIASGTAVWRHGGLPVVPIRWVLVRDPESRFAPQALLCTEPMREPAQIVGWFVRRWTVEVTFQEARAHLSVETQRQWSDKAIARTTPCLLALFSIVTLLAARLPVRQRQRIAAAAWYPKPRPTFADALAAARYAIWRERTLAISPRRRARTKPRFRLPA

SEQ ID NO: 69 - protein, 300 aa, Methylobacterium sp.
MLMDLSDVALFCSIVSAGSLSAAGRLSGHSPMAVSRRLVALEAELGVRLLHRTTRTIALTADGETFLPLAQAMLDAKAAAMAAFSERHEGLSGVLRVTAPNRIGRALVVPQAVRLMAENPLLHVDLMFSDRIVDIAASGIDVALRVATLQASELVAVKLADNPRILCAAPSYLARHGRPERLVDLDDHTCLTLHAMDAWPFTQGGKPVAKRIGGRLAANSVDTVPGACVAGAGLALLTYWDVARDLTDGTLVEVTLTDTEPERLAIWAVLPTKQHTPARVRRFLDVMKEELAAHPRSRTP

SEQ ID NO: 70 - protein, 76 aa, Methylobacterium sp.
VTAVHNEQTKLLATALNNIAVAYVVIGFVTPMMAASFGVPSAPALRVENAIFTLVWLGTGCALHYGARRALRSLKP

SEQ ID NO: 71 - protein, 85 aa, Methylobacterium sp.
VPRSHQEATAVLPASRIEVSPRRGLRREESARYVGVSPSKFDEMVRDGRMPKPKRIDGCVVWDLRRLDLAWDALGGDDAASNPWD

SEQ ID NO: 72 - protein, 293 aa, Methylobacterium sp.
MSLALSVLSGLGAQAETAGSLSTTTAVSGSAAAMYNLGILYINGQGVKQDFGTAGRWFEKSAAGGDVDAMLNLGSLYYNGQGVKQDYAAAAAWFEKAALAGNAEAMNNLGSLYDAGQGVTQDYATARSWYEKAAAAGAASALYNLGLLYANGQGVGQDYGAAASWFGKAAAAGNVDAMNALGSLHLNGQGVKRDAAAARRWFEKAVAGGNVDAMNNLGSLYLNGQGVKPDAAAARRWFEKAAAAGHAEAMNNLGFLYVNGRGVKQDFEVARRWFEKAAGGAAAANVPGDIALR

SEQ ID NO: 73 - protein, 487 aa, Methylobacterium sp.
MTMNESAPGHPILREVPIGIAATGMRHETDSMGGIDVPADRYWGAQTQRSLQHFSIGDDRMPKRVYHAYGYVKKAAALVNAAAGRLEDWRAQAIVQAADETIAGKLDAHYPLYVWQTGSGTQSNMNVNEVLSNRAIQLLGGTLGSKSPVHPNDHVNMGQSSNDTFPTAMHVATVLELDEVLLPKARALADAIDAKAQAWMDVVKTGRTHLQDATPLTVGQEWSGYVAQMRDALALIESSRAGLYKLAAGGTAVGTGLNAPEGFSAEIAAKIADLTGKPFVTAPNKFAAQGSLDAMVAAMAAVRGLAVALMKIANDMRWLASGPRCGLGELLLPANEPGSSIMPGKVNPTQCEALVMVCIQVIGEDNAVAFAGSQGNFELNAMRPIIINNTLHAIRVLGDACEKFRTYSVAGTELNRTRIDETVNQSLMLVTALSPVIGYDLASKIAHRANDEGTTLREAALAEGVPAERFDAVCDPRTMIGHGLAGA

SEQ ID NO: 74 - protein, 380 aa, Methylobacterium sp.
MATIRKRTLPSGKVRWLAGYSDGGGKRRFRQFETKKEADAFLVQARTQVATGVHTPDSVSPTVAEAAELWLKRCERDKLERTTLLQYRGHLTHHIGPRLGAVKLSRLTVPLINEFADQLLTAGRSRVLVSRVMVSLSSIVTEAQRRGLVTANNVRSAKPVRRSSREDKRPEMPSRDELKAIIAATPDQWRPLILTAIFTGLRGSELRGLTWGDVDLRRGVLSVRQRVDRFNTFGPPKSKAGTRDIPLPPNLLTTLKAWKLACPNGPLGLVFPTVDGTVQGHANILHRCFWPLQVKAGVTVLKDGQNEQGRAIKVPEAKFSLHALRHAAAALWIEQGLSPKRIQTLMGHASIAQTFDQYGYLFEARDDEAAMMAGVEKGLL

SEQ ID NO: 75 - protein, 545 aa, Methylobacterium sp.
VRPAAAYRAGQRALAAGFISALLLGHGPASARTFVFCSEGSPESFDPARATTTTTMNAAWQVYNTLVEFTPGTTTIRPALAESWTVSEDGRTYVFALRDGVRFHANARFTPTRALNADDVVFSFARQRRSEPDGAAQGFTYFHDLGLADLIEAVDAPDPRHVRFRLREADTTFLANIAQAFGAILSAEYAAALAAGNASDDLARAPIGTGPFVFEGYRPDQVLRYRAFPDYWRGGADGSEPGERPDGLVFAITPNAAVRLNKLRAGECHAMAFPATGDLDAIRAEPGLTLLALAELNVAYLALNTTRAPFGDVRVRRAVNLAIDRRAIVAGVYGDAGILAQGPLPPGIWAHDADLPDTPFDRGEALRLLAEAGLADGFDVDLWYPPVSRPYNPNGRRVADMIQADLAQVGIRARPVTRPWNAYRAALYGGEPTLMLYGWTSDNGDPDNFLNVLLGCKAAQTGGANLARWCDPAYDRLVEAARRTGDREARQALYRQAQAIARRAMPWVPLAHTKVHLALRNDVLGLTMDPLGRHLFETVRFRDPR

SEQ ID NO: 76 - protein, 240 aa, Methylobacterium sp.
MSSTLQDRSVVVFGGTSGIGLAAARQAEAAGASVIVVGRDAAGAERVAAENGFAGWRAADVTRPETVAAALADIPRVDHLALMAGTFVAGKVREAEVDHLKRAFDERIWAAAYALRALGDRLAGDGSVTLISGALADRPNAQGTAVLAAASAAMEAFARGLALELAPVRVNALSPGTTDTPLLARTLGAHRDAYVAGLTERLPQRRLGTAEEAGAAVVFLMGNGFMNGETLHIDGGGRLI

SEQ ID NO: 77 - protein, 588 aa, Methylobacterium sp.
LSWFWGLGFFYAIHVTLTYGWLGFLAFALPNATGLGLFGWMLGAPRRNLDAIVAAVQGPYALLFMGAQFFAVAITIFGFAAYAWLPLFGHDAAVGVIALVLVACSLGHAVPLRGIRIVHCGALAVGLAASVILLGGLSAHRDGWQVPLQAFDERFYGLVVPSLVGFLLGPWMDIQHWQRAVEIRRSGGSVRAAYVTGALLFLGLLTINALMAARAGLGMPVVSSDGLSGAYAAVAQAIGREPATGVAVAFVIWTAIAAATTIDSFYSATRWLGISVTARSNSPLLAFVPAGLVASPVWILGAALATAAAAIWANLSLLYLMMPFATLLVGAAACLVCESLGATRRYDPVLTSMIGATACLIFVTGYLAPSWALLAIAPLIGLIGALPMIAEVLGWRAAPPVAELIPAAERAPRAAPVPVAVDQTDAVASHGFDGHWFVLRLIPTYDDTNSVGNVYFANYVRWVGKARELFFNICMPDFDLKSTDFYILTKSFQHDFRREAMEFEPVTVRISIASHNRKFVTLAHEIHSEVNGLLGRGEQSLMFVDTVHYRPLDIPRAIIEGFLPYWPKTSPHAVADGSGPTGVAPLGV

SEQ ID NO: 78 - protein, 243 aa, Methylobacterium sp.
MQTPTNIVRFRQPEDIDDPLTDVLRAGARRLLAQAVELEAEAFLSAMQDLRLPDGRARLVRHGHGPERAIQTGIGPVPVARVRVRDRGASGSEDRIRFTSALLPKWARRTRSLDALLPVLYLRGVSTGDFQDALAALLGRDAPNLSPAVIARLTTTWADEYARWQGRDLSARRYVYVWADGVYLQARMEEQAECMLVLIGATPEGRKELVGFQVGVRESAQSWRELLVDVKRRGLSIAPEIAV

SEQ ID NO: 79 - protein, 234 aa, Methylobacterium sp.
METPTNLVRLRHPEDLDDPLTEVLRSGARRLLAQAVEMEADAFLSAMQDLRLQDGRARLVRHGHGPERAIQTGIGPVPVARVRVRDRGASGSEDRVRFTSTILPKWTRRTPSLDALLPVPYLRGISTGDFQDALAALLGRDAPNLSPAVIARLTATWADEYARWQGRDLSARRYAYIWADGVYLQARMAEQADCMLVLIGATREGKKELVGFQVGARESAQSWRELLVDVKRRG

SEQ ID NO: 80 - protein, 80 aa, Methylobacterium sp.
LVDVKRRGLSIAPEIAVGDGALGFWRALDEVFPGTAHQRCWVHKTANVLDKVPKSVQPAMKADLREIHGAPTRAAAEAAL

SEQ ID NO: 81 - protein, 73 aa, Methylobacterium sp.
DLREIHGAPTRAAAEAALAVFVEKYGAKYPRAAACLTKDRDRLLAFYDFPAEHWDHLRSSNPIESVFATVRHR

SEQ ID NO: 82 - protein, 854 aa, Methylobacterium sp.
MNVNSAGKRPIMPAWERRCLDASPEEIARWGTLYPESTNTGLLCGHLVGVDIDVLQPALTDAIADRARRILGPTPLERIGREPKLLLGYRLAVPADKIQTAALHFTDDPQEKPTKVEVLLRGQQFVAFGIHPETAAPYRWPDASPLTVDFADLPETTEEALRLFVAEAEVILREAGAATKRERRQTERARETKGRRAAGFGLNEKPNRETIADALRSIPNDFDYDGWIRIGFALYDGLGEAGRDLWEDWSATSPNDDAAFTSRKWSSFAGGRSVKIATLFWHAAENGWRRPGAGRSGAPKRDRAERRASADPEAEISGEDDGRPVVRFVAGKVPEAVDRMEALLLASPVEIYSRAGALVRPVIDAVPAAKGRMTTVARMCPLTTVSLADMAARTMRFQRYDGRAEDWLDINPPVEMTATLLAREGQWRVPAVAGIITTPTLRPDGSLLTVAGYDLATRLYLALDPGFTMPKLTERPDKREAAEALGFIETLLAGFPFVGPVDRAVALSGVLTALVRGVLPTAPLHAIRAFTPGSGKSYLVDLAAVIATGRRCPVIAAGKTEEETEKRLGALLRDAVPVVSIDNVNGELGGDMLCQLTERPLVRVRILGKSEAPELECRSTTFATGNNLVLTGDMTRRALVCSLDAEVDRPELRDFDFDPIATVLADRGAYVAAALTVIRAYRVAGSPSVCGAIGSYEDWSDMVRSPLVWLGHADPVASMETAREEDPELSAIRELFEHWRSHLRLSSGYTTNTIIRTACDRDAGSHFAGPGDFKLAEFRDLLLRQAGDGGAVNSRRLGKWLSRIKGRVVDGHRIEMKADASNGNRFSLCQVSVPEYPAGSPVAADYRASSAPEF

SEQ ID NO: 83 - protein, 127 aa, Methylobacterium sp.
MDMAERFSQIRKIMPPASCAVASWYPGADLVDAFAVTLPGPRPHDLSRLAQATLLNPPSWITAAMTVRDAAVSLFGVRTSGEIRGRLKTDSRDRIDFFPVLSRSEREIVLGEDDRHLDFRLSLLLRV

SEQ ID NO: 84 - protein, 268 aa, Methylobacterium sp.
MSRAGIRRTYGAISGAVLVFIVLPLVVIVWVSFFANRILAFPASGYTLDWYARALDTDAFRDGFVTSVETALFATAASLTLGVPASLGLVRGRFPGRDAVQALLLAPMVVPGIVGGAALFIAFIEVEALLDIQVAGTLGGLLVAHTLIALPWTIRLVSASLASADRAIEEAAASLGADPLTVLRRVTLPAIRPAIVAAALFSFVISFIDLEKSIFLVGPGRTTLQIALVNYLEWNLDGTVAAVAAVQILIVGTALLVSDRYARLAQAF

SEQ ID NO: 85 - protein, 613 aa, Methylobacterium sp.
MSPSQEERIAAEQLRLVLDGVTQSVAVGFLVSTLMLAVLWSLVPHAVLLSWYGAFLVERFGAAAYAHRVRAAIGEPDRARRVERVIFLSKIVEGAILGSLIWIALPLQVPAVSILTMSLLGATCSNGVSLLAPRRHLYLALVVPVAVLAAGTLWSLGGAPYRALAICSILFVVGQYGQVVLASRRVRESIELRFENAALVEQLRAETAAAHRARRDAEHANTAKSQFLAAASHDLRQPVHAQGLFLQALSQTDLAAPQRRILQNAQTANVASTDMLNTLLDFSRLEAGVITPRPRAFELQPLLDKIENELAPLADAKRLIYRTPQTDLAIVSDAALLELVLRNLVLNAIRYTERGGVLIGCRRRRAGVSIEVYDTGIGIPADKREDIFREFYQLGNPERDRHKGLGLGLAIARGIAASLDHPLSLSSKVGSGSVFRILVPRTLDAGRDAGLDDAPAAAIAESGGLVGARILIVDDDAIVRDAMVALLSGWGCLCRAFEDPTDVTDLPPQGPPPDALICDYRLRRGQTGAEAIATLRQHWGRPIPAILITGDTAPVRMREALDSGVPLIHKPVRPDLLQKALAALIPPGRPPVGPVGAEVRRGPETTDLVRAEG

SEQ ID NO: 86 - protein, 268 aa, Methylobacterium sp.
MAHIETAAPPLLKIRKLHKSYGTNEVLKGISLDIHEGEVVSIIGASGSGKSTFLRCLNLMETPTSGFMDFERFAFDYEQGARRQPTPQQLCELRARIGMVFQSYNLWPHMTVLENVIEAPIRVRRMPRRQAVAEAEALLQRIGLYEKRHAYPSKLSGGQQQRVAIVRALAMAPKVMLFDEVTSALDPELVGEVLALMGSLAADGMTMLLVTHEMAFARDVGTRTLFFDGGVIAEDGPPDAIIGAPRSERLRQFLRRVLHQPAAPGQTA

SEQ ID NO: 87 - protein, 140 aa, Methylobacterium sp.
MQQQISVITLGVSSLGRSRAFYGDGFGWAPVFENDEIVFYQMNGFMLGTWQNPNLDQDMRRASEPSPSAFCLAHNVPNRGDVAPTIARLIAAGGTLLRAADEPPHGGFRGYLSDPDGHAWEIAWNPAWRIDARGLVTFGL

SEQ ID NO: 88 - protein, 126 aa, Methylobacterium sp.
VTSSTGQRPAVLLIEDEAIQMMVLSDLIEEAGCDVVEATTTTKAIQILENRPDIRIVFADLDMRGSVMGLRLAALIRERWPPIELILTGAVKPDLSSIPARGVFHDKPFQQRKLVQCIREFASVSQ

SEQ ID NO: 89 - protein, 137 aa, Methylobacterium sp.
VPELNAILETALYVADLDRAEAFYRDTMGLRCLFTDFRMRAFDVGGRGVLLLFPEGGSLQPIETPGGLIPPHDGRGPAHIAFSIDADALAPWEDHLAAAGVAVEGRTRWPRGGVSVYFRDPDGHLLELATPGLWKGY

SEQ ID NO: 90 - protein, 399 aa, Methylobacterium sp.
MARRKAPRIPDAILDQLLAGADPKTAFEADGLLDELKKALAERALNAEMDHHLAGEDAGNTRNGYGRKTVTTETGRIELAIPRDRQATFDPQLIAWYQRRFPGFDDKIVSMYARGMSTREIVAHLRELYGIEVSPDLISAVTDAVLEEVAAWQARPLEPVYPIVFFDALRIKVRDEGVVRNKAVHIALGVRADGSKEILGLWLEQNEGAKFWLRVMNELRNRGVEDVLLAVVDGLKGFPDAIRAVFPEALVQTCIVHLLRHSLDFVSYKDRKLVAGALKDIYRALDAAAGEAALAAFEASEWGRRYPAIAQSWRRAWGEVIPFYAFPGEVRRILYTTDEMDKTHRAFRGSFLRARATSWRSAGPRLQAPPGRLHSSLADLRRPRTVFDGRGVQCATTRS

SEQ ID NO: 91 - protein, 406 aa, Methylobacterium sp.
MARRKAPRIPDAILDQLLAGADPKTAFEADGLLDELKKALAERALNAEMDHHLAGEEAGNTRNGYGRKTVTTETGRIELSIPRDRQATFDPQLIARYQRRFPGFDDKIVSMYARGMSTREIVAHLRELYGIEVSPDLISAVTDAVLEEVAAWQARPLEPVYPIVFFDALRIKVRDEGVVRNKAVHIALGVRADGSKEILGLWLEQNEGAKFWLRVMNELKNRGVEDVLLAVVDGLKGFPDAIRAVFPEALVQTCIVHLLRHSLDFVSYKDRKLVAGALKDIYRALDAAAGEAALAAFETSEWGRRYPAIAQSWRRAWGEVIPFYAFPGEVRRILYTTNAIEALNATLRRAVRARGHFPTDEAALKLLYLVLNRSEKAWKMGPREWVMAKAQFAVIFGERFTRAMAA

SEQ ID NO: 92 - protein, 406 aa, Methylobacterium sp.; identical to SEQ ID NO: 91

SEQ ID NO: 93 - protein, 406 aa, Methylobacterium sp.; identical to SEQ ID NO: 91

SEQ ID NO: 94 - protein, 187 aa, Methylobacterium sp.
MRFDACWDPACGEGHMFEVLLEYFGGGGWGSDIFDYGRGYRVEDFLDEGTVIGSPEDGMAPEFIITNPPFRPATAFTLRALTLAPVVAMLLRTVWVEGVQRYETLFRDRPPTLLAPFVERVPMTKGRWDPDAGTATSYAWFVWVRGRDPHAPFWIPPGCRQRLTKPTDRTRFAVQTATPLFDLAAAE

SEQ ID NO: 95 - protein, 1763 aa, Methylobacterium sp.
MVAVNQIAVNETRFVYTTEGVDRVRAQNEQVASSLDKVTSASGKATDAEGKAASSSDKAAQARAKLAAVQERFQRQMQAEAQILGMAQSQQDALTAATERFADAQSQAARSASALQSAANDNTGALERQGEAFKAAGKFALEHPIIVAAASVAAARALSGFAATAAGSLATASAVTARYAATSTEMGTTVAAGAALASRGLSGLSTGAAAAAVGLETFATKAAGLTTTTSLLSRALSLVPAYFLPIAAAFAVFELASAAIKKAYADLNQLVQLGEKAQSLDIGAPFLKSFEAIAPKIQATKDQIDAAIGKASSFLKDSWGSGNGLSKLFNDISSTGVAGAGGLQATALSDTATSIQERIQAALAGMKELDELGLHLASIQVGEKVFGPEFVERLRVSNTSAEQLSAALQAAAEKEVLKQEQVDRALALNRQISDTKQAISEAWAVTVDFSAAALLLNEAWLKILQAVQWVVETINSAISAVGNFASAVASGIGGAFDAVSNKVSGLLTQMGVLSAQQKVVASETPKIDGTYGPQQPTITARQFPYVFGPEAPKAAAAAAKQSKQAAQEAVSSYDNLIQRTKDRIEELDLETQSVGKSSEAVIKLKLAHDLERAAKKDGITVTAEMRAETDRLGTSLAASTENLANAKRQLELTREAQRELGDTFGTFAEDVILGGQKMSEAFAGLAKTLASSSLKALLTGQGGLAGLFGTAGEKSSDLGGLLGGKISFGSLFGGGSSNDAGSPLPGAQGPSLPSSSLFGGLFDGEKITKALGLGAESGIGNALSNALKPKGNGGILSSPLGGAIASVGAGAAIGYSSQSPLMGALGGGLAGLASGNPLLAVAGAGAGLLGGLFGQSEAKKQAKRQLQQELQARREALDQARPQIEQLALTFEGGSIGNIGKTISDALSQAKQAIKTASDGGDQALADKLMKDYQSYVARLTAVFAEGFNGVAAEMQAGFGAGGPFSQAISSVQQLGEVLKGFVTDAGRLSPAAVAAAQTAAVTGALAALQPPPNLSATQTELARINGTATGLNQVLKDLGLSADQAAAAIKDGTNKALDALRTKFSDDLGRKINDALNKGYLNDAADLVKEVASLSQDASAIGGDLGQVDTYFTAAAQKIVDGSQLAGSAFDELITKFPELAGKVHEFSETASMSADQAAKAAQEALSAIQDRMRGYEDRYVAATFETESLPGKLLAFDRAAEWERWQEGAKGNQAIVELERAQGAERLKIINDFAKAATEALNARLKGYADRLFNAGNDTSTLGGQLAAYDRQAQQEREDEAKAGGQALVQLEMTQAAERAKIVADYAKQAADALKQQMSAAQTAFETFVKNIKTYLDNLRSGGSSPLSPKDRLAAAQSQYDAQLALAQGGDRTALDNITQYSDALLAASKGYNASGEGYQATYQKILDDLAKLPTQVSAEQFIVDAINDSRDAIVSATDAMKLELKEGLIANSPQLIAAALLQYFNMLDTSVNGLLDYSEFTAGLGPLATEAEQQQARAIFNAIDANGDGQLSKLELQNASSYRLEQYTASTDANTDQANNIGNAQKATMDNQAAYLNSINNLTNAAYATQQQLVSLNASINSQNAFIQQNTGFTNSYLATQGQYFGDTYLLQGQILNNLRSANAKNGAPVYATGGWVSGPGTGTSDSISARLSNGEFVVNAASARLNGPLLEALNDNRPFAMPTIGVPAGGGRDDAALIAELRALRAEVARLTQLADEGNSIAAEGHSGTRAAVGRNTAALETGNTVASRKSLERPVKAA

SEQ ID NO: 96 - protein, 277 aa, Methylobacterium sp.
VLGRVDHRSRLVVERRVNGAGSHPRQAYPCNELIVMLGGRAVVRRTGDGQDEKCLAGAGTAWTGPVGFMEKAELSEAISCLHVCLPRALIEHSALADYGIDASLVELAFVGGLADPLLVSFARAFEGMLGRPQSPTDRLFVDGLTTALAAHLIANYTVDRWKPSTAPRKLDERRLKRVTDYIEAHYAEPIPLERLAAEACLSPFHFARLFREATGLTPHRYVTDRRVRAAREALALGRATLMEIAVEQGFGTQDNFTRVFRRSTGLTPGQYRATVRR

SEQ ID NO: 97 - protein, 137 aa, Methylobacterium sp.
MLTPFHLAYHVTDLDAARRFYGGVLGCQEGRSTETWVDFDFFGHQLSLHLGEPFATTRSGKVGDHTVMMPHLGVVLPLDAWEALAGRVEAAGIAFDIPPVVRFAGEPGEQRTMFFFDPSGNPIEVKGFRDLAGVFAH

SEQ ID NO: 98 - protein, 250 aa, Methylobacterium sp.
VTAPVGHAAVDPGAGETLRVRVRRGETVADYAVPRRANQTVLDVVTEIQRDQDPTLAYRFACRVGMCGSCGMTVNGRPRWTCRTRVAAVAPDGVLTLEPLRNLPVVKDLAVDMEPFFEKWRRAHGFFEPGENPPEDFAVVEPESAARREVDAGIECINCGVCYAACDLVTWNPDYLGPAALNRAWTLVNDVRDRDRDRLAAVAGDAGCHSCHSHMSCTEHCPKGLSPTFSIAGLKRETGKAALRRFWRRG

SEQ ID NO: 99 - protein, 109 aa, Methylobacterium sp.
MSALLYLAQRGTAAILAVTVAVHLGTILYAVRGGLTAGEILGRTQGNVAFLLFYAVFVLAAAIHAPIGLRSVLREWTGWRGRSLDVAMIALSALLAGLGLRAALAVYAA

SEQ ID NO: 100 - protein, 125 aa, Methylobacterium sp.
MRTATSTAGRAGITRASLRRPGFAAALIHRLSGIALALFLPMHFIALGTALQGADRLESFLGLTHNGFVRTAEWGLVCALAVHMALGLRVLAIEWLRFRERNARVVAGCLAAAFAVGLLFLLSGA

SEQ ID NO: 101 - protein, 203 aa, Methylobacterium sp.
VAHHVLDMPATEAEIRALRIGDTVTLRRWLFGIRDATLIHMFDRDRRTRLDLDGHAVIHTAPNVHRVPVSNEAPVGFAPFCIGTTTSMRMERFTDALMEREGVRLIVGKGGMGPATLDAFARRGGAYLAIVGGAAALETTWIETIVDVDLDDLHPESLWQFAIRDFGPLLVGMDSHGGSLFADVQRDVAARRDAVIASLEDAR

SEQ ID NO: 102 - protein, 574 aa, Methylobacterium sp.
MSPEQVETDILILGSGGAGLFAALHAKKVAPDLDVTVAVKGLLGKCGCTRMVQGGYNVALAPGDSVERHFMDTIEGGKWLNDQALAWTLVTEAQMRIRELETELGCFFDRNPDGSVHQKAFAGQTFDRTVHKGDLTGIEIINRLSEQVWRRDVRRLEDHRALELIPARDGSGLAGVLMLDMRTGEPKLVRAKAVLLATGGGPTMYKYHTPSGDKSCDGLAMALRAGLPLRDMEMVQFHPTGLLAGAGTRMTGTVLEEGLRGAGGWLLDSTGQRFMEAYDPRAERATRDVVSRSIMRRLRDGFATPSGGVHIQMSHLGPEDVRRRFKGMVERCADCGFDLAGGLVEVIPTAHYMMGGLQFAVDCTTALPRLYAAGEDTGGVHGANRLGGNGVANSTVFGGLAGQSMARAVTREGRLAEPDPAAIEAGLARAYGPLGRPAESLPEIREALYETMWADVGILRDAAGLTRALATLDGLSDAVARAGAPDGDRRYALTWMDRLNLENLVLVSQAVARAALARTDSRGAHFREDFPEASDLATSHFTVVRQRGGALDLAMEPVHFTHVRPGGSLLDAAA

SEQ ID NO: 103 - protein, 99 aa, Methylobacterium sp.
MAYFLLRLEPPRPSFPFDATEAEKALFSAHSGYWMEQAAAGTAIAVGPVFESGGTWGLALVEADDAARAEALGEADPVLMAQAGFRYTVSPVPSLILRR

SEQ ID NO: 104 - protein, 441 aa, Methylobacterium sp.
MLADRQISAARMIRRSRTTVIVLGVIAGAAVAALLIHLLLGLLSLDIAVAKTSTEDREAAQALTQLFQTQHPRVRIRTIFEPDRLGASAALDKGETQLALVRSDAAPKDGQTLVILRRDAVVFVAPGGSPVDSVAKLRGSTVGLLDGRKLDPRLLDLILTHFGVPPSSVHRRILTIDQLTEAARSRQIGSVFVVAPVGSALWLPLFTALRKGSGTVKLFEVDEAAAIAKEHPVLDTIDVPKGAFLGSLPAPGDDITTLSVSHRLVARGAMPDWLAGEITREVLTGKPRLVALDDDLAGIEAPDTDDKVQALPIHPGATAYLTGNQPSLSDQAQNAAYWVGLMISALASLGAAGIGLYRRFRPLQPPTRVMRLLEIWLSVSSADPAELDHLEREADTLAAETIRMEAHRRTESVEIRLVALLVAHVREAVQRRRRHVAQRMT

SEQ ID NO: 105 - protein, 184 aa, Methylobacterium sp.
YFLEHAIASANAQELDRPATIHFFVGIDPGIEIPAQLAAHPQVTFARGPQRGQIPALNAAIGAVDDSWDLVGFLEDDDHWLPPYLGFALRALESFDFVSSTQLETDEAGEVVRINDFATPSGWLMRRTTFAQVGAISPASKWHYDNEWLGRLAETGLRRAHLVEATAPVTLQDAIQVRPWLANV

SEQ ID NO: 106 - protein, 495 aa, Methylobacterium sp.
MLRYAACLLAGLALTGPAAAQTLRYGMMEDPDALDPTLARTFASRMVFAALCDKLVDIGPDLKPVPQLATSWELSPDEKALTMHLRPGVLFHDGEKLDAAAAKFSIERHMKMPGSQRRSEIAPIDSVDVVDDLTFRINLKQPFAPLLAQFTDRAGMMVSPKAAERLGDKFASAPVCAGPYKFVERVPQDRIVVERFPDYWNKDAIHIQRIEFRPIPDATVRLTNLRAGQLDLLERLAPTDVAQVKRDAKLKLDSTYELGFQEILFNPHKAGSPVSDPKVRAAFEAAIDRNAINQVVYNGEFLAGNQWVNPKNPNYVAEYPIPKRDVAKAKALLAEAGKPNPQITLTVYANSESPQVGQVIQAMTKEAGFDVKIQAVDFTTALDAADKGNYEAQLYSWSGRSDPDGNTFSFLACKAALNYPKYCSPEADAALQAERGTVDPAKRKAAWKALADQVLKDRPGIYILHRKLLWAYSQKITGFVPYPDGLVRFTGLKLN

SEQ ID NO: 107 - protein, 309 aa, Methylobacterium sp.
MSTGSEIARAEAVGLEAAPSGAPAHAILREPGTLAAFWRRLRARRSAVVGLVIVGLLVLMAVFAPWIAPYDPTATDWGNVRGPPSLAHPFGGDEVGRDVLSRIIFGTRASLGAGLVSVALAVSLGLPLGLLAGYAGGWIDGAISRLTDALLAIPFLILAIALAAFLGPSLVNAMIAIGLSATSTFIRLTRAQVRAVAAEEFVEAARAMGNPPWRIARVHILPNIVPAILVQATLTIAAAIIAEASLSFLGLGQQPPDPSWGAMLNTAKNFMDEAPWMAIWPGLSIFLAVLAFNLFGDGLRDALDPRQRT

SEQ ID NO: 108 - protein, 338 aa, Methylobacterium sp.
MIKPLLDVRDLAVAFDTDGGAVHAVNGVSYTLHEGETLGIVGESGSGKSVHVLAMLGLIPRPPGRITGGQVLFEGRDLLALKEQDLREIRGGAIGFVFQDPMSSLNPGMTVAAQIVEPLRIHLGLDARAARARARELLDLVRIPNAAARLDQYPHEFSGGQRQRVMIAIGLSCRPKLLIADEATTALDVTVQAEIVALVQELKRELGMAIIWITHDLGVVAGISDTVQVMYAGRILERGPVDDIFADPRNAYTLGLLRSLPDLSGGRAGRRRLHQIEGAPPDMRHLPPGDPFAPRNAYATPRCRAEMPPLAQAPGAAPGHLVAAWYDLPKLLDEEAAR

SEQ ID NO: 109 - protein, 307 aa, Methylobacterium sp.
MNASQQPVVSVRDLSKHYPLRSWWGGKGAVFRAVEGVSFDIRPGETLGLVGESGSGKSTIGRAVTMLNPPTSGTIAFEGTDLAKLSAGAMRRMRARIQTVFQDPYAALNPRMSAGEYVAEAFKLHRRDMRGPERREAVAALFQRVGLDPRFMGRYPHQFSGGQRQRICIARAIALKPSFIVADEPIAALDVSIQAQVVNLLQDLQDEMGLSYLFISHDLRMVRYLCHRVAVLWRGRIVELAEADALYDDPRHPYTRRLLAAVPVPHPAEERARLAARDLAGHDQPPDGPLTEVAPGHWVALPRGQQA

SEQ ID NO: 110 - protein, 84 aa, Methylobacterium sp.
MGDAMIRPAEFWDTVGGLVTAKVEPVIGRADRHRGPVIDYLRDLEALARRQCSSRETVQIIASGRRLLGDRSEIGPSDGPFTRA

SEQ ID NO: 111 - protein, 97 aa, Methylobacterium sp.
VDQWRKMHPAKPAACVAREINAPIRTVEKWFKGEAKPSLDYVGPILNRYGLAFVVGAMANPLPWLDDLAREERKLKLLAERQAIDDMLAEDWRRAQR

SEQ ID NO: 112 - protein, 90 aa, Methylobacterium sp.
MAALTRISGQKRLVAMRISLGLKLSAVIGLLALVAIGIAAFAVRQSNWEQERAAATDRIWNAGLQAGALGQAIEHAVVQATALYTAEDTT

SEQ ID NO: 113 - protein, 389 aa, Methylobacterium sp.
MPIGLQDFDFGLGETADALRAEVERFARAEIAPRAAAIDASNAFPADLWRKLGALGVLGVTVEETYGGAGMGYLEHAVAMEEISRASASVGLSYGAHSNLCVNQIRRNGTEAQKRRYLPKLIAGEHVGALAMSEPGSGSDVVSMRLRADRRGDRYVLNGTKMWITNGPDADVLVVYAKTDPEAGPRGITAFLVEKDFPGFSTAQKLDKLGMRGSNTCELLFQDCEIPEENVLGAVGRGVGVLMSGLDYERAVLAAGPLGIMRACLDVVLPYLHERRQFGRPIGEFQLMQGKIADMYTATNAARAYVYAVARACDRGRATRRDAAGAILFAAERATAVALDAIQALGGNGYINDYPTGRLLRDAKLYEIGAGTSEIRRMLIGRELFAETA

SEQ ID NO: 114 - protein, 76 aa, Methylobacterium sp.
MRTIILSGALFAALCGAASAEETTVIRRDGPAVVDHRDTVVEKREVTTGSVDCGSKTVHKEDGMGNSKTVHKEGCN

SEQ ID NO: 115 - protein, 223 aa, Methylobacterium sp.
MFVFSIVQQKGGVGKTTLAISIAAELRARGKKAILIDADPQASAVAWASPRKLGFEVRAELIGGQTVSQWLRNVLKQQADFVIVDTPAGLGPAFRAAIDIADLIIVPCGPSSLDLNAARQTLSQVSSALRSDARSQARIVTIPTRVDVQHPEGQQIAEELSSFGEPVGPALSHDVYYVRSFSQGVAVTTAAPASPAAAEIRAVTDFLLRRLAERNGGLERNGA

SEQ ID NO: 116 - protein, 123 aa, Methylobacterium sp.
MTLPITPSRHTPLPVHSRNPRRAYDVDGFEITPMTFQQAMDKGVLAVRVICGCGHVEETPIYVGAWPSTSFVPDAGMTLRCSACSTPDPWTEPVWPAIPSTDGLEPSCLLPDQLPESDPGLVR

SEQ ID NO: 117 - protein, 506 aa, Methylobacterium sp.
LNGALRSRQSAQAALRELDRQDYLQNHLRFVQRFFREKEGYDMIVGPHHRIMCETLDRVLRGEISRLIINVPPRYTKTEAAVVHLIAHGLALNPASRYIHASFNGPLALLNSTSVKDVMRLPAYREFWHREPRDDLDSKELWRTPEGGGMKAGSAGGPITGFGAGLMYEGAWRFTGALIIDDPLKPKDAPHETMRKAVNDNWNATFASRLATEDVPVIVIMQRLHVDDFSGFLLKGGAGCKWHHLLLPVLIDNAAEYPAEFTHGIPIAHGLPDGPLWPYKHNAEQIEALRHDSYTFAGQYMQVPVVSGGNLFNEDWLHGYDELPKLEYRMIYADTAMKDGERNDYSVFQLWGKGVDGRAYLIDQVRGKWLAPELEKVARAFWWMHADMETHHFGALRAMKVEDKASGTGLIQTLVRPYAGEGGRKGIAIPVIPIQRDKDKVQRANDALPQFACGNVRVPTDAAWFPAWKSELLAFPSGSHDDQVDPTCDAVSDMLVNVSNSRLVFG

SEQ ID NO: 118 - protein, 535 aa, Methylobacterium sp.
VKPEAQRKAEREKAVALIRALDREEIVTEARERFMPFVRFTMPDPQDPDDAKRSAYDDQDFHRAIGLALEKVERGDMPFLILTVPPRHGKSQLTSRHFPAWLLGRDPRRHIVVAAHTDNLAEDFGADVRNIMSTPQYKQVFPEVAFQRGGNAKNRLQTTKGGLAFFVGRGTALIGRGADFLILDDLIKNAEEARSAAVREEVWEWVVKVAMTRRMSARSPVVIIMQRWHEDDPVGRITDPTNPKHDPMLASKFKIIDLPALAVDDDPLGRPKGRALWPLSKGQPKFDEEFLEQQRRLDPTGFHALYQQQPSAVDGTLFLRDNIRLYSPDELPANLTPYCTSDHAVGEDRKKHDASVLLGGGLDRGNNLWLTNCIWERWATDRIVEAMLDMAQELNPLIWAAERGHISKSIGPFLRKRMHERNIFFPLREITPSENKEVRAQAIAGRVAQGKVFFPRHAAWTERAIDELLKFPNGRNDDFVDALAYFGILLQSMFAPGRSEQERRAAEPKTGSYAWIKAMQKRQEQAEQFREGGGY

SEQ ID NO: 119 - protein, 213 aa, Methylobacterium sp.
MLVDDHAVVREGYRRLLERQPDMEVAAEAGDGAEAYRAYRMAEPDVVIMDISMPGRGGIDAIRQIRQVDPSARILVFSVHAAVSYALQAIRAGARGYITKSSASDLLIDAVRSVFSNKLTLCAEISHLLAASRLAEETSPIDQLSPREFEILRMILDARHTDAIAADLSLSPKTVANYHYAIKSKLGVSSDVELVYCCIRCGLIDPFAVVGAD

SEQ ID NO: 120 - protein, 267 aa, Methylobacterium sp.
MNDETEARGAGEDLLFSVAEGVATITLNRPERKNAFTFPMIEAWTAALQRCRADAAIRVVVVTGAGSAFCSGGDIVEMGERLDQPPARRKEELYGRIQRIPLTLEDLDKPVIAALNGVATGAGLDLALMCDLRFAAKSARFAETYVRVGLVPGAGGAHFLPRLVGTAKALELFFTGDFVDADEALRIGMVNGVHADADLMPAVAALARKIAKAPPLTLSLIKRAVYQGMRNDLRTNLDLISSHYAVITATPEHREAVQAFIGGRDRT

SEQ ID NO: 121 - protein, 579 aa, Methylobacterium sp.
MNRADAPQGYDADVIVVGAGPIGLTTGNALRHHGVSCLILEERTDVKAYSRANNLWARPQELLAGIGLRDLLAENSYAIHTINFFVNGTPTTPIPIADVASPYPKVLYSGQDVIERTLAGEFASRGGKLDRGCTVTGVEQDDESVTVVLRRGKDGPEERRRCRYLVAADGAKSTIRPMLGLDFEPERLPNCMNRQVDAKLSWRRSMEPDQLWFFYYERGFAGILPVWGGYHRLFFLADDAGVPDRDPTLDEMQAVAREVTGDETLTLSDPQWLTHSRFQYGVSPEYVRGRVFLAGDAGHLSLPIGGQGMNAGLHDSVEIAWRLAMTLRGEAGPVVLASYDGERGGEHARLSAQQARGFRWTVYRGAVTDTVLGLAAKALPNLGSLLQGTDDMQQMGVEYPKSLLNEDRLSGLATLLRSGPKPGQRAPDAEVTHNGEATSLFPFLCNPDGHTTGWALLCFDGRSSDAGESLLDIIEAVAPWPWVRPRLVLAGPMVDSRSVPVLSDMDGKAHGAYGLEGRPALVLVRPDGHIAFRSDADRADCLVAYCRKVFGSAREAPEADARRMEPRLMTEECRGRQLD

SEQ ID NO: 122 - protein, 446 aa, Methylobacterium sp.
MARTDVDAEILRFESETGEIRQAPEPVGLRVTTLVLAAFLTIGVGLSAVARVDRVVTSDRGRIIPSQGPILFQALDASIIKSLDAREGEQVHKGQLLATLDPTFASADVDQASKQLASLDAQIERAKAEQAHRSYDPHSSDPDRVPYDKLQKQLFDQRASQLKSQLASFDAKIAQTKATIKKLEGDEARYTEREKISGQIEGMRQQLVEKQAGSLLNLLIASDSRLEMLRTMENGRNAMVEARQQLSSLQADRDAFLQQWLSQSSQDLVTAQGTRDTVVAQLAKAARHKDLVQLHAPADAVVLTRAKVSVGSVLREGDTLMTLVALDAPIEAEINIAASQVGFVRAGDPVTLKVDAFNFVEHGFAEGHLRWVSEGSFSLNEDGQPVPPYYKARVSIDQLKFTRVPVGFRLIPGMTLTADIHIGDRSVLAYVLTGASRGLSGAMREP

SEQ ID NO: 123 - protein, 299 aa, Methylobacterium sp.
VAATVAARGLFPVKVVADVLGVARSNLVEQIRSGSRSRGPYRRADDEAVLIAIRAITDVRPTYGYRRVTAILNRTRRATGEPALNHKRVFRLMKRDSLLLQRHTGGRPVRAHEGRVIAAASNQRWSSDGLEIGCWNGEAVRVAFAIDTHDREVIAWVASTGGITGQMVRDLMLTCVEARFGSLEARFGSLCATHPVQWLADNGSAFTAAETLSFAAALNLVPCFAPVRSPESNGVSEAFVKTLKRDYARVQPRPDANTVLARIGAWITDYNEHHPHRGLGMRSPREFIRAQMQPAPCPV

SEQ ID NO: 124 - protein, 136 aa, Methylobacterium sp.
VRWCSDHLELRCRDGAVVRVLFAIDACDREIIAWSATTTGVSAEMVCNLMIACCERRFGATKTPHPVEWLSDNGSAYIAKETAQTAAALGLRLLHTPVRSPQSNGIAEAFVKTLKRDYARLAILADAETVMRLLSA

SEQ ID NO: 125 - protein, 153 aa, Methylobacterium sp.
VRVAFALDCCDREAMSYVATTAGITGEDVRDLMMAAVEHRFGAVNQLPSLIEWLTDNGSCYVARDTRRFARELGLIPKTTPLESPQSNGMAEAFVRTLKRDYVRVSVLPDAESVLRQLPVWLAHYNDLHPHRALGYRSPREFITRSTQETLSG

SEQ ID NO: 126 - protein, 168 aa, Methylobacterium sp.
VRAILLICLLGFLGVTAVLKLRDATRPAPVALAVTPPPEPVPAVDAAGVALQAGRNGHFYVNALLDGRSLPMMVDTGASACAFSEEDAARIGIRVTPADFTRVWNTANGTVRVAPIRIAIVQIGSITVRDVDAVVIPRGLLSTSLLGMSFLRRLRDFGISGSTMTLRG

SEQ ID NO: 127 - protein, 286 aa, Methylobacterium sp.
MFDATKMLADALGEHLALTYQRTFGSREPRYAEIIEAAARLTIERIVGSDALYHDGDHTALVTLVAQDILRGRFLQQGITPEDWLHMILAALYHDIGYVRGVCAGDRLQAFVIDAQGTTVSLPRGASDAALAPYHVERSKLAVQERFGTHDLVDASRVIRAIELTRFPVPEDDSHRETGTEAGLLRAADLIGQLGDPLYPRKLNALFHEFAEIGVNAELGYDSPADLAERYPSFFWGKIEPVIGDAIRFLDLTVEGRGWVANLYAHVFAIEHDRRRMGPHPGPDPL

SEQ ID NO: 128 - protein, 326 aa, Methylobacterium sp.
VITGPCLIVQPIHAAGLDRLRAAGLEPRPASGTDPETLAREVADCVAVITRNTGFPARAIAAAPGLRVIGVHGTGTDHVATAEATAAGIAVVNTPGANAVSVAEQTLALIFALAKALPEADRSVRAGDDSFKFTARLVELAGLTLGLVGFGAIGQATARLAAALGLRVLAYGPSRPDADFANAGALRAASVDALLAESDIVSLHVPLTPGTRGLIGRDQLARMKRDAFLINTSRGGLIDEAALVEALEAGTIAGAGLDVFAREPLPVDHPLARQPRAILTPHVGGSTGAALIRTAETAATRVVDVLAGRRPGGLVNPDVWERRRGV

SEQ ID NO: 129 - protein, 37 aa, Methylobacterium sp.
MFASPHAFVLHHRERLAVLVSSALFLAGALPLFWAIG

SEQ ID NO: 130 - protein, 269 aa, Methylobacterium sp.
MNRRHVLALAALCASLGAGLLAAPATRAAEGKLELIEPGKLIVATDSTFAPFSMRTPNGELDGLEVRVMREVCRRLGLEYSPVNIKFDALLVGLMADQYDITSESMDITPARQKQVAFADGWLESGARIVTRKDTGIKGPADLKGRNVGALSASTFGKLAEENGATLKSYKTAADAMQDLVGGNIDAVINDAVAGNYAIKARKLPLVMIETPLSTVQKGFAIKKGKPNLHAAVNKALGEMVADGTYAKLVTPLIGYDPAPKEPIRTPAM

SEQ ID NO: 131 - protein, 226 aa, Methylobacterium sp.
MKTLDAASYTTALSARREQSLGQMAYDRLLDMLVRRDLPAGTVLHERRLAEMLDISRTPTREAMSRLETEGLIERQPGGMLVVKEFSLRELIEILHVRRLLERESVALATGRIADAVLADLQRQMEALLAAGDPDAPGNWEVDRRFHDLIAEHSHNATLAKTIKDLRLKTQMFNLSRMPERFEAVHREHLAVVAALRAKDAAAAADAIAAHLENFKQGIIRRLSEV

SEQ ID NO: 132 - protein, 101 aa, Methylobacterium sp.
VILSAGLEPEEDGTAALVPLRPDFDAAALRTLAKSSRDPDQTRRLLALSAIYAGSLRSEAAALGGFGLQTVRDWVLAFNAERRPPIALVRRECEFSGFVSP

SEQ ID NO: 133 - protein, 213 aa, Methylobacterium sp.
MPAPAPVVADARARYLPLIAREAAGTGLPLAVADAVARIESGYDPTVVGSVGEVGLMQVRPTTAAMLGFRGTVAELASPEINVRYGVRYLAEAWRRADGDLCRALMKYRAGHGSEAMSPLSQLYCARAQAILGNPEARVVRASARAAAPDRLAARSAGPVHRTRVAAVPAKPMSFWEAHRARIARLNAAVVSRWRARGWSAAPDGSSGEPAGG

SEQ ID NO: 134 - protein, 423 aa, Methylobacterium sp.
MPIVLRPDGVPALLPWLWLDLELRDRGLQAGTLRAYAGVSCLLEDWFALRGVDCTARLRNQQSFEDWEVRDLRNHLYRLTPAGARVRRHAIAKRDRLVEEGRREVGEEPIRLLEGVVSQPVLKQRISVAAIYLRWLDETLSRMIFPDPRQRAEAEHVLTHLADGLCELKVRALEVRREGLALHQQKLLLSAILPPPADQPQTRPLFHESVRHRNFAFILLLASTGLRIGEALGLKMQDVVLQNDWLSVTVRRRPDDPEDPRPRRPQAKTLERTITLPHVAAVALLDWCDFHRKIERLYGPEHGSPFVFLACNIHEAANFPATPLSLAGADKIFRDLRERLPPEAGNVTAHRLRHSWMDHLWTSLRAAGPQDPFVIDVINYAAGWRPGSGQAQAYSQRAQREAADGFAAIFQKQLVSLLEPDRK

SEQ ID NO: 135 - protein, 442 aa, Methylobacterium sp.
VASWIEQAVWWQVFPLGFVGAPDEADPAAPVTHRLAHLHGWLDYAVELGASGLALGPIFAASTHGYDTVDHFRIDPRLGDEADFDALVAAARARGLRVLLDGVFNHVGRAHPAFQDVLRHGPESERAGWFRLTWPRGSGPGIEPDYACFEGHRQLVTLNHDDPRVADHVAAVMGHWLARGADGWRLDAAYAVPPRFWARVLRQVRLAHPEAYIVGEVIHGDYARIVQDTGMDSVTQYELWKAIWSALNDRNLFELAHALERHNGLLDRFAPLTFVGNHDVTRIASRLTDERHLPHALAILLTCGGTPSIYAGDEQAFRGVKEERVGGDDAIRPAFPPTPADLAPYGWPVYRLHRDLIALRRRHAGLHRARARALHLANAQIVLALGDGSARVLTALNLADTDATLPAPEARAIEAGTGDLAEAGSPDARVTLPAHGWAVLAV

SEQ ID NO: 136 - protein, 169 aa, Methylobacterium sp.
MWGTDLTTTWTAEGQVAVFVAIDHRSAECVGIHAARRATRFEALEPIRQGVRQRFGGFSAEIASGLSVRHDHGSQYMADAFQAELAFLGIASSPAFVRAPEGIGCAERFIRTLKENLLWVEHFETVEDLRHALLAFRDLYNETWLIERHGFRPPADICAAQLPPAAIAA

SEQ ID NO: 137 - protein, 1129 aa, Methylobacterium sp.
LAALGDAEAARLAGMPPDRDGLAAWLDAVVDAAEARRQGNPSRAATGDAVLRRALASVLRYAVAEGGTETVARLADRRRPNPKTPRAYQRLSWAEPLHLALRAALVHAPEADYDAAVAFLNARIAEDHDWPAACAFAFILADDRAAPHPLQPVAVVEAAAAAGIDVAADTAYLPLLADAPPEAVAGWRAKRSYHVYFVYCALDAAEAAATLLAVARAAGQPALPALDWLLHYALDEERRSVALAILSTGEAGALPALLSHLHEKPVAAALDAALEADPAAILPRCLAALAGGRSEPALRARVNRALDAHGIDRVRGWLAASGGRGAGILDALAEARAVPLAEPAAWPRVLRDPPWRTKARTRDDLVLALAPLPTPFAHAVPEVAPSYWRARNAVTLDGPEALSAFVAATELSHPTQGWSRIPPPLSEPPRDDPPALVAWVAARVAQIDEACHYWANSPYRQLVGSLERQPEPLALALWAQSRVVAGCFHVSQWPEIVWAMLSRFGERAMPGLVGLVEADPVGLLPAVLAVDDGRLAPPAARALTKLKKAREPALAWLRRHPETALTRLLPDAVGRPGALRDAGEHALRVLAQDRADGRAIIASVAARYADQAPDVTEAVAQVLDRDPLARVPAKVGKPPAWVVPSMLTRPRLRDGTALPDAAILTVCEMLSFTNPDAVYAGVPMVREACTEASLAAFAWDLFSAWIAAGTPSKDGWALRALGWFGTDATARDLTRLIRRWPGEAAHARAVTGLDVLVDIGTDVALMNLNGIAEKLKFKGLQEKARQKIAQLAEARGLTPEELADRLAPDLDLDERGGLDLDFGPRGFRVGFDETLKPWVRDAAGQRLKDLPKPAKADEAGKAAAAVARWGALKKDARAVASLQVARLEAMLAGARRVQPTVFGPCFAAHPLVRHLAQRLVWATFADADPRTGPGLTFRVAEDLTYTDADDAPLDLDLTGAAPGLIGLVHPLQLEAGALAAWGALFGDYEIVQPFPQLARETYAFTEAEAAASTTSRFAGTVVEANRLRGMAARGWPLGAPQDAGVVWWIERAVTFPGGAAGQASLTFSEGLFTGAVEFEDREQTLGDLTLGSPWSSRSDPGQRTFGELAPVTASELLRGPSLLAGTRLR

SEQ ID NO: 138 - protein, 801 aa, Methylobacterium sp.
RGAGRLDRLLAAGSAPQAAPEALPSVLRDPPWRRRGAALARSERAVAPIPTPFAHGFDPDEALDRSTFYFEAGTLVESMTDLAARIRATEAEALYDMPIPPPAEPVPAADADPAIALAWLDRRLDLDRDAFTGFFYFNYGPWFRMVGWQPEPLALMLWEKTGPQRAHYVAWRRTIAVMLSRFGARAVPGLVRLVAADPAQLLPEVESVDAADLAPVAARAFHRTRKLRPAAAAWLRAHPRTAALRLLPETLGPAGPDRDAADAALRFLAAEPAGRAALDAAVAAYAERDPGVPEAVAAGVDSDPLEQVPSKPPKLPDWVVPAALPRPVLRSGGALHDAAVTALCEMLAFSDPLAPYAGVAQVRAACTPESLDAFAVALFQSWIAAGAKSTGEWAMQALALIGGDHAARDLTRQIRAWGQAGLKPRGKAGIAVLAGIGTDVALMNLSAIAEKSPLLQLREAARAAIVDAAEARGLDEVDLADRLSPDLGLDARGGLDLSFGERRFRVGFDETLKPVLRDAEGRRLAALPRPTKADDPESAKAASRHWAAVRKDAEAAAGLQITRLEAMLASQRRVAPGVFWPFFAAHPLIRHLAGRLVWGLYPDAAPATPPGRVFRLAEDLSPTDAADDALALDVAAAEGVVGLVHPLHLDPEERTAWSGLFADYEIAQPFPQIARETFAFTEAERAAAETHRFDGVRVGGRRLRGLRPQGWSTDTGSEHVHAVQRPVALPDGTRLVAVLRFEDGFWHRPGPEGDGIQTLRTLTLSETGWRAAATHRFGDLDPVTASEVLRTPSLLAAAGDA

SEQ ID NO: 139 - protein, 146 aa, Methylobacterium sp.
MCNLYSGMPSADYEGETRSIRLGGHSTSIRIEVMFWNVLEDIAAAQGMTLPRLVTLLYDEVLALHGEARNFASLLRCACLRHLEMKAARLASAHRRAVEQRGRVAGDVDGALDRIDDRDVGVGHVARTARALRGDAVRPRDARGEG

SEQ ID NO: 140 - protein, 508 aa, Methylobacterium sp.
MDMPVDVVVAGAGPVGLLTAIELTLGGARVRMLERLTEPSTTIKALGLGPLGVEALQRRGMGAAIEAVEARSLAAMDRLPGQIGGGPRGAEVSGHFGFLFIRRDPQAEPDRRMRAVDQQSLEAMLLDRAAALGIDLRRGCTLTGFTEAADGVEVAWTAPTGDARVRCAYLVGCDGGRSAVRKMAGFAFPGTPPTMTMYQAIADLDDPAGTLPVGWHRGPGGVFGHGPFPRRLFMLDFSGPPADRQAPVTRDEIETALRRVSGTDVRVARIAVANRWADNTRLVDTYRRGRVLLAGDAAHVHAPFGGQGLSLGLGDAANLGWKLAAVLRGEMPESLLDTYTAERRPVAEAVTANTRAQAAILRPDPQSGALRDLMARLLESDEVSRILGGLMRGLSARYDLGSAEDAVGRMAGDGPLGASGATLYGAMQDGRGLLVDGSADGAASRMVAAATGRVTCVAVPDGPSTLVRPDGCVAWTGAATALDGLREAVGRWFGPSPAGPLGAPAPMC

SEQ ID NO: 141 - protein, 476 aa, Methylobacterium sp.
VTPFRLKQVLAVWDARELDLKWALVGRIALIAILCAAGAAAYAMHDVAAKTRQRNAETADEVHKQLRLQLLRIERAADIPQRFPDWEIVTRYALQPGQCVQLIPAEAGPIRSSCVGVEAHARAAPDWFATLYRFLFFAGSTVSLPLEHHGSRIGIVEADIDPDAVVGSAWIVLKQVSGALAAMTVVLCVLVYGAVAHALRPANDILIGIDRVAKGDLGWRLPSLRLRELRRIATVFNQLASHLQVATRERAELARRLIDAQEQERRWLSLELHDDVAQRLTALSLLARSIQEGARSSSPSVVAESAELATMASDAVRALRSTLAALRPPEIDDLGLRVALRSLIAAQAQRAGGRIHVTLAADAQADRLPSDAAAHIYRIVQEGLTNAVRHAAAHTVAIALNVAETDGGAEVQLILTDDGSGAPAEALERPHSGLGLLGMRDRVHALGGQIVTDTSPGGGFRLRVRFHAALASEEVS

SEQ ID NO: 142 - protein, 112 aa, Methylobacterium sp.
MRRIGARRADGAVALIGPRVRALPAALPSALPALRDWVVAGLAREAEQRRLFPWLAVAFGGGILVYFAAADGAPSPAAPLIAAALALAPVPALGARPAALAAALAVASAFLG

SEQ ID NO: 143 - protein, 158 aa, Methylobacterium sp.
MASVVHRGPGPNAVIGGMRVSYLARSDETGDGLGIYRVAMDPRTPGAGLHRHARLTETFSVEAGRLALHVDGVDHDLGPGDFALIPPGVAHAFANRGDRPVRFTLSFAPALGREGFFEGLARLAAEGRLGDAAAMTDLMARYDQEPLAGFAGWSSVSG

SEQ ID NO: 144 - protein, 97 aa, Methylobacterium sp.
MMAARRWLSAMGLALLPATAQAALPPSWQRVREVQAVAEAAARVLGSRPIDAVERVDGERYRVRAGDCRVTVRVVVRPRAQPGPQAFDAIPDAPDCP

SEQ ID NO: 145 - protein, 134 aa, Methylobacterium sp.
MDDRQMARGLAWFGIGLGLAETFAPRRVAAATGLDGHEGLIQLYGLREIASGAAILAAAEPERLLGLRVGGDLLDAGLLAARATPSNPRRNRTLAAALAVAPVVMLDAAIWLRARDRRSPSPGDPGRKPGAIAR

SEQ ID NO: 146 - protein, 301 aa, Methylobacterium sp.
MATLARSEVLALDRAARARPRIPSGVGGVLPGTLLVVLALLGPLALMLRYSFNRFVPGELMVEGLTLANYAKFLHDSFYRDVLLTTLWVAALSTLICLVLGFPVAYALVRQVGPRWKSKLLILIILPLLMGNAVRTAAWMVILGDKGLLAALLSGMGLTPPRLMYTPSAVVIGLVSVTLPFMIVTLQSVLERIDPVLEEAAESLGAGHLTILRRVVLPLALPGLLAGTMLCFILSMNAYATPVLIGGPQFHMMAPEVYQQVAKAMNWPFGAALAFVLMTVTLVLTTTANVLVQRRYRRWSE

SEQ ID NO: 147 - protein, 272 aa, Methylobacterium sp.
LAAIWLTALIRALTSGTVVVLASVLAEWLGPVWGALVVSLPVSAGPAYVFMAMEHDAAFVAGAALNGFAANAATGLFLIVYAHRAAGRDMTATLGPAILAWLAAALPVSAFTWTPTTAFLLNALVYGAGALSTRHVVRATLVRSAVVVRPRPLDLLIRASAVALFVAALLALSTALGPARTGVIAAFPVTMTSAFVILHRRIGGAAMARLASVAIRGVFGFGLTLLTLHLTIQPYGAALALTVALLVSLVYSAGLLVVQPRPGRQEPGIVTR

SEQ ID NO: 148 - protein, 288 aa, Methylobacterium sp.
MSGLPRAAPDSVPDSIPDSAPATTPLARTGIRRRGILVPAVSAATVLAALGLWLVATRVGWVKPLFLPPPEAVLAAFGQAWRGEIDGAPLGLHIGDSLLRVLGAFALAALVGIPVGLAMGTSRIARGILDPPIEFYRPLPPLAYLPLMIIWFGIGELSKVLLIFLACLAPVALAARAGVRSASVDQINAARALGASRWQVLRHVVFPAALPEILIGLRIGMGVGWTTLVAAEMVAAQAGLGQLVLNASNFLRTDVVVMGILLIGLFAGLFELGMRGLERVLVPWKGRH

SEQ ID NO: 149 - protein, 110 aa, Methylobacterium sp.
MRSMPHTHPPYAAEFRRQMVELVRAGRDPADLAHEFEPSAQAIRNWFAQADRGESRGASKSDVLTLAEREELARLRREVRQLRLERDVLSKAAAWFARESGAVPSGSSSS

SEQ ID NO: 150 - protein, 153 aa, Methylobacterium sp.
MRRALAALVLALPPAVPLTAAADDLPPPVAAAAARAEASCGSEPATLKPGFVTRQDVNGDAVPDFILDFAAVQCGDDESAACGTAGCEMQVFASTTDGFVDAFDAVAHDLRFRTVGGRPAVIVDMTGATCGRSGQDPCGAIAVWNGRTFGRTR

SEQ ID NO: 151 - protein, 149 aa, Methylobacterium sp.
MHAVHELPPITITTRDFDRLVVFGLDAYLRGDRRADFLLSELKRATLCPPRALPGEVVSVHRWVHYRLNDDPTVRGQLLVHPHDLTDLPGGLSVASPLGTALLGLRVGDRMPFRIDDAGIQHVVAVVGIGRRFSDEPVRGRGAPAPREA

SEQ ID NO: 152 - protein, 85 aa, Methylobacterium sp.
MAEGAEGMRDWHVLIVGGLPTDGQKRATVIGGIADGLRRGGAGVRIVKAADRSEFDTEAGRLKDARSHLNLIEIAYPGLVDVPAG

SEQ ID NO: 153 - protein, 212 aa, Methylobacterium sp.
MRILLLNPNTSAAMTARMARAAEAALAPDAHITALTAATGLPYIASRAEAQLAGAAVLETLAAHHSGHDAAVIAAYGDPGLVAARELFDLPVVGMAEAAMLTACQLGARFAVVTFAPALLPWYEDAVALAGLSARCAGLHAVRRPFQAVTDVQDELRPEILALAERAVGEGADVVILAGAPLAGLAATLRDAVPVPLVDPLAAALGQAQALV

SEQ ID NO: 154 - protein, 472 aa, Methylobacterium sp.
MNAPVPAPRTRPDAATIAGLAEALRAVLGDRVTASPAVREQHANQLTWAPCEPPDLVVFPHATAEVQAVVRACAERDVPIVPYGVGTSLEGHVNAPFGGVSIDTGAMNRVRAVHADDLDCTVEAGVTRRALNAYLRDTGLFFPIDPGADATIGGMAATRASGTNAVRYGTMKDAVLALTAVMPNGDIVTTARRARKSSAGYDLTRLLVGSEGTLGIITEVTLRLHGIPEAISAGICPFPSIKAACDATILTIQSGIPVARIELLDEVQVAACNRYSKLSLPETPLLLVEFHGTDAGVREQAERFGEIAADLGGGPFDWATGADQRARLWQARHDVYWASVALRPGPTIKNMSTDVCVPISRLAECVEATKRDIAATGLTAPIAGHVGDGNFHTLPLVDADSPEEMSAVAGFLDRLVARALDLGGTCTGEHGIGQKKMRFMESEHGPEALGLMRTLKRAIDPRNLMNPGKLIP

SEQ ID NO: 155 - protein, 252 aa, Methylobacterium sp.
MMRALEGQVAWVTGAGSGIGQAAAVALARAGMRLALTGRGQEALARTAEMVRAAGGEALVAPADMGVADDVQRAWEAVHAAWRRCDLLVNSAGLNVPQRGWSEITPAGIDAVVGINLNGPFYAARAVLPTMRAQRSGLIIHVSSWAGRYVSKLTGPAYSAAKHGLVALSESLNQEECGHGIRSCCICPGEVATPLLDKRPVPVTAEDRGRMLQPEDLAETILFVARLPVSVCVNEILISPTWNRGYLEGVKL

SEQ ID NO: 156 - protein, 539 aa, Methylobacterium sp.
MSIVGVQVSSVGAVMMEGRKAAVRAQVESAHGIVAAFARQAEAGAVSADEARRRAAEALRAMRYNGGDYVFVYSSEPGNIGRNVVHPDPRIEGTRSRDDAAMKKTFVWTMIQHAREGGGFTEYRWARLGETEPAPKVAYSLAYEPWQWVISSALYVDDIHALDRARMVTTLLWLIPLGIAIGLVGFLLARSITRPLSAFTAALRRLAGGATDVAIPGLGRRDEIGQMAEAAGVFRDSMIEARTLSTEQRAEQERRQERAQWMEAVTRSFDTEASQLLARVDTAAADMREACRAMADTAAQASRQAGSAAGAAQQAAANVQTVAAATEELSASIGEIGGQVTKSAAIAGQAVSEAERTDRQIRGLAAAAERIGEVVRIISAIAEQTNLLALNATIEAARAGESGRGFAVVAAEVKGLAGQTAKATEEITAQIAAIQGETTEAVGAVHSIGRTVDTMNAIASAIAAAVEQQRFATGHISQNIDEAARGTDAVSANVVSASSAAEATHRVAGEVGAAAGDVCRSAEALRAEVMRFLVEMRAA

SEQ ID NO: 157 - protein, 401 aa, Methylobacterium sp.
MTSDRKLKVVAVAGSGTLFFHAAVLGTFLAASAAPTPLYRFYQETYALSPVITTAVFAVYALALLKALLVAGSISDHLGRRPVIFGALLLELVAMALFTTANGAWGLIAARFVQGVATGIAASSLGAALVDVDRARAQLVNAIMPLIGMAAGALGTSALVQYGPHPLHLVYAILAAVFAAQAALLWLTPETGERRAGALRALRPRVVIPPQARRPLAAITPTNIATWMLGGFYLSIVPSLVVAATGSRTPLTSGVMVAALMVAGAFAVLQRRGRDAAANLTIGTLAMTAGLVIVLAGMHGGSVPVLIGGTLVGGAGFGTSFLGALGTIVPLAKPSERAELLASYYVESYLAFSLPVICAGYLVRRIGYVTTADLYAAAILAMSAAGFLARRALTSRRVSPG

SEQ ID NO: 158 - protein, 91 aa, Methylobacterium sp.
MTEMLRDNVERGRFELQVGGDVVFATYRREPGQLVISHVYAPPVLRGTGAADRLMEGVAAHARAEGDRIVPLCGYARAWLRGHRTHRDLLA

SEQ ID NO: 159 - protein, 513 aa, Methylobacterium sp.
MATSLIRSRRMITRTLDHDRWEEIADGAVLQTDGVIAAVGTYADLHARYPDAPVIGSGREILLPGFVNGHHHVGLTPVQLGSPDMPLELWFVTRMVARNLNLYLDTLYSAFEMVGSGITTVQHIHGWMPGSLEEVEARSNEVLRAYRDIGMRVSYCFAVRDQNRLVYQADMDFVASLPAPLQDPMKRWFERFQMSLEDNFALFRSLHAGQEGASRAKIQLAPANLHWCSDAALEGLAGLSESYDVPMHMHLVETAYQKAYAEKRGGGTALEYLDRFGMLGPRLTLGHGVWLNEADIERVAATGTCICHNCSSNFRLRSGVAALNRFEAKGINTAIGLDEAGINDDRDMLQEMRLVLRAHRVPGMDEADVPSMAQVLRMATVGGARTTPYGDSLGTIEVGKGADMVLIDWDQIAYPYLDPETPLLDAVIQRAKTGGVTAVLCEGEVLYADGRFTRVDRDAALKALHDDLSRALSDDEVERRQLSKALLPHARRFYANYIDPSRHEPFYRPSSRV

SEQ ID NO: 160 - protein, 268 aa, Methylobacterium sp.
LASDLRSDDAVACRGVAKVWAAGTARAHEALRDIDLTVRPGEFVVFLGPSGCGKSTLLYLIAGLESASGGELLAFGEPVTGPSPERSLIFQETSLLPWLSVWQNVSFGLSLKGVPEAERRSVARAALQRVGLAEAFDKRPDELSGGMRQRVAVARALAMRPKVLLMDEPFAALDVQTRQKMQDFLLDVWRDSGASVLFVTHHIDEAVALADRVVVFTARPGRIKTIVRNDLARPRDPFSPEAEALRRHLTELLRDEVDRAFAEQEALV

SEQ ID NO: 161 - protein, 309 aa, Methylobacterium sp.
MATFLARAAAVPQDRPRLPLGQRLALPEGLVPLLRRTGWMLISVGCFAGLWELLWALGIADAKLLPPPHIFLGNLAEQARFFNTAQRWQIGTGMNTGPSPAMAVLITVLASTGRVLAGLALAASLSILVGVAIRYFKLFERLTLPTITLLAPVSPIAWLPVAIFMFGIGNAPAIFMVFIALFFTMVLSTIQQIDGVNRNYINVARTMGASKRQIYARVIVPAILPGLLAVLRLNLFGAWMVVLVAEATGVGYGLGQVIMLARNTFNPSLVFFTITLIGLLGFAFDLLFRLVQRRLLYWLPRDAGSSLGL

SEQ ID NO: 162 - protein, 350 aa, Methylobacterium sp.
MCDRHGVYRVPDLTRFKPSRRRFLGGTAAALTLAVGPGLTGPAAAATGIRATHGTGFCNLNFFLAEAMQLAKDDGLTIDFVNTPTFSDQVTFLGMGQVDAGVMPYTSFMALYDAGAPVKIVAGGGIEGCVLVAQPGLDSPEKLKGKTLGTFQLDTLEVLPYDWLKKNGVAFKDITVRYMGSTPEAVEAFRAGALDIISTIEPYGTALLTDVKGAVKLSDGTDIYGKGYTDCVLAVRNELIAKNPAAVKALIKGMMKAQGLAESDPQAALNKLVGSYYKTSMSNAQLAMGRQPSVVDARNQTQFILDRTDSVAEMGYIKRKPGRDAIDWTLLEQVIAENPDLYGKLKLKSA

SEQ ID NO: 163 - protein, 317 aa, Methylobacterium sp.
LADSAHTADRSIPPCPITGAPALRCVERLDAGFLTLLWHYSGRVDVGPLLRPAGTFRLWESPTGLIFFDPPVAGDAAFYRAFYGRIAAHDKLAGPETERLEFRQAAAHVPSGARVLDVGCGHGGFRAYVPDATYTGLDPNFSAEDPTGAILDETVEAHAARVGPVYDVACAFQVIEHVADPLGFAQALAACVKPGGVVLIGTPLWPSPNTTIPNFVINAPPHHLTWWTPRALEALAGTLGCTPEAVHAIGMDRHDSLIHWMAKVSPVRCRDRFFRRTWSWAAALAFAYGVGAVLDRVLPVPKRTRPNALLLAARKAA

SEQ ID NO: 164 - protein, 488 aa, Methylobacterium sp.
MQDEAPDATAEITLVKGARWVVAWDPDSGGHVYRTGADVAFADGALIHVGPGYAGPEPARTVDASGCMIMPGLVDIHTHLFSEPMNKGMWDEVGSQRLYNTSLYEYLPILRPDAEGTRAAYGVALAELALSGVTTVCDLALPSAGWLDLLGASGLRVCIAPMFRSGRWLTRNGHSVDYEWDAAAGLRGLEQALAEIAAAEGHPSGRLSGMLCPAQVDTCTAELLRDAHSEAVARDLRFQTHAAQSLSEFHEITRRTGMTPIEWLDDLGVLTERTIVGHGIFLDDHPWTHWHSPGSDLRRLAERGATVAHCPTVFARRGIALHHFGRYLQAGVNMGIGTDVYPHNMLDEMRLVSYLARVVAENPRDTRAADVFHAATVGGARALGREDIGRLEPGCKADFVLVDCGHPAMRPCRDPVQSLIYSAGDRAVRQVFVGGREIVRDGRALTIDYAAAAAALEEAQGRALAQVRQLDWAGRGPDAIAPPTFPGL

SEQ ID NO: 165 - protein, 226 aa, Methylobacterium sp.
MRPRDTTEPARILIINPNASRAVTAAIDAALAPLRLPGGPILAVTDLPEGPESIATQRDADSVVMPLVRCVADDPSDAFVIACFSDPGLHAVREAASGRPVMGIAEWGILRALTLGERFGIVALSEGSVRRQRRTVRQMGLGDRYAGSRPVEARASETADAAMGPRLIAAGRTLVERDGADVVVLGCAGMARHRAAAEAAIGCPVIEPCQQAAAAALGAVLLRAAP

SEQ ID NO: 166 - protein, 278 aa, Methylobacterium sp.
MSDAVTGPAAIAGESHEAPPRDKERLRAGVLVLLVQIALLAALLSAWEWQTRLNPQASFLFGSPSAIGRFLWQGLADGTLLRDAGVTALETGLGFLIGNVVGTLAGLSLWYSTFVSRVVQPFIVAIGSIPIIALAPIIIIWFGTGLASKVAMSTLSVVVVALVTSYKGALGVDPDQINLLRTLGARKPQIFAKLVVPSSLADIFAGLKLTVGFALIGAIVGEFMSSSVGLGHAIFQAGSLYAIPKVFAALVGTIALALVLTFLVGRAERILMPWRDHL

SEQ ID NO: 167 - protein, 286 aa, Methylobacterium sp.
MSEGPPHAATHPAPPLAVEHLAKAYRTGGRLLPVVGDLTFALARGEIVAIVGPSGCGKTTLLNAVCGLTPVDSGRILWNGVPLDRRGRPPSGIGYMLQKDLLLPWRTALDNVKLGTELRGMPRGQADERARALLDQLGLHGFAGAYPATLSGGMRQRVALARTLINDPDVLLFDEPFAALDFQTKLLIEADTVRLVREGAKSALLITHDIEEAVSIADRVLVLSGRPTAVKASYTIDLDCAPDDMIGARESAGFGDYVRQIWADLDIPRSTLGGAGRGIRRAAARS

SEQ ID NO: 168 - protein, 317 aa, Methylobacterium sp.
MAGLAVGAPLVARAAGLKTVRFSEAVHNLGYINLYVGIHAGIFEKNGLAMQVSAAGGDTQTFAAVLGGSADFAIGDPTMVVISRENGGPGMVVGTVVQRAHYFAVSKTVEPFTDPKGFKGKRIATSPEPNTNFSVTKRLLESNGMKLGADATIVPVSPGTEIAAMLAGAADIAVAYQPGVAQAVAQGARIVFDFSNYVGPFCNTGIMVLPGTIQKDPETVQALVTAFEEAGRRTYGDPDYAKKVARLEFPDLPGEVVDAAIEAELKYKIPASTVVTEKDAWESLMGMQKYLGNIKGTLTFDQVVDNTFADKAAKRAG

SEQ ID NO: 169 - protein, 499 aa, Methylobacterium sp.
VLLLEAGRDWRSADAPPALRSANIIPFMYDLAHQADWQWPGLMSRRTRVQEPRFYWRGRALGGSSTVNAQIAIRGVPAAFDAWAEQGCTGWSASDVLPLFDRIEDDADFGTEDGARRGGPLPVHRAKPEAWGAVDLGLRAAALAAGHPWKADLNAPTGEGVSCNPINSRDSHRVTTNDGYLEPARDRPNLEIRCEALVDRVLFAGRRATGLRVRFGAEPWTEIQGREIVLCAGAVHSPAILMRSGIGPAEPLRALGIPVRQAHEAVGRNFMDHPILRATMDLKPEHRALGPDARHTNCCVTYSSGLSGGGERDMIFVAYNHRTLTGPEPTPQGAVGVGLYDAFSRGTLHLTAADPEANPVIDENMLDDPRDRLRMRDAVRRLAGLAAHPALADLATAIRFGESPLPIGDAARLPDDELDALMLAEAGDIQHAAGTCRMTGWQDASGVVDPDLKVRGMDGLRVCDASIMPSDCRANLHFTCVMIGENLARRMLTGGSRHP

SEQ ID NO: 170 - protein, 166 aa, Methylobacterium sp.
MKDRWLRLRADDCVTPSGHIVDPYYVLETPDIALVLGIDAADHVILVRQYRHAYGGPSLELPGGAIDPADPDILAAAEREMREETGYIFADAERVVTLNADPARYANRMHLVRARVTAAGPAQPDPAEDIAVVRVPRAEALQLAQSGAIVGAVHAAMLLIGLSSTG

SEQ ID NO: 171 - protein, 200 aa, Methylobacterium sp.
MTTDHTANPWLTLSSETYHEDKYLRLDVDQVRHQSGVEHPYTAVRFKVFGLTVLPIDDAGRTFLVGQYRYLLDRYLWELPRGGGAVDVPPIETAKRELAEETGHSAAHWFELPKLTASPEITSEWAPCYIAWGLCPISAEADPQESLSIRRLPFGEAVNAVLAGEVVDAASVALLLGTAERARRGQLPQDLTALLGTGGL

SEQ ID NO: 172 - protein, 252 aa, Methylobacterium sp.
MDAMDRENGTTRLGMLTPSSNSVLEPATAHLLAGVAGVSAHFARFRVTEIGLSAAALDQFDPEPILAAAELLADARVAAILWNGTSGAWLGFDADERLSAAITDRTGCPASTAALAFRDLFRARDFRRIGLVTPYTGDVQRRIQANWGAAGFDCAAERHLGLSENFAFAETGPEAIAGMVRAVAAEGVDAVAIVCTNLAGAALAPTLEAELGVPVIDSVAVTLWKGLELAGCPTAHLAAHGRAFAAGGAGRP

SEQ ID NO: 173 - protein, 118 aa, Methylobacterium sp.
MSATTPGRQSLGFGDDLDAFDPAEFALVKPKAPKPEPEISRKAAEAVGFRSREAQKAEPAPAKIQQRRRRTGRNAQLNLKAKPETIAAFTRIADAKGWGLGEAFEHATALLEREYATK

SEQ ID NO: 174 - protein, 212 aa, Methylobacterium sp.
LKAGRRQHAAIVFVDMRGSTTLAESLDPHRLSEFLSAFRRRVTRLARLRGGVVDKFIGDGALVVFGLPEPRPDDAARALAFAQDLVAVIARWTDRAGPAQAVRIGVGVHYGEVFCGIIGEEARYEFTVLGDAVNVAARLEQATKLHGVPILVSEAARRAAGAPAEAWREVSREPLRGRREGMAYHTPAASGAAGPGPRREEDIGLSAVEPAL

SEQ ID NO: 175 - protein, 304 aa, Methylobacterium sp.
METSPDDPRRPENRLAYRAAVDRPRLTLPGGKHVAVWPVVNVEHWLIDNPMPRQILVPPTAASLLPDIPNWAWHEYGMRVGFWRFLEAFVSRGIRPTLSINGSVCTAYPRVAEAAHAAGWEFMAHGFHQVPTHRVADQPAMIARTVAAITETTGRPPRGWLGPGLTETLDTPDHLRAAGLAYVGDFVVDDRPCRVATRTGDLVALPYSVELNDIPLLAIQHHRADEFVERALAHLDRLAAEAAGSGPLGGAKVMGFAIHPYITGVPHRIGLLERLLDAILARDDAVFMQGGEILDWYRATGDES

SEQ ID NO: 176 - protein, 210 aa, Methylobacterium sp.
MHFDSGEISTLVWKAAAKLDVVSPRTGRRLHVTPRRLRHTLATNFAALGIPPFAIAEALDHSSLNTVMVYVDNIRVIQERIDHALAEYMAEVSGGFLGRLIPDEVAAGGSAADRIYADFGEGEVEAVGNCGLSSECNLAPPISCYKCRFFRPWLDASHERVLEMVEARAHRLREAGAIERLVELNVDAIRAIRNLMNEASALRKAGGGSI

SEQ ID NO: 177 - protein, 152 aa, Methylobacterium sp.
VRSDLAGGRMSRQRKRDAVLWLLRGEDLESVSRGLGVTAATLSGRRDAFLAAGEASLSTRPLDAEALESGRLKAKLGEMLLEREVLETKVAALEARGPGPFWPAGGRSHEPDRLAGQRQRLGLARVCRIWRVSRGTPAVKAAVVLPMGCQAA

SEQ ID NO: 178 - protein, 133 aa, Methylobacterium sp.
MPKFYFHLRGPEVLDHDDEGLDLASVEAAYLEAFKAVPGMGSDLASTAKNPIRYGFEITDAHGTVLMAVPFAEVLDRGQKRTKQPAKLQLHKGRAEMRRTAGLIVELREAHAKLNVTLAETQRLLDIAKRTGR

SEQ ID NO: 179 - protein, 65 aa, Methylobacterium sp.
MVETFFKTLKSELVWRTAFQTRAEATIALARYIDGFYNPCRRHSALGFKSPTQFEKGIAHQTALH

SEQ ID NO: 180 - protein, 159 aa, Methylobacterium sp.
VALLFNIDPDSAEDSVPLSAIIDSVHVDDRERVLAVIRRSAQEGATYLNEYRVVSADGQTRWVLSRGRFTKDHAGRPVGGSGILVDITGMRIREGTFDDVESGQIAAPLERAADHAISAQQAIVDLQDPELKACADALLMALGRKLAEREVLERRKGMH

SEQ ID NO: 181 - protein, 533 aa, Methylobacterium sp.
MMTRIKALLLGSSALMIPIGGAHAADLPTFKAAPVEFVRVCNAYGAGFFYIPGTDTCIRLSGRARYDFLYQTSKVRTGGGGDLTGYLGLMRLNLDSRTQTDYGTLRAFLRIDVANRSGPFLTSGSRQRESLAIAGLGADAFGRTQTYVNADKAFIQFAGLTAGRASSFFDFYAHDFELIGGTAGSDTFSTNLLAYSAILGNGITLTASMEDPTYRRFPIFGTGSAVGAFTAGGGFAGYSNAFNPFTPSTWLAPIVVGPGNVAFVDVTQKSRMPDFVGAARIDQAWGSAQLSAAVHEINAGDAGSTVAGITTATTGLGISPTGRASNAYGWAVQGGLKVNLPFIATGDTLYLQGAYGQGAIAYTGISNYTAPYDALGAAPVGGGSFAQYYADAVLNPATGRLELSTSFSAVASLLHYWSPAWRSAFFGSYAQIDYNSKGRNALGVLGFGFAPAGASTSNALAFATSPILRGNNQMITGASLIWTPVKDLDIGVEGEYIRTALNSGVTPDISKNALRYVNSQDAAQFRFRVQRDF

SEQ ID NO: 182 - protein, 97 aa, Methylobacterium sp.
MKNIILACSMGAMLIAGPALAQDGGATIDPSLIVRTNGSGLDAWSASEGNDKAGGMWEGATGYSAAIQRPSAVETVPANRQWSHLNSRERRRGQPAY

SEQ ID NO: 183 - protein, 461 aa, Methylobacterium sp.
VRLLEVRRTSGFRVACLFFATFGTASLALSGFLYVDTRSYGRKAAFEWVEWESKHLLNLSPRALRERIDASEDFAEGGRPLVLFGPDHVRRAGAPIAFPDKAPIGKPFILAQPLDHRSRTLFSQLTELPSGEYVLVSRSAQDLQSLEKALVETFVWGMAATIVIGLIGAVVFGAGSLRQNDAITKAVERIMRGDLSERLPTRGVSADLAHLTRVVNDMLDQLERLMLEIKGVNENIAHDLRTPLTRVVGTLERSLRKADSVVAFRAFNEDVLAEVKSIVVRFSALLRISEMEDRLRRSGFTQVDLGRLLEDAVEYYEPLAIERDIRLLWDRPDGLCTIEGDRSLIFEAVSNLIDNALKFTPGGGRVTVALLRNPTGIQVTDTGCGIPAEELSAVRARYRRGALKTDKSGFGIGLSLVDSIARLHSATFDIASDGSGCRVTLSWIHSVSGHSSIDLLPAASL

SEQ ID NO: 184 - protein, 222 aa, Methylobacterium sp.
LVVEDDRRVAAEIGSALAEYGFQVDEAPSGSIGLRKALDGNFDVIVLDRMLPEIDGLSLLTELRAAKVSTPVLILSALSAVNERVDGLRAGGDDYLAKPFEFIELTARVDALARRKMAAEAVNELVVGDLRLDLIERVLHCGDREIELLPKEFAIIEFLMQNAGTLVSRKMIFESVWGYSFNHQSSVIDVHIGKIRKKLDPDGLNPRIHTVRNTGFILRAPS

SEQ ID NO: 185 - protein, 461 aa, Methylobacterium sp.
MTRFNDAPGSGAEAAARAHQHAAEIDPLRQDGAGEALVHAVPPPPRKRPFLVAFLALGSALGLGAWHHWETYQASLETQTEAVNFVPTVRTGPAQVDDGPMTLTLPGQTEAFDHADIFARATGYIAERRVDIGSRVKKGDLLVRIAAPDLDQQARQAEAQLGQFKAQLAVAQADVEQAKASVTLANVTDARTATLAGQGWASKQNADQTRAGMLTATATLAAAQAKVKVAEANITAQQVTVDRLRTLTTFENVVAPFDGIVTARRVDVGDLVHGDAGSGTPLFTVDSTDVLRVAVQVPQSAAVGIRDGVKARVQVAQIPDRIFAGTVSRSSVALQSSVRTLDTEVDVANPDGVLRPGLYVAVTFAVPRTHPRVTVPSEALIFDADGTRVAVVGADDTVRLRPITIARDLGTRLELRSGLDSGETVVLNPPAGLQDGSRVAPRGSVASQVPTAKLSEQASAE

SEQ ID NO: 186 - protein, 404 aa, Methylobacterium sp.
MASIRSCVLSVAIGFAALAGPALAEPIRVKVGVLNDMSGVYADTGGKGSVVAAQMAVEDFAKTEPGVQVEIVSADHQNKPDIGAAVARQWYDRDGVDAILDVPTSSVALAVSQVTREKNKVFIDSGAGTTELTGKQCSPNTIQWTYDTYALAHGTAGAMLKRGGDTWYFLTADYAFGLSLQNEAKAVIDTGGGRVLGAARVPFPATDFSSFLLQAQASGAKVVGLANAGGDTVNAVKQAHEFGLTDGGQKLAALLIYAVDVHAIGLQTAQGLVLTESFYWDLNPETRAFSERFYPRNGNSMPTMNHAGVYAGLLHYLKAVAATKSTDPQKTMAWMKANPTDDPLFGKGVVRADGRKIHPMYLFEVKAPSESKGPWDLYKVLETIPAEQAFRPLSEGGCPLVAKP

SEQ ID NO: 187 - protein, 541 aa, Methylobacterium sp.
MQTLRGADIVARTLEALGVTRIFTLSGNHIMPVFDALLETGISLVHTRQEAACVHMADAWGRLTGEVGVALVTGGQGHTNGAAALTTALAAESPVLLLSGHAGLSELGRGAFQELAQADIARPMTKAAWTAGSVAALGPDLARAFRIAREGRPGPVHLSLPVDLLETAVPAASVRIPDRAAAAIRAAEPAPDLVADLLAALAGAERPLIACGPALCDASGRAAMATLEETLGLPVVGMESPRGVNDPALGAFAEVLARTDLLVLLGKPLDFTLRFGAAPALAPDCRFALVDPDPALLARAPADRLAVSGLADPRPVLAALTARATALPRREAWHREARAALAYRPPAWADFHGTGQRLHPVELCRAVDAFLERRPDGTLICDGGEIGQWPQALVRAGRRLINGVSGTIGASIPFAIAAALERPGAPVVAVLGDGTFGFHMAEFDTAVRYRIPFIAVVGNDARWNAEHQIQLRSYGPERTRHCDLLPTRYDTVVQALGGFGALVTEAAELPAALEAAQASGLPACVNVMIESVPAPVIRRPG

SEQ ID NO: 188 - protein, 202 aa, Methylobacterium sp.
MVNKHVAIRTEDGVCGTHVVAPDGAGPWPAVILYMDAGGIRPALGDMARRLATGGYRVLLPDLFYRYGPYGPFVPADVFKGDFRAILGPLMATTDNLKAAADTAALLAYLDTRGDVAGRAVRAVGFCMGGRMAITAAGTYPDRFAAVASYHGGNLATEEPASPHRVAPALRAEVYIAAAENDGSYPPAMAERLETALSRASV

SEQ ID NO: 189 - protein, 81 aa, Methylobacterium sp.
MTTTATRPAGANDTGLSLAQDLLSGAEAIALFMFGEATEANKRKVYHAAQKLGLPTFRIGGTLCARRSTILAWIERQENAA

SEQ ID NO: 190 - protein, 263 aa, Methylobacterium sp.
MPPAEGTPIWFELNAADPDVAQAFYEAVAGWRVAPSPMPEHGGYRIAEADGAPVAGIRRPTPEAPGLPGWAVYLATSDVDALAARAVDLGGAVRFGPVDIPHVGRFAMVSDPQGVVFAAMNPAHPGASRAFGPVPLETERTRGHGVWIELATPDPAAAIAFYGALFGWEKLGAMPMGDLGEYAFIGRGDLRPGAVMSSAATGAPARWNWYIHVADIDAALATVRAAGGTVLQGPDPIPGGSYAANIADPAGHQLGLAGPRQAT

SEQ ID NO: 191 - protein, 48 aa, Methylobacterium sp.
MSKPKPPTNALLTPEKRTEDVDQTIRPLSLSEFIGQRAARANMQVFIE

SEQ ID NO: 192 - protein, 56 aa, Methylobacterium sp.
VEAFRAKVERGIYSQPVRQQGCLPKWHRERLTHDIALRHGLQHELPLIRKDFEHLI

SEQ ID NO: 193 - protein, 393 aa, Methylobacterium sp.
VKDSLNVAGFATGWGSRLYAGEGAGEAVDRDETPVARLRAAGAVILGKTNVPELTVQGYTGNPVHGVTRNPWDPALTPGGSSGGAVAAVASGIGPLAVGTDAGGSIRRPASHTGLVGLKPTAGRVSRTGGLPPIMLDLEVVGPMARTVEDLAAAMRVLGAAEPDSVAPHGFGPFGSAAVPERPLRILHVPAFGTAPVDPEIADSVAEAAGRLAGLGHRVETGRFDAATAITAAWPVLGQAGIAWLMRAHQGGLDALGPDIRALAEAGAALSAADLFEVQRMALALRRDLAALFADHDLLMTPAAAALPWPAEDTHPPCIAGVPVGPRGSATFTGFVNAAGCPGISIPCRPSGAGLPIGFQLVAPWGGDETLVAMAAAYEAAHPWRMVWEDAAP

SEQ ID NO: 194 - protein, 66 aa, Methylobacterium sp.
MAYDRPAWTGSTPYDVETTGSFGAPLGGRYDRDPWTCPQSSAAEGNANQQNFPVKQYGQTAGGNRC

SEQ ID NO: 195 - protein, 414 aa, Methylobacterium sp.
MSLHLDDPVTDPVEDRLPPPPSPPHRIRSDAEAIAAARAVARIFAAGAAERDRDRRLPWAEIAAFTESGLGGITVPREHGGAGVSHATLAEVFAILAAADGSAAQIPQNQFGVLALVAAAASPAQQARIYRDVLAGHRIGNAGPARNGKAITGVDTRLTAGPEGPRLSGTRFYSTGALFAHWIPTRAVGPDGGPLLVFVRRDAPGVRVVDDWQGFGQRTTASGSVIFAQAPVEAELTIDLAPLAGRPGLFGPVSQLIHAAIDAGLARGAVAAALDFLRTRTRPYPFTAETVAEDPHILGEVGRLTVDLHAAEEVLARAGRALDRIAAAPVTAQSAAEASVAVAQAKILTTEAALEASERLLELAGAAATRDGYNLGRYWRDARVHTLHDPVRWKYHLLGNHALNGVLPARHQWN

SEQ ID NO: 196 - protein, 320 aa, Methylobacterium sp.
VPLRRRPTAARRPSEKRIAPTVSTPDHGLSELAQIEVNLEADTSTLWAFMRPQGRPCQNPEMLADFSRLQDGIERGFGNGGLDLNYFVFGSRFPGVFSLGGDLSLFASRIRAGDEAALVGYGNACVDVLHRNMNALNLPIITIGLVQGDALGGGFEGLLSFDVIVAEKGTKFGFPEILFGLFPGMGAYSFLARRLGTIRAQEMILDGRTYTAEEMHELGIVHVLAERGQGEAAVRAYIAGNHRRRNGQQAIYRAAREVNRISLEELRKIVSVWAAAAMNLTDRDLCIMERLVLAQDRLRGKAQAAQARTVTARGLAASTR

SEQ ID NO: 197 - protein, 308 aa, Methylobacterium sp.
MPGPERDIVIGADGFLGRNLVQRLRAEGREVVEIGRAAGDLSEWANVERALRAAPPSSRIFHVVTRQRTGAVQYDIQGELLAINARVHLNVLEAWRLFQPQAKLVSTGSSCTYPESAEPLPEARFGQGATHPSVIGYGLAKQVLATGSAAYAHQYGLCFLHCVLATLYGPHDNKASDRSHFVGALLDRAVREKAAGAAQFEVWGNPQTVREVLYVDDQIDAILAADRAFDNEILNCAANTPVTVEAVARAALVALDWSVPLVSPPGSFQGAAYKMLDSSRFLDRSGWRPRIALEAGLRRLVAAEYADR

SEQ ID NO: 198 - protein, 325 aa, Methylobacterium sp.
VAALPLTSLPDTVVVVGATGFVGRNLVAHLADRVPRLIAVSPSGRAVPGAHEAARFDALEALSVPADAIVVNVAAQRYDADKFETAQSDLLTGNAEIANRLYRFCLTKGIREVRAASSVAVYPAALDPLDDAQAVDLNAPPNRNEAFYAWSKRWSEVIADLHAERYGIHTISFRLSNPYGPHDSTDPRKAHVLPAFVMRALAPGERFEIKGNPLVERDFIYVGDVVDVFARSLEMRETSDALNLCRGETTTLLDLARTILEVAGEDRPVHAPDTATHGVLARRSTNQRLRERLGMSTFTGLADGLRPTIAWYREAYRDGAHHAGA

SEQ ID NO: 199 - protein, 310 aa, Methylobacterium sp.
MRILITGGAGYIGTILVPMLLERGHHVTVLDTFKSGAPDLFSACQYDTFEPIKGDARDTRILDELIPKHDVLIPLAALVGAPLCKEDAIGATTLNRDAVIALVERAGGGQRIVYPTTNSGYGVGEAGKFCTEDSPLRPISLYGTTKVEAEKAVLESGRGVTLRLATVFGMAPRMRLDLLVNDFTHRAVTDRALLVFEGHFKRNYIHIRDVAKGFIHAMDNYDRMRGEAYNLGLSSANLSKLELCERIKVHVPNFVYVEAPIGEDPDKRDYIVSNEKLEATGWFPDFDLDRGIKELIKGFRMIRNSRFANV

SEQ ID NO: 200 - protein, 131 aa, Methylobacterium sp.
VAAATEPLTESADALVLGTDFFGFLASRFPRFCSAAMISLLDTMTAPTTSSSPFGRRLVWKQPDRGRDRGLEQAEDGNEAVACPEFGMMPRDQTRCLPLGVAVVARCDDASREHTTGRGEPMDLIGAARVS

SEQ ID NO: 201 - protein, 103 aa, Methylobacterium sp.
LQAEVEADPTFDPPALRTRPDLWPHLAFVSNAFSELSSDRPLGALGGCGPIPWSAIERYAARYELDDLESFERFAHLIRAQDRAYLTIMAEKQKSGSGGKGKP

SEQ ID NO: 202 - protein, 81 aa, Methylobacterium sp.
MVEFVRPLMCPVMRKLIGMIVRMSQHPGLQEQGQLIDQLTELETEGIARDVPWRTVEAIRATRLRLRVEGLMPRTPLPRGH

SEQ ID NO: 203 - protein, 316 aa, Methylobacterium sp.
MALREPRADTADACPGLAGGVGRRARAIPLRRRLTVAAAGRGRLLAAAPLPLLLALAATTTPEPVAVGLGGLALAWLSLRVQRLRGAACAATRQRNNLARLTAPTVARWVAETDRAARRPGWEQEATVLFADIRGFTRLCEGMAPGEVAAFLAPFRSRAARAIEAAGGLVDKFVGDEVMAVFGVPDAAPGDAGRTVAAARALAAAMAAWSGERGQAGLPPVRVGVGLHRGPVFIGVIGAERVEFTAVGDTVNVARRLEQMTHALPCDCLASEAVVRAAPSGGARIVAVGPVRGARTVLRLFTLRLDPAAPSRDGSE

SEQ ID NO: 204 - protein, 365 aa, Methylobacterium sp.
MNLLKRLFGRADAARAAEAAPDEPLLVNAYATVRDLPALPFDHALNGRRDLSDPELQPHLDGFIGYVMGRGDGQMTALRYHLWRHLQRVRNHVSFAVAASDLPRVEAWALAANAVLFLPDGSVRAPDMALLLSAAGETDPAARLPYPPDAVARRARTLEHLEDLDPKPPAGMPPALGEAELALRPPAEVLRRALALLYVAAWGQAFGAGTTLREPGQRALNPTGFAALSPAERAQIEAADPKDAAAASWRYEAANTLLWALGVRAARIADRDATVDVDALWRAVAPLARDAGAADAARLRPPGEILEALDRAWRAHWVVRQARQKGTTLAGLNGDVVAERHVALNWLTGFQNDRDTPWDATDTPT

SEQ ID NO: 205 - protein, 115 aa, Methylobacterium sp.
MQSSRWAGAFLAAGLIVAFAPPARADAALVLRETRLHTPPDSHEPQRAMVNLRNTGPDLATNVTVLCTFTGAGGTVLDTQQASVPEVVSLADVQAETIYYGWPRASSATCRLAEP

SEQ ID NO: 206 - protein, 319 aa, Methylobacterium sp.
MSKPNPRTAAAITLRDGASAIADLETQHRMAERALSGAEGALQEASAKYDAALGEGREAALAARQVRTTAEVDLDIARRNVDTLGRKLADAHEALRLAGIEHKRTEAERLRSVFEETVRQGLARMGVDARSILRAWAEAELAIREARAAQGPKGPAIPDAEEFRSVRRGADKEIRRTRITRWIRPGTREPYADEIEREIIRHGSIGFLPNPCMSGGGREIAERGVFDRVTYEKAVGAIHMPKLIESLCVPALVGGQVPGWMPVEGHVDPRTILTRLAELEHPAAEPKGELQTVDTFVHLVGAEAAAAWDCQEFRVRAAG

SEQ ID NO: 207 - protein, 897 aa, Methylobacterium sp.
PLARLDQRGLDALLAGHALAPDSLADLYPLTPLQEGLLFHARLEPGDAAYRNQVRLDLEPLDPDRFARAVRATLERHDVLRTAILDPADGPPLQAVLDAVPEPLTRLDWTGEPSSQDAPHEDALAARLAERLADCLAALAAEERARPFDLARAPLLRLVLVRTGPDRHHLVLTVHHLILDGWSTARLVAEVLARYRGEEPEPVTGRFADYLAWLARQPRAAAERFWQHALAGLDAPTRLADTFDPPGMTGMTGAPGARDGQRPPGHGEVRHHGEVRHRVPAAAAGRLLARARAAHLTLNTCVQAAWARLVAARTGQARVAFGTTVAGRPADLPGAETVLGLFINTLPVVVDLDPARPLGAWLAGVQEAGLGLREHGHLPLAAIQRLAGPAGAGTGTGTGTGGLFDSLVVFENYPVDQALAAARHGRDGNGNRDGNGDGDGNGGGDGDAADPHALRLGPAIVAETTHYPVTLVVHPETGPDGTRLALRLSYAADRLGHADAEALLAAFVAQLAALAEADPATPLGALPPPLPDSDRAVIGSANATARAYPDGAGDVLAAFADHRAHDPDAIAVTDAQGALTRRALDSAASALARRLVRAGAGPDTLVGVGLERSCALLVAWLAVLKTGAAILPLNPELPRPRLVATAREAALRLLVTESGPAARMPGPAELPDLQILTPDLAEAADDPALPAAAPHPDALAYLIYTSGSTGTPKGCANTRAAIANRLAWMRAHFAVGPADVILHKTPVSFDVAVWEILLPLVSGARLVMAPPQAHRDPDALAALIRRHAVTIVHFVPALLEAFLASGRLAACPSLSRIVCSGEALAPDLAAAVRAQSRADLANLYGPTEAAIDVSAWTCGPEPDAPRVPIGHPIANTQLHVLDDALHPVPVGVVGELY

SEQ ID NO: 208 - protein, 545 aa, Methylobacterium sp.
RRLSRRDSFFERGGDSILALQLVARARESGLALTPRDVFTHPRLAALAAHLDAAPNSAAAPPPQVDPAREAGPVPLTPIQRRFLDGPVPNRQHWNQAIVLAPRAPLDPGRLAEALAAVEAAHPALRLRFARDAHGAWTQTCRAPGQEPPLWRRAADGAPAFAALAAQAQTSLDLAEGPVWRAVHVTLPAEGTERLLLVAHHLVVDAMSWRILIQDLAAALAGRPLAPPPTSFPGWARSLDVLARHPGHAGRRESWLAGWLAGGPGADAALRPVRPEAPNVESAQTEIADSLDADTTDAFLRRAGRPYSAHPDEILLTALSIALARRGDGTAVGVILERHGRDADALADALAEPLPEPVAEPLSDAQDGPTLPRHDLSRTVGWFTTLVPLRLDPLGGEPDLPPDDDARGLALGAALGAALCRVKEARRALPQPDLSHDLLRHGPAADLRHRIAATPEPGILLNYLGQIDADRADPDAPFALAPESAGPMRDPHSPAGAELTLTALVRAGRLHLAWRFSPDRHDAAAIAAIARDTRQTLEALLAHCA

SEQ ID NO: 209 - protein, 67 aa, Methylobacterium sp.
MFKNTARAALCLACLWSVTPALAAPKEMPQGKRDEMSMKDTKHEVVMQRKENKEANKNVDSLITNRK

SEQ ID NO: 210 - protein, 470 aa, Methylobacterium sp.
MDRAQQLLRSLTKDARIVEIGPSFSPLAPKRDGWNTFVIDHAPRSELIEKYHDQTVDRIEEVDFVWTGGSIADAVPVDQHGTFDAFIASHVIEHTTDIVTFLRASETLLRPDGVVILAVPDKRKCFDFYRSLTGTADAVAAFLEKRNRHTVRTHIDYALNMALKDNGTVGAWSGRDTRPAIPANPLTDEPQWLGAAQLPYYADAHAWVFVPASFNLMILELAQLGYIDLRVEDFLDRDATEFFVWLRKGRQQLAPDEIREQRTALMQRAIVELAEQVQQLPETSLVEMASAGALRDQLLKATYRTEALRTVLAALRASIGRFGLDRAKFKRLIGAASQKVPGNLSAAVQHKILLTEATKILDGITDPAVEADDRDPAVIDGAVLVAPLGAAQFGDPLLAAELERERQRARAVRMVLDAVLGSLRGRALDKKRFRDLVTQAAARTPNDGPESARHAVLSEESRRVLGLPVA

SEQ ID NO: 211 - protein, 228 aa, Methylobacterium sp.
MSVLATALLTGASLGLSIAAPIGPTSLLCVQRTLSGGLSTGLATGLGVATVHLTYGGLVMRWGADLAAVWSNGAVLSLISGAVLLALAFRVLRSVSVLQEGRACRDTLAVSYGSAVVLALANPVTPVLFLAAMPAFLERGTAPFPVLAAGVFVGSFGWWVVLNTAVSLFRRCVTSQVLNRMNKAAGLLLALLALSLLVRGLDGGTVARSSSAGVSGVSGAGVRAPSRL

SEQ ID NO: 212 - protein, 236 aa, Methylobacterium sp.
MPEPLLATTGLRAGYGGKPVLQGVDLAVRPGEIVAVIGRNGVGKSTLMRSLVGLLPASAGGIAFRGAAVEGLAAHRRARLGIGYVPQGRDVFPRMSVADNLTVGASLLPKGERPDYERAFGPFPILRERRGQRAGTLSGGQQQQLAIGRVLVGGPALILLDEPSEGIQPSVVQQIGRTLVDLNKRTGVTIVFVEQNLDLIRAMAQRSYVMDKGRIVAELTARDLDDRDLVRRHLAV

SEQ ID NO: 213 - protein, 330 aa, Methylobacterium sp.
MQWLDQSIMARKGVAGGKPGREHTITEAEQGRYHYVYGPFAEPVLTVDPGAVVTVETHDAFEGKIRHETDSPTQILNFPYLNPQNGPIYVNGAEKGDCLAVAIRSIRPRGPQPCGTTLIMPEFGGLVATGDTALLNPPLPERVRKLEVTAENGVRWNDRITLPYQPFIGTIGTSPEIEAISSLQPDYYGGNMDLPDVGVGAVIYLPVNAKGALLYLGDCHAAQGDGELCGVAVEHPTHTTVQIDLIKGWTFRWPRLETEDFYMTIGSSRPMEDAARIAYRELIRWLAADFGFDEIDAYMLLTQCGRVRLGNMVDPKYTLGASITKAIAHA

SEQ ID NO: 214 - protein, 95 aa, Methylobacterium sp.
MHIGRVAGATRNLGAPRDWDPAKDGICGGLPIRDEPHSPGVNRMVSAWLPTPEEIALIAAGAPIYLGVLGIEHPPVSLFVGNPPADDAAQPEERS

SEQ ID NO: 215 - protein, 327 aa, Methylobacterium sp.
MALRTRLTDAFGLRQPIVLAPMDPASGGALAAAVSAAGGLGLIGGGYGDHATLDREFARAGNQRVGCGFITWSMARDPSLLDAALARSPAALMLSFADPAPFADRIRAAGVPLICQVHTLAHARRALEVGAAVVVAQGTEAGGHGLTARGTAAFVPAVADLIARERPETLLLAAGGIADGRGLAAALALGADGVLMGTRFWASREALIHPAAKQRVLAATGDDTIRTQVYDIARQRAWPAPYTGRLLRNTFIETWHGREDALRAASGDRRRDVEDADAAGDYDVANVTVGEAVGLIDDLPGAGDLVLRIAEEAEAAIRRISGMAAAP

SEQ ID NO: 216 - protein, 436 aa, Methylobacterium sp.
MRLLRSIYGQVLLGIALGIGVGVVAPDFAVGCKILGDMFINLIKMIVAPVIFCTVVVGIAHVGDMKSVGRMGLKTILYFEVATTVALAAGLLFVNLLRPGDGVNATVDSLDAKLVAGIAGKAHAQSPMEIVANIIPHSAVDAFAKGDLIQVMFFSVLVGMGLAMLGRRGEFPLKVVHAFGDVLMKVVGLIMHFAPIGAFGAMAFTIGKFGLGILAQYGMLIVSLYLTFIVFIAVFLGGVMRFYVGLSLWKLFRYSREELFILLGTTSSESVLPRIMAKLNGLGVDKSVTGLVMPAGLSFNMDGSCIYLTMAIGFIAQALNVPLTWEQELGILAIALVTSKGVAGVAGAILFVLAATLQASQLLPVAGIALIIGVDRILNELRCVTNAVGNMVATLVIARWEGKIDLAHARAVLDGRITPNLDLLDDEDEVADAIPA

SEQ ID NO: 217 - protein, 334 aa, Methylobacterium sp.
MRRRDVLAGAAALLAGPVPGRAQEVGAVAIARQPSLGHLPLMLMEEQGLLQKAAAARGVAGLQARYLTLAGGAAMNDALLSGTIQFAAGGVPPLVLLWSKTEGTAMAVKGVAAMNSMPLLMNTSNPKVHRLADFTDRDKIALPAVKVSVQAMFLQMAAEKELGAGRRNDLDRLTVTLSHPDGMAALLGGSEVTAHFTAAPIQELELRRPGIRTVLNSFDVLGEPSTFNVVWASSAFAGANPRVVAAFGAALDDALAAITADPSEAARAYVRLARDGSDVGLITEILKDPQVTFTATPRAVGKVADFMARTGTIRRRPESWKDLFFAGVHDKAGS

SEQ ID NO: 218 - protein, 248 aa, Methylobacterium sp.
MNTILITGCSSGFGLETARTFLERGWHVVATMRGPRSDLLAPSDRLSLLPLDVTDPDSIARAVAAAGPVDALVNNAGVGLLNALEGVSMDAAREVFETNTLGTIAMTRAVLPQFRARRAGVVVNVTSSVTQRPLHLLSVYSASKAAVNAFTESLALELEPFGIRARLVIPGRAPKTAFGANARARMGMDIPEAYAAVAAKVFAGIQQADGDLTRSSDVAEAVWRAVTDPSCPMRLPAGADAVAWAKAG

SEQ ID NO: 219 - protein, 301 aa, Methylobacterium sp.
MTDPLTQVVGLLRPSAPLSKLVTGSGHWAVRRTDSGLPFYAAVLEGGCRLAIDGEAGIVLGEGDFVLIPAAHAFTTTSLEPPTLRRTAQRPVAVSPGVFRLGDAEGPPNVRMLVGHCVFASSDADLLVSLLPRYVHVRGAARLATLLGLLNEETRADRPGRDVVLARLLEVVLIEALRATAGPAAPSGLLRGLADDRLAAALRRMHDRPTASWTVAALAREAGLSRSTFFERFRRAVGVAPMEYLLAWRMALAKDLLSREAVGMAEVAARVGYSSASTFSVAFARHVGRPPIRYAREWQAR

SEQ ID NO: 220 - protein, 376 aa, Methylobacterium sp.
VETVHSGGRPLTRAALAGRRRALEDGRTVSRRELSAAGRDAAKALNLRPALRSILSALCAVWGEQEWERLVVWPSNEHLCGMTGLSERALRYGLRDLVALEIITPRDSANGKRFAIRGPGGAVIDAYGFDLTPVVARKGEWATAIMEATARDAQRGRAFDLLTVRRRAVSEALAALRARFPATDAADLLAAQEALERSTPRRRASGADPDVVLDAWGELQVMAEDRFYQAASAGNSSRHIEQDTGSPTDPCAKAPGKEPEPTRRLEPSLVAAACPVAAEFGVTLRTEADVIEIGRLMRGGIGAHPSAWSEACKALGPFQASVLVLIVAQLHDDDVRRGEIRIRNPGGYFRQLVRLCSEGRYGLEAELMAMRRRKMT

SEQ ID NO: 221 - protein, 338 aa, Methylobacterium sp.
MKTIGFLSFGHWSPTGGSATRSAADTLLQSIDLAVAAEELGTDGAYFRVHHFARQLASPFPLLAAVGARTKRIEIGTGVIDMRYENPFSMVENAGAADLIAGGRLQLGLSRGSPEQVIDGWRHFGFAPAEGETDADMGRRHTEVFLDLLKGTGFAAPNPRPMFANPPGLLCLEPHSEGLRDRIWWGSASDATAIWAAQQGMNLQSSTLKAEETGEPFHVQQARQIRRYRQAWQDAGHARTPRVSVSRSIFALVNDLDRAYFGRGTSSDQVGIIDNMRAVFGRSYAAEPDRLVDELRADAAIAEADTLLLTVPNQLGVAYNAHLIESLLTHVAPALGWR

SEQ ID NO: 222 - protein, 268 aa, Methylobacterium sp.
VETASDGTLSSSLAFMLPGTPRAEVEAVFKAEGQPAEAVPIPTNPSLVRIGSEVILIDAGSGNSFQPTAGKLGETLESRNISREAITQVVFTHAHPDHLWGAVDDFDDSERFPNARYVVPAEEWDFWTREDVETLVPDWLKGLSAGSRRILRRLEAKVERRKPGESIAPGLSYVASPGHTPGHASVLVEARGEQVLIGGDALSHAVLSFRRPAWAFGSDLDRDLAASTRLALLDRLATERMMLVGFHLPGSGVGRVERAGHSYRFIQT

SEQ ID NO: 223 - protein, 282 aa, Methylobacterium sp.
MDDQDKQFITQQILDVGRQLYAALDSKIMTAHAQQLAQMQDVRRLAVVQLAPKNDFCLVTDHPIAYESNDHTVPRGTKDDNTRNQRFCHAVESHFGRKVRALDLGCAGGGLVFDFLIRGNAAFGIEGSDYSLRAQRAEWSIIPDYLKTCDITKPFALMDQRSGTKAKFDVITMWEVLEHIEESLLPQLFANVKSHLADGGLFVGSAATYDDVANGVSYHPTVKPETWWRELVRQHGLEFVPMTMFQFKDFCRGSGNENAFYDADFSKNPELGFHFVMKHRPA

SEQ ID NO: 224 - protein, 350 aa, Methylobacterium sp.
MTASAALKDPRRYFEAIGADRASEALAPPVCLYLEVTNRCNLLCETCPRTFETLEPPADMSWDLFTRIVDQVPNVARVVLHGVGEPMLVKDLPRMVRYLKDRGTYVLFNTNGTLMQPKRFRELIDTGLDELRVSLDAADRASYRRVRGKDFFDRIVRDVGKFVAFQKASGATTPRVSLWLTGLKETVDQLPAFVRLAAEMGVTEVHLQRLVFDEAGYGMARADLSLFESARAEETAAIAEAEALGRSLGVTLDASGATEPGISLKRQEDRAWATCRRPWSLMYVTAHGRALPCCIAPFSVRGYSNYTLGDATQATLREIWNGAAYRDFRTSLLSDVPPAPCRNCGLRWSL

SEQ ID NO: 225 - protein, 215 aa, Methylobacterium sp.
MTLRRRALPLAALALALPLATPLATVAARAQDRLPTIPPQDYTPEQKQAAEAFAQARGKPPFGPFEPLMYSPEVMTLARSMGDYLRFKPKIGTTLSELVILMTARRWTQDYEWYVHAPIAEKAGISADIIAAIRDGRRPAKMSDDETLVYDFTAELQDTKRVSDATFARAEARFGKPGVVDLAAISGYYTFLAMELNAARYPIPADGKPLPRMPE

SEQ ID NO: 226 - protein, 304 aa, Methylobacterium sp.
MSYPARVQVIEVGPRDGLQNEPAPVPIAARVALIEALAEAGLTRIEAGSFVSPRWVPQMAETAEVLARLRPRPEVGYSVLVPNLQGLERALASGVRDIAVFAAASESFSRRNVNGSIAETLDRFAPVLEAARANDLRVRGYVSCVLGCPYEGDVAPAAVARVAASLHAMGCHEIALGDTIGTGTPRAARRLVERVAADVPLQAIALHFHDTYGQALANILACLELGVSAVDAAVAGLGGCPYAPGAAGNVATEDVVYMLRGMGIETGIDLDALAAAGRSIASQLGREPASKVARALAAAPPPTP

SEQ ID NO: 227 - protein, 132 aa, Methylobacterium sp.
MSEITEAAPAAEPDYDRLLRANLRRVFNERDADARAAALDEFYVAEPILFEPDNVVRGRAAIGAVAGTLLDRFGPTFRFVPVGRGVGHHGMGSLRWEAGPEGGPVAVTGTDVAEIVDGRIGRLWVLLDPPAT

SEQ ID NO: 228 - protein, 299 aa, Methylobacterium sp.
MELKWIEDFLSLAETRSFSRSAEARHVTQSAFSRRIRSLEVWLGTALLDRSTYPITLTADGRHFLETAEEVVRLLTLSRADFRNRSERSSLPVVAITALHSLCLSFLPRWLGTLRGELGAMSSRVLPENFNICLQALVEGGYDLMLTYHHPGIPIPLGPDRFPCLVVGQDSLVAVAAPADLPRDREGRLPLLQYSRGSFLGRLAAIAQAREGAPATYPVHTNENSMAEALRSMALAGHGVAWLPRSLVAGEIAAGALAIVSPEMSMEIRLYRSAERARPFLEAVWSAAAADSKNYSGSE

SEQ ID NO: 229 - protein, 176 aa, Methylobacterium sp.
MQETGAHLSRRGFLGAAGSTLLAVAVMPDGSVTGRAWAQMPKATKPETFASLVQMSRDCYPHDRVADRYYAAAVQILDDAARTAPGELTLLEDGMAALNRAAVERHRLPYAKVPQDTDRAALLETIEPTPFFQKVRANLIVGLYNQKELWPIFGYEGASFDKGGYLERGFDDIDWL

SEQ ID NO: 230 - protein, 197 aa, Methylobacterium sp.
MTEHPVAGPALAVDVTVDPLATPYFDYILDGVRLDLAHLEPRGLTFFVKNLGRDLTVDVKFSNHCFTVDFDPAVHNPAHVIMDHKRRRAYDPERHALSRGLPDMIAALPSAAVYLTPSDRNYVYVARLVTPAGMVYPMYFHLRRAKDTAPRNLQMVVESAYPVEDARAVLAGTTKISFAVLCAKVFRGERIRPQARR

SEQ ID NO: 231 - protein, 160 aa, Methylobacterium sp.
VRLRAVALSRSVSMTLARDPDAHLSSTTDAAKLSLPLSWWRVFAPEALDMAAQCRLSAALNAVQPLPSPDWSAACRGDSAAAIHIALNVLAEAIAFPGRLDPAMSAICLCAVRGDGSCIDLLVHVLGRRARRRADLKVLCLAHAWCSVPRRGSDRVGVAR

SEQ ID NO: 232 - protein, 242 aa, Methylobacterium sp.
MDVVARRRGRPRKAPVVPVAQLPRTGLHEQAAGRLRDMIVRGVLPAGASLVETDLSVALGVSRTPLREALKLLAAEGLVELHQNRSARVPDWTPEEILELFEALAGIERLTAELAAPRISETLMDALRGKQAQLDRMHRDQVLDAYFALNQEIHRTIVEAARNRPLAEAHAALQARAQWARLRALSSGSRWEESAREHRDLFEALAARDAAAAGTVAHRHVLRTGVVIAETLQARRTDPAAP

SEQ ID NO: 233 - protein, 327 aa, Methylobacterium sp.
MEDAVMELVTKPLRDEGPLPLLVTPPEGAAGTALADALPAIRAAAEAHLHAAGGLLLRGFSLDGPDAFRSFAAGFGHDLLSYEFGSTPRSPVTQGVYTSTEYPPHQHIPLHNEQAYARDWPMKIWFYCQQAAPEGGETPLADSRAIYRAVPEPIRARFAEQGLMYVRNYGNGLDVAWEQVFGTQDRGAVEAYCAGHGITCEWKPDGDLRTRQVCQGTARHPETGEPVWFNQAHLFHVSNLEPEVRATLLDLVDEPDLPRNVYYGDGSPIPDADLDAIRAVLAEHTVVFPWQSGDVVMLDNMLTAHARTPFKGPRKVVVAMAQAGRAQ

SEQ ID NO: 234 - protein, 647 aa, Methylobacterium sp.
MQAVARSESLAAAPCAGPADRAGRRGGWRDRWRAPRLRVVLALGFGTLGFLTTLTLAALVSREATRRLEAEVGGQLAEIAGQMARSLDIGMFERWRDIQIAAASDSLRDPGTGTAAKRAVLERLQATYPAYSIIGLIDADGRFSVTSTGALEGADVSGRDYFRGGRAGPYLGDVHPAKLLEALMPPDEAAARAASREPLRLLDVAAPVRAPDGRVLGVLAAHLDWTWARDMARILEAGLRGHRQGAEILILSRDGTVLLGPPALQGAPLPRSVLAGGRPLDPEGTSRVGPWPDGAAYLSARASTAGHRDYPGLGWQVVVRQTADRALTSVAALRGGILAAGSAVALAAALLAWLLAGLIARPLLDLAAAAETLGRDQPLPPLPRSFVREGATIADALAAAADERARRAETHRLLIDELNHRVKNTLATVQAMAAQSLKNLGAGAAAGRDAFEARLLALSRAHDILTRESWASADLRGIAAQAVRPFLGPDPAGDDPSNRDSSGRETSDRDAAGGDTADRDTLGANTPRITLDGPDLRLPPEGALALTMILHELCTNAVKHGALSVPGGRAALAWTVEAGPDTETLRLTWRECGGPPVVSPSRKGFGTRLLERGLAGGRTASLTYEAGGLVYVAANPLPAARLHTGRA

SEQ ID NO: 235 - protein, 272 aa, Methylobacterium sp.
MRTSLRRDLDWFSFHGAVLLLAGLCLVLLAAPTVIVVVVSFTSGFSLRFPPPGYSLRWYAALAEAEQLRAAAWNSLVVAGWTTLLSVALGTAAALAIARSPRLSARLLDSLFLSPLVLPALAFGLAALMLFSLAGIPVSPLTLVLGHTVVCVPYVVRTTVAALSQMDPVLLESSTSLGASRLYTFRRVTLPLIRPGILAGGFIAFMASFDNVPVSLFLRDAATDMLPIRMWQDLEGRLDVTVAAASSLLILVTVVLAAVMERAAGLSRRMAG

SEQ ID NO: 236 - protein, 300 aa, Methylobacterium sp.
VSAGPATAAGPVAAPLRPGRAWTAAYDIRLALPLGAFFLVFFLAPLALLLLVSFYADPAMTRFGLDQYARFLLDPFSLRVLGATLWLGVEVTALTLLLGLPLALLLTWAPGRLRGLLTLIVLLPLLTSVVVRTFAWIVILGRQGIVNAALLGLGLTDAPLKLLYTEGGLVLALAQVQLPLMVLPLVTALSRIDPNLADASAALGAGAWRTFLRVTLPLCLPGIVAGCLLTFAAAITAFITQSLIGGGQMLFMPMYLYQQASSLNNWPFAAAIAIVFLVAVLACVTLLNLAGRLSGGRARA

SEQ ID NO: 237 - protein, 347 aa, Methylobacterium sp.
MPLHRRSLLAGALTLGAAQAFPGLSRAQARKLVFATFTGSWEEAHRAVLVPAFRKSSGGDVILDPMLSVDQIAKVQAARANPPIDVMLHDPGPALTAIAQDLVEPYPVAQSAHYGDLIADAQEPMGPAPFFQIVGLTYNPEKVKTPPTSWADLWKPEYRGRVGITNLNSTLGTGFLVEIARMHGGSETDVEPGFKALEALKPNLAAVAANPGALAALYQQEQVDIGPGNFNAIQILKARGVPVEFAAPKEGIIAFKTTIHIVKNTPSKELAFKLIEAALSPEVQAKLMQSPYLIVPTNRKVAIDGEVAKVLAKDADELKRKSVFQDWAAINRGRPAWIERFNREIRV

SEQ ID NO: 238 - protein, 157 aa, Methylobacterium sp.
MSDPITLDTVAAGRLRDAGHLNYGKRGGGTIWQHTTIARLSAIDRPTLSAEETKRLGVSRLREWCVDGVAVGSLETAIAALAVPPVLTEEETAILARVPADWVELHAFREALGAEWGAPVGATLIMLRQKGAIQNERRPGETRPQPWIRRTPEAGHG

SEQ ID NO: 239 - protein, 134 aa, Methylobacterium sp.
MVSSNDPPRAERVEVITSVQRRRHWTTQEKVRLVEETYLPGQSVSLVARRHGLNANQLFTWRRLMERGAFTAAGAGEEVVPASELRAAQQQIRELQRLLGKKTLETEILREAMERVVAPKKLPSRVTSWPEDGR

SEQ ID NO: 240 - protein, 98 aa, Methylobacterium sp.
MSSDPTAPPVHGEILSGVQRRRRWSTTEKIRLVEESQQPGSSVSFVARRYGISPSLPFSWKRRMLEGGHQAVHADEEVVGTSRVRELERRVRDLERLL

SEQ ID NO: 241 - protein, 294 aa, Methylobacterium sp.
MPSATTDDGIRLHYEESGRGTPLIFVHEFAGDHRSYEAQLRHFGRRYRAVAFNARGYPPSDVPEAVSAYAQARAADDILAVLDHLGAPKAHVAGISMGAFATLHFGLRHPGRALSLCLGGCGYGAEPERQALFRAEADATAAMLLRDGMAAFAERYAVGPTRVQFETKDPRGHAEFKRMLAEHSALGSANTQAGVQKGRPSLYDLTDELGRMTVPTLIVAGDEDWPCLAPSLMLKRVIPSAALAVLPNTGHALSVEEPDAYNRLLDDFLAQVESGRWPMRDPRAISATITGIRG

SEQ ID NO: 242 - protein, 183 aa, Methylobacterium sp.
MARALPDVTSIEEGVGLLRTQLLSISDAIARTRQEIADLRQEQETSRARDELLAVVQGTEDATNAILTASEKVDTLARGIVRRSGEDANRADARAIQIEMQTIFESCNFQDLTGQRISKVVRTIVLVEERIGEMLRVWSGPGDAPSRPNPTTDTRSEEAALLNGPVLPGDASVSQDTVDAMFP

SEQ ID NO: 243 - protein, 93 aa, Methylobacterium sp.
MTRMIGPWSAPAAWPVRALAVCAVLAGSGPALALENPASAFCATMGGQTILAKLPDGGTIGLCALPGRKIVEEWTLYRMLHGVKPAPDADPFR

SEQ ID NO: 244 - protein, 473 aa, Methylobacterium sp.
MPSFRNNAVDPQQISSAFDSIANAFKVTPQEILAGAKSRETMQKVQYLADAYKLAQDPNSDQGQLDRLASIAGAYAPSQSLTAVDRNNATSLRTNAADNARALQVAREGQAGETTRTLLSPVGEGQTRFIPPSVASLYGLPAQQIGAVKANEGQTVALPGGGTVEGREKPLTEDAVKARVLAGMEPAAQRAAAFGNTPVETVMTPQGPRISSRLDAIGQAPAPDTQKAQFFNYDTPDGKSGTARTDGSGKLVDTQTGAELPPGSRTYTAQLTGNKTDTGLGASAKSNIETQLLDLSNLEQSVNALDKIATSNPQSIGLTGQVLGIGQDAMATMKEAATMFGPKAQDYLKQVEDGSLPPEMSRYFNPNIPQATLLENTILAQYAKMQDPNGRLSNQQMEIAAKALGIDGMLKSADKTKAVIAGIRQQIAQKRAMLGGAAPAANAIRPPDAAGGPAPAPAGAPVRRKWTASGELQ

SEQ ID NO: 245 - protein, 268 aa, Methylobacterium sp.
MERDRRHKAFMRRGEILPEPGVEAPVEGEAEAQPEAKPAESPREKHQRERREREAERVAARRAEYDLPEGKQWAMVEACVGRTGELCEKLTQAKIPHFRPRDEIDQVLSSGRIRKMQVPLFDRTVFVGLKDRGQLEELAAEHPWLMERRVYGDMPWLRRDKTWAWDVEHVERCVLGQDKDGHPVIAAATIPDKQMREFAETLIGSMPVFDVEEVFSIGESVRVADGPFASFSGVVEEFDAGRGMVKVEVSIFGRPTPVELELHQVERQ

SEQ ID NO: 246 - protein, 429 aa, Methylobacterium sp.
MSDDRYHRKALGNRPLRPETLMLGYGYDPALSEGAVKPPVFLTSTFVFTSAEHGKAFFDYVSGRREPPVGEAAGLVYSRFNHPNSEIVEDRLAVFEEAEAALVFSSGMSAIATTILAFARPGDAILHSQPLYGGTETLIAKTLAGFGIAPFGFSDGTDPASVRAAADSAADAGRVSVVMVETPSNPLNTLVDLGLVRAVAEEIGARQGGEAPVVVCDNTLLGPLFQHPLREGADISVYSLTKYVGGHSDLIAGAALGSAARMKPVRLLRSAIGTGLDPHSCWMLGRSLETLSLRMNAANRNGEIVGRMLAAHPKVARLHHLAHLEPGSRQAQVYAKQCAAPGSTFSFDIVGGEAEAFRVLNGLQLFKLAVSLGGTESLASHPASTTHSGVPKTVRDRLGITDATIRVSIGIEHPDDLVADLAAALSVLG

SEQ ID NO: 247 - protein, 705 aa, Methylobacterium sp.
MAPSATHDLGTSLFRPERVAVVGASDDASKTTARPLRFLRRSGFGGTVYPVNPHRETVLGERAWPSIESLPETPDHAFVLAPTEGVLEAVAACAARGVPLVSVLAGGFGEAGKAGRAREAELTAILAGSRTRLLGPNSIGIVNVNTGLVLTANAAFAEPTLPAGGLFVASHSGSMIGAILSRGLAKGIGFAGFVSTGAELDLSLGEICAATLDDPLIDTYALFLESIAHGSAIRAFALAAAARGKPVIAYKLGRSAQGAELSQSHTGAIAGEDGIADAFLKDCGIVRVETLEGLIEGAAMLRRVGRSGRSVAAKPQVAVVTTTGGGAAMVVDQLGLRDVAVVSPSVETMAALAARGVAAAPGRIVDLTLAGTRPAVMKAALDTLLAAPEFDVVVAVAGSSARFQPELLVPGIVEAASGATKPLVAFVAPEAPEALARLAGAGIPCFRTPEACGDVVAAVLGRRPAKPMVPTKPVTDAEAALARPASPHQLDEAEGYAVLARLGVPVAPHAAVTPDATASPVGYPAAVKLLSAEVLHKTELGGVVLNVRDDAGLRDALIRIVRNVPRAAPEVAVERLLVQAMAQGVGEVLLSLRQDPDAGPVVMLAAGGVLAEIHRDRSLRLAPVDRDEALAMIGEVRALKALAGYRSRPKGDLDALADAVVAISRAGPEILEAEINPLIVRDEGQGVVAVDAVVRLAATQEGSAA

SEQ ID NO: 248 - protein, 182 aa, Methylobacterium sp.
VILPPLRRTAADARTVATVAHDGQVDKAGRPYIEHAARVAAGVLGLSEGCPFWSDLERDEALQAAWLHDVVEDTRYGFGDLAKEGFSDNVLTSVAMLTKPGGRVTYAAWINNIAKVGTLRATLVKLADLEDNSDPGRLALLPAETRERLHLKYEPAKAILRAAAAAKGWLGSTTTVEGSGPR

SEQ ID NO: 249 - protein, 91 aa, Methylobacterium sp.
MSSTRKTALRGALLGLALAGPALADDTPTTAGAVDRLKGLANEAVGGAKRGVGNLTDDEALKAEGRDQKLRGQAQQERGKAKDAVENALDK

SEQ ID NO: 250 - protein, 286 aa, Methylobacterium sp.
MEWSDVRVFLAVARSGTLGGAARSLQTSHPTVGRRLRALEQAIGHTLFQRTADGLVLTEEGHGIIALAEQMEEGALAMERRLAGQEQNLKGSLRISSADWFGAYVLPPILADFSRAYPNVDVEILTGTRLFNLAQREADVAFRIVPFNTADVVQRRLFRLEYGVYIAEEAPDPGYGDGTGFRLITHETSTGHFPDIAWLIESFPNARPVLRSNNRNVQGRMCKQGVGIAVLPRVVGTQIPGIRRLETPTQPPARDIWMGYHRDLRRLRRLRAFISTVSDHLVNATV

SEQ ID NO: 251 - protein, 488 aa, Methylobacterium sp.
MSATEQSFEPRPSEEQPGSAEARAATRPEHFDVLILGSGQGGKLLAWHLGHAGRRVAVVERRWVGGSCPNIACLPSKNEIWSAKVAHLVRNAARFGTITGPVTTDMEAVRQRKRAMVEGEVAFHLKAYGDAGVDLVMGSGRFVAPKTLEVRLNDGGTRVLTGDQVFLNLGTHATIPAIPGLAEAAPLTHIETLELDAVPAHLIVLGGGYIGLEMAQALGRFGSRVTILQTGPQLLSNEDADVADEMQQILAAEDIEVITGAETLSVTGRSGQAVSLVVRTGEGERTIGGSHILVAAGRTPNTQGIGLEEAGVALTDRGFIRVNERLETSAPGVWALGEAAGSPQFTHVSVDDFRIIRDNLAGGRRSTQDRLVPANMFTEPPLARVGLNEREAQRQGVPVRVARLPMSAVLRTQTTGETQGFMKALVGEDDRILGFTMIGSEAGEVVAVVQTAMLAGLPHQRLRDAVLAHPTMAEGLGSLFAGVPPRSS

SEQ ID NO: 252 - protein, 460 aa, Methylobacterium sp.
MDDHYDALVIGSGEGGKFLAWHLAKAGQRVAVIERRWIGGSCPNTNCLPSKNEIWSAEIAHRARQADRYGIETGPVAVDMGRVVARKRAMVRDLIDMHLDRYRESGAELVMGTARFTGPRALTVALNAGGSRALTAEQIFLNLGTRATIPDVPGLREAGPLTHIEALELDAVPAHLVVLGGGYVGLELAQAYRRFGSAVTVIEHGPRIAGREDPDVASALAQLLEAEGLAIRTGTEVVRVRGRSGEAVEITVRGGAGEAVIAASHILVAAGRAPNTDGIGLDRAGVALTERGVIEVDDHLRTSAPGVWAIGECAGSPAFTHASADDFRVIRDTLAGIPRSTAGRLMPSCLFTDPPLARVGSTETEARADGHAVRVARLPMAAVLRTRTTGQTDGFMKAVIGPDDRILGFTMLGAEAGEVMAAVQVAMLAGLPYTALRDAILAHPTTAEGLNSLFAAVPAR

SEQ ID NO: 253 - protein, 429 aa, Methylobacterium sp.
VEQDSGEDDGQPAAQVRTPISRPLDLLNFLLIDVNGAIKPYLNVYLYVHRGWDDASVGLVGTVSGIVGIVAQTPIGTAIDAVRDKRVILLGALVALSLATLLVALFPQFWPVLAASCVLAAVGGMLSPAIATLTLGLFPADKLAQRFGRNAALERTGNVAIAVLIGLVGWLFPDRAVFLLVPACAIVSAAALYSIPRGAIDARRARGGGEDDAEQAPAGWRTLLTCRPLMIFAACVGLFHFANAPLLTLVAQEIGQARPDWSSVIVSVCIVGAQTVMVPMGLIVGRRAERWGRKPLLVIGFAALPARALLYLVWRDPYWLIAVQCLDGVGAGLLSAVKPLVIADITRGTGRYNAAHGLIGTVQGAGASLSFVIAGTLVHHVGFDAAYLACAAVAAVALGVLVVLLPETAPGKPRVGLPARLRALRPGKA

SEQ ID NO: 254 - protein, 535 aa, Methylobacterium sp.
VPVIESALDPRAPEARANAEAMRALVADLRATADRVRLGGGEAARERHRARGKLLPRDRIRALIDPFSPFLEIGQLAGHGLYGGEVPSAGIVTGIGRVAGRECVIVANDATVKGGTYFPMTVQKHLRAQEIAQQNRLPCLYLVDSGGAHLPSQDEVFPGRDHFGRIFYNQATMSAQGIAQIAVVMGSCTAGGAYVPALCDESIIVRGQGTIFLGGPPLVKAATGEMVSAEELGGADVHARISGVTDHMAETDAHALGIARRIVANLNAVKRPALAPRQPEPPRYAAEEIYAAVPADRRTPYDVREVIARLVDGSDFDEFKHLYGQTLVCGFAHIWGYPVGIVANNGILFSESALKGAHFVELCAQRGVPLVFLQNITGFMVGRRYEAGGIAKDGAKMVTAVATAAVPKFTVLIGGSFGAGNYGMCGRAYGPRFLWMWPNARIGVMGGEQAASVLATVRRDGVEGRGGTWSAEDEAAFKAPIRAQYEEQGHPYYSSARLWDDGVIDPADTRRVLALGLSASLNAPIPETRFGLFRM

SEQ ID NO: 255 - protein, 200 aa, Methylobacterium sp.
VGRTAGSNGPRTAAAIRRAGLRLIYRHGYEAMTLRALAAEVGIQAASLYNHIRSKQDLLFDIVRDHMETLLARTDAALAAATGTPTDRLRAFVAHHVTYHLEKKQEVFIANFELRSLDPPHYAAIVALRRAYEDRLVALLERGSEAGELDVRDARVAGYAILGMLTSACTWYRPDGRMTKAAIVALHTDMALRGCVRRQP

SEQ ID NO: 256 - protein, 37 aa, Methylobacterium sp.
VLIEEFRKAGELPDAAAGWRMEIHDANGTVLRTLPLS

SEQ ID NO: 257 - protein, 134 aa, Methylobacterium sp.
MADAVASQRAVLIVEDDPVQLMDAAAALRDVGYAVAEAATVEAAQAHLAARPELVAMVADVDLAGEPLSGFTLAKAVAARWPELAILIVSGVAWPAEEQMPMGARYLRKPFTPEGLAGALGAVLAARGVGSVPH

SEQ ID NO: 258 - protein, 74 aa, Methylobacterium sp.
MTAEERLAELKAADTRRQTRRREALKQKGMTQQNVWLKPSVKAVIDQAIQNGRFKSRTEAIEWALASAFEEKSA

SEQ ID NO: 259 - protein, 388 aa, Methylobacterium sp.
MHEFTELRGREAAFPEAEFSARQAAARAAIAGAGHDALVVTGPETIYWLTGRQTAGYFAFQALLVPVDGDPALLVRQLELPGAAANTWLDDIQAYPDGADPAAALAALVRGRGVARPALERDGWFVAPALAARIDAALGSGPLPDGSGLLAPLRAVKSAAELAAIRAAARYAQAGLAAGLDACAAGTDENAVAAAMLAAATAAGSEAVAMEPLVASGPRSGLPHMTWRRRRLEPGDAVFLELAGSHARYHAALMRSVWIGPPPAEAQRMMDCALRALDAALGAIRPGHPCAAPHAAAQAVIDAAGYGPAFRKRIGYSMGVAFAPDWGEGALLSLFTGQDRPIEPGMVFHLPATLRRYGAWTVGASETVIVTADGVEPLSDLPRTLSVR

SEQ ID NO: 260 - protein, 113 aa, Methylobacterium sp.
MGVDIARVKALIATLEAVTSAPHFHRTAFRTPRKTFATLDEVGHDINLMFDPDLRDFFCEQVPAAFSPVPGGWGRMGATRCDLAIVDEATLMSALTAAHRLAAPKPRARRGGA

SEQ ID NO: 261 - protein, 156 aa, Methylobacterium sp.
VDRMMLSRRGVSGLAALVAGLVASRASADPAAGPKTHRVAMQVSSNEGGVFDLALNNAVNLAREYSDQAEELEVEIVAYGPGLHMLRADTSPVRLRIHSITESVPGIVLSACGNTVKAMEKAEGHTVELLPHVGVVTAGAVRLVALQEAGWSYLRV

SEQ ID NO: 262 - protein, 559 aa, Methylobacterium sp.
MTSRRDFLQIAAATAALVPSGWTRAFAQQRLTQDDLLAFEPMGNVTLVHLTDIHAQLRPVLFREPSTNLGVGAARGQVPHVTGRAYLDLYGIPGASQLAYALTPEDYVALARSYGRMGGLDRIATVLDAIRAERGDKVLFLDGGDTWQNSYTSMVSRGQDMVDCMALLKPDAMTGHWEFTLGTERVKEIVDGLGCPFLGQNVRDAEWNEPAFEATKMFERGGAKVAVIGQAFPYTPIANPRWMIPGWSFGIREEDVQASVDKARKDGADLVVLLSHNGFDVDRKLASRVKGIDVVLTGHTHDALPQAVKVGNTLLIASGSHGKFLTRVDLDVRDGAVKGYRSKLIPIFSDVIAPQKAMADKILAIRAPHEAMLKEELGRTEALLYRRGNFNGTLDDMICDALLSEREAEIALSPGFRWGTTLLPGQPITREDVYNATAITYPAAYRMPMTGARLKEVLEDVADNLFNADPYYQQGGDMVRVGGVSYAIDVARPAGSRISDLTLLRTGKPIEAGTSYTVAGWASVNEGTEGPPIWDVVASHIKAKGTVNPTPAQVTVRGA

SEQ ID NO: 263 - protein, 191 aa, Methylobacterium sp.
MSTRRRFLAGALALGLPAKAMAQAIQGDDGLYREPWFLESFLDLPDDLKAAREHGKRLAVLWELKGCPFCKQIHLVNFADPATSAFIRERFEILQLNFIGSREVTDFDGQILSEKAFAEKYGVRSTPSIQFFPSEDEALGGKPPLQREVLRLRGYAPPEEFRRTFAFVAERAYERTNLQDYLRSPKAAQRG

SEQ ID NO: 264 - protein, 113 aa, Methylobacterium sp.
MAGAWGLALWPGSVEAAELIKFERRGCPWCKAWDKEIGSIYPKTDVGKRAPLRRVDLDAGIPPGLTLKRPIRYTPTFVLVEDGSELDRIEGYPGEDFFWGRAERLLERLPASP

SEQ ID NO: 265 - protein, 347 aa, Methylobacterium sp.
MSDILPAYLLRAALGLVLGALLGTVARRGRFCTLGAIEDAVYAHDTRRARAWLLATGIAILGTQLLETGGGLDLARSIYTGPRLEWGAMILGGAMFGFGMALVGTCSFGALIRLGGGDLRALLVLLVLGLSAYMAISGVTALLRVTMTEPLSIDIGSQRLGELLRLDQTGRIVVGVVAAAGLCIAALASRAFRETKRLLFGAIVVGCVVVAGWWTNGIAGFDEFETRAVGSFSFARPVGDTLLYVMLASGTKIDFGVASVFGVLLGSFASARHAGEFHWEAPDDAREVKRHLFGAFLMGTGGVTALGCTIGQGLSGLSTLSVGSMLALGAILVGARAGLYYLVDRHA

SEQ ID NO: 266 - protein, 110 aa, Methylobacterium sp.
VTGLSLHAVDAATGRPAEGMRVRVLRAGGKRRVIAEGRLGADGTLDHPVVRTRLAAGLYEVVFVIGDFVGAAGEGFLEEAAIRFRLDDPDRHCHLPLKFTAFGVALFRGC

SEQ ID NO: 267 - protein, 416 aa, Methylobacterium sp.
MSNGLTPTADRIVVASEADWNDAWYLVCMKVSTIGFVVVDARERVATLDALRAAGITDIAAHLDAHPDVADRLRHGMVILDVNEAAVRMFGAGGRADMIGQRTQRFFDPLCTAQVNSARAFAAGATSFQQQAHSVRLDGSRFETLFCVVPRADGATSGLWLASFVDITEHVARQMSLEVLRDELAHVSRISTLGELSASIAHELGQPLSSIGMTAGAMLRLLDRADLDRDLLRRQCQRIVDQVTRAGDIIDRTRRMAAKRDSVRAPVSVAEVLAEAARFVAHDLNRTEIRLTVAPADAAAQVVADRIQLQQVFVNLLMNAIQIHRQARTPGPEIAVETVCRDGSITVDVIDNGPGLDPGTLDRLFDGFFTTRAEGLGLGLRICRTIVAAHGGSIDASPRDGAPGARFSVCLPLARS

SEQ ID NO: 268 - protein, 132 aa, Methylobacterium sp.
MSKRDAVFPPGRQALYDKHRYSAAIRSGDLLFVSGQVGSREDGSPEPDFGAQVRRAFDRLNSVLAAAGCSFDDVVDVTTFHTDPETQFDTVMAVRDVMIGEPPYPNWTAVGVTWLAGFDFEIKVIARLPTPV

SEQ ID NO: 269 - protein, 221 aa, Methylobacterium sp.
MHELGPDFVGPAAEPRPSEPCGPEIAASDWPSVRQWRKETRAALIARRLGMSAQDRAARSERIGQGLRAALPSPSGLSIGLYWPFRGEFDPRSLLTELRGSGARLALPVVVEKARPLRFRVWSPGDRMIRGVWNIPVPAEGETVDPDVLIAPLVGFDQAGYRLGYGGGFYDRTIASMSTKPRVIGVGFELARLATIHPQAHDVPMDIIVTEGGVWPRTERS

SEQ ID NO: 270 - protein, 405 aa, Methylobacterium sp.
LVANIAANVLTRGTLIGPFLYSLANLAEVMLAVRLLRRTYEHDALLQSTRSALRFLAIAGLLAPAASGVLGGLTAHLVFGEPLLRSFGTWVASDGLGLIVFTPFLLSLFRGDYANALAERSWRDRLEAAALLVLAGSVAYATFFCTSRPLLFLIFPPLILIAFRLGRLGVTAAAMVVAVIGGVATMYGRGPMVLIAADAVTQAQAFQVFLAFILLTCLPVAAEVSARARLTAELAAHDREMTRSAFTDSLTGLLNRAGFEHQIETILPIRALPPVSLIAIDVDHFKQINDRWGHPAGDRALETLGSLLASQIRPGDLVARLGGDEFVILLRESDLERARAVCERIRASARAAAFSTSAGSEAPVSLSMGLAVARVGERYEALAQRADSALYEAKHAGRNALRWAA

SEQ ID NO: 271 - protein, 295 aa, Methylobacterium sp.
MTIVPHPAAQRGGRQRLAARRQPGSATTSRITVPLGSAAALGCGHVQPAIQQICAPELMAAAQAALDGAFRATFVPDPLLGPGLSQLGSVLASMVKRHGSLIEAAITDVLERSGRYVVLRNVAMPITVPTQELVRASSVAQLNQTSIELTGAVAQSVFLDLIVVDRKESRAIIAEVKRGSGKNEARKIHQVEWVLRCAQVQGRSFLASLGYEVAQIRAVLIDVYGRAGYGDDITVSGPAIDQLFATPVLAALETVTAALQARLHAAVPDLLTMALASLAVPENVKHPHSPGPLAP

SEQ ID NO: 272 - protein, 104 aa, Methylobacterium sp.
MARDGNRPHPSALARYPVPIELISALFRADDAERDRLLAPMPAYGRARIAAYCAEHARLEALGLKVARSCDEATLVRAAGETVGADLFARSRAPAPSPIQLQAA

SEQ ID NO: 273 - protein, 91 aa, Methylobacterium sp.
MRASKPVTVTLGDLQDRVEARVKSGSYASVSEVVRAGLRALDREEAALDAVLRQRVQEALDDPRPPIPADQVFTALQAHHAARMKAAKRGA

SEQ ID NO: 274 - protein, 147 aa, Methylobacterium sp.
MPASASLEERPPLVIPTTDLLSLREIVTATHPSDPRAAVAAWLAEELDRAAVVAPEAFPPRVITMHAEVSYRDDVTDQVGRMKLVYPGEEDAEGHAISVLSPVGAALVGLSEGQSIRWRTPSGGFRGLTVLRVLFQPYGGAGASDGP

SEQ ID NO: 275 - protein, 76 aa, Methylobacterium sp.
MSRYFISTDDHVEVMDEEGVEVPCRDALRDLLRQTLTAILRDEGEMTGVDEFTAKAFDERGRLVMQARATFSVTDQ

SEQ ID NO: 276 - protein, 76 aa, Methylobacterium sp.
MPRYFIDTADHVAVRDDEGTVLPDRAALRDLLRRTLTALLHDEGEETGVNDFTARAYDEDGRLVMRARANFHVVDP

SEQ ID NO: 277 - protein, 283 aa, Methylobacterium sp.
VADRPILLREAEVRAFLTGRRTQLRQPLDPQPQFFDVPILEGRGVGRVGHPGELWPFRCISTAVERDFQCWARRAVPHLAVGDRLWGQEPWQVAHETLDYETGGEYDVFEWREDEYGDPRPFLGGDARFGTRAGLFYSADGQDENPSNFYPLIGIRGDVLRPAEINWMPAEDMPRWASRCTLLVTAVRVERLHDISRDDAMAEGIVQTWGDFRGHPPEWALREGEDASHFYDNRTSVENFRLFWDHVHGPDAWAANPWVAAATIALQPGNIDSPAQAAEAAHA

SEQ ID NO: 278 - protein, 423 aa, Methylobacterium sp.
MGELCVPDHSAKTHSAETNRDGPLAGVRVVDLTSVIMGPSATHILADLGADVIKIETPEGDSFRHYRPARGAGMGGNFLHLNRNKRSVRLDLKRPAARAALDRLIATADVFVHSMRPDAILRLGYGYARVRTLKSDIVYCGAYGFGADGPYAHKAAYDDLIQAGSGLAALQTAVTGQPGYLPTVLCDKIAGQAIACAILAALYERRAGGGGQAVEVPMFETMVEFNFVEHMVGYAFEPPLGPPGFNRVLSPRRKPYRTRDGHACILPYSDRNWRDFFIHTGRLEFLDDPRFAPLAVRVENIEILYALVEEEAPRRTTAEWVAFCDSVSIPCMPVLGLENLPEDAHLKAVGFFGSAEHPSEGRYRTMRRPVSFSGSRFAIRRHAPRHGEHTAEVLAEAGLDPAEIAALIDAPDKPDTAPLEAAR

SEQ ID NO: 279 - protein, 95 aa, Methylobacterium sp.
MIRRCLLLLVSALSLPLQTGVALAESEMPAGGAFMSSYTSDPYFDPRSRYSQAHSTGDIRGQPMLAEPGDAQPPCELFDTACAAAFERSRPHAYR

SEQ ID NO: 280 - protein, 112 aa, Methylobacterium sp.
MAARPRFASTAQAMRASAAIRRAVPTAGGAARLAHHLGLHAVSVAQWTFCPTQHVEAVEAASGVSRHDLRPDLYPRAGKGRDLTPDQAVAAHLAAGDHFARTGRCLSSEAHT

SEQ ID NO: 281 - protein, 358 aa, Methylobacterium sp.
VRAPAVVGLVLLLMAGPGPASAQVEPSPAAEGTGSAAARGETVVVVRATTDEAEVADLLAGFREAHPGVAVSYTKMNSATLYDGFVEEAAAGTVKADIVWSSAMDRQIKLVNDGYAAHYASPEASSLPAWAVWRNEAFGVTAEPIAVAYNRTLLPPEQVPQTRADLIRALTDHPETWKGKVAAYDPERSGVGSLILAQDADVTSRTWDLVSALGQAGVKLYTRTETMLDRIAAGEAILAYGVFGAYALERARHDPAIGLVLPTDYTLLVSRIAFIAKDAPHPAAARMFLDYMLSREGQARLAARSLTPARTDARRADDPVASAPALRPVPVGPELLANLDQIRHARMLRRWRRAMEGR

SEQ ID NO: 282 - protein, 466 aa, Methylobacterium sp.
VTRPRAPSIRRRLLVRMLLPALALALLLGFAGALVIRNVVETTHDRLLDGSVLAIAERLTVEDGEVSVDLPRVALGMLESQAQDRIYYSVTYGGALVTGYRDLPGLDVDTLPLGVTTHRDGIVRGAAVRIAAQARRVYGKPNPVLVQVAETREARQGLERRLLAGLALAELGLMGLIGALSWYSIDSSLRPLTRLSDAIDRRAVPGAINLQPLDVAGVPREALAPVLALNTLLERLEQSIAGERTFTSDASHQLRTPLAVLRMHVELLRRLTPGEPAHAAAIDDIDGAARRLERLLAQLIALARADAGAAGTDAPAAITDLNDIAARVVTEQVPHALARGGEIALDRPDGAVPVVGDPFIVGEILTNLVDNAIRYNRPEGTTVVRVRRTEIGACVDVEDEGPGIPPEVREKVFERFYRVATRDGPDGSGLGLAIVRALADRIGGAVTLGSRPGGSGLVARASFRVP

SEQ ID NO: 283 - protein, 335 aa, Methylobacterium sp.
MRRSILFLAACLLAGITPAASAGPAADGVADLGSYAARVEVHPFESLTLTDRQFLTGTSEGAKPITVAGILRVAKAGTERLPTVILMHGSGGLGGNIEFWQRALAARGISTFAIDGFTGRGLTSVNTDQSLLARTNLILDIYRALGVLAKHPRVDPARIAVMGFSRGGQAALYASLKRFDAAWNRSGVIPALYLPVYPDCSIRFRDDTAVADRPIRIFGGGGDDYNPAATCAAYAERLRAAGADVDLTVFPGAQHVFDNPAGPTQPVVARGAQTVRACAISEAADGALVAGPDATPFTYADPCVQRDPHIGSDAAARAGILARVSHALDVAFRGR

SEQ ID NO: 284 - protein, 845 aa, Methylobacterium sp.
LARELSGGGLRVVLLESGGLDRMESADALDAIVNVGRPRATQWAVRNRIVGGSSHTWGGRCAPFDTIDFEQRAWVPESGWPFQRDALDPYLERTAKYLGLAYGNHFSDARFWELFGSQPAWSEPDPRMLLPFFWQFSRDDAESYPFEYTRFGRKLDEKLGPNVTLISGATVVAIDVNGTGDRVQGVQVAAPDGAIVKLPARHVVLCAGGIENARLLLASDHQVPGGLGNRFDRVGRYLMDHLRGPVAHFDPHRSRALQRRFGRYTIEDRLFRGGLRLSPDVQRSRQLLNCAVWLGETLAPDDPGDAIRRILVGKPRAKDILTLTSNLPLLLRGCRDHFIARNGFPRKLSELSLECMVEQRPDPESRVMLSDRRDHLGSRLPLIDWRSHEDEGRTMRETARLVVSEFARLGLPVPELADWVREEAPIPLSFVDVAHPTGTTRMADDATRGVVDARGQVHGIDGLFVTGSSVFPTGGHCNPTQMIVALAIRLADLLKVREQRDTVVSDLRTSPPVPADLRVLVTGATGRIGRILVEDLQERGYAVRAVTSQPLTEAQPRTGRIEWRTFDFTADQDYAGLVHGCAAVMHLAAELGKQDRMQAINVEATRRLAEAAERDGVRAFCYMSTVSVYGSGRARTMTETAPVLTSSVDVKSEYWALDYVRAYGRTKLAGEEAIRRVASTLPYVILRPTVVVDLHNLIGLRDWSLSKRLFAAHRPSHHVYVRDVTDAAIWTMTRSLSGAWPAGEVQVFNLSDHEARDARIGDFMRRAFAISRDPRFRVIPMPAVVDWLHDFLRNRTLPLRNPLWRMRFPNDRLRQAGYRHRYGMARARAMALDILRAETRERTRA

SEQ ID NO: 285 - protein, 324 aa, Methylobacterium sp.
MPGTNRRDLVRAALAGGAVLGLGGRARATAPFGGAQAPGFYRTRVGSCEVTILNDGARSFPMPDRFVRNVPRDEALGAARAAYMPPGQVTVPFNPTLINTGAKLVLIDTGNGPVPGAPVGRLAANLAAAGIRPEDIDLVLLSHLHPDHTNGLKRADGSLAFPNAEIRAAAPDWAFWMSDANMARAADPVTQGYFANTRRVLGDLKDRIGTFAWDEEIVPGITALAAPGHTPGHTAFAVASGADRLLVQSDVTNIPAFFLQHPDWHVMYDHDADQAQATRHRFYDMAASERALVVGYHFPFPSLGHVERDGPGYRLVPIAWTGAL

SEQ ID NO: 286 - protein, 96 aa, Methylobacterium sp.
MNITMVGSGYVGLVSGACFADFGHTVVCVDSNRGRIDALNAGRMPIYEPGLEALVAENVRQDRLSFITDLEAAVGQADAVFIAVGTPSRRGDGFAD

SEQ ID NO: 287 - protein, 990 aa, Methylobacterium sp.
LGIVSTSYVGRSVERVEDAALLSGLGRYIDDLGTRPGTLHASILRSPHAHADILAIDVQAAKALPGVTAVITGRDLDAVTTGLVPALRAAVDARAIAVDRVRYVGEPVAIVVARDRYLAEDGCDLIEVQYRVRPAVVDPLAALAPDSEILHEGVGANLVSDRRFRYGDPEVAFADSPHSLSVTVRYPRNTGSPMETYGVVASYDPTDDSYDVLANFQGPFSIHAVVARALKVPGNRLRLRTPPDSGGSFGVKQGVAPYAVLIAATARLVGRPVKWIEDRLEHLSASVSATNRVTTLRAAFEADGRVTALDWDQVEDCGAYLRAPEPATLYRMHGNLTGAYAIRNVAVRNRVVLTNKTPTGLVRGFGGPQVYYPLERLMQRIAVTLGLDPFAVIRANLIPADAFPYRTATGALYDSGNYQRALDEAARDGGLVELKRRRDAARAEGRLYGIGLTAAVEPSVSNMGYITTVLTAEERTKAGPKNGAQSTATITLDPVGSVTVQVASVPQGQGHRTVLAQVVADVLGLPMEQVRVTADLDTAKDAWSIASGNYASRFAAAVAGVAHLAATRLRDRLARIAAAQLNLRPEDLLFADGRIASRLNPDAGLPFARVAATSHWSPGLVPEDLGAVIRETVFWTPPELTAPDAEDHINSSLCHGFIFDICGLEIDRVTGKIAIDRYVSMHDCGRVLHPGMVEGQVRGGFAQALGAAVYEELAYGDDGAFLSGTFADYLLPTATEVPDLRILHVESPSPFTPLGAKGVGEGNCMSTPVCLANAVADALDLEAIDLPLTPAKLAALAAGGDEPAPPAGRAAKAAAKAGDRTLRGDGAATVTAPPETVWAMLLDPDVLASVIPGSHGVRKLSDTRFRADVTLGVGPVKGRYKAEVILSDLDEPRAVTLTGTVTGGLGSGGGTGRLTLEPDGSGGTRIAYVYEAAVGGKVAAVGGRLLDGAARVIIGGFFTALARRAGGSGKRGLRLPVALRWLLARLGVSA

SEQ ID NO: 288 - protein, 69 aa, Methylobacterium sp.
MTVSDSAVPYVLGAAAVRSVEVIDGGGTLAIRLRSPDDSEFCVLLPIGVVGDLLFQLADVMSVSLDPRP

SEQ ID NO: 289 - protein, 323 aa, Methylobacterium sp.
MAIRHDDLIVIDGLIVSDFGPEVFADMRRGGVTAANCTCSVWEDFATTMRTMARWRRWFREHADLITPVHDVADIHRAKAERRTGIIHGWQNTSAIEDRIEYLELFHALGLRIVQLTYNTQNLVGSGCYESRDSGLSDFGRDVLAEMNRLGILCDLSHVGPKTSEDAIRASQRRVAYSHCLPAALKDHPRNKTDAQLRFIAERGGFVGVTMFPPFLARGAAATIEDYLDAIAYVIDLVGEENTGIGTDFTQGYGQAFFDYITHDKGDGRKLTDFGEVLNPEGIRVIGDFPNLTAAMERRGWPAARIERVMGGNWLALLGDVWA

SEQ ID NO: 290 - protein, 57 aa, Methylobacterium sp.
VLPRVTEDCRARLCRVEFDRVPGVGHLSMAEDAAPAALDRIGDRSAGVPAPGDCGEP

SEQ ID NO: 291 - protein, 309 aa, Methylobacterium sp.
MLTALLAAAPARAQAPAQAPAPAPAGPATKPESDPAQETIRKLNAYVGLLNRTLRAQDSLGRYQSWVNMKTGPTGRERIIYGLYGLYDVRGEIAKAEAATAQPPAMPDLDGAVKTYIAAYQALAPTVTEAEGYYERQDYRADKMEQGKALHAKLAVAGPAFLAARAKVDAALRVEKEKSDALELAALEAREGRKARWHVANVMTACRKVMDLLPTDAKPVVDMAAFDAALGRYAVAVKDMDGYSAANPNSFHVFESRPRALLGKLREFDDKLAKARGDARRGAGRDVTWIVNDYNMMVSTAQTATTFSR

SEQ ID NO: 292 - protein, 534 aa, Methylobacterium sp.
MFGKILIANRGEIACRVIATARRLGIGTVAVYSEADAGARHTWMADEAWPIGPAPARESYLVAERILDVARRAGAEAIHPGYGFLSENADFAGACAGAGLVFVGPPSAAIRAMGSKAEAKALMERAGVPLVPGYHGAAQDVPALKEAAARIGYPVLIKASAGGGGKGMRVVEAAAAFEAALAGAQREARASFGDDRVLIEAYLTRPRHIEIQVFADSHGNTVSLFERDCSIQRRHQKVIEEAPASGMDPVRRARMGEAAVAAARAVGYVGAGTVEFIAEGETFYFMEMNTRLQVEHPVTEMVTGLDLVEWQLRVAAGERLPLGAPDLALRGHAIEARVYAEDPARDFLPAVGTLAHLRQPEAVPGRVRVETGIVQGDRITPDYDPMIAKLVVWGEDRAAAIRQLATALAAYEVVGVTTNLSLLRAVAGHPAYRAADLDTGFIARHADDLLAPLATGAVDPALWAAAALTVLRDRRTAVAAQAQASGDPWSPWADPDAWRMNGAGYQDLQFRHGDAPPVTLRACPRPDGSARLDL

SEQ ID NO: 293 - protein, 331 aa, Methylobacterium sp.
LFARVGQPAACPWRLALITLLQFSENPSDRRAADAVRARIDWIYLLALDLTDPGFDASVLSEFRSRLVAGEAEALLFDTLLTLCRERGLLAKRGRQRTDATHVLGAFRSLNRLGCAIETLRAALNALAVVAPDWLRAYTDPSWIERYGRSIGDFHISQGETARRACAETIGDDGHRLLAAVDTKAAPGWLRNVPAMVVLRRVWLQNFHVAEPPAEGSEGDGRIRWRTEAEGIPPALAMVASPYDPDVHYAKKRATTWIGGTVHLTETCDDAQPPLIVHVATTPAPAWTGRCSTRCTRRWRRRICFRRAISSMLPISTPTASWPPREITTSP

SEQ ID NO: 294 - protein, 503 aa, Methylobacterium sp.
VSAAAPVLSEAAAAEEEPGLASGAAVTRRSFDAARWVALASVGNVVLSFGVFLVLARLIGPAEFGMVAIAAVFIDILQIVARCGLPDAVVQRADLDEDFAATAFWVMLVTGILCAVGLVALAGPIAWIFDLPALQPVLCALSACFVITAAGAIHEARLQRSFGFRKLALRALGANVLGGAAALVLALDGYGVWSLVVQRLVAAIATTLLTWAAARWIPPLRLHLASVREQVAFGSRLLCTYLLLVASIRSQEVIAAYFLSATDVGYLRLAWRCIDLVSQVAVIPLTTVGLTTYARLQDRPGELAAAFHGFTEASAFLAVPAFFGMAAVAPTLIPFLFGDQWHDAAPVLRTLALLAPEFVATSMLWMIFTALGRNGTALRLAGAQFGLGAVAAFVTAPFGLAALVAGHVVRAYLFTPAIVASAGRVVPVTNERLVRLLAPITLCAGAMAGLVLLVQGPIHAALGDRFGLFAAVGLGIAAYLGLAWIFMRGTLRTAVGLFLRRPA

SEQ ID NO: 295 - protein, 408 aa, Methylobacterium sp.
MTEVLHADALAERAPRDRAQASRSDVAARPRVLFVSHTGTMSGAELVLRDAVRPWAGSSAFLFEDGALTEALRNEGLEIRLARRRSALAGLKRDVSPLSALPVLGQLGALALEIARAARACDVVYANSQKAFLLSSLAARAVGRPLIWHLHDILDGAHFGRAQRVLQVRLANLCAARVIVPSEAAARAFVQAGGRRSLIRIVPNGLDVDPAPCPAATLRAEFGLPDGPLVGVFSRLAPWKGQDVLIEALATLPGLSCVVVGAPLFGEDAYATHLRDLATRLGLSDRVLFLGQRDDVPRLMQAVDAVVHPSVDPEPFGRTLVEAMLVGVPVIATDTGASAEILDGGAAGTLVSPRRPDRLAAALSALFADPDSFRARTALAQERAPSRYGADRMQRDLADIILQVAGRA

SEQ ID NO: 296 - protein, 389 aa, Methylobacterium sp.
MRVAIVHDWLYIVGGAERVLEQLLRIYPDADVFALFDFLPEADRARLGYTQAHTSFIQRMPFARTRHRNYLPLMPLAIEQFDLSAYDLVISSSYAVAKGVLTGPDQLHVSYIHSPMRYAWDMQHTYLRESGCDAGMKSVLARLILHRMRVWDFRTAAGPNAIVANSAFVARRIHKVYGRTAEVIHPPITLPSQRYDGPRGNHFLVASRLVPYKNVEAVIRAFALLPDLELVVAGTGPDAARLREIAGPNVSFSGFVPDAELRHLMATARAFIFAAEEDFGIIVVEATSEGTPVLALGRGGARETVQTRGPQRTGMFFDTPEPVAIAECVQRFLLQEGHFTREACWAQAELFSAELFRSRFSTFVDDQMAMHRAACETRPRILPRLEAVG

SEQ ID NO: 297 - protein, 530 aa, Methylobacterium sp.
MKRRTLLQGAGALVAGAVAAPALVRAEAARTLRFIPQQDLVTLDPVTTFAYITRNHGYMVFDTLYGMDAAYRATPQMVEGHRVEADGRRWDLILRAGLRFHDGTPVLARDCVASLRRWAKRDPFGGSLMEATDELSAPDDRTIRFRLKHPFPLLPIALGKASVPVCAMMPERLAAIDPFQQVPELIGSGPFRFKPDERVPGDRVVYTRFEDYVPRPDGPLTWTSGPKVVHFDRVEWRVIGDTSTATSALIAGEADWQEYASHDQIALLQAAKGVSTRVLDPTGFVTMLRVNHLQPPFNNPAIRRALWGGIDQTACMQGVVGAEDPGLFHVPLGFFCPGTPMASTDGLQPLTDPRDPARVRADLKAAGYGGETVLLMVPSNSAPLLALGQVAADLLQRVGMTVEVYAVEFNAMLQRRNRKGPVSEGGWSAFVTNWSGMDWLNPAGYIALRGTGESGYAGWATTPRIESLRDAWLTAPDEAARAALCRDIQLQAMQDVPYYPLGQYLQPTAYRSRLTGILDGFPTFWNVRPA

SEQ ID NO: 298 - protein, 759 aa, Methylobacterium sp.
VPPARPGAGAARWIPPAILAAGLLATGLSTALSWQAAALRDRLTFEHATEIELRTVEDQFRTYTALLRGAAGLFAADGDTVTLAQFRAYVQRIEFQRLYPGFLGIGFTPTLPASARETFAARAAALGVENARVRPPTDNPMISPVLFAEPPNPRNLAAIGFDVMSDPVRRDMVERARDTGQPAASARIQLVQEIDANKQAGFLVAMPVYAGGAVPPDLEDRRRRFLGFVFGAFRADDLFNSIVAAEAEEDAAFAIYDGAPSEANLLHRSARASAAGAGRLTREAHLELGGRTWTVAFAQRVSPRRGSALPEIWLVCGGGLFATALLAFAAYRQRRTQDEIRQLNASLEARVEERTRDLRAAADRLRQAGEERARMEEALRQSQKMEAVGQLTGGLAHDFNNLLAGISGSLELIEARIAQGRSKDVGKYIAAAQGAARRAAALTHRLLAFSRRQTLAPRAIDADRLVRGMLDLIQRTVGPSVEVRHVGADGLWVALADPSQLENALLNLCINARDAMPGGGRITIETDNRWIDRQQADAQDMPEGPYLSLCVSDTGTGMAPEVVARAFDPFFTTKPMGEGTGLGLSMIYGFAKQSGGQVRITSTVGQGTNVCIYLPRHFGEADADGPDPGRGLMAQAEAGETVLIVDDEPTVRMLVTDVLSDLGYTAIEAADGAGGLSVLQSGARIDLLVTDVGLPGGMNGRQMADAARVARPDLKVLFITGFAETALPGDGRLEPGMAVLTKPFAVEALAARIRELIAR

SEQ ID NO: 299 - protein, 363 aa, Methylobacterium sp.
VAEAAGGRDARANNFGSLRLLFAGLVILAHAPELVDGNRSRELLTQVFGTLSLGEIAVDGFFLVSGYLITASYRAKRSFGDYLARRALRIYPAFVVASLLCIAVVAPLGGGNLAAASPLETLLRLSLLLMPVVPGAFAELPYPLLNGSMWTIPCEFGCYLLLGLFGTARALRRRGRYLGLLGGLGSLLALRWLFLPVGHPGDTLGSLSEMIRLTFVFCCGGAFRLFADRIAYTRRGATRAALLLLPLMFSRPLAEPAFAILGGYLIFWFAFAVRPTALSRATAQVDPSYGLYLYAWPVQNLLVARIPGISPWTVAALALAAAIPLGLLSWYLIERPMLRFRPGPGGARPEPGAIPAAGSALGA

SEQ ID NO: 300 - protein, 497 aa, Methylobacterium sp.
MPQTPRHTETLEAQLFDLAPVSLWLQDLGALKARLDAWREAGMVDLRAWLRDPGHLRTCQSLIRIVRVNRSTLATYDARDEAELFAHIPAIFNDPRADALIEVLCQLWAGATQVRLVTQNRTVAGRVIDVSYAGQMLPGHEADWARYLISIEDITQREALRRESDSDRRTEALFQHAPVPTLIRDESELAARLAALRADGITDLAGHLAAHPGWLAEAEASRRIVDANRPALALFGVDTRAALARHLSGGLGEAPLQLFREELAELWDGAAPRSRDIAARGRDGRHLHLKMQRSPVPATGDGRRLVQIALTDIGDNKRSEARLEILSLTDPLTGLRNRLGYAAELDRLEADRTVPTSVIVADLNDLKVTNDDRGHEAGDDVLRRFGAILARHSPVTARPARIGGDEFVILLPGLDAAGAAALARRILDGIDGENRSGAAVISAALGSATWRGDGSLKAAVACADSHMYAAKRRYRDGAWDGEPPVPGTSVFSQASLR

SEQ ID NO: 301 - protein, 247 aa, Methylobacterium sp.
MGPGPTSASSATCAIGVMAKAPRSGRSKTRLCPPLNPDQAALLSAAFLRDTTANILEAARAAPIAAYAAYAPRGAEALVVPHLACGTRLVPADGGIPAPAAVEGFGLCLLQAVGGMLAEGHAAACVLSADIPTLPTRRLVQAARILLAPGDRAVLGACDDGGYYILGLKQAHARLFADIAWSTDTVAAATRAQAREIGLALVELEPWYDVDDAASLARLSADKTGYAAPATRAVLARLAETSEAVPA

SEQ ID NO: 302 - protein, 232 aa, Methylobacterium sp.
MHPVSIVIPTLNEVEAIGAVIREIPPAYAADVIVADSGSTDGTQAIARAAGARVIEAGCGYGRACALGAAAAAPASRVIVYLDGDGADRGDLIDRIAGPVLAGSQDLVLASRTLGSREPGSMLWHQVLAGRLAGLGIGLRYGVRYTDMCAFRAIDRAALRALDLRELTYGWNIEMQMQAARAGLRIREVPMPYRRRMGGSSKVAGSLAGTLRAATRIGATYLRVAAGPARGA

SEQ ID NO: 303 - protein, 195 aa, Methylobacterium sp.
VASGRRALKMEETRARLIRAARAAFAEKGYAAASMDELTEAAGLTRGALYHNFGDKKGLLQAVIAQLDAEMVAKARVARERAPTPWLGFLDEGVAYIELALEPEIQRIVLLDGPAVLGDPSRWPGQTACLRTTTETIQALVEAGTVKPVDAEAAARLINGAALNAALWVAASDDPPAVLGRATEAFRCLANGLLK

SEQ ID NO: 304 - protein, 523 aa, Methylobacterium sp.
MSLFITSTAFSIPALFGALGALATGPAAAFLGKQVFVRAQSLAAKGRMDDLVMIGLSAMAAVFGISLFALMGWCLGRFLGQAHDWWGNCLLPRRALGGADTGADAGSVCGINPYGMIVILDVAVAAILAGAVWLFGRVNVNRFSMHGVYRNRLTRGFLGSARTRRDADPFTDFDEEDSPRIADLGTEKRLLPVVNMTLNLTDLLHTEWAERKAASFTATPFACGSAILDRADRARDRPGTDGPRGAYIRTSQYAGMETPGDRVSAGRGPLLGGLLTISGAAVSPNWGYHSSRLIAFLMTLFNVRLGAWLPNPAVARRDDLKLAKPRNSVLALLSELGGRSTDVRQAIYLSDGGHFDNLGVYEMLRRRCARIVVIDAGQDERCTFFDLGNVIRKAEVDGLAKVQMGEMRILPRATIEREGKRAGALGYARGTIAYPGARDAASLIYIKPSFLDDIPAEVRAYGATSPAFPHESTANQWFSESQFESYRALGFYQVSKMFGSQLTTLSDWSVYLDSEIGRRTADS

SEQ ID NO: 305 - protein, 405 aa, Methylobacterium sp.
MSASVADIQADASPHHLPALTTGRDAWFLDTEQALAEEMDHFCGPPEPGDRAPWQARADQARLAALCLSGGGIRSATFCLGALQALASRRMLGEFHYLSTVSGGGFAGGWLQTFIRQCGGIAEAERQLGGSGNEIFAKLRRYTNYLTPEVGILSRDTWAGIVLYIRNTILNWLIIFPLLLFVPLALLAYRTALEAASGSTLWLPLVLGSAALFVATFSACTLLPSHRPRTGGVTAYASPARIAACIIAPTCVWALALPFTLRALFEQPLPLSGLSLCRLGLAYFAVQVAAYLSGLIWQTSKGHPGLWLYERNLGPWLASSLVSAGLICVCADASIGWLVGGSAAGFDAAKAEVSQVLTVAAPPALIVIHLLQSVIFIGFRKSAECADLDREWVARVDGQLLLAAM

SEQ ID NO: 306 - protein, 236 aa, Methylobacterium sp.
LKLVRGDRGRNFLLLGISLLFVAAGLGIIATGADGGVTATVFFGVCAAVAVWQLRPDLLESESRSAGSLAAQFPGPVILRASVRKLLFLALMAAGFGGVTLWMVLHEAPSTAMQLLLWPGVVLFLGGVPFLILTAIRGSALHLDETGFTVVQVGRARRVRWRDVSVFEPVSMPGSGQRLVTFDDASAGATRLGAMNRRLVGRNAGLPDSYGLDPDALASLLTAWRKRALQREDDRF

SEQ ID NO: 307 - protein, 263 aa, Methylobacterium sp.
MIEIRNLSVRYGQGTDAVGALSGIDLTIGPGEFVVALGASGCGKTTLLSAIAGFLAPTEGRILLDGEPVRGPGAERGVVFQRHALMPWLDVAENVAFGPKMRGVPRAERRRIALATLDLVGLPDCADRKVYELSGGMQQRVGLARALAGDPRALLMDEPLGALDAFTREQIQELILRIWHRTGKMAFFITHDVEEAVFLATRLVIMSPRPGRIVETLDLPFSRAFVEGRDARAVKSDPAFIAVRERVLARIRGGAGAAPEAVR

SEQ ID NO: 308 - protein, 225 aa, Methylobacterium sp.
MPRVAGQAVIADDDPFFRIALASILTGHLGFDGVHQAGSLDEALETLAEKPDVRFALFDLAMPGMESAASLSAVRECFPEVLTVVVSGSTDREDVFLALRAGVHGFVPKGTSVEALIQALGMVFNGFVYVPAFVTRVPGEGAPTAPAAWREAARDPTASLTPRQRQVLDLIVAGQSNKEIARSLALGEGTVKIHVAALLKALGVANRSAAAAWAGANLGRVRASP

SEQ ID NO: 309 - protein, 355 aa, Methylobacterium sp.
MHAITSDAVVIGVDTHKDVHVAVAINGLGARLATASFPVTCAGYREVAAWAAAHGVVHAFGIEGTGSYGAGLMRALTAMGLRVIEVGRVNRQLRRRQGKTDTVDAKSAARAVLAGEAIDEPKLGDGAVEMIRRLKIARDPALKVRTQAMVTLKTLLVNAPQALRERLIGITGKMTLIRAIAALRPGAPVSTTASAKVALRALANRWLVLDAEIKEHDAVLEQSVRAQAPALMEAPGVSTGTIAEMLVVLGDNLQRIRSEAAFAKLCGVCPVPASSGKTSRHRLNRSGNRRANAALYRVAVVRMRHHLPTREYIQRRTSKGKPPREIRRCLKRYIAREIFRHLCIGSASVPDRKTA

SEQ ID NO: 310 - protein, 61 aa, Methylobacterium sp.
LAERSGVAATTLAHFEVGKRDPYTRTLADVRRTLEAAGVIFISADEVGGPGVRRTRETTVA

SEQ ID NO: 311 - protein, 111 aa, Methylobacterium sp.
MVIGTRVLTIRSLDADISVPVRLCAPEYADGHWICRYTIGWPEHPWDSFGAGVDALQALHLTMQKIGIDLYSSAAHKAGTLKWEKPADGYGFPIPKNGRDLLIGMDKIFEG

SEQ ID NO: 312 - protein, 640 aa, Methylobacterium sp.
MAAPDGIRAVTLSSGGLAEVTLVHAVDGDGTIGLSVRPEQVDDILKSLVVRDPVGTVGALRLDGVDQADETLRTMPFTADDLSAPARLVGKLQGVPIRVQSGGRTLEGRVLGVSERNAGTETGDVSILTVLTATGTLESVPIEDGASVTIQDSAMAAKIAEAIAAAGKAKVGDAHRVEIAVSGRGQREVRLTYVVAAPVWKTSYRIVDGGGRANLQAWAIIENALGADWTGVDVTLSSGSPVALLQRLHKRYWRKRPEAPVMVEDVGMPDLDPGTVASKSVARLRAPAPAAAPLPAPMARMDTRDSRMEAAEPSYDAAAATAGAAASEGDVAANFTLPHPVDLRAGGTLSVPFLDTEIEAERVALWKPGQGVHPIAALRIRNSAGATLPAGLITLYDRKAGYLGDARLPATPVGEQRLASFALDRKVAVQAETAPSDALTKITVVDGVARATVIAREVTTYTIKGAPDAARSVIIEHPRRDGWTLTASARDSETPTAYRLKVAVPAGGTAETRAVLERVRIDAYDLVDADEALLVRWASLATDPELGGKLKILSQARAEVAAATRTVEEIGERAAKVQAEQERIRSNLGAVPKDSELARRYLSRMGAQEDELAKLDAARTQAEDGLRASQARIRSLIAAL

SEQ ID NO: 313 - protein, 178 aa, Methylobacterium sp.
MYRISAMLVLATSPALAAPAAAGDPGTRAPFIREHRCAVVERLDAIHRRGPVDVSRDRFIVVAPHGQAQRYVQCIFQDRDTRMFCEAASGAYGPPGRRRLRLDATARQALAALGYVQADPAENYARLVELGTPPDMGIVADLMLAALHDAYGARPGDILDIEAPHGGMPGRGCGAPVS

SEQ ID NO: 314 - protein, 321 aa, Methylobacterium sp.
MTGRGPARATRRRVLAGGVLATGAAASGTVRAEVHPARAGEVRHGTVRADGVDVFYREAGRPDAPVILLLHGFANSSFYFRHLMPKLADRFRLIAPDLPSFGFTHVPEDRAYVYDFASLSRTAEAFVGALGLDRYILYTFDYGAPVGWDLALAHPDRVAGIVSQNGNAYLDGLGDAAWAPLRAYWAAPNAAAVAAIRARMTLDGVRAAYVQGVPDPSRIEPEAYTLDAAILARPGNADRQVTLKLDYERNLARYPLIQAFFRARRPKLLAVWGRNDAFFIPPGAEAFRRDIPEARVTFLDTGHFALETDGDAIAEEIRRFF

SEQ ID NO: 315 - protein, 119 aa, Methylobacterium sp.
MVEPSRTEEEGKARTGASSWPDNLPPRPLVIFPRGEAALDVLSTVPEGPPRRFRWRARIHRVAHAEGPERIAAEWWRAPGADRDYYRIECEAGHRLWLYRDGPHAPDRPAAWYVHGLFA

SEQ ID NO: 316 - protein, 309 aa, Methylobacterium sp.
LRILVATDFSTRSQRAVRRAGILAQQTGADVMLMHVVNGAGSRQVARDVREAQRMTVEQAAVVPELFRVDCRSLVVPGRLPDPVLNAAAARQVDLIVVGSDHGKDAQGLGQTVRDLIRAAPCPILVVNRSVVGPYAEVTVPVDLSAASARALHSVASLGLADRARVTVVHAFDVLGKPRLSGFGIPREQIEGYVESWRSVYAEETEAFLEAEGLARRNWVRRTEEGRPDEVIASLAARTCSELLVMGTRGRTGFRRALLGSVTEAVLAAGQADVLVVPPPRPGSSSRSERSGWPLSAKAERTALQVVTA

SEQ ID NO: 317 - protein, 210 aa, Methylobacterium sp.
MHPYVSDGLHADPFDAFRVRAHRGPMGGDPRGRHGPHGHPGRGPGERRMFGRGGRGDLARFFAHGDLRLVILHLIAEKPRHGYEIIKAIEERVGGAYSPSPGTVYPTLTLLEELGHVTVTPGEGTKRLHAITPEGQAFLDGNRPTLEAILARMAEAEAARADGPPPSVVRAKEGLKLALQMRLARGPLSAEQAAAITAALEAATAAVERA

SEQ ID NO: 318 - protein, 77 aa, Methylobacterium sp.
LAERVTHLAAATLSAKRRSLDRQLGAILATPSRCDLTRDLQAKISRARDQLLVFLAYPGQVEPTNNGSERLLRPAVV

SEQ ID NO: 319 - protein, 677 aa, Methylobacterium sp.
GYGFVEPGPGSFIAGAQITGGNGGAGGAAGGPGASGGAGGNGGIGLFLYGSTGTNTGQITGGNGGLGGAANGGMAGVAGQGGAGLSGANIAITNTGTISGGFTGGSTTVRAVAINVTGGTNSLTPSTGTLNGGLGIAGGATTLRVLGNAPNNLGPVANAGTFDISGTTAGASITTLSGTGGTTLGAQTLTITNGSTSYSGAISGTGGVAVNGGTQTLTGASTYSGGTTIGSNGGAVSSTLQLGGPTSAGTGTISFGTMSGTATARLGLNVAAQPTNGGTFANTISNFGSGNEIALAGLTNSSVSYNSANSSITITGTRSGGGQVSENFVLSAPRTTSFAAVSDGQGGTIVRAATAPNPTNPTNPTNPSQPANPAPCYVTGTRIRVLRDRVISDVPVEQLAVDDLAITAAGTPRPIRWIGTRAYPGSTVPPAERPVRIRADALGEGVPARDLLVSPDHCLWLDGLFVAAGHLVNGSSITRGEMVADLTYWHVELDTHDLLLAENAPAESFLAAPGVRGGFDGVQALDVGTGRMPYAARAELGPDLAALRGRLALRAVSFDGAAEPGPVRAWLDRCVVAGDGLLHVGGWARDEAQPDTPLCLDVLVDGVVVAFAVAAEFRSDLAAAGFGDGRCGFDLGVDVRLAPHVHHSVEVRRSADGLLMCAKRMDATGAWTALLAA

SEQ ID NO: 320 - protein, 51 aa, Methylobacterium sp.
MMRRLDGFARGLGLDEAATRRIVEKIVAEMPDRSDEERLDTARQHMIIASA

SEQ ID NO: 321 - protein, 526 aa, Methylobacterium sp.
MGAIYTVELQAHTGSAVESFYVASGEFNTGPADVPAHQHFHPSLQTPANFERSLFGNGSTSGAASIGFGEIVIVNAHGRYDAWPDYAFDGRPCIVKAIPIDEQTGKAAWAYKDAPVLIRGTIDSLDITDAFTTIRLRVYDRLSDLDKPLLTQRYGGTTLAGGQGADGTADLKDTLKPAIYGFKASVSPVTVNPYDLIYQVSLRACVSIVAYDGGVQLTNAGDFGTVAALLAATLTPGKYATCLASGMFRLGGSPAFAVTADVTAAGAGTAADIARQMLLDFGLAGSDLDTASFSALAAKNPALCGVLVTGDTSVLSCVSQVLASVGGWIIPDGRGVFTVGRLELPTGHPVALFEEWQVEEKLERLAPGDSNRGIPAYRIIVRYGQLGRTLADSDVAGSVSPDRTAALALEWREATAEDGSIKGRHLLAQEMTFDTCLVNAADAQAEAQRLLSIYGTRRDIWRIQVDMTDLDYRYDQSAGDPFTLIIGLGAEVQLSAPRFLNPPKNLIVIGRVEDCNKNRIQFDLWG

SEQ ID NO: 322 - protein, 156 aa, Methylobacterium sp.
LKKLLRKAHVKPLKQVAALPFRVGADGRIEVLLITSRDTGRWIIPKGWPMTGRKAHQAAAREAYEEAGLEGQIAANPVGRYHYQKRFDHGRAFPCMVRVYPLRVEAQHERWPEQAQRTLQWFPPEEAARLVHEDELQELLTDFAARPVEIRGDGRG

SEQ ID NO: 323 - protein, 502 aa, Methylobacterium sp.
MAELREGPEATAPPAFSKRRSLAWMGFCQGGLFLAQFGTSLALARLLTPHETGIFSLAAAIAGLLSTLRSCGLSSYIVRAERVDAALLASVFTVNLMLSGAAAILILAFSVFGSVLLGDPEVQRALAILAVVPLVGALEFRPAAMIERHGNFRGVALVNMLRGLVASGAMLALALLGFSYMSQAYGQAAGAVAAALAANGLGLRYVSLRLGLAGWREILTYGGRLFAIAGVAGIAGRMGDLVLGRMLGLSALGLYSRAASLNTLMWDHLHVVITRITFVDLANQQRNGQSLRTCYLHTLRMITVLLWPAFAGAAVLAGPIVRVLLGPGWEGAALPFCLLSLAAIVLTSLSMTWEVFLIRDQTALQARFEFLRHGAGLVMFSIGCLFGLGGAGAARIGEAFLAVGLYRPHLERMTDTFRRDYAPIYLHAATLTAVAVAPAILVMSAWGWSAETPLPSLAAAIAAGIAGWVCGLWYLDHPLVAEARLLLAHMRPARPATTVSDL

SEQ ID NO: 324 - protein, 262 aa, Methylobacterium sp.
MAMVTISRRRALGAVAAGAAAGLGPAAAAEAQPAPLFPLPQATVPILGEAQVFPVRRIYCIGRNYAAHAREMGSDPSREPPFFFQKPADAVQVVAGGVADHPYPSLTQNYHHEIELVAVLKSGGRDIPAAQALDHVYGYATGLDVTRRDLQRGMGNQKKPWEIGKSFDQSAPITPILPVARVGHPARGRIRLAVNGTVRQDADLSDMIWSVAEQIAELSRAFELKAGDIVFSGTPENVGPVVRGDVLAGSIEGLPDLSIRIV

SEQ ID NO: 325 - protein, 117 aa, Methylobacterium sp.
VRRFWISTILGLELLLGGTLAASARTAGVPDFNIRAICAPEHRAGSTAIDQASYRGCLSDEAAARRTLIKRWATFDVAERRTCATESQIGGAPSYVAMLTCVQLGSDALPINPPGQP

SEQ ID NO: 326 - protein, 727 aa, Methylobacterium sp.
VRASSSRKRKILVADLLCGAGGSSTGCQRALAGLGLEMELVAVNHWPTAIATHTLNHPAARHYVQDIATVRPHLLVPEGYLDLLMASPTCTHHSVARGGKPTSDQQRSDPWHIITWLTELRVKRLIIENVWEFTSWGPVDHRTGKPVASRKGEYFNAWIDTLKRLGFKPEWRKLNAADYGDATTRSRFILMARSDGKRLAWPTPTHRRRDEMAGDLFSGSKPWRPAREIIDWSIKGRSILGRKKPLAPKTLVRILAGALKFKWPAPFLGLLRAELERSLAYHLRWTLSVRNAPRSRVDRHKRRLLARRLVSQLRQARADARAPAQSSPVADPMVVTLRRNGAGSDVGRPIPTVAACGTHIGLAQPVIVNMKGRSTASDANQPLPTQTAHAPHLFAAEPIVVSTAHGVDAGEADPHSRRSRSVDEPLGTVHAGGGNFGVAEPFVVSPRHSREGAGPGPRAVGEPLPTVTAGGSQVAVVEPLVLSRHAGGAARSVEEPTPTQVAKHSHVLISPYYGHGWQERAGGAPACLNGDEPLPTVTSKGRFGMVVPVCQSGGGAAARDVEDPVPTMTTAKGGEFGFVMPVTHHDGSDRARDPASEPLPTVTGANRGELAFIAAQFGEREGQAPRVHDIDQPSPTLCATGRVNLVQGTEGYDILFRMLEPHELAAAMGFNDEERRYEFTGTKTEQIKQIGNAVSVAKMKACVGAIMADTVPAARDFPLSMPLIAAE

SEQ ID NO: 327 - protein, 94 aa, Methylobacterium sp.
MLYMVHMQVNIPASLPDEEVARLKAEEKAYAQKLQQEGRWRHLWRIAGQYANYSVFDVAGNDELHELLSSLPLYPYMAISVTPLAQHPSAIAAN

SEQ ID NO: 328 - protein, 269 aa, Methylobacterium sp.
MSSAVTATGITGRTRVYGILADPIYHVKAPEVMGALFARHGVDGVLVPLHVAADGLAAVMDGLRQLRNFGGFIATVPHKTAMTGLCDALTREAEQIGAVNCVRREADGRMVGTMLDGIGFVEALRGSGLEPRGRSAALAGAGGAASAIAFALAEAGVARLTILNRTADRARALAERLRAAYPGLAVAAEGVQAEHDLLVNGTSLGMRPQDAAPFDLGALHAGQFVAEAIMDPETTPLLAAALTAGCRVQKGLPMLECQIALMARHMGAL

SEQ ID NO: 329 - protein, 349 aa, Methylobacterium sp.
LRKATAAFGADLVHVDAPAAPGAGRVTVAVAAAGICGSDIHAFEWTPGYGFMTAFMPVTLGHEFSGTVRAVGDGVTALAVGDRVTCWPTVPCGACAACGAARPQDCQGRRVVGLHADGAFAEQIVVPADNCRRLPDGLPLTVAALAEPLAVAVNAVDVAEVGPGHRVAVLGPGPIGLCIAFVAQQRGADVLLAGLDDAARLDLARRIGIRDTVDLAGIGLDDAVRRAFDGEADRVIEATGSARSVSDGMAVLRSGGVMVVAGIHSGSLDLDLTGFVRSKKQLRAAHDTTARAFDAALALLAAHAGTLEALITHRRPLADAGAAFELARSRQAMKVLLLPEAAASREAEQ

SEQ ID NO: 330 - protein, 197 aa, Methylobacterium sp.
LLDLRERAARFARARGGATAVEFALVALPFFALVGACLENGIVFWEQEILQQAVSDASRQIYTGTFQTTNAGTTDPATLMSRFRTAICTQPNGTPRVTIFTCANVRVSVMKVADYGSATPVSPVATNASGASDWNPNFASYACAGNSAIVIVQAAVDIPVFFPLLGAAVPNLPNKRRVLQAATVFKVEPYTAPSGCS

SEQ ID NO: 331 - protein, 67 aa, Methylobacterium sp.
MKTVVATVVVVLFCAGARADELNDMPDIACAQASSAVERDHIGCPGTDKAAAGSRAATSPLDHAEDD

SEQ ID NO: 332 - protein, 138 aa, Methylobacterium sp.
MPAAGGSPAGLRLTCTDAAGLLARIAPRIGRYATLRLALAGGEAVLFAPDTGPGRPALPWCATPLGWLAADGPLLLPFGCRLAVPAPWRAEVARRLLDRHGMSGPALLVPEGETLRLLDLAGSRALPDIDTGRLGEAA

SEQ ID NO: 333 - protein, 171 aa, Methylobacterium sp.
MLAVRLSKVALVGALAMTCTLVVYGNVTEPAVNLAFVQHVLSMDTILPDSGIADRAITDPALQRGAFAMIVAAEAVTALLLWIGVALMLARLRAPRGDFDRAKTWAIAGLSVGFLVWQAGFLGIGAEWFGMWMSKVWNGQQSAFRFAMTVLGVMIYVALPEAEDPEASGRG

SEQ ID NO: 334 - protein, 405 aa, Methylobacterium sp.
MSRTSPSAIDRAPVADRSGTGNVVRLAVAQALAGANSTVVFATGAVVGNMLAPSKVLATLPISIFVVGMAACALPTGSIARRHGRRTAFMVGTGCGVLVGLLSAWAIVAASFWLFCAAMFLGGAYAAVVFSFRFAAADCVPADRRPRALSAVMAGGVFGGVIGPQLVTHTMNLWPPYLFAATFLAQAAVAAAAALILAGVRLPRPAAGSVSGGRPLAVILAQPRFVIAVICGAVSYLLMNFVMTAAPLAMRLCGHAQEDANLGLQWHVIAMYGPSFFTGRLITRFGASRVVATGLTLTGAAALVGLAGAHVGHFWLSLILLGVGWNFGFVGASAMVLDCHRPEERTRVQSINDFIVFGMVAVGSFSSGGLLTSYGWDTVLWVSFAPLALAATALALTTGRSAKAW

SEQ ID NO: 335 - protein, 225 aa, Methylobacterium sp.
MKNRTIAGSIGTEIRRRILDGRYPAGSQLRQDGLAAEFGASRIPVREALFQLEAEGLVRILPHRGAMVAPLSPADAAEALELRAALEPRLLALSAPRLTDDDYARADALLEEYAAALRAGATARWGALNTELHLLLYGRAERPRALGLVGSLLAECDRYTRLQLSTDSAELERADREHREIVRLCRNGHASAACALLTDHIDHVAAALMAFLGAAPGPARATDIV

SEQ ID NO: 336 - protein, 953 aa, Methylobacterium sp.
VTGTVFSRSLRARLVGATLSTAAIALAALVFLVVLRSGQTLREQAQEVSTWSEAQLSDRLLSDAKLAAARLQMQREDVERRFATMSKRWDVAKAVFSGNTVAASELLRPALALADLDGAIAFDLNLRALTADRVEADLLAANAAFRTSPVAASLRAVLARNDREHADGFVMSLRWDDALARALAATESGTVADVFGEPLFDDFGEVIGGLVGYRVLRAHEPTLTAFASLSNRDVLILADQSLLSSAGSEVSNAQLGPPSGAELHDVLGAEKVARCIPQPPDIRLCVAAPLRELQQLTGKVVGIGEESSRSLLRTLSVVAGLTLCLVAVVMLFLSSRITRPLVRITQTVSEVARGNWHVSVPDIDRADEVGDIARAVVVLEHSLSERDQLRDDVFRQNTVLTERERQLQEQNERFDAALNNMSQGLCMFGVHGRLKVYNSQFCRIYGIAPGVLDLEPTQDEVHRLAGLTDWSAAESGPIRRTLTRTLADGRCIEITVEPMADGGWVETHEDVTASVTAQARIAHLATHDALTGLSNRALLADRLAAAFADHAVGGRAVTVICLDLDDFKGINDTLGHPAGDELLRQVGRRLTGLCPSGGTVARLGGDEFAMVLFEADLPDGVLALAEQILIQLRRPFFLAGQFVAVDGSLGIAVSGTEDADGDDLLRRADVALYAAKADGGRRVRVFEQEMEERQNQRRWLERELRLAIGTAQIELHYQPLFDLATNAVTSFEALARWHHPERGMISPGEFIPVAEATGLIDALGAYVLERACADAMTWPGSLRVAVNISPIQFREGNLDRFVEEVLLKTALPSHRLELEITESVILSQDQASLEMLSRLRRLGVRFSMDDFGTGYSSLSSLNTFRFDKIKLDQSFVRNLLEKDEAAAIVHVVAELGRSLKITTTAEGVETPEQLARLRASGFSEVQGYLLSKPIPAAGVAAFINAQEHIHVAA

SEQ ID NO: 337 - protein, 269 aa, Methylobacterium sp.
MALLFTSLRRVIAGGIILLALPAAARADDLAVVGTGDGIEMLQAVAAAYNAESGDARVSVPPSIGSGGAVAAVGGERQRLGRVARPLTEAEKAQGLVEVPLARIPSAIFVHQGVGVTNLTSAQTAAIFAGTVDNWSALGGPDLKIRVVRREETDSTLTVLRATMPGWRDLALTSRSKTATTTQDAIATVRETPGAIGFGPYSPALAGDLAVLTIDGRAPRDPAYPSAVTLALIYKAATRDAAASAFLAFATSDRAGQIMAERGGTPLRP

SEQ ID NO: 338 - protein, 345 aa, Methylobacterium sp.
MADRVTLVINGRRVSASAGQTLLDAGLAAGQAIPHDCATGQCDTCRVRIHAGAVDDAGTRIGETVQACRARLTTDAVIEFDEVPETVRRTGTVDRVVDLTAEIVEVTVALRKRLTYLPGQYVRVSFAGLPARDYSPTLRADGSGELNELIFQIRRQPDGAVSPLLGGRIGPGTAVKVEGPFGTAFHRLGRGRLVIVSSGVGWAPAWAVARASRMREPERDLLVVAGARHPQNLYMRPALDWLRERGATTVLTCSGGNPPPDARPGRPTLHMPMLTRDDTVLAAGAPEMVAAVQFLAAATGATCYADPFYAAARGADGKPPSDTNFLQRFLQRVAGHRTAKTEPVA

SEQ ID NO: 339 - protein, 590 aa, Methylobacterium sp.
MSEPLTLAPHPPGGAETAPSWRSAPAVQVDRHPRSDVGTIVIHWVVAIAMVASLLTGLRISADAPVARTAKFLAPLLPQGEVWTVHFVAGLTLFFGITAYLVYLVRGRLTDRNGLSRLRALRVSGRSRAARKARWGGINVALHWLIYAVTLVLTGTGVALYLGYGGWVVWLHATCALVALAYIAVHTLAHFMYGGLWQLLRLFRPAALADGAARRRRPLLAAAVIGLPVVGGLAFADVKGRSTLVIDKVTAGPDLSKLLDDPVWRTARPVSVRTIQGANFGGTGETTVEIRAVRDATNVYFAFRWWDPSRSLKRVPMIKKADGWHLLDADAARADVTAYYEDKLAVIFSRSDAFGSGGSTHLGARPLPDAPAPLNGRGYHYTTDGSYIDMWQWKAARGGMLGVVEDMHIGPPTDPTAAERAVKGRYQAGYWGDPGTSAYRYNFKFEGPGGYAGAVEPLRLPKDWQATVAKLGTVDLDFDASTSPGSAWWMVEKTETVPYSAAADAEIPVGTVMPGVLMTDGYTGDRAGISAAADWADDHWTLVAARKIATGSKYDVDFLPGNTFYLYVSAFDHTQTRHTRHMRPVEVLLR

SEQ ID NO: 340 - protein, 750 aa, Methylobacterium sp.
MSGLEIDFETRSPVNLKVEGVYRYMEHPETAPLMASYTIDGGPVRRWRPPEPCPADIVAHVEKGGTIVAHNAGFERLLWQMILSKRYGWPAVRLRQFRCTAATAAALSLPRDLDGLGVVLNLSVQKDKMGKTLIDRFSKPRKVTKADVERYQGRPMPALFHEPGDFPEEFERFHDYCDVDVLTEQAADRRMMPLRTECQEAYWRSEQINDRGLRIDVESAKAALLLVDRAKLRLDREMRHLTEGEVEACSQVAKLKDWCAVRLGQGPAMQAALEFFDGVLPEGEGEEIASLGKADMDDLLEREDLPPAVRKALELRRDYAKASTAKIKAFLSRAGQDGRIRGAFLFRAAGTGRYSSTGAQVHNLPRPRKVFDDAHLDPRDLFEAIRKANVEWLEMLYGEELGKPLPLLSDSIRGFIWADPGKELLAADYSGIEGAIQAWFAGEEWKVKALFDLIADPSLPDMYRRAAAGIFNTTTDLLTKKDKRRQVGKVSELSLGYQGGVGAFRSMARNYAMKLGPIFGPAWEAADPERRERAAKRYEECCERGELLTKQLTREEWMGAELVKIGWRATHPAIVAAWKALEEGTREAVSSPGTQVQVLKVSLLVARGFLWCKLPSGRCLAYGAPSIREVEVPWADKALTPELREKRPVVTCLGVDSQTRKLVRYALYGGLTFENIVQAIALDLLDNGIEIAERAGYPVVGHVHDEIITEVPRGWGDLAWFEKAICELPGWACGLPLTAGGWRGKRYRKD

SEQ ID NO: 341 - protein, 80 aa, Methylobacterium sp.
MPGLAEDDWLIYYDQRVRGLPDEWIGQLCVVWISEDEVYVKKVFRGRDSGPYLLVSTGGLPPIEVEEINWSAKVAWIKPR

SEQ ID NO: 342 - protein, 261 aa, Methylobacterium sp.
VSSMNFVTGKTTSVRAAEPGRKRARKAVKGASQGASQEASHAAGGDDDLPDLTLTDRAYQQLEEMITTLVLPPGLVLGEQNLVQRLGIGRTPIREALQRLARDGLVVVMPRRGILVSDINVRSQLRLLETRRVLERLIARLAAERSTREEREVFAGLAQDMRDAAAASDDLAFMRLDRQFNELIATASRNEFAVRSLESMAGLSRRFWYQHYKQAADLPLTANLHADVCEAVARRDVEAAGAASDKLVDYIESFARKTLDL

SEQ ID NO: 343 - protein, 185 aa, Methylobacterium sp.
AEPVAALLRDWTAANGLCRGGSGDDPRTQAACERRDGLDRRLAAAGWCYGRPADTGAQRTWQPCGVGTRQPAQAGTETPQGAARRALLDVARGPAEAGRGQPVQFVVHALNRVGPWAFLFARMQRPDGRPLPRAADDLDSNDYAALLRQDGNGWRVVDFVVGPTDVAWEGWDRRYGAPASVFAVR

SEQ ID NO: 344 - protein, 430 aa, Methylobacterium sp.
MKRLDVAVIGGSIAGLTTACLLARSGHAVTVFERSAAALTGRGAGIVTHPGLRAVLARCGAPAGAGDLGVTVEGRRVLDRDGTVIAQRSLPQVLASWGRLYGLLLDAAPPDSVRYGAALAAVEPDDARVVAFFEDGRRISADLLVGADGQFSTVRSRFLSGVAPRYAGYVAWRAVVDAAALAPATREAIGGHFAFCLPPGEQILGYPVPGRADGAAAGRCFNAVWYRPTEEAALAALLTDTGGVRHALSIPPGRIKAAVLDSMRTDAARILAPPFAEVMLRAEQPFLQAILDIETPTMIPARGVALIGDAAFVARPHVGMGATKAMEDAAALADALDAAGGDVDAALTAFEARRRAYGAAVVARGRDLGAYLQAQQRGAAERTAAERFRSPEAVMAGTAVPLRPRGGSPPRARRPGARGAGSRCPGTRRW

SEQ ID NO: 345 - protein, 107 aa, Methylobacterium sp.
MPKRLTITVPHNLGAAEVRRRIDRHMDWAFRRLEKEKIQVEAEDWFGNRRAFSGTGYGQKASVAIQVAEDALEVEALVPWMVGMFAPVIEAIGRHYAGRLLSDEGAS

SEQ ID NO: 346 - protein, 106 aa, Methylobacterium sp.
MPKRLAITVPHDLGTAEVRRRIDLHMDWAFRRLEAEKIRVEAEDWLGNRRSFSGSGYGQSARVAIQVADDALEVEALVPWMASLFAPVIEAIGRHYVGRLLSDEAA

SEQ ID NO: 347 - protein, 448 aa, Methylobacterium sp.
VDGSIAAVTRRLDSLPMTRLHAAALAVCTLGLFTDIAEVALSNALAAIFLAPPHNMPRGSLSLLLASVFAGGAVGAPVFGMLGDRLGRRRALQASLALMAAGSLAAAASQGLTALTIARTVSGFAIGGVPPLVATYLAEVTPARRRGATLLVCAGIGLLGGLAAIGLVQMMAPAAPLGIEPWRWALILGGALAALGGLLFARLPESPRWLASVGRSAEADAACRRFERAAGRMRVAAPGGPHPAPATTGPAGFRGLFAETRQLRRTALFVGLYTLAPLATIAFPLLSAVVMVEKGFKVEQSLVFAALSMLGPPLGTLLTALVIDRLERRAFLTALAAAMAALGTAFAASGTFLTLVLVGIAFNTAAATYGSILAVYATELLPTPLRASAMTCAWAGGRVAAALAPIILLPILSAYGPHAMFAVITLVLAASAALLLAGPRGLSGRAVA

SEQ ID NO: 348 - protein, 135 aa, Methylobacterium sp.
MVAAPGPILAGALVVAGLGFASAAEAQMPTRVGTCAATTIALIGTRFSDTLVKPKGDGIGDGTSVDLKNGVYGVSYAYVEAVARSRVGDRVMTCLVLLPTGCPKGDDRGKMYTTTNLRTLDSWTLPDSQHMCGGA

SEQ ID NO: 349 - protein, 426 aa, Methylobacterium sp.
MHDLSDPVTLPAGTVLFEEGAIGHCAYLILSGRIAIFRRRDGGEAVLARRGAGEIFGEMAILDALPRSAGARAEADSVLVPVDAAQIRRRLAGADPILRLCLEGLIARFRETLPRLGPAVAEGLPAPPSPAARADFDATVASLAQERALRRALARDEFALFLQPIVRLATGRLAGFEALIRWHDPERGLVPPAAFIPAAEANGLILAITAWVIDAIGRIVPRILQAGLRAPASVEPSLFVSFNVTAQDLARADIPGLVDAMLRRTGLAPGALKIEITESALMQDPAGAAAALARCRAAGLGIAVDDFGTGYSSLSHLSTLPITTLKVDRAFVRAMLAEPRDRRIVQTILRLAEEIGVVAVAEGIEGRAEAEALAAMGCALGQGYHFGRPMPEADALAAAAAWNAEAWRVGLSGEADPGRHGFHARA

SEQ ID NO: 350 - protein, 63 aa, Methylobacterium sp.
MSDDDGFDRMVEATILAHQLVAAHGTATMQLLSRLLLMEIGTEIAARRDPDPAANDNPDALED

SEQ ID NO: 351 - protein, 427 aa, Methylobacterium sp.
MSVRETLEARLARIAAGDPAVFTRLYPEQARAAADAADARRRVGISLGPLDGAMVSIKDLFDVAGETTRAGSVLLADAAPARTDAPVVARLRRAGAVILGKTNMSEFAFSGLGLNPHYGTPGNAADPARIPGGSSSGAGVSVGQGTSDIAIGSDTGGSVRIPASLNGVVGFKPTASRVPLEGAFPLSYALDSLGPLARTVADCAAADAVLAGEEPAPMEALAVAGLRIGVPRGLLFTETEAPVAEAFERALSRLSRAGARIADHPIDDHLAAMDAALPDGSLAAIEAAAIHADWLDSAADRYDPRVHRRIVAGRNATAAGYIRTMRRRAALIAAFDRHLAPLDVLALPATATTAPLTAPLAADDAAFLAANRLMLRNTAFGNFFDLTGLSLPMPDLPRPAGLMLLARHGQDRRLLAIGAGIEAALAG

SEQ ID NO: 352 - protein, 96 aa, Methylobacterium sp.
MSRSRVPEAQSRPDGTGVIPSHDTAILGSGAVGAGAIGASALGALALGAAALGVVAVGAFAIGRLSVGRARVGTLEVGSLEIDTLTVRSVRMPDRG

SEQ ID NO: 353 - protein, 149 aa, Methylobacterium sp.
LSKWYLYGIALVAGVANAIEPGQNATLAKVTGQPMLAGLFCFGLAIACFLAAMVVAQLRGRTRAEAATPVPWWAWPGGILGAAVVLAQLYISEKVGAAPFLGCVITAGVVGSIILDHHGLVGFARHRAGRWRILGGALMVAGVALVAVF

SEQ ID NO: 354 - protein, 76 aa, Methylobacterium sp.
MTRTLTIAALAALLAVPAVQAQARPRHTPAKAQPSAAIKARQTVLNDFNARMSRLDALMGAPSTSSVRARSAEAGR

SEQ ID NO: 355 - protein, 38 aa, Methylobacterium sp.
METTMTWTNRIALAATLIAGAVALVTYAQALSLPAHFA

SEQ ID NO: 356 - protein, 261 aa, Methylobacterium sp.
MQAMFADGQVAVTLSGEGPPLVLLHSLLADRTSFDRVTPALGRDFRLLLPDLPGFGASAPAPGGLEAVADRVGAALRAAAGGRPAAGLGNGYGGFVLLLCALRHPDLFDRLVFADCGACFPEPGRAAFRGMAGAAAEKGLAALADTAMRRLFAPAFQAAHPDLMAERRAAFLRTDVDVFRAACAALAGLDLRARLSEIRAPALVLVGEEDEATPPAMARELAAGLPDARFVTLPDCAHVPQLQAPELFAREVLAFLRPGSA

SEQ ID NO: 357 - protein, 105 aa, Methylobacterium sp.
VRLPARLAAALRPPARAGVQHLPRRVWPGEEAAWRDENGVRHPRAVRRALAALAALEPRGRYGARIEGRGKVVTGPASALVLRDAEAEIGFVLGLTPDGYGAEPF

SEQ ID NO: 358 - protein, 287 aa, Methylobacterium sp.
MKPAPFAYLRATSVDDALEALRQHGPEARIIAGGQSLMPMLNMRLTKPAVLVDVMRIPALKEPRLDKGALVIPAGVRQAILLDRPGLARDLPLLAAALPWVGHIQTRARGTLCGSVAHADPSAEIPLCLVALQGEVHLRNRRKVRRVAAETFFAGMMATDRADDEMIEAIAYPLRREGTGTAFAEIGRRHGDYAIVACAAVVDGTRMRLAVGGVADRPTARDFPHLDGSALDDALNAFAWDLGAGDDLHATARYRRDLVRSLGRRVLEQAAKVARGDTHQEAVPCHS

SEQ ID NO: 359 - protein, 221 aa, Methylobacterium sp.
VQHFGVTVQNMDRAFAFYTEVLGGTEVMRDGDFKGEPVHFTLMADQEIVARERRVDPRTIGVPDLKGGSQRLDVRFVQFENVVIELLQYRDATQPMGGGDSWAEPRDHMSPAYPRSMHICFYVRDDVNFDKFIADLEAECARRGMTQVRANRTVPVHSEEQRRAAPRDTNSIKIHEGPSNGWSIIYCKGPEGEQLEFVQVLGPVKKTFADAAEARRATNRG

SEQ ID NO: 360 - protein, 171 aa, Methylobacterium sp.
MAYHPVPVTHVGLTVTDIRAATEWYTKAFSCRHIIGPLHIRHDGSHIGEVFKGIFGDRFEEGYVSHLATANGVGIELFEFVTPKSEAVDDNFRYWKTGVFHFCLVDPDVEGLARRIAEMGGKQRSKVWTLFEGEPFKAVYCEDPWGNLIEIYSHSTELMYANRSTTAARAE

SEQ ID NO: 361 - protein, 100 aa, Methylobacterium sp.
MRGTQSSTGAPKAPLADPRRGCDLPRFFLNVRRHGTLIADREGDELPDRTAAEHLARDILREMRRLPHVYGAPRGWRADTFVITDEAGAVVAEVPYASVL

SEQ ID NO: 362 - protein, 262 aa, Methylobacterium sp.
MSGTLLETVDERGVATLTLNRPEQHNAFDDGLIAALTASLHRLGAAPGIRAVVLAGAGQSFSAGADLAWMRRIAGQSFDSNLADAAGLAGLMHSLDRLPKPTLALVHGAAYGGGVGLAACCDIAIAAESARFCLSEVRLGLIPATIGPYVVNAIGPRWARRLFQTAEVFSAERARAIGLVHEVVPDDRLEAAGAEVLRDILRGAPGAQAEAKDLVFLCEGRPVDADLGRETGRRIARRRASDEGQAGIAAFLDKRLAPWRRD

SEQ ID NO: 363 - protein, 119 aa, Methylobacterium sp.
MPVTEGLTHLTFSIIRLAMFAPRSICSPCGRSGRMARRGVFVRAEEVAFLEEARRWWQRCVLVLTRAKPQGPLYNATSKVIDAIDDVAEVVTGDRRTFYQRDATTPGENLPPMKWRTVE

SEQ ID NO: 364 - protein, 78 aa, Methylobacterium sp.
VRAEEAAFLEEIRRWRQQCVLVLTRAKPQGPLYNATSKVIEAIDDVAEVVTGDRRAFYQRDATTPGAALPPVKWRTVE

SEQ ID NO: 365 - protein, 71 aa, Methylobacterium sp.
MVSEPVGPEGYKRRVRYEKPHASIYAHPKVFKALREIAAATDCKPHDLYIEGLRMVLRQHGRDFDALNRGE

SEQ ID NO: 366 - protein, 452 aa, Methylobacterium sp.
MTRLLASPVRRLAALGLALLVVNVGALAIHVPGADTVGSVTRANVFVGVVVVGLGLYLLAVGLVLRERLPRAALWTILGVAVLMRAALLPAPPFLSSDIYRYVWDGQVQAAGINPYRYIPADPALEQLRDPAVYPLINRKDYARTIYPPAAQMVFAAVGQVSHGVTAMKLAMLGFEALGVLAMLAILRGAGLPSARILIYAWNPLALWSFACDGHVDAVAIGLLGLALLARTRRGYGLAGALLGAATLVKLLPVAVAPAFVRGGRLWRPMLFGAAVIAVLYLPYLGAGTNVLGFAGGYGAEEGYETGTGYWLLAGLGHLGLSTQGLLRTYLVCAGLTLAALALRIAFGRDRAPARDAVALCRDAGLLAALITCAASPHYAWYYPWLALPAVVAPAPALIWLGAAPILFLIDPFNDRFLWPALVFVPALVLAARALWQARTAPLAALPEGTAR

SEQ ID NO: 367 - protein, 92 aa, Methylobacterium sp.
MIGAGYVGLVSGACLADFGHTVVCIDRDPDKIASLNAGRMPIYEPGLDVLVAENVRQGRLAFRATMRDAVAEADAVFIAVGTPSRRGDGFAD

SEQ ID NO: 368 - protein, 393 aa, Methylobacterium sp.
MTAAQPLSTDPFLPGPRVRVAGSATGPLAGLTFAVKDLIDVADTPTGGGNPDWPRIYPTPARHAGVVQTLLDAGASVVGKTVTDEVSMGILGENAHDGTPLNPAAPDRVPGGSSSGSASAVAAGTCDFALGTDTGGSVRVPASFCGLYGIRPTHGRIDFSGICVQAPSSDTCGWFARDAATFARVGEVLFGQAMPDRPPHTLLVAADALGFADAAVQEALAPQIDRLAALIGNRRDVTMAPQGLSVWQRAQRVLQSSEAWQTFEPWLDACNPRMAFSVARSLIQGSMMMDAERSAAGLMRIEARARLAQLLLPGTILCLPTTPFPAPLRGLPLGALHPLRERIACLTSHGGLTGVPQVNLPGAQVDGAPIGLSILGARGADLDLIRIAVALEA

SEQ ID NO: 369 - protein, 86 aa, Methylobacterium sp.
MTRLPIIVLATLALGGSAVAAEQGASSKTPGHEMQDRGSRAGSPGASGYAPGHEMKSGGTDSSGSTSRSGGSTTGTTGTSSTGTRR

SEQ ID NO: 370 - protein, 317 aa, Methylobacterium sp.
MLDTDDLRFFVAVAASPSLAAAARSLNVSPPAVTQRLRSLEKRLRVHLVDRSGRGLTLTDEGELLAERGRDLLGAFDDLADALAERVGAVTGHLRVVAPLGFGRRYVAPVVTAFRLRHPGVRIDLLLSDRLGRIPSETWDLAIHVGEIREATPSLTVRALAPNDRILCAAPAYLARQPAPRVPADLRDHTCIALRENDEDVTLWRFRAADGAEVRVRVDAGLVSNDGDVVRGWALAGLGVIVRSEWDVADDLRAGRLARLLEGYALPSAPVVALLGSERRSRAARTERFLEALRRSFDPLPWRPPAGPGAATGDAAP

SEQ ID NO: 371 - protein, 206 aa, Methylobacterium sp.
MIDLYAWNTPNGRKISVALEEMALPYRVIPVDITQGAQHAPDFLAISPNNRIPAIVDPDGPDGSPIPVFESGAILLYLAEKTGRFLPEDRRQRVAVLEWLMWQMGGFGPMPGQVHHFLTVAEPDRAYGLARYSKETHRLYGVLDRRLAQVAYVAGPLSVADFAILGWAWRHERHQVDLADYPQVRRWYDRMMERPAVQRGFAVPLS

SEQ ID NO: 372 - protein, 286 aa, Methylobacterium sp.
VGQSNLALIYENYSDRATLSGGSWQPGSLRLTNLQTPYIAEKARTTSTDPAATQFTVDFGQPYIIGGVCFGPSNVRPDALCRYRMYDSVGLLYDSSIIPFPGTTVDSASLDWEDNGFWEGVSTEFDDLYKGVYFIDFPTLPVSCERITFEIFDANNPAGYIEIGRLYCGKVWQPQYNYDYEGHSLDFQDKTDMQESVNGTRFFNPRPLRRSFSFSFSYLPEADTFRDVYRIATRAGTYRQVVVVPNPGDVSTFVREAFLGTLGALPSLRRPAFGYAATAFKIEETL

SEQ ID NO: 373 - protein, 80 aa, Methylobacterium sp.
VREAIEAAGARLLYLPSYSPDFNPIEQAFAKLKALLRSVAARTIPDLWPAIRQAFTRFTPQECRNYLAAAGYEDDLAVAT

SEQ ID NO: 374 - protein, 124 aa, Methylobacterium sp.
MDDLLREFLTESGEHLDTVDAELVRFEQDPNNETILRNIFRLVHTIKGTCGFLGLPRLEALAHAAETLMGRFRDGLPATSDSVTLILLTLDRLKAILADLEATGTEPAGSDDDLISALERMAEG

SEQ ID NO: 375 - protein, 381 aa, Methylobacterium sp.
VGEVYAESTPVPDTGATYINTTITILRGFNLIYDADSGFAGYQRIAPESADLIAQPMIALQGSLSLASQFTTGLPVFLMSTTALNPLDVASLGGDVSGPGGLIKVGLGTLELAGTNTYAGGTTILGGTLAVSRDANLGAAGTGLTLGGGTLEVLADGFATARPITLAGPGTLQIDVGTATFAGPIADGSQPGVLIKSGSGTAVLSAANTFTGGAVISAGTLALTATGSLIAPVLVGAGASFLNAGLVAGSVGNFGVLANSGTINGAVANAGMAVNAGTIAGGTTNSGSLVNTGTLAGGLTNTGTALNTGTIGGGVISSGILSNSGAIGGGVANTGLLATSGTISGGLTNAGTVLASAGRIDGPIANNAGLLAVSGSVAGTG

SEQ ID NO: 376 - protein, 433 aa, Methylobacterium sp.
MKVLLCSTPATGHLNPLLAIAHMLIADGHEVMVLSGSAFRDRIVAAGARFMALPGAADFDGRDLRAVVPELAEIAPGPDWLRVAMERVFVDRIPDQARGLRAALRAFPASLVIGDDMFFGALPLLLGPRAERPAIVLCGTSILHCARPDRAPAFLGLPPAETPEQAAAYGRIAEAYEAAVDRPVGLSLAAKLAELGRAAPPWPLFDAVVRLADTYLQLTVPSFEYPFPLPPTVRFIGALPIVPGQAALPPWAGDLDGARKVVLVTQGTVANHDFGLLVGPALRALADEPDILTVVTGGGRGLDAIPGPIPANARLSPYLPFEWLLPRIDAMVTNGGYGSVNQALSYGIPLVAAGLTEDKADVNARIAWSGAGIDLAANDPTPEAIRKAVRTVLDAPGHRREARRLAAEFAAYDAKAEILRLLSSHGGRARSAA

SEQ ID NO: 377 - protein, 379 aa, Methylobacterium sp.
MQDLEAYSVLVGSIYDRVGQPEEWSALLEDLTDFVGGRVGQLAVFSLDGNRKPLWAVSGFERSRYREFLYRHATEDPRLPYILSNQGKVIRAEEGVDAVQFRESALFKEVVQPFEIEHSLVTYFAKEADVMATLAAMRGEEGGPFRSDEVRRLAMLVPHLRRAFELYALMRQASERTSDLASALDLLDAAVILTDSDLRVAHANRAAEALARSRTGLSFVKGSLVLKDSQTGRRIARAAGEALAAASGDVAITQADHITVTCGESGMPYRVSLHPLSKRPAGTGSKVRAELAIVIRTGTPKVQGSNAARLQKLFGLTVAESILANAVASGRSLDDHAQDRGIAISTARTQLRALFAKTETHRQGELVARLREGLDVSLN

SEQ ID NO: 378 - protein, 475 aa, Methylobacterium sp.
MLPVLVARKGARIGMLLAVLAVPVAGEAGWKGPEAQPLFVNEANPAGYNYAPSVITENGTTDIWWCGQGKTDVIFHRSYTPQTGFSPARIVFQPTPNSWNRQYVCDPSVIRGRFVNPADGQTYAYAMYYSGADNLPGNNNQTGLAFSNDKVTWVDYPEPVIKPINPVVARGNYGTGQPAIFSDGRSGLFVFTTDLTGPQGVPGFGDLYVRHTADGVHFGAPARVPNATTDGSTINPNSDFAYDPKTGEVYVITGLPGRACQQVACKDPGRNPDRETYQMGLFRMPLKAVLSGSPAAWTSLGYLNSDVTGFYLNHSPGFQRDGAGYLTPFLPDITVFFSGGDPYPGTWRIAEARRPKGTDRLPLRRAFGPGGHWVTTGYIGPGYTIERSLGTVLTLPAPGTAMLMSCAAGQDHFLSRDPRCEGQTPLGQTGYVYEAHRPGSHPIYRCIAGGRDHFVSTAPDCEGHASEGMLGYALD

SEQ ID NO: 379 - protein, 98 aa, Methylobacterium sp.
MKFGVLILAGACGVLVGIVIGYVAGARLSQAFAQLPVTDRSPAAQALRIVDRIATEHGLARDTLLRAMLDQQGGGTGTARPGEEPGRVPGTAPGEPAR

SEQ ID NO: 380 - protein, 71 aa, Methylobacterium sp.
MTAALAAPVTQVCAFMLGCALIHAARAHADLITRLLAVTAVGVAVLVLLVASLDYAPEGGTFDEVTVYAAS

SEQ ID NO: 381 - protein, 65 aa, Methylobacterium sp.
VESITPRPANWEIAGGGIRLVFPVQAGQSHALIRFTGSPAFRGGVNLTARLDAGEMLSWSQYAVP

SEQ ID NO: 382 - protein, 152 aa, Methylobacterium sp.
SDDLDELLTLVWKKPAFFVAHPRAIAAFGREATRRGVPPVVVHLFGAPFITWRGMPLVPSDKLPIDLDPVTGAETTSILLLRVGEGEQGVVGLQKSGVTGEIEPGLSVRYMGTNDHSIASHLVTRYFSAAVLVEDAIARLDNVLLGNYHDYA

SEQ ID NO: 383 - protein, 142 aa, Methylobacterium sp.
MALRSTSIRIASLLLAACWAAPSLAEPAAVARPKMLVYGNYCGLGNNAPLPPIDVLDAACARHDDCTPDTDLPTKACNLRLEREAMVIANDPHQPDGLRTMAGFVAAFAEANPSQVIPDLVPVVVTVNAPARAPRTAYTRLR

SEQ ID NO: 384 - protein, 127 aa, Methylobacterium sp.
MLTRTVIGLVAPVCLAAAWATPSLAQPAANGGPKFLIHGNYCGPGNNAPLPPIDALDAACARHDACTPDIGLPTKACNLRLEREAAAVARDPRQPDNVRSLAGFVASFAASNASSPAPTVLPARLAR

SEQ ID NO: 385 - protein, 510 aa, Methylobacterium sp.
MSTYHLSQSEFEQQLQSVDPSIQQRVEAALSAAGVDIAKDGVTLETGPQGNVSVGSSVNLFEAVAAGKYTITAGDKSIIATGTNKVTVDLAGSGQNTVIVGSGGANVTTNGGDTVIGGSGSSEFVAKGGGNVLYGGSAQDTLAAVDGNNTLYAGSGRNNLNGGAGNDSLYGGGQSALYGGRGDQQLVGGANGSARDTLVGGNGSDVLFVQHGNNTLIGNSGDTLYGGTGNDSLSAVGGNNTLYAGSGLNTVQGGAGTDSLYGGGQSSLVGGTGNQQLVGGANNSAHDTLSSGAGNDILYVQHGTNQLIGNGGDTLYGGTGNDTLSATGGNNTLYAGSGLNLVQGGSGRDSLYGGGQSSLVGGTGNQQLVGGANSSAHDTLVSGAGRDVLFVQNGSNQLFGNGGDTLYGGIGNDTLATTGGDNYLYGGGKTAFELSNTGGNDTIVGSSTDSLRIDNAGLGTASYNYNQVDNSTTITFSGNSAMSVTVSGLTQVTYSDGSSHSLGQQVPPHP

SEQ ID NO: 386 - protein, 47 aa, Methylobacterium sp.
LFNTILALLAVLAVMTAHALYKLVRLPFRLVRGLFRHKAPRAQLTAR

SEQ ID NO: 387 - protein, 47 aa, Methylobacterium sp.
LLNTILALVAVLAVMAAHALYRLVRLPFRLVRGLFRHKAPRAQLTAR

SEQ ID NO: 388 - protein, 499 aa, Methylobacterium sp.
MRLAVLQFTHETVTFLPNDTTRDDFTYPGSPASGAALLATDPKGYMGGFVQVAREYDGVELVGITSPLWPRTGTASGWITADAYAHFLGQMVAELRALGPFEGVYLALHGAMAVRGVPRPEADIARQVRAAVGEGAILVGTFDLHGNEDAAFLDHADMAFAVKYFPHYDGHLQGQRAARMLVRAVRGDFRPAHRTLKVPILSPTVVQWTGAAPWSDLVQRALVWEAREPDVYVNVFFGFPWGDAPDGGMTVQAITNADPALAERVARDVADLAWRQRRALLETTRIHTIADGVRRARAAVAEGAAPVVLADHSDRSGRATWLLGEILRQRLARTLVATVASPDIAAGSLADGDPFDAPVGGGGDPSAGEPVRITGTVLRVVAAPEPGVAGSGGGGTWICVAFGVGNVLVLSPQLAQIVEPDELWRLGLDPADFDVVAIKSRVHFRRGFDDSGYARTILLVEPPEPFLGTVRLDHLAYAQMRAADFFPYGDPPGPVPSDP

SEQ ID NO: 389 - protein, 96 aa, Methylobacterium sp.
VTFTWRRTFPGTHHDFVAEEAGQHVGRIKRMDGGPQNGTWTWSCTGCQRGHEAEGVRPLNGMADTRDEAIEALAAAWARAKAWSARSWQPLVPGGS

SEQ ID NO: 390 - protein, 51 aa, Methylobacterium sp.
MEWVYRGFETSMLGLALCLGLGACLTLGTARVPAGTLSVTLPMLTVTAPAP

SEQ ID NO: 391 - protein, 844 aa, Methylobacterium sp.
VADEILRMQAEVQDRYSGPLKALRAQLLDTARTGADHSATLAKGFKAVEGTMQSTARTASSVLNPAFAGLGITGLTAGAAVTGISNALNKLTGSMLSVGQLSRETGVAAKTLQEFSSVAGRFGVEQDAVASATKNFAAQMRTFSIGTGEAFRWVMQQGRDASGRKAFQDFATDLQRTSDEGEKLKKALSFMETIKNPVERGIFAQQFFGNQDLGRIADGHLGRVVDLFKKAREKLGEFRPEDIIDAEKFDRSVSSLKGSMQRLGTTIAREVLGPATELTTWADDLVSGKRADVTKSLREGLQELKKELGEINWKQFGDDSLTVLRESTALAGKTAAAFHAIAEAIHAIREGNYAGAARGLDGASGPLARRLAPRVGDDEIAAKEQVESWKKALAEAEYDQETGGPAIDFKSREPLLRKRLKESEDVLSGLQGRTPEQRQKDFEATEKLRKALDANTEELKASRNGATVQKQSMDTQGGLFGGATVQTAGFGSGFRRFGGYGGGSGPGYAGEQGPAGGGAGRSLGGGGRFNGLGSSRPSVAPIGPRPTVPQLGGPAETDEQVTVHGHKWNPGASTSAGKARVQSWLQFFQAPVDQGGLGADAGTARAMVAMMQGESGANLKPDAEGDYKDPVNRRNPTAFGTAQWRLERFQALKDMAGRMGTQWTDVGAQQQHFRNEVLNGRYRGVWRDILNAPTEEQKLRLGIGGFERPKYPGLAYDFRLPNLRRLQRGAAATGGATAERADGSSAALMRPERADGAGWAAREAARKTFEAQQAEAAGLRASGARVASAAAQAGVVAMPKVEVNGSVTNVVERPGPDTRIRTTASGKLFQDVVQRSGAQMRRAD

SEQ ID NO: 392 - protein, 676 aa, Methylobacterium sp.
MSQDEALRMAAVVTDGFTGPLGKLRDTLRTIGREGGQHNDALAKGFKGVETAMHGVGRTASTVVSPALSTIGVTSLSVTAAVLGVGAAMRSFVSAGASLGQMSRETGVAANEIRILSSVAGKFGVESSSVEGAVKNFAKAMREMHAGSRETMNYLMTQGRTAEGRKFFQDLARDIDSTSDQGEKMKKVIEAMEAIPDPVERGMFAQKFFGNEDFGRLGDKHLGKIQEIWKKTAQNLGPLDPKAVESAESFERSMKSLQTTMSKIGTTIASELVGPAEQFSTFLSEAVSEQRGGAIKAIREGIQGIGTELGRTDWQTAGKDAKAFLSETTALATTLAGALARIAETIHSLREGKIADAFRSADGGSGPLARKLAPRVGDDQIEAQESVDRLRKLLDVSKEAQQHVIGRAQIGAGLLDAPEKVQRDLEAAEARLKVLQSRTPEQRQKDFEASERLRRSVDSLTEEMKAARGSGNATVQQQSFDGAGAGFGGARIQTASLGGAAAAARVGNILGGRGGGIYAPGGGEGAVSPPLDPNDPVVRRRFDAFRENRGGGRSFGEPATPAERVGERLRGEGASGAGDPGMLDLIARAEGTTRRGYDDSFAHQVSGSLTDKTLGEIEQIQRGMRGSSAIGRYQFMRKTLFGGRRGDTGLVGELGLSRDDKFTPELLILPRHRGHL

SEQ ID NO: 393 - protein, 575 aa, Methylobacterium sp.
MSEMSERANMTGAHALAVALHRHGVRDVFGQSIPSALFLAAPHHGIRQIGYRTENAGAAMADAYARISGRVAVVAAQNGPAATLLVPGLAEALKASIPVVAIVQDVHRRFTDRNAFQELDHLALFAGVAKWVRRVAVAERIDDYVDMAFAAAASGRPGPAVLLVPLDLLDERPDFEAAAPRRSASLGTYPLDRTVADPARIAEAADLIAAARRPLVIAGGGAHSSGAYPELAALQGLGLPVATTVMGKGAVAETDPLSVGVVGYFMAPRARSSHLRSLVTEADVVLLVGNRTNQNGTDSWSLYPADARFIHLDVDGGEVGRNYEALRLVGDAKLTLAALAEALRQRDLAGLEGRRAPLTDTVARAREAQAGDMARLVDMEAAPIRPERIMAEIDAVTTAETVVVADASYASIWIANFLTARKAGQRFLTPRGIAGLGWGLPFALGAKAARPDAPVICVTGDGGFGHVWSELETARRMRLPVIVVVLNNQILGYQKHAELSLFGDFTDVCDFEAVDHAAIARACGCAGTRVERPEDLAPALRDALAGGAVTVIDVITDQRAYPPITSFEGKDALAY

SEQ ID NO: 394 - protein, 222 aa, Methylobacterium sp.
VPDWVRPIVKESLSERAYRELRVALMRGQLRPDTRLRLRPMSARFGISATPMREALLRLVAEKALALDARGSVVVPRLTLDQLLEIRAIRTDLEGRAAAAGAARRAAEVDDLEAIHAQISHCHASRDFARAVNLNTEFHLTLCRLGQMPILYEIVELLWVRCGPILSHLYDDGVPDWEPHPHRRIIDALRRGDSEAARDAVREDIERGGSGLFAHVRAAATG

SEQ ID NO: 395 - protein, 215 aa, Methylobacterium sp.
VLVMGSLPIGLGHFRRDERGIAAVEFALVLPLLIVLYFGTAELTRVVDATRKLTLFARTLGDLSGRVDNALATQNGMALATQDGMTKITSAATAILRPLDASGLQIVVNAMGVETVNGSLKGFVCSSWPQNATQRPANQANGSNGLPATPAAYQFDGARYILAEVTMPYTPIIGSALYRWIFGGRGLTFTRQIPWSERTPSEIVMPGGTACPVYN

SEQ ID NO: 396 - protein, 211 aa, Methylobacterium sp.
VGQAILGTAACADPTLTRLETELDAAYERARERVAGEPALVEALRGEQAMFAEGRAAVAALPGASLADYLASWRSWLDAIGPPRPGWDGIWLTGAGSLEIAPRGDGVYRIVAHADEPTRGAYTCAFIGIGRLRGDAIEVEWDAADGGDGADGWTLTIRRAEDLMHVEQHRGGSEAVTPPFCGHHGSLDGHYLPALVKPGSVTAWGPARATP

SEQ ID NO: 397 - protein, 989 aa, Methylobacterium sp.
VPGRLRPPPVPDAREPLAALRPRGWVHAGTIPLDGILMARGSVGPDWRARLLPWLEHAAEVRARGDRVLVLFAAPVTRDCSALGPVLPVVRSAGILTAVPLAEPEAPVAAALRDHVVHMTGGRLAAEPLAAFASLDIAGWWDLDAIAVHPAERLPVLRPAPPARRLVSAPALVADADPLAPVRDAVSRRPRRRTKHVLGDLVTRGRRLIVGALGLLWTAYVVLLAFIMVGAMVLGFAENVRTTAEHGAAAAHWGSLALPVLVLLVLAWFAFRRRGARAAREGAAPSAIPPAGTGRTPIWRRAAAWLAWRSPYAAHLRRLYARRLTEVERLFAAGRVDEALYRAIGLGGEARRGSAFADLPLTGPGLRRSLDLDLGPQRASGLSLAPADEIRLAALYRAQAVAMAGRGDTDRAAFVLDSLVGNPHEAVRLLAESGRLETAARLAEARRLLPATTVPLWFRAGQTERALALAARHDAHAELWKELGADDPFRPVLAEAWAARLVGIGALDRAAAVTFGLPALAERRLDWIRQALDAEAPVQAEPLARALRALPWEGRDGNRLHAAFADLVGATGAEAAGRRSAVAALLLDAQFEGGPERPPTPAFALLCRGLARRLATDDGILGHDAERARLAGRLAEAGGQVALRQHLRQLRTRSAPSASRLSGPLVVPDGPALAEIADAALLSGGRLLLGYRSGLVRLLGRAGRERWRGQVDGLTGFARLGAGDRAIVLRETLEGPDVQLFDAGTGRLLPLGPLPITHWHGQADETGWLVFDGEALVRLDTASLLGRAGGAPGSDGALAHHWRLPMTEPGRPLLLAAFADASALIYARHDGLIEWWSLSSRTLAVTCRFWTPPDRGSGVLGLTEAVAWSLEGTGANPHLRAHPHVFTTATREQERALVEAAARAEAADPPRLVAAENDRLWAATATEEGTLWAGVPGANRIRGPAVLWQGSGSLRARFAPEGDVAAILDERGRLIVFETVTGQVTLRLI

SEQ ID NO: 398 - protein, 637 aa, Methylobacterium sp.
VSAASSSLRKTLPPALAQWTALFSDMAEPDLRILAALVEALRPLVEPADGAGGQPQGEIDGLGGLGTRGGIERLVASEWLWRDLDPDAFLQRAAERDLLTLEPVYRQAADAGAVLVVVDAGPELLGAPRLVAFAALLCLAGLARRRGARLLWASTATPERRWLGALKRSDAAILLRESAATSLDAVELERVLAEPVATRAGGRPGASLWLIGGSDLPEAARPCRRITIAERPRLGSDGLAVAADVAVLDASGPVAGARLDLPPEREAVGLLRDPFRPRPAPGRPPPRRSTPDRSAAPPDWAPRGLAFAPCGEHLLVARPDGILIVPVTGTSGALRLPVAPYERLVGLDVGRSRIRAACLNVYADDARLTLRSWTFDRSGAAATLDRRIPRDHPLVSRRLPKAVLPPLGTLKRRNRSWLLAADGTAFLVSEKRLIEYAPLAGELPLAVTPAGLLMRDRADGVIARRPSDGKVVARFPSRAESLRPGGGLALCAVRGQPTLGIEQAGGHWDVVNAADGTVGHLRPQGRIIGIVPQYDGVRGQAVEGLLALHLDREEAGSARLTFRTPDGVAAGDPLTLPDATLDAVRVTVDADAVPCIAAARCDAAGFVDALAFSQLHRGWSHLTDLGAFAETVPCLGA

SEQ ID NO: 399 - protein, 358 aa, Methylobacterium sp.
MVHLALVAREHLLLIGPPGTGKSAAVRACAAGTGARCFEYLIGRFTEPAELFGPLDLEALRAGKLRPDISGMLPEAEFAFLDEVFLGSTAILNALLGVLNERRYRRGHFDTAVPLRCCVGASNALPEDPGLAAFADRFLVTAFVDPLADTDLEALLAGDPVASVEPGDGDAPLTLAEIDALAEAAARIDLAPVRPAYAQVVRKLRARGVRLSDRRVVRGQSLVAAAALIAGRTAAEEADLWPVIHLVQDRIAQDEARDLLRVELGAAASPVLPAAAKAAGYGPAARAADLAREGEALAASAPDDRTAPTFEAWLVRAESFLVQIDAAFGTEERPPALAAARDALLTRCRAPVPGMTPA

SEQ ID NO: 400 - protein, 781 aa, Methylobacterium sp.
MIRGFGRSGIARRVLVVGAIPILVAAAIALGAWILLYEAERARTGAVVATETAQTLTSMNRARADAVSGGTARRDEAERRFDERAATAAGQLERLDGLARTRGQSALVATVTGDLNSQATRMRSLLLSERTANATIADMARRADALVALTDVARRRQQQDNAQLIAVLAVKDAELERNQGVVTALRELREAISTAELNRARIGRPVFPIEFDELAADLRQLDAVGDRLRRVLRVDGEAGAADRATELLKAYRDRSRTEDGLNRVLSEGFELTRATQAGRVLVEWCDQLVQVNVTRQNRLYEEVALLIRHSVLSNEAELSAQDIALTALRLARRTDAALARRDTAEASRVLEAGAELSGTSRTLLIPVSIRDEMAEAIDGWRTQLAATIEKIGEQNETIADMDSRAATMSANAQTLSRAFIDDADQFGSVIRQLLVVGAVGALCLGIGAAAAVARSITRPLHALQHSIVTAAAAPAPEDIGRDSHLLTRRDELGDIARATNAFLEQIRRREADRRNASQRADDALTNLRQAQEDLIRAERLASLGQLVAGVSHEISTPLGIALTTATQVQSDSAAFERLVGENQLSRSRLTQYAGRMREGAQLLTSNLMRAADLLYSFKQVAADQAIEDRRPLNLADWIDELLKSLRALARPGRHVFQVECPPDLVVDTLPGILAQVVSNAVKNAIEHGFQDREGGRITITGIRSGDGIGLSIADDGRGIDGADLGRVFDPFFTTARARGGTGLGLHIVHNLVVNRLQGRVELQSSAGAGTVLRLWLPERLA

SEQ ID NO: 401 - protein, 295 aa, Methylobacterium sp.
MPASPSLARDRSRIAALALATLIGVGDPRPGWSLDMPDSPRPARPSRPVPPELAAALAAYRTYVVAQADAFVRETARFVAAIQAGQLAEARRLYAPARAPYERIEPVAALFPELIKRLDVRSDEFELRERDPAFVGFHRLEMALFTLGTTEGLGEVAERLAAETVTLRDRVAALAIPPARAVGAASALIEGIAATKISGEEERYSRTDLWDFQANIEGSKVVFTLLRPLLTDRDFVARVERSYKRVEDLLARYRSPDGGFQSYDNLTARDRNALKGPITLLAEDLSTLRGRLGLD

SEQ ID NO: 402 - protein, 414 aa, Methylobacterium sp.
MMRFPSQVTTRRQLLGGLGAAALVGPARAEDATPTIATEGTLVAQPFYGPHQAGIVTPQPAAALYVAFDVLAERRGELPHLFRTLTERLAFLTRGGAVPDLHPQLPPRNSGILGPTILPDNLTATVSVGASLFDYRFGLGRARPRHLGPMERFPNDALDPAQCHGDLLIQFCSNTAETNIHALRDVIKATPGLLTPRWKMEGFLPPHVVKTMGADTVRNMLGFKDGTANLDVRDLRMMDRYVWVGAGQDEPAWTTGGSYQVVRIIRTLVERWDRTPLGEQEAIIGRHKGSGAPLRQGHERDVPDYAADPDGEAISLAAHIRLANPRLPGTEGSLILRRSYNYSRGLTAAGQLDMGLLFVCYQADLAAGFITVQNRLSGEGLEEYIRPIGGGYFFALPGVSGPGSFLGEGMLAAT

SEQ ID NO: 403 - protein, 433 aa, Methylobacterium sp.
MQTDRVDPTYRKLRWQIFAGIFLGYAGYYLLRKNFSLAMPYLVEQGFSRGELGTALSAVAIAYGLSKFLMGMVSDRSNPRYFLPIGLVLSALVMFLFGFVPWATSSVGIMFVLLFLNGWFQGMGWPPSGRTMVHWWSQKERGGVVSVWNVAHNVGGGLIGPLFLLGLAWFNDWHAAFYVPAAVALGVAVFAFITMRDTPQSCGLPSVEAWKNDYPDGYDANHEREFSTREIFVEHVLKNRMLWYIAFANVFVYLLRYGVLDWAPTYLKEAKHFSVDKTSWAYFLYEWAGIPGTLLCGWLSDKLFRGNRGATGVVFMFGVMAATLVYWLNPEGNPGVDLAALICIGFLIYGPVMLIGLQALELVPKKAAGTAAGFTGLFGYLGGSVAASALVGYTTDHYGWNGCFILLLAACVLAIVCLSLTLRHSSTAVAQPA

SEQ ID NO: 404 - protein, 374 aa, Methylobacterium sp.
MSRTDNADAGDEVAGIVLDQVERLLAQHLTPALLAASDGAAGAAAWPTDLWAALAESGLPLALVPEAEGGIGLAATVAARLIRRCGRAALPLPLPETVAGAALWAAAGGQVGDDALSLVPGGGPVRIAPHAEGFVLDGRVAQVPWGGSVAALLLDTVDASGVPHLVRIAAPGAIRDTHHNLAGEPRDTLDLTGCTVPAEDVRAAPGWATGTGVPSVEAAGAWVRAQQMVGALETCLASALDHAQERQQFGRPLAKFQAIQHMLAEAAGHVAAATAAADLAAACWGDPRFVLATAIAKARCGEAAGHVAAIGHQIHGAMGFTQEHPLHRATRRLWSWRDEFGSDALWQERIGRAVCAGGGAALWPMLVRLRGGAG

SEQ ID NO: 405 - protein, 383 aa, Methylobacterium sp.
MHSFRFSAEPLPPEAESARASVRAFLDAERAAGHFVPHRTSWTTFDAAFSRRAGAAGLIGLTMPEAYGGHGRSGLVRFVVTEEMLAAGAPCGAHWIADRQSGPQILRHGTEAAKRAILPRICRGECAFGIGMSEPNSGSDLAAVRTRAVRDGDDWVINGSKIWTTNAHQVDYLLALVRTGEPGPDRHGGLTQFIVDMAAPGVTVRPILDLSGHHEFNEVFFTDYRVPDAMRVGAEGAGWGLVTEELAFERSGPDRFLSDYRLLVELVDRIGPEPDRFQAVETGRMVAQLTALLGMSASVARLLDQGIVPGVEAALVKDVGNGFERAVPEIARRLVPVEPSLTAQGDAFREALGGVILRAPSFTLRGGTREVLRGVIARGLGLR

SEQ ID NO: 406 - protein, 303 aa, Methylobacterium sp.
MDPRVGDQGRFEPCGFRNRRFARRVMVERIAPRGAASTDLTVGADPAGSDMTLVKSAGRVLQILELFDEIQREARVSEIAERLNVPQSSTSVLLKSLVRLGYLDYDRGSRSFLPSPRVALLGAWLDKGPVRDGSLVRMLEHLSERTGGTVILAARNAIFSQYVHVLQARTAMRFHVPPGTRRLVVWSATGTALLADSPEAEIGPLVRRTNAEAPAEQPPIALAAVLANLARLRRDGHFFSRGLVTPGAGSIAVPLPRRIDSKGRPLAVAVSGLLDEFERREAEIAATIHDAVARFLPEDPSRP

SEQ ID NO: 407 - protein, 478 aa, Methylobacterium sp.
MALPDLSRFYIDGAWVEPVSARPFPLIDPATETAFGTLALGDAEDVDRAVRAARAAFPAFSETAPAERVALLRRILALFEERFEIFAETIRQEMGSPIGFARKGQAARGPAHLNALIAVMERFAFEEDRGTTRIRREPIGVCGLITPWNWPINQIVVKIAPALAAGCTMVLKPSEYSAVSAMLFAQVLHDAGVPPGVFNLVNGDGPGVGAAIAAHPGIDMVSFTGSTRAGIEIARAAAPTIKRVAQELGGKSANILLEDVDFDQAVRRGVAACCTNSGQSCSIPTRMLVPRARMDEAAAIAAEAAAGLRLGPTADPETDLGPVVNRTQYERVVGLIRTGIAEGARLVAGGPERPDHLDRGFYVSPTVFADVTPDMTIAREEIFGPVLSILAYDSEDEAIAIANGSRYGLAAYVQGRDRDRARAVARRLIGGQVHINYPPPDVHAPFGGYRQSGNGREWGEAGLQEYLETKAMIGFGLD

SEQ ID NO: 408 - protein, 317 aa, Methylobacterium sp.
MAFDRHIFSGTIPALMTPCRPDRTPDLDALARKGRELVDAGMSAVVYCGSMGDWPLLTDEERMAGVERLLAAGVPVIVGTGAQNPKRAAALAAHAKAAGAHGLMIIPRVLSRGSSAAAQEAHFGGILEAAVDLPSVIYNSPYYGFETRADLFFRLRARYPHLVGFKEFGGAASLTYAAEHITGQSPDITLMVGVDTQVVHGYVNCGARGAITGIGNVLPREVLHLVGLCEKAAAGDVRARRRAEELDAALAILSSFDEGTDLVLYYKHLMVLEGNPEYALHFNATDALSAGQRHYAETQLRLFKAWYAHWSEAGAGA

SEQ ID NO: 409 - protein, 313 aa, Methylobacterium sp.
MLDDHFRTRIALLRAERDFRLAVGGYCQGMIEPAQIVWPSHKLLNQIGRYVVSFMLIHNDYAWRHHGGPRPTLTVLQAMVGSSPRQTAGFVSALKAGRFVTAVADRGDGRVKCLQAAPALVTEIARSGRLFVAAMDAVTRRDPGRAGMLDGPDRLGELVRLSAAHVLRHGTLIAPFPRVLHFAGRDCGYPLLTALVGAHYAATVPGAPAAVSLSLRSLAERLDVSRAHVGNLLGEAETAGWIRIAGGHLTAFDPALLAEFEVWAAGQMLFYDDLAAAILAEAPTAPVPAGASGHAGLACVPVDPGIPTGGTAP

SEQ ID NO: 410 - protein, 318 aa, Methylobacterium sp.
MPVRLDARLAGDLFFFRALVEAGGFARAGDRLAVTQSAVTQRIQRLERRLGYPLLERGAREIRLTAAGHDLFAAARSGFDGIGEALLRAERRERRETLRISCIPSLASEWLAPRLRAFSDTHPDIDVAVFGETHDLDPGRMAQSGIDVAIRYGPTPPPGATVVFDHPEPVYPVCAPAYRDAASQPGGAVVLLHDATPWEAAASVSEEWDRWISVHGAPWDGGIQNLYFNLAQLALRASLGGSGIALGRSLIVAPYRADGRLVPACGEAVMNGLRYFVIVRALPPAGPAAAFVDWLGRTMAGPPGSPEAPRRGGAADRG

SEQ ID NO: 411 - protein, 147 aa, Methylobacterium sp.
MTHQETAFVEAMVRTGDALYSATVAGYAQPASAASKALKRPDIVAAINSAVRLRVQSEGAAVAASVLVEIALDKTAPKAPRVAAARALGEMTHLGGLEGAGLDKPLSEMSRAELVEARQRAVAYLAELDAPVIEAEAVEAPAGGLFD

SEQ ID NO: 412 - protein, 597 aa, Methylobacterium sp.
MNYQRKYSFSGYQANNPQRPLPATQIDAELDAISAAFEQTLDAYGVAKANGFQGNVIEWLASLKGEKGDKGDKGDRGPAGQKGDKGDTGSQGPQGDPGHQGVQGVQGPKGDQGEQGSAGPAGDRGPQGLQGPKGDQGVQGLQGPKGDKGDTGSQGAPGTNGKDGSQGPKGDQGAQGLQGPKGDKGDQGVHGPKGDQGEQGAKGDQGAGVVIKGSVPTPADLPASGNTPGDTYIMTTAGSGYAAGDGYAYTGSGFTNVGQIRGPQGVQGPKGDKGDQGLQGVQGEPGAQGAKGDAGAQGVQGPKGDQGEQGIQGPKGDQGIQGVQGDPGAAGPKGDTGSQGPKGDTGSKGDQGIQGPKGDQGIQGVQGPKGDKGDQGPQGPAGSLGFQPVQQGTGPGQGTNTVSVGWGTIKNAAGIDTAALLLSIDGQAQGAIWTDQLLGQSFGRKRIENLATGAHFCAAVGLGSSGLTASAGNGFQRIMLNAVEADVEGLFKTGSGQSYYLVPMSGVYNITGALRFPDNTGSFFYGFGVHTAEEDGSHMSWSFRPTNNGRYVSQYSRMAHFNKGDQVRMIFYSDAVVANLPVDRAAFQIALLSGDIV

SEQ ID NO: 413 - protein, 261 aa, Methylobacterium sp.
MCDPLTIAGAALSAGGIAANSIGASQAAAASSRAYAAEQARQAQLRQEAAQVQQHSNSLYEGFAGKQQDRAADLASTLRSAQLPAQGSASTTVEAPASSSNITTQGEASQRANADAYAGQQATALGDLRSFGDLLGTNALAQARDASQIGQIGNFMRGSASVLPQELNAASHAGDTAKLFGGLAGGLGKVGIAAGINGSTLGGLFGGGASSGGNVSTSLPTMAASGMGSIANAYGNLPAAPMSIAQPFGAAPSFASSPYRV

SEQ ID NO: 414 - protein, 206 aa, Methylobacterium sp.
MSKKDGGAGKQANIARMEEAQRQATIRQGTDQINSTFDSQFTPDFFNKQRDNFLAFQLPQLDGQYGDAQRQLTYNLARNGNLDSSTRGFQQGQLQKTYNTQRTTVADNANSYANSARSNVEQARNNLISTLNATGDATQAASSATNQAAILAQPQAYSPLVDAFATTTGALASQAQADRAAAIANGTYTGGSGLFGTSGGSVRVTR

SEQ ID NO: 415 - protein, 74 aa, Methylobacterium sp.
MYDGPIPRSRYPATMIDDTDPVLEAVTALRAAGVAVDPIGDELERWQIGDLIFSDADLWRLAASRGLVEDSDSL

SEQ ID NO: 416 - protein, 126 aa, Methylobacterium sp.
VPATAQQLDGWPGIVIALLGALAVVLVPLTGFMKEWWGYRKEVLAAEKMKPEIARDIGTASGGAVFDSIALADLAKAINGLTAAIVADTASEEAQHTSQMTAALSRFTEVMDRWEDDHGRQPRGRR

SEQ ID NO: 417 - protein, 172 aa, Methylobacterium sp.
VQTSVQAAVRALLTTTDRSEITVPLVAAAAGVTPSTIYRRWGTLAELLADVAVERLRPDGEPADTGSGRTDLEAWAEQYADEMSSAPGREMIRDVLAAADANCAQRCCSFTRDQIAIIADRAVARGEAFPDPEAVLDGVVSPILYRILFGTALNRERILELVDRTLTAREAT

SEQ ID NO: 418 - protein, 142 aa, Methylobacterium sp.
MTQGTEPAALPPHLAQEYAAARDNGCVGTRLLSEDDRSRVWTIVLAPGARIGFHTHVLDYFWTAVTAGRARSHYGDGRVAEVDYRAGDIQHLSFGPGESMTHDLANIGDTELIFTTVEFLDSANPPLALPAAVRAEATRRAA

SEQ ID NO: 419 - protein, 131 aa, Methylobacterium sp.
MILQRLALRAGIACALLLVPGHARAWEGIASTYGREIFRINPKGLTANGERFQPMGRTAAIWDVPFNTRLRVTHLATGRSIVVRVNDRGPHRRLGRLIDLSTGACRALGACGLARVRVEVVPSGRRVADAR

SEQ ID NO: 420 - protein, 137 aa, Methylobacterium sp.
MKRLAIALTALSSLVLFAPSSEARPHGRGFHHGPHHLGHGVWRGRRHGLHRYRHHRLHRHYRRHRGYRGYRGVHFRPAGYGYRPHAYRSGGLGGYRGVGFATGAGLGLATARPGLYGAAYGRPYGYGYAPVGYGCAY

SEQ ID NO: 421 - protein, 99 aa, Methylobacterium sp.
VILSRWRGYSAAMAKRPMTLDLFTTLDIVDDDVSAVVDAYLADPTPGSVAFGDGFRIDPAAAVASHPFARTLIDQPWADAGLRRAAIRAAILLAEPERV

SEQ ID NO: 422 - protein, 383 aa, Methylobacterium sp.
LIHLINMTDWLDRAEALDALGIRAQTLYAYVSRGLIEARRAPGRRHSQYRATDVAALADRRGRSRASAAIAAGAMAWGEPSVVTAISTVHRGSLIYRGRDAVAFARDASLEAAADLLWDSPEPTLFDVPANAAATPFLALAGLLQDAEAALGRGHHRLCRDARRAVAHLAASCGIPEGRAPLHQGLARLWSLDAATADRVRQALVLLADHELNASTFATRVAASTGAPIAACLMAGLSALSGPRHGGAAAAVLRLVDEADATNPREAVRACLDRAGALPGFGHPLYPDGDVRAAALGAVLPADPLLDAVRDCAVAATGARPNIDFALTALVRTAGLPRSAPFTIFLLGRSLGWAAHAMEQGRQGTLIRPRARYEGPRRSADRP

SEQ ID NO: 423 - protein, 279 aa, Methylobacterium sp.
MLRTAIALTLLLAGAPAWAGPRWQDLPPTPAPVAGTVSGRASVNGIRLYYATIGNGPPVVLLHGGLSNSDYWGHQVAALAARRTVILVDSRGHGRSTRDDRPFGYDLMTDDVVGLLDVLKIPRADIVGWSDGAILGLDMAMRHPDRVGKVFAFGANADPSGLIEGVEKNPTFAAFIDRAGKEYEALSPTPKDYAAFVDAVGRMWGGQPRWTEADLKRIRAPVLIADGDHDEGIKRAHTEYLAATIPGAGLLILPNASHFAFLQDPALFNAALLGFLDGP

SEQ ID NO: 424 - protein, 125 aa, Methylobacterium sp.
VHFMRMMGFVALVLSGLGLAGPASAAPLSPAPLAGDASGLTRVGYWCGPGFHLNPWGRCVPNARRFYGPGPAFYGARYYGGRRFYRTYNYRWHRNYRWHRNYHWHRNYRWHRNYHWHRSYHWRRR

SEQ ID NO: 425 - protein, 29 aa, Methylobacterium sp.
MTLALIITGFLIVNFVMAGFFSLVALWAD

SEQ ID NO: 426 - protein, 403 aa, Methylobacterium sp.
MAEDGIADSGRAWRRLAAATALGTVGGVGMWSVVVVLPAVQAEFGVDRAAAALPYTLTMLGFAVGGLLMGRLADRIGIVPPLVLGTVCLALGYGLSALATNLWQFALVHGVLVGALGSSVAFGPLMADVSRWFWRRRGLAVALCASGNYLAGTLWPPVVERAVHAFGWRATQAGIGLFCLVAMLPLALAMRGRPPRASATRAAGPQAVTTLSPAALQGLLVVAGTACCVAMAMPQVHIVAYCGDLGYGVDRGAQMLSLMLGFGIVSRVASGFVADRIGGLATLLAGALLQAAALALYLAFDDLTSLYVISALFGLFQGGIVPAYAIIVREYLPAEEAGARIGAVLMATLAGMALGGWLTGAIFDATGSYRAAFVNGLAWNAVNVAIVLWLIHCRRARTSPAAL

SEQ ID NO: 427 - protein, 231 aa, Methylobacterium sp.
MAKFHFVEDYEAYVRQLMRDLPLDEAMSVAVGGDYDRIGAIECEILQHFGLRDGQSVVDFGCGSGRLAVHLARTASVAYLGLDVVQDLLDYAKRRCPRDYRFARNTALSLPVADGSVDLVSAFSVFTHLLHTECYIYLEEMHRALRPGGRVVASFLEFSMASHWGVFTKTVGEQRTSTVPHLNTFIERSVWQTWADHIGFDSVTFLDGTAAPWPSGVYLGQSLAVLGKAPA

SEQ ID NO: 428 - protein, 468 aa, Methylobacterium sp.
MSEAVSPAVNAGGRLDRLPIGPFHRRIMWLIGIGMFFDGFDIYIAATVLGATLKSGFSTLPQNAWFVSATFVGMMAGSFLTGFFGDRYGRRFTYQANLLVFGLAAIGAAFAPNMTVLIVLRFIMGVGLGAENVVGYSTMTEFVPARSRGRFLGLMAVFVVTGLPAASLVGYLIIPTFGWRAMFALGGLGALAVWYARKSLPESPRWLEAVGRNAEAEALMRAIEAEAARGAPLPPAAAAAPVTQLGLAALFRPPLLSRLLLGCLCLVVINTLLYGFVTWLPTFFIRQGLSVATSFGYALLMGLGAPVGSAIGALTADRWGRKPTIIGASATAILFGILYPMTLDPVLLPLVGFGLTVPIYVLVALLFGIYIPELFPTEVRLRASGLCNTVGRGATIVTPFLVVTLFEAYGIAGVTGLMIGLLALQIVAVAAFGVEPRSQSLESLEAGVAPAEGGPAARARGTVPRPIH

SEQ ID NO: 429 - protein, 507 aa, Methylobacterium sp.
MTLHAPEPTVETRGNFIDGREVEAGDGALIDVRNPATGAVIARIPNSGPADVDRAMRAARAAFEGREWGGMDIRARARLVNRLADAFEANLDTLYRLETTNNGRPVNETRAQLSRLPDFFRYFAGVALARRDDVIPVEGNYLNYTRRTPIGVVANCTPFNHPLMILCKSLAVVLATGCTTVVKPSEYTPLTTLKLAQIFTEAGLPPGVFNIVLGLGASTGKALAEHGDINKLVLTGGTEAGRIAGSAAAKVFAHQTMELGGKTPVMVFDDFDVERAVNYAAFGAFIGAGQTCVCGSRHLVQASIYDEFVERLAAKTAAIRLGDPFDPATQLGPVISERQRERVLAYAGYGRDQGARAVAGGRAARVPGFEGGYFVEPTVFADVTADMRIFQEEVFGPFTSVTRFEDEADALRLANDSPFGLAAAVRTRDVARAHRVAHAVKAGIVWINDHHRLDPASPWGGVGDSGLGRECGIESFNDHFDVKSVMVATGDGPFDWYRDTAGQRRLN

SEQ ID NO: 430 - protein, 210 aa, Methylobacterium sp.
VLLRDNIYAAIRADILACILRPGAEVREQELARRYAVSRQPVREALLRLERERLVTVHARQGYQINAISVADARDLLRMRLALEPACAAEAAAGAPASVLASLDAFRAVADGADFIAENRAFHIALAEASGNRRMAATVRDLVEQADRLVRVSLDGIRGRDPAQLVDEHAAIIDAVQRRDGRGARRLVRAHVAQAERRILTALERSAIVL

SEQ ID NO: 431 - protein, 137 aa, Methylobacterium sp.
MQDIPLGAKGSFAMLVGPSHLASQFKDNILPPVFATPMMVLIMENAALNAVRQYLDPGESAVGTKVDVTHMAATPVGHRVWAEAEVVGVAGRQIQFRVAAWDESEQIGAGTHERMIVDIERLGKRLAAKQPAPSKRA

SEQ ID NO: 432 - protein, 154 aa, Methylobacterium sp.
MSFMRVTICAVALCLVAGLGHAQEAGQTVAGEGDWVLRKSAAPSSGDVACVLAPKARSRIQIVGDRIEITGLPKNSIFNYQYRIDDGPVSTAMFPTTQMQDAGVITLNGDVLKDILAGRRFSIRLLDRWHEAMTEEISLSGLRGLIDKRAEACR

SEQ ID NO: 433 - protein, 80 aa, Methylobacterium sp.
MAFPDANEPSATSISALELVNTLIERKENGEPVDADILSFLTDMERLGLTDTDAYATLDAYRPGPALGATGGDDASEADA

SEQ ID NO: 434 - protein, 217 aa, Methylobacterium sp.
MGGTVATWNSDAGPSGHGIAAGRPGRPPPGGSWNLAAFERHRAAYLARARRILGCPAQAEDVVQDVLLRLIADPPPAQTAIQAAYVGRMVRNLALDRARRQGLERRLFTGLDAAPDPADPGIGTPEAAAASRESLRQVEAAVAELPEPVRTVFQLHRVEGVPQIEIAARLGVSRALVCGLVRRGHLHCLAALDRRCAACPARAEAPGRQRRRTAPVN

SEQ ID NO: 435 - protein, 266 aa, Methylobacterium sp.
MARLQSSGFFDLGDGRLEYHFVGRQPEVAPTLVLLHEGLGSAMQWGALPETLAQTTECGVLAVSRQGYGASSPVPLPRPADYLEHEARTVLPRLLDAANFRSGVMIGHSDGASIAALALAEGDARLRGGVLMAPHFFVEEVTLSAIRRTRAAYERGLLRTRLGRWHTDVEGAFRGWNDAWLDPARRGWTIEAALTRLTVPVTLIQGTEDAYGTQAQIAAARRSCPPSLLTVREMPGVGHEPHREAFADTVALISAFVEYVLKDEPG

SEQ ID NO: 436 - protein, 449 aa, Methylobacterium sp.
MQTAATFASDPPALARPTGRQTATAAMASLFGWGLDLFDLFILLYVAPVVGTLFFPADKPMLSLAGAYASFAVTLLIRPLGSALFGSYADRFGRRRALMVAVIGVGLSTAVFGLLPTVGQIGWLATAIFLFFRLVQGVFVGGVVAASHTIGTESVPERWRGLMSGAVGSGGSAIGGLLASLVFYLVSLMAPGEAFADWGWRVMFFSGLLTSVIGLILFRNLEESPIFKELQARKAALREGAPTKASPIRSLFSPSNRGSFAVATLISFGGGAAYYLTSGYLPTLLKLVNGVPNATASMILIGANVAAAIGACGMGELSQHIGRKRSFLLMGVIRLFAFPVLFLTMANTTSLMGVAACAFLLSLIANASYAPLLIFLNEKFPTAVRATGTGLTWNIGFALGGMLPTFVSLIADGPTQIPMVLTVVMTCVTLVYLVGAVITPETQGNLDRA

SEQ ID NO: 437 - protein, 268 aa, Methylobacterium sp.
MTSDTHTIDPRLTNLDGFRVEIDSERERADVILARPPMNVIAMPQRDEIRKVFEALDEDPRVRVIVLRAEGEHFSSGGYIKGFLDASPEHVSKLAWNMAAPARCSKPVIAANRGYTFGVGFEISLACDFRIVSETCRYALPEQKLGQIPGSGGSARLQKIVGITRTKDIVMRSKRIPGRQALDWGIATECVADADLEKATDALVDELRAFSPIAQRTAKKLLNDTEDASLSIAIELEGHCYSRLRQADDFREGVEAFHAKRAPRFTGS

SEQ ID NO: 438 - protein, 519 aa, Methylobacterium sp.
MLDLGTSFLASVSRDPWALALVDGETRLTYAEWFGVISATVAGLDRLGLKPGDHLVTVLQNRHEAATLHWACQFSGVVITPINWRAKAEEIDFAIENAEARAIAYEPVSAASLRESAASQLIPRIAVGTPPGPGETAFADLAATEEPSATPRADAEAISLMLYTSGTTAKPKGVPRRHRAERAAAVAHVAQNLYGRGERTLGVMPLYHTMGVRSLLAMSLIGGTFVCLPRFDVAGALRLIAAERITNLYLVPTLYHDLVHHRDFQATNTTSVRKLGFAGAPMTDGLLARLTEAFRPDLFVNHYGSSEVYTFTINHEAAVKPGSAGRAGLNTMVRVVSLGGDPSRTAAPGEEGEIAVIAKGDEAFEGYWHRPEADAKAFRDGWYFTGDTGFADADGDLYVTGRVDDMIITGGENVSPVEIESRLSLHPAVSEVAVVGLPDERWGRIVAAFIKRSGSTDAAALDAHCRAGGLPSHKLPRRYVFVDEIPKSPVGKLLRRQLVAGEYVLEGGAEPHAEGHEAA

SEQ ID NO: 439 - protein, 177 aa, Methylobacterium sp.
MPQLDAQDRHTVAFTLNGRETAVEVETRTLLTDALRHGLGATGTHVGCEHGVCGACTVSIDGVPARACLTLAVGVEGCAVRTVEGLAPEPGRLGVLQVAFRRRHALQCGFCTAGILMSLDAYLALRPNPSRREITEVIGGHLCRCTGYAPIIEAALEAAAELRGDIPAPSSPEAAHA

SEQ ID NO: 440 - protein, 285 aa, Methylobacterium sp.
MSEALEIAHGTFGRVALLDMDRSLVRHAHPHCHVLLKVEGDDTEFLVGDRVVALTDEQAVLVNAWETHAYLHDPRRAKAMILALYIEPDWLGAFRRNWAASGAPGFFGKPLGGVTPTIRRFAHDLAAEMVYAPHSSHIQDQLLSGLMIAVIERFTAWREEAESLRAAARRNASDWRIRRTIARVRAEPGATLGIEALAREAGLSRAQFYRLFEQSTGAPPHVFLNAIRIEQAVESIVGSEESLAAIGTRLGFAAPAHFSRFFRDHVSVPPSVFRSIVRRSGQPAV

SEQ ID NO: 441 - protein, 234 aa, Methylobacterium sp.
MAFNTELDSALEAAFAEARALYKERGFQRRVGFGRRPALINVDLANAWTRPGNPFTCENIDEQIIPGVQALLAACRRNNHPVVHVTTCYQVTDVDSPKTDMGLWHRKIPVEVVDQNKPELWAIDSRIEPVPGEQVLVKKRASAFHGTYLAGFLRANNVDTILVTGVTASACVRTTLCDGLAEGFRTIAVRECIGDRVPGAVAWNLFDIDAKFADVEPLERCVAYLDEVGLRNAA

SEQ ID NO: 442 - protein, 350 aa, Methylobacterium sp.
LSLDRFSPTRRQALLGGAAAILTAGAGREARAAAGTVVVSNWGGDWNQRTVRFVETPLVEAQGLTVVRDLGMEPERKAKLLAERRLRRGSIDVIHLNDSDGFEMMKQDVLADLDRSRIPNYGDVVPALRKDYFVPWLYSGVVLIYNKDKIKDPPKSYAELWDKRWAGRLGLTNQLYFNYMMMSGLIQGGNLTSVETGRERLVALKELVQPRLYAAHQQLGAALATGEVDIALNYKARGLQWIGEGSPLAIQYPKEGAIAITFGAGMPKRAPNPDGAYVYLNAMLDRKAMAELAAASFYAPANGAAELSPELRARIDFSPEEREHLNFPDYAYVSKNTAEWLEWWNKTMAR

SEQ ID NO: 443 - protein, 385 aa, Methylobacterium sp.
MSANTYDVIVLGVGGMGSAACWHLARRGVRVLGLERFDIPHAMGSSHGFNRIIRLAYFEDPSYVPLLRRAYENWRELEGRFGEQLLFITGSIDAGPEGSAMVEGSLAACRMHDLPHRLLDGAELRRVAPGYNLPDTHRAVLQPDGGFVSAERAIVAHVTQAQAAGAEIRAREPALSWEPTASGVRVRTERGTYEAGHLILSAGSWMGEFVPQLKTVAVPERQVLGWFQPREPALFAPDRFPVFNMEVEEGKFYGFPVWHVPGFKIGRWHHLGETGGADTLSRECEAEDEAVLRPCVSRYFPQANGPTMAMRACFFTNTPDEHFVIDTLPDLPQVVVASPCSGHGYKFCSVVGEVLADLALGRKPGFDLSLHALNRFAPRSYASTD

SEQ ID NO: 444 - protein, 316 aa, Methylobacterium sp.
MRPFSYERAASAEAAVAAVAARPGARFIAGGTNLLDLMKFQIEAPAHLVDIRHLPLKAIEDLPDGGLRIGALATNTEVAAHPRVKRDYGVLARAIVAGATGQLRNKATTAGNLLQRNRCPYFYETSLPCNKRQPGSGCSALGGVTRSLAVVGTSAHCIAQNPGDMAVALRILDATVETVRPDGSQRRIAIGDFHLLPDDRPEIEHPLEPGELVTAVTLPRPPGGAHHYHKVRDRASYAFAIVSVAVILHKDGTGRVAFGGVAPRPWRLENAEALLPSGPAAVITAAFQSATPTAGNAFKIPLAERALALVLSEGRV

SEQ ID NO: 445 - protein, 915 aa, Methylobacterium sp.
MEILTALVERAGQVVSKADLHKRAWPRTTVDESNLKVNIAAIRRAFEGAAPGKRFIATVSGQGYRFVAPVDVMSWPISAAARRHNLPRATDLLGRSEDLAAIATKVLQRPLVTITGPGGVGKTSLAVTVGHALVEQFPDGVWMVDLCVIDSDRYLASAFAQEMRIAIHADDPQAALATALADRQCLLVLDCCENALDQAARLATMLATAAPGTHVLATSREPLRMAHETVHRLRPLPAPTALGIPNAKDVLTFPAVALFVARASAAAPDFRFEDDDAWAVVEICRRLDGLPLALELAATRVGAFGLRGLLRLLNERLDLLDDGRRAGHPRQRGLTATLDWSYGLLSQVEQALFRRLSVFHGVFPLDAALAVGLSAGEAERACIGHLADLVAKSLVVATPGWLARYQLLDTTRAYGLQRLAESGEDDAVRRRHAEFCVAQCRDVSARRSARAASDPREELVALVHNVRAALDWCLTDRRDPVLGRTLAAEALVVWDTLALLQERIEASEWALASAAPADGPEDRYEITLRASLAAALLQVEGPTARIAELWSGALARAERLSDGDGQLRALWGLCDFQTWVGDHSASFALTERIRTLAAASGDRAAGAAVDRPAATALRYLGRLDEAREAAERLLARAARRDSPGRRLEDHGLVAARGTLANVLWLQGRANHAVASARRALVEAEASGQAFALTNALAHTVIPIALHGGDLDEAERGLDRLGDHVARHAMRIWQVIADCLEAIVSLRRGDAGGLHRLEDALVEMGEIGFRMRRPAYLGSLASGLAAHGRLPDALARIDDALAASECGGELWCQPELLRIKGVILLASTGIAGEPDAARHFLQAIDLAGSQGAAMWRLRAATSLAALDDRFGGQEALAATLGDFDEGLDTPDLRAARARRAGRGGLGRDAGRPVSLA

SEQ ID NO: 446 - protein, 360 aa, Methylobacterium sp.
MAQTVSWGVLGTGVIAQRFVSDLLGRPDARLAAVGARSHGSAQAFAAAFSQASGAPAAVAGVEALAARPDIDIVYIATPNSDHMDSALACIEAGKSVLIEKPIALSGGQARRIAEAARREGVFCMEAMWMRFTPGVVRAKAMLEAGEIGDPLHLDARLFFPRAPNAPGRTDDPAEGGVILDLGVYPVSLALHLFGAPTQVSGVGLDRGGAAARQAALALGWNARTATLSCGSTGEADNAAVIVGTRGRIHLHRQFLCPPFLTRVRTAAAPAPADRAPPRRQAVGRLAFAKRLLQPLDFRRVALIPTPYLGFGLRHQIDEVHRCLLAGARESPIMPLADSIRTLDILDRVRARPQPLEAVA

SEQ ID NO: 447 - protein, 409 aa, Methylobacterium sp.
LPIGTSAPAASLLADRVAVFLLGAALNFNVLTSTFGLPFQRLSDLLPFLLIPWLGLRRAVVAEAVRQAAPLAGILALIAASLVLKAHKQAGDVYLTLVLLLYVVQAFILLVMFRDRRFEDAFCVGLLAGMLASLAVLLLAASGTPLDRFGLAVPTDGLDEELKLFVQDKQGGLWASGNETGHVFALAGAAALLLSLRYRIKIIYLAYFAALLASFPFTNNRAGLFMPVLFLGLLMRRNLKAPAVLAALGVLGVLLVAWAVTGEIPLPGTLSQAIERRFAEDHNVTGNFDERFLSGVTALQLVVEYPFGVGEVARREELQALTGLVTPHNGFVSLALQSGIATALLLIAGLGRVLLAPAAFGPFLTYSAVFLIPSLMFEELSVNQYFLFFMGFILASLALPPDRAQSETR

SEQ ID NO: 448 - protein, 445 aa, Methylobacterium sp.
MMTPTLSSNYARVLAEEPRAQGQDRPREQAAARAVTGPLRILHLSALYPPYIVGGAERSVEHLAEELVTAGHTVAAACIAREPEPKSVRGGVTVYRMAHHNDFWLEDWPQASRFGRAWAKVKQQWNFAVAAEFGRVLDDFRPDIVNTHSLLDVSTLVWREAAKRGIPIVHTVCEYDLICGNAAMFRDGKPCDRWHLGCKVVNAAKQITNRSVDAVVSVGTEILKTHVDHGLFAHLAPERRRVIFYSCTVPEGDPEARRRIDRTGQPMTFGYLGRINTEKGVGTMIDAFRRLGPGDWRCLVAGHAMDDSIERFKAQAEGLPIDFVGWAKPAEFLSAIDVLIVPSFWAEPSPRTIYEAYTMGVPVIGAASGGIPELIGEDNADWLFTPGDDADLAARLRSVIDRGRGDLPDERAFQHVIRESTSERVAEKYLDLYAELVAERRASRP

SEQ ID NO: 449 - protein, 418 aa, Methylobacterium sp.
MRILHLSSLYAPEQVGGAELMVETLARTQADLGHSVAVACAARTEGGPVLQDGVTVYRTGYGTPFHILDWPQRGRADRLRYKLAAQWNRHALDRMAGAVRDFGPDLVNTHSLSELPPALWPMLRRIGVPIVHTLHDFTSLCTNGAMVRHGHPCAQQHLKCRLYAAPHRRCQRAVTAVTAVGTDILDRHLAAGLFTQVPPSLRRVIWNPIPSGSPVARGKRAPGAPIRFGYLGRIEGAKGFDVLLDACRRLPGSGWSLAVAGRAVDGLDSYRGLAEGLPVTFLGYAERDAFLDDLDCLVVPPTWPEPFGRTVAEAYGRGVPVIGTATGGISEQVGPGPWLVPPGDAPALAAAMARIVAEPARLAEGLARSARIRAGTDPLAVATAYLDLYAATRDAARTEPLPELSARAERPHLSECRS

SEQ ID NO: 450 - protein, 731 aa, Methylobacterium sp.
MSFLTVDLADRTPVRALAQEPARGGPLAAALARIWHRRYLFAAVFATVLGLAVTALLMIQRQYVASGSVIVAEAEPGANNASMAWIQKIGDPADIESQILVIRSPRLLRLAIDDNLVAAVLAECRYAATGGHPDRISEKKEAACTKLTTDRNALVEYLQKRYTVLSSGRSRIITIGYKSPLPETAQTMANGLINAFLDDQREAQASSRKAAADWLHTEISQLDASIRADETRIQTFRRRKGLLKGSLAPISAERLTSISQQLAAAETAKADAAARLSEIEAKGARGADSAPAVLASPTIVSLKQQLSGVSAQLANQSTLLGANHPVIRALETEQASLRARIEQEIGNVARGLRKSYEASNALAKSLRAQLETAKTDAAAAMDDEASIEGMVRNAEIKRTRYADLVKRAGELETERRILTGSTRLVSLAELPQEPFSPKAVPLLAGGIVLAGVLAAAAALLRDFTDRRVRTSAQLIAGTGAPVFAQLPSLEPAGLVGRFSERQRELDLAEALARARVDPVMQNVLRNLHAHLVLAGAGKSRVILVTSAKPREGKSFTAFALAGIGAASGRRVLVVECDLRRPNFEASLGLGRGPGLGGVLRGEIDPAEAVVQAGRFDVIPAGTPTADSTELLMGDRMADFLKWSRRYDLVLLDTPPTSLLMDAAMLARHVDGVLCCARYGRSQLSDTVETVANLRRAGGHVLGIAMTMVRPGIQSTYDVMPLPDPRTAASAR

SEQ ID NO: 451 - protein, 241 aa, Methylobacterium sp.
VTRLTRRSALALAAGALAAGRAAAAEPLHRCEALIDSIGVNVHLGHRGTPYVDRFAACARALDELGIRHLRDDIVLVGDEPAGQFERIADLADRGYRFSLIFYDGLTPGPRVPPERFAEIARWAGDGLIVAEGGNEPPVAARPGLARLSADHQAALFRAVRADARAEAVRVAGPSYIQGNVAAAQDLAAVVDLANIHAYPGAEHPETDGGGSLARFVTAARPVFGDAPVIATENGYHTALA

SEQ ID NO: 452 - protein, 328 aa, Methylobacterium sp.
MSCDTLSNLFSTLSVQVHAFAFCEIQAGWQLAKNGMPDAILVHYVLSGCGTIAVEGQEPLRFGPNCIIIPPRGMQHAIGFAGATRAVTADDARRVLPDGLIALTAGDGSRDILLACGSISARYAGALGLFDRLHDALVEDLSGSDRLRHAFAFMVEELVQPSFGTQEVTSALMKQCLAILLRVHLKEKGAQSPIFEALRDPRLVPAIAAILDAPGAPHTVDSLAALCAMSRSGFAERFSAIFDEGPIEYLQRARLQRAARLLTASPMPVKVIAESVGYASRSYFSHAFKAAYGCDPSAYRTRATRMVQALEPLPTRGAGVAGPDPGEA

SEQ ID NO: 453 - protein, 130 aa, Methylobacterium sp.
MAGRAADRFPQPVRVGDLPGRFLLQPEESQPVLGRVTGLVRRADGGTAVIVRLDGALGLTWLGLRPVAWSGIGPRLVAVPVEAVALLGEHVALMGLTPERLHALPTFATGSATAIPPDETLRVGIVRPFH

SEQ ID NO: 454 - protein, 371 aa, Methylobacterium sp.
LAAYLDRWSGCAHHALAASDSEPLTLTALLHFAGPEDRRRWREADLGYADPRGADWLRATVAARYRRLEADDVLISAGAQEAVTSVLSALLGPADHAVVVVPIYQPSELVVTRLCAADGVALRPDRNWPLDLDRLAAAIRPNTRLVLINFPNSPTGAALDRATLDGLIDLCRRHGLWLVSDEVYRQTDRDPERAVPPVVDLYERGISINGLSKGFGLPGLRVGWAACRDRGTLDRILAAKNLLSSCLARPSEILAQVALQAEPHLTRRARGIGQRNLHRLRALLDRHPDLFDPDEPRNLAFACPRFRGREGATAFARTLASEDGVLVLPSVLWHSGLASIPTDRLRLGLGRVGSGAALGILAVHLLRRAGR

SEQ ID NO: 455 - protein, 530 aa, Methylobacterium sp.
MADVLIVGAGPVGLTLACELARHGARCRIIDGAARPSPYCRAIGVTPRTLEVWEDMGLARDMIDAGLWLTGLRTILHGQPPVDAVSAPLDLPYASLGLPQFETERVLNRHLERFGVRVERGLRLTVLEQDAAGIRAHLQEANGAVAEAHFRYVVGCDGAHSTVRRLLGIAFEGEAYPWPFMLGDVHIAWDVPYGLAVRALRLNEDAPPDMFIAIPLPEPGRYRVSMLAPQHLVPAGGSDHGIQVELQGPSLADLQAVADDLLPDGSRLSDLRWSSVYRISMRLAAAYRRGRCFLAGDAAHIHPPTGGQGMNTGIQDAYNLAWKLALVLRGTSPEALLDSYEGERRPVGADVIARTRTASEGYGRERGGAPDRLADTQVLVSYRNTAWIADDATEPTEAGPRAGDRAPDVNGLVRDGLGFPTRLFDALRGTEHVLLIHAAGMSDAVAGPDLPIWARQHRPRVRVVVIGGDAAIPGVTTLADPTGAFDRAYGAGTMAWLIRPDGHLAWRGRTWREPGLHAHLRRQFPSAFPQ

SEQ ID NO: 456 - protein, 564 aa, Methylobacterium sp.
MSDRAVSYVHGAIGEPLLGLTIGQALDRAAAAWPDHLALIAHAQGVRWTWRELKDQADAFAAGLLALGLRPGDRIGIWSLNRAEWVLTQFAAARAGLILVTINPAYRLSELEFALNNVGCTALVTATAFKTSDYLGMLNTLAPELAASGPGRLSAARLPHLRTVIQIGGPPAPGTVPFDAVAARGDAAGTGALRDLADAMQFDDAANIQFTSGTTGAPKGVTLTHHNILNNGHFVGRAMRLTAEDRICIPVPLYHCFGMVMGNLAALTHGCAMVFPGEGFDPRATLETVQAERCTALYGVPTMFIAELDHPEFAQFDLRSLRTGIMAGAPCPIAVMRRVVEQMNMRDVTIAYGMTETSPVSFQSSSDDPLERRVTTVGRIHPHLEVKIVDPEGRVTPRGARGELCTRGYSVMLGYWGDAARTAEVLDDAGWMHTGDLATLDAEGYCNIVGRIKDMVIRGGENIYPREIEEFLFRHPQIQDVQVFGVSDPKYGEELCAWIRLRDGETLSEPAVRAFCAGQIAHQKIPKYIQFVDAFPMTVSGKIQKFVMRRCVEEQLGLARSETA

SEQ ID NO: 457 - protein, 1292 aa, Methylobacterium sp.
MLDMDRIGSRKGGLSVFGKATPCPAPCVAALAVAVIGLLAALGAAQWTRAWNGRVTAERFQVAAGRLASVIDGRMARYEYGLRGARGSVLSAGEAGITREGFRRYADSRDLGREFPGARGFGFIRRVPAAGEAAFLAGARRDGAPDMRIRQLQPHDGERWVIQYVEPMARNREAVGLDVASEDHRRGAALRAMETGAATLTAPVTLVQATGMKERGFLLFLPVLRDGAPAATPDERRAATFGWTYAPLIIDEVLAGVDLDADELDVAIRDVEPEGTTRFYAGRDATEVPPGGLAMTRRLSIFGRTWDVDVTARAAFLAGLNLVRPATVAAVVVTGALLLAGLVYLRLTGRRREVLAAVEKARLAAIVENADDAIVGKTVEGVVTDWNPGAERLFGFSPGEVIGRPAEDLVVPAHLRAQERDVLLRISHGDAVAPFATLRTRKDGTVFPVLVTASPIRGPNGAVAGVATVIRDITEQAAAEEHIRTVNASLERQVAERTAALQAGSALQRAVLDHAGYAVIATDMCGTITLFNPAAERMLGYAAEELVGKATPGVFHDPAEVERRAGVLSRELGRPVEPGFEVFVAKARRGQPDPGEWTYVTKGGERLPVLLNVTLLRAGDGTDLGFLGIAIDLSERYRHEAEMKAAQAGTWNYEVATGRVRFSAECARQHGLPERETEIDVEAEWKRLAHPDDVPHVLADLAQAIEAGGSYTTEFRVPLADGGMRWITAVGRVEADASGMTSRVIGLTLDTTARKAAEIALSEAKAVAEAARAEAERANRAKTDFLASMSHEIRTPLNAVIGFTDLMLASGRLDPGNRRQAELVRSSGNALLTVVNDILDFSKVEAGAIELVEAPFPLLAMVDNCVSIVRGPADAKGLEFRLRMDPDLPRWLKGDEHRLRQVLFNLLNNAVKFTASGSITLDVAPQGRISGGERVRFRVVDTGIGIPKDKQNRLFQRFSQVDGSIQRDFGGTGLGLAICRHLVELMGGEIGVSSVEGGGSTFWFIVSMPRASAPAEAPSPALPAAPRRTGRLLLVDDSLINQELARAVLIGAGHVVETVGDGQAAVDAVRDRAFDLVLMDVQMPGMDGMTATRLIRELPGPVSRLPVVAMTANVLPEQVSAFRDAGMDDHVGKPFDRDHLYATVDRWLARSGTDDVIPLPESASPEFDEDAWSAVRRYLSPGRPREVLALLVGELDTSFEGDAADQAVRVRLRLRAHSLSSASGMIGFTEMATACHALERFDEARVASEGVAAFAKALDRVRGLADRCARKAERMLEDMEGSPGLRTVCGRG

SEQ ID NO: 458 - protein, 412 aa, Methylobacterium sp.
MPLQPHETAFTQAPAPPRPVPVLPDAAAALAVADRLAEAFAEAAAERDLERRLPVAEIARFTESGLWAITVPREYGGPGLDSATVAQVIARIAAADGSLGQIPQNHFYALEVLRNGGTEAQKRALYGRVLAGERFGNALAETGARDHTRRTRLVRDPAGWTVEGRKDYCTGSLYAHRIPTLANAEEDGRAVAYLVFVPRDAPGVTLVDDWDGFGQRLTGSGSVLFERVAVEPDWVVPFQASLERPTAIGPFAQILHAGIDLGIGAGAFAATLPFVRDRARPWIDSGVARASEDPLTLHALGDVQVRLAAADALLARAGRYVDAAQEAPDADSVAAASVAVAEARAASHRAGLLAANKLVELGGTSATDRAEALDRYWRDVRTHTLHDPVRWKYHWIGAYHLDGRQPPRHGAL

SEQ ID NO: 459 - protein, 195 aa, Methylobacterium sp.
LQDASATPEIQAVDAPIAADEPAQAPDHSPDHSAEAAPTGAETVDAAMTGAAPGGASEIAAETAPDGAVDVPSDQGAAAAATTSEAEFEAESGPDTVIDIAPPPVPGAGPGLAATANRISFTPDRLDVVEIGSIIARYVRGEGEAAVAHLRALSGARSPADVIRLQVGEVQRAADASLTCWVTVVGQASRVVAYR

SEQ ID NO: 460 - protein, 200 aa, Methylobacterium sp.
MSAQHYLPKLRALRIPADARNSEGTVAWCDWCETVHSHSAGGGPRVAHCHRKESPFTAFGYDLAPVGWAPDAGAAVPAGLLVGRRRLSDTLDAAIPGLRTAFERCVVGRKRIGLARISVFGRQWSIEADVTKGEPASGWTTGVGLLGLLSALYGVRRGVAGVRLLEAITGEEFDASARLTIAKAIDASAARAAGSPGARA

SEQ ID NO: 461 - protein, 191 aa, Methylobacterium sp.
LAFCWAHVRRRFYELAKAGPAPIATEVLARIAELYRIEGEIRGRSPDERRAVRQDRSRPVVAALEPWLTTKLGLISQKSKLAEAIRYALSRWAGLSLFLDDGRVEIDNNTVERAIRPLALTRKNALFAGSDGGTGHWAVVASLVETCKLNGVEPQAYLTDVITRIVAGHPQSNIDDLLPWAYAPQPLRVVA

SEQ ID NO: 462 - protein, 656 aa, Methylobacterium sp.
MARPDLRALTDDGLIQLANAGLVKRALREVAAGQGPELAEAGDGTVEARFADGTITRLGPGRPPGEASCTCPASGMCRHRVALVVAYRAAPVADGLADGAAEGAAVPAAAPVAWDPGTLDGAALEAGLGGAAAAELRRLLAGGITVGLERGAVPAARLPTATVRFLVPDAVGYARCDCAAGGGCAHVALAIRAFRESAGAAEIRLGGAAPAGAEAKPVGTAETDLAEAADRVVAGLLEAGVVSGPEAHDAALVRLRRAAERRGATQLLLAEADLDGQVAAYAGRHAAYDAAVVLALATELLGRVRGGEAALGLGQPYETAMGKTRLVSLGARLLARGRGATARVALADTDTGALLALERAFAPGEAEADIAAGLPGRLLSPGLSVSGTGQGQILTSVARRRADGLLALGQGTRGRTALLPRDALVALPAPLAARDVPSILRRLADRPPVFLRPRDRLEAFHVFPVEAVLGQAWAPGAQTWQAAVALPGAGGTLHLARAYDPAAPHALDALAGACAGRWGPVRQVAGPVRIEDGTLVCDPWSVSVDRLVVPDLAAPDDAGHPIQPAPDLGPATLLDEAAALLANALHAGRRAFAASARAGGADLVARLAATGYPATAARLSAFLSATLAAPGAQSEPFARAALWVAAMRDDPGPEEA

SEQ ID NO: 463 - protein, 118 aa, Methylobacterium sp.
MAVRRIVTNIRATEVEAARSFYADVLGLEVVMDHGWILTFAAPGISATPQISVASAGGSGTPVPDISVEVDDLADVLARVRRAGLPVLYGPAREPWGVERFYVRDPFDRLVNIVAHLA

SEQ ID NO: 464 - protein, 344 aa, Methylobacterium sp.
VPGTTLLALLIHLDGSGAVTFLITIPAMLPLYDRVGIDRRVLACAASMAAGVNFLPWTGPMIRASAALKLPIPEIFSPLVPVQAVGLVFIFAASYWLGLREERRLALVPGAAGSAGSAPGPATTARTLSDAERALRRPDRFWINIVLTAAVLGTMVFLAEKVPPALMFMLGTALALVINYPQVDAQRQRVDAHARAAILMASILLAAGVFTGIMQGTGMLRAMAQTAVTFVPPEMGRHIPFGLGLVSMPLSMLFDPDSFYFGVLPVVAEVAHQLGVPPVQVAQGALLGQMTTGFPVSPLTPATFLVCGLTGIDLADHQRFTFPFLLAASVVMTLACVVLGVFPI

SEQ ID NO: 465 - protein, 445 aa, Methylobacterium sp.
MRTVRLGAGAGYAGDRIEPAVELAERGDLDYLVFECLAERTIALAQQAKLRDPEGGYDPLLEARLRAVLGPCRARGIRIVTNMGAANPVAAARKAGALARELGLAGLRIAAVTGDDLLDAVRAGDFVLEESGEPVASLGNRVVSANAYLGAAPIVAALADGADVVITGRVGDPALFLAPLVHAFGWAMDDWERLGRGTLAGHLLECAGQITGGYFADPGCKDVPDLARLGFPIGIVAEDGTVEITKVAGSGGRISLATCKEQLLYEVHDPARYIQPDVVGDFSDVEMEQVGPDRVRLRGATGAPATGLLKVSVGYVDSYIGEGQISYAGPGALARGRLALSVVRERLALTGVATTELRCDLIGVDALHGAALSGGREPYEVRLRVAGRTETHAEAVRIGNEVETLYTNGPAGGGGAWKSAREVVAVQSVLVPAALARPRVHVVEA

SEQ ID NO: 466 - protein, 114 aa, Methylobacterium sp.
MKLRALAHARTGDKGNTSNIALIAYDAADYEHLAAHVTAERVRAHFRGIVTGDVTRYALPKLGALNFVLTGALGGGVTRSLALDAHGKGLGAALLDLDIPDRSAGRAARGSPRR

SEQ ID NO: 467 - protein, 139 aa, Methylobacterium sp.
MLFHMVSGGPQPVAPFSHAVEVDGFVFVTGQMPDTPDRPGVLPDGIEAQTRNVMANLATVLAGLGLGLENVVVARAFLTEFKRDYAAFNATYKSYFPSDRLPARTCVGTTGLAYDALVEIDLIAHRGGATSPSSAARSG

SEQ ID NO: 468 - protein, 86 aa, Methylobacterium sp.
GAATGTVGGILGVDDRPRFRSYVRDRGVRSYSWGGPVRVGTVLPEDSVTYYDVPTEYRVRPGYRYTIVNDQPVLVDRGHRIVEVID

SEQ ID NO: 469 - protein, 52 aa, Methylobacterium sp.
MRIIGARVMAVAVMLLVMAVWRGLEQLGVASVVEGCLVAAIAATAATALARW

SEQ ID NO: 470 - protein, 301 aa, Methylobacterium sp.
VTRLQAATLATAFASALAATLLAPSSARAIDCRKAASPLERMICADPALRKADAALGAAYSGLLHSTDDAEIRAMLVASQKRWVAARDTWLGDLDAADARAVVLKAIRARTEDLSGRSKSDPARPHWIAAALRQRAFAARFTGGPFAGFDTACYFLPVGQDRVYGCFGSRRYQNGDRVCTLSDDWASGHTSETRTVARVVDGAARTVATCTIGGSDDAECPGPDNADGRWARPAAPAAAGAAAPAGPRPVLDVELAPDADAETWLSTCLTDPAYPPPDPVPAARTAPGSSPPAPAGAPSSR

SEQ ID NO: 471 - protein, 409 aa, Methylobacterium sp.
MRAAAPETPCLAFLEALPVAERWQRARDWIARAPQPFFAQLRARRTALDCGAAILVAGRAEVEEILSLPQVFSVALYKPKMGEFMLALDGTEVNYRDKAVMRAVLSWRDLPAIRDLAGAETDAALDAGLDQGGGSIDVVASVSRRVPLRIVQRFFGFAAPDADLLRWSYANQFDQFNNLPFDERPDADAIHAAADLARQEMRAAFARIIPARVAAIEAGADLPDDVLTRLLRLHLPAATGFGMDRVVINVGGLLIGAIETTSEAVVHALAELLGRPQILAAARAAARTGPAAFDGYVWEALRFAPIVAFMFRQAETDHVLGRGSPAESGIAKGRVVLPLSLSAMFDATGVPDPDRFDPARPEQTYLHFGRGHHECLGRYVAGAMVPEIVRRILLRDAVRAEGAVEDGVP

SEQ ID NO: 472 - protein, 88 aa, Methylobacterium sp.
MAKERPTLTSLSDRLARKVSTPAVEPVGPVLEAQPKTSKADERVQIIVRMTPAERKALRRIALDQDTTAQALAEEAIRDVLRRHGAFE

SEQ ID NO: 473 - protein, 125 aa, Methylobacterium sp.
MKLAMLACLAALCLTGPIAHAAPGETTRPAPAANGTHPPETAAPHPATAPAPGAAPAQAAPRAANSARAERRRRSYAACNRASHQRGLRGGKRRRFLIRCRLGYERTRVPGGQPAAAAPAQPGRK

SEQ ID NO: 474 - protein, 52 aa, Methylobacterium sp.
MQDERKTAAFQVRMRPSVKAAAEKAAAEESRSLASLMEYLLIEHLKAKGYLK

SEQ ID NO: 475 - protein, 71 aa, Methylobacterium sp.
VTFLMAYIAQTGGTLMRIRYLLPLVGLLALTACKDEKKAEAPPPPPPPASTAPANPAPPATTTNPAPANKP

SEQ ID NO: 476 - protein, 56 aa, Methylobacterium sp.
MRIRYLLPLVGLLALTACKDEKKAEAPPPPPPPASTAPANPAPPATTTNPAPANKP

SEQ ID NO: 477 - protein, 456 aa, Methylobacterium sp.
MASFQDFQDGYERTWASLQIRPEKLATVRKLAQQLAAGKPRYQEIEARTGVPWWFIGLCHYRESTFDFDTYLGNGQKLGRRTTIVPKGRGPFTGPQAFVEGAVDALRLQGLVGLGDWSVARALYRLEGFNGYGYHGRGVNSPYLWGGSTAYGPPGARGGKFVRDHVFDPNVVDTQIGTAVILRSLIDLDATVALAAPRAVEAAVSREPDDELADSTLWVQQSLNRLGATPPLVEDGRNGPQTMTAVATFQAQCGLDDTGLADARTIAAIQEALRPAAPDHAVLTRIQDLERQLAARAVTTMQPAPMQPASMPPVVIAPATPAPAAPLADVAARLDELLQALRRQIDGARLPTAPILPSPPTARPDGAVLGPVNGALGQTIGQLLSGRKSAIGIIGAVATQILSQVPLNTGLGQVLAQLTPAFGLSPYTMPIFIGLTAWGALGKFEKWNARAGQATP

SEQ ID NO: 478 - protein, 456 aa, Methylobacterium sp.; identical to SEQ ID NO: 477

SEQ ID NO: 479 - protein, 81 aa, Methylobacterium sp.
MFEQMVEAPRTVRRLEVITTASGRRRWSQAERRRILAEAMAPGAVVLVVARRYGMSPQHLFTWLREARQWKGSCLRTGSPR

SEQ ID NO: 480 - protein, 49 aa, Methylobacterium sp.
VRAEAAAANETETPREKLGQMEDKARSGTDLGEAIDRATAAVGQDDGKR

SEQ ID NO: 481 - protein, 367 aa, Methylobacterium sp.
LFGVSVDESVRSALLGGARVVFNLSGGKDSGGLSHAANAYLDEIGHPRDRRLAIHADLGRAEWQSTPATVEATAAHLGLPLVVVRRNAGDLVARWEKRFSNALERYEGLETYNLIGPWSQANKRFCTSELKAQVIGPHLARLFHGETIVQVIGIRRDESRDRAKTAISSLDTRFAKPGNRHGTTMMMWNPGVLWSRDEVLDCHARHAIPLHEAYTVYGSTRLSCAFCVLASIRDLEAAASAAGNRDLYLHLVKMEATSTFSFQPDRWLADVAPSLLPASLRAAVQQSKLDAAARRDIEEAMPAGLRYVNQWPPRVPTPEEARAIQAARTAILARHGLRNLYDTGEKVRDRFAELIAKRDAKAAAAAQ

SEQ ID NO: 482 - protein, 250 aa, Methylobacterium sp.
MTFTAHNIRLADGSETLPEAGWLIADSPWTQAALRSLRLFYGHRLAGRSIVDLGCLEGGYTLEFARAGMRATGVEVRRSNFENCLRVKDGAGVPDLAFVNDDVWNLAAHGPFDAAFCCGLLYHLDRPAAFIRLMAECVRDVVILHTHFATETNEALFQLSPPAENEGLPGRWMHEHDLDDTSQLEAHKWTSWSNKRSFWPTKPALIQLLKECGFDMVYEQYDMLGHDIRGSMESGYYHQQGRSMFVAMRT

SEQ ID NO: 483 - protein, 236 aa, Methylobacterium sp.
MFATSLALWVIAILLLLAWLHLQERVTEQCRRAIRPQIERLIIENRWMEHHARGAAAFEALWDRELVRLHRAHISRPLSAVVRFRGFRRLVRAEFASILPAEVASWTFVDRASPSQAHYEALMLRCLKSAGWRLDYQDQDHFVLLRARTRVVVCLHWTERDVACLPISDVAAAAERAGSTTACVMTNGRFSGAARAMAEEQNVLALHCSQIDLLLPRDKSTVAPRTVRETGFRLAA

SEQ ID NO: 484 - protein, 399 aa, Methylobacterium sp.
MAAAVFGAAALTALPASAQYADGGIKIGILTDMSGGYSDLAGRGSVTAAQLAVEDFGRPINGRKVELVFADHQNKADIASSIARRWFDTEGVDAIFDTNSSVAGLAVREVARSKGKIDINSGAGSMALTNAACSPTGAHWSWDTHSLAAGTAAALADDPKNTWFFITADYTFGHDLEAQVTRVVKAKGGTVLGSVKHPFPNPDFSSYLLQAQASGAKIIGMANAGADTINTIKQASEFGILQGGQRLGGLNIFLTDIYSVGLPAAQGMILTTGFYWDMDDQTRAFARRFGERMGGRMPTMVQAGDYSAVLHFLKAAEAAGTDDGLKVMAKMRELPIQDFFARNATLRPDGRMVHDMYLAQVKSPAESTGPWDFYKILKTIPGDQAFQPLSESTCKLVKG

SEQ ID NO: 485 - protein, 98 aa, Methylobacterium sp.
MPYMIETFDKAGSLDVRRANRAEHLVYLDKIKDRLLACGAKLNDDGSDAGGGLYVVDVETRAEAEALIHADPFYKVGLFERVEIRRWRKAYLDGRSYL

SEQ ID NO: 486 - protein, 268 aa, Methylobacterium sp.
MTERQTNPEAIVRRASHAGRRVLVTGAGRGIGRAIAEGFGARGALVGVADVNADDVAATVAAIEGGGGRALPLRLDVADYAAVEAALSEAAATMGGAFDTVVNNAGISPKHDGAAHRVWEMDPAEWNRVVAVNLTGSFNTVRALAPAMCAAGRGWIVNMSSVAGKTHSPIVACHYAASKAGLIGLTKHLAAELGPFGIRVNAIAPGRIETPMVRAVGRAVNDEQVRLTPMGRLGAPEEVADLALYLTSAEASFVTGQTVDVAGGLYMT

SEQ ID NO: 487 - protein, 609 aa, Methylobacterium sp.
MTDIPLASAPSAAPTAAPSAASSAFPRRGAAALALVLAALLAVPVAVGNPFIYHVFITICVFAALSTAWNIVGGYAGQLSLGHGIFYGLGAYCGMLLVGAGISPWIGMVAGAALAVLVALAISYPCFRLHGPFFSLATIAFLEVFRVLALHFRDLTGGATGLMIPLKFGWTWMVFRDRWPPLAIAFGLLLLTLAVAWWMRSHRIGFYLVATRERESAARAAGVRTVRVRLVAVAVSGALTAMVGTFHAMYLTFIEPAAMFSLTLSIQIAMFALIGGLGTVFGPLFGALLLVPITELARGWLGAKALGLHGLVYGLVLVLVVLFLPNGLMGLVSRFARAGAGGRGAQAASVPAVPRAPERPAVGADLVRVEGLQKRFGGLHVTNDVGFTLREGEILGLIGPNGAGKTTVFNMISGFLKPDAGTVSVRAPDGTWHRPGRPADFATLGVGRTFQIVQPFAAMTVEENIMVGAFHRHSDVREARAVARETAERMGLAPWLGSEARGLTIGGLKRLEVARVMAMRPRVLLLDEVMAGINQTDVRRAIDLMLSIRDTGVSIIAIEHVMQAVMALSDRVIVLSSGQIIAQGSPQDVVRDPAVIEAYLGKEFAHAHA

SEQ ID NO: 488 - protein, 336 aa, Methylobacterium sp.
MGMRAVIADGQGGPEVLRIVERPRPEPGRGQVLVRVEAAGINRPDVMQREGRYPPPPGASDVLGLELAGIVEALGPGAGRFRTGDRVMALVHSGAYAERAVVDEAVALPVPEGLPAVEAGAIPETYFTVWSNVFERARLQAGESLLIHGGSSGIGTTAILLAKARGARVIVTAGSPEKCAACLALGADTAIDYRREDFVAAAKAATGGSGPDVILDMVGGPYIARNLDAVAVDGRIAQIAFQQGSRVAEIDFQPLLMKRVTLTGSTLRARPVALKARLAEALAEHVLPLLAAGRARPPIDSVFPFERVAEAHARMDAGQHIGKIVLSMGDAAQGSR

SEQ ID NO: 489 - protein, 120 aa, Methylobacterium sp.
MTYVSGFVTPVPDANREAYVASAGAAWALFREYGALHQMEAWGDNVPEGERTDFRRSVALRDGESVVLGWILWPDRETADRCEAAMRTDPRFRDLTMPFDGSRMIFGGFAAVFEASRGAA

SEQ ID NO: 490 - protein, 104 aa, Methylobacterium sp.
MPDLAEVELYCAEARDILAHAENIVADLDRRGACEGHCLMANQGLAALRNLDRIIERHRRRLTFLALPNAVGPSPPPSPPQKRNWLLFLRRRGGYAGHGIEAHS

SEQ ID NO: 491 - protein, 384 aa, Methylobacterium sp.
MGLSHHRIGILFSAHGPYGLVGRAMLNGALLAVDEVNARGDCVLEPVIRDPHGALAGYVAGAEQLLDTGIRHVVGCYTSSSRKEIIPIFEKRDALLWYPSHYEGFETSANVVYTGAAPNQHIVPLVRHLLAGGGRTAFCVGSNYIWAWENNRILRETLAIAGGDVAGERYLAVGETAFDQVIAAILAAKPDFVFNTLIGISAYRFFRDFRSACAARGIDQARTMPVASCSLAEPELEAIGPEAVDGHLSSSVYFTSIDTPRNRAFMAAYAARFPEGPTPSADAESSYIAVHLLARALARSGTEDAATVRRAACADAFEAPQGPVRLDETTLHACLTPRIGLSTAAARFTIVAQAEEPVAPDPYLVRSDPRVVPVSRRPRLKVVP

SEQ ID NO: 492 - protein, 213 aa, Methylobacterium sp.
MTTPRLIQNFSGAQALLIAPPSTATDVLASTLMKLGLTVASVVPAGEAPWLDFEILDPEHHIVIVDGDLPLPGLAASAVPDLPPVPVVGLVGVEAPSRLKGLLQLGATGLLRKPIHGASVYAALFLAVNEHNRRRLLEERLARLEERRRGRRHVVKAILRLMQEHGLDDDAAYETLRRDAMRARQPLEAYCEALVRARPSVTAPAAAPRHARS

SEQ ID NO: 493 - protein, 253 aa, Methylobacterium sp.
MDLGLRGRRALVTGGTKGIGGAIVDLLADEGAAVALCARNAAEVAAKVAALRARGVAATGRVVDVADSAALRGWVAEAAEQLGGLDIVVPNVSALAVGSDEAAWRSGFAVDMMGTVSAVEAAMPFLERSEAGAIVVISSVSGREIDFAAGPYGAFKAALIHYAQGLAFQLAPRNIRANSVSPGNTYFAGGVWHQIETGNPALFAEALRLNPTGRMARPEEVARAAVFLASPAASFITGTNLVVDGSLTRGVQF

SEQ ID NO: 494 - protein, 48 aa, Methylobacterium sp.
MIASFLAIFVAFAACQALLTVKFADFLSADRTRNTVEPPADVANAKLA

SEQ ID NO: 495 - protein, 32 aa, Methylobacterium sp.
MKLKALSYVMIGAFVTGLLMTFVGSATALLGQ

SEQ ID NO: 496 - protein, 232 aa, Methylobacterium sp.
MIGPAVTALAAAGPAAPGAGPPGRGPPCGPVPGCAVFGSNFAPDVPDAAVEAVDDEADAPVRPSEADDAAPAVTGSGFALADWAAGPVDGFRPSVPEAGGPASDFGSVVPGLAATTGSVAGLGGVPGTGPCGPFAPPAAVEEVEADMDADVEAVDADVVAGRDAPPDGVGCPGLPGAASGFRPPGPGLSASLGGGVTGKSSNSSASPRPPSTAAAPGARARYGGPASLSPRG

SEQ ID NO: 497 - protein, 249 aa, Methylobacterium sp.
MLELSLDADTIDAQAPRLPDSVQYHLGHLLAATYAQDNVEPTIADRFAELLRLLDGAFGRAQYGREKAFQASLLALVPNLQRFARSLLRSHVGADDLLQNTLLRAWRSRASFAPGTNLEAWLFTIMRNQFYNEHRKRGREVQDEDGAQAERMVSLPEQGGHLDLSDVQAALDRLAPPMRQALVLVAIENLTYEETAAVMQCRIGTVKSRVWRARTQLAEMLGYTGLEVGSDDVMLAAAGPKGRKSTAVS

SEQ ID NO: 498 - protein, 436 aa, Methylobacterium sp.
MPRLRWLMIGLCMAANAINYIDRANLAVAAPSMSKELGLDATDMGLILSGFFWTYAIMQLPFGYVADRVGARLSLVVAVVWWSACTALTAVGRGFLSLLGLRMLLGIGEAGAYPSFAKVAASWFPRSERSFASSIFDSGSRVGSALAIPLVSWVIATLGWRESFVVTGVLGFVWAVFWMWLYREPENHPKVSPEELARLRAAQERPKTVDAADAQNQVPWLSLFSYRTVWGMMAGFFCLNFVIYFFITWFPTYLVKARGFSLAELGTLGSLPALASIPAGWLGGFASDALYRRGWSLTAARKTCLVGGMLMSSVITLSIIAPNIYVALLCFAVAYGSLAFTAASIWALPGDVAPTPAHVASIGGIQNFASNVAGIVTTTFTGVMLTVTQGSFVIPLIVAGGFCLLGAFIYLFVVGEIAPLPVRDARAPALRPEAAR

SEQ ID NO: 499 - protein, 215 aa, Methylobacterium sp.
MAAITAAAQKAPPGEATALTPARDVKPVTAPDPRSIYTLTPEAAGAVFALVENRIQVIDAALDVTDRRGTQAVAAAMATATATTPVVSPETTKTIGAANRNWSEDVRLDHGPSRLVGADTAVAYDSPRVTAAWSLAFPDVAGRRFRAVQLPGPSLRSVLHEAEAGLDDTGSDIYLLCNSAHFETIRQAHPRTHINWINVDNDEIVVVWRKPSEEG

SEQ ID NO: 500 - protein, 58 aa, Methylobacterium sp.
VGRCRVCGLAYGGILGREAGVIRLDRARWRRLCPGAAWLTVPAACAGLRASFGGGAGS

SEQ ID NO: 501 - protein, 101 aa, Methylobacterium sp.
MIEQGPRIAREFHVGVGGDRWALMRDLQTGQPYVSHSPGDDAPEVQLDLGSFLVLFTGEEREKLLRLIGSLLPDEDARADADGRAGTSRPLTFVSRWLPNR

SEQ ID NO: 502 - protein, 83 aa, Methylobacterium sp.
MDNQRNARRVSVNLSGCISVAGHPAIPCVVHDMSRWGVRLRLVGTERVPPAFTLTIDATDTVIGCETVWKNADEIGALTDLME

SEQ ID NO: 503 - protein, 386 aa, Methylobacterium sp.
MDINSFAVSPLDYGASVNADPETNRVAFQNAINALQAKGGGRFVVPQGIFVVNAPLTASLGQNGSIFMEGADTNSTITFTGGAQNGLVVDAGFIKLSGFRIVVSAMPNIGQGSACYLRNASALGGSFQNIVVEDMRFEGRVDARPSYFLAVNGPATSRIRGVTVVGFYNQSFPVDSTGIYIFGEVSPSGGASGDWSCEGCTVIGVGTAFLVNEGAGPGQATVEGSSFTDCVAVGVQVGLHMVGNGYQVPGHSWKGGHINAAAVCAQFDSISQFEIADCLLYLDAGGANKQGFILFNGCTQMRARDNQMIHIAQTGDTGGGVYGVAFANGTTASRAQNNDGIGFPGGSAVIYNQSGGNNRAGGNGRGGQGALLVGGNLIDLGGNHVF

SEQ ID NO: 504 - protein, 432 aa, Methylobacterium sp.
MQPVPLPHQIVGAQFLANGGLLLADEPRVGKTGASILALDFLMARRVLVVTTASGRFNFSREVREWQAFPREVQVMMGTAGRVQPQTDVAVVGWSTVGNEQQQAHLLDWRPELVVLDESHYAKSFEAKRTVAAMALADAADRTFCLSGTPMPNSPLDLWPMLRTLAPERVSDLSFDDFMGRYCVVRHKFVAGEWKPIVKRGKNEVELRQRLDGLLLRRTQQDVGIREPIFSTLALDGGAVGTAAIRAALAELPEADEILDAAETGDTKALEHHLGTLRRVTGIAKAHAVAELVKEEIETGKMQRVVLMCWHTGAIEALRGLLKAYNPVVLDGSTPAAKRAGVIEAFQNNRSQVFIGQIIAAGEAIDLSVSRDLIFVEQSFAPKDMKQAALRITNHGQKAQCLVRVAALAGSIDEALTAVLVRKVASIKEVLQ

SEQ ID NO: 505 - protein, 126 aa, Methylobacterium sp.
MRVLICGGRDLDPALVWNWLEAHATEECADALGRAQHVLISHVIQGGATGADSGAAAWARSSEIPQSCFPADWDRYGRQAGPLRNTQMLAEGRPDVVIALYPAGAGTADMVRKARAAGLPVVEARI

SEQ ID NO: 506 - protein, 70 aa, Methylobacterium sp.
MTDEQKGYLQALSDMRSWHRWEIGQALGDVRRMEPHEKAIAWLDELIATKKRHAAEDEAELRRGEPAPKS

SEQ ID NO: 507 - protein, 188 aa, Methylobacterium sp.
MSDAISSALSAGTIGSTDATALAGALSSIDGSLSSTSAASTSATSRSGLDPSSMKDRIDGLIADQVSSGSLTADQATELKNLFASPGRSTQSADATGDGTGAVAGPDGSPPGPPPGPAPTDAAGSAGSGASVSASASTSTTDAARTTNDLLSTFIQQLQSGQAGSVGYGASGTANSGAVSALLLDFRS

SEQ ID NO: 508 - protein, 148 aa, Methylobacterium sp.
MKSTTQQDQLEIVSALAASLADRMLMERLTQGKLPLANASRLWTASLLLEEHARPIPRIVTDVLEQVRHVEPDDDAADGDDADGIGAGPQPDLAAARRPARPARRRGLTRLLRPFRQAAEACPASTDAPGDGAGPSGGSGVPRARPGR

SEQ ID NO: 509 - protein, 106 aa, Methylobacterium sp.
MDKVYAGDRTIDGIVVTVNGAPLPDRAEAKCYSRNGFEWSYEGPEPSQLAYAILVDHLGDAAEAERLQPRFMRGVVANFQNEWEMTTADVARVLEHLESGGAARSG

SEQ ID NO: 510 - protein, 71 aa, Methylobacterium sp.
MPFPIKFGLSVAVALAALAGWFYMGHLGQTGPRWAVAFLGPFMVVSLWIFPEVMRNRSDGRTPRHRIREAR

SEQ ID NO: 511 - protein, 129 aa, Methylobacterium sp.
MDMIEPNVAALAWFALFAGVACTGFYVLAGMFPLETRPDLRARPLGLALIAANVLLLAALTGGMLAYGVTELRWSSLVIVGGFAILFAPGLFNVWPQRWRDGVAGLAIVLAALCGALGLLQQVGAVFVL

SEQ ID NO: 512 - protein, 263 aa, Methylobacterium sp.
MELANTRMSERQRNYRANYRQRVAGWYNGFLHIAIIYTIGLTALYIYVSNIHAPSWIELATVPVVFLFCNFFEWWLHRYVMHRPQSNPIGRAVYNRHTLQHHQFFTDHEMRFADHRDYRVTFFPPYALATFTLMSIPGAIVLGNVFTPNVGWLFITTTTSIYMIYEFMHFCCHVEENWFVRNMPFINTNRRHHTAHHDQSIMMERNMNLTFPIMDWLFGTSDLNRGLIGTLFNGYDTRHVKTDMRKTARTPGAPEPRAMQAAE

SEQ ID NO: 513 - protein, 221 aa, Methylobacterium sp.
MRVLVVEDDAALARGLVAALRHGGYAVDHEADGADAVQLALSEPYSLIVLDLGLPGLPGFDVLKAVRAAGSTVPVMILTARDAISDRVRGLDLGADDYLLKPFDLAEFEARVRALVRRGQAVPNPVLRCGTLELDRAAGTVTLGGAPVALRRRELAVLTILMTRAGKPVPKERLSAEIFGFDEAVAPNALELYVARLRKKLQPDGPEIRTIRGLGYLLMPV

SEQ ID NO: 514 - protein, 105 aa, Methylobacterium sp.
VRAEIREEIRVAARGRDPCFIRSAWRRSMPFANFKIPQGMMTGPQKADLIHRTTDLLVAYFGEAARPHTMVLVDEVVDGGYGRADEVFDLEALRRLRAHHETGSR

SEQ ID NO: 515 - protein, 364 aa, Methylobacterium sp.
VSFSALMIAPAAQAASTLEAALRAVPDSVLATPDPMPIVFMDVQALSRATGGALSDAGLRRMAFPQSIRPLNALGYGGAQTWTEKAGIPFEDISYFAAFGQPPARVTYWGLATKAAADTLVAKLKDRNFRPVSTAPRILANGEPRALNLKARQPTDPWSGPMGETSAILAIDRVIAQASAAADLETRVGVGRSAADHEAVATSLTGLAAADERDPGAILQAAVVTPLMGITPDDPAALLSATTDLVAQKKAIEDQRERGRDGVPAYAGGIVADYQGKNGPALLVSLAYPDCRTADRAVSALKARWQAGMTPAASVDGRSVESPQRGCAAVLRVDRAPGANSPFGEFLGTYMQRGFNVLQIGSQR

SEQ ID NO: 516 - protein, 91 aa, Methylobacterium sp.
MAGEAKRAAPKRRGDDPDAARAEGEKVGARIDAAFEKLAGKLRARADRARAKLDAATKAEKRAVLLRRYELYADAAAYLEERLVDRGGRSA

SEQ ID NO: 517 - protein, 75 aa, Methylobacterium sp.
MLPTDLDRPAELTLWPGYAPARVAVSHSFPTLRAALAAAVAAIDAEDANPWIITEGGDILAPGWIRANTAGAVLQ

SEQ ID NO: 518 - protein, 319 aa, Methylobacterium sp.
LFSTADFKPKDSFRLWRETIFERIVPVELTPAAAHAFTGTLEAAEVGPLLITRVTQSAITTVATPDTIRRHGKYETLNVAITLKGRVFSAQDDRTAIQNPGDIVVMDRRPATMASDVDTQTLFVELPRESLERALGSTRRFTCLTIGADQVGTSMVTTFFQELVRNAERLTPDMSNRMASVGVDLIVASIAERLAHETPKNIQGVLIFQRALAHIEAHLGDLNLDPAGLAAAVGVSLRHLQALFREQDRNIADWIWRRRLETAAQRLADPGFAHLAVGELAYSCGFCTQSHFSRRFKDSYGISPSEYRWRNRGADQLAG

SEQ ID NO: 519 - protein, 134 aa, Methylobacterium sp.
VLTAGLVAAYVSNNRVPTADLPTLIAQCHDAITALAANGAASIEAAGDTDALRDRPTAAQIRSSIRPDGIVSFIDGRRYKTLKRHLTAHGLHPQSYRERYGLPADYPMVAQEYAERRSALARSIGLGVPGERAA

SEQ ID NO: 520 - protein, 74 aa, Methylobacterium sp.
VIGVVGLRAVDVLGLFVEPAVICLLAALVITWALRWILDWIGINHLVWNRALFDFSLLTAVTALLILSLRVQGP

SEQ ID NO: 521 - protein, 618 aa, Methylobacterium sp.
MAGEVALSEDAPGLLQRLAAWWPREAAEAVRIALTAIAAIWLAMWLELALPHWAGWTVISVTLATRAASLRKSLWRAGSTLVGVTVAMVLVANFAQATLAFDLALALWMGLLTAASSVESGQRAYGFASMGFTVPIIALADVQNPEAVFQIGVDRCSTILLGIGCAYASNVFVAPGVPAVSRALAGRLEAAAEACDAWMAALRRGERPGPMPIAAVMTLGEEVTDTFTEQPSLRSGGRGIRNAAPRLRRVLAAGLLRALLPDRPGSRSTDLIGAGGAIAVRQVGRVRVSARLLRAGGRVGRRRVPFRPHLLLWNDLDWDGWHAFDNALRTAAAVLLVNGFWYVTGWSHGAGAATWASLVCVLLAAHADPRAESRAFLVGALLAGVVGLTVRYTLLTATGSFALLAAVLLPVAMLAVVGRADKRAIYGIGFGFFVFGVLDPKNPMTYDLADSLNTVLAELLGMAVAAIAFAALPPPVSAATLRLRARRRLVRSVRGAALDPGLLLPPLDRYLARGFGRLALIGADEEAARSGERLLVIGLLLLALRETDDREGRRVGRAVWARLAASRPAGPETAPDPLRALADRATLPLQAERIGALAALVSDLDRAGWPNLDPGGRA

SEQ ID NO: 522 - protein, 132 aa, Methylobacterium sp.
MIRCVRIWTGDDDNSYFEEGVIDLPHGERGDILSGTTDVVSISFRETQAGGTYAWHAAPTRQFVITLRGTLDFQTRAGAHFTIRPGDILIAEDTAGSGHSWRLVDDEPWCRAYVILAPGAEARLPFVPNKTA

SEQ ID NO: 523 - protein, 76 aa, Methylobacterium sp.
MQDSIDTVRELSAAELDQVGGGLGVGLTVGLGVDASQELGAVSGVVGQVGGLVSGLVGSVLGAVGGVVGGVTGSLR

SEQ ID NO: 524 - protein, 137 aa, Methylobacterium sp.
LRKNQDQLEPTISDVALRVVTAYLSNNALPHTSIPPLLITVHGALSALTDRPAVVEAPPEQPDAAQIRGSVRQDGIVSFIDGRSYKTMKRHLTAHGLTPDLYRARYGLPDDYPMTAPGYAERRSKIAKAIRLGRKAA

SEQ ID NO: 525 - protein, 116 aa, Methylobacterium sp.
VLAALLGGLLAAPFAHGQGTDDLEAEMRARVAAAFPDAGLVTFRKIRPIPAEAESGVAFCGQVSSGPVGQGRSDFQVFLYDRTASAETVRILGSESLNGYRVGRKLIGALRRVGCL

SEQ ID NO: 526 - protein, 90 aa, Methylobacterium sp.
MEVRMCARKTFYIFVSASDGEQFCAVRQDQPIPSLIDGVRWMYVGCIDTTRDRPYGFDVDAAHAAMRHRSVYFYRRELMFRRANFLLEAA

SEQ ID NO: 527 - protein, 223 aa, Methylobacterium sp.
VLWFLVALGLVRVVDAAARAATFPGGYWIVLGGALALSWTCSARVFPYWQVHALVGALPFYVAGLRLGRRAFDVSALLGACGLAVLLLCAPRNFVHVATGQYGDPALFAVTAVAGSAFALAVAGRLRGPPRAAAGLLGRASFELYIVSGYFLLLAPHWPAWDRWDRLVLLAAIGLPLHLIAARGLRGPIRAVRAAADSVVDGLVGGLSGRRRRARPGLSGADP

SEQ ID NO: 528 - protein, 72 aa, Methylobacterium sp.
MTAPQVIATIFFLVSVGSATTLALMAAASAVLDAVAETCDRARPDAGRDRSRRVTEAACRLRRAALARAAIP

SEQ ID NO: 529 - protein, 73 aa, Methylobacterium sp.
VQHLFQAVAIFAFGCLLIHAGRAYARATTLLLSATALMLSVTLGTVLCQRIGLTGRSVAAGPSYTVALGRPAP

SEQ ID NO: 530 - protein, 47 aa, Methylobacterium sp.
MTAPLLISVAFAAVTAGAATLWALLVANGMNGVTESRPTERHDIRTW

SEQ ID NO: 531 - protein, 270 aa, Methylobacterium sp.
MARRPTYHNDGRGPEHLIMRGTLVVATLLAFSAVPAAIAANPVRDVLWVALQGCVLAKKAAGRSFPCLAVDLGDAARPGTAVLRAPGQPTHTVVMPTDSVSGIEAPVLQGPRGAAYWRAALAARHYVSDALQGRLPPSAVGLEVNSVGGRSQDQLHIHLDCMRRSVTAALKAHGDAVGDSWAPFPVPLAEVSYLAMRVPADAVEAFNPFAALARVPGWQGHLHDASFAAVEADPGDPRGGMILLAYREPEASAEYLMDHGCRVARHGRAG

SEQ ID NO: 532 - protein, 101 aa, Methylobacterium sp.
MPLTGRFWFRRTWTGKLVLLVEEERGRWFRRRLGRTLRWRDARLLDLAEGPLRGLMTLERTYRAEFGPGEPRRPAGLTAVPGGLALPRGGPEPGTRPSLSG

SEQ ID NO: 533 - protein, 74 aa, Methylobacterium sp.
MTERDPYRHEDPIWYDRIEADEPPGLILDLLAHVFVPIMAALGAVRALYWLPTRLWGRASRSLLRHRTTAAKRP

SEQ ID NO: 534 - protein, 66 aa, Methylobacterium sp.
MSDAPDPKRKTIADSVLVRLSTFALGIGLYEGIAQSIVEKAVADMPEATVEQIAAAAQMMMLFVSG

SEQ ID NO: 535 - protein, 40 aa, Methylobacterium sp.
MDRFLTMIMVAGGVATVVWIAAMLVVGWQMAVVLMGLSAV

SEQ ID NO: 536 - protein, 38 aa, Methylobacterium sp.
MTKPITLTNRLVDAVVTAAIAFSLVVHAQVMILPPHFV

SEQ ID NO: 537 - protein, 36 aa, Methylobacterium sp.
VTLDSHRPGDVPRARGWRVMVPGGGIVVTVCEAEPG

SEQ ID NO: 538 - protein, 148 aa, Methylobacterium sp.
MSKLSLSLNAVRPGADDHPRPHVALRDEASAIAAAVRVFEDGLTDLRAGVPVADDAASAAAAADAATGLLAGIAGQTSLMALRAAIEAARDGGEGRGFAAAAAEVRDLAGQMVRATDTIVAQVGQIQAAAERAQDTATRGQRQAASAH

SEQ ID NO: 539 - protein, 95 aa, Methylobacterium sp.
MSARDAADAGRRHWFYDSRILVCTFCLLAVMVIFWQVSRFEGFQPIFTCARNQDVDRDLLSVGMRACMGDAPSQAAQARCMHVVYLLACTDERWR

SEQ ID NO: 540 - protein, 90 aa, Methylobacterium sp.
MTSTALAVMMAGVLGAFCTIVFAVDWVPGSVVGLPNLPSRRVIGLWVYNGVLCLALAAWLVCTYFCTVDGYEDIPAVRDSYCRPHATVGA

SEQ ID NO: 541 - protein, 81 aa, Methylobacterium sp.
VIPMSGGMLGSLALAAVFTLGCFGIHSARRHPDAVTIGLFLLLGLLASLYVGRHVGPDVHQPTWQHEALYRESAPTSHPTM

SEQ ID NO: 542 - protein, 63 aa, Methylobacterium sp.
VDPQPFTIDTEAQAQTYLTDLLNNPKNRSMSEIARHCALRVRNPKIKAFFLTEGAKMLAEMKA

SEQ ID NO: 543 - protein, 50 aa, Methylobacterium sp.
MLARPFRLFAPALAALGLVALRLASPFIGPVSPPQAGATDDAGVVFRHYL

SEQ ID NO: 544 - protein, 221 aa, Methylobacterium sp.
MSVNTVSGSSLQRDLVSALRQARAANAARLDVGTAATANQETGKQAAADDTAPSTGTASTPTLSNDLMASLLQLQSDFSQMGLQNGVTAPAEAAANADDSSTTGTATGAAPGQAAGGAPAVHHHRGHHGHRPVSDAEQSEGAAQAGAAADASAASSAISSASTSTSTSASTSATASTDPATATGSGSDLQSFLQQVTKAVTAYAAGGPLGIAAALTSTTKA

SEQ ID NO: 545 - protein, 73 aa, Methylobacterium sp.
VPSRFYFDIENGEETIRDAQGVEAADLAEALAEARSVIDEMAGELEAAGPAGAWTLVVRDATGAEVGRVPIKG

SEQ ID NO: 546 - protein, 75 aa, Methylobacterium sp.
MPLSQNVPHAARQADAMAAQMALAAHALRMRGDVGAAESLLAMARHNRILALKLRIAQELAPGQGRAERRATAGR

SEQ ID NO: 547 - protein, 71 aa, Methylobacterium sp.
MKSCNVDAGTQRLSGAARKSFMADCLAGKSAAPAKELTPQQMKMKSCNADASAKSLKGAERKAFMSTCLRG

SEQ ID NO: 548 - protein, 62 aa, Methylobacterium sp.
VLVVLLVSVGLMIAALAGLMIWQSETAPPDYASQSQAAARKAVTGSESGSVGAPPAGTRSAP

SEQ ID NO: 549 - protein, 65 aa, Methylobacterium sp.
MRGKDGPDKPPTEPAPAARPRGFFRRVLDGLEAVELLVQAGRLVWWLLRGLWLAAGAIVRLFGDR

SEQ ID NO: 550 - protein, 403 aa, Methylobacterium sp.
MQAHFAGIDNPNPMIGPARLIRAAFEGADMAALAAEILAEGGDSALDAGTALDMATILLLKHRFTEGLALQSEVLDGQRVFSLRSNPDQARIRVLVLVTAGDLMANTPIDFLLNDGDFGLTYLYLRPGEPVPHDLPAHDVIVTGIAYARTAEPLLEALAAAADQWTRPIVNHPRHVLKTSRHGIADALRGAKGILAPDVVRVSRSILSAAASRIAEGPTYPLLVRPLDTHAGNDLQKIDRAEDLHLYLAQTDAEAFYVTQFCDYRGPDGLYRKLRVVLIDGVPYLCHMAIRDHWMIHYLNAGMLEDPVKRQVEAAAMATFDTDFAERHRAAFAEIHRRIGLDYLIIDCAESADGRLLIFEADTGMVVHDMDSEELFPYKAPQMRRVFAAFQDALRGRVRGRTA

SEQ ID NO: 551 - protein, 165 aa, Methylobacterium sp.
LAILFAGIALISTAQGGLSLRQLAGIGEAATALARDWVPSLEKVGAIEVAASEVRIKQFRLVLLSDTSEHRDANEAALAKTHAQLRDARRAYEPLITTADERRHYDAFHASWARYAEVDREVRRHVEAGRRTEATALLVRPDVVALDDGARAALARLVDHDETSA

SEQ ID NO: 552 - protein, 39 aa, Methylobacterium sp.
MTEAEVGPEVGAEAEAVERHKAETETAAGDVADDLADFA

SEQ ID NO: 553 - protein, 233 aa, Methylobacterium sp.
MGKRFTATLAVLLSLALPVTAATLHSTYIDPAAMALQRVLPPPPEAGSEAAKVDMQAVETAVRARSPDDERRIIANLPCTLDRFTGVLGPTFTAETMPVTAALIEHVFQDGELAVLAAKAAIARPRPYTVKPDLATFGHRSDSTSYPSGHATFGYLAATVLSRLVPGKRQALFAFAASYGENRMIAGTHFPSDLEAGKIAAAVIAEVLFRDPRFERDLDRATAEIAAQGASGR

SEQ ID NO: 554 - protein, 265 aa, Methylobacterium sp.
MILSPLNALFVGPLEGYRDRIVSAEDPRPSVRGADLLDPRVLTDQLDRFARTFAAPEPRAVASIWAKQHFSMLVVPALAANIVLDLVLPVALDAVEIVPDDGGLTRALKLRGPAAGSDRSGGQTGERAPADRFGALIDAHLAPLVGALAAVSGVAPRVLWSNAGNIFEFVVRRTEGLPQAGRTGHAAAASVLTSRRRSGAPNPLFAPIRYVPEAGDAPAGAPPRRVRKVCCLRYLIPDQSLCGACPLPARPEAGPAGTHGPRRPA

SEQ ID NO: 555 - protein, 97 aa, Methylobacterium sp.
MRKLALISAVTLSLGALGATGAQAQGYGYGYGGHHGYGYGYGRGYDRGYGHRRDFGYRRHRGLSTGAAIGLGIAGAAAGAAAAGAFDRGPGYYGRGY

SEQ ID NO: 556 - protein, 59 aa, Methylobacterium sp.
MSALVTFVGCGLVLAGFAAEKFAEHRWLAASRPAPLDTLAVLALALPAVGLTLMATLAV

SEQ ID NO: 557 - protein, 54 aa, Methylobacterium sp.
MLDVAFWWCVAVALTGSVGLVGLAVVAGRSGRSQPRGLKLSRTEPLVLRHFGRA

SEQ ID NO: 558 - protein, 65 aa, Methylobacterium sp.
MHFEIRATDTRLWTWVLLDATQMPVLTSDRTFPSEAQASAAALAFAKLVTRAGRTLTAAPPGGLI

SEQ ID NO: 559 - protein, 175 aa, Methylobacterium sp.
LRAAGYVGAWTADVSAGQSLLDEGTAALLAGDATLAGRPLPIEIALRCTHPDDRDWVFARIARVRQTGGPVSAEYRVLTDGGEVRWVLDRGSLTPDPAGRMRGRGIIIDTTDSHRGPFLPSAAGDLPADDPMVLAIDHLLQARAAIVAMGHQRLQQVSDLALFEVGRALARRARA

SEQ ID NO: 560 - protein, 160 aa, Methylobacterium sp.
VLAAALVTALAAASTARAEPANQVLGTWRMVSARLDPEGRNAPAYGARPSGLLVFTRDMHFVEVLTDADIPRFASSARGQGTAEENRAAMAGSIGFFGTYTVDADGAFSGNRVEGSTFPNWVGDVRTTEQLRLTVEGGRLSESFRRPDGTRIAITWERVR

SEQ ID NO: 561 - protein, 100 aa, Methylobacterium sp.
VIRTDPDFEHAVIGGFKLVEDAYARGIISWMRRCALRDLLASGESELYERRTYVTPHSDPDAIQIGVYLEPTSAFLIELGLLTPEMTAPEQADSGADRER

SEQ ID NO: 562 - protein, 544 aa, Methylobacterium sp.
MRRDEGDGRTVSDGIQHERSPMRRREVLAALAAAAVARPAVAQPAKVLRFIPESDVAVIDPIWTTATVTRNHGYLVFDTLYGQTAGYEFQPQMVEGHAVEADGRLWRLTLREGLRFHDGAPVLARDAVASVRRFAARDAFGRALIDATDELAATSDRVVQFRLKRPFPLLPAALGKTGTSMPCIMPERLAKTDPNTQVTEMVGSGPFRFKADERVPGALTVYERFDGYVPRPDGAASFTAGPKRAHFERIEWRIVPDASTAASALAAGEVDWWQNPTPDLQALLRSRSGIRLEVLDPAGGIGCLRFNHLHPPFDNPAILRALLGAIDQTEFMSAVAGDERALWKDHVGVFSPEAPMATRAGTDGLVGPRDYAAVRRALAEAGYRGERVVMLDPTDYPATHPLALLAAEAFQKCGLAVDLVAMDWGTLVQRRASRQPPDKGGWSTFVTYLNGTNNFDPAGQLGIRGNGDQAWFGWPRAPRLEELRAAWFTAPDSAAQKAICAEIQRQFFIDVPYLPLGAYYEATAYRGLTGVRNGFPQFYDVRPA

SEQ ID NO: 563 - protein, 393 aa, Methylobacterium sp.
MRTAPAFSSRHLDRLGDRLTADVDSGAIAGADMLVGGADGAIWRRTVGYRDRVAHAPLGPDALWRIYSMTKVVVSAATMVLAERGALRLDQPVAAFIPAFEHLSVLDPDGGLRPARARPTVQDLLRHTAGIAYGYLGDGPARRAYAADGLLAEDLDNAAFADRIARLPLEHEPGTVWHYSHATDVLGRVLEISGGADLQRVLDATVLEPLGMADTLFQISAAMGSRVAQPLPQAPGQRPVFHDPAQPRRGQRGNGGLVSSTADCARFLRMLLAGGSLDGARVLAPASVRLMTSDHLGPAIAKAAYYPPGPGYGFGLGVAVRLAAGEAPFPGNVGDWFWSGVGGTYFWVDPVEGFFALLMMQTSSADQRQHYRTLTRTMVYAALEDRRLSETAP

SEQ ID NO: 564 - protein, 84 aa, Methylobacterium sp.
MPQNVEYWITDRPDGRFDVVVRLESGKIFRRRGCVSRTEADTWIEGLRMLMAAIGAPVSAADVTSDDPSPLGSQPVDGADHSTS

SEQ ID NO: 565 - protein, 129 aa, Methylobacterium sp.
MSHPVDWNAFADAWCAAWNAHDVERVLAHFHDDAVFTSPGAARIVPASGGTVRGKDALRAYWTEALRRIPDLHFAVEQVFAGIDTLVIQYRNQKGVSVSEVLVFEDGRVRAGHGTYPIGVDNPVGAAAG

SEQ ID NO: 566 - protein, 230 aa, Methylobacterium sp.
MKSEKITWRASGSRERLYDDACGTALALEFIGERWSLLIMRELVYGPRRFGEIRANLPGISANVLTQRLESLGAAGIVLRYRLPSPANVQVYDLTDWGREAAPLMRDLGRWAARSPRHDPSLFMSAASAMMSLQALVDRGRAAALSATVAFHFPGEDFVATVAGGEIRVRRGVAEAPDLAFTGDTMALRRTIYGKAPLDRDGAGGTLAVAGSVDLARSFIDLFTLPVKAG

SEQ ID NO: 567 - protein, 70 aa, Methylobacterium sp.
MDGSDSAGPTMYDLIHTLRLWLWRRQVRAMARECRMSGTSDGDWIAATVAASATSSGPGAPVSYVSGTGL

SEQ ID NO: 568 - protein, 91 aa, Methylobacterium sp.
MPTLGLKLPLRICVLENAACVEDAGGRRTGYVYWDEGRSGGGDRPFTRAEAIEQVRIIAGAWAGALVHSGTLDTGPAPEPGAAAAEPSPEG

SEQ ID NO: 569 - protein, 84 aa, Methylobacterium sp.
MRILTRTTLLAAVLAGAAGTAHAAEGQGKAGGRQDAGAPTTSMGAGGLSGTGSTQEGARTGPVESKGQPGGAKPPSAPKAGTGR

SEQ ID NO: 570 - protein, 367 aa, Methylobacterium sp.
MTRLRLIADDLTGTLDTAAGFTGLCGSIPVAWPEILAGDGSGCLAIDSGTREGSAAEAARIVGALAPRLDGADIAFKKVDSLLRGPWAAELAAVLRAGAWKRCVVAPAFPYQGRRTEGGRQLARHGAGFEPVSGDIAEALRAVGLPARRADVSDGPVAGVAVYDAASDADLARVADLGGDGPVLWCGSGGLAAALARGVAAPGDDRLAGPVLGLFGSDRPETAAQLAAGGPHHLVLSARHPDHAGAVAARLDRDGVVLASLALPEGTAREEAAARIAATFAGVIDRVPRPGTLLVAGGETLKALCLALSVSRLDVTGQITPGLPRSTLRGGRWDGLAVVSKSGAFGTEGVWRDLLHGNGFPRSRSDA

SEQ ID NO: 571 - protein, 81 aa, Methylobacterium sp.
MPAYHLRRTLEHADGRCGLAFASDRLEADDAEAAIRCARDLCRTAANMLLTGAVLTDSLGRILWSFTLALAREPLCVRPTS

SEQ ID NO: 572 - protein, 255 aa, Methylobacterium sp.
MTFRLTRLFDLTGRTALVTGGNSGLGLALARALGLAGAGLILTARREADLAAAAEDLRAEAVASEVLPADLAEPAAVADLVARLDGRPVDILVNAAGMNLRQPFAAVTAEAFDRHMALHVRAPFLLTQALAPGMADRGYGRIINVASLQSYRAFPDSAPYGAAKGAVVQLTRAVAEAWSTRGVTCNAIAPGFFPTPLTQAVFADAERAARNAAQTACGRNGELTDLYGAAVFLASEASAYVTGQTLPVDGGFTAK

SEQ ID NO: 573 - protein, 64 aa, Methylobacterium sp.
VFAGRGQWRGPDGRIVREAARIVLIVTEPTPEAVAALREIQEAYRRRFAQGAVGLVLQRSCALF

SEQ ID NO: 574 - protein, 362 aa, Methylobacterium sp.
MNAAETRQLSLWEQSLRRPEAGADRPTTRLGPALDGRMDVSFLHKGFCIAGLPLRRPKNTMEPWNRRDGRFSLTVEPARFVLPNGRQIEVGVPFGPKARLLSMWLATEARDPRRSAGDRWMEMGRITEWLKAVGLPVTGGERGSIGPTKDQLVRLSFPIFTMVLNGDEGGHVFKRESLIEGGAFKDDDLEVWAAGGHSAMRWPEALMLSQNAYDRFTRHSIPVPTARLRQVAHNAMAIDILVYLCYRLPLLSRGESELLTWRDLMAQFGSSEFASRFKQAFSESIKRTLDAYPEANVAMTAEGLVLRHSDPAELRRAFVAVAGGPTRRARAAPRARKAARVPDQMGPCESADLLTPAGAARG

SEQ ID NO: 575 - protein, 62 aa, Methylobacterium sp.
MTRILTSVLDGAAWVADALDDILVEAALGFGAAVPLIADPSGDPPTGATTGTSETGAPPIRT

SEQ ID NO: 576 - protein, 99 aa, Methylobacterium sp.
MGEAVSGTYTAADPGFAQTHRSRILVGTAEGDIIGFVTSTSSPQEITAWTGRLVRTDEKTAEAIHAVFHAVERSSQPKAVTGHVALETTIFSKVENACS

SEQ ID NO: 577 - protein, 114 aa, Methylobacterium sp.
MKMISTKMLMVAGLAAATLACGAASADARGFGRGGFGHGGFGHHGGFGHRGFGHGGFRHGGFGHHRHFYHRGFRRRFGGFSWGYPANSLFLGPQFGDCRAIYNPVFFGHERVCG

SEQ ID NO: 578 - protein, 100 aa, Methylobacterium sp.
MRGVCPLLRSREPAMADLIDFPGKRRGAGSAYRLHRFGADGSDRGTVLIRARDDAEARHQADRLAEGLLAELWSGDRLLDHFAPADHPVAGCIGPLRDGP

SEQ ID NO: 579 - protein, 280 aa, Methylobacterium sp.
MTLKPKLKATTSHTPVRSPSVIIVANRRGGCGKTTTTITIVDLLALNGIEAVVFQVDDQPQLAKLLGRRVVSLMPRLGDASLARALSSPFSPLYAACQAATESGGVVVVDVGANMVQLFVRWLRDVALQEDLDAWKMPAVLMVPAVRESAAVEGAIETLADLRKVLPGAVPVFIENQRDEPFASVKPASDLGALLRERLQPALAGCVRLTMPVIEGEAWQVFEAVGLRFLKVLALSPPEVAARIEEDVADAKIMRSYVARYLRAMHAECAKVLHLPEGGA

SEQ ID NO: 580 - protein, 575 aa, Methylobacterium sp.
MSIRNQALLSANPIRAWIWALLVWLFTGLALAVVLFDVVPMAAGSAGHGLGLGGAVHALPDLLMILLGRATAPAATGSTRPDVDLTTLLMAARYLIVLCLPLGLGLATYRHAVSRQPRRLNATFIGGATYAEKRDAPRLAASLLAEDMRVAGPGIALCPDLRLPRNREIQSILVVGRPRYGKSTALQFMLDGILARPGDKLVVFDSKGDVAAGWPSADVIFLAPHDTRSWAWAVGRDVLGETGARELAAALIAVSDREPNWTLGGQEILVAAIRKLQAEHDTGWSWADLDEILDLPDKALRKVALDHHRPALRYLTLDPDTECFDRTAASYISTAMAPINRLVRPLAQAWSEIQPQYQISLRAWLLDDTPQRRTLILQAASHLPSISSTWITAALEMMARFCVGPALADSTERRLWYILDEFSTVPKISALPALLAQGPSKGVCVILACQNLELVEDNYGSILTQAIIQNMDIQVLFRLNAGPTAQYLTQTGIQKTELQRYGQPAAKDAADEDANKPEKVSLVTPHDLATLPRGEAYVTVEGSILRLRWPKSTWIEHRAGMIQAPWVTALGTSTP

SEQ ID NO: 581 - protein, 396 aa, Methylobacterium sp.
VPRRSAGRRRAGAPAGILSLVLFLSLCSAAAAPLAAEPVRAETREAAPALRTTEPETWRVATHPVPPLVMDEDGRLRGFSIDLWNAIARELGVRTAYLRVDDLPALFAAVSDGRADLAIAAVSITAERERRFDFSVTMLETGLRIAVRSEPDATGSATARALRALLSDAAFLQVLLGLAALILAVAALVWWLERRHPGGMAARSGPARGFAHVVWWALSSLAAQAEEMPRSPLARAVTVLWLFTCIALVAWFTAGLTSTATVERLRGAINGQQDLPGKRVGTVANTTSVAYLADHFATPVGFATLEEACAALQAGTVAAVVYDAPALSYYATRPGHEALRLVGTAFNRQSYGILFPASDPRRKRVNQALLGLREDGRYDEIYGRWFGSESGESQGR

SEQ ID NO: 582 - protein, 80 aa, Methylobacterium sp.
MRAKILVLSFGLICAGAGPVWAARPVLGRLPSAVAQATPGTGSAPILSAGIAGAPALTVLARRKPARRPRGARLGSLRPL

SEQ ID NO: 583 - protein, 58 aa, Methylobacterium sp.
MRPSSRAFLGCLVLALLIGGLGLGLRRAVAVTPVDPAFRAVLRAYAAPDASGGPQQHE

SEQ ID NO: 584 - protein, 337 aa, Methylobacterium sp.
MTIRDALLAGPLGFGAAPLGNMFRDIPDHEAEATVDAAWQAGTRYFDTAPFYGSGLSEIRLGKALSKYPRDAYRLSTKVGRLILDEVETGARDQGEKGEIFRYGRPNKVVYDYTADGAKRSIEDSLRRMGVDRLDFVWVHDIARDFHGDKWIGLFEQAHTGAFPALDRLRDEGVIEAWGLGVNNVEPVELLLSLDEVRPNGTLLAGRYTLLDHGRALERLMPAAVERKVEIVIGGPYSSGVLAGGAHFEYGSVPPEIAAKVETIKALCGKHGVPIKAAALHFSLAHPASAAVIPGASRPERIAEDHAAIGFEVSGDFWRDLRRSGVVAPDAPLPSGQ

SEQ ID NO: 585 - protein, 49 aa, Methylobacterium sp.
VPEYDIKIVAPRDRKAPDAKRETPPKRKLDWDRAMREAAEAELSIQSHD

SEQ ID NO: 586 - protein, 97 aa, Methylobacterium sp.
LNEPEQGSAEAVYISAMVGEMMRRVLEDALAELARTRGAAFLEIFVARELARCAELFRERPGDTPETTDMLRAWFAMEGGEALRAVVDRASVEAARD

SEQ ID NO: 587 - protein, 73 aa, Methylobacterium sp.
LQAFDEQLAHELVRGLVQSAVARGLDPAIRLDQFRTLQQAAVALSRDAAVVRTSEQIVRAIDCALEELTAVRS

SEQ ID NO: 588 - protein, 690 aa, Methylobacterium sp.
MEAYYGADRALLGFQCRFDRADGSKTFQPLTLFRETATGALKWRWKGWPGPRPLYGLDRLAARPEAPVLLCEGEKAADAAGELAPDFVAITSPNGSKSAGKADWSPLKGRRVVIWRDADLAGLEYAEAAAALILAAGAASVSLIDPPGEAPQGWDAADAIAEGWPTVRVLSLVASARPVGRLAERPASGGRLAPTPAPVEAPPAEDVGRRGPGRPPWHDTLLGLTEDYILWHTPKKHAYASIPRPEGHRENWRLNGEAFARELSLKAFEETNRIPSKAAIEETVRILEAKAIAYGPCRKEWLRVGERDGKLYVDLGCPQWRAVEISPRGPEILQSHDLPFVRPEGMQALPEPVFGEENAIGDLRAFVNANSDEDFQLIVAWVLGALRAAKEYPLLILNGEQGTGKSTLSRLLRSIVDPNAAGMLSAPKEDRDLFVLAQHAHLVALDNLSKVENWMSDSLCILATGGALASRSMYTDAGLTILEATRPVILNGIPTLADRPDLAQRSITVRLKPVPAEERRTSTDIEREWEAAAPRILGTFLEALARGLQDVDKVALDKLPRMAGFARFMVAAAPGLGPDFDGQGLFNAYLANQSELASSAFENDPVATAIVALMQAAYSGEWQGTPTELLQALSDPAVTPERVTNSWAWPKKAQTLGNAVERIAPALRDRGIDVRKRHSGKTFYEIRSRS

SEQ ID NO: 589 - protein, 75 aa, Methylobacterium sp.
MLDGDAFAHEIAALLIADIKTSGARTRGEIEEACRISLESLLGGTAVPPQIAVLMPIGLERWPRVVVKGRPLPDV

SEQ ID NO: 590 - protein, 32 aa, Methylobacterium sp.
MLRKLLTAFIVPKLIAYLGRRYDRRRGTGRPY

SEQ ID NO: 591 - protein, 230 aa, Methylobacterium sp.
LPAPPSRFDAVLLDLDGTLVDSLADLRTALNATLAREGLPPVGTAAMRAMVGDGAVALLRRALRASGGDPERAPDLLPAFLAVYEPLAAAGTALFPNAAAAVRDLRAAGYALAIVTNKPARATGLILDAVGLAPLIDTVVGGDTLPERKPDPAPLREALRRLRVEPGRAVMVGDMHHDIAAARAAGTAAILARYGYGRPDDARTADAVLDDIGGLRAMIGALPAGGAPAS

SEQ ID NO: 592 - protein, 523 aa, Methylobacterium sp.
MRRRTFLAAGAAALAAPSVGRAQGARVLRMVPQANVTSIDPIWTTAIVTRNHAYVIYDTLFGLDADLRPQPQMAAGLKVEQDGRRVTIPLRAGLRFHDGTPVLARDCVASIRRWAARNGFGQTLMAATDELAHDGDTDIVFRLKAPFPLLPQALASVSQPAFVMPERVSQTDPYKQITDATGSGPFRWKADEFNSGSLMVYERHPGYVPAPGTPSLTAGGKVAHFDRIEWRIIADGATAAAALQNGEIDWYEQPPPELQQLLARNRDIVVEGLDRLTNPAILRMNHLQPPFDDVAVRRAVLPAIVQSDFMAAIVGDDPAAYDDRCGIFTPGTPMASQAGLEALTGPRSLEAARAALRASGYDGAKIRLIGPTDLLAPAALTQVAADLLPRIGFNVDLALSDWGTVIQRRVSREPVEKGGWSVLLTTFSSFDNADPAALQPLRASGPNAWFGWPSVPRLEALRTAWFAASDAEARRAICADMQRIALEEVVFVPVGSYRSMTSYRRDLTGRLPGFPILWNLRRA

SEQ ID NO: 593 - protein, 828 aa, Methylobacterium sp.
MTGAAMTGAPDTPAAAATRALTPEQRACLDAAGAVPNLVAEIDLPGPVDADRLRRGLAAVAARHDALRTAFVREQGFRGLRQAEAAAPAIPLDTGARQGDVGTVGLVPERGQTLAAVLLPGATPRLRLVASALAVDAGSLDRVLSEVAAVCAADAAPGADPEAATYAQYAAWREAVAADDADGEGQAYWRDHLGAGAAPLRLPYRRGVAADAVEEPAAATRLSRAVDAAVTDAFARALARPDLAAAGAEAVLQAAWWLLVARLAERTEILGGWAHDCRRDYAVFAGTVGVFTKTLPLRLALPAETSVSEAAAGLAARLDEHRAFQELCPLDAAGDDRRPAVGFALAAQGAAQDRLLPGPAGFELCLEPALDAEGRLAALTLHADPHRYAVEALETLLDQVETLLARLPAKAATPFATYPLVGAREEARLRAFGRPAPCALPAETLPVLVARHAAAAPDAPALVGAGRTLSYAALEDRVARLGAWFAAHGVGPERVVALDLPRSVDLVVAILAVWRAGGAYLPLDPAWPQARRDRLIALARPALTVALSADTAAGRHALGAILDGLGEARRPAEARDPSDMACLLFTSGSSGTPKGVVIEHAQIRAYVEAVIDALDLSGHGRFALTSTVAADLGNTMLFAALRLGACLVVADEAEMADGPAFARFLRANAVACAKLVPSHLAALLDGVEDPALPALLVLGGEPTPAALVRRIRAAAPATRIANHYGPTEACVGVLVHPDAATAPPDESLPLSRVLAGSEAYILDAAGALAPTGAVGVLHLGGAQICRGYLPGTEAGGTGAFSPNPFGAGRLYRTGDRARLLPGGRLVLA

SEQ ID NO: 594 - protein, 422 aa, Methylobacterium sp.
MVSRIVVIGGGFAGLWAAAAAARARTEFGLDDRVAVTVIAPDPFHVIRVRCYETDLSALRVPLDDVLGPIGVERREARAIDIDPAARTVTVESAASSAASSGVVETLAYDRLILAAGSLLWRPEIPGIASAFDVDTFAGAQALAAHLDRLGDAGGPDEAGRWTAVVIGGGLVGLELACELPARLAAARDRAGATGPVRTILIDHAREVGSAMGAAALPGIREALRDAGVTCIGGARVGAVDRAGVTLADGTHVPARTSVCATGMRASPLGGTLGLPRDPLGRLPVDAFLAVQGIAGVYAAGDIASAAADDAGHRTVMSCQHARPMGRFAGFNAVCDLAGRPERRLRFAAPDYVTVLDLGAWGAVYTAGWDRGTLVSSGAAAKATKRIINGTRIYPPLDRDAASILAAAAPIIQAAPATQAAR

SEQ ID NO: 595 - protein, 370 aa, Methylobacterium sp.
MLRSVSRASPRPAAGLLILACGVGLAGPARAEPAPAPATAAATPGTGAADGTPVPAAVRARRQEAGVAVAAATVMAAPPPSFFNFSDTVVSYRFQGPSAEPGLRVQRPDGQFVGREVPKTVINLFHANAWAYGTNLLSLDILRSGSQDPAGNQVRRFEGVGATEFYLVYRGVLSLNKVFDTQALAIPGFVKDVGLSFGADVNTKDTTFDSEKRAGTFGLSFAFDVPAGFVNLKVQGYKEFSRNGFAGYGPVPGFDYAHFRSVEFKMTPEFEITYTIPLPFTGLPLSLAGFNTIVLPKGRYGRFNENDTQLEFVSQTNLVLDVGQLVAGTPNRVEVFAGFQYWHNKFGADPRRTLNTEEKALIAGVAYHLK

SEQ ID NO: 596 - protein, 343 aa, Methylobacterium sp.
MGNRREFLTATAAGLAAAAAAPARAAEERTAAPKSTPAGAPPFGMPRDMVLLNMRRGDGYALGVKTKDGVLDVEAAGRALGMPVPADMDDLLQNGRGPALRALIDAVEAAPDGRFVLAEAGVAYAPVVTRPEKIIMMGFNYRHHAEETGTPIPKDPPLFNKYNNALNHHGGTIALPTQAAREFDYETELVMVFGRECRNVSEADALDYLAGYCTGNDFSARDLQTLTSQFMIGKTSDGFAPLGPYLVTADRVKDPNNLKLKTLVNGRVRQDWSTNDMIFNCRQLISFASKVMTIKPGDIFYTGTPQGVIFGEKIPRKDRAWLKPGDEVVSELEGLGELRFRLV

SEQ ID NO: 597 - protein, 108 aa, Methylobacterium sp.
MRSILAATLLLAIAVPAGAQSLSASLEPITPIANPGQLSLGGSSTTGPFPTVSAQTGGLVNAGQLSFGGGGGGGGGGRIGASGGLSAGTTLGTTTAGSGGAGQLGGLG

SEQ ID NO: 598 - protein, 233 aa, Methylobacterium sp.
TATGGSGVTGTTLGTGGTIGATGARSGLSGASRTGLGSTAGSLLTSTLGTGGLGGGPGLSPGLGTGLGTGLSGAGLGAGVGAGVGAGVGAGVGAGVGAGLNAAGSLGSSLATGSSGVASPGLGSGVAASGIGAAGATLSSGGLFGLFGLGTGTAASGTSAVTVFGAAGAGTGVAGIAGTPGLPADDPAQAARTLPTGGGAIGGAGIGGAAAAPVRTGDLCGGPFAEACLGQGF

SEQ ID NO: 599 - protein, 263 aa, Methylobacterium sp.
MEGMKALDLRQPHERVTILLVICLPTEGLITGFEAGRWTIVGRFEQIEHAKRRLRRLMHFLEHLEARAFIIQETVPRQSSKRAPWLTLVRFREPELYLDQSDAVEASEEALESWAAIADSFVAPSAMKAKPAPSKRNPIAIAALMATAVVALIGIIAALQALSIKLSNAIPSAFTRAGGITMSIPDEHRAGWYVRVKIYPDKSVEIIDRFPAYARGKHWKEGDMTPEELAADVKRPLTADGNLMDTPDPIPARTGVAAALRQN

SEQ ID NO: 600 - protein, 73 aa, Methylobacterium sp.
MAQCMAQSSGHEVPTQTRAVAETGLEQARTAFGSVVGAARRASDTVRTTPVRGQDAAREAAAAARDAAGTASP

SEQ ID NO: 601 - protein, 61 aa, Methylobacterium sp.
MTRARETADPTSRGPDAREADEPPAERVKAEPATIPTEDPEVGLSQKGSGEEAIVRRETEI

SEQ ID NO: 602 - protein, 84 aa, Methylobacterium sp.
MALKTTYLVQPFELHRNRLRPARQEPAQSEFGALKKAEALAARMPGAAALRVVADDETGELEGVTILGQFGTVPDDFAESLLGG

SEQ ID NO: 603 - protein, 47 aa, Methylobacterium sp.
MDWFDLPEDPQPPSAADESRMRLYIAAGLIGIGALGMVGGMLHILPA

SEQ ID NO: 604 - protein, 86 aa, Methylobacterium sp.
MATPETQAPYRLQCMIHRESAGGIIIHDEQIPGPLVEAAVAAAKARFAELRAGRAGSAALRDSAGRVVWSARQDAATPGTGGSATR

SEQ ID NO: 605 - protein, 31 aa, Methylobacterium sp.
MTDTPAPYLAVAFLSALCLLVAGLQAEGLLW

SEQ ID NO: 606 - protein, 30 aa, Methylobacterium sp.
MGLVAFIVFVCPWMGIAGLLWMRAQQAKPL

SEQ ID NO: 607 - protein, 504 aa, Methylobacterium sp.
MKQRTQELRAVERPARAVSSEDGPREDIDRTTEAHEAFLKSWNTYVPTIRTADELKRARGLWDAWQHFLAVGAEAGALDRAGERDLADRVRTTALQADAEAVARDIDTLLTDHDAAVAEQLGAVDAAGSTFRPSLVAGLSTAALAALVLVQATLRGVAQPMTALASAMQRLAVHDLTVAIPPVTGCTELAVMAAATRALQETLRQAVRRDAEADQLRAQSERRRTVIEQATERVETKIGGMVEAVSSSAAALRVTADDMGRAIRDRAVRSTTMGAALAQTRSKVRRCAVSAETFGAAVEEVGAQAESTATLAGSAAADAARTTARVQALSSAVDRIGDAVRIIAKIAAQTNLLALNAAIEAARAGDAGRGFAVVASEVKALAAQTREATDLIGQHVSEIRGSTDAAVSAIAGITARVEDMSRAANAIVDSVERQGATAREIVTAFAEATDGTERFDAEGAGVAEMPEAAEPATTAVLTAADDLTQDAARLGEALAGLLESLRAA

SEQ ID NO: 608 - protein, 274 aa, Methylobacterium sp.
MLSYLGDKIVGLTLAVLNALAPLEVHVDKGVPYADGSAHRADIYRPAGGKPRPVAVFLYGGGWRTGSKDEVAYVGAAFARRGVVAVIPEYRHVPAASLQNILADNAAAVAWTIAHAAEYGGDPARVTVVGHSSGAWAAAMLGLDATWLQRAGSSPAKLAGIVGLAGPYATSALTDPLDRRVFAGSDPALQPINHAADPHPAMLLATGAADLDVNPAGTLALDRELRGFDGRETMKIYPGIGHGQIVHAMSFPFSLRYSVADDVARFVKGARAGP

SEQ ID NO: 609 - protein, 81 aa, Methylobacterium sp.
MRITVRDQVKAAIIGTMAEAQKEGRCPLAAAEAAFPGTPTVVLGGCYGEMLSDDEDAWWKRIEHTIDAEVIRNAVASASAQ

SEQ ID NO: 610 - protein, 135 aa, Methylobacterium sp.
MDHLTDHRSTFMLEKVGAIVAAYVSRNAIEVTALPALIDQVHTAIAVLRCAPSEFGGVGLSQSQVDASIQQDGLISFIDGRSYQTLKRHLTAHGLTPERYRAKYGLPADYPMVAPGYAARRSEIARAIQLGHKAA

SEQ ID NO: 611 - protein, 37 aa, Methylobacterium sp.
MFAQPHALILRHRERVAVLISSALFLAGALPLFWAIG

SEQ ID NO: 612 - protein, 90 aa, Methylobacterium sp.
MTRTLFRSAGLALLSLAVPATLAAQGLAPDQTGTGGGPATTITAPNTNSLGVTKPPGTSLGPGEVPPRAVQEHERARLNKIERSICDGCN

SEQ ID NO: 613 - protein, 323 aa, Methylobacterium sp.
MPADILDELGPLFLGSRLKRLADRFQADAARILRDEGLGIQPAQFPLLAAIDRYGPLTIGDAAAALGVSQPAATRTAASLVALGLLEEARSDADLRQKALSLSDAGEALMARAKDALWPRVDRAVASLCAGLSGPLLDQVAALERRLDAVPFAARIRQDGAAGDAATGLTIRDYTDALADRFRDINAEWIEAMFALEENDRRMLSDPRGEILDRGGLILFVESADLGIVGTCALMRTEAGCYELTKMAVSARARGRKAGEHLLRAVLARAEAMTVETLYLLTNTKCAAAVHLYEKVGFRHDPEIMDRFGRRYARCNVAMRYPL

SEQ ID NO: 614 - protein, 414 aa, Methylobacterium sp.
MDMQVEKAQGRPLKGIDRNKVIAQSLRQFARLPGLPDTKKGVRSYQSHVKSDPWLPLLFVVCFVLPTLAAGIYYGLIASDRYVTEARFAIRPTIGTADKATPDTVGTNAGVIKATVAQETLIAQEYIHSRPMVEAVAAELPIRAWFGRDDIDMFSRFNPEKPVEKFLRYWRRRVDVDVESASGIMSLTVEAFDPDESLAITKAVMADTERMLNDLSLPSRKDALDVSTRVLKLAEEREAKANAALNELRNREGVLDVIKSNTATIKSVSELRETRTKLAVQLAVLQRDLGPQSRSIVDLKQQIGDLDANIARVQQQLAGTAPTEKRRLSDALTRFEDLEHERENAEKYHRDVQLAYDRARIVAQQQVVALVPIVEPIKAGSSTEPRRILMTSIITAGAAVLFAAAMFTRRMLIT

SEQ ID NO: 615 - protein, 79 aa, Methylobacterium sp.
MYKLPPGSLYRLRTLAQTGARFYQVSGYMRRMEVLGLVLATGRTDPDAKTVEYRITEAGRAELEERHGPAWPGSAEDEA

SEQ ID NO: 616 - protein, 125 aa, Methylobacterium sp.
MDSGEALSDRRVGPALRAVVALLALYALLLQAFLGGLMPLPAATDGLCAQHADASAPSGTPVPHDHGDCCTAAQATGPALPPRPASVGFRWAATADLRPAWPLTGSVGARAPPGTIASPRGPPTA

SEQ ID NO: 617 - protein, 516 aa, Methylobacterium sp.
MLLRATATAIRAHLDDRASRLIAAAGTCLLLCLALLGVYLCLDLRDVAWHNARRNAGNLLAVIEEGVGHSLRVYDLSLQNSARLASRADITALDPDIRRLALFDTAVAGSGLGPIAVTDAAGDVRLTSDPGVRTRPNMSALPEFEFHRSNPEGGLILSGPTVSLITGEPIIRMTRRIRTPDGSFAGIVSGSIRLAHFQALFERLHFDDGIALNVFHRDGTLLIRAPARPAALGQNISASPGYKMYRAKPRGEFQGRSFLDGVERVYSFADLDDLPLIVTVATDVDSIRGVWIYKAAIVAVLILCLCVLAFGLTILLHREVGRHVAAEASSREANAALAVLARTDGLTGLPNRRSYDEHFAVEWKRAAQLRTPLALLIVDADHFKQFNDRFGHQRGDEVLKAVAECLQRTLDTAGLSFRIGGEEFVALLPGVDATAASVAAERVRRAVVNLRIPHAPEVGGIATVSIGVACADPAGGDPPEGLFTAADAALYAAKKAGRNRVRAAAPADPVALALRA

SEQ ID NO: 618 - protein, 132 aa, Methylobacterium sp.
MDLTHVRAFAAALAAKDRDAVLAQMAEGVVLNTPLAAEPVRGKAAIRPVVDALLAAVDAFEIREILEGPAHVAAFFGATAGPHRLDGMDDWRLDAAGRIAEMTVLWRPLPEAIAVRDRLARAAETPTSAATG

SEQ ID NO: 619 - protein, 120 aa, Methylobacterium sp.
LEFSWFTKCQMMASNYAQHWEMVLEPDLGSLIQAVATDARTSFTGPQSMRRVAERLTLVADSLVAASDDRARAADVRREDGRCTEALQYLASQLASTAASVEAWKHASASATETSQAPSA

SEQ ID NO: 620 - protein, 72 aa, Methylobacterium sp.
MEIKRDLMDMAHADTIVKSLKSRGLTRDEFEDVVSGLVDDGLLSLERAQVLTLRFERTEPQSPSLVDDRDVR

SEQ ID NO: 621 - protein, 73 aa, Methylobacterium sp.
MPTPPDAYLRDILAQAEQDLAAAELRRAQQARIVAGPLNSPETRAAAELLLREIDRTITSIRANRHLIADILA

SEQ ID NO: 622 - protein, 246 aa, Methylobacterium sp.
LLCGVLADRLLRACAVGSGDWPAWMRAALPDHCPAPSVALDPDGGAILAAIRTTDDAVRAAELALTRRALTCDASCPVPPRRAARETPQVIPPDLARRLTGIERGQGLELTLAWEGASDLDLQVVCPDRTRISFEHRASCGARLVADQNEKGGSSASRPVEHVIWDDAPAPEGRYGVEVGLFARHGEARPEIPFQVILSRHGEVVEQRAGRISAERVAQAVLSFDLPIAAPPQSGPQAPTGSAAVP

SEQ ID NO: 623 - protein, 130 aa, Methylobacterium sp.
MSATTKLTETPRLGLDPVNPKLAQQYEQLVDLLARRLSPAHAHLFAEPAPVAVAGTGRPGFAWFAAFDGDARPVTALDPAAAATLRATAARLVAEISAFADGLEREGEASRDLARLLRDALVVPDADHLW

SEQ ID NO: 624 - protein, 72 aa, Methylobacterium sp.
MGSSDPETRRRQLDRLRAAYEARAGRPDLSAIGSGARHSRALLGRILVVLGGLPDGAGLPAIGPGGNGRAQT

SEQ ID NO: 625 - protein, 139 aa, Methylobacterium sp.
MGSMRNAFIYAAILSTLPLPAAAAETCRDHYRSEGTPMLQAITYKTWMIFPSVSPRAAFDRVTRAVLAEGFVGVHVEKALGTLTAQQETSGSGRPQTLRVVVRKAGAGSRVDALFMVQAGQIGQDVDQNLCRIVDAAAQ

SEQ ID NO: 626 - protein, 165 aa, Methylobacterium sp.
MPLVVILAALCGGLPVLAFGWQTFGFYTVILASCVASAAAVLVGGGLALLRAGRSRTAQDPAKIFDIDRLTSGGRSDFRLVPRRLYFDIEHGREIIKDEIGIEATSIDQALDDARSVIRDMVQELADEGYAEDWVLVVRDARGASVARLPIERTPAQARPDRRSA

SEQ ID NO: 627 - protein, 52 aa, Methylobacterium sp.
MPSASLMDQIAPVRTSRTRRRPHPALVVASVALAIGLWFVIYAVAGRAIWFW

SEQ ID NO: 628 - protein, 618 aa, Methylobacterium sp.
VTRSQAARQTARQAARQTARVVALTAAILLPVQAGSRAADRGPADGPGDRPDGTPHFLEQSWTPQERAWFYRASQGSQIMPYAWFMSLERPDDDTLFVADGLARFGYLPNPYDGTRGSDRSGLPIGFVKDVDDRGEWIGMTCAACHVNRVDLRGRSILIDGGPADADMFAFIEELGRALARTRDDPARFERFARRVIPAELSAPGTGPSEPDRRRLRASLTRLAEDFSQYVASSRTAVPWGPARLDAFGMIFNRATGIDLRDPHNIAPPDAPVSYPFLWDTSWHDRVQWNGSAANGLAVERLGRNVGEVLGVFARTDIREPTLPPLWFETSADRVNLLRIENQLGALTAPAWPDRIAPRTEAQARDAAAGKAHYDRYCLSCHAIAPTGANRTLTVTLTPLAEIGTDPKMATNAVSRRARTGILEGIRMPFLATTPPLAAETSSLELVATLVAGAILAPLDRGPDPAGVGADQSVILDRLLKRGAAALEARNAMLDDVSTAGGKGLVAAFVGARRDRDLMVYKARPLNGIWATGPYLHNGSVPNLYELLLPSSRRSRTFRVGSRELDEDRIGFRSDVGPFLFDTALPGNANTGHEGPAYGTEQLDDAQRRQLLEYLRTL

SEQ ID NO: 629 - protein, 306 aa, Methylobacterium sp.
VRLPVTGDGRFWALAFLGLGLPACLALGWIGLTGETPSTSALAVGGRLAAIAAFLSLGLAALALATRGRAALFALLCFPTSLAAASGPDGPVLALAALAAALLSPRPMTGRHGSARRAGAALAIALVVLARPACAPLVGMLLVPFPPPGRRVRAWRERLPLAAFALLPALLPAASPGLPPPGAAGDGFVSLPVPLPGFLSGVWAAALLAPPVALRRGPLPPPAERLWLSGCALLGLWLAVLSQALAPAGGLGGMQARDLLPLAPMLILAFARGRIGTAAALRWPALLPVLAAALDAVVLPMIALRA

SEQ ID NO: 630 - protein, 72 aa, Methylobacterium sp.
MTVRLFAAAALAATLAAALATPASAQGSAARHGLSNVTAVMLPEISVTYHRPVPADRSAGPHGAGPAGRQPR

SEQ ID NO: 631 - protein, 68 aa, Methylobacterium sp.
MTNATDRRAGRRGVRGGRAQVRTVPPGLLLAGGVGANAPLTAVDLIAQARAARREAEARDGADRAEQG

SEQ ID NO: 632 - protein, 199 aa, Methylobacterium sp.
MDLYAGSAQIRLHEHQIAQDLGISRTPVREALTLLEREGFVSTVPRRGLFVTRKNKREIVEMITVWAALEGMAAHAAARNAEDADLRALGRAFEAFDIATLPDHLKAYDEANLDFHRTIIRLGGCGLMVEMTTNLFIHMRAIRSAFLHRAGRLEDSMREHAAIIAALQARDADRAAILVRDHALGLIAHVEAHWVWPEG

SEQ ID NO: 633 - protein, 199 aa, Methylobacterium sp.; identical to SEQ ID NO: 632

SEQ ID NO: 634 - protein, 95 aa, Methylobacterium sp.
MIVLIAAAIVSGLATAAILAPVSALAALIIAPLAASASAILACIFIAWRNTRDDVGPPNLETQADAMVAVLCEVAQKGKIVPVAAPVRVRGHRSA

SEQ ID NO: 635 - protein, 37 aa, Methylobacterium sp.
MYALAKTRERTDWELVVVFGSWIVFEIAILMLCLVSM

SEQ ID NO: 636 - protein, 89 aa, Methylobacterium sp.
MKTLISLTVAGLLATGAAATAAENTGTRMQGSPNAAGYTGQGATGKGETTGTTTGSPGSEMPKQDSRMKGPPNAAGFQPGGGGGGSARR

SEQ ID NO: 637 - protein, 224 aa, Methylobacterium sp.
MRRPIRKEKPIMTAHRFDAVLFDLLTALLDSWSLWDSVAGSTEAGRRWRAEYLRITYRTGAYRPYEELVAEAAEAVGLPRRLAADLEDRYGELRPWPGVTETLRALAARSVRLGVVTNCSERLGRIDAHCVGVELDAVVTAERAGFYKPDPRPYRLGLQALGVEPARCLFVAGSAFDLVGTAQVGLATYWHDRVGMAAPDGASPPLAHETTLDPLRAWFDPGAR

SEQ ID NO: 638 - protein, 58 aa, Methylobacterium sp.
AGRASGDASPDCDALPTLELLRLWESLREPVSRQRVLAAARQEARTLRASRAEDAAAG

SEQ ID NO: 639 - protein, 49 aa, Methylobacterium sp.
MAAPIKTVRPGQVPGAGVTAAADQTIRPLSLAEFIGQRAARANMQVFIE

SEQ ID NO: 640 - protein, 91 aa, Methylobacterium sp.
MRRDSDGTGRISALTRMRRRLGRLRDPLATPAALHRRWAGAATGADLEARLIAVLAPHVDTAFYASWYGITADPVRDYLVHGWRAGRDPRP

SEQ ID NO: 641 - protein, 42 aa, Methylobacterium sp.
MMNSVLALLTVVAVLVVTALIKLPLLPFRLVGRLLRSRPAAA

SEQ ID NO: 642 - protein, 246 aa, Methylobacterium sp.
MSPARSLPAGHLRTSLAALVALAPVLSLGQGASRADEAPAAPVFNKAEAAEIAVPLRQDPALLRSFGTCPADTFARERPFWRWAFAPRRPTERRCAREPASCYALCTRWSNAPACFDLALALEHHSLDVADILDKERLYALACAGGFPAGCTNRAAGIRNGGYAEDPFRDAPRADTDACLARSFRLDCDRRGAWGCAMLGQAYRLGEGVAAEASRARAAFDMACAINPDFAACTFAKRQLAEMGAP

SEQ ID NO: 643 - protein, 132 aa, Methylobacterium sp.
VSAGDAGPASDALRALYGRVDPMPEGPPAPGHARASLCVDVGDGDDVAAAERWMLAHASRLTRVRSTGCGCCVIGWDIEGPAALVATLPAALGATSDWAGPAATPRRAASARGRRFWAHGWERWWERWVRRR

SEQ ID NO: 644 - protein, 31 aa, Methylobacterium sp.
MSRGIETDALPETPEAEEPRIPSAPAHPVTG

SEQ ID NO: 645 - protein, 189 aa, Methylobacterium sp.
VAIAIPCGTMVHADFAVSLGSMMHSLGEMPMSIVVGKSSIVADARNLGLEYAQKYGAEYVLFIDSDMTFPKDALLKLLVRQVDIIGATYSRRTAPFHFLGDILPEQPADAPKGLLEMSRIPTGFLLIKSTVFEKLKKPYFRFRVDEEAGVNIGEDFDFSDRARAAGFRIWCDPYLSKELGHIGEQSFKL

SEQ ID NO: 646 - protein, 238 aa, Methylobacterium sp.
TLAALLRVCGLRPARAPVEDTGWLGAIGQETLERDAFLDLQARLVAGHFDHGFYRARYGLSEAEDAVRDYCDTGWKKGRNPRPDFKGWAYRAHHPSAEATGLAPLVHHLARALLRGDDLAGEAFDPRYGTLPAEEDADLFEQARLIEPFFDAPWYLKRYPDTRGFENGPAIHFLSHGQEEDRDPSKTFSTRFYRRAYGHLLGPGESPFLHYVRTGRAAGLMGCPEDLGTYPPMEAPAA

SEQ ID NO: 647 - protein, 54 aa, Methylobacterium sp.
MPRTVDRPHPARRRAVHLPRPRAGAAATGLFLAGLILSAATVPLVEPADAATGT

SEQ ID NO: 648 - protein, 176 aa, Methylobacterium sp.
MLTLERPDSIAPAATDVPLGTLLAACNAQRAMPLVFTYDGRTIQRGYHVTEVKAGQFAALDCGANPESWSEIFIQLWDVIDGDRTHMTAGKFAAIIRKVSEHVGLDPAARLTFEVSDGVVPMQLHSADTPELIDGVLRVALSPRAASCKPRDRWLEEQNKASACCDPSTTEQPCCG

SEQ ID NO: 649 - protein, 179 aa, Methylobacterium sp.
MLDLAKIDVAVPPRRTADDIQIGALLATCDEHPAIPLVFVYDGHAVRPGYHVTEVKAGQFAALDCGGNPESWTEIFIQLWDVIDGDRTHMTAGKFAAIIRKVSEHVGLDPAARLTFEVSDGVVPMQLHCADTPELIDGVLQVALAPRAASCKPRDRWLEEQNKASACCAPSTTKQPCCG

SEQ ID NO: 650 - protein, 169 aa, Methylobacterium sp.
MLDVAKIAVAVPPRRTADDIQIGALLAACDEHPSIPLVFVYDGHAVRPGYHVTEVKAGQFAALDCGGNPESWSEIFIQLWDVIDGDRTHMTTGKFAAIIRKVSDHVGLDPAARLTFEVSDGVAPMQLRCADTPELIDGVAQVALAPRAASCKPRDRWLEAKGTAKACCS

SEQ ID NO: 651 - protein, 286 aa, Methylobacterium sp.
VVRAIEAAAEAEAEIIVVDNGSEDGTDAALKRWSASVSIDRRDVLLLAQSRPGVAGSRNAAIARASGDIIAFIDDDCVVSDQYLRDLIAHYAGDTESVIRGGRVELGSTEDIDFTTKTEALASRLTYPAHPGGFVHGCNMTCSRAVIERIGGFDAAFGPGATFRAAEDTDFIYRGWAAGVAVEYVPDMSVKHFHGRRDPRTIDRLHWNYQFGNGALYAKHIGRSPWLIKHLYWSARNAARELVGGPCFDAQLGLTWRAIVTANLSGVLAFAWHSARTLLTRAPARA

SEQ ID NO: 652 - protein, 183 aa, Methylobacterium sp.
MTGAPLQGHAEFSGDAQHRYRLDRWWSDAPRALVCGCNPSMAGAEVNDPTVWRLVELLRPIPTIGGFTIVNWEDRVATDPAAMRAWRMHALHTDEAGYNRARDANLARIRALSAAAPIRIVAWGDLVPMERQTTLVLRAMSLDWTHPLYAFGTTASGAPLHPMARGRSRIPAGTLPTLWREHE

SEQ ID NO: 653 - protein, 102 aa, Methylobacterium sp.
MSIKTPPPGALHHEEDCGVSTLRQQRTERLLSRIAGAVQMPPSTFYRPPNAVDTGASAAAISVASVASDAECAELLAAFNLVRDPEDRRRLLELVQKTAQRA

SEQ ID NO: 654 - protein, 96 aa, Methylobacterium sp.
MTITSTKTAILSCLALAALATVPGRAEARGFGHGSFGHHGGFHHGFHHGGFHHGFHHRFGGHGWWSPAGGYAASSYYGDCHLFFSPVWGRYERVCR

SEQ ID NO: 655 - protein, 242 aa, Methylobacterium sp.
MHHHGLRILLVDDDAEVQRVVSGYLDAHGVDVVPASTRAEARGELADPSQFNLVVLNLRPGAENGLDLLRDLRAVSDVPVILTTAHRCEEFDRVLGLELGADDYIVKPYGLREFLARVRVVLRRVAAQASSRPAEAPCRRFDGWVLNRRRRRLINPDGEEVVLGKRDYALLAAFLDAPQRPLSREYLLQVTRVHDDVFDRCIDVQILRLRRKIERRPSDPKLIVTERGVGYVFAAAVESTSH

SEQ ID NO: 656 - protein, 58 aa, Methylobacterium sp.
MNRDPRARSKQADGKARTAESDRETDARARQAVVDAWRRALLRMRERRATEDRADPGH

SEQ ID NO: 657 - protein, 78 aa, Methylobacterium sp.
MPRFFIDLHDGTELVRDKDGYELPGLDAARSQAVKIMTRIAQGLSDRPGRQDYIAAVRDDTGVVRMRFRVSLDAGPVG

SEQ ID NO: 658 - protein, 140 aa, Methylobacterium sp.
MPIMPWIHDALYVGSFAALVLVARQALVRRDLGLSGLPGLERLRRSLGPGTVSPEWPRFTSPRTSGNTAFDAWRDGEIGRIEGERRALETRLRDFEGFVDALKRAQDRATFERFVAEHPAGSGAAVDIVGTADHAELRRG

SEQ ID NO: 659 - protein, 92 aa, Methylobacterium sp.
MTPDEMDDREEHPRIEDPRSRPTLFLRRLPPQFRGERDGLTTDAAWLFDAFSGSPDRRDIKLGRGTHRMHLEAGRRALWRASAACLSGPVPA

SEQ ID NO: 660 - protein, 92 aa, Methylobacterium sp.
MNTLKIASVAAGLCLVPAMSMAQQSVSQDNLKRYCTGDYLEHCGQFAPGGPEVQACFREKAKLLSPNCSIAITAYQKEQNEAGAIRKVSVTR

SEQ ID NO: 661 - protein, 97 aa, Methylobacterium sp.
MTFLKTLLASLALCAALLVWAGLAIGPEQPMDRTSPGLTTAAVLASDGMAPDGRPGEPSAASGGPDRRDLDRAALDRLAKRVSGQVRDASAAGTPAG

SEQ ID NO: 662 - protein, 94 aa, Methylobacterium sp.
MLRQIGAGPARAVATPDAATAREIRASIQAEGLISFIDGRSYKTLKRHLTAYGLTPEEYRAKYGLPRDYPMVAPGYAAKRSEIARSLQLRHRAG

SEQ ID NO: 663 - protein, 89 aa, Methylobacterium sp.
MRHVIGTSSAAAFGTLCVLALVGWTQAADTVPMQASGGAKASAVARDGGACGGGAWPYPPGACAGAGPVGDPAARRVRLIAVDAAPGRR

SEQ ID NO: 664 - protein, 71 aa, Methylobacterium sp.
MPHFSDDPGADEDPDLLLALRRMLRGGERAPRRLPTCAERFGVPAPRDCARDAQDAVLAGPDPQPPRSRHR

SEQ ID NO: 665 - protein, 61 aa, Methylobacterium sp.
MLDVIARLLLSAGIMVGTTYLPALSQAVTGQPAGTRIYAADAPACPAKPTMAGIRALACLG

SEQ ID NO: 666 - protein, 338 aa, Methylobacterium sp.
MPMSLRHAAVAARLLVAALLLPALGGAARAETTSVRIGLQYGLVYLPVMIAQSEGLFDKRAKAAGLDGLSVTLTRFSGSTAMNDALLSDSVELGTLGSAGALIAWDKTRGSQQIKSLTALSSVVYTLFTGKPGVTALKDFTFGDKIAVPAFNSPQAILLRVAAAQQLGDAAKADALMVSLPHPDATAAMRAGQGIAGYFATPPFTQVLKADPKIRTVMTSTGLIGGGDITAATLNAKQGFVDANPKVAQAIRAGMEDAVALIRSDPKRAASIYLASEQVQIDRAQVEAILTDGSIVYDVAPKGMVALAKAMAAQGFLRKVPRDWQEIFFPGLEGRDGS

SEQ ID NO: 667 - protein, 458 aa, Methylobacterium sp.
MSVTSAALATDTAGARPAASQSIEEKRKSAIRGAFFSEYIDMFDIYLPVVALAPVMFMFQPKNLSPQMETVLASLVFITTLLGRPIGALIFGLIADKVGRRAASIYSVAGFGVITLLIGLLPGYETLGLASYILLVLLRFLDGIFLGGGYTGAMPLAIEYSKKDKRGFVGGLIIAGFPAAYVSINLITMLMFYLFPLDGPGSPYTVWGWRIPFIVGAALAGLLALYYVHKVSESEVWKKEAAAGAEQAEASPMAGLFSGKGGRDLLQVLLLMTGFWTTQNIITIYMPTGLLVKTLHLNGFALTATLMICYTILFFSYIGSGLLGQLIGRRRFFVIVGPLIATVGAYILYTLTVTPDMAFGTRVLLVSLLAVIVTSPWGVIVTYINERFATDVRATGFGIGFSLSVVIPSFYAFYMDWLSALMPLALTPVALLIVGGLIGTVGALIGPETRDVDFGTGH

SEQ ID NO: 668 - protein, 301 aa, Methylobacterium sp.
MNGNRIGFIGLGNMGGRMTRRLTGAGIDVVGYDTDREAASRWGATDAASIAAVVGEADVVLMSLPDSKVVERVVLGEGGVLAGCRDGQIVVDLSTASASSTRRIAAALAERGVAYVDAGISGGAAAAEKGTLTLMVGGDPAIIDRLGWVFAPIARKVVVMGGSGAGHTTKLLNNFLNAVSLAATAEVMVAGRKAGLDIHRLLEVLNASSGVNFATLNRFPKIVDGDYLEGGLTGKLMTKDVVLYTDLLHELGVASLNASGPMASFGLATALGYGDVISNRVVDAIGDVSGGVRLHGNRHEN

SEQ ID NO: 669 - protein, 254 aa, Methylobacterium sp.
MTGPAPSPESLRHTVQGELGYWDAEQAALAELAPGFLDAWARLAMVPVRKNHLGAKDRALIALSAATAATHLYAPGTRRQIRNALDAGATAEEITEVLALTATLGIHACNIGVPLLLEVLEEAGQRSGPAPLTPRQEQLKSDFTRDRGYWHAFWDGLLELDPDLFEGYLDFSAWPWRHGVLTPKMKEFVYCAFDAAATHLYVPGLKMHMKNALGYGATKEELMEVLEIVSLIGMHGAELAAPILRDELAARGRG

SEQ ID NO: 670 - protein, 36 aa, Methylobacterium sp.
MRMRGFPWKSSAFRMREPAQLFERRIYDTAMDAAGM

SEQ ID NO: 671 - protein, 55 aa, Methylobacterium sp.
MASSMLVTLAWLALSIFVWAQLDAEKVLLLFAYLTALQAGYLVGAYISADAGPSR

SEQ ID NO: 672 - protein, 82 aa, Methylobacterium sp.
MPADDVPTHDGRAPPAGESRLRSIAKAVSWRVVGSLDTLLLSYLFTGSVLVAGSIASTETVTKTVLYYLHERGWGLIPLGRA

SEQ ID NO: 673 - protein, 44 aa, Methylobacterium sp.
VPIIPSPRHAARRSLFQSGIGLRLALAALLSALVWLTIAWALAT

SEQ ID NO: 674 - protein, 119 aa, Methylobacterium sp.
MTFQTKARPLLAALLPPTLLTTVTAPAVAAEPVSTFMAYTAPLAAPLGETAPHIPLIAASALIAASALAMFLPFRKPAAPARVEAPAAPVETAAVGPIYCPRTRRWRDASTGRLVKAPR

SEQ ID NO: 675 - protein, 88 aa, Methylobacterium sp.
MAEYHVTTYPPHVGPAEMALVARRVDTAGDRFVGAVVAVLDSLSLRDTEGGWRAYRAALAAAGSLRRGAVAARLTVAGGYVVLVERVA

SEQ ID NO: 676 - protein, 114 aa, Methylobacterium sp.
MQPRSLDELRRLLPGVGISIYAMEPGGPVTLELLEEGDPGETPQAIVWTAPSEREAWEKAFPPTPAEPVPQGSFMPPEGSPARAELAAAVEDPTAGLAAELAAELPADAGGLFD

SEQ ID NO: 677 - protein, 55 aa, Methylobacterium sp.
MNRQPKGQNLVRATVHLDAALLAELDDAGRARSLSRSAMLAQLLRQMLPKTRRTS

SEQ ID NO: 678 - protein, 116 aa, Methylobacterium sp.
MFDADDTPGYLHDAYRAALDNGLLSLNLTRVGTDNRMWQASSRFAKSSGFHVEIEANALEAVMKALGAYTKIGAPAPAGLFDDEPAPEGKPLDDGFDAIQDAVYGADEPEDEGLFD

SEQ ID NO: 679 - protein, 145 aa, Methylobacterium sp.
MKSLAVAALGAGLGMAATAASALTNAVAAGTELISGEPRAARRRQARKGHRFVIGRRGSRSRYQPHQGSREIARRVRQIMDGQLVAWTPPGTEAPAADAALRAEKAIPAQVLIDAGLEAERRAKRSEAARKAAATRARKREAANG

SEQ ID NO: 680 - protein, 189 aa, Methylobacterium sp.
VNLYKPRANKKNPDKLKYEVNLLYPKSADLSAIKAAVIQAAKAEWGEKAVDLLKNGVIKQPILDGDGPQGVNKTTGERYKELEGMFFIRCASNLKPALLSPKVTAAVEGEHLYSGCYGYAAIHAYTWESDEQGRGVSIGISMVQHAKDGERLGGGQQDPSKFFETIPDDDSGTGGAAADTGDGAGALFS

SEQ ID NO: 681 - protein, 430 aa, Methylobacterium sp.
MSAGHVQRDHAQWSASASARLWACAGSLALSGRTGRADSESEAAAWGTACHEVSEDCLRTGKDAVEWIGRFVQTKRHRIEVDEEMAETAQVYIDHVREEVAAARADDPGDDQILWLEQRFKLDAINPPFEAGGTADAVIYSRPTRTVKVKDLKGGRGIVVEALGNKQARTYALGAVLAMPGLDIQHVEVTIVQPRAPHRDGPIRSETFHIVDLLDWTTELLEAMRLAKLADDTYGSNGSEDGSFDEWAERFLHPGDHCTFCPCAGSCPALAVAAKSKALLFFKDESGVEQENTVGKLTPAEVAEILDRADMIQNWLNAVRAHAHAEAEAGVEIPNYQLVAKVGRERWNDGAEADVIAACEWAELPLSEYQNAPKLRTPKQVRKALGPDLAKLVERHSTVPTAGTSLVRQDKTVRTPVQPKAHLLFDVIDD

SEQ ID NO: 682 - protein, 179 aa, Methylobacterium sp.
VSISITINGDNASEAIREILTLAGSMGMSRGTDTSAAALATGMSDASSDSRQTAEPAKEPAKSTRKKADKPAPAAPPEPAPEVKAADAADEAAESEKVVEAKAEEAKVDPAEVFDRNVMRNAGGEYAKLYGMAAAQEDGPKIIGYPAFSKVPDEEIEKATRALRAAIAENPYGRTKAAA

SEQ ID NO: 683 - protein, 84 aa, Methylobacterium sp.
MGTLSPREREALLLRLEAFADAPREPSRYAANTVQADLVSAFRDGDRHYLLVVPAGGQPVRVDVTGRLGALFAYLGEVIEKAGI

SEQ ID NO: 684 - protein, 71 aa, Methylobacterium sp.
MGLRIRHTRVPPQVWKKALKIKGGKDDARMEAMRRWPALAKEFRVRRPDFAEAALIAEYGRLQEGANDLFA

SEQ ID NO: 685 - protein, 87 aa, Methylobacterium sp.
MSVICLIQRTGEAMAGFNSTKFLKAHFPDCATMRSLLTAYGFEPPAADTAEKWWRRGSVPGAWLPVLLGMLELEHGKPVSLLPYLDR

SEQ ID NO: 686 - protein, 138 aa, Methylobacterium sp.
VREPSFQPQDDNVRKHKLHMIAGRIAELRRDRGWTQAELARRAGLNRNVVNTTENETSFPTRENLARMASALGIELNELTDVFVIEAHHRAPAALSLTEAKGRPGYMAVQINRMLKTATALKIFQLIAEDDADAADRG

SEQ ID NO: 687 - protein, 332 aa, Methylobacterium sp.
MAAAQIYFGEWLINEQRAARDPKGSGLDFADVWAFYAKEALPKLVSGENTARSGRHLLEAFGDLPVADIGQAHLDDYVRDRRAGRIGRPAKLSTIWLEVAKLKAAVNFAIKRRKLPATARLELDSLEPPEVRDRWLRPEEVDRIIAEAETRREGGRLSRAERFLHLAIETAARRAVIENLQWDQVDLEAGVIHYHRHGDLRSKKKRPSVPISSRLRPILERAFEERITSYVLDTSSDIYHHIERIARAADVKGFHPHLLRHTAATWMARRGVPLWKIAGILGNTMQMVEQVYAKHSPDGLADAVEHISAARKPAQAVRPNVSANDDLGALSV

SEQ ID NO: 688 - protein, 150 aa, Methylobacterium sp.
MLVRLAIEADRPALVELCVQAVEESVRGIPPDREIINETIDSSFATAEPTFFVVERQRELIGFMMASIGSYAFASGIFTTQQVMFVRPDMRGTRAAALLIRHLIAWSTRLGAKEITGGNNNGLYTEQTARLLEKHGFERVGVFMRRPGVQ

SEQ ID NO: 689 - protein, 163 aa, Methylobacterium sp.
MILEPVTYATALQVGQGMRERDVMEFAAVAPVGAEDLASWLAQRFGRRSELLCARTNDGEPVCIGGAVEVRPGSATLLFYGTDRFPEIALGMTRFIRRHYFPSLAAAGSHRIECVTLDSYREMQRWLETLGLERESTLRAYGRDREDFAMYAWIDADARSPRH

SEQ ID NO: 690 - protein, 536 aa, Methylobacterium sp.
MGTIWIREFTGGLDTRKLAETSKGGTLVQAVDGHINRGGEFEQRAAFVPVYTLPKGTVGLAFTKAGPTVFGSIPDPGVPNGVNYQRLQHPDGATELVAVRSFDLFSGKIFAVGTFADGDIYQFYDGKRITNYGTNTAVVPGSPVRTFGRKLYYLTGPNLIYSNLADPTNFDADSGTKLPDGTTTDVSAPDADGKTTKTETTRKTNADGTVTITVVVTKPDGSVTTTTSTEPAPTTGVGAGFNDLSEEDYGSEDLTAIGRYQNYLAIFSDRTVQVRYMDPDPALSKGIQSLHNTGTISPRSVTEFGDTDLFYLDASGLRSLKARDASNAAVSTDIGSAIDVLLTDFVAQQSAEDVQNAIGVIEPRDGRFWLAIGDTIFVFSYFPAAKVSAWTIYKPGFKVEEIIVYKRRVYLRSGDQIYVYGGLGAELLYDDTEAVAWLPYLDGDRPTETKTLQGIDAAVRGSWRVDIGMDPAQVEASDKIGVVTETTFMANRIPASHQATHFSLRFRSDGRYLPNKPAVLGSAAITYSAESDKARS

SEQ ID NO: 691 - protein, 239 aa, Methylobacterium sp.
MARGQTLLKLLDDLRAECRLSPNPSHNAQQRETQVRLLQRMQEWLYDDYDWPHLRIERTFPSQRGQRYYGLPKDIALERILHLEVRFGTRWLPVGTGIDTECYAGIDSDGGQQGWPVRRWRIWEDDRIELWPVPDQDAGTGIGDDGSIKVVGIRNLRPFRDDTDVCDLDDRLIVLYAAAELLAAAGAKDAQLKLQQAAARYAKLKGDLTPRRRVQMFAERPERAPLRGMPMVDYRPASK

SEQ ID NO: 692 - protein, 219 aa, Methylobacterium sp.
VPKTVTPAEIQILQRMHGDDAVHDILPGEPVQRSKQQELGRLAGMYSARDEDGKPHLQVMFPSHTLLPMTIDELGLPDEFFRATSRARPTTRTVEVPVEQTHGAPSTPPTQVGWDNTEFEPTEVPADPETQPELAGTMVDPRSQHQNDEPPGVALAATNDGDADKLRARAEAQGTGPGSVPTQTGARTDGGPVETAGAKTAEQKSAEVAPAADANALFS

SEQ ID NO: 693 - protein, 360 aa, Methylobacterium sp.
MPFTANELANIANSALDYYLNKGKVEKQNIQEKPMSKAFEASAGQFPGGKGLVSIGVKGGQGGGSFQGYTHDDQVTYYNPASNLRVGYAWKEHHIGLGLTHTELKIDGITVVEDGADQTTTEKDGREQFALANLLEGKMEDFDEDKKASWDKLLHGDGTADAKALAGIQSIILDNPAVGSTGGLSRVTYPWWRNRAATAAAAAAGTGQDAIASSAAGGGVLMQFLQKEDRQLKRFSQGGVKLRRFAGSDFIDAMEREIRANGNYSLSGFRAAGTVDGKMADPTWDGNEIIYDPTLDDMGLAKRMYAIDMRRIRLMYMIGEKNKKASPPRPYDRYVMYRGLTSTAVMIASQLNTSGVYDIK

SEQ ID NO: 694 - protein, 342 aa, Methylobacterium sp.
MPFDREDLPEELDEALEVQAGSEGTDGQAGADGAKPADGEGSSASQAKTEDEGLLGVVRDAAPAKKPDAAAASPAEGAEAGDKPGEGAPKQPDNENYSDVPFNKHPRFRQLLSERNANKGDAEKYRQVDTFIRDNGMTAQEAADLLTVGAMAKTNPAKAWELARPWVENLLKACGEVLSPDLQQAVQEGRMTQEAAYEVSRSRASVAAMEASRGFEERRRQEQSQTEHARSITTAAEDWETDRRARDPNYDTKLELIHREIAWRHHNGDVPKTPQEVKAQLDDAYKAVNAALKPPATPPAAAPGRQAPPRTATKPVTGGSVAGGNAKPAPRSMLEVVQQAAG

SEQ ID NO: 695 - protein, 741 aa, Methylobacterium sp.
MFDAPQTALADEAPPTAAEVTPEQVGPAKEQAPTEQELALQRRISKTIREDKRHFKKAFEQMRSDMRVAMRGHDKDWSDDKYKANITGRHVKAKTAALYAKNPKAVARRADKIDFKIWNEDQQSLLMAFQTMQAAQQAAQMSQAQAAGDPNALAAGATAPEPQLPPGFAEAQALIQDFQEGMAARMQAQRIAKTLEKLFAHAIKEQQPLGFKESMKQTVRRACTTGVGYVKLCYQRQMGPSPSVEYRLNDSRVRLEHLKALIEAQQGDEGSVADLEAEAAEIEAMVESLSAEPEIVTSEGLVFDFPQSTRVIPDRLCRSLEGFVGARHLTLEYLYTPEEVKEIFGVDLGKKFKPYLASGKLADDTSESYQHQSDILDSEEPAGEQPKGDLCLVWEYFDKAAGLVYYVCDGHEGFLKPPAAPDVYVDQFWPVWALTFNAVESEDELFPPSDVALLRDIQKEYNRSRDGKREHRRAARPRWVFSKGSFTDEDLSWLGTAPAFSATGLNIDPTKDIKTQLQAVPVPGVDPNLYDVGEIMADLQYVVGNSTAGLGAPQKGTATANSIAAGANATADQSAVDDLDNFLTAIVRGAGQILMREMSEETVVKVVGPGAVWPEMTLQEIADELSLEIEAGSTGKPNQAVEIANWEKMLPFIMQMQGISPQWLARETLRRLDDRMDLTDALVDSLPSIVAQNRQAQAAPGDPNAQPDAQGHNGAANGPAAPGGPAGRGAPMGAQSKAPPV

SEQ ID NO: 696 - protein, 135 aa, Methylobacterium sp.
MQLDLTTAFAFIACILSVGALVFKSGGQAQAQKSFETYSTKVDADRQKWREDFEKSVEQRFGAVNGAVTLCREQVHDVREDLARNYLTKSEVKEIELRVSNSQDRILDHLDKIDTRLNEMQTRVLEAINKATSRG

SEQ ID NO: 697 - protein, 385 aa, Methylobacterium sp.
MQSRLPTICANYGVRAQNDLGYTRNKVAGLFGNGDVESQGFNTLQEISPVVAGSAGGYGWMQWTGPRRRAYLAWASALGLDPAADETNYRYMVHELLTIETAAHRAILACADTPEAAAAVVCTKYLRPGIPHLDRRIASAKAAVSYIGPAKGASSPDVGPVGVPISPAAPPVRLQRGQWPEDALTRFEVQAIQQRLLDLGYHVVGFVDGKWGERTAAAITALQENAHTALQRTDVAIDGHYGPQTRALLADDASRAKPSPQRAGVTAKTLAKAGNPVVKAGTKISWASLGSVLAGAGALAGTLSSTWTTELPWPFSMLAGFLPPWAMLCLVVAFNLYTGLKASGLIGTAVERVRQGIDNTGAAQDGPAKLTLPNLPFGLDKLLPR

SEQ ID NO: 698 - protein, 434 aa, Methylobacterium sp.
LFSFTAFQQAQGDDSFPGTELDVELDTTNNALDALLDAFKTVLRADGKLANGIVTRNSLAADLILGIGAARPWSPTQPYLADETVTRGYRIYRALVPSLGVDPAAGGTSWELAADLSQAVVIADGGVGTAALQDGSVTNAKLAAGIDGAKLLDGSVPASKIGAGLGTVPIGARMAYAGFRAPAGWLFEAGQPISRTDYADLFAALTETLQVDIGAGQKTLLNASKSIAGIGLRSAIVEGVGIPAGARLVSDANGQLSINAAATASAVQATIRIFPYGNGDGATTFNVPDSRGRTDFGRDDMLSSYWGTGAGRLVATVDGGSLQAGAFDAGAGKEQTLLKITNLPNNLPAGKVTVNFPKQNLATYGALATASVTTASGALPVQNVWTGTVNGESNPQQASADFQVDGTNANPTGSQPFSIVPPAHVTNKIIFAGV

SEQ ID NO: 699 - protein, 106 aa, Methylobacterium sp.
MARFPLTAAALEHEAEELISGLLAQPAFKSAIQELLMASVKELRDALDGAKASVDSLTAKVGQVSGSGIDPADLDPVLAEVNTLRSTVEALAASLPEPKPAAAPAA

SEQ ID NO: 700 - protein, 450 aa, Methylobacterium sp.
MSIKALRQKRADLVKEAQATFDLAAKENRGLTEAEAQRDDAISAELTQLDADIGRLERQMERQRQLGATVDDNAESERRAHAEPRGNDKPFRSLGEQLRAVMSASRPGGQVDPRLSMDGAGFSAGPTGMSEGIAADGGFLVQTDFAADLLANTYNAGEIASRIRRIPIGPNSNGLRANGVDETNRANGSRWGGIQAFWTGEAALKRQSQPKFKRIAMELEKLTGLCYATDELLQDTTALGSWMEQAFKDEMLFKVEDGIVNGTGAGMPLGYLNSGCTIAVAKEINQAAGTIVANNILKIWTRMAPANRKNAVWLVNQEVEPQLFALMLLVKNVAGTENVGAIAFPQVTYTPPGANGNEYGMLMGRPVIPVEYAAPLGTAGDITLADLSQYLGIDKGEMKTDSSIHVRFIYDETCFRFVYRFNGQPIWQQPLIPYRGTATLSPFVTLATRA

SEQ ID NO: 701 - protein, 78 aa, Methylobacterium sp.
MRWAIIRQQQVLYRGTREEVLAAAERYDLICHTVPGIPQPLDGRGFYPDGAEIPPRLRQGAVMLPEDMLPVRLRRRAA

SEQ ID NO: 702 - protein, 123 aa, Methylobacterium sp.
MVEHRRKPPIVATPRRKHWREHVRLSSGELRPTVWTAIRLPNGDQRGKTFTRATRVQLRLRDQAESRQFLFLPGTKIPRPAALYWQDMVSLPLVFAEVEGRLWRSRRPVRRFPQRPLREASHG

SEQ ID NO: 703 - protein, 50 aa, Methylobacterium sp.
VLLDASHLPVMESDRTFPSEAQASAAALAFSKLVTRAGKTLTAPTSGGLL

SEQ ID NO: 704 - protein, 218 aa, Methylobacterium sp.
MDRKSRHFRTFADDMKQFADFSDVADRDLDGQTPFLPNGYFSYGDALALTTVLATRKPARYVEIGSGNSTKFARRAIGKYKLDTKIECIDPNPRSSVRDIADNWISDGLLDVDPSYFESLNDGDVLMLDGSHLLFHGSDTTHFFLRIYPLLRPGVIVHVHDIHLPYEYPEVCDRLFWNEQYILAMMFYYKPASDIIAPIKYMHREGMCDEGASFWFEV

SEQ ID NO: 705 - protein, 109 aa, Methylobacterium sp.
MRPWPILVLLAALLGGLASAPARAAPLPVPASAEAAAPAPAVQQAHWRHRRHWHRRHHWRRHWHHRRHHWHRRHHWHRHHHFRRHWHRHHVWHGRPYGRPYGHRHVTFY

SEQ ID NO: 706 - protein, 121 aa, Methylobacterium sp.
MRSLVFGAVLAVVMPLAAQAQDAGDAAAGEKAFAPCKACHNFQKNGVGPDLKGVVGRKAGTYEGYNYSAALKNSGITWDEANLHEWLKNPKAKVPGTKMIFQGYPDDKKINDVIAYLKTQS

SEQ ID NO: 707 - protein, 54 aa, Methylobacterium sp.
MSMIATGGCLGSTLLCLLTASSGPLLALAGFFGGGTAGGLLGALAVAALGRGRA

SEQ ID NO: 708 - protein, 100 aa, Methylobacterium sp.
MRVTSAIGLATVLLSAGSAVAFAPALFAAGPAAVAQLCTESAGTVSCANGYAGFRGPSGKLWIGKDRRGTVIVSIDDRRNDQESLRREQDHGRFVLEQAW

SEQ ID NO: 709 - protein, 32 aa, Methylobacterium sp.
MAAWSIVDLLSVIGSRPADEARITAQADRIGD

SEQ ID NO: 710 - protein, 88 aa, Methylobacterium sp.
MTTVVTEGTMQEIQLRDAKATLSAVIDQAKQGAPSIITRHGRPEAVLLSFEDWQRLSRVPSFGRLLMAAPLAADDLPSPSGGLRSAEL

SEQ ID NO: 711 - protein, 448 aa, Methylobacterium sp.
MQSTPPYGEPPLPISSDAIADGPKVPGAARRRSVVAGAIGNTLEWYDFATYGYFSAVIGRNFFPSDSPTTSLLSAFAVFAAAFFMRPIGGIVFGHIGDRYGRKTALLLSAGLMAVSTFLMGCLPTYASAGLLAPVLLVVLRLGQGLSVGGEYTSSAIFLSETAAPARRGLTGSLACIGAAGGILLGSIAGTLVTGLLTPEDVHQWGWRLPFLFGIVLGVFIFALRRHIDDDHVETVFREDRAPADQRSPLRTAVEIDGSAMLRAFAMNLGLACGFYVVFVYLVTFMHTVSGLPQHTAFLINSLAMVVQAVCIPIAGALSDRFGRKRVLVLTGAGLTILSWPLFMLLTTGDTLLIVLSQVAFAILIAGNAAVVPTAFVEMFQHRSRCTALAISFNASMALVGGTAPMAATWIVHHLAWPTGPGLYVAVLSAISLAAVLTMRDRTGESLA

SEQ ID NO: 712 - protein, 223 aa, Methylobacterium sp.
METPTGDHSGAFEASPLAAIAVAVARGDVARIAALAPGLDLSVRGGRNLTLLEWAIWNARPRAVSALLDAGADPSVPGLDQETALHMAAMVEDPTYLEILLRHGAPVDPVSPRGQWTPLFRAVQNRREAQIALLLRAGADLNRVDATGNSLLHVAAQVGAANPWVLRLLEAGIDPTLRNAQQKTFQPYFFTTPERLLNDSGRETRAAVRAWLARRGVPADPDR

SEQ ID NO: 713 - protein, 28 aa, Methylobacterium sp.
VRSDTMLTALSPLHLAALSLIVAYLGWG

SEQ ID NO: 714 - protein, 74 aa, Methylobacterium sp.
VQRARSWYRRYGRLGAPQTPRPATQGPQAVRGRSLEDWARLGGGLLGPESADAPRPEIRADRAVALGIPISPPD

SEQ ID NO: 715 - protein, 173 aa, Methylobacterium sp.
MRLTTRTPSRPRSLIVGCAAAACAFLAVPSEAPGQAGPGSEEALVNGIQTIRRGDTVTKVDRTGKGAVLCMRGILRAMRAVGQACHDGADPDFQQELRAALARIDRFIADNAPDRAVPSRDGTTEPQHRPGAVCGRDAEAMYEALRTGGAAGLRAQVDDLLSIPREPVMNPCL

SEQ ID NO: 716 - protein, 174 aa, Methylobacterium sp.
LLIVAHEDILPRVCGTDGQSTMFEIAQDDLSDTQTRALLALHLAGMHASSPPGSVFALDLSGLQAPGVTVWTARRGGRVASVGALRMATDGTAEVKSMRTHPDFLRLGAGAAILDTIIAAATARGARRLSLETGCGPAFAPALELYRRRGFVSGPAFGTYVPSDFNQFLHLAIA

SEQ ID NO: 717 - protein, 221 aa, Methylobacterium sp.
MKRLMSTPPDRRSRKRLATRQAISDAATQLFLERGFDAVTVDEIAAAADVGRMTVFNHFPRKEDMFYDRDEEGRALLRETLRQRDPRVAPVETLRQLAHRLVTGRNPVVEFSARSGAFVATAAGSETLKARARAIRDELAGVVRVALAESVGRGPEDPDADLAAGLLLATWSVAFLRAHRTFRATRRTEAANAAFLAVVDRGTAGLVAALAGTPYAEAAAP

SEQ ID NO: 718 - protein, 37 aa, Methylobacterium sp.
MTDAPDPPEGPPGKTALLVVLTLTAVAAAAYVLIHMD

SEQ ID NO: 719 - protein, 508 aa, Methylobacterium sp.
VNTISAAVQKPAPKPDRDLAPSPHPAGDRQTLPDPAERGAFDLVLRAVSGGTPAARPETDEGEMGEPESETGEDPRPEAGASPAPPSPVDPGNAAAALAEILSAAVLAARPEMPAGHGAGAPGPAPSAASPAGPDAAPETSLAGNLEAARADASPRAGSSPGPLLQGSPPKIEVLDRAVHFKPVLPGAARHVLPAAAAATSPLPAGPNAADAQPRADRPGPVVPAVAGPDPAPIATAAQVAAQIAGTVAGKVAAAPPKATVALATDPEPRAGDASARAAATGIDGPGELTAREDNRSRSGIAGLRLAPTGRQGPPGGPIPGPGNGSGTEPARLAAVLPAIAAAITEEIERATAAGPERRVGADPAIPAAQDGPLRVLKIQLRPESLGIVTVELRLVDGQLETHLRAARPETAAMLQRDSAILTELLKQAHYRPEIIVEPVRPGDAGFSAGGSPSQGQSGLTDGGARPGHGGDGQRQEDQRAAKRPTIGRRDGERTDETVRPRDGGVYL

SEQ ID NO: 720 - protein, 44 aa, Methylobacterium sp.
MAEICITEDQNGRWTVYTAGLVATDLTREAAEAFAASYRRVAAG

SEQ ID NO: 721 - protein, 88 aa, Methylobacterium sp.
LTRSIPAPALVLAAATLAALPAAARAQDRPGPGAAPPAETAPKPAADTKDPGKTATEAVTHPSAVPPTEGAVGTGKPPATGDAPTTGR

SEQ ID NO: 722 - protein, 66 aa, Methylobacterium sp.
MHRIRLGLRRRAPVPPAPALPESLTRYVSPPAPEAGLITAPLRDIGMALLVGVVVALVGGRILEAW

SEQ ID NO: 723 - protein, 170 aa, Methylobacterium sp.
MRGLVSTATLSGVLALVFSMPASAASDITVAAIATGRLYVVGTTDRPHTAVILDNRFKTESDENRKFQYELVYHPANCVVSAAIDGTIHEAVVSNCGQQVVPGTWLDPKPAMRRPTPLERVLSPTVEVPSTVFCPSVQTERSQDPARIELADRTPPVFTVVTGMNFSPRY

SEQ ID NO: 724 - protein, 31 aa, Methylobacterium sp.
MILRAEQVSTGFVGGRIRVRAAEQQDARRRN

SEQ ID NO: 725 - protein, 314 aa, Methylobacterium sp.
MMRPRWVRRDLLKSCFRDLPICAAASLLPTSRSSAAIDASVDPTQGRTLVFDEPFAEINGRIWNGGPKATTGPSGFYGRSAFAPLAGAEGFKPYEIVADAEATGGTALQISAKYIGRKMSVVNYYGNNIPDYQWISGNLQTGSRSGVVSVGWRHGYLEARMKFPRHPLTWPAFWLLNREGITNAKRSIEVDIVEHKGFEPKLYGAYLHEWGQPGEHNEGTGVPTPVDMTEQYCRYGVLIHDGQCIPYFERKPIINPKTNQLNVWTLTRASEMEQAGDVFWPLLTLALRTDVPAPQLTEAQKLTHMRVDYFRVYA

SEQ ID NO: 726 - protein, 294 aa, Methylobacterium sp.
VRDAVRGRPGTASPRGSTGRARTGLSRRSLGLLVVLAATAVWLAVALVPNLLGKGGALWAIVHGACVPHALRGQGPAPCSLVDLEGGVEKGYAILKDLRGPAQFLLIPTARITGIESPVLLQPGTTNYFAKAWRARTFVEGRLGHPLDRRDVSLAVNSRLRRTQGQLHIHIDCVRRDVRDTLRRLAPTIGDRWAPLAEPLVGRPYRAMRVLGEDLGTADPFDLLARDDGARSAMGEHALAVVGAEFPGAKPGFVLLDGLVTSRFGKASNGEVVQDHTCAVAAEPASSGFRPLED

SEQ ID NO: 727 - protein, 99 aa, Methylobacterium sp.
VRNAGAAVGPGTGRGDAAALFALRIPRGPFSDTYPMGHASRGLVIGAGLGHACPHPDAVGGRNRSGGALPGSRRERQGWDDAREDLLDARSGSREAGDR

SEQ ID NO: 728 - protein, 54 aa, Methylobacterium sp.
LLFSRQAEPTIRTSDLVGATAGVALLGGLCLLLVALLTSEAQGFTDLTSILTDR

SEQ ID NO: 729 - protein, 93 aa, Methylobacterium sp.
MLTTLLAAMIREVPVVWSTSVDDGPVDRVKPDIVLTEMAERLLHQTVEDDFAVAARVAGHAAAVTAGWRRSREASPHGQGAGLTRPAAFDRRG

SEQ ID NO: 730 - protein, 57 aa, Methylobacterium sp.
MAVESATATAESFTIPTGHHVDVAEAIEMRSPATSLRAGAPPHVAESAINMSFPRTT

SEQ ID NO: 731 - protein, 37 aa, Methylobacterium sp.
MFKNRPNLHATAVMTLVCLGAANVVIAPASVLYLLYA

SEQ ID NO: 732 - protein, 74 aa, Methylobacterium sp.
MQASECCIIRVSIAASLGWLIAITLMWKHGVLAALIVSPLFGTAAAIAAMTLFWFVSLFVSCEPIGPRASDTNR

SEQ ID NO: 733 - protein, 94 aa, Methylobacterium sp.
VAKPAAPPQQAEGAPGSGQPPDSPGQGVDLNTASVEELNALGAGMIGRRIVAFRPYGSPEDLVTRRVLKKADYEAIRAAVAVRQTESAGAGRPD

SEQ ID NO: 734 - protein, 84 aa, Methylobacterium sp.
MEAIGVEDRSGGRRDASARLRRIAAATGVPLAAFFGAPAPRPLAELSELIGLWQSIADQEGRNAILAVARARAAGTKDGAGGPA

SEQ ID NO: 735 - protein, 97 aa, Methylobacterium sp.
MGLTAFAVFVIPWVLLAVFLTRSPSTLRLGTASAPWRSIPTHKEMARADRRALHPHERRAGETDGVSGRDQRVRTDPPAGGALGTSVEPTEPDDKLS

SEQ ID NO: 736 - protein, 59 aa, Methylobacterium sp.
MLTMTLALLAVLIAGALCLGMISAFLPFQRPREEIELAEFADDEFFDIGGPIIDLQATR

SEQ ID NO: 737 - protein, 231 aa, Methylobacterium sp.
MNTTVTAIASAILAGALLGAPTGAKAQAGSFANHGFGNHNFGAAAVGGGFANRGFSNPGIGAGAAGGFANRGFGNNAFGPAAGAGGGSFANNGFGNHNFGRPAVGGGFANPGFGHGFGAHRGYGHHRHYGYNRGYYGRPYGYGYGYGRGGYALGGLGLGVAVGGLYGGYGYPGYGYDTGYYGGYAPVTYGYADTETDRVADDDRYCARRFRSYDPQSGTYLGRDGRRHRCR

SEQ ID NO: 738 - protein, 43 aa, Methylobacterium sp.
VTGIDGPTTRGRLQQIDTHALLTIGPHRRRSAVGSAREPEPVP

SEQ ID NO: 739 - protein, 70 aa, Methylobacterium sp.
MLCTEGEGQRGVPGGTRAGPGAAQPVPRSDAAGEIGSARLLQGRREIVIRHGDHAYRLRVTASDKLILTK

SEQ ID NO: 740 - protein, 50 aa, Methylobacterium sp.
LLVVLVFAALIGGAIGFAVVLPKGFLLALLAAQAGAAVAVGLVVLLTRRR

SEQ ID NO: 741 - protein, 90 aa, Methylobacterium sp.
MSSESTGPVTVRGSVGVGAGVAPATVQGGPLPATSGGRDGAVGPLAIERFPRPVGHRDRPDARLRPPLSPDNPRHRVRRIDGARAPQPGR

SEQ ID NO: 742 - protein, 53 aa, Methylobacterium sp.
MDRHGQEAGADTAAEAGLGTAGDTAGDAARDTARDTAEARAPSPARASARTAT

SEQ ID NO: 743 - protein, 46 aa, Methylobacterium sp.
VAAVCMGFLRGMRSLPRWGRFGLWVWMGAIRARAVVSRLGGIEAMR

SEQ ID NO: 744 - protein, 307 aa, Methylobacterium sp.
MRFDVRHISSCLVLAQELHFGRAAQRLATTQPGLSRLVAELEAEVGVKLFRRTTRTVEVTEAGRAFLAECRIGIDHLERAVTLARRTATGMAGVLRVGYMDFAINGRLPELVRAFSEFRPAIRLELSHVPSQSQREALLNDRIDVGFTLSAVENEHFESLLFDRDSYVALLPVTHPLSNARSLTLKDLASEPFVLGSGGSWSAYREAFFAICHRRGFHPTISQEASSSEGIFGLVAAGTGVSTYASCVRNVQRRGIVIRSLDDVPDTIATYATWMKPARSTSLEAFTTFLATVWGSAPARSNTRSKF

SEQ ID NO: 745 - protein, 273 aa, Methylobacterium sp.
MKLFDADLVFPRVPATMPSPWMPLEVGRAMGAICKPHDAGGGTSFLGLHFDDHCFGPAPEHVAHAVLALPVRAFDLEPDTRREDLRKAFYLAAPGFGRRPDFTLGAGAFMVRSFEGADPRDTVYLIWPVRCDPGEAGLDCHNGMGRKAFRFAADGALRDVSADVLPADPLLSSDDRVRQTKYGGSVLFLLDDKLPYAPTMRWIMEFDPDSPPLEKDDPKAAGPWAHFGFVHWTGSRFELVDRITRSQWPCRKFHDAPACSTYPDDFEDPFVIP

SEQ ID NO: 746 - protein, 117 aa, Methylobacterium sp.
MAVESYGDYRDYFDSKPVTAKRAPRSASQKMTPIDITTDLSAVRRRADGDRREMYRYDTGSRLIADMRPRNWDGGHVPVQPHSWSPDGFWSPMVQSREGRERPDQSFEGRGRPERFR

SEQ ID NO: 747 - protein, 149 aa, Methylobacterium sp.
MRFAVAALLSAVPLAAAADDLPPPVAAAIAEVEAACGSAPATLDPFVIDRQDVNGDGVPDFILNVGGLRCGDEEVSQCGLMGCPKIVLASSKNGFVVVLDIYAHDLRFRPLNGRPAASADDEGWNCGSVRRGPGRTTFLWDGTRFACAE

SEQ ID NO: 748 - protein, 29 aa, Methylobacterium sp.
MAWSAPVVSEICVGMEVTSYESAEIDTFH

SEQ ID NO: 749 - protein, 31 aa, Methylobacterium sp.
MKPNTIAPISSDRRGNGPDRQSLPVAQGEEE

SEQ ID NO: 750 - protein, 26 aa, Methylobacterium sp.
MMEFMNFVSTTSPYFGSGMISRFSAE

SEQ ID NO: 751 - protein, 47 aa, Methylobacterium sp.
MTDLLVTLQEPAEPAGQAGPESETSALRAHIARILRRLPPAKATKTT

SEQ ID NO: 752 - protein, 72 aa, Methylobacterium sp.
MVERYHFRLRGPDEVIEDEEGVLANSIEIAVAEATQLIAEMHARGELPDPDERWCVEIHTTDGVVLRSLQLY

SEQ ID NO: 753 - protein, 122 aa, Methylobacterium sp.
MSGPRPIAVLAEDEEFSRLVAADMLTALGFEVLEAEHAQGALQHLEACDGAVLLYTDINMPGTMDGRALAHAVRARWPETRIIVCSGCDPREATALPEEAHFIAKPCGEKLVRKALKALHLH

SEQ ID NO: 754 - protein, 624 aa, Methylobacterium sp.
MIIRHTRRLQRSGEAVASRDGRLVAPAPTEPDWDILGLIDLGGRATVVALLGPNDARAFRFLNPDGTALASCAADFLAAPWDGAGPLDWQAEALHTDDGDASNTRAMIEDLHLLIEALARAAAASPEHAVRVVTGGGSDPRAQAMHAALARLNAAPAGAPPHLPELVTKAIVARGGQETAHPDGGDLRFSIYLPMPGFRFVGYAADRNETLCTLIGKNSRLASALLDVRANTAYARPNLGSVGFDAATLVQVRLWRQYLLPALIDGAARSTRVGVVFEHAHISHAIWNELAAVDDVLSLGRAPAVFLFASCNEPISPVDAVFPELAGHVYRGIEGPLPLLQAAVAGAAIFLPFRSYRVSQRLADRLAALARSAEPALDARLTDAARRATIVLIGLRLENRQWVRQLDGYVALIRRLGRRRGERFLVIVDGHNTLAGAEGGYVESYCESLVPAEGSVPSIVRKELELIGALRARVADVSNVELMPLVPCSMGASLVAALHTDLFVTHFGAGLAKYKWVANAPGCVISSRSVLSGKDDLRIYDTEIFRENVSACHYFPAERVTDLDTSTNALHVPGSREREDFDLDLEEFASFVEQNLPKRRAARPHWLRRLTLFRTRAATDAARL

SEQ ID NO: 755 - protein, 32 aa, Methylobacterium sp.
LVIHQGEQEMLQRRVFVPALPGERQGAVEGLF

SEQ ID NO: 756 - protein, 45 aa, Methylobacterium sp.
MLEPLLFIGLIIAAVAAATRLGIAAAAPMAPSRLDAWDGRADADA

SEQ ID NO: 757 - protein, 43 aa, Methylobacterium sp.
MATKMMTRGMTVTDHIVAWSMLTGLALAVLQLALTAALPTHFV

SEQ ID NO: 758 - protein, 210 aa, Methylobacterium sp.
VVDEGIRGEDHGREHDQPDLLTVAVALIGIARVARFGRPVLLRVARVRGLRRALGRSLPVIRAGVVGRQAQGRGRDESREQRGRVNRELRPAGALRDREKLGIASGDLVDESAEIAASHRAVQDLGRDDVAAVDPGEMHDGVAIRPAEDEPGVRLVAQALLAADLQAGPDQRGLDAVEFRELLLRPAALARRCGSEERDDRAHRDLTSAQ

SEQ ID NO: 759 - protein, 139 aa, Methylobacterium sp.
MARRSGTPAGTFAGPRRAWIGSACLSQHETRRLIRTRAPGRVRWNGRRLSEMARRIGAPAPPVAILTAALIGGLPRELREVRCWTQARIGRRAGTAGDAVLHPFGCTCADAGGIRIRDRVVPSPCLRRDVHSQTVVRAT

SEQ ID NO: 760 - protein, 46 aa, Methylobacterium sp.
MAGIPGVRCRVLVMFRRHRAPNRSLASLPVIRFGGSGLDLQVGCRC

SEQ ID NO: 761 - protein, 38 aa, Methylobacterium sp.
VNGGTLCVRSIVLEVPGRLAASIVLPGAWIGSAHLRAG

SEQ ID NO: 762 - protein, 221 aa, Methylobacterium sp.
MREITGSLFQSLDGVIQAPGGPEEDQTGFAHGGWTFPYFDASLAGPMGKLLGGDDELLLGRRTYEIFAAYWPHNAEQPIGATFNAIRKHVVTGSDAALDWNNSRRLAGDPVAAVTRLKESEGPDLLIQGSSRLYPALLPAGLIDRLVLITFPVMLGRGKRWYADDPAAARTWTLVEQSHSPKGVHVAVLARDGAVQTGSFASKPPSADEIALRERQAAGRW

SEQ ID NO: 763 - protein, 114 aa, Methylobacterium sp.
MAVACPVLTPEERKASEILDAAQRAMMETVHAAVAEAAARVRQQSLDAGLDLAPPPRAYFESVVHQRMYLTLCGAAVGTFAGGDARTAIGLIRNQQLIANRYWAAGIAVTPRAP

SEQ ID NO: 764 - protein, 92 aa, Methylobacterium sp.
MPSTPPRLAFSHAGQDFIVKARPVSDGIEVRGFWHARSRGRTRFFVVVPADALEKAKRPDWADPVQAALKLVRKQIVSAIDEGEPLAEDPQP

SEQ ID NO: 765 - protein, 32 aa, Methylobacterium sp.
MALKIFSYAMIGAFVGGLAMTVMGSAGVLMGL

SEQ ID NO: 766 - protein, 71 aa, Methylobacterium sp.
MRRTAEILTTLILFTVVMSALGWVASITAPGIGDWLSARIGEGGIWAGFAVLWVTAGVLLYREKAGRAAGK

SEQ ID NO: 767 - protein, 841 aa, Methylobacterium sp.
VGDARPRQTTARVLLASLIGTTVEFYDFYIYATAASLIFGPLFFPAALQSAELISAYASFGLAFVARPIGGAVFGHFGDRIGRKATLVASLLLMGLTTSAIGLLPTFALAGWLAPVLLCLLRFGQGLALGGEWSGAALLALENAPPGWRARYAMFAPLGAPLGFFVANGLFLVLTLTLSAEQFADWGWRVPFLLSVPLVWLGLWVRTNLGETEEFAAAVKDAQPPRVPLVALMRDHAGQVVAGMFGVVACFSLFWTATAFALGYGTTTLGYSRASFLTVELGAILFMAAAIVVASWLSDRLDPARVLIVGCAGTIVSGILLAPMLGSGSLATIFAFLAFALWVMGFVNGPLGAWLPSLFPPQVRYTGTSVAFNVGGIIGGAFSPMIAQALAAQSGLTAVGFYLALTGGISLIAFDTSARRRALDALARSERRYRALFEQSHVALCEVDLSEAQAHLAEARATGALGPDLRGQADAALVAALVAECARRIALVDVNDATVRLLGCGSREAVLGSMSRFLPPGNDLVLPLLQRIDRAGGRFEAQGRLIRADGREVTAILVVALPDDEAALDRVACAMIDVTERERAKEALLAAQAELARAGRVSTVGAISASIAHEVNQPIGAMVMSAEACLRWLRRETPDLEAAARAAERAVRDGMRASRIVQRTREQLRRDRSQPEILDLGSLLAEVATLLDREILAAGATVRTVIAATEARVLADRVELQQVVVNLVTNGLHAVRDLPEPRRALRIALTAPAPGRLRIAVVDSGTGIDPEQLPRLFSPFFTTKRDGMGIGLAICRTIVESHGGTLTGGNNDGPGATFAVELPAAEPGAAGGAAAEPAAAG

SEQ ID NO: 768 - protein, 76 aa, Methylobacterium sp.
LADPEFEIGKFGPNDKRSVLRQIAHALGVPEDAFLDESEALATIDMTGDLLRVWHALTLSDRRLLLQMARGMISRG

SEQ ID NO: 769 - protein, 69 aa, Methylobacterium sp.
MSDDVAALLLALATENAELRQQLATAQDMLMETAIDAGHLHARIEALQAERDAWQAEAERLARRPPRSL

SEQ ID NO: 770 - protein, 64 aa, Methylobacterium sp.
MAIDRSGERAALDTEVEDTQDTIAKLREAADGTPPGHSSRVALKKAEEKLAELVKHITRRDRTG

SEQ ID NO: 771 - protein, 42 aa, Methylobacterium sp.
LIALSGIERARTAPTCGGAAILDLALCLILSVTVVGLLLLAL

SEQ ID NO: 772 - protein, 74 aa, Methylobacterium sp.
MPKHARLALAAALLSALAAGAVRADGTSAFGAANAAQLRGYTASPAQIYVPAGGPSAKPAAPATQRPKAPARSR

SEQ ID NO: 773 - protein, 65 aa, Methylobacterium sp.
VTICARTGGEPPLCRIAARCTSEALLREDLFREDGRPFSGTERLRAQAISQGCYATLEAAARSAR

SEQ ID NO: 774 - protein, 112 aa, Methylobacterium sp.
MRKIGIIATAAAMALGSVAVTTSAEARPYGYHGGYGGYGHGYYRGRRGIGTGAAIGLGIAGLAAGAIAAGAARDSYYGGGYGYAPSYGYGYAPVYGGYGYAAPGYGYYGYGY

SEQ ID NO: 775 - protein, 33 aa, Methylobacterium sp.
MKGFTKIVSYAAAAAAVCMLAVVVVQSAGLLAG

SEQ ID NO: 776 - protein, 509 aa, Methylobacterium sp.
MAAALLAPASGRAETTVKAVLEAEIVTLDPYFTTAYITRTFGYMIYDTLFAPDATGVFRPQMVDTWSVSDDRLTWRFTLREGLRFHDGAPVRAADCVASLRRWAARSALGGRLMDVTSSLEPVDDRTFVLTLREPYGLVLDTLGTTSSPTPFIMPARLAATPPTTQLTEVVGSGPFVYDRTAHIPGDHMLLRRNPDYRPRPEPADFLAGGKVVKVDALDIRVIPDGATATGALGTGEIDYMQYAPFDLIGQIEANTSLAVMNFTGSHRFTGHYRINTASKPFDDPAIRRVLLRLVDQREVLDGFGLDPRFSQTCDAFFICGSPYETHVGTDLLHDPSVAAARAALKATAYKGEPVTVMVANDLEAARVSSTILADRLKQAGFTVDLQVMDWAALLARRTKKAGWSLFGIHALGLDLSSPLTNSAINFNCKDAASSGFMCDPRMVALFDRFAREPDPDKRRVIAGEIQTIVYGEGLVVPFGQFAQPAAYRRSLTGLIPSAIPLFWNVAKP

SEQ ID NO: 777 - protein, 88 aa, Methylobacterium sp.
MLKSLAAAALLAVGIAAPASALPVAGSPLPAAQDGLIQHVYGGCGPYGHRGPYGGCRPGGQWGGYVGRACPRGFHLGRGGRRCWPNRY

SEQ ID NO: 778 - protein, 45 aa, Methylobacterium sp.
MTLLTALSLLPFAAIANFALVVALANHFDADKPATGFTGPVPNLA

SEQ ID NO: 779 - protein, 63 aa, Methylobacterium sp.
MSVSAGQEDQMTAPFSLIRRWLDCRRARSELASFSERDLADLDLVGCDVKRIASARSGRRGAA

SEQ ID NO: 780 - protein, 48 aa, Methylobacterium sp.
MRYRAVSVLDVSAMASEENPTDETLMLREHIRRILRKLSRARAELQYG

SEQ ID NO: 781 - protein, 101 aa, Methylobacterium sp.
LLSSPFDRALSTIPASIGRGAESIGDDVANATFEILKGIRARVAMPAMAGGFDARVSAIAAAVVALENRSGCRSSAERMPCAAWEIDRKQGTRQSDTIQLS

SEQ ID NO: 782 - protein, 224 aa, Methylobacterium sp.
MDHAADPDPVLIRLREGFERVALVLRADLWAAAGDAGLNPTQAQVLALLAGRPGGLRAKEIAAQLAVSAPSMADTLSALARKALLTRAPDSTDARAVIVRLTDEGRALGRALAAATSQVMSALARLTPPEQADLLLTQIKLIRTLQQAGAIPVQRMCVSCRHFRPNAHPGEAQPHHCAFVNAAIGTRDLRLDCGEHEAADPDVQAATWTSFANGSPPLRAPRET

SEQ ID NO: 783 - protein, 239 aa, Methylobacterium sp.
MTRIKARGVGLVAAALCALSTGASAEPIRAQPNPAVLASFDIVETTIATRGDTAVFTTRVRGEAGKDKPDATGKFEGSSVYAYVWPTTLDSDAIGFDKAQGIVALAVTFHPDFDDAAYGARNRHVWHPHWVVLARDAACGGGLKVVDIPDGAKPKVPPTWPKVPLLIDSPDYPTTFRGDTVQVEIPVSLITGIKGASFDGVTSGLKVNGNLHAPLLCVSDVFKVASGNLSLPGKVTPQK

SEQ ID NO: 784 - protein, 182 aa, Methylobacterium sp.
MTILAPELVTGRWFNTPAPLSLAALRGTVVVLHAFQMLCPGCVAHGTPQVEKLHRMFAGNGAVAVIGLHAVFEHHAAMTEVALEAFIHEYRLPLPIAVDRRGDDGPIPQTMRRYGMRGTPTTIVVDRDGRVREHAFGQVDDLALGILVGSLIAVPGTGSVRGALAPDGCDEAGCRLPEETRP

SEQ ID NO: 785 - protein, 540 aa, Methylobacterium sp.
MSSFDESVARQQRFMGPLLVAAILFGLAGLPVAVWLDLRGLSERMLATQAIETGRIIDQMRSFYASDVVQAVNAATGRVETRHDYKGVPNAIPIPATLSLELGERISGGDGAVKYRFVSDLPFKDRKPHDLDSFETQALADLRAHPMTGFVSETTGSIFDRQVRIAAPIRMESACVRCHNAHPLSPKTDWKVGDVRGIQEIVLHQPIAANVFAFKYLLGYFILAALAGTTFLLLQARQSRLIDRMNRELTESNGFLASVSVQIAKYISPQVYKSIFSGERDVSVATERKKLTIFFSDIKDFTATTERLQPEELTALLNEYLTEMTAIAVRHGGTVDKYIGDAMLVFFGDPESRGVREDAQACVRMAIEMQKRLGQLNARWRRSGIERPFQARIGINTGYCNVGNFGSDERMDYTIIGAEANLAARLQAAAVPGGITLSYETYALVSDIVQASPQEPIRMKGISREIVPYAIEGDLTAEAPETIFSEHARGIDFYVDVDALEMEGAARLRKRLLDTLAAVDRRMTGAGTPSDDGTRPSAAG

SEQ ID NO: 786 - protein, 629 aa, Methylobacterium sp.
VTTPLDRRRLNLRWLCASCLIATCGAALMGAALRMSVDTDLAPAKPAFRQGPAQVAEGQGVVGQRGDRLVRRQLVASDREEFSAPVTHQVGAREIIRTQPFVRLVTSLSSGDAVDGQIPPFDPTRQLAEDGEVAPVADEPGDDPSGTTVTITRSALAGTPVPDDAPGLSDEDVTALVERQSDEARQTGPRIAVPLAPQRLLSQILVAAPADAAATAAGADTGRDPFHAIEVRVVPENITDLAETQPASGLSLTETRDVVLKRGETLADALAANGAEPARVTAILAAFSEHARTGLAEGQHVDLLLVRSHAGEAARRIARVTLYGAGGVEEIVAERDSGGFVTVAPPSAQVAASHSGDDGDGEGSGASLYRSIYEAVLRNGLPGILAERIVGIFAFGLDMQRRVAPSDRLEVLFSPSEKAGGAPEVRYVALTLDGVKHRAYRFEAPEAGTASYFSETGNSLRKFLMRMPIADGRITSPFGTRVHPILHYARFHNGVDWANKAGTPIMATGDGTVAYAGPRGGYGNRVEIHHANGYVTAYNHLQRLAHGVQVGATVHQGQVIAYMGSTGLSTGPHVHYEVSVNGRFLDPMTIRLPDSQGVSPRLMTAFERQVAATNALRHHGALAMSALPL

SEQ ID NO: 787 - protein, 403 aa, Methylobacterium sp.
MNGVAPSIRPAARAGDPDAAFLATVATLRPLIAEHRSALAVGPDLPEPVAEALIDAGLAQLWLPRGLGGPEAHPLSVLAAIEALAELDGSVAWCAAISSGGASRFADLIDADVMRSLIPAGRKFAGSGSGQPTGTAVRHGSGWRINGRWSWASFCRYSSVSALMCVEIEGERPKLDENGRPSLRGVFIASKDVEVVGNWNAGGLRASGSHDVACTDIWVPNEQTIDGASLMMPRDRKPLYMLPMASAAAIAAIGVPLGIARASIDAFIDLAQTKTPHGGKVPLRLREDVQVAIARAETSLGAACAFARDTVSEFWWEAENGRPITLAWQAKLRRACWYAGHVGKQVVTSMYEAAGSSAVLEDLPFARQLRDVYAACQHMHYQDRLLVPTGRILLGLESDAPLI

SEQ ID NO: 788 - protein, 54 aa, Methylobacterium sp.
MPGGIGIGRGDPLRPAVTRTARFSGPEGFHPGALWLAAAAPLLATLLLLVRLAA

SEQ ID NO: 789 - protein, 32 aa, Methylobacterium sp.
MMLKAFSYAMIGAFLGGLMMTVVGSAGVLMGL

SEQ ID NO: 790 - protein, 72 aa, Methylobacterium sp.
MRLLWDRVLDRAWLGLAAAAAVTVAVHEGAAVGRLAWTLGSGGAALAAPAGGGRAVPPARAAACGPAPAPSP

SEQ ID NO: 791 - protein, 776 aa, Methylobacterium sp.
LGLYSKLRAALAEDALLARGVKRSLVDGLYQPFASLAVGAASGTIVATAAAFWSDDRAITVTAFAVGLIGLTRIVLARIYLTKGPQKHDRYELWETYFSLGAFAYAASLGILSFLITTRSSNLALQVITPTFTIGYAAGISGRNAGRPLLAIAQVLLSAMPLSAGLLVSGDGERASLGILSLLFAYGMIDITLSTREIIVSALVTTREKEALAEKFQAQANLFDIALRNMSHGLCMFDARGRLQVWNDQFLSISGIPSNRIHTNSTAKSLYASSRAIIDERAAGRGATLSTFSAASNALRSGNLVLILPDDRVVSLMQRRTAEKGYVIIFEDITERRRSEARIQQMARYDDLTGLLNRSSFKAKVSQALKASASSKGAFAVHLLDLDHFKVINDTLGHPAGDRLLQMVADRLRGIGALSGSVARLGGDEFVIVQQSVTSPAVAEDLAQRVLQELERPFDIDGTHVTVGASIGIAIAPFHANDEDRLLKCADIALYAIKGAGRSGFKIFQHEMEAATRARHALESDLRAALTNGELELHYQPVVDASTGAVVSCEALLRWQHPVSGYIPPSDFIPVAEDTGLIVQLGDWVLNEACREARNWPSTVSVAVNMSPRQFGDPQLAFHVIGALNRSGLPAHRLELEITESVTLGATHKIVDTIHTLRQLGIRLSIDDFGTGYSSLSSLRNFAFDKLKIDRSFVWDLDRKAESTAIIRAIVGMGRSIGMAIVVEGVETETQLSILRAEGCDLIQGYVFSRPVAAPQIRAMLATAQPVTKLAS

SEQ ID NO: 792 - protein, 86 aa, Methylobacterium sp.
MEQTMTPRTAHPVAPYLLLAELGAALFGGTAASAEERITLEIIGAVRMTGPGMIRPADATPVRAEDTQAREAGVERPSERIAARHN

SEQ ID NO: 793 - protein, 29 aa, Methylobacterium sp.
LRGIARRRPDGAEEESWPFVDNADPYSVV

SEQ ID NO: 794 - protein, 43 aa, Methylobacterium sp.
MIGIFQPFGVLHVWTSIGRPDTAAMLCLLLDPIVGGAVVLRRF

SEQ ID NO: 795 - protein, 271 aa, Methylobacterium sp.
MGVARTRVDRRTWSVHGAAKRNTAIIQAGLARIVEDEILPRLALAHQADPPSPASTTRSPTPERVASLAQALMEGEPHAEWVRALLEEGLSLDALLLDLFAPAARYLGELWEDDAADFLDVALALGRLQNLTRALCADLEGVDVTANGRRVLLMPCPGETHLFSLALVASFFREAGWDVVLTNGADEDPASLVRAEQFDLVGISLSCDILLPVMAVSVAKLRAASCNPDLRVIVGGPLFVREPASARVVGADAVAADAQSAVRIAEATLAR

SEQ ID NO: 796 - protein, 229 aa, Methylobacterium sp.
MPDRSLRAVWSDSLMAEVGARLPLFDDLSPDTIQRLSAEGFGRGLLTASLRARLRKAGFPDLGHLAQSSPVAIATIRKFGPIRVERVRHFILDVLARWLPGAREMHTPEATRVRRLDRLRGLPAGCLPLAAGQIAALRFADASCADVAACSRLGLLRTGAVTSGDVDHVVAALTRLARASDPVPPRPLEEAGAAPSCDAATGAARRAALLAEQDREWDEAAPTARRPRR

SEQ ID NO: 797 - protein, 69 aa, Methylobacterium sp.
MRKLTRLVVRMAQRPGLLESGRLIDQLTDLEAEGLARNISWRSIETIRAARLKLRVEGLMPTSSLPLAP

SEQ ID NO: 798 - protein, 101 aa, Methylobacterium sp.
MSDMPERIPAMIRVRDAARSARFYRATFRLDTADRPGFETFTPIDLAHAASGLASELTVNTGHDGACGLGVGAARGTARSCFIDDPDEHKIEVLARGWRFA

SEQ ID NO: 799 - protein, 261 aa, Methylobacterium sp.
MDLQLTGRSALVTGSTAGIGLAVAKRLAAEGAEVIIAGRQQAKLDAAAAAVAAAGRARAILADPATAEGAAALVRAAPAVDILVNNLGIYEAKAFPDIADDDWHRLFAVNVVSGARLAQAYLPGMQARGWGRVLFVSSESGIVPPPDMIHYAVTKSAQLTIARGLAQLTKGSGVTVNTVLPGPTRSDGIGDFLKSVASDPDLSPEAMEAEFFRLHRPLSLIQRLIEPDEVAAMIAYLASPLAAATNGAALRVEGGIVPTVA

SEQ ID NO: 800 - protein, 73 aa, Methylobacterium sp.
MPRWLQFALGLVTLIALAAGIVRTLVRHMPDAAASWLGPWAYEALILLLAVSFVAIIVRAAQGYRSPRSDKVR

SEQ ID NO: 801 - protein, 128 aa, Methylobacterium sp.
MLRRLTILLPLLVSTVAHAAGPGARAVGTFEHQEDGYEQGVEVKAAGAAGFTAQFSTGTKGCGGEVTMKGRPTGPDTVVFSKTEGGQTCRITARYASDFRSVVLEEQGCTMWHGASCEFQGTLKRKGR

SEQ ID NO: 802 - protein, 76 aa, Methylobacterium sp.
VPYSEPMSASTGHGLHDVAQMLRQVVAIDLLHDLLVGAERSSDLAGRHARPHDPRREGVGQCAWQLSKSALTLDDD

SEQ ID NO: 803 - protein, 320 aa, Methylobacterium sp.
MPVTIPDRLGLGVADAGNGLSARAAEARSRLVRWIVGKRAAARVPTRILTDDEIAAFRRDGFVTVPAITTAEELDTLRGAYDRLFEEARGWKDGSLFDLVDVDRGASEARSPQLLNPSRFEPLLRDILFRANALAMSRQLLGNRAALVFEHAIRKPPKIGAATAWHQDEAFYAAYTNYRAITVWMPLQDVSPENGCMLYVPGSHREPLLTHRSIGGDPRIHGLEALGVPVERAVPCPLPAGGATFHDCRTLHCAGPNLSAGPRRAYALGFGVRAPEHTLRHEHPWNAEKRTLRQERERQARGGLARLKAGAKQQIKALIR

SEQ ID NO: 804 - protein, 88 aa, Methylobacterium sp.
VHMQHVSADNDRVAQWCAAHPVLLAFGLCAFGLAVVAAVWGLGILTPATATVIAFIYVACLGGFLMEYFGINELIRGVRCIWFVLTSV

SEQ ID NO: 805 - protein, 76 aa, Methylobacterium sp.
EYALPTDSFLNFFRSSAVTLKVEGLYVSLDRQKNSAGGVFYGNLLPPNGTAYLNGAAAKTEFAVVRAGLNYKFGSY

SEQ ID NO: 806 - protein, 87 aa, Methylobacterium sp.
LIVRWIGAAARKRGRAANREAPPAPASDNVTRLSWADTFGRAISADPQRSKGPATVLAMRPRASRRACGPIVRARQAVSAAIPTSLP

SEQ ID NO: 807 - protein, 39 aa, Methylobacterium sp.
MRYRHSGINELPIAESDRKFHGPLGRRPDNQPGLSHFGF

SEQ ID NO: 808 - protein, 182 aa, Methylobacterium sp.
MSPEYVRPYVKAQKNDDRDAEAIAEAATRPTMRFVTLKSQAQLDMQTLHRVRDQLVGERTALMNQIRAVLLERGYIVPQGRAKLAACLASLMDEAAVPALSARMRVLVAEVRERWQDLDKRIAALDAEFAETVRSDEHARRLTTIPGSARSTPRLSWRPSAMSLPLHGGVTLQLGSASCPGS

SEQ ID NO: 809 - protein, 105 aa, Methylobacterium sp.
MFTKTARTRLAAALAFGGLAFAAPAMAAPLGRDAGLQAEAGDVQTVQYGYGYGHRHGGWGHRGYGPRHHHHGWGRGHHHGWGHRGFGPRHHHHGGWGHRHGYGRW

SEQ ID NO: 810 - protein, 68 aa, Methylobacterium sp.
MSTSANPPDPCAETAALRKDKLRAHIRSVLSTIRSHHTGRGAPSIRATGYVLGGWFCGSAAATIPLFT

SEQ ID NO: 811 - protein, 70 aa, Methylobacterium sp.
MKHGARNDIPATVTAIKRGDVMAQVEVELVGTAYRMASVMTVDSLEELGLKEGDTVHVLAKAVNVLLVKP

SEQ ID NO: 812 - protein, 58 aa, Methylobacterium sp.
VKVFRIMQAATGAILWSGAALDPMAALDAMARAAGFRDRTRIPNHLRAGGLHVEELQA

SEQ ID NO: 813 - protein, 107 aa, Methylobacterium sp.
MDENGLEFLRTIAERKVESSAARALNRIAQSLDLPIEAFYGSDHCGSVDRLTLEGETERVLMLVGVHLRRLDPAARRRFGEAVLALVGPVSAEACARIAENAERGDP

SEQ ID NO: 814 - protein, 105 aa, Methylobacterium sp.
MLWSCLILITEQAFVPVQWERASVRREAVLEGLVLGVVGAVVGTGALVFSMGAIEISGITHCMDWQRRHDLVRPDDGPLPPLASERLGSQMLKHHAAAPGRTDRM

SEQ ID NO: 815 - protein, 29 aa, Methylobacterium sp.
MTAKRALITGVTGQDGAYLAQLLLQKGYA

SEQ ID NO: 816 - protein, 113 aa, Methylobacterium sp.
MAPDMSRYRRLPGEEPRYALAEARTLIAERAYLFSLYAVDVVASDGLTGRHVLAVPVAISAVSITVGLVLTEADSRRAEAGDLAGVVSLAQAVQGGYRRFRTFPANGLGRFVL

SEQ ID NO: 817 - protein, 89 aa, Methylobacterium sp.
VLRKFLLAALLALGFAAAAPEGASAAPIGPGLALPAEAAPAVAEKAQYYYRRRFYGPRPYWRRPYYGRRFYYGPRPYYRRPYWRRRFYY

SEQ ID NO: 818 - protein, 50 aa, Methylobacterium sp.
LLGFGQRLEDGAGIPGPAPDEAIRPDRDEMLESYGDRIELAAGGWSSAGP

SEQ ID NO: 819 - protein, 334 aa, Methylobacterium sp.
MTGPDRPGGRAPPRRDQASGRVTPPGHGDGTAAFEAHRPQLLRIAYRMLGSRSEAEDVVQDAWLRWVAADRSGVAAPDRFLAQVVTRLCLDQIKSARARRESYVGPWLPEPLVEPLVEPGADGVDEDDLTLTLMLALERLSPLERAAFLLHDVFGLPLGDVAETLGRAAPAVRQLAARARRNVRAARPRFPVTRDEGERVARAFFEASASGDVAGLRTLLADRVTLSSDGGGKVLAFVNPIRGLERLLRLYAGARRKWGDGRAALVGFVWIDGLPGYVTRERGGLLQTTALAIENGRIDAIYITRNPDKLRHVARAVAAGPGPGDAGGPVARRS

SEQ ID NO: 820 - protein, 255 aa, Methylobacterium sp.
MHPAVAAANAFKAVHDAGQVPDYERILRQGYSRFLAPGDVVVDVGAHTGLHLVAFVDIVGPTGKVHAFEPIPFLMKDLAGRFGRRPEVELHDVALSDTAGRTDFTVASVPGESGLLARYFSSPAITSKTIKVRTERLDTVLGHVPAVAYIKMDIEGGELNALSGAAQLLRRCRPIVSVEYGWAGYSAYGHAQDSLYRFAESHGYICADITGNLIDDASTWLAVSDYVTWDFFLVPQERRADWAALFARRPEPGPA

SEQ ID NO: 821 - protein, 35 aa, Methylobacterium sp.
VALLALYALALQGVLGGLASAAAGPDHVLCLADGG

SEQ ID NO: 822 - protein, 84 aa, Methylobacterium sp.
MEVPMDRKQALELAIFVIALVPFLRCLMPSATRSRGPRRSGSLSYDSGSGGDGGAIFGDGGCHGSDGGSCGDGGGGGDGGGGGD

SEQ ID NO: 823 - protein, 445 aa, Methylobacterium sp.
VEFRFDRKEPGVWISAGTHVALLALALVSVAAPALPEAQEGVPVEVITENQFSEITKGERQADKPMPNATSRADRKAEKFEDREPENSKQDAPTAPTRTAEMKLANADEMPLRAEPDPQEAAQAAKAAEKAAQEKRDAEKAAAKAAEKAAEKAAAEKAAAAKAEAKAKAEAVAKAEAEKREQLEKLIEKQEAEAAAAAQKAAAKKAEAAKEAAKEAAKKAADAKAKAEAEAERQKEIAEAKAEAEREKAEAAAKAKAEAAKAEAAAKAEAAAKAKAKAMADAKAKADAEAKARKQAELADKFNAGDIRSVLASKAPSQSTGATGHAVQKVAALGAATGNAQRLSPSLRDALVGLLQQQIERCYSAPPGAAQGVVLPVLDIRLNPNGSLSTEPRIMRGGASAVDQSIAQAALRAVRRCAPYNIPATYAPYYNDWKAINAEFEFTAT

SEQ ID NO: 824 - protein, 60 aa, Methylobacterium sp.
MTILMAVALAIALLGIALTSAAYRFAPVSKHIASGDIVLVCGISTAALGSLGALLQIFTA

SEQ ID NO: 825 - protein, 28 aa, Methylobacterium sp.
MVGADHNGTRILGHTVGEPAAYVQAFRR

SEQ ID NO: 826 - protein, 99 aa, Methylobacterium sp.
MRTGMRVRGVDNRERRHWFYDSRLLVFGFCLTAFVAIFWQVSRFEGFQPIFSCARTTDVDRQLLRLGMDACMGNARTQSDREGCMRTVHLLACMKERWR

SEQ ID NO: 827 - protein, 50 aa, Methylobacterium sp.
VLLDETEMTVAESDRSFPSRTQASAAALAFAKLVARASRSLNGGASSGLL

SEQ ID NO: 828 - protein, 74 aa, Methylobacterium sp.
MLDVVARHQFSIKRFPIPTNVASTSAMGIHMDLRDALAAYLDVGTQHIVGLLEQRSATQIEQYGANLHAAMTAP

SEQ ID NO: 829 - protein, 100 aa, Methylobacterium sp.
MGSKSPVRSRSSRAAAPEDDLFERSAPPHGPGAGRRLQRIADALQVPATSLYGPPGAERGAGVAGGRADEADALLHAYRRIDDPEIRRRVLTLVQDLAAR

SEQ ID NO: 830 - protein, 202 aa, Methylobacterium sp.
MPKTNASVGQTCLEAFQIALDSADMIGHWAWDPATDRVRVDALVALLFKVDPTAAESGIPLAVYEKAIHVDDRGRVDALIRRSVAAGSSYVAEYRVISVDGRMRWVLARGRFTSDRGGRPTGGRGILVDITALRAREAIGGATAPDLGDTPLDRAVEHALAAQDAIAALGDAALKAEADALLMALGRRLARRQVAERRRRLN

SEQ ID NO: 831 - protein, 79 aa, Methylobacterium sp.
VPDLRRRALTLTRDAIAGDVQGDDLVRLTLLKAWERRAAFRPGTGMPAWLDTFLRSRPAGGRAGPTGLSRNGVSAEMAR

SEQ ID NO: 832 - protein, 55 aa, Methylobacterium sp.
MLIPAPTIRRLLMLGLVLVALVALADGVARHELRTAARAMTLADAAPQTERASDE

SEQ ID NO: 833 - protein, 27 aa, Methylobacterium sp.
MLRGGLLWLLGIPLPIILLLYFLGVFH

SEQ ID NO: 834 - protein, 76 aa, Methylobacterium sp.
LQSDTGCPRPHHAGDATADMMEHAAEEQAGLRVRIVVRGLVGLDERRHQMFRWTRVVAGCRRPGDGLLAGAPHQIA

SEQ ID NO: 835 - protein, 26 aa, Methylobacterium sp.
MTILDPITGELVTIAVPRPRPQAGPR

SEQ ID NO: 836 - protein, 37 aa, Methylobacterium sp.
MTSGTMMRGEAPANVGVMVQGHDALGRDRPDPFRPLP

SEQ ID NO: 837 - protein, 99 aa, Methylobacterium sp.
VLALRHDRRHRGQLDLLGDADDLCRTSGVQAGAAARTRLGTTRDDCIGIIAQHPAVTLVRGLAPLGLECARCSLRSVTGGLDEVREVLSGCCSHSTTLS

SEQ ID NO: 838 - protein, 324 aa, Methylobacterium sp.
MRRVFSTAGTHPRTRFKLWQEVVAERIGPIEQRRRADGPFAGEIEIGAVGPLTFSRITQSALTTTITADTVRRRPDGLIRVNFRLAGSSTFQQHGREAVQGTGDLTVIDHHPGVLDARTDGQTLVMALPRERLEGMLGPARLFAALTMPAGSATTRLVTTFFGDLLRVNRQLSPEAAERMATIGVDLIAAALADRMAREVPHSLHGSVVVQRAKAHVEANLGDQTLDPPRLAAAMGVSLRRLQELFHGRGQHISDWIWERRLAAAARRLSDPISLHRSIGLVAYECGFANQAHFARRFKDRHGLSPRAYREAAALRLSGSQPDP

SEQ ID NO: 839 - protein, 137 aa, Methylobacterium sp.
MAQEMRWQKREGDGRVHLAYEIPDSGAQGLALTCDTRGGQLSVDYYDDRDRARDGTRAEVEFASEGGTLSLPMRAKQLELDDQIVLQTTTTLTQDWVRILSGKTLRVTLSGDTQRIPLAGARSGLAALVAGCSRPSR

SEQ ID NO: 840 - protein, 209 aa, Methylobacterium sp.
MARRVATTGGAGGTGILVGLLGLCLAGPALAGSTSVTARPGERVRLDGYATHETRPGCPSVPAAAIELVTPPRGGRIEQRREFLVLGQNIDGTPSRDGCQDVERDARTLYYTARPDFAGHDTVSVIVTFVTGEEATYTYRITVPEGEGRRAPAVSQAPAPSDAGLARPAPAARAAPAERATLAASPAATPAPAPREASTGDFLRDAARG

SEQ ID NO: 841 - protein, 200 aa, Methylobacterium sp.
VSAVIQLGELVMILDLHRQGLSVTAIARQLSLDRKTIRRYIARGLEPPAYTPRPPRERRLDPFTAYLRERVAAYPALTGSRLWRELKERGYAGSTRTANHLNPSSLPHRTINALYTLELHIEAGVVMQASECCIIRVSIAASLGWLIALTLMWKHSVLAALLVSPLFGTAAAIAAMTLFWFVSLFVSCEPIGPRVSDTNR

SEQ ID NO: 842 - protein, 39 aa, Methylobacterium sp.
MKRQRETGAGTARFRADAAGAAPAERVPGLGLGVAAGRA

SEQ ID NO: 843 - protein, 182 aa, Methylobacterium sp.
MTAIAIITAPDRMWIASDGAAYTEPDGILRHIAPKVVLCPDWDCVISSRGMGLAAEAMRMRGLRHNARDFDELVENASELAEVAEADLSLSARGVTHHFTLILSGYSRSRRTFETHTVRTRPGPGWDADAGRIVELPPFGVSRQPALLLLPEPAEEIAAHFGLELPRGQANFQLDPPSVSRT

SEQ ID NO: 844 - protein, 199 aa, Methylobacterium sp.
MAQAALSLAAFQTAYPSAEPRRPAPPRPSYVETAYDPVVRTRAPYPSAMRRARRRARLTALIALTGVSLAGWAVFSHPQGPVRPEAESVAAAGPVPQAAAAPRPSLAWMLDRSPALGAGTATAFGGEAPPVAGFQVAAAAPSPAVREIARQVAQAERARAAQVRMAQAKAAEKVADKIGEKAGEKGAGAPVRMAAAEPT

SEQ ID NO: 845 - protein, 45 aa, Methylobacterium sp.
MKKLLLASTVLAGMTAAASAADLPRRAAPPPVFTPVPVFTWTGFY

SEQ ID NO: 846 - protein, 881 aa, Methylobacterium sp.
MQTGAVASEKMATAEAKVQEAVDKAARTFTGGVVLIAERNRAFDRLRAAADPVVKAQQAVERAATAADAAIRRGTTTTDEAARIVGIYQQRLASAKVAADQHVLANDNMAKSTGIASHQLQNLGYQINDVVTSLASGAPAMQVLAQQGGQVVQILGETGVSGAVRGVAGAIGRFLTPATVGVSALSGAVVLGYMAWSRYDDDSRKVGVTLQGLGRETGLTRDAFEKLATSAAAAGNMTVRQATDIGTALAATGRIGPDNISKLIGVSKDLAATFSVSLDDVKEKLVAFGTAEGITRLNDQLQFLDARTLRVVQSLFRAGQEQDAIRIAVERLPVALAKSETAQGAVAKAWDAIKSAASDADNAMGRFLDRITKGPSPADRLKELQDRVEALKAAEAENIVQPGGTRRAYVPSTSPTVASTTPTPLPPSRPSELESAKSDLQSYMEKLAATKRAELEVAERKELEASLNRKSGELKKLTEEAGLGSDSWRKYKDLQIAADEALKSGNPELMKRVDNVKDLSEASSILEHVVTTTTNAEGERMTAGEKAAEQRRIDIASTRAVTVEERARAAQMQTEARQRGQLITVAQAQADAEHAATMVREQAAQQLRMMLRDQDLEADSLKLRISLIGQGAEAQAVAMARQRMEQDLTRQGVVDLNSDLARSVIAGAEANARLGVSYDKAAEAQQRLRDGQKELASEFGSFVEGVTIGGQRMSEAFASLSKSLGSNALKAIISGDGPLAGILGTAPGEKGQLGGLLGGSGGLSKLFDVDKITESLGIGAESGIAKALGDALRPSKPGGGILSSPLGRGLAVAGAGASIGYSSQSPLMGALGGGLAGLASGNPYLAVAGGIAGIAGGVCGHKPSRKKDRDHERRQRHLRFA

SEQ ID NO: 847 - protein, 906 aa, Methylobacterium sp.
MSTVVTQLVVDARGAEDGVRRYTTAMQSGASASEVMAAAEAKVQAAIEKSERAFTGGVVLIAERSRAFDRFRAAADPVVKAQQTVERAANAADAAIRRGATTTDEAARVVGIYQQRLESAKVAAERHTVANDNVAKSTGIASHQLQNLGYQINDVVTSLASGAPAMQVLAQQGGQVVQILGETGVGAAVRGVGSVIARFITPATVTVGALTGAAVLGYMAWSRYDDESQRVSTTLQGLGRETGLTRDAFEKLATAAAAAGNISVRQASDLGTALAATGQIGPQNIGKLIAVSKDLAATFGTDLDGIKDKLASFGTVEGITRLNSQLQFLDQRTLSLVQSLFRQGKEQEAIALAVDRLPPSLAKAETAQGAVARAWEAIKNAVSDADTATGRFLDRLTKGPSPTGRLKQLQDRVEALKASAAENLVQPGGTSRAYTVPTSPTVSSTTAVPVPPSRPKELEDAQAELRRYMESLAEAKRQEEAVAAQKELEASLNRKSQQLHNISEEVGLGSDNYRKYKDMEIAVNEAINSGDPALMKRVDSVKDLSEMSSILEHVVKSTANAEGERMTAAERAARQNAVDLDGVKARTVAERESVAARAQVERARGQTITAAQAEAQAEHAALMVREEANQRLRDMLRDQSLEADDIRERIRLLGQDTEARAVSTARRRAEYDLIRDGYSLNSDLAQSVIAGAEANTRLGVSYDRAAEAQQRMRDGQRELASEFSTFVTDILAGGQKMSQAFDTLAKTFSGNTIKALISGEGPLAGIFGTAAGEKGQLGGLLGGRLNLGGLFDVDKITESLGVGAETGIGKAISEALRPSKPGGGIMSSPLAGAVASIGAGAAIGYSSQSPLMGALGGGLAGLASGNPYLAVAGPRCGRGAVFGKPAKSKPQQEPSSDDRHQRDRAA

SEQ ID NO: 848 - protein, 474 aa, Methylobacterium sp.
MPEAQAASSITRIGMCDEADARLDIAAVERFLKEGYPAASPASVTTSRSAVRMASEARGIARQTMDNRIGSPNRAGSHKRRFGLEPDWSLAETHAAQAARARRGELGTDPVLTGFELSQVKTRFDSEGAFAGETITQIPASGPKFELPAGQAISKVTATVKANGQLGTQWIRYKPEGTDPVAFAESLREAMQDCRGLARVPVAVPAQDDELLTVYVIPDLHLGMLAWAWESGESYDLKIAADMARTQLARLLAMAPPARNAVLLFLGDYFHMNDRRNVTPRSGHTLDTDGRWRKVYDVGARLAVGLAEAVAERHDQVEIAFLPGNHDEDAAQTLAVALDLFFERHARIKVAGSPGDHWFRRFGKCLLGASHGHTMKADRMAWMLATDRARDWGETEHRHFFFGHIHHETAKEIGPVRVESFTSPAAKDSHASQGGYRSNRALNAVTFHIEDGEHCRHRVSIRTPQPAVELQVAA

SEQ ID NO: 849 - protein, 265 aa, Methylobacterium sp.
VSAGAVAVVCGSRGNPHWHWVAEQLDDLHARRPIRRLVEGGQRTREQQGSVWHVVGGVDFHALCWAQDRRIERRTVEADWAGQGKRAGPLRNGRMLEEERPDFVVGFPGGAGTADCLAQARTAGIEVIEIARDCCRFSYVPTLSVELCREWPDALFVFGDNLQGWGRKGQAAIRDEPNAVGIPTKRAPSEAPTAYLVDADYARVAERVAPILAHLREHIERGGRVFWPENGIGTGLAELPHRAPRIHRAFENARIKLQRLGRSMP

SEQ ID NO: 850 - protein, 241 aa, Methylobacterium sp.
MPVAATETADPFDVPALIREVDELWDPETTLMTHNERVLIEFCRRLAAPLRAIVDTRAGMALSRKLLEQSGGSGPAWKPFINVALQGPEYLMVLAGLRSLSATARGPAPFQDRVLEQMCEICADDPTDLEERRDRHAEEDAELLQSLGLSREAHHRIVDYVHDRPVGDPGQELGGTMHTLAGLAALACLDMVACGEAEFDRVGRPEITAKIRRKRANRHGRGPLPGDDAGLVTSTASRPGA

SEQ ID NO: 851 - protein, 51 aa, Methylobacterium sp.
MVDGPRRPARSDAIPPGAGSGDGPRRTRFRRRADSARAAANIEAVTGVPDP

SEQ ID NO: 852 - protein, 27 aa, Methylobacterium sp.
MLDIVFLAAGLAFFAAAAGYAAACDRL

SEQ ID NO: 853 - protein, 345 aa, Methylobacterium sp.
MPNVVANRQVAHIWAHQAQDSARSHNGNFWFEGRKLYSYSTPIANLVPGVDGELIALVTARSYSITTNGKHIGPAHSALGYGRVRKTFTVPFIGAFGGQNRGDLNLSETNAAEIHAANLEAYLADYTATVERLPRKRDYDRADALASLNRIANPACDYAEAFGLSRPAYDTDADEAAAFRLWSARNTPERIAARLARAEAAAAAKAARDARDAAARVERERALREAWLSGEPTAYFHGRDERGGAYLRVRGDVLETSLGAEVPLSHAIKAFRFVKLCRERGEAWHRNGRTVRVGHFQVDSIEASGDFVAGCHRINWSEVERIAASLDLLDAEPSADAVEPSHAAA

SEQ ID NO: 854 - protein, 33 aa, Methylobacterium sp.
VTARAVLLPLAEASAVMFGAVAFLAVAVALGAL

SEQ ID NO: 855 - protein, 37 aa, Methylobacterium sp.
MFYVLALAVVGASVALPFLGLAKLTEWTHRRCHPYDL

SEQ ID NO: 856 - protein, 384 aa, Methylobacterium sp.
MSVVSPLIYNIVDYGAVSNGGDCSGAFQAAFNALNNTPEGGQIYIPPGRFLIQNPIGGTTDKSCVIKGAGADASVLVFNGPNLNNGLVLQQVTPNNACAFKDFGVVATGCPNLGNGSVLSIIGVLQGCNGITVDGLHVRLTDDAPCSNVLYVRNPSSGVIRDFNVDGYSGWGEGNTATGIYIICDTQGANAIQLYNCNIFRVYKGIWCVGGQIQQYVMEGFEANECTLVGVQYGLHMQGGWYRPPGNAWKGGHINARQICILLETWYEFKISDTLLYLDGSAAANSQGHIRVINCDEIQIHNNSTRYVDEITGGPTQRGIWGIAISDSSNVLVQGNFFDIGRADSAALYSVSGNSNVRSAFNTKRGGGAYGAGAYTEIGQDIVV

SEQ ID NO: 857 - protein, 38 aa, Methylobacterium sp.
MTAPTRKVRGGCGFCAVVFAAGLMIAGYALAFFVTLHG

SEQ ID NO: 858 - protein, 107 aa, Methylobacterium sp.
VSLQSECAFYWRFAPILEMAKTSWIAGPILEEARDEIQSIALHTRNALLREMCISLLDATAEDRIVNFSTEQVVNEILRAVVRGSRAQFPGVSEGNKVAHLDVQAFG

SEQ ID NO: 859 - protein, 64 aa, Methylobacterium sp.
MSKITDQDLLSATSNGDGTHDGVKLAQWLYEAYTGKPLPRDKAEELVQEGVRRARIRKDQEARG

SEQ ID NO: 860 - protein, 281 aa, Methylobacterium sp.
MTKQPLAVVTMAFNEAMLLPIWARHYGRQVGAEHCYVLDHGSTDGSTRDLPVNVLRLPRSPHDEHRRAVAAGDFCTSLLYFYDRVLFTDTDEMVVADPARDANLVEFVRRLPGAPSIVSAFGVDLLHDHTREGPLDWARPLTDQRSVIRPFNSLCKPTLIRERPDWAAGFHFSHRVPATTIVPFLYLFHIAFVDNDLLVQRQMQRNKVEKAQVDHHQIPPQPLLDHVKRDMETVRRVGTKLEPGDREFERVRARWTNLLDLRQFVQLDEFWELPRRFRGLI

SEQ ID NO: 861 - protein, 70 aa, Methylobacterium sp.
MPADRDFGAPAQPAAPPITISVQIFREIMGAAGAVLAGYGAWLHYPPAGFMVGGGVLVGLAIVGTLRGNG

SEQ ID NO: 862 - protein, 41 aa, Methylobacterium sp.
VVYWPRIVDAAQARGIEINNDILVRAHLPRERLAPAETEAA

SEQ ID NO: 863 - protein, 62 aa, Methylobacterium sp.
MSEGDDPIREAVSALRANGYEVESMAGDHMLWLVNGQALTEGELMALAVRLGLMDSTTDKLQ

SEQ ID NO: 864 - protein, 384 aa, Methylobacterium sp.
MTITCKGAVLRRIGCSQPYAESKPLSIETITLAPPTASDVVVKVAGAGLCHSDLSVINGDRGRDVPMVMGHEGAGEIVELGSAVTDLRVGDHVAFQFSVSCGRCRACLGGRPNICEAAPAARSRGELLSGGSRITDAGGATLRHQAGVSCFAEYAVVNRGSVVVIDPELPLTEAAVFGCAVMTGVGAVVNTANLRAGEAVAVYGLGGVGLSGIMGARVAGAGTIVAVDIEEAKLDKARSLGATHCFNARDPDLDAKVREATAGGVDCALDFAGAIPALRSAYAVTVRGGRVVTAGLAPFGAQFAFEQGDLVSNEKQICGCYMGSCVPVRDLPRFVKLYRSGALPVDALIDSIIGFDELNAGFDRLAQGSALRQILAPHGGPRPT

SEQ ID NO: 865 - protein, 203 aa, Methylobacterium sp.
MQTFAHIVDGAVREVVKLADDKVLGKDLYSAAFAAECVSCAATVVAGMLYDPATKTFAPAPVPVVDLGALKGRLKAQVDADAEALRLTLITPGSGQAMEYQEAYAEAVQVDAAVKANASATFDPAAFPMLSASLGYDLDPETGKATTDIPGEARAVLAAYDAYQKAGAAIRGVRLRAKAAIDAAADAASASAAYAAIVWPTLA

SEQ ID NO: 866 - protein, 48 aa, Methylobacterium sp.
LRRPPRSGRDRRAFYGQVHRRRADMLILNPMTGQMVEVRVPRPKPKAA

SEQ ID NO: 867 - protein, 85 aa, Methylobacterium sp.
LKQIRGLYHQWARSGLVRASGNPLIRLAARRGLPAANDVVTADAQIAALAPHFDTAFYASWYGIAADPVRDYLVHGWRAGRDPRP

SEQ ID NO: 868 - protein, 134 aa, Methylobacterium sp.
MTQPHLIEFRHILDHRGALTPIEAEKDVPFAIRRVYFIYDVSHGAVRAGHSHKELQQVLIAISGSFKVHLDDGRTRKTFLLNRPNIGLYVPRMVWRDIDDFSGGAVCLSLASQHYEESDYYRDYDTFLRAVESR

SEQ ID NO: 869 - protein, 33 aa, Methylobacterium sp.
MPTMISVVATGNRMNGAEMPPFMAGPRADVRPP

SEQ ID NO: 870 - protein, 110 aa, Methylobacterium sp.
MSHTAFSSKSATGRTTASRLVSAALAGLVLVGTSVMPAAAGHFMSEAPAAAKPVRLPALHTTTGFRRVSAVGQTKPPGAALDWRAGTTPGLDAQSHRLDQLITTTICSRC

SEQ ID NO: 871 - protein, 141 aa, Methylobacterium sp.
MRHTGGGRTTEGETEMALEHAQPLGSAGVSDSDVTDTLGEGPPWTSWVRTAEASQPEAQADGPALPRQIGKGALAVTVLAACGRSTGGTACRTRTGYDAHDERVGRQLDADDGQAIGHEGQDTAGHGVLRKADLRRWGTSR

SEQ ID NO: 872 - protein, 189 aa, Methylobacterium sp.
MKKPALTGYTFNPTARTLDFSATSGFTIQSLLVVIHEPTGKTLYAKGKAQFAPKTLAGAVITLNDFVDTTGMAAGDALYVLREDGQDVATDGRLESLRRGSTATSDASGSLAAATNVAPAALAANANRSFIEITNTGPNPLAYRWGAAASATNGHILGPGLTARYHAKVPVGALNMFSTAGTTYFVSVG

SEQ ID NO: 873 - protein, 101 aa, Methylobacterium sp.
PCLGFAIRSGPRRIAEGRPGVGREVPRSVEQMTELVGRVSMKTLVRETTDLIEKLCIEAALRITRDNRASAAEMLGLSRQGLYAKMRRYGVGDLDGPVEDI

SEQ ID NO: 874 - protein, 135 aa, Methylobacterium sp.
MRTALAALCLIAAADAAQAAGKAAVSVDQLLADPKAHWGEMVLVRGIRCVDPGPGGFICETTVNGRLIRLDASGLGGHASEAIAEKLIGPCNGLAALTKPACTFDVKFVPTGSGFEDGVTIVHTPEIDMSATRRR

SEQ ID NO: 875 - protein, 54 aa, Methylobacterium sp.
GAYGGGGGYRNDGYDDRRDAYRDRRDYDRPPPRRPYDDDYGPGPRRYRGDPDEY

SEQ ID NO: 876 - protein, 65 aa, Methylobacterium sp.
MAEAFVRTLKRDYVPVSVLPDADSVLRQLPVWLAHYNDLHTHRVLGYRSPREFIDRSTQEILSGL

SEQ ID NO: 877 - protein, 369 aa, Methylobacterium sp.
VFVTLELSKPAWLLAAQAVPSGKTSAHRVSGGDVEGLLALLRRLQAREQRSSGREVAIILGYEAGYDGFWLQRRLAAEAITCFVMDPGSLQVDRRARRAKTDRLDAAMLLRALMAWCRGDHAACRMVQVPSVEREDARRTHRERQRLIAERVQHVNRIKGLLATQGVYTFQPLRRDRWERLKEVRTGDGRDLPQRLRGEIEREFRRLELVLEQVAAAEAERDAAVADPAVTDADAEKVARLARLGGIGTELATVLVREALYRPFANRKQVAAYAGLTPSPYASGDRQRDQGISKAGNPLLRKSMVELAWLWLRYQPGSGLARWFVERVGTGRGRIRKITAVALARKLLVALWRYLATGLVPEGARLKAA

SEQ ID NO: 878 - protein, 67 aa, Methylobacterium sp.
EGGRARAGAEALQAARALRAAGLPALVVDTGTRGDEARSVADAMGARYLKLPRAEAGQLSAAVRAAL

SEQ ID NO: 879 - protein, 89 aa, Methylobacterium sp.
LRTLSAAAPLAAVLAGTAYAQAPATAPGAPPTSSGVVTPQSGATGAPGAVTGSPTGQAADTRSNSSSAAGNANQPERPSPQGGSGGSSR

SEQ ID NO: 880 - protein, 108 aa, Methylobacterium sp.
LSVLGKWRIVELPGYADDYADMVEPAYILFEATGGEFAFGCVTGAFAGGGDHAAVKFDWNGNDEMDEACGSGWAALQADNSLRGEIGFHADDDIPFIARRWPSSSTAC

SEQ ID NO: 881 - protein, 1036 aa, Methylobacterium sp.
MFVDPVPFGPTIRLVPHSGVQFVEYDFHIDTVGRLSRRFVERAVTGTPQGDGRRTYRLLPTWNEDDPGAEAVETARGDDREYAVGERGALEVFLEKWTPVPMLRVKAGVEGGEELDLGPTNWARVRIVEVADRAPDSPISHRVIFAFDTELLERRPNRPYTAPCLEDAANEHEFRFAHRFRDIGWFLGAAGEDEEARRLAGFQEWVPAWLLEQFREFKAAQRPDRPLRDTDFPNALEHYARYLVFLEYLQTAVRPRTLRLTDTVTAEPAIRPVTVDLILDIGNSRTCGILIESHPNEDRVDLNNSFVLQLRDLSEPEQVYTEPFESHVELSHARFGRDHLSRLSARPRAFFWPSPVRVGPEASRFRELAQGTEAVGGLSSPKRYLCDVRPVNQEWRFPDRDYGADGTSPLIDRTIRQFVNSRGDVIAQLDADRKRYGIRVLPDDRVGASRLTFSRSSYFTFMVAEVVCHALSTINNAGVRERRRTKDAPRKLRRIILTLPPAMPVQEQRLLRSRAEGAVKLIWQLMGWADNPPPGLTQPEVHVAWDEASCVQFVYLYGEITQKLGGAVDGFLRLVGRPRPFAEPDTAPGPEIRPEPSVRIASIDVGGGTTDLMITTYYAEGNRAIKPVQNFREGFRIAGDDILKRVIERLVLPTIEAALRSAGHPDPHALLLERFGGDRANMAEQEKHLRRQFVSRVLEPIGLRILGDVEAGAEITARPFAEFFPERGGRNLRRALPQQRLLDFLEIPARAGGAADFALTDCVFESRADVVSACVVATLDLVLDNLCEAVHALDVDVVLLSGRPSRLQAFVDCLVDKLAVSPDRIVPLHQYQAGTWYPFRERDNRRIGDPKTTTAVGGMLCALAEGQLTNFTLFTRRLALRSTARYIGELELSGQLRDAGLVFREVDLDAPASARRQGPAMSAKLRYYAPMRLGYRQLPVERWIATPLYRLRMRAGQEATQLRLPLEITLERSGDGRPDDEGPDALLRSESMKEEFEITDAYDADGLDVRRKIELVLDTLASEQGYWLDTGILALD

SEQ ID NO: 882 - protein, 871 aa, Methylobacterium sp.
MSTEHLAQDCRNTGRLAEDAEQWLGDEANAGAVGRERADLIRYVRKAANRAERLARAAARPMCAGVFGPSQAGKSYLVEVLARPEDGALRARFDGHEPVDFLAEINPIGEKEATGLVTRFTAGAGAPAGQTPPGAPVRLRVLSEVDLVKVLCNTFLHDGDATKDTPLGPEAIAALLASLKAQARPGTSRFGDVAIDDLQDYVRDQARGTRPLDDLARYWDEARSLAGSLDLDGRARLFAPLWGGHAAFTALYRQLAEALERLDHPEEIFAPLAALVPREGSILDVATLAGLGAARSDDTLTVHAAGGRAVTLARATVAAITAELRIEIADTPRAFLQEADLLDFPGARSRQKVDLTHFLTAHPDALKETFLRGKVAYLFDRYVAEQELTAMMLCVRPSNQEVVTLPDLVERWITLTHGSSPEARAQLPNLLFLVLTWFDSHFVDKAGDVGQDAGLRFRNRIEASLLGFFGKAHTWPRQWIPGAPFRNTYWFRNPNYPAESVIRYDGRREVAFLPEKQERIAELRAGFAALPEATAHFADPGRAFDEALRLNDGGVSYLVENLSRVCRPALKAQQIASRLEALRAEMRERLARFHVALDIETRLAERREAAGQVFDALDGVVAAGQFGSLLRALMVDPAALAHALHGAEGATTEAALPVAAPRIARPGAIPRPGAAPTPRVEASSPGSDRERAMARAVVAAWIGALRRTIEAEDFARRFAVPLTALEIVVSELIVLARRADIEGGIASDLRDLATVERSEQSTVKLALIAATRLNRLTGSLGFTLVPPAGERPAIQDEAGDRVAFAQRPVSYDARSIGQAPATFAHTYATDWFHGFYRVVEDNAKSASGVTVDLAQNARIGAILAGLQARAA

SEQ ID NO: 883 - protein, 228 aa, Methylobacterium sp.
MTIRITEDEDESGGYAFIDLGRPLASPLLSFRRQDTEPRHLGAEGWQPEVAWLAPLAVTERDGRAVARFGPNVVDRIEELVPIEIVAQDGTSFGVVAWPTISPAPSGGGILAGLPAPAPTLTRDGTGGPAVPVAEAVPLPEPGPAPPQDAAPAAPPAPEPPARKSRLLWPLVALMLLALAAGGAYLYRDRLPDLVTRREAPPQEPGPPPAPPESDSRLTAAELRHRYA

SEQ ID NO: 884 - protein, 68 aa, Methylobacterium sp.
MTSPMTPADRDRFEKCLALADQGATAGERAAARAAAERIARGAGLTLAAAAEALRRSGQASADRATRP

SEQ ID NO: 885 - protein, 28 aa, Methylobacterium sp.
VERDRYLPNVSPGRMVDEEADLESDTIG

SEQ ID NO: 886 - protein, 592 aa, Methylobacterium sp.
MTGATRFVASRTLAGLDAVRTDDRLVIESYDRLRRVLRQHGGDAAAELFAEPVISRSNGAAPARVDWYTKLDGPIRPLADLDPDSAVHLRHRLGAALAALEPALRDREAGPFAAACLNLAGPSAVLAVGDVPLLVDWGLLPQGLAADERGRVRHYASTLGAVAPGHLPYPPVDREDWAARFEPAAPAGPDASRGPRLGVPARPAWRGSIAPVVAAGIAAALVALSYVPGVLVFPPLLQAVSAESRAFQTAWLDGLRRRRDALAAADGFACPRLRTELPGLVPQSPAGVRLPTDPAAPPAARAAVEPSAPPAESGRPGAPATDGLVDRLERSTVLVLAGDATGSGFFVADDLVVTNRHVVEGASTLMIAGRHAGVAPATLVQVGAPGTLTDFALLRVPPRSGGRPLALAKPGRPLTPVVAAGFPGLYLGTDPTFARLRDGDAAASRDLVPVVQTGVVNHLQRYDEAAVTLVLHGAEIAPGNSGGPLVDYCGRVVGVNAFGRTDDRMPVTARYALGADGLAAFLAGAGVTAAVDDRLCDLQATPRPAATAAAEPAEAAATPPAPAPAAPTGQTAPRPDARTAPRPGRDARPPAR

SEQ ID NO: 887 - protein, 274 aa, Methylobacterium sp.
MIVSAIRDSKDPTPVYAQAPAQIDRKDCYFYHTLELSTGEVVEGGWDLRGRYADYIGHVDLRGQRVLDVGTAGGFLSFSAEEAGASEVVSFDQDTGARQHLLPFAGSPYVVDHAGWVRAHDRAMQAWKNAYWFTHADRGSKAKVAYGDVYDLPAGIGLFDVVILGAILEHLGDPVRAIGSIAKVASNLIVINTDYIPGDEPMARFNGRPERPEYSFVFWTYTIETYRRILAICGFEIEKVYKDSFLGTPAVPGGVRPNMPRAAIVARRIARSSK

SEQ ID NO: 888 - protein, 688 aa, Methylobacterium sp.
MSAEKIGPQHRARKAVLYVRQSSAHQVQHNRESQALQYAMRERLAGLGFAEVEIIDEDLGCSAAGGTLRAGFERMVAEVCLGKVGAVAAREVSRFARNSRDWQQLVEMCRVVDTLLVDQEAIYAPRLGNDRLLLGLKGSLNEYELDLLRQRSLSARYEKARRGELVVAAPVGFIKVGDRLEIDPDRRVQAAIRLAIDKVAELGSVRQALLWFLEHGLDLPTRVNAGPVVWRRPRYSTLREFIANPAYGGAYAYGRSRVTASYDAAGAKARARRTPRSEWLALKPGAHEGYVTWERAEAIRAMVSENVPTSSRGAPKLGSALLSGLLRCRRCGRKLSVQYTGAKGQIPRYACVRGRIDYGEPNCIAFGGLRVDDVVEAALLSVVQPGAIEAARAAESQASMRRDEAREAMVRDLEAARYAADRAFRQYDAADPENRLVTGELEARWNRALSRVGACEARIAEHDAVAPRPALPPIALETLAADLQDVWSAPTTDARLKKRIVRTLIHEAIADLDEVRAEIVLTLHWAGGAHTEHRLPRRRRGQRTSTPADVIEAVRTLALITRDDVIAGVLNRNGVRTGHGNRFTRERVTALRSQYRIPVFREAAAGEEPWLNLTQAAARVGVAARTLRLAAERGEIDAAHPLVDGPWVFSRAALDGPAARVLAQEALNRGKHPAVPHPAQQSLFASTT

SEQ ID NO: 889 - protein, 73 aa, Methylobacterium sp.
MERYELVEGSAAKFWEVGVSGPTLTVRFGRLGTQGQSKDKTCADAAAAAKEKDKLVREKTAKGYVRADGAAPA

SEQ ID NO: 890 - protein, 181 aa, Methylobacterium sp.
MRAPLLAFIAWVHAGLIASMALPSSPALADAAQDCRSGSPEMRVGGCSRLLAEARTPRQRAIALDGRCWANIDRGAFADALTDCNSAIRADDQYPYAFHNRGVAYAGLQNPTAAIADFNRALAMRPAFSNTLINRAKANITLGNTQAAIRDYEEVLRLKPDNEEAKSSLNLLRGAVVTSPS

SEQ ID NO: 891 - protein, 593 aa, Methylobacterium sp.
MAPPARTGRRWRRLAAATALGVAAATGVHAASPGLTVQAAAARSSAVTGQRIALLIVPQAAASGGRAATANADEEAYRKRLRDIGFEVWTVGPADRPQLDRGLREAVGRLPEDAQVAVFALGPTIGGADDVYLLPQDTPADAGQRPGLLDSEGVRLSDVLRRVARRRTRELVVVIDECQSAAGGRCDFDAAAGSSGASVIGAERAGRRTASGAPLAGRASLRDPMFAAMAQEGETFLQSHETLKRGLAGSDLEPRASGALTTSFAFIPQGFFAGLRTECNKIDPNTEPAALRGVNLDAAIRGCEAMTGTYPYARPFEDRLQAGREQRAYQRAVASCDDPTATASYSASYPAGRFRALVDTFAVECGRTRDRQDEARRQQADEARRQEEDRRRRQEEMDRQWADARRQREQDEQRRLEEERRQRELQQRTTVGSASGWTLNYSTNLLEISPLANDQYDPQKQTYTTIWHSRQHGEQVVMYVQVSPNERCGSAQQFITEQIRPRRSQISRAQEVNTSPVRAGFVLEGRGTAVAQNSFDDRGFYDFATIRRDDRSTITNIGGRFPAEFSDLYRAELLRMMNSMQLPGRDVFNNRCG

SEQ ID NO: 892 - protein, 275 aa, Methylobacterium sp.
VREAVMSNQTTKATSATSLRERAAQARDAAGRFIKRSPPVAPAPTHAEQVAEAALTGDVLAACGIDHRDGTVSYADATGKVVRHPMARWIAFNAVQMYSHVQSEMGRRRVIEANPLPGAEHAAWEARIRRELRVDAIAALTFTPGHAFQVEQDRRTGAEPMADGSILALIEEHRAAYAEWDRLSEVWSEMLTTDPGYAEAVAASEEPGRREIAAYEALFSARPTTLPGAIALTEYLREATERVSTNIQPSDAERALSIIASALRGIVAAAEPRGH

SEQ ID NO: 893 - protein, 136 aa, Methylobacterium sp.
MVLEACPDVVLYARDGIRSWSDLAGAAEVVRPALGIGPDVWEAALAAMGRDHALAALSAILQRAESIGAPGAYLRDLTRKARSGRFSAWPMLFALWRQRRRASSDGSSGPLRVAEVDRGQHARPLGGGAARASTFC

SEQ ID NO: 894 - protein, 68 aa, Methylobacterium sp.
MSDETELRHHQAAIQHMMRRLDGFARRLGLDEAATRQVVERIASDMPEWTDEERLETARRSLLAVASA

SEQ ID NO: 895 - protein, 139 aa, Methylobacterium sp.
MIAARQHALPPDVEARQQVGFRLRAARDAARLQGRAQSPALRREIGAALRAARDAAGMSQSTVARRLGISTPMVCFFETGQKRVPLNRRDDVAAVYGVPPEHLDRPPVVTRSEDEAALVTGYRHLSEDERAALLALVQS

SEQ ID NO: 896 - protein, 76 aa, Methylobacterium sp.
MAKDRDVPNRQVRPLPESLNRLLLSDPTQPIGWIEDPLIGYHRPSVYDRVLWWFSVAAFAAAAFMTSASMTVRLLR

SEQ ID NO: 897 - protein, 60 aa, Methylobacterium sp.
LRSAFEIISGPLSQRMCSRMPRRLDLAQLQHDLLRARLLTSPHVRLPWSQLILSISPVQS

SEQ ID NO: 898 - protein, 133 aa, Methylobacterium sp.
MTKVENPKRAHGLKKLPLELIPRVALVQEAAVYGLGADSPAKAYGRFNWRKSPIDDAIYVGAIERHLTLWAAGEDVDPESGVSHLAHIRACCGILLDAMDAGSFVDNRHRSPETIRVLRGYDAAALPVVAPAG

SEQ ID NO: 899 - protein, 281 aa, Methylobacterium sp.
VFLRKNYLAKGSTWCAGELNRTVGAVRAMAKKLKLGRPAEEVRFRWTQQHDDRLRRVYENGKIGGVKELAHSLGITPGQARYRAGELGLSTRWQTGPWTEPEIEFVEAHTHLRRSTISLLMKKKGWTRTPVAVQQLIRSRGLAGANDRFLPASTVAAYLGVTPVVVFKWLKDGLLSSESPTGGEQDGRPVYLIENRELARFIVQNPLKLDPRKFDWPWVSDLLARYGSFGLIEGRTMIERVAALDREKRTPREIAEILESTPNSVSVMLSRIRAQERRQAA

SEQ ID NO: 900 - protein, 1658 aa, Methylobacterium sp.
MMSLFDVPQLPSAPPPPAQSLPVDFYLDGVRALSRGWAARARDNVEAISLSAAILAEGRPATPEEQARLMRFVGFGATDLAQGCFPTTGSFRSGWEDIARLLQAATRPEELKALARATQFAHYTPEPIARAMWAALLRIGFRGGLALEPGVGAALFPATMPAELRGQTRFIGVEVEPVSARIAALLRPSDEIRCEDFTKARLPRDFDLAIGNPPFSDLTVRIDPYRGLRLHDFFLVKAADHLQPGGLAAFATSRGTLDKADGGARVALHAACEFVGAIRLPDGAFRASAGTDVGVDLVFLRRRASGAVIDLPAWLETASAGFPDFPGIRINRYFLNNPDMVLGRPDLARSPRGETVYACRAPEGFDLEAALARAVARLPEGRAQPVAAPRTPVIETERPSAPSAIERLHEGSYLIGADDELQQIVDGRPVPVRIRAGGSGPGIFRTHAAMIRKLIPLRDAVREILRLQMARADSMDAQARLGALYDAFTAKHGPINRTEVSESTDAQGGKSEVHRQVNLIPFRDDPDTHLLASIENYSLEADTATKGPIFSEVVVAREIAPTIETAGDALARCLHETGRVDVDRIAALIGRPVADVLTDLGPAVYRDPDTAEWQTADAYLSGPVRAKLAAAQEAAKADHSYRRNVEALETVQPVDVPPSDITARLGAPWIPADVVQDFVKEVLGGDVVVRHTADVATWWIDLRWFRCRPEASHAYGTPRYSAGQALLDALNARTPRIVDRIRTGVNQWTEVVNAADTEAAKTKQDALKRAFESWVWAGGPLAHFRADRLARLYNDRYNDTVPRSFDGSHLTLPGASAGFRFRPHQLRAIWRILASGTSYIAHAVGAGKSAVLAAAVMEQRRLGLASKPMMVVPGHCLAQVAREFLSVYPLARILVADETAFAKDRRQRFLARAATADWDCILITHSAFKLIATPKAFEQQMIADAIADFEAVLERVAESDRLTRKKLERAKQGFEAKLEALSVRHDTFLTLEEIGVDQILVDEAHEFRKLTFTSNMTVKGIDANGSQMAWDLWVKAAFVRDRRIARGDRRVDRALVMASGTPITNTLGELYTVLRFMDMEALRERGLHEFDAWAASFGESRTELELQPSGTYKPITRFSEFVNVPELIALFRARADVVTEEELRDLVPRPRIRSGKRQIMTSPPSEAFREFQRELGARIKAIAARSGPAKKGDDILLTVIGDGRHGAIDLRMVDPFNDNEPANKLNKLIANVLRIHHENAGCVYLQEDGTPYERTGCAQMIFSDLGTEKSIATRGFSAYVWIRQELIRLGVPVGEIAFVQDYKNSRAKARLFAAMRAGIVKIVLGSTQKMGTGVNAQLRLKALHHLDVPWLPSSIMQREGRIDRQGNQNDEIELWAYATEGSTDATMWQTNERKARFIAAAMAGDRSVRRIDDVGEDAVNLFALAKALASGDPRLMQKAGLESEVARLQRLRSAHYDGQHAYRARIRAAERTIVEATESAQAFEAVAARVSGPFVLTVGKKDFTDPAEGGKALTDAMKAVDRMLEGGWFKGSKAKVEDELVATVHGLRILYTSGVDGGGSWSAAKLQVGSQWVALRCKSITPGAVAFHQVAEEVASIAGAAEAARFEAERARSLIADTEPLVGRPFDLEGELNLKLEELDRLNAELDGASIEDLAPAA

SEQ ID NO: 901 - protein, 95 aa, Methylobacterium sp.
MNQTEARYDAHLRARHATGEVEWHKFEGLKFRLADNTFYTPDFAVMIAGGALEAHEVKGFWTDDARVKIKVAAALFPVQFVAVQWKRGAWVEERF

SEQ ID NO: 902 - protein, 353 aa, Methylobacterium sp.
MSPNDTADPLPPKPASLPGRGSVWQHYKGTFYRVAEVSRHSEDPRQWLVTYAPVEGGDAWTRAVRAPLVNTWPGFLDFRPNAPGHRFRHVSGPRTWRDEAPESQTAAERLSAAAPLMLAALKAYRAQYADRPSWPDDEVACLELADAAIAAAMPALEERETIAVTWRDENYGDVSDVLAFRTYGLTSLPEQVRRQVDRVIRAAGFSFNPRRASWMALADPTHDRKAGLTAALEAAGFQVEHRGAIPDVTPPGPAVPAPPGPRPRLTLTWRDENYGAVSGKIAFRCYDKGDLTEGMWAPIRKAVEEAGFTQHLGRSCWMADDTPGRMDSLAEALEALGYFVVHAGAVPADRVRA

SEQ ID NO: 903 - protein, 180 aa, Methylobacterium sp.
MHYYAHLHVDGTTVHEILELADDQVLGLDLYSKEIAEASVPCDASVRAGFTYDPVHQTFTPPPAPPVDLEAYAGAAHAALRDGGVTIQGMRVKTDAESRGLIDGAFALSKSRPGGQIDFKAASGWVSVDASTMEAIAVSVGLWVQACYSAYRQVDEKVTSGAFTTTEQVDAAFAAVALPS

SEQ ID NO: 904 - protein, 187 aa, Methylobacterium sp.
MFGPRRFGAIRGALSGISAKVLTERLQGLKQAGIVAQRTLPPPASTPVYELTPWGYEAEPIFSVLGRWAARSPSHDPALPLSAASLMLSFRTMFDPAQASGFEATIGFRFDEDAFRVTVSEGELHAARADLVGAHAVVGAAPPVVAAIVYGGLPLADAEASGQVSLEGDRDVVQRFAGLFPLPGKAF

SEQ ID NO: 905 - protein, 87 aa, Methylobacterium sp.
MRLLRLILLTGTVLPGLTLVQLADAAPGRIQVAQGGPDERGPRGGEPPHGGPRPERPPQERPGPPPGPPAARERPEPRPERAPPPPR

SEQ ID NO: 906 - protein, 81 aa, Methylobacterium sp.
MPLHVPLANGWTLSISEDTPPAFCAVAAWPSHYSDAPRDQSLWFVFEGRQVECRCWLLEDLLQALELILRAPRPSDLGEQI

SEQ ID NO: 907 - protein, 238 aa, Methylobacterium sp.
MWIKQLIGRLAGQVVDLPFSAAENVLANGTGELATDAEVLAAGFEPLPAVAPVRTDVLPLGYRVEPTEVGGFDLYDAGGLLLNVEPLANMIVAVEAAHDHREAVYLPVQVVPVGQLPPQLPIPPRVLTADYLLEPIEGGGFDVLDPAGLKINDAPVADEEAARAMVLLHVAEATGRTVEQVEADEMEQPPVTEIDVPEDWKSLHWSQRKALAHRINGGAPVANAAEADHVIEEYLTRP

SEQ ID NO: 908 - protein, 161 aa, Methylobacterium sp.
MPKENFATRTKLVAVLAVAADGAGRSGRAVNLKNAAFATVLAKITQGNAAPVTLTFLQAQDVSGTGAKPITNPAPIWANLDTDASDTLVRQADGVSFTTDAAVKNKHIVAHIDPAYFDIANGFKTLIVATSASNAANLTSVDVLLEAGRYQSEPLPTALTN

SEQ ID NO: 909 - protein, 123 aa, Methylobacterium sp.
MARLEADGYDLEAEILPALLDAAAAARTPVRTWRIWADRVAERINAQRLTRASQGLPATPAAPVAEEDKIDLGAPFGRWAEPVLRTAVAKHREMGGWVDHLWGPPPGQPGCKIPPRLLIVEAA

SEQ ID NO: 910 - protein, 81 aa, Methylobacterium sp.
MRPVRFHYLRLQEWLAHLDEARANARIRSILAFRNRRAADAKRYGAEADAICPPEAPAREWSPRLWDRDHDARSDTRERQP

SEQ ID NO: 911 - protein, 94 aa, Methylobacterium sp.
MAGAPAHSGTLEDRVRTILFDVLATEPERQVDAAYLVQDLGADSLDVVEFGFELEEAFKLGMDELDLTSAITVGDVIAAVRRVVDARAVPAGGA

SEQ ID NO: 912 - protein, 112 aa, Methylobacterium sp.
MAAGARETLDLSTIDPAQLAHAAETAARANLAAAGILGACSERSTMRAAVRKIEHGQALASLALLMSFVAEHYASLLPVFLALQEGSVVAVEEVTISRSRKDERSKLALVAR

SEQ ID NO: 913 - protein, 210 aa, Methylobacterium sp.
MDNEGTSPADKFFSYGIECGPHTILDTLNSSGGVLEQENHEDGCTVWDEQARRDLTYIAALVNDHRAGRLVEVSDAPPGPWRPMLAGANSLGRNRKGDVTINVPTALCWLQFSPDSFTGTEDETRPGVGFTLVAYPGSAGEWPNGVIPRDEAFRLYQMLARFFAAHPPPGEPAARELEAAAADAEPVRGDRLRRIAAALRGAAVGGPRHG

SEQ ID NO: 914 - protein, 96 aa, Methylobacterium sp.
MGEQKRKAAAGHVPPEGMANVSGRHVTELARGIMDLLEKPFDEGMQADVAAHVMVATAVDLWRANYGDAQVADALKRAIDRRLEKPAEYWGGKRGA

SEQ ID NO: 915 - protein, 45 aa, Methylobacterium sp.
MPILEELGYVEERATRGSTRRRAWHLTPRGRELLIALGIRESAEP

SEQ ID NO: 916 - protein, 96 aa, Methylobacterium sp.
VLLNALILVTTLVPHAESGADALARALTPPATVSAPADSPPPHFDPATRSVSNWHAQTGAQLTPRALAVTASLADDPPYVARCVRLNNGWCIKSPR

SEQ ID NO: 917 - protein, 37 aa, Methylobacterium sp.
VQAWLLSAAAASPSAVCMIARIVRAQRPHFGLQPRQA

SEQ ID NO: 918 - protein, 91 aa, Methylobacterium sp.
MTTRPPRSGGPTGRKPQAGKFSTSKFRGGKAQADGRARTGPRTSARDAAERAARNRGEDAGTRDPWGAQAAAAPAPARPPKPRRDAATPRD

SEQ ID NO: 919 - protein, 310 aa, Methylobacterium sp.
VGGRPAQFGRGARGMTAPLRVGGLTIDVLTEIAHRYMPVSFLFNDLPEPDIARNMSWLGPRFIEPRERTLGLAFQAYVLRAGGLTILVDSCNGEAKHRPTAPWQHDLRATEFLGNLARLGLCCEDIDIVVCTHLHCDHVGWHTRLRGGRWVPTFPRARHLFGRREFDHFRARYDREGAAAVNHGAFADSVLPVVEAGLAEFVDEDHRLLADETGEIALVPAPGHSLGHCCVRLRAGGTEAIVAGDALHHPIQLDLPDLPMRADHDPGLAVATRRSLLAHCADTGAWLCAGHIPDWSIAQIRRFEDRFRMG

SEQ ID NO: 920 - protein, 206 aa, Methylobacterium sp.
MTAQLQQQQMQLQPPSDAARLFAVEKDVASLKEGLSVLGTSMDKGFRDLATEMKARSTINWQPIAILLGVLGSLGTMGFTWINTGQGRLEMAIAKVETASMRYVPREDLDARFTVLSQRRDDLQRLTDARVERIERDLDAASKQIVPRGEHEQMWAAQRARDADLQRQADQNRQGLYDLNTPRDTIQGMQRRIDELERDARAPARR

SEQ ID NO: 921 - protein, 50 aa, Methylobacterium sp.
MAEVCIANHEQIVRYGSPEMQAASRALLYVLAAEIQRREQAMSAANNDEA

SEQ ID NO: 922 - protein, 161 aa, Methylobacterium sp.
MGQHNPASVAELLAKRGSLVEIATRDRMAAEEVGTTNQPIHLRELYRLGVVMTPNMELIDIYPEGNRFVGVLRNTMTDAEEERLVDRIVVDHGTLPVDGLCHGLKAGSVNRGQNDQGALLRGEPQPFDLSGGYALHRIGDALAGRNIHAALYDALRLCKDI

SEQ ID NO: 923 - protein, 220 aa, Methylobacterium sp.
MNVSRIRDAMRYCDLPDVLDYSIAELRLGLAFIALDLLELKAGFRQDQPRGRDGCWCGGSGSLVVARKDKTGDPRIDGKTDAIVDVLGEVVQTCDPGQGPLYGIEVHTKFAARMRELDLPGIGRHGIEQSFSAGDLVRYGLDGSIRTDVILRDGRTSAAPVRAIWDIKTGKAQLTPARARELRRGVGVDDSVPVIEVHLRRGNSVKGLSISAILFGERLP

SEQ ID NO: 924 - protein, 141 aa, Methylobacterium sp.
VAGTPFDFREPAVIGARIRDGRDAQIVRGRGYDHNWVVTDAPTAEPHPVARVEDPDSGRVLDVASNQPGLQFYAGNFLNATAVGKSGLAYRQSDALALEPELFPDTPNQPAFGSARLDPGKTYRNVITYRFSTSPAHRTQK

SEQ ID NO: 925 - protein, 294 aa, Methylobacterium sp.
MQIGFIGLGSMGSAMAMNLVKAGHEVRAWNRSRIVQDRVHGITLVPLVADAFQADAVFTMLSDDPAIREVILDAGVLARARPGLTHVITSTISVAFARELELLHAKAALGYVSAPVLGRPNVAARGQLNILAAGKADAIDAVEPLLASISKKVWKLGEDPARANAAKIACNAMIAMAIEAMAEGVVLTESVGLDRAVFFELILGTLFSGRAYESYSAQITNRSFEPGFKSKLALKDMRLAIEAGNQIGRTLPMLEAVHEGLTRAVSAGLGEKDWSIMADMTVRNMAIAAAYSER

SEQ ID NO: 926 - protein, 611 aa, Methylobacterium sp.
MPYADIEAHGVIGNLRTAALVCSDGTIDFFCFPQFDSASVFAALLDDAKGGHFSITPEPDGVRTRQMYLPETNVLVTRFMSEAGMAEVVDYMPICADGPKSALVRRVKGIRGSMTLRVACEPRFDYARAASRARLRDGGLIEFAPEGEAAPLRLRATVPMTVTKSGAATTVTLAPSEEAGFVFECTQERPSDGSLDAFLESTFSETMAYWRSWSGRSRYRGRWRETVQRSALALKVLTSADHGAVLGAATFGLPEWVGGGRNWDYRYCWIRDAAFTVYALMRLGYTDEATAFIGWVEQRAREQGEGDRLQILYALDGGSEASEEELDHLAGYRGSRPVRIGNAAAEQLQLDIYGELADAIYLADKYGVPASIDTWHGVARALDWVCENWNQPDEGIWEVRGGRQAFLSGRLMCWVALNRGLRMAGQLARPAPLQRWHETQDAIAQSIYTDFWNPEKRAFVQHPGTDALDAAALLMPLVKFISPVDPRWLSTLDAIGRELVSDALVLRYQTKEGANSDGLEGREGAFTPCSFWYVECLARAGRLEEAQLTFEKMLGYANHLGLYAEELGPQGEHLGNFPQAFTHLALISAAYALDRALSEKGRPSMGQDLRG

SEQ ID NO: 927 - protein, 206 aa, Methylobacterium sp.
MISFAGSALGRDLRNFYPEVAFVDEASPLGRTLRRLSDVLDAAETRDERRFTSDLVGVVPDLRRYALSLSRDATESEDLVQYTLLKAWEHRTSYRLGTSLKAWLFTILRNGHLNGRMKYRREVPDPEGSYAAGLASLADQEHRLDVQDMQEALARLEPAQREALLLVAVEDLSYEAAAARIGCPPGTVKSRVSRARDRLAAELGEA

SEQ ID NO: 928 - protein, 336 aa, Methylobacterium sp.
MRALIYTGPNALIVDDVPVPVPGPGEVLVRVEAVGICGSDMHAFHGHDARRPAPLILGHEAAGRVAEGPRAGARVAVNPLVTCGRCPACESGRTHLCPSRQILSMPPRPGAFADYVCVPEKSLVPIPDALSTTHAALAEPLAVAYHAVNQGARLLGRPLAGARCVVLGGGAIGFGSGLVLAMQGAGEVVIIEPNPERRSEAARGLPTARCRAPDDAEGPGPDSADLILDAVGSDATRAKASQLARPGAVIVHIGLLPGDRGLDVRKITLQEIVVSGSYCYTMQEFRDVVGALADGRLGPLDWVEERSLAAGAAAFADMDASRVAAPKLILRPDAPA

SEQ ID NO: 929 - protein, 437 aa, Methylobacterium sp.
MTIDYAKRATKTPETETDAARQVVTEMLAAIEARGEEAVRDYARSLDRWTGEIVVTPEEIARRTKDIPERVKEDIAFAAGQVRRFAEAQRDSVQDFSVELVPGLVTGQKLVPCNVAGCYVPTGRYAHIASAYMSVATAKAAGVPTVVACSTPFRGEGIHPYVLYAMQVAGADVIMTLGGVQAIAAMAFGLFTGKPADIIVGPGNKFVAEAKRMLFGRVGIDVFAGPSEVGIIADETADPALVASDLVGQAEHGHESPAWLFTTSRALADDVIARMPALIDALPPTARDAAAAAWRDYGEVVVCGSREEIVAVSDRYASEHLEVHAADLDWWLAQLSNYGSLFLGEETTVAFGDKTSGPNHILPTKYAARYSAGLSVHKFLRPLTWQRMDREACKTIAQATARISRLEGMEAHARTADHRLAKYFPGHGLDLGEAVTA

SEQ ID NO: 930 - protein, 368 aa, Methylobacterium sp.
MTEIRGNGCRGGRRRAWLLAGALALAPVVAPALPAKAAEPERIGVSYQPSLYWALPFYIATQKGWWKEVGLEPTFAVFPAGAPQVAAAQAGSWDVGGTGSVPAILGAARFGLLTIGLTNDESKTNALMVRAARHDAILKDPKQLAGQKLLVTTNSTADYAARACLRKWGLGPREMRFVNLGQAQIISAMIADAGEVVGVWAPNTYTLEEKASAQVLCSGADADAMVPGSLITRADFAKAHPDAVAKFLAVYLRGWGWAKANPKDAHDMAKRFYAEGGVEASDHAIDQEFALRPTYALDAQLKAMARADGPSQVDGWFSRIGAFMAEVGTIAQAPDAKGYIDDAFMKRVAADPKLRAFATEFDAAAAPR

SEQ ID NO: 931 - protein, 261 aa, Methylobacterium sp.
MSAIRFERVEKSFGSNVKALDGVDLTVADREFVAIVGASGCGKTTCLRLVAGFEAPTGGRITVGGQPVTEPGPDRAVVFQQFALFPWKTVTQNIAFGLRNKGMPAAERQERVAAAIDMIGLSSHADAYPHQLSGGMQQRVAIARAYVLEPEVLLMDEPFGALDAQTRVVMQEELVRLARRNPRTVLFITHGVEEAVYLADRVAVMTRRPGRIKEMIDVKAVREAERWEEHARIEDVMDLESFVHLRTHIWKSLRDEKAAGR

SEQ ID NO: 932 - protein, 263 aa, Methylobacterium sp.
MIASRQPLPLRRSLALGAIGTLAFLGFWAALSRSGLVSPLFLPGPVAVAERFATLTERPFAGGTLPAHVASSLQRFLIGYLLAAAVGVPLGLMMGWSRLLDDIVTPIFDGLRFIAPIAWVPFAALWFGTGIGGPILIIFAGAFPPCLINAYRGARYVDARLLEAAEMLGTPGYRMIAEVLLPAALPSIVAGLRISAGLGWQSLVGAELIVASTGVGYMMVQAQGAVSTATVMVGMVAIGLVGVVIDVALRALETRLRRHHGQA

SEQ ID NO: 933 - protein, 260 aa, Methylobacterium sp.
VKFSRRMCVGMATLVVIAVLWYVATTGLGLISAGRFPAPGDVETAAVQAFVRGYPDTTLLTHVLHSLRLVALGFLVSVTLGVPLGLLMGWNRTAEALINPVFLLLRPIPPLAWIPLAILWLGLGDGAKVMVIVIAALPPAVISTQAGVRGVPPQIIEAAQMLGTPRLRFVTDVLAPAAAPMIFTGLRLALQASWTTLVAAELVGSLAGLGYVLNVAQQDLYPGMILVGMAAVGILGAGSTALLGMAERRAIGWAQLRGAA

SEQ ID NO: 934 - protein, 134 aa, Methylobacterium sp.
MDVTVNRPEVVAEITALFERYERALVEKDVAVLDATFWDSPHTIRYALHENCYGFAEVHAARVAADPPPGGAKETRIRLEILTLGNDFATVNLEFKPRGKAGIGRQSQTWMRLPDSGWKVVSAHVSIMPPADCI

SEQ ID NO: 935 - protein, 538 aa, Methylobacterium sp.
MSDAVLEIEKLTITLPPGADRPNAVADLDLVLRPGAVTCLIGESGSGKSMVARAILGLLPGPRVRVAGGRIQFEGADLAAITPRQMRKVRGARIAMIFQEPMTALNPLHTIGRQIDEVLRIHTPLGRADRRARILALLASVHLPDPGRLLRSYPHQLSGGQRQRAMIAMALALNPRLLIADEPTTALDVTTQAQILHLIRELQREHGTSVLFITHDFGVVADIADTVAVLQKGVLVEQGPAASVLGAPKHPYTRALIAAVPKLVPPPRRAASTAPLVVEARQVEKTYGARGLFGGRITRALDGVDVLLRRGETLGLVGESGSGKSTLARAITRLMPVDGGEILLAGHSVAELTRRQMRPHRRRVQMVFQDPYGSLDPRQRVVDIVAEGPIIHGTEPGIARVQACEMLALVGLDPAAAQRYPHEFSGGQRQRIGIARALAMKPEILVADEPVSALDVSVQAQVLALLADIKARLHLSMLFVTHDLRVALQVCDRIAVMRSGQVVEVAPTSEIFFAPKHPYTKALFAAVPGAQWQEPIPA

SEQ ID NO: 936 - protein, 136 aa, Methylobacterium sp.
MQAGWSAIPNIIIEKQATLGLDALDMNIILHLTHYWWHPDNLPHPSVETIATALNVKPRTIQKRIKALVELGLMTREERRHTKNGSTTNLYGFQGLIEACRPYAEEKIAEIAKAKEAKQARLVRKKPRLVVDNADD

SEQ ID NO: 937 - protein, 239 aa, Methylobacterium sp.
AAIGVDLTSGEAIAADVVVSNADSAVTHARLLPEAQRWSPGRFQRARSSMGLFVWYFGTKRRYPAVDHHTILLGPRYRGLLTDIFDRKVLAEDASLYLHRPTATDPSLAPPGCDAFYVLAPVPNLAGGQDWQTLAEPYRRRIAALLEASVMPGLSEAIVTSKVTTPLDFQDDFLSYRGSGFGLEPVLTQSAWFRPHNRSSAVRNLYLVGAGTHPGAGLPGVLSSARILDSVVPDARVTA

SEQ ID NO: 938 - protein, 246 aa, Methylobacterium sp.
FFTTKEIGKGTGLGLSTVFGIVKQSGGTIDVQSKVGEGTAFRIYLPRHVPVAEPEEVPAPAAEPALPRVEPLAPASTAAHPDSGPDAKPVTAPAAGGDAVVPKGETPPAKVDKPAPRKPAADHTGQGTILLVEDEDPVRAVNSRALSARGYTVLEAASGLEALAIVREGAQTIDLVVSDVVMPEMDGPTLLREVRKHQPDLKVIFVSGYAEDAFRKNLPEGETFNFLPKPFSLKQLVETVKKTMAD

SEQ ID NO: 939 - protein, 262 aa, Methylobacterium sp.
LTNGSVEGPHGHLKRAIADALLLRTSTDFPDLTAYRTFVDEIVGRRNARQAKRIDSERAVLARLPERRSCDYEQVSVRVSSAGGFRLRKVFYTVPSRLIGHTLRVRLYDDRLDVFVGGSHLLTLPRGRAHPDGRHDQVVDYHHVIHALRRKPMALLNLVYRDRLFPRAPYRHAFEALRAALPERQACRIAVDLLALAHDRGCEAELAECLAVELAAKLLPDLATLRARFAPDPATIPHVTVALGSLASYESLLDSVTTGGAA

SEQ ID NO: 940 - protein, 103 aa, Methylobacterium sp.
LLGAIQALIADLPTYGYRRVHALLRRQAERDGRPAPNAKRVYRVMKVHGLLLQRHVGGAETRRHEGKVAVATRNTRWCSDGLEIAAENGERVRVAFALDCCDR

SEQ ID NO: 941 - protein, 103 aa, Methylobacterium sp.
MTGTIVSLRSGRSTTSALTHFDITAMELLREGRATTLSEARLDAIRAELLAKRAELAAVLADLQARPSSGDAQIDAVNATLRIEAGIGLSHIELFIKQVEVCP

SEQ ID NO: 942 - protein, 58 aa, Methylobacterium sp.
MRFAVSMMQGLVKGPASRRLSRSRRAALAALAVAGLAAPAQAQTLASLPTEAGARVQG

SEQ ID NO: 943 - protein, 58 aa, Methylobacterium sp.; identical to SEQ ID NO: 942

SEQ ID NO: 944 - protein, 77 aa, Methylobacterium sp.
MGDDDLHAPSRETGYLSALRDLMIVHQQWIEDGCGFENVQAHRHAIRFLGGLIAMKQARMASRAKDPKSERPRGWSS

SEQ ID NO: 945 - protein, 567 aa, Methylobacterium sp.
MEMFEAFGFSERVLKEAYWVNETCFWNPDPSQSNMITRTGRIVDTEEGLSEFPHVIMNQARVHDFFLATMQNAPTRLEPSYGRNFLDLALKDAETGDGIEPSSDFDYPVNVRLERIDDSQTSAVETVRARYIVGCDGAHSAVRGAVGLTVHGDSANQAWGVMDVLAVTDFPDIRLKSAIHSAKEGSLLIIPREGGYLVRMYIELDKLDANRRLARDAVTVDHLIAAARRILHPYTLEVKEVPWWSVYEIGQRLCEAFDDGGLAHREHRSPRIFIAGDACHTHSPKAGQGMNVSMQDAFNLGWKLAAVVRGQCTPQILQTYSMERRAVAQELIDFDRAFARMFSAPPRPSDVTGGDGVDPAEFERYFVKHGRFTAGTETCYPPSLITGQSTHQNLAEGFRIGTRFHSAPVIRLADAKPLQLGHTVKADGRWRLFLFADPESPDARSSRLRAVCTYLAEADDAPIRRFTPAGADIDSVIDVRAILQQGHRQFVLGAMPPLLRPPKGRYNLVDCEKVFCPDPKAGDIFALRGIWRADGCIVVVRPDQHVAHVLPLDAHAELAAFFDRFML

SEQ ID NO: 946 - protein, 161 aa, Methylobacterium sp.
VAAFVSRQAVAAADLPGLMRTVRDGLLALGDAAPPIVAEPEPDRPAPTPAQIRKSVHPDRLISFINGCEYRTLKRHLTAYGLTPDSYRARFSLPHDYPMVVAGYAAEHSALAKAIGLGVHGAQAAWQASSSIVNDAEHLYRSRNAVLGRAKLPDRQTRMTP

SEQ ID NO: 947 - protein, 95 aa, Methylobacterium sp.
MKFRPLHDRVVLRRIEGEEKTKGGIIIPDTVKEKPQEGEVVAAGPGVRDEAGKIIALEVKAGDRVLFGKWSGTEVKIDGLDLLIMKESDILGIVA

SEQ ID NO: 948 - protein, 313 aa, Methylobacterium sp.
MSAVNVICGSRRACVLTDASLYDSAGTIVGFELKAYAVESWTGVITGRGNWWGPTFVRDLAESFGSFDEFMSRSAATIEREHREAMEGGQLAGQTLIEVHAVGWSERRDEPEAYVLRSPSAFLDADEPSYVWRSLEDEDGIFHHAHLSAGELWQLHRQSAEEGVDWTAETFDPVRHGIPLMEAQRRQAADAMAGPDVAGKHVIGGALWLTVVDREGVRQGIIRQWPDSAGEAILPASLDESSLPKVPPSGFSAAWTFERFDRAVRAGVIDFATFDFDPAALARLEAAAPTGVGLSRQQRRAAKAQVRKLAGAR

SEQ ID NO: 949 - protein, 67 aa, Methylobacterium sp.
VQGIMPDVAVHGHPIAGHACRDSLIGDRRRSSVVGSSRILAVGAENLGRGAIRSNAASKRISPIVRL

SEQ ID NO: 950 - protein, 43 aa, Methylobacterium sp.
VTSGDAFIMLTSVRYCLGRHSYAPSVITQACDGWVQAPMVLRT

SEQ ID NO: 951 - protein, 186 aa, Methylobacterium sp.
VSSAHDGDPGVGAVQSCDRLASAPWDPDAPDAQRTVNFRDLRAGAAVAACRAAVAEAPRLRRLHFQLGRAYDRQGANHDAFEAYRRAAELGSGAAKVNIGILYQQGRRFEKSDAKARAWFRNAAATGIPEGMYCYAVALDNGIGGSPDAAAARAWYVKAAERGTAKARDALVRLELDGTGTGVRCD

SEQ ID NO: 952 - protein, 62 aa, Methylobacterium sp.
VSAPSPHGSGGPAPRRILVTGAAGFVGGHVLPLLAGATAGSTAESAARAGWGRSGRRRRALP

SEQ ID NO: 953 - protein, 357 aa, Methylobacterium sp.
MPFALPDLPTVRRTNRDTLAAFLEGADASVPNSALRVLSDMNAGGAFLNLKYLQWLAKNFLPDLAEKGWLDRWASILFGGRKAATFASGTVTVTGTPGVTLPAGSILATSDGVQYQTAVDVILSAAITPVAVTCLTAGAIGNRDKGALLSLTVAVSSVNAQATVVLIDGGADTESDDDLRVRILLRIRNPPMGGCATDYEQWTLSLPGVSRVWVAPMEMGIGTVTVRFACDVLRAGNDGLPTPDDCALAKAYLDTVRPVTVADLFVLAAIPQGIVPRILNLSNDTPSTRLAIAAALQAMLLEKAAPGQTIFACWISDAITDAVGDATFDLVTGDFVMANAGSIASLRQPFGGGIAFT

SEQ ID NO: 954 - protein, 236 aa, Methylobacterium sp.
MSDAFIRRDGEDYAQAFARLLPTGEAWSRDPAATLMQLVRGQAEIWGAVVDPRAADLLEIETDPRFTLELLTDWERAYGLPDPCVPVVQTLPERRQRLAQKIAMQGGQSRAFFTGVAASLGYAITITEYVPFQFGLSSFGGSHGRLNPPGFRYCWSVTVTGARLTRFQFGVSSFGRDPLLSIRRAEDLECILGRLKPAHTLLRFNYGPPAPTVRQQRFSFGTSTFGGDPLLRLIAS

SEQ ID NO: 955 - protein, 98 aa, Methylobacterium sp.
MADRKQTFTPEFGAEAVRLAQTSGRSRREVAADLGVGLSALRNWIDGRREREMDNPPTDRQEDMAAELKRLRRENEVLRQEREILKRATAFFAKEGSR

SEQ ID NO: 956 - protein, 40 aa, Methylobacterium sp.
MRIAIITPSRLKPSTLAGKAGQYFLEHAIASANAQELDRP

SEQ ID NO: 957 - protein, 643 aa, Methylobacterium sp.
MANTIRLKRSNTAGNAPASLADGEVAIQQADGALFWRNASAAVQKLLLPRRAPVADAAYPIKSTDTYIGISSLTAARAFTLPLASSYPAGHVLTVVDESRLCSSSLTITFGVTGSDKINGATTFVVSEPGFFLRLVSDGASKWSSSFVGAASKTDLVTKLDQNFGNVSFPGARNTLGLREINAADPQYGGGVVADCTGVGVGTDNGPRLQLAINAWVASGAGSVLKIPRGRYRITTPVIANLGGLAGLVFDAGDALLTPDPVAMVAISIRNGFGLTIRARILEGGPFGGWGASNPYGVDYSSIADAVAGGGQEAIRVSGVSGYTVDLWAQNYAGRLLRITTAASGDPMTSAIKGRIVTTRGTDLSKPRVGQSIFTDNGTGDPTGAWGQLEGLHNDFDAYGPVWRDVNDVAVTYLDGAYAYTGIALHGVGIVHGASWYIGDIDSNASNTHLDFAPSPATGRPGYRLSLAQLTMLNAGNGLNISGTDLSQRAADIGIARMIGATGTFGNAVNIANAKGVAARIEASGAGGSILAITGAGADDVRLDLHASGLNGNFAYIASEVAGRIQIGGAMSNPVPGNSVLVVGGNTPVRLSDLDVSGPSGPSLLYFVSQTNKVRWVSGSKSGAATTYAGYQPAYAAPAVDIQ

SEQ ID NO: 958 - protein, 466 aa, Methylobacterium sp.
LREINAADPQFGGGVVPDCTDVGVGTDNGPRLQLAVNAWIAAGPGSVLKVPRGRYRITTPVIANLGGRVGMVLDAGDALLTPDPVAMVAVSIHNGFGLILRARLLEGGPFAGWGASSPYPVDYGSIADVVSGGGQEAIRISGVSGYTVDLTAQNYAGRLLRITTAAAGEPMTSGIKGRIVTTRATDLSKPRVGQSIFTDNGTGVATGAWGQLDSLHNDFDAFGPIWRDVNDVAVTYLDGAYAYTGVGLHGVGIVHGASWYIGDVDSNASNTHLDFAPSPATGRAGYRLALGQLTMLNAGNGLSISDTDPSQRAADIALVRMVGASSAFGTALKVDNAKGVSARVEASGLGDAIAAVAGADTDDVRLSLHTPGLGGNFATIATEVTGRVQIGGALANPVPGRSVLYVGGDTPVRLSDLDVSGPSGPSLLHFASATNKVRWVSGSKSGAAMTYAASPPAYVSPAVDLP

SEQ ID NO: 959 - protein, 115 aa, Methylobacterium sp.
VHGVIAGLLTGAPNFETGAVEQANVEKPSAAQIRKSVRDEGIVSFIDGKTYKTLKRHLTSHGLDPRSYRDRYGLPADYPIVAPSYAAQRSELAKAIGLGQLGAMAGRGRKGDKAA

SEQ ID NO: 960 - protein, 123 aa, Methylobacterium sp.
VHAVIAGLVAGAPNTETGAVEQADVEKPSAAQIRKSVRDDGIVSFIDGKTYKTLKRHLTSHGLDPRSYRDRYGLPADYPIVAPNYAAQRSALAKAIGLGRPGAMAAQVDEGVQPERKGRRKAA

SEQ ID NO: 961 - protein, 184 aa, Methylobacterium sp.
LNFNDNGFDAAVIGTNMNFNRTNNTGAIGADWIAHFVQSIGPKPIGSALTAIGKMRVGIDLSHANFDADKMALALPAGARIYGNAYNTDTHSMPRYTMPNVDWIERSPSGFWGIYYNNASTMQFNDAQVTSIPVFFAYGGIREPSNPPPNSQTGCTTGDRAWDSNFEYRCVAANTWRRAELKPF

SEQ ID NO: 962 - protein, 184 aa, Methylobacterium sp.
LNFNDDGYDDAVIGTNMNLNRTNNTGAIGADWVAHLVQSIGPKPIGSALSAVGGMRVGIDFTHANFDADKIALALPAGARIYGNAYNTDTHSMPRFTVPATDWIERSPNGFWGVAYNNLTALQINDVQVTTLPVIYASGGIREPSNPPPNSQTGCTPGDRTWDQSWEYRCVASNTWKRAELKPF

SEQ ID NO: 963 - protein, 61 aa, Methylobacterium sp.
MGDERDPVLEAAEALRADGVEVEPAGDDFTLWMVKGKLLTNLDLLALAVLLGPIDALIGVQ

SEQ ID NO: 964 - protein, 61 aa, Methylobacterium sp.
MVEKRDPVLEAVEALRADGVEVEPADDDYTLWTVRGKVLTNLDLLALAVLLGPIDTLIGVQ

SEQ ID NO: 965 - protein, 217 aa, Methylobacterium sp.
VPTPLAEGKGLIIGSEALIRSHSVFYEGSMFGDKLVTGHKVIVRELTRAGASFQIGTLGDIQGHCCVGDYVRFQSNVFIGKGATIEDCVWIFPHVVLTNDPHPPSDIQLGVTVRKYAALSTMSVILPGVTVGVGALVGASSCVTKDVEDYRIAVGNPARDKGPVWRIKLRDGSGQPAYPWISHFQRGYPEHLVREWQDLLNGSWERLRPNDMEGSPT

SEQ ID NO: 966 - protein, 210 aa, Methylobacterium sp.
LAEGKGLTIGANALIRSHSVFYEGSTFGDKLVTGHRVTVRELTKAGANLQIGTLCDIQGHCTIGDYVRFHSNVHICHGATVEDCVWIFPYVVLTNDPHPPSELTLGPTVRKYAAIATMSVVLPGVTVGTGALVGASSCVTKDVADYRIASGNPAQDKGPVWRIKLRDGSGQPAYPWISHFRRGYPEHLVKEWEDLLDGPQMVLGPDEMRD

SEQ ID NO: 967 - protein, 162 aa, Methylobacterium sp.
MPNRVQSAFRAAAEVGVGLVAACNRLRLPRAANPFVVGVHAPMRAELTLEDLPVTGTIPPGLDGLYLKMGANPVRAATRGHDWFLGDGMVHGLALEGGRALWYRNRWIGSRTAAAALGRPAAPGPRRGGNDTVNTNVVAIGGRIFAVVEAGSFPVELSPTLE

SEQ ID NO: 968 - protein, 162 aa, Methylobacterium sp.; identical to SEQ ID NO: 967

SEQ ID NO: 969 - protein, 111 aa, Methylobacterium sp.
MRRLALLTTLALLPAAAMAQDYDPSKATKYASPPMYRPKVNQLILKGTGGVVCDNPAGCDASTLSVTLPSGAKLTLPDAFAAKMSSINVAAAPSSAGNWGSVDTAFTGDTS

SEQ ID NO: 970 - protein, 77 aa, Methylobacterium sp.
MYRPNVDRLIVRGAGGIVCDNPDGCDASTLSVTLPSGSKLTLPNAFAAKLSSINVAAPPSSAGNWGSVDTAFTGDTS

SEQ ID NO: 971 - protein, 57 aa, Methylobacterium sp.
MTIFQVRQARSRAIVWTGEAESADRALEAAAQSAGYHTFAEMPDALRTDMAVEAVTV

SEQ ID NO: 972 - protein, 57 aa, Methylobacterium sp.
MTIFQVRQTHSRAIVWTGEAATADRALEAAAQAAGYHTFAEMPDGLRSGMAAEAVKV

SEQ ID NO: 973 - protein, 85 aa, Methylobacterium sp.
MMDERQALTAFAALSQETRLQIVRLLVQAGPEGMASGVLGSELGVSASTVSFHLKELDHAGLIQARREGRSIIYSAAYPALSGLI

SEQ ID NO: 974 - protein, 85 aa, Methylobacterium sp.
MMDERQALTAFAALAQETRLQIVRLLVQAGPEGMASGVLGSELGVSASTVSFHLKELDHAGLIQARREGRSIIYSAAYPALSGLI

SEQ ID NO: 975 - protein, 37 aa, Methylobacterium sp.
IEVPVMLTVVWIVNRSQGWYERGATRNAALKTISREV

SEQ ID NO: 976 - protein, 37 aa, Methylobacterium sp.; identical to SEQ ID NO: 975

SEQ ID NO: 977 - protein, 94 aa, Methylobacterium sp.
VRSEAVGRSRLTIISALGVVEILTWGSSFYLPAVLAGPVAQDTGWPLAWVVGGLTLGLLVAALASPHVGTVIERHGGRPVLALAALLLSAGLVV

SEQ ID NO: 978 - protein, 94 aa, Methylobacterium sp.
VRSDPGGRSRLTIISALGVVEILAWGSSFYLPAVLAGPVAQDTGWPLAWVVGGLTLGLLVAALASPHVGTVIERHGGRPVLALAALLLAAGLVV

SEQ ID NO: 979 - protein, 46 aa, Methylobacterium sp.
MSTFERYLTVWVALCIVAGVALGHVMPGIFQAIGSAEVAQVNLPVA

SEQ ID NO: 980 - protein, 46 aa, Methylobacterium sp.
MSTFERYLTVWVALCIVAGVALGHVLPGVFQAIGSAEVAQVNLPVA

SEQ ID NO: 981 - protein, 185 aa, Methylobacterium sp.
MPHPEIQPASRREWWPETFIDEVSPDGRATPSDWLIRLEGGGYAYGDPTDRLAPPKAVREGDVVEFSFRDYLGSSLMTLDADGEPVWTPPLPQGVNLFWDGHDSDTICDTEGAFAEFVKEYGEHQDSQVTVLCHWSERTLRCQFTAAGGVLRFLPIDDPPPPPVMPVEAPVQPSHDDLFSAAPTA

SEQ ID NO: 982 - protein, 180 aa, Methylobacterium sp.
MAENLIPAIDGRQWWPSDCLDEIMPEGRATPDSWLFRLADGTHRCGEEGETEHPVCSVSEGDVVEFIASDNLGRARMTVEDDGSVRWEPRPPDDSHIFDADDFEMSGDGPDDFVRNLRSFNDLDPGESVEVYVTRWSAAVQCRFTAEGGPPRFVPLSDPPPAPEKPLAPPAPPEPHPTLL

SEQ ID NO: 983 - protein, 530 aa, Methylobacterium sp.
MDRVIVYPNALPRALDVLRTNQFAMVGLGGIAQATLGTSTIVDGFTLTPTSPASLSCNLGPGQIYQIDSLEETAISSLPSDGTRIVKQGLLKATTLITFAPQLGVGQSACYLVQAQYDDADTGDQVLNFYNAANPAVPLAGVDGNGQSSKTIRSGAVALAVKPGIPTNGVPTAPTPDAGYVGLFVVTIAYNQTQILAGNIATYAYAPTILDKLPAIPSALQSNKYVYVKDVGAVNALSVNPVPAYTAYQEGQELVVVPNFTNTSTTVTLSVSGLPAAAIGLANGSNPAVGDIIQGRPLRLRRSGTGFWNFTGPAPSEAGPAAAQQAAAAATQGLKTPPYYNLVPGTYSVVVPAGVTSCDSELWGGGGGGGGVGAVNNGSGSAGGGGGYSFKTITGLTPGQTITLVIGGAGTKGGAGGAGGNGGTTTLGAYHSASGGAGGSPNGIGNGGVGGLGSGGDINIGGGYGSAGASTGVSLGGAGGSAPFGGQGGGGAPGIAGDGTMPGGAGGGSGSTTINPGGAGAPGGCIIHWK

SEQ ID NO: 984 - protein, 151 aa, Methylobacterium sp.
GSAGGGGGYSFKTITGLTPGQTITLVIGVAGTKGAAGGAGSSGGTTTLGAFHSATGGAGGSQNGIGTGGVGGTGSGGDINIGGGYGSAGASTGVSLGGAGGSAPFGGQGGGGAPGIAGDGTVPGGAGGGSGSTTVNPGGAGAPGGCILRWK

SEQ ID NO: 985 - protein, 210 aa, Methylobacterium sp.
MTAILSLPLLQVAFETATNEDWRDGLAFATAGEAVGYAAPGNTGTGTITDLAVSAGAYIGDYVVTMASPTAFRVTDPDGYTLGAGALGVPFSRSGVSFTVTAGASGFAARDTLIVSVLPAPIDITGIAFRMQVRTAAGNESVKLDVSTEASTIVNGGATGVLGIAVPGERMARMKPAALVFDIVAIADGLERRVATGTINHVPGVTRLIA

SEQ ID NO: 986 - protein, 224 aa, Methylobacterium sp.
VSNLALIQPQPVDFDTTQATDWLDGLPMIGTPGVIGTLASPSNIGSAGLVVSAAPGAALGVHKVTVAALVNGLIDLTVSDPSATITGFGIAGLPFYAGGLTINLSQVTGGAALAIGDSFAIAVVPVAIDLTGLRFDLDARASIGDPSIALQATSDGPNPTIANGGPLGVIAMAVARASMARLPVKPEGYPYGITASDPVSGLTVPVFYGLIHHTAVPAQIGQGA

SEQ ID NO: 987 - protein, 68 aa, Methylobacterium sp.
MIVALLLTAAGVIVGMPIVLYGFIRLDERPGRASWLILLLGLVIIVAPVTTALVLHQEESGAGRYVGR

SEQ ID NO: 988 - protein, 68 aa, Methylobacterium sp.
MIVALLLSAAGVIVGMPIVLYRFIRLDERPGRASWLILLLGLVIIVAPVTTALVLHQEKSGAGRYVGR

SEQ ID NO: 989 - protein, 321 aa, Methylobacterium sp.
MQAGGMTNGGKTVDTQIADALREALMCSVFISPSDPGLTYEELQEVGRRAGYRDGEVNDALRQVANNYTGRDRYVPEENTFIHGLTWMPDNPELRDFDAFDFVVKALNERIRDIGIREARIDRGVVVEQAVSSGLDRVAVEAAITYMVFGNLLAESNGSLRTTQVMGTMVVPGDRWREWKRGRDVAWPRPHRARMRPIVSDVIGRRTNGRPSHAEPLAAFPDALDRLGFRTFKVWWTQIAREMLTSDPSSAATARIVLAAALVEGVLTFVVQHARSKGLAVFQSSDFQRTPEHWKIVDLIRSAATGGKDAVLTQDAKVRAE

SEQ ID NO: 990 - protein, 321 aa, Methylobacterium sp.
MQPGGMTNGSEIVDTQIADALREALMCSVFISPSDPGLTYDELQEIGRRAGYRDGEVNDALRQVANNYTGRDRYIPEENTFIHGATWMPDNPELRNFDAFDFVVKALNERIRDVGIREARMDHGVVVEQAVSSGLDRTAVEAAITYMVFGNLLAESNGSLRTTQVMGTMVVPGDRWREWKRGRDVSWPRPHRARMHPIVSDVIGRRTDGRPSHAEPLAAFPDALDRLGFRTFKVWWTQTAREMLTSDPSSAATARIVLAAALVEGALTFVVQHARSRGLAVFQSSDFQRTPEHWKIVDLIKSAATGGKDAVLTQDAKVRAE

SEQ ID NO: 991 - protein, 111 aa, Methylobacterium sp.
MKNLRQHPDGSGGMYLNWTKEQLVEALQDRIQRKDKVPNGGPYERYFLVIITDEFMLTSDVVSAYLEATVFRVELITDVILGLSYEPSPTPNDRAGTTPTFRLPLAARERR

SEQ ID NO: 992 - protein, 111 aa, Methylobacterium sp.
KASMKNLRQHPDGSGGMYLNWTKEQLVEALQDRIRRKDKVPNGGPYKRYFLVIVTDEFVLTSDVVRTYLEAAVFRAELITDVVLGLSYEPSPTPSDCPGSNPIFRLPLAAR

SEQ ID NO: 993 - protein, 164 aa, Methylobacterium sp.
MIRSALRPFWWAYWACVALFMLGTVAGAVGPSVQARVAPIHEDMQAVSIARTPERMCWDYTSRKLREAATDDLDTFLYVAGHDRMVVAPVGEVDGMPWRASRAPGIGPYRKRWCIDLPPGVPVGEPIRFELTAYYRGPWGLWRMPLAWPPVGAKGLPGTRTTTP

SEQ ID NO: 994 - protein, 362 aa, Methylobacterium sp.
MTAVVASAPAPARRRLEVNLPDAHIGLWQKDPNDPTLRTEIYEGLLGHLKRRGFKITAVPRVAKHHRCISPLYRLAARGDLRAEIHVSGCVVQLDWWSEAAPEGNKSGRQYDFGRRRRMPYLDGLRFELEVRHLLAWVAERADIVTRPQHRGDRRVGIGRGEVSAAEYIEAAYATSWHTDKDLGRPKCSDSNRKSADGDLIEQESRVWFRDWHGRMLTGIAYYSLNNRWMIVTSAHSMSWASAYEIFTRCPPDLRRKRNERQRRKRLEGELAKAIQRMDFRRAETVRKILFGTELTYGIYHVEHDALYGPGFSGYTKDRLEAGRFTWNEAAREVRGHPDLLRLVLPDGKHLPASELGQAKAA

SEQ ID NO: 995 - protein, 479 aa, Methylobacterium sp.
MNARRSNKLTPLEEELLDLRDRVQELQDALRERDKAFAPEIRIPAEWGLSRAEAVTFSALMNAVGKTVRRAGLLLVCLPSYTVPSDEVLDKTVASLRKKVTPHGYTITSVMGVGYSITAPADPAEVPQPAAAAVAAPAPRKRPAGPNAYSEAEDAIIRAGVEAGKLLPAIRLDLVSAGFRRSCTKSIRSRAEWLGLKVPVELKRWTPEEDEIVATNTNAPIKRVRTLLATAGFRRTIKAVASRRIDLGLQPRPMGLTPELKQIVRACIAQQMTDPSTLAHLRGLGHDVTLSQVKNVGQQIRARSRPGWTKERVDTLRAMAEEGKRPIDIAHALGLTNSKTVNEKARHLGISFARLWLDEEVRTLLAMMGERKTSIEIGEALNRPPSQVVNKARRMGMSFERWPEESAWTDEKIDALRKASEDGVRLADAARALGRAPDAVFQAARRFGISFSRDRKNLLPLARTEQTKINGNHYSVAQQ

SEQ ID NO: 996 - protein, 185 aa, Methylobacterium sp.
MLSPAHFDYLVSYAVAREIRYWSRADKCQERVTSTGANAVGRMLASANADAYANRYSSHGDEFERGENFRAAREYRWRPFPGPFDPVQVIKAVDCLEYQACEASGWEDSDASMLCHAIRAYAVRALAGYDDAKWCIDDVADLRPAKPAAAPASGVASRALRLAAAVPAFTPPAPPAPFFGQGALF

SEQ ID NO: 997 - protein, 207 aa, Methylobacterium sp.
MPDLSRRALLASITAAAATIALPASAAPLSGTVIIDDPWHSIPPAPRPLPTLPELKALSERALAALERHWPRHIYGETFLSEGDSPHGLVIRCDCLDRPDTSHGRSGYRCSSVLPGTPMIGAMSGYFEPEWDERTTYGILLDVTWWNERPAAISDADWAEVLAIVDMTPESHAERMADLARQTGEADAAWDRFAEEFNRTNGELPHV

SEQ ID NO: 998 - protein, 158 aa, Methylobacterium sp.
MKRETAPPRPMTAREAHAALEQLRSEIGPKAYVSISIAASDISDAIIHASIYAHGIAQTSPNFACKGEDLGEAVAALRAGWAGFQEEHARRMSADMALEIIRLTDAHGCCTDAALRGSKFSVGDVRRWGEAACARANEMAGRGPFTIVSIAGANGEAA

SEQ ID NO: 999 - protein, 151 aa, Methylobacterium sp.
MTDIIKTSAWSQKVPSDHIKIGISRGTPRGHAAGYRLFKTLAPGAWFNSVSATEYRERYFAEILAPLDPAAIVATIQKLAGDKVPVLVCYESPTKDEDWCHRGYVSAWLKDKLGLDVPELGHEERGCGWSHPKLPPTQRVKPAVDGPARLL

SEQ ID NO: 1000 - protein, 182 aa, Methylobacterium sp.
MLTFKRTRGSRLDPLPTFEVLAGAARLGFITDTGPEGAGMRWKGTAADGTPLAATSKAKIAQKLQIHDAATRNAPGPLGPVYAEPARVSDAHGRYFSHIHAGTGREDRGNVIAAVYQGGPGGTLNTGPAVDAAARLLAAAPKLLAALKSVQGCPQAAPWLAAAGIHEEIQAALAAAGPAPRT

SEQ ID NO: 1001 - protein, 130 aa, Methylobacterium sp.
MRTVFAILILAAVGPAAAADVYLFDLLRRPDYKRAYNAMLKSGSSVPKWVTAYSRTLNGPSQPSSEIKADGETYLLADVCKVHDCLDHKLHVIFAPGGRRAWGRLYENGSTSWIGSPSPALRKAAERIEF

SEQ ID NO: 1002 - protein, 340 aa, Methylobacterium sp.
MYDGEGRFPRIEGRRDISEYATGRISTDEVPPHERIDHWTEACRTAFGGFEFVDVERKGFHAALSTLTVDCLTVGHYVGSPHAMARTKAHIRSSDNNFYLVILGSERTFNLEHGRYLNSAPGGISLLDNTQPFLGAHPDGLDIINVFIPRAVLEQAVGPARSIAGLSIDATQSTYPLIASYLSALIRHGGALTPARQARMAAVAVELLAAGFAERIESGSPRSLSGAAILCRAQAFIAEHIGVEGLSINDVAAALNISVRRLQEVACAENVALMDWMWERRLQLAQAKLADPANGVMPVGLIAYQCGFASQAHFSRRFKERFGQTPTEFKVWAGLQRAPA

SEQ ID NO: 1003 - protein, 106 aa, Methylobacterium sp.
LLYARIEPESEHRQNGLLHPEKVIQAGSIQLTSVSFENGSLPIISACAEFQLSFDRAFRDTGGLYDWMEQTDWLDHALCFGFRLQDGGEWDATYDHAGIDFEIVTP

SEQ ID NO: 1004 - protein, 179 aa, Methylobacterium sp.
MSGSGVVHEAAVAASEPFGAFAAGLADLSPLRWAVVAACRRPERDCVVPLLEEARLPPEAARRVAEDARRLVETLRRRGTRGGVEGLIHEYALSSQEGVALMCLAEALLRIPDAATRDALIRDKIAGGDWAAHLGHSPSPFVNAATWGLLVTGRLAATRDEAGLSAALTRLIARGGQAG

SEQ ID NO: 1005 - protein, 58 aa, Methylobacterium sp.
MVSRAVCRTAGPNCLTGGVLLAESGKSEKDMSALPGRSAVVERRASAAAFAEKAPPVA

SEQ ID NO: 1006 - protein, 55 aa, Methylobacterium sp.
MRRFIVLWTVPGLGFAFEADVAATSPREARAAFRAMFPSDRVKAVKLPRGNGRFV

SEQ ID NO: 1007 - protein, 164 aa, Methylobacterium sp.
MLSPGLDFDPRFWPSDPSPDETVCLQLSDRIDCYCLLDRQDYLWARRWLWCHTYGSGSFDPDTWTIDRPDGIYARRSVPIPGRITPSGRPAYGNLFLHREILERAEGPPPDPSWVGDHINGDTLDNRRCNLRWASKSLNAQNTVRHRAATLARYAAQHAAACSA

SEQ ID NO: 1008 - protein, 74 aa, Methylobacterium sp.
MADDMSEDKTASRQKSDAAMERTRKLVLDTLPPGPVRDRFAALTLDELRGLEFDSDLWRQVRVALSHVEGRHLN

SEQ ID NO: 1009 - protein, 48 aa, Methylobacterium sp.
MVDCNCTGLRFGKLVFVWLRRERAFRLNGFFAFTFAFRSIRCLCLKPA

SEQ ID NO: 1010 - protein, 289 aa, Methylobacterium sp.
MSSLIFHDLPRGPLPLYISEPVPGLEEAKATLLLDHHHREVRFVAADPFTPFTIPPAGVDRYSWWDVDPMLPRWQVRELYGEARPLLERIQMGTTLTQLPTHWHRTRTPEALAAAEMVEELAAQPAQAAVEWVPGLRPVREETALERAIRITEAAVRSEFIHQFHQKELAGMPIEAHERNFRNLLAHGKDIFYSHGDRTLGMSGSPILNLSPGTGKSQGVIGLLNAMGPVSKSLATDDGSAVGSPSQETMRRRTKGVILPGNHDRYSRKGINGKWGALFEESDVRRIAG

SEQ ID NO: 1011 - protein, 45 aa, Methylobacterium sp.
MTKSLQIIDTKLNKIILTKISEHEAHKRVDLLNSCGIVRYKARAI

SEQ ID NO: 1012 - protein, 486 aa, Methylobacterium sp.
MSWDNEKVVAFRPTDSQLLERLPHCFDTERALLAALLLKPDQLTEVAHGLKVDDLFGAEHREVYGTMLALSAGGLPVSAVTVAQYLKTREIAGQPPARYLASLAADAASWDAPGHATIVREFARRRALVMIGEGLAEQARQGGAEDQASTLIDETDTALLEVRGTGSDGRMSGQDAAQATAWMRERIEGLRSGLLRSTAVPTGIADLDRATNGGFQRGQLWLLAGRPGMGKTVAMTSLSRFAAREAGVLVFQCEVTRDQQIARYLADLSYLHNRPLTFGKIMAAVELDDDELWRIDEAMKRYERLHLKLECEPSVSVAQIAAAVKAEKRRLAKMGQDLGVVFIDYLKFIKVSDRYQGNRVLEIGEISGSLKQLAKSEDICVVLLTQLNRGVESKDRADKRPSLADLRDSGELEQDADAVLMLYREAYYLEKKLKGSSDDDVATRLIEKQNTLEIILAKNRSGPCPTLDLWCDVASSAISQTTRGPR

SEQ ID NO: 1013 - protein, 170 aa, Methylobacterium sp.
MALPKILALDLATRLGWAYGSPDGEPHYGSKLLPSTGAEIGRFGDAYDQWLLDMITLENPALVVFEAPFVSGTGNSNTARKLMGLCWQTELACYRRQIRCLEHNNQSMKKDFAGSGRAEKLDMMAAARRHGWDPKDDNAADALALWACAVHEKAPKYSRLTLGRLGGRAA

SEQ ID NO: 1014 - protein, 77 aa, Methylobacterium sp.
MLGKTLRDRITGFTGIVTGHVEYLTGCNQCLLTPPMRDGKRMEAEWFDVQRLEDTGAAIIVLDNGLTPGCDRAAPKR

SEQ ID NO: 1015 - protein, 133 aa, Methylobacterium sp.
MRNLRLLDVYRDASPRVIAMYGDAGDHSYGVFRVPSPTGGQPLVVIASTGEGWDHVSVSLPNRCPNWPEMEHVKRLFFREDETAMQLHVPPSDHISVHPYCLHLWRPLSGEIPRPPGWMVGPSSTEAAGKVVA

SEQ ID NO: 1016 - protein, 109 aa, Methylobacterium sp.
MRIMLSAKMGEQVRKDPRTVIVDRVPWELFDEQTTRARCESNHGQTIERISERGGFDATEAVGVLTGLKWGELRHLREEHAHRILYQMVHLFRRGVLTGRRSMQEASNG

SEQ ID NO: 1017 - protein, 73 aa, Methylobacterium sp.
MIGRTYLEAGSPVRVLIRWGRTSAGPSAPIGPLSDCSWSRRRAPHNVLIERQDGSRVVRPFRGLRKLPEVDHG

SEQ ID NO: 1018 - protein, 133 aa, Methylobacterium sp.
MGEPMKALSIMQPWAWLIVNGHKDIENRDWRCHRRGHVLIHAGKKIDRDAMQDLRSGRHPVTGELLRLDLPEVFETGGIVGEATIAGCVERSESPWFVGRFGILMRDARPLSFWPCKGALGFFVPAPVAEVAA

SEQ ID NO: 1019 - protein, 74 aa, Methylobacterium sp.
VIAPTEADIGRRVIYHPVRGHTVEEGVITSFNPAYVFVRYGADAGSKATPRELLEWFGPASDSGLKDQGGDSAA

SEQ ID NO: 1020 - protein, 98 aa, Methylobacterium sp.
VGASEIPVGAQFRLEITWRVLGPGPAFAGMPDDGAITATSPDGGLAVDQPNGTVTWSYTTAQSLGIPLGAVARYTLRCLFGSHTQVWAYGPLRVRGAA

SEQ ID NO: 1021 - protein, 60 aa, Methylobacterium sp.
VPTPAPRPVPKRGEDARLYARRALDYGDANAAGLTDTADRYRALAEAMEHPAPAPETTAP

SEQ ID NO: 1022 - protein, 508 aa, Methylobacterium sp.
MGILVPVGIVAVCSAMLLQLRQDAWDKAEETSRNLIQVIERDIDRNVEIIDVALQNVVENLKLYDLEDISPKHRQRILFDRAINAKDLNALLVLDQYGNCIYDAAGWPPRRYNNADRDYFQAHKADASLGLGISGPIMSRSVGKPVIILSRRTGMRGDDFNGIVLGSLSLSYFDRLFQDLKLGQAGTINLFLDNGTRILRYPQNDTGTPPNFADAPNFQRFQREGRGSFVATTQTDGIERLYTFTRVGNLPLMLNVALSTREIEADWQARALVIGLLVFALCGITVGLSLLVAWELKRRNAAEAELAVLSHTDTLTALPNRRAFEAAFARAWAAGRRCGGSVALLIIDADHFKRYNDRHGHDGGDRVLMALAQAFASCTRRPGDFVGRIGGEEFVVLLPDADAEGAASAADTVHAAVASLSVEAGGVHVGRITVSIGLAYGVPRRGGSPEDLLRLADAALYKAKATGRDRTCYVVMDEHRAVGAKAPSNPSSDPGARPTRPEPASLVA

SEQ ID NO: 1023 - protein, 140 aa, Methylobacterium sp.
MFRRPLSPTRLVRAAVLGAALLGTSTAAEARRAALRADVEGYAMAACLTRQDVPYLREQGHLWGNAILQRGHGSVEDWTTLADAVGAAAARQTMSMARGDGAVHDALKPMPLLFCHELVRSPAVRAAKVRAMRHLAPDYR

SEQ ID NO: 1024 - protein, 38 aa, Methylobacterium sp.
MRNKIETRRRHYNESGPQTALEWPTAQELDLATALQAA

SEQ ID NO: 1025 - protein, 67 aa, Methylobacterium sp.
  MOD_RES (50)..(61): Any amino acid
MINEAVRERLGRWRSADILMRSVDFQAVVDMQRAVLWDEIGHHLGTAAPXXXXXXXXXXXXAHGTGR

SEQ ID NO: 1026 - protein, 256 aa, Methylobacterium sp.
MTKTVAIVTGASQGIGRATAMRLAQDFSALVLVARNRTKLEETASAVREAGSEAFVIDLDLAEPTAAATVVQQTLSAFGRIDALVNIAGAVPGLDVFQMTDEQWHAGLELKLHGARRLTIQAWDVLKATRGAVVFMSGNAAVTPKAAAAAVGAINACIEALAKAFAERGIVDDVQVNSVSPGAIMTDRRTAMLQRAAEAKKIDIAEAKQGFLKQAGITRFGTAEEIADVVAFAVSPAAHWMTGTVLRMDGGEVRSV

SEQ ID NO: 1027 - protein, 323 aa, Methylobacterium sp.
MRAIVLDGFGGLDVLTYRDIPEPEPLAGHVVIEIKAFGINHAEVHMRRGEWAEAAPVSGIECVGIVKSCPGGEFPVGAKVAALMGGLGRTINGSYAQLTSAPVGNVALIEADLPWAELAAIPETYATAWTCLFRNLEIQKGQLLLIRGATSSFGQAALKMAVNAGARVIATTRNPERFGKLQALGAERCEIERPDLSKHIADAKQIDAVLDLVGNSVVLDSLAMLRRGGRSCLAGWLGGLDPIPDFNPLLQMASGVYLTFFGSFVFGTPGFPLADVPLGQIAQDAAAGRLDVKPVRIFGFDEVREAHRLMEANAAGGKMVVVH

SEQ ID NO: 1028 - protein, 326 aa, Methylobacterium sp.
MATPEDWLSRLLALVPVRGRLDIYCTYGAPWRIDQAGAAVGEMAYHAVVAGSAVLEDPTGGPPLRLSAGDILLLPQRVDHILHDGSGAPAAPAHTRTAANLLISENEGTGERLDMLCGHFVLARAQERLLRDYLPPRLVVRTADPGASATLSGTQDVLTGLVSLMRHEAVSDGLGGRAMLNALSTALFTLTLRLASEARDRPVGLLALAGHSRLAPALSALFNEPGRPWTLPKLARLCNMSRATMARQFQERLGQSANELLTDIRMTLAANELRNPSASTGAVAETVGYQSEAAFQRAFKQRMGVTPAQWRRDAQSVEPPVPALPS

SEQ ID NO: 1029 - protein, 173 aa, Methylobacterium sp.
MPGLLSRILACRPLLLRWAPVPLRLVVGYGFLAHGLAKAARGFDAFPAIVEAMGLPLPHLFGWLTILVEILGGLAILLGALVPLASLPMAIILLVAAFTVHLPYGFSSIKLQAVTAAGASFGPPGYETDLLYLACLLTLVMAGAGPLSIDELLRKRLGAVPADQTLRHVGRRG

SEQ ID NO: 1030 - protein, 76 aa, Methylobacterium sp.
PVTLQDAIQVRPWLANVLRNGGPNVQLVRHGFVLPLVCRLVHPGSGTSDVGSGGTSKAESNAEYQRLVDRFGRIPW

SEQ ID NO: 1031 - protein, 88 aa, Methylobacterium sp.
MVATSLAISFTVGAIAIAQIGPFAERATPVLASVAIGLGMLALIGGLSQLNAEGAAVSRADPRPEFGMSWRPPATEPYDRTGSGRTER

SEQ ID NO: 1032 - protein, 80 aa, Methylobacterium sp.
MSTVNLENSIGIPVENALRFARLMDSWFAGVGRVAVPPGNPFLGINPEERETIAFGFADLVERLAAIDAQVSGPDGICPR

SEQ ID NO: 1033 - protein, 109 aa, Methylobacterium sp.
MTMRRSFPPLAALRAFEAAGRRLSFRAAADELGVTATAISHQIRLLEQTLGLRLFYRETRRVRLTAEGTVLLPVLRDGFDAFARAIDEIRGRHAAGVLTLSAPTAFVAK

SEQ ID NO: 1034 - protein, 149 aa, Methylobacterium sp.
MRDRAGNRTTMSARALRGSGGEAQAPFYVAIAASLASAYYPGDRPGDENPGLGLCLLDEAFSKLDVRNSQALVDLYRAWGLQLLIAAPEDKRTTLTEVMDTIVTVYKSPDLTSVRIEAEHPLEAARRALHAINPDQVGIEGFRQSDAAE

SEQ ID NO: 1035 - protein, 194 aa, Methylobacterium sp.
VSDVPAPSRSRPPEYVAIGLIQDAEAYRVAAMRVHPSRETFGAREVDLLAPAWHLLCHSSELALKAYLLSTGVDQGSKKGGLMHSSIRHNLNGLYQWAMERGFEPPDEDFGDLIEFLDPYHSAHVFRYREPDRMPFVPPFVIADILKPVISGVARTVRAKWKATREAGSDDADLASVGLAQAQPPESNTKPSRG

SEQ ID NO: 1036 - protein, 66 aa, Methylobacterium sp.
VSTTLKARMMRLENCYPDLKPGPERMSDEELDGVIGVLRQLEAGETVDPTRLDWATAIMQREQMLS

SEQ ID NO: 1037 - protein, 92 aa, Methylobacterium sp.
MNLKALEARLVRLETKHGAGQFDHLTYEEVERALFDRLHRMADAAGGIDELMAEWDAETDPEHSALIAQIRSHECDVRASYLEMEGRLCPRP

SEQ ID NO: 1038 - protein, 81 aa, Methylobacterium sp.
MSAVLQFPRFRAYRPEPDAMRLAFDFGDWCVELRRSGKLARRIRFASLEEARAEVARQEAAGLRRLPDAPMPEPIGGEDIA

SEQ ID NO: 1039 - protein, 67 aa, Methylobacterium sp.
MRPLVYSDTITVRTDADLRRAIDAAAEREGASASEWVRRALGSIVRIDGPPRSPTPAAPAGALPAAA

SEQ ID NO: 1040 - protein, 68 aa, Methylobacterium sp.
MQTLACRTELATLLRGIQGIAGLAACNLETGGSVQDLCGLFSALGQLDANATDLAGRYGVLISTAGSA

SEQ ID NO: 1041 - protein, 95 aa, Methylobacterium sp.
VISRSLQLDDFLWALDNSRRRYRVRPTRLGDLTFRFGETYPGLITVVSVNGIHHVVMTARCEISPGPWLDTDAYADFRLLAINRKRALRNYGGAR

SEQ ID NO: 1042 - protein, 42 aa, Methylobacterium sp.
METSMTLFTRFALATAVAAATVAVLAGTYVEILDRALPMHFV

SEQ ID NO: 1043 - protein, 89 aa, Methylobacterium sp.
MKKLITTLVAGTALLGAASAVQAHEWGGGYGYGYGYGPGHGHSRVIVREGYGDGYRGVRFGHRGWDRPDVRVIERRGYGHRYHDDDWDD

SEQ ID NO: 1044 - protein, 87 aa, Methylobacterium sp.
VRSTIIAAALLAALGSAVAIPASAAPIGPDTGVSAPAGMVSTVQMDPVERHMMRRRMERRMMRHRMERHMMHREMRREMRREMMRRM

SEQ ID NO: 1045 - protein, 138 aa, Methylobacterium sp.
PGGTVLAALAEDAEGERLMLDGVWRRLRAVRRGAELTVIVGGRNATLVHVDPLAPPRTEASGSDRVTAPVPGRLTQLWVRPGDAVEKGAPLAVIEAMKMEITLRAPQAGTVAEVRHAVDDMVEEGTEIVTFAAEERPA

SEQ ID NO: 1046 - protein, 118 aa, Methylobacterium sp.
MGDINGDIDQTTFQQVGRLLGAERAAEMLGLLRGTLTALADMTDDDLRGPAGLAGVHRLKSEAGLMGFGRVSQACEAVDAVGTNGSVPQGRLDDLRAAMTSALATVATLGPNPGRPTL

SEQ ID NO: 1047 - protein, 140 aa, Methylobacterium sp.
MATASASVEIPAPASEVWRLIGGFGSLPDWLPYIPKSELHEGGRVRHLANPDGGVIVERLMAFDEAGRSYSYHILQSPFPQRGYLSTLRVRETGDGQRSRVEWSGEFQPVGVSDAEVTKLFQGIYEEGLAALRKHYADEG

SEQ ID NO: 1048 - protein, 104 aa, Methylobacterium sp.
MKRRRGLLSFSRVRSAAANHTEALVTRWLPDGHREGREWVARNPTRGDARAGSFKVNLSTGAWGDFATDSKGGDLISLAAYLRNISQLEAARNIAEMLGIDAYE

SEQ ID NO: 1049 - protein, 152 aa, Methylobacterium sp.
LALNATIEAARAGDAGRGFAVVASEVKQLAAQTARATEEIAGQVGRIQGATGQTVDAIDGITARIREIDGVATSIAAAVEQQGAATREIARNVAEAASGTGAVTGTIDAVARAADDTGTAATRMLASASSLSEEAAELRREIDAFLHTVRAA

SEQ ID NO: 1050 - protein, 105 aa, Methylobacterium sp.
MRGSDQRSGTLFSYVNWEARVRPDHPLRTIRQLTDVALVALSGDFSALYAARTGRPSIPPEMLLRARIASPEMLPDVGSLPHLICSPRRFGGGSDDEASEHGDAR

SEQ ID NO: 1051 - protein, 81 aa, Methylobacterium sp.
MGEPTEADVLARAKRTFIAKNHDDRAWDAGFTEREARNGHNVACLTEVERQEYLEQARHELRTSSPSERTDRSKARRKGIE

SEQ ID NO: 1052 - protein, 58 aa, Methylobacterium sp.
MLSPIDALQKLRDQMVINRRKIVDQEESIQNVQAEIEAIDRAIKDEEIISKSTGSKVT

SEQ ID NO: 1053 - protein, 137 aa, Methylobacterium sp.
MALLTDTPESSADAVPKQNRDEWAETVSSYIERSLLIVVGASVTVVAGFLSQVWSSASVAFRTDLATNLKALGTLFVATFVLPTLRFFVELHRDDDPKKSRKAFIVWVIAAALMFSFYTRLIDQLGDIVLKYAKVVG

SEQ ID NO: 1054 - protein, 66 aa, Methylobacterium sp.
MPQTLTGWVLFAALWLTGPIAGYAAMNLAAARWEREAIMRRDILAVTILGSLLLVSALLLMFVDGL

SEQ ID NO: 1055 - protein, 36 aa, Methylobacterium sp.
MFWTHPTETMMWVGVSLVIGLFVGDWGADRQRLPPG

SEQ ID NO: 1056 - protein, 181 aa, Methylobacterium sp.
ALVRDLRESATRIGDVVGLISGIAGQTNLLALNATIEAARAGAAGRGFAVVASEVKELAEQTARATEEVARQVGEIQSWTGDASDAITRVVSRINEISAVSSGIAAAVEEQGSATQEIVRNVGQAALGTGAVTNNITDVARSAEGAGSAAAQVLEAASGLLGQAQRLDAEVGRFLDTVRTG

SEQ ID NO: 1057 - protein, 58 aa, Methylobacterium sp.
MSPRLAAVLSLETALCSAILVEAAHDRLEEEAPATGIARVSAWLLLAAIDFLLWSKAT

SEQ ID NO: 1058 - protein, 66 aa, Methylobacterium sp.
MIAFTPNPHKLRVTPSAKEPGRFDWSITRDGVIVRQSVRSFGSEGASEADGDVAFREITARWQSAR

SEQ ID NO: 1059 - protein, 271 aa, Methylobacterium sp.
MTVLAPTSAQETSRNPLAAFGGGAAIGALGGLIGLGGAEFRLPLLIGLFRFDALEAVILNKAMSLVVVATALPFRARTVPFDEIGAHWPVILNLLAGSLLGAWFGAGWATRLRSETLYKVIAGLLVVIAAVLMFGHDAAAGAALVTGSVQIVVGVIVGFIIGVVASLLGVAGGELLIPTLVLLFGADIKLAGSLSLAVSLPTMLVGFTRYSRDQSFSVIGRNRAFLLVMAAGSIIGTFIGGQLLGIVPSGVLLPLLAMILLVSAVKVWRHA

SEQ ID NO: 1060 - protein, 93 aa, Methylobacterium sp.
MVTDASADLAVYLLKEVASRAPSIVAFMVAEGRRLPEDPDEARQEVRQRWPEMSDDERDMAFRMAINVLRRIERDCAENIARLDALTTDAGRG

SEQ ID NO: 1061 - protein, 251 aa, Methylobacterium sp.
MVGLARRKPKNDAVAAVQPLSVIDGLRAARAQADAERADAVRARVDAEGRRHAAVKAEDERALARLDDEIATARRRIDIAEAKFSRLDGELAQAEYDAEQRRRHGVRSEAEAALNQAREIMRTEYPAAALAVVEVLRRVRELQGAAYRANADLPDDAAPLSLIVDPMHVAAASAPQAMMWAHVLFNRRTGERAPSSVQSGPEYELRQVMVPRPAADNHAPTMQAIADFVNLPGVEPGKYFYGAVRWGQPRN

SEQ ID NO: 1062 - protein, 33 aa, Methylobacterium sp.
MIQPPLRRKIRVLSTIGRISVALMRTMRILRSD

SEQ ID NO: 1063 - protein, 133 aa, Methylobacterium sp.
MASVRVPVKPIGVPFARAGGMMGAQANGAESGRTIIPPILDRIRREPHLLASLPGLVEAAIEAGAAVLVQAEISAADIAAWKRGFIHAANALVHPFFEEMQALLDSSPGVGEPAGIPAGRSLRPEDLGALPPR

SEQ ID NO: 1064 - protein, 79 aa, Methylobacterium sp.
MQRNKVSTVFTPARVAADLGQDEDALFDIIVDMEPEDGLIWVHGSGDEAYLAFTNDGIHELKERITALRAERDLLPPRP

SEQ ID NO: 1065 - protein, 78 aa, Methylobacterium sp.
MNATASDVETMRRFNRLYVGQLDADEIAAFDNLCSQVLMQRSYERLAGLMGLSQARIPSAGHAAIDAASTTPVTTAAE

SEQ ID NO: 1066 - protein, 466 aa, Methylobacterium sp.
MARLRIAMVSAWCLIPAGALVLLVPALVNGFPFIFQDTSDYLIFTPRLYRSPFYGLFLFGFHLNRFIWAPVIAQALIGSALIYMLIKTLPIRNRPGTFAGLIAFLGAFTSLPWFVGFLMPDIFTAYLFIAVYLIGFHLERFSRPLRVVLVGFAGLTMVVHLSHLVLGCGAIAVFVLLSCWLRQPWRQTIVRAAVLCIPVALTVGAYLTYNLAVFKAVAVSPAGQTFFLANLIEYGPARDYLRDACPGAGYKICDQVETLPSTANAFLWEAGHLDRLGGFAGMNAESATIVRATVMSRPGYVAAVVANNFWRALGAHAPDTDVSSAFPPYSAIFEVIASKFGSQALAAFQASAQMRDVVPHSLIRTVDTVLIALAWVLAAATCLVAVARRERELTALPLFFAACVLSDTLVCSALSGVFDRYQARVIWLLPMTAILCLVSLKDRAWQQLDRARAPYSSNTPGLNAAS

SEQ ID NO: 1067 - protein, 186 aa, Methylobacterium sp.
LVERRYREAQRMQRRQGGDFMSHFRTALAREWASFPGDYGQQGINGGMYPGQRASISRERLTASAQAWLDRREGRVASSASRRAEVLADPNDERRRPDFASTYRALKAEQDAVRDDMMPRVGEPSLLQKSLRANGVGVTPNVEGAVNIRIDKPGPDTKVRAGASGTLFRTIRQSRGRQMQPAGEDV

SEQ ID NO: 1068 - protein, 230 aa, Methylobacterium sp.
VLTSSDPDYLEKLAHIQAILADLRRDEAFFSIDEFGPFAVRMRAGCKLVAPGEVPTVPQWQPSRGSLILTAALELSSNQISHFYSQAKNTAEMIRMLDLLVVRYRDRRRLFLSWDAASWHVSKKLNARVAELNEIAAKGGGPLVETAPLPSGAQFLNVIEAVFSGMARAIIHNSDYADVEAAKAAIDRYLADRNAAFLRHPRRAGRKIWGKEPAATTYCEAGLFKDPLFR

SEQ ID NO: 1069 - protein, 76 aa, Methylobacterium sp.
VSRYFISTANGHVVEDDEGVELSSRGALRALLGRTLTAILHDECAIGGATECSARAYDEEGKLVMQARATIDIADQ

SEQ ID NO: 1070 - protein, 51 aa, Methylobacterium sp.
MTEDFGSRDGQRDDKTGPSPFADMIEATRLTGLGRLEEATALIQRSLGGQK

SEQ ID NO: 1071 - protein, 97 aa, Methylobacterium sp.
VARSHLAERLSRPARPHGPYRKPEDAQLLPTIRAIVDARPSYGYRRVTALVNRALRSRGEASVNAKRVLRILRANGLTLAPHTARRPGRTHDGIVVA

SEQ ID NO: 1072 - protein, 128 aa, Methylobacterium sp.
VLALHVTPANADDRTAVATLADAVQEATGDSVDLAYVDQGYTGERAAKAAADHGISLEVVKLPEAKRGFVLLPRRWVVERAFAWMARFRRLARDYERLPATLAGLYLVAFSVLLLRRAADFAAVRNSL

SEQ ID NO: 1073 - protein, 53 aa, Methylobacterium sp.
DEAPARVPPPDASGPTSGPTSGQGPSPRSTAGRRTNELRLGERWKRRLPHFMR

SEQ ID NO: 1074 - protein, 53 aa, Methylobacterium sp.
MATLIVTAKLNAIDPQAWLADVLTRIADHPAPRLHELLPWHWRSATAPLAEAA

SEQ ID NO: 1075 - protein, 56 aa, Methylobacterium sp.
MTALPFDNSYARLPERFYARRPPTPVAAPRLVRLNRALAEELGLDPDWLAGPDGVA

SEQ ID NO: 1076 - protein, 164 aa, Methylobacterium sp.
MVTLRPMIFEGLTPQERYVWTKKRVNAMRQLFADNDDLPEFAALWSRESTRVRTEPPYGAKGEHLHLLVHTAGARELLRKALHKSFSRREAFVDPADDVVRRLDNGQLGDASTYLLKAVHQNVWRTYPATPHRPSGEIYGPRVGWTRNILDEQPVRRPASRVGG

SEQ ID NO: 1077 - protein, 173 aa, Methylobacterium sp.
MTNHLFSLVRDGAADPAKTVIETPDGRRYAYADLIARSGAYAAALRAAGVAPGDRVAVQVEKSPEVIFLYLGAVRAGAVFLPLNTAYTPAEIGYFLGDAEPTVFVCDPGRREALAEAAAGVRTVWTLDAAGGGSAAEAADRAADAGAAFADVPRGPEDLAAILYTSGTTGRSK

SEQ ID NO: 1078 - protein, 87 aa, Methylobacterium sp.
PVPGRSGVPVSGRPRLGAPEPAARAEAAPDAGAEPDDAPMKPWKVVLGIFVLFQAAALLHPALGLLVLAVALLLGLRRLLRRWRRRR

SEQ ID NO: 1079 - protein, 102 aa, Methylobacterium sp.
LGRVRRLRPVAGRTRTARTLTRRSAIRRGPVGGRVALRGTVRLVIGAGAIPVGRLALLRRGRRTLRRGPPLGRRNLIAIRPLLTLGPRRGRPPCGPRSGRSG

SEQ ID NO: 1080 - protein, 182 aa, Methylobacterium sp.
MHVRVRLDGANPRRWHVALLERLSGLPGIAAVSVDAAPGPDGWPAQADLLFRLEALIFRLAPNGSRLVPPADLAAWTRPATPDLVLDLCGDAVAPCPVWRVAYDGGLGETGLLASLLAGRVPQLDLLEGGTVVAAGRLGSDYRGSIAVSFEDALSRTATLVAAALRALSDGRAFAATPAAGA

SEQ ID NO: 1081 - protein, 76 aa, Methylobacterium sp.
PVTLQHAALVRPWLANVLQLGGPNVQLARHGFVLPLVCRLVHPGSGSSDVGQGGTSRAESEAEYRRLVDRFGRIPW

SEQ ID NO: 1082 - protein, 207 aa, Methylobacterium sp.
PPRRYSVAEALLDRRVLAVAFVYFGNVALLYGLSFFLPQIVKGFDLTNLQTGLVSLIPFAIGIVGMLALGRSSDRRGERKGHAAFALLLAAGGTAAAALVSDPYAKMALFSVSAFGIFGGLPVIWTLPTAYLSGAAAAGGIAIINALGNLSGFAAPYAVGAIKDATGSFTGGLLLIAAAGLAAMVTVLCLTHDRHLEQAARGARAAE

SEQ ID NO: 1083 - protein, 32 aa, Methylobacterium sp.
MTTPEARALGLPGASPGELAHADLVGRLAREI

SEQ ID NO: 1084 - protein, 79 aa, Methylobacterium sp.
LGPTVDAYRDRFCLRYRNHITPNQYPIERVIAGERFHDVVVEVRRADKPDMDFVHSLRSLVATDRDGNPSCLALILKDV

SEQ ID NO: 1085 - protein, 65 aa, Methylobacterium sp.
VTDRPALDVVIVNWNGGGLLRACLASLAAARDAAAVQVTVVDNASTDGSTETLPALPRPLRLIQN

SEQ ID NO: 1086 - protein, 71 aa, Methylobacterium sp.
ISFWFGRGGAGGTGGAGGTAEIVNAGGRIATEGDSAFGALVQSIGGSGGSGGGAFPAGAFFAVGLGGSGGR

SEQ ID NO: 1087 - protein, 167 aa, Methylobacterium sp.
VADFTYIATWGGFVYAAFVIDVFARRIVGWRVSRSARADFVLDALEQALHERRPFAGSGLVCHSDRGSQYVSIRYTERLAEAGVEPSVGSVGDSYDNALAETVIGLFKAEVIHRRGPWRSFEAVEYATLEWVDWFNHRRLLEPIGHIPPAEAEARYYAQAEVQALAA

SEQ ID NO: 1088 - protein, 167 aa, Methylobacterium sp.; identical to SEQ ID NO: 1087

SEQ ID NO: 1089 - protein, 93 aa, Methylobacterium sp.
MTKHTPPFSPEVRERAVRLAREHESEHGSQWAAIQSIAAKIGCSGETLRKWVRQAERDRGVRAGPTTDERERIKALYRLRIVRHRSEAYAAMA

SEQ ID NO: 1090 - protein, 81 aa, Methylobacterium sp.; identical to SEQ ID NO: 6

SEQ ID NO: 1091 - protein, 85 aa, Methylobacterium sp.; identical to SEQ ID NO: 8

SEQ ID NO: 1092 - protein, 82 aa, Methylobacterium sp.
MPRTLITWTQDETAGVPLPRFVGRVGTVVVGICAYDGSSRFWTWWSPLAEDIWGHGQDAEGARQGCEAWLRGWLENFRPFFT

SEQ ID NO: 1093 - protein, 584 aa, Methylobacterium sp.
MDDDTLTLIPDDLDEAQPTAGAWVIAVIDDDPAVHDGTRYALASYTLDGRGLEILTARSAAEARVLLAERRDVAVVLLDVVMETDNAGLELVDYIRRELRQETVRIILRTGQPGQAPERRIIVDYDINDYKAKTELTADKLFTSLTAALRAHQQLKRLDETRRGLEIIIDAAPMLLDHKSMQRLAEGVLTQVASLLNVACAGILVLRETAAPQERFCVLAGSGCYGHYAGREPCWPLEERVQPLVERAFAERRHSFGEHWSTLYLHTASGSEIVALIEADRQLSETDRSLIALFTSRLSIAFDNVILYERLQLTNADLERRVVERTAELIRANRRLDLQRSDLRRANSLKTEILGTIAHDLKNPLAVILGRAEMLSDLIDMQGDREQMRAQVQHVRTSAKGLTTMIDSLMADAMNDALDISLRREPVDLAGLAREVCEADRPLADAKDQTLVCEGPDELFLCGDAERLREALDNLVSNAIKYSPTGGAITVRVSREPGPRGAELICAVADHGPGLSPEDSARVFGRFQRLSAKPTGGENSTGLGLSIVRRIAELHGGRATAESAGPGLGAVFAIRFPEESVGLI

SEQ ID NO: 1094 - protein, 254 aa, Methylobacterium sp.
MTIPDRPAPGAARGGAAIPSIAVVDDEAATREMVGDYLKLHGFSVVLCDGGRSLREHLAGHSPDLIVLDLNMPEEDGLSIVRDLKARTAIPIIMLTATASAIDRVVGLELGADDYLPKPCELRELVARVRSVLRRVQTPTAAAPAPVPVSGRRIRFGTKWLELDALRLSDDAGLEQALTRSEFDLLKAFADNPRRALSRERLLDLADARDPDAFDRAIDVRINRIRKKVEPDPGNPRYIRTVRGLGYIFRPEGD

SEQ ID NO: 1095 - protein, 775 aa, Methylobacterium sp.
MRVGPKIALVGGVPILAAGAIAMAGWLLLAQEERARRGAVLAADVYHDIATARLVRDQYAAADAQDRPAYAERFASLTARAEAGLGRLAGFARIDEQRARTASVERALAGYRGEMDAFVRRTRENDGLIREMTQRADTLIDLTDRARLRQQASNADLARSTAEKVEALRVARGLVARLNALRARSAESAVLAAQAAARSDAPAAGPAGAAVSEGDGPRAQGLFRAASRDLAAALRADGRDADAEALDALTAETAGSKPDLRARLDAWIERTLKIETSGQESLHDEVAQLLAYSVEANEIERATQNVAISTLKLGPRTAGALLHRDAALAERMRDEGERLARSAASLPISPLIQAEMVQALDGWRGRLTTTIGGLRQQNAMIVAMDGLAATMIDSAKALNDAFVEDADRSGIVIQRILLAGAAGLLLFGALVVILVARSILVPLRALQGDMVMLTGNPAGAAVRGTARRDELGDIARATAVFVSEITRREGALRRAKDQADVALVELRRTQDNLVRAEKLASLGQLVAGVAHEINTPLGIALTTGTLMSDEARAFRTGLSAGTLSRSRLNHFVDRVEEGATLLCTNLTRAADLVQGFKQVAVDRVSDESRSVVLATWLDDLLASLRPMLRKGGHTVERACPADLVIDTNPGVLAQIVTNLIANAVVHGFRAGEPGRITVDVSEREGGLVRMEVRDTGQGIPPEHLDRIFDPFFTTARSAGSTGLGMHIVHNLVTAKLGGRIAVSSEPGQGTVVQVDFPAQGAGAAARPRTGAIRTP

SEQ ID NO: 1096 - protein, 132 aa, Methylobacterium sp.
MLSDAQWAVLEPLVEACRPKAKTPPQDLRRTLSAILWRHQNGAKWRAIPQDLGPWWRAAQIFIRWSRGGVWERLLALVQERGVQLGMVFLDGTNMRAHQKAAGAAKRGDLQPSETIVKLLADHVAAMGPRLA

SEQ ID NO: 1097 - protein, 608 aa, Methylobacterium sp.
VSTILVFGGYGGFGARLSRRLAEAGHDVVVAGRRLARAEAFCAANPPCRPLQADRNGAVAPLLERVRPDLVIDAAGPFQGSGYALPRACIAAAIPYLDLADGRAFVTGIGQLDAAARAAGVAILSGASSVPALSGAVARHLAQGMEAVTAVEIAISASNRATAGTSVAAAILSYVGRPIRLWRGQRWSAAVGWQALRRERFALSDGASLGRRWLALADVPDLDLLPDRLPGRPAVSFRAGTELAVQTIGLWCASWPVRWGWIPSLQGLARGLLLAQRLTARWGSDRSGMVVRMFGTAAGRRVERRWTLLAADGHGPEIPVLPAAILAERILDGAIAPGARDAGTALDLSDFEPSFARLSIRHDVRESGQADALYARVLGPRFAELAPRVAALHGVLREAGAHGRAVVRRGRHPVARGLAALLGLPVAGAHDLHVGFSETRGVERWTRAFSGRRFTSAFSEERGCVVERFGPLRFRFDLAPEGGGLRMVLRGWSVARLPLPLALAPRTAAREWEEAGLFRFDVSIVLPRVGLVVHYRGWLDTDDRAGRRSGFVPGAEPAAPPRSGHPAQGPSRPPGGDPGPVTALPIPSSRAHAPSRSGHGPEPRHGRV

SEQ ID NO: 1098 - protein, 83 aa, Methylobacterium sp.
VDLAASTLSAQRRSLDRQFGAILATPSRYDLTRELQATISRARDQLLVFLAYPGKVGPTDNSSERLLRPAVVQRKVTNGDRAM

SEQ ID NO: 1099 - protein, 82 aa, Methylobacterium sp.
LQAKLSRSRDQPLVFLAYPGKVEPTNNSSEGLLRPAVVQRKPTNGYRDMWPAEGEAAIRTVVDTARLSGANPFGFILKTVGA

SEQ ID NO: 1100 - protein, 598 aa, Methylobacterium sp.
MSLSSPRKADAVRRVLAFVVRSWRRRWPLVAGLTGAITLATLAEVLLPLFAGRLVDALSGSDRRAALDAAWPAFLAMTGLGLATALLRHVAWSLVVPLSLRTMSDIVGNGFARVQRFSTEWHANTFSGSTVRKISRGMWAIDGLNDTLLLSLLPALVVLVGTALVLGLHWPALGATVAIGAGAYVGATALLATRVIAPAAALSNALDTRLGGALSDAIGNNAVVKAFGAEAREEARLGRLLAKWQRRTRRTWMIVTWGGTGLLGLLLVLRTAIVAIALWLWWRERASPGDVAYVLTATFVVHGYLRDIGGHINHLQRAINEMEELVALEAEPVGVADRPGAVPLAVTGGAIRFETVRFHYGDHTRPLYDGLTVTIPAGQRVGLVGLVGRSGSGKTTFVKLIQRLYDVSGGRVTIDGQDVASASQASLRAQVAIVPQEPVLFHRSLAENIAYARPGASAQEIERAARLANAHDFIARLPKGYATLVGERGVKLSGGERQRVALARAFLADAPILILDEATSSLDSESEALVQEAMARLMRGRTAIVIAHRLSTVRALDRILVFDRGRIVEDGPHAALLRRPNGAYRALFERQADLAESA

SEQ ID NO: 1101 - protein, 73 aa, Methylobacterium sp.
MFAITGHGQAYAQPRPPDGNLDFLCNFLGDCPARVAPGGPDRDVRPFSNSLGRPCAWRDRPTPEGVRRVRVCW

SEQ ID NO: 1102 - protein, 471 aa, Methylobacterium sp.
MMRFTFRRAAALLGLGVAAVPLSSLAIPVSATPARAQATKVEGPALPYASTPDLRAATVARAVRDQRATNPIAAAETAREMAQHDYDTIFRGFLDGTPLRPDDAGDVLTAFIALQWMVANDATVEPSAAALRAIRTRFVAPMAERPPLSQPVTRAAFAEQVKLRAVLHHAGWQAAKRLGVLPRFLAGLSNEFIPVATLRNLALTEDGLVPKDRAGRAAPKPPPVAESPSVPDARPAPSPAPSAPDAAGPPRHAANWDQVEGVYFRSTTGFGVGGLMTIDFEPLIFLRDGTYYEVADTALEDVDLAAERAARPKRFGRWSAKGAGFVLTDARGRANDYALGDGSFFRAFPAGSGERVARAYRRLSGGGNTALGGDVAIAVESRYDFHADGSYGRGGSVGATNSGASTGVGTAIARRRAPEGGRYALDRHTLTLTAADGRTRRLFFAYGSQKDPPEIDREMIFVGDDVFSPAD

SEQ ID NO: 1103 - protein, 454 aa, Methylobacterium sp.
MTVTRAAIPSPSPERRRSDRDRSGSADLTNWRAYAVAGYALIVATFGVVGTWAAVARLDRAVISPGVVVAEGSRKVVQHLEGGIVQEVLVRDGQAVRAGDVLLRIDPVQSRASNDLLRGQLDGALILEARLRAEQGQAQDLLLPPEIAERRAEPAVAGLIDDQASQLSERRASFQAQLGLIEARVTQLKTEISGLAVEKASGEQQVALIQQELEGLRGLQEKNLIPLSRVLIMEREHARLRGVIGRSVAETAKAQNDINEAGMQTAQLKQKLQESLTAQLLDTRQKIAELREKLIVARDVLRRHEVRASHQGVIQGLKVYTIGQVVRSGEPLMEIVPTNDRLVISVQFAPNDLEAVHAGMRAEVKFPAFQTRRMSAIFGTLTMVSRDRLIDDGTKQAYFAGTVEIDDHQLPDDVRPRLLAGLPAEVVVSAGERTALDYLVAPFFDALGRSFHER

SEQ ID NO: 1104 - protein, 108 aa, Methylobacterium sp.
VYAHQQRLDSEEVLELRREGGRYLKELREARGLSQRQLAALVGADYYTFISQLETGRGRIPPDRYRAWAEALAIEPRAFVRNVMRFYDPITHEILFGDRSAEPEGNEA

SEQ ID NO: 1105 - protein, 289 aa, Methylobacterium sp.
MIGNPNIELLRSFLAVVESRSFTAAAQALGLRQSTVSGHIARLEQALGRALLTRDTHRVAPTPDGQAMIGFARDVVDAQDRLRAFFSPEGLRGRIRLGVSEDYTLSTLAQVLARFADRHDAVDLQITVGLSRALYQGYDAGELDVIFCKRRRGDPRGTLAWAEDLIWTGRPGLVPDPAKPLPLVLYPPPSMTRTLALDALEAVGRSWRVACTSGSLMGLRAAVEAGLGIAPHSAKILPPGLAAISEAAGLPPLGAVEFVVLGPGRHHAAATALQETILASTGELQGAAR

SEQ ID NO: 1106 - protein, 587 aa, Methylobacterium sp.
MGDPSLQSALTIGLRSLRPVLATAVVFGLFINLLLFVSPLYMLQIYDRVIPSRSETTLAGITLIAAFGLAVYAMLEMLRARLLVRGGVVFDQKIATPIFDAAHRGTLLRPGAQHDTALRDVDVLREFLTGAGMLAFCDLPWIPIFLLACFILHPWFGWMALVGGGTILGLTLLNEVATRRTLDAASQASREAGQSAATVFRNGEVLQAMGMVASMRGLWGRRHDDVLLLQARASDRAGLIVAATKFVRMLLQTLVLGIGAYLAIHREISAGSMIAASIIIGRTLAPIEAVVGNWKGFTAARASYRRLVDLVAVAGSETRRLVLPRPRGLIEAEDISVAAPGATRPILKAVSVRLEPGSVVGIIGPSAAGKSTLVRALTGVWPLLEGTVRIDGADLNHWDRALLGQHVGYLPQDVELFDGTVAQNIARFADRDDARVIEVAQRAGCHALIQSLPEGYNTVIGRGGHGLSGGQRQRIALARALYGEPSLVVLDEPNASLDQPGEAALMRAVADLKRSGTTVVLVTHKVSLLEEADRILLMSEGRVQLSGTPEQVLAHVTGQRPVPTLVPPVGPAASQSRRSSDEQRSAG

SEQ ID NO: 1107 - protein, 123 aa, Methylobacterium sp.
VIADGAGRAIAFRIAPGQAHELPHALPLLGHLPGIPQWVVADRGYSSQRFRQQLREVGATPAIPSKSNEAPERFPDWIYTNRNVVERLWARLKEWRAVATRYEKTASSFTGVLCLAAALDHLR

SEQ ID NO: 1108 - protein, 123 aa, Methylobacterium sp.
MGALLDPVLGPAFASGRIVDGILLLVALEALALAWLARRGGPPLPSLLANLASGAALMLALRAALVGAGWVAVAGWMLAGLVAHLADLGLRVRAATAQRRSAAPAGTTPATAAFTRVTSFKQL

SEQ ID NO: 1109 - protein, 73 aa, Methylobacterium sp.
MPDYRLRGAVRGEDGEIGAPRVDEVLTAADAKEAVRLANSRSLTIEDDAVNALWLVDAHGTLLWSLRRADRES

SEQ ID NO: 1110 - protein, 107 aa, Methylobacterium sp.
VRILFVCGRARARSPTAEQIFARLPGIETASAGVSPDADEPVDADHLAWAEIVVVMERAHRRKLMRRFGAALRGTRLVCLDIPDVHDFMAPALVALLDARAGRFLPR

SEQ ID NO: 1111 - protein, 121 aa, Methylobacterium sp.
MHDTAPKHEDPGPGYTQEDWDEVSNNPKITAEEMAAMRPAREVPEVYGLLPKRGRPKLPNAKVNLTLRIDPQVLEGYRATGDGWQVRMHEDLQAGLDRRVMEILDRAKRMVPLSRPGKQTA

SEQ ID NO: 1112 - protein, 891 aa, Methylobacterium sp.
MDQAKPRRDTTIARAGAGRTGYVTVRGAREHNLRDIDVEMPRDALVVFTGVSGSGKSSLAFGTLYAEAQRRYFESVAPYARRMIDQVGVPDVDAIEGLPPAVALQQQRGTPSARSSVGSVTTLSSLVRLMYSRAGTYPPGQPMLYAEDFSPNTPQGACPSCGGLGRVYQATEASMVPDPSLTIRERAVAAWPQAWGGQNLRDILVSRGVDVDTPWKALPRRLRDWILFTDEQPQEPVYAGLTPEQTQLARRRGLEPSYMGTFTSVRRHVLGTFTNSQSALMRRRAARYLVSEDCPACHGKRLKPEALSVTFAGLDIGALSRMPLSALAEALRPAAEDRQPEADAAPATLDRAVGRKDRAERAASGGSAHAGAPDVRVTPNLSIEKRLAAQRLASDLIARIGTLADLGLGYLSLDRVTTTLSSGELQRLRIATQLRSQLFGVVYVLDEPTAGLHPADGDAMHDALAGLLAAGNSLFVVEHDIGTMRRADWLVDVGPEAGENGGTILYSGPPEGLRDVAASRTRLYLFGLVEAPPRPSREPAGWLRLEGIVRNNLKGVSVPFPIGCLTTVTGVSGSGKSSLVSQALLELVGERLGRPVKTEDEPDDPLDEVPGPSEGRIAGGMDGIGRLVQVDQKPIGRTPRSNLATYTGLFDAVRKLFAATPEARRRRYDAGRFSFNVAKGRCPACEGEGFVSVELLFMPSVYAPCPTCHGMRYAPETLAVTWNGLSIADVLALTVDRACAAFADEPSVLRPLTVLRDLGLGYLRLGQPATELSGGEAQRIKLATELQRGQRGGTLYVLDEPTTGLHPTDVDRLMVQLNGLVDAGNTVVMAEHDMRVVARADHVIDMGPGGGDQGGTVVAAGRPEIVAAAAAGRTAPYLREEFATVRTRPPG

SEQ ID NO: 1113 - protein, 86 aa, Methylobacterium sp.
MHQFIGLFAIFVTLAGVLHTWGAPRWAIAGLCLIGLLGVSATVVGIQPKVAPSPVSQVQSLNDAMQPVFEGVWDPLRPGRLLTTSR

SEQ ID NO: 1114 - protein, 360 aa, Methylobacterium sp.
VKVLASGGRSSAATARAVGRARPIVAKPRFAAAFLRAGLLAGLLTGTARANDSAAELDAGGLVLRREPGIALVSEDLSIARDRIDVSYLFRNQVQEARTVRIAFPLPPIDGRELSFSALALPRPDSPNFVGFTVTVDGKPLEPELEERAFVGEREVTDLLRRHGLPLNPLRFEAISAAAKRIGAPEWAALVKAGLFPDVPDTPDRMTEGLWRGEAKFHWLQTFPPGQEVRIAHSYAPVTGFHLLEPKAASRAAYRATYCLDEAGLAAIRRLHAKAPDPGGTLRATVVPYIVTTARNWAAPIGRFTLTVDKGSPEAVVSFCRTDIRKTGPTTFRWEARDYVPDQDLRVLIVQPASATPGTR

SEQ ID NO: 1115 - protein, 271 aa, Methylobacterium sp.
MRTHDLPRAARARLGRSGLLLAVGLALALAAPARANPLTEVPGARAAQPDEAPPPRDPAAERAEAEEARAANPGPTAIIRSLAPFADGNPGAPARPLAVSPDDGGPAVRVVPARSIDLTVFFAYDSARLTPEARIQLEPLGEALRAEPLAGHGFLIAGHTDAAGGRAYNRRLSLARARAVKAHLVETYGIAPERLRVHGWGPARPKDPDAPLSRVNRRVEVSLIAPARSGALRFVLPVADGPCSDLADPRLRTDLDLDDFRAAPTPRPCTE

SEQ ID NO: 1116 - protein, 468 aa, Methylobacterium sp.
MDIRTRRLLTAPLLPTLARMAVPNVAVMVVQTSIGLIETYFVAELGTDALAGMALVFPVVMLVQMLSAGGMGGGIQSAVSRTLGGGRQDAAGLLAWHAAAIGLGLGAVTSLLALTLGPRLYAAMGGTGASLRAATAYATVVFGAAILIWLFNALAAVIRGTGNMALPAGVTCAGAVLLIPLSPALIFGWGPFPRLGVVGGGVAFAAYYAVGATVFAAYIWSGRGVLRPSPRPPRLTWAPSREILHVGLLSGIASMTSNVTVIAATGFVGTAGPAAVAGYGTGARLEYLLVPLVFGLGSPIAALVGTALGAGMHARARQAALTGALVAGVLTEAIGLTAALHPAGWLGLFGHDPAMLATGSTYLRVVGPFYGFFGAGLALYFAAQGAGRVGWPLAASVLRMAVALGGAWIAARLGLGLVGMFVALSAGFVAMGLVNAAAFATGRMFLAEPAPSTSPVPPSLTAAANSGR

SEQ ID NO: 1117 - protein, 72 aa, Methylobacterium sp.
MSAPVIVTTLFVGGLMAIPTLGKWATQVTEVLASLLAIATVLVAILYLCDRWPDYFANPRMPVGLTATPFAD

SEQ ID NO: 1118 - protein, 43 aa, Methylobacterium sp.
MKSMLRVTTALAGVAFAGSAFAADLPRRAAPPPVFTPVPVFTW

SEQ ID NO: 1119 - protein, 654 aa, Methylobacterium sp.
MRTGWILAGALGCALGVTPTQARITQIEVVTVEPFADGAEFGPAGAYERVIGAARGELDPADPANAGIVDIALAPRNARGMVEYRTDLFILRPKDPARGSGTLLFEVLNRGRKFLFNWVLDAPAQGAQAVNDPRNAVDAGTGLVLRRGDTIVWSGWEADALRQQGGMAIDVPVASRNGKPIVEIVRDELVSATRGPPEAPFYLTFKAASQDKAGTQLTVRRREADPPRPVPEEAWHYATPRQLELLPKGTKPLPGSIYQFTYRATEPKVLGIGFAATRDVVAYLRGDAAGGANPAGGAIRHAVALGISQSGRYLRDFIAQGFNRDEAGRRVFDGVLSHIAGIGGVFLNARFGQPSRTNTQHEDHLYPENAFPFSAAVQHDPVTGRNGALLRDDGFDPLLIEVNTGTEYWQKGASLLATDPLGRTDLALPDTTRVYLVSSGFHYGRAGLTSSRGPCANMRSTLNPAPALRALLVALEDWVTLGTPPPDSQIPRLSDGTLVEPAEAGYPFIVGVPVPTAPNTIARFSTYVDPKPESGPQYRPLVPRVDADGNDVAGIRLPAVAAPRATFTGWNLYADPFPAGALCDREGSQLPFARTRAEREANGDPRPSLEERYPDPDAYLAAVTKSVDALVRDRLLLREDGDRLVQAARQESAP

SEQ ID NO: 1120 - protein, 489 aa, Methylobacterium sp.
MPAVGTFRVCAPGRPPFAAAVAEGVAEAVALPSVLVTMLGSLIEAWPRQIYTQPLVTTRFLGQRTTYVCDPGHIRSLMVDQAEALEREPFMLRALAPALGAGVLTADGDHWRRQRRTATPMFRPDRVRSFVPAMARAAAATRARWRDADPAGSERDILREMMRTTFDVIVATMVSGDPYLEVGPFGAAMDAYLGQTSWKIALEMLRAPAWIPHPGSRAGAEAVRYLRGEVARTIARRRARGEPGSDLLGLLLQARDPETGAPLTEASLVDNLLTFVSAGHETTALALAWTFRVLAEHPEVEERVVAEMARLGADPESDPGSVDRLPYTRQVLLEVMRLYPPAPLIVRRTRAPVRLGDTVVPAGQSVHVPVYALHRHALLWESPEAFDPGRFAPERAAARDRYAYLPFGAGPRVCIGMGLALTECLVVLATLLPAFRLRPVTAEMPAAQFRVTLRPRGGLTMRVAPRHGAGQGDGHGAEHGAEQGAAHAA

SEQ ID NO: 1121 - protein, 697 aa, Methylobacterium sp.
LPRANPVSALRRFARTALILLGMTCLAPLAPARAAPDPAAFADNADAVAVVIGNRSYKQTVPVDYAHNDAEAIRAYLIERLGYRESNVFLLKDATLNEFNQVFGTERNPQSGRLWRSVREGRSNVFVYYSGHGVPDLATKQPFLLPEDGNPNQGESGYALETLYRNLELVKRKIGADHQLVVMVDACFTGETGRKGESLLAVSAPGFAPARPKTEGGIVRLVATSGATPANWDEANKLGLLTSRFLMGVSGLADAREHQGDGDGLVQWTELKRYLRREVEDAARRASGREQVPEIDEAPIVLKASLPVAAVAKGVEAIRDEAAWRRAEALGTREGFEAYIGACGETCLYRPQAMDRLLAGRRRDAAAIDQENWAKFGTQRQYQAYLDSCGEVCAYRSLAEGYLGGKNPSADPRVKRCDELAAGTDDPDRPSGVAGVKLGRIEPAAAIEACRGAAAAYPDLRRLSYQLGRAYDRADRYKEAFAAYDRAAKAGSISALNNLAALYENGQGVKRQQAEAFRLYRQAGEGGNVVALANAARMLEYGNGIPKDEAQAVALYRRAVAGGDVASISKLVPHYATGAYGFPKDLRQGFDLFRQAADRGDPVAMATMATLIDNGFGRYFPGVRSADMVLRALKHGELGAASVSATDTAAQKLKPETIRSVQRAIKDADYYTGALDGRFNPVFVRALDQYARANETE

SEQ ID NO: 1122 - protein, 105 aa, Methylobacterium sp.
MAIRTMARPSPSRRRLRVILILLLITWLPVVPFALGLALTNLTGCTVNEAGTHPCPVAGHDIGGLLYTLTMTGWLLIPFLPFMALTLLLTVVQGLLMILRAWLRR

SEQ ID NO: 1123 - protein, 85 aa, Methylobacterium sp.; identical to SEQ ID NO: 45

SEQ ID NO: 1124 - protein, 170 aa, Methylobacterium sp.
VSDAARLLAEIHAARALVRDAATTARPNHAGLWAHATRAPDGPVDLATVRAIRGDAATARRYRTMLGALALAHAPLAAAASDGAILRRRVGAYALEILEAADGAPPLLVLRGESGQMPRLIEAWLGDETVRLDLGPAIEGAAVLALDPAVPDAALMGRMLRDPACAVFLL

SEQ ID NO: 1125 - protein, 376 aa, Methylobacterium sp.
MTRPAILVVVPTTRGPLVLRGLRPRPGLPAPAAFADGDYRPLPWSADYARLCGAAGPLARWTGRTPEPHELRLSGSFDAGRSWEVPVCLAHGLADGGHPLAAAPEEADLILWATGAVDLDLAVLPGDYALLDKIERSAATIAEAPDAALAVLLPDGPERAQAEAVFRGMGRNVRILPSHSVPAALAALTAPRPLERAETPPARRWWRLALPAGAVAAAGLAGVLALGATRPDPVSKPRPDAPAGPASPPPSIEVRIASPIHVSELRAPAGSSCRRVAFGADPPERRPVPAESGDHLAASRLTPDLCGLAIGAEPGLRVQVGPELRDAALPAVRLADGALGYFLREGARQNLVYTVQAVPEAGTGALAGRLVHTLAR

SEQ ID NO: 1126 - protein, 326 aa, Methylobacterium sp.
MIAMRRRGPLLLGTACALIVLGRGDAARAQSVGFDPADYGRAQLPLRQTTGDAAAYVDQNKGAFEPVSELDPKDGLAALARPIGRVDIVLQNGRTGQQVGASCTGTLLTGDYVLTNHHCLPQSGDLRPIKASILMDYLTLDGKGSRRFEIDPKPVEFDARLDFALARVAGNPTATYGAARLSGEPVTANRSMLVIHHPLGRPKVMSRFRCFAVKDQAEGPDLRHRCDTLGGSSGSLMFDASVAGIALHKEGGLDPKDPTSFNSATRLSAILGRSPTLTRIAAAQGRPVAAADPGTRPVGPGPAPQPRPATDGPLDPAGMNAILRGR

SEQ ID NO: 1127 - protein, 322 aa, Methylobacterium sp.
MPLVRTTAFRTTAFRAACLAVLALGSAYAAPARAQTKPNVVVMGEDADEDAVPRGNRIFQRVIHELSETMNLRGYNVYDETAVAMGFTQANRVRRRDAELIEVARAVQNPPLDVVAVFQIYASASKSAYSDIVRPEIRIPGRLLNVRTGQSLGSFEVAGLQLPPLPQGCDRECLLERVGAEAKTVAADLAAALTAKLDGVIAPRRGADAGAAPPDAAPVGGAVAAAPGGEGCGGLPSAYVVRLSGFSAQEVQAAEEYMAAFRCYEHHRPVRASGASTEYWYETRSDSARLGRNLRLMLEHMSAPGQVQFSGNTFVISRVATR

SEQ ID NO: 1128 - protein, 444 aa, Methylobacterium sp.
MRRLLLAALLLAPAAARADPATQTLAPFLDAVAACAGRPDLTLAVVGVEPGQTALSREQSEEVRLAVETRLQATGRVRLAAAADVVRIKALREGTTGLSGAEAEAQIRSAFAGDAAVFLVEPRRAGETASVRLQAVTQSAACKATSDPLVVPIHVGAGVADVDAVMDGAVKAFAQAAPNAGAVEVCPFVAEGGHSTCAGALTDRLVIALDAEARSANRVLRGARLDVRRRPPGTACAGTVTARGRFRTDHDRQSWMEVEFQRDGAVLAPTGRRRIATEGLGCDPVPRPFLDHLAATARTDAGRLSVAAAATPFAAGQRLEMRIESRVAQNLYCWVVAADETAFVALPVRDNPASQLALKPGDSRRYPRGYGLDEIVAGEPFENLFACFGVPGGLPPGLAARWLAAAPGADGEARLLQPPDVLDLLDRIRATPGVTEAAARVVVR

SEQ ID NO: 1129 - protein, 463 aa, Methylobacterium sp.
MTGGYDERCAADLANVGDGRDLSRADRAWLARVVTGAVRPNRDKPLWDLAHALAALAEAAGARDGRDLITLALDPGLARPAALSARFGGGPAVDDRGPVLGTAWSTGWAGLARLLALAEFVLTAEDLAQFATVAGWLDELAAAPDAESAAILAKRLARHLAAYRNAHLPLAPLERRFRALLTFLGGRRSVADDDILDFWRAEMATGERPGFRIVAEHFVTFEAAGRLLEGLDALAAPAALDAHAGWEERLDAALGDLAAAEPAAALATLLADWPEGPKILTGAEREDLADFLRLEPYHRTRPLTTLRAVSFGRVQSGIANRLRRGGGGAAIAERATCLEAESYAELRTRAGLLAAHLDRMLRIAAALRIADRDALPEAVRGALEAAEADLRRVRRAGFDDRAGLSAGFAAAEPALLRLAEAAADLERSLDGLARHRPLDALFPADRDIFAVALAAAYAGEAAA

SEQ ID NO: 1130 - protein, 101 aa, Methylobacterium sp.
LAPVRLSERFIDTRNSIAMPVRLITTALLLSAGATAALAAPMSADDKAALQQQCMGDFTTFCGGMPPDDGPETQACFEKNMAKLSPGCQGAIQSYKQGKKG

SEQ ID NO: 1131 - protein, 140 aa, Methylobacterium sp.; identical to SEQ ID NO: 54

SEQ ID NO: 1132 - protein, 108 aa, Methylobacterium sp.
MAKTRREFTPEFKREAVALLESSGRPQMQVAAELGIQPSMLRQWRATLNGALPRPRPAGSTGSAPPSPVASPSDQAAEIARLRRELDRTRMERDVLKKAIGIFAEMPK

SEQ ID NO: 1133 - protein, 182 aa, Methylobacterium sp.
VIPEEARGQPLEIWFQDEARIGQKGTLAYVWARRGTRPRAVQDTRYASAYLFGAVCPQRGVGAGLVMPRADTEGLNAHLAELARTVAPGAHAVLVLDGAGWHKSTDLVVPSNISLLMLPPYAPELNPVENTWQYLRRNKLAHRLYDSYEAIVEACCDAWNWLMAAPDTITAIANRTWANVSA

SEQ ID NO: 1134 - protein, 318 aa, Methylobacterium sp.
LKAMVLTKFGGPDSFELRELPDPRPGPRQVRVAVHATSINPLDGQIRRGDYAAQVALPAIIGHDVSGVVDQVGSDVTEFRAGDEVYYTPRIFGGPGSYAEYHVADAGIVARKPVNLTHSEAASVSLVGVTVWEGLVERARLQVTETVLVHGGAGGVGAIAVQVAKAIGARVLATARGSDVARVERLGASAVIDFEREDYVDAVDRLTEGRGVDVVLDTIGRDTLARSPRILREDGRVVTLVDTATPQNLIDAWGRNATYHFVFSRQDGRKLDAVTRLLERGLVVPRVGLEFPLDEVASAHARSEEGRLGGKIVLRVRS

SEQ ID NO: 1135 - protein, 158 aa, Methylobacterium sp.
MDIAGAYRIPVAREAVWAALNDPEVLARCIPGCKELVQASPEEMTAKVALKVGPVSATFAGTVRLEDLRPPEGYSLVGQGNGGMAGFAKGRAAVSLAAEGGETLLTYTAKAEVGGKIATLGGRLMQATARKLADEFFGKFAAELGATGDPAAPRAAEA

SEQ ID NO: 1136 - protein, 518 aa, Methylobacterium sp.
MQRARSRRRLVGACLALGLIAAGPGAGSAGTLTRAQVEAQLPALEALARRAVDAGAVPGLAVAVVLGDETLLLKGYGLRQAGKPEPVGPDTVFQIASLSKPVTATIVAALVGDGVVDWDSRVADLDPAFQLHEPYPTAQVTVRDFLNHRSGLPGTAGDDLEAIGFGRDAILHRLRLAPPASSFRAGYAYSNFGFTEGAVAAAKPTGQPWEAVARDRLFRPLGMAATGTTHADFLSRPDRAALHVRAGGVWTAKIERDPDAQAPAGGVSSDVRDLSRWLRLVIGKGRFEGAQRVAAPALAQTHAPLMARGRNPVTGGASFYGLGWNVEYGRHGLVWGHAGAFSVGAQTLVSIHPEAGLGILVLTNAFPSGVPEGLADSFADLVFDGRVGRDWVTAWGAAYESLFAPGIAADKAAYGTPPAPPAAPLALSAYAGRYANAYVGEAVVAEADGALTLTVGPAGARRYPLRHFDRDLFLSFPDAEAPDRPSAVRFAIGSDGRAAAVTVDALDASGLGTLARRD

SEQ ID NO: 1137 - protein, 108 aa, Methylobacterium sp.
MDQSAALRTDHPATEQDALAELPAGDFVRRWRQITGEPPAILLSSRSEMIALLVESVPMAPLIPQGESPGTAGSGETPSQDHGSDGPDGAASGSSARSDQRGARQGPA

SEQ ID NO: 1138 - protein, 232 aa, Methylobacterium sp.
VVSKEDRGVTVTEIERVEAGPRRGGRPTRAEAARREAHLIAVATTLFLERGFDATSIDAVAEAAGMSKPTVYARYRDKRALFEAVLRERIAAWLAPLSAAAEAQAAQGGSDDVETALEDLSRTLLAHGQSPGAAMLKRNLVAQALQFPELARLAHEEGWLRGVRAVAQLLDAFARRGRIAVADPEIAADLFLSLVLGRSSQATLYGIATDPEAQERRRQAAVRLFLDGVRPR

SEQ ID NO: 1139 - protein, 98 aa, Methylobacterium sp.
MGNSARARFTPLARSDLEEIWRYTVGQWSADQADRYHQDIVNAATELANGAKIGRAVEVRAGYLKYRVGSHFIFYRRTDAGIDVIRVLHQRMDTDSHI

SEQ ID NO: 1140 - protein, 105 aa, Methylobacterium sp.
MEQARPLLPGVAFAEDAYHCAEGADALVLVTEWDAFRALDLDRLRAAMQRPVLVDLRNVYRAADVRAHGFAYSSVGRPDEPGDQPGDESEIPPALPPADAVAGTA

SEQ ID NO: 1141 - protein, 794 aa, Methylobacterium sp.
MSSPSSGRTLFFFEKPSAMRQLQRFFRSPSTVCVAAEGHLLSAEEPGSIRPEWKPWRFDLLPIVLPTIPVGYGTNRSGQSHAPKIAAIRQALSGVDRVIIATDPGREGSMIAWEVLEHLGWNGRVDRLKLGALDEVSIRRAFAALAKDPASGERDYAAYLEALCRQYEDYHLGLNGTRAISLRLRPPAFREPWRFGGVQTPTLAILADLEERIRSFVPQDFFKVALHIRTHAGAEITLWHAPKERILDAAVAETIRSAAATWSGPLAVAHRDVRRAPPRLFSKDTLARRCAKRFGWDPQHTAGIAQDLYDQGYLSYPRTESEHLPEGQAGDAAAIIAAVTTVLTDLSTVVPRDAAPLIRRGLKGHYVADPGEHHAIVPLRKAPERGRLSTDQFRLWELVAKAYLAAHLPDGVDARTSVTADVATPLGVRRFAVSGSVVRAPGWRALYGSEAELETDAVPGKTKREAEATATRLPLVTDGEGASAATAEIATAKTEPPRRITRGELPVVMGRLIDQVDDPAAKRALENPANPNEPKGLGTAATRDTILPKLLKSRYITLSTGKDPAIEVTEVGLRFVSAVRSVFPAYGDPVGRAMFEAELAEIGRAATRAEAVARATAFRQRTRARLDDLITAIAQAPTVSLDPSLIPAGPGDQRPPTPAMVAFAVSLSERKGVTLPRGCRSSISVCRAFLDTHAGPRAGQEDDAGRADGRRSPSAAMVGYARSLAQQRGIPCPPDAETDFDACRRFLDAHAARQGQGRDEANAGGAKTKRPAEREKRRGRVARTPRPAAARRRA

SEQ ID NO: 1142 - protein, 290 aa, Methylobacterium sp.
MDLDIREFEEVCRDLYVRALKILPPDIKAGFADLQRAETSATGRAILDTMVENVAVAERTKNILCQDTGIPIYNVVIGADVRFDGAALKAAIRRGCERATKDFSLRSSVVHPITRRNEQTSCGIRVPIIHVDFDDRPETVAVEMIPKGSGSENGSFLQMLLPSDGIGAAKRFVIDRVIELGGRVCPPTIVGVGLGGTSDLCMHLAKVAATRPLRSVCSDPEGARIEAELSRAVNELGIGPQGLGGRSTSFAVHVELAATHITQNPVAVNIQCHSARRARATLTPGGIAFD

SEQ ID NO: 1143 - protein, 218 aa, Methylobacterium sp.
VPTGRRLTPEARERQIVEGAVAYFAEVGLDGHTRELARRLGITQPLLFRYFPTKAALIERIYEEVYLRRWDPGWEATVRDTALPVLERFRRFEIDYQRRIDDYAWLRIFVSAGLKGFDLPSRYLGMVRARIFAPLLAGMRAESNLPDPEVQPLAADEFELLFGIHGALVYVGLRSRVYGMDGTADRDAVRAAMLDAALPGLLATHRRVVSAARSSDAL

SEQ ID NO: 1144 - protein, 116 aa, Methylobacterium sp.
VTTVHNEQTKLLATALNNIAVAYVVIGFVTPMTAASFGVPSAPALRVENAIFTLVWLGTGCAVLLRCEACPPEPEAVNYDWIFVTFGIPAITLAIAYAAVRANERAAQRLDPPAGE

SEQ ID NO: 1145 - protein, 86 aa, Methylobacterium sp.
MSLRGRQDDATPLPAARFEISPRRGLRREESARYVGVSPSKFDEMVRDGRMPKPKRIDGCVVWDLRRLDLAWDALGGDDAGHNPWD

SEQ ID NO: 1146 - protein, 300 aa, Methylobacterium sp.
MRATSIVSMSLALSVLSGLGAQAETAGSLSTTAVSGSAAAMYNLGILYINGQGVKQDFGTAGRWFEKSAAGGDVDAMLNLGSLYYNGQGVKQDYAAAAAWFEKAALAGNAEAMNNLGSLYDAGQGVTQDYATARSWYEKAAAAGAASALYNLGLLYANGQGVGQDYGAAASWFGKAAAAGNVDAMNALGSLHLNGQGVKRDAAAARHWFERAVAGGNVDAMNNLGSLYLNGQGVKTDAAAARRWFEKAAAAGHAEAMNNLGFLYVNGRGVKQDFEAARRWFEKAAGGAAAANVPGDIALR

SEQ ID NO: 1147 - protein, 487 aa, Methylobacterium sp.
MTMNESAPGHPILRDVPIGIAATGMRHETDSMGGIDVPADRYWGAQTQRSLQHFSIGDDRMPKRVYHAYGYVKKAAALVNAAAGRLEDWRAQAIVQAADETIAGKLDAHYPLYVWQTGSGTQSNMNVNEVLSNRAIQLLGGVLGSKSPVHPNDHVNMGQSSNDTFPTAMHVATVLELDEVLLPKARALADAIDAKARAWMDVVKTGRTHLQDATPLTVGQEWSGYVAQMRDALALVEASRAGLYKLAAGGTAVGTGLNAPEGFSAEIAARIADLTGKPFVTAPNKFAAQGSLDAMVAAMAAVRGLAVALMKIANDMRWLASGPRCGLGELLLPANEPGSSIMPGKVNPTQCEALVMVCIQVIGEDNAVAFAGSQGNFELNAMRPIIINNTLHSIRVLGDACEKFRTYSVEGTELNRTRIDETVNQSLMLVTALSPVIGYDLASKIAHRANDEGTTLRAAALAEGVPAERFDAVCDPRTMIGHGLAGA

SEQ ID NO: 1148 - protein, 94 aa, Methylobacterium sp.
MDADWSSYAPAWPARISVTLKPALVQASEVAPAAGMVEGSGAEIEGLEQFGGPIGVTIVDANIQVSDGRPGLLSNTPEAGRGGPTSRVRSSGIA

SEQ ID NO: 1149 - protein, 293 aa, Methylobacterium sp.
LAAAALLCAGLAACAPWERELLAQAPVVTPPSPTDLNLETLPPPTRKIDIAIYNFPDLTGQNKPNDNIAEYSRAVTQGGGAFVVDALRRAGRGQWFSVVERTGLANLLQERQLIRATRQEFEGTDAKPLPPIRFAGLIVEGGIIGYDANTVTGGAGANLLGIGGDTKYRRDEVTVAMRIVSVQSGEVLNSVTVTKTIYSVALNANAYRYVAVAKLLQVEAGVTRNEPTQMAVREAIDLAVYATIIEGSRKKLWRFRDPVLGTRLVGEYLARDRPTPLEVPGPTVAAGPLVVKS

SEQ ID NO: 1150 - protein, 231 aa, Methylobacterium sp.
MRPVHQERHLIDRIGWLRAAVLGANDGLVSTASLIVGVAASAANTGEILVAGSAGLVAGAMSMAAGEYVSVSSQGDTEQADLARERRELADDPTAEREELARIYVGRGLDHALALQVAEQLMAKDALGAHARDELGISEVTTARPVQAALTSAATFSAGAALPLVTAALSPGNLAVYTVSGASLVFLAMLGALGASAGGAPIARATARVTFWGVLAMAVTAGIGSLVGKAV

SEQ ID NO: 1151 - protein, 164 aa, Methylobacterium sp.
MRQSGLLGPLVCGCALLAVVGAQAGSLVYQPVNPSFGGSPLNGSWLQAQAAAQNDAQRSAQRDQQLFSANQSAANTKTPGQIFAQQLQTQIYSSLANQITQALFGENAQQSGSYSFGGSQVTFQRLGGNIQLQIFDGQSTTTIVVPATAAVGGSSGATPLLGAP

SEQ ID NO: 1152 - protein, 545 aa, Methylobacterium sp.
VRPAAAYRAGQRALAAGFISAVLLGHGPASARTFVFCSEGSPETFDPARATTTTTMNAAWQVYNTLVEFVPGTTTIRPALAESWTVSEDGRTYVFALRDGVRFHANARFTPTRALNADDVVFSFTRQRRSGPDGAAQGFTYFHDLGLADLIETVDAPDPRHVRFRLREADTTFLANIAQAFGAILSLEYAAALAAGNASDDLARAPIGTGPFVFEGYRPDQVLRYRAFPDYWRRAADGNEPGERPDGLVFAITPNAAVRLNKLRAGECHAMAFPATGDLDAIRAEPGLTLLALAELNVAYLALNTTRAPFGDVRVRRAVNLAIDRRAIVAGVYGDAGILAQGPLPPGIWAHDADLPDTPFDRGEALRLLAEAGLADGFDVDLWYPPVSRPYNPNGRRVADMIQADLAQVGIRARPVTRPWNAYRAALYGGEPTLMLYGWTSDNGDPDNFLNVLLGCKAAQTGGANLARWCDPAYDRLVEAARRTGDREARQALYRQAQAIARRAMPWVPLAHTKVHLALRDDVLGLTMDPLGRHLFETVRFRDPR

SEQ ID NO: 1153 - protein, 225 aa, Methylobacterium sp.
MMRQRGPSRVQILLAAATVWSAGILSAGAQSAAPPGPPQPAPAQPAPMQANTANPGTGQPAPAAPGCDATCVRANNELASQICAPRIEAQAPTDFEWVSRPFAKIFQQAEAPEGGATVVRYRGDSIRFLSPAKEWVRVTYECGFDAAKRSVEYVRVRLGRLDKADAPAQPAQQGRASALAPQPVSPQAQQQAARTGTAAPRKLLPSEPSEIEVRQVNPRIRQAQP

SEQ ID NO: 1154 - protein, 331 aa, Methylobacterium sp.
MSLPVAPTHMFGRRRRGVRGTLALCLVVSGALTPVIASRASSTARSPAVPEVAALTPFAPIAAPPPLGLPDGHADGPASPIIAPVNADLMILGRGAFRPIEATALLFPQAGDGMHALIIAAAAANGLPGDFFLRLLRQESGLNPNAVSPVGALGIAQFMPGTAAERGLRNPFDPLEAIPKSAELLREHRVRFGNLGLAAAAYNAGPQRVRSWLEGRSGMPTETRDYVVRITGRTVEEWAAESGRSFLSAPSLFSNPRGFGPVAGWAADPTARPSPVFEARPVTRSMAAASDRSAKRGARRLSAQSQQPRSEQALCAVLNGQGRTCLVQAVY

SEQ ID NO: 1155 - protein, 239 aa, Methylobacterium sp.
MTTQTLKGQRFLIVGGSSGIGLAIAAVALAAGAEVTIASRSREKLNAAIGTLGTGASAAVLDTGEAEGIERFFADQAPWDHIAVSAAETARGPVRQLDLDAAKAAVESKFWGAYRIARFMRIREGGTLTFISGFMSERPQAAAPLQGAINAALESLARGLALELAPTRVNTVSPGLIETPLWSRMPEKDRAAMYAGAAERLPARRVGQSEDIANAVMFLATTPFATGSNVRVDGGGTIA

SEQ ID NO: 1156 - protein, 240 aa, Methylobacterium sp.
MSSTLQDRTVVVFGGTSGIGLAAARQARAAGAEVVVIGRQAAGAERAAAENGFAGWRAADVTRPETIATALADIPRVDHLALLAGTFVAGRVLEAEVEHLARAFDERIWAAIHALRALGGRLAGDGSVTLISGALADRPSAQGTAVLAAASAAMEAFARGLALELAPVRVNALSPGTTDTPLLARTLGAHRDAYVAGLTERLPQRRLGTAEEAGAAVVFLMCNGFMNGETLHIDGGGRLI

SEQ ID NO: 1157 - protein, 588 aa, Methylobacterium sp.
LSWFWGLGFFYAIHVTLTYGWLGFLAFALPNATGLGLFGWMLGAPRRNIDAIVAAVQGPYALLFMGAQFFAVAITIFGFAAYAWLPLFGHDAAVGVIALVLVACSLGHAVPLRGIRIVHCGALAVGLAASVILLGGLSAQRDGWDVPLQAFDERFYGLVVPSLVGFLLGPWMDIQQWQRAVEIRRSGGSVRAAYVTGALLFLGLLTINALIAARAGLGMPVVSSDGLSGAYAAVAQAIGREPATGVAVAFVIWTAIAAATTIDSFYSATRWLGISVTARSNSPLLAFVPAGLVASPVWILGAALATAAAAIWANLSLLYLMMPFATLLVGAAACLVCETLGATRRYDPVLTSMIGATACLIFVTGYLAPSWALLAIAPLIGLIGALPMIAEVLGWRAPPPVAELIPAAERAPRAAPVPVALDQTDAVASHGFDGHWFVLRLIPTYDDTNSVGNVYFANYVRWVGKARELFFNICMPDFDLKSTDFYILTKSFQHDFRREAMEFEPVTVRISIASHNRKFVTLAHEIHSEVNGLLGRGEQSLMFVDTVHYRPLDIPRAIIEGFLPYWPKTSPHAVAGGSGTTGVAPLGV

SEQ ID NO: 1158 - protein, 140 aa, Methylobacterium sp.
MEIPTNVVRLRHPEDLDDPLTEVLRSGARRLLAQAVEMEADAFLSAMQDLRLQDGRARLVRHGHGPERAIQTGIGPVPVARVRVRDRGASGSEDRVRFTSTILPKWARRTPSLDALLPVLYLRGISTGNFQEALAGVSGR

SEQ ID NO: 1159 - protein, 870 aa, Methylobacterium sp.
MTDHFRLNPTELRLALRERGYHPVPVSGPTMNVSSAGKRPTMSGWERRCLDASPEEIQRWGSMQPDCTNTGLLCGRMVGADIDVLRQDLAEAIADRARLVLGPTPLVRIGREPKVLLGYRLDIPTDKLQTAALLFTDDQVEKPTKVEVLARGQQFVGFGVHPETQAPYRWPDASPLTVDFADLPEVTEGALRQFVAEAEEILREAGASTRRERKQEGRKREDKGRRAAGFKATERPDRATIEDALAHVPNDFDYDGWVRIGFALYEGLGEAGRDLWERWSATSPNDNAAFTSGKWSSLAGGRSVTIATLFWHAAENGWRRQGRSGAPKQDRAERKASADPEATPEEDDGRPIVRFIAGKVPEAVDRMEQLLLKSGVEIFSRAGALVRPVLDEVPAAKGRMTTVARMSPLVAVSLADMVARIMRVQRFDRRAEDWLDINPPAEMTMTLLAREGQWRVPPVAGVVTTPTLRLDGSILERPGYDAATRLYYAADPGFHLPPIPERPTKVDALRALAVIEELLAGFPFVDHVDRSVALSGIFTALVRGVLPTAPLHAIRAHTPGTGKSYLVDLASVIATGRRCPVIAAGKTEEETEKRLGALLRDAVPVVSIDNVNGELGGDMLCQLTERPLVRVRILGKSEAPELECRSTVFATGNNLVLTGDMTRRALVCSLDAGIERPELRAFDFDPVAEVLADRGRFVAAALTVIRAYRVAGAPKVCGAIGSYEDWSDMVRSPLIWLAQADPVTSMETAREEDPELSAIRELFGQWREHLSLSSGYTTNAIIKTACEKGPGSSFDYNVQEFRAPEFRDLLLRQAGDGGAVNSRRLGKWLSRIKGRVVDAHRIEMREDGSNGNRFSLCQMEARSYGQEPQF

SEQ ID NO: 1160 - protein, 150 aa, Methylobacterium sp.
LWLVGTFLEDLVPKGTLRSGIWSAHFDLGFVLTGLVVAFLIWRRAGGRNLPVEDPGPLHRLAKATHAALYVLLLVIVGLGVANAFVRGVSLGPISLPQVGDPEWRRSLTHWHGLAANMLMAVALFHAVAALVHHYLWHDAVLLRMLPRRS

SEQ ID NO: 1161 - protein, 331 aa, Methylobacterium sp.
VTLPHPVLLADIGGTYARFSVLPEPGGPPGPIRKVPTAGFPSPVDAIRAFLDRQDAVRPRSAFLAVAGRIAHGITRMTNAPWRFDPGEIGVAFGLEAVRLVNDYVPLAAAVMVLDAEDQADLARLGPAVEGIGPRLVLGPGTGLGAAALIPAGDRHVIQTTEAGHIGFGPCEPDDGLPWSALMATEGRLTAETLLSGPGLVRLVRVIAAARGAAAGWNSPPDVLDGAKSDPIAREAVHQFARLLGRFAGDMALVFSASGGVFLAGGLAPRIVEDLRGEAFGAAFEDKHPFREAMRAIPRFLITRPEPAIDGLAAILAHEDRFLFPGQDWRP

SEQ ID NO: 1162 - protein, 377 aa, Methylobacterium sp.
MTRQQLTPPAGVLVAIDVAKARNEVLIEVPGSGRRRRLSVLNTRAEHDRLIALLSNLGQPVTCGFEATGNYHRPIAWRLLQAGFAVRLISSVGLARTREALHNGWDKNDPKDAQIMLHMIRIGASQVYHDPLAAGINDVQELSKTHDAVSRAKTEVLHRILTHYLPLYFPEVDRFRHNSRSDWFFAFLDRFPTPACITALSKEAFIAAAWDVVGRKVAKAQLLGDIYETAHSSIGLPVPPDAPAVSMFRLVIGEARGLIQQRDAIEATADALLTDSSDYKLLRRIPGIGPINALTILAEAGDLRRFSHQWPRVLPDRQEPPGSTLTTNTPRAHVRGRRPVAWPPVLHRYVGRCRPESHTVLRAAASSGRRQPRPARL

SEQ ID NO: 1163 - protein, 268 aa, Methylobacterium sp.
MSRAGIRRTYGAISGAVLAFILLPLVVIVWVSFFANRILAFPASGYTLDWYTRALETDAFRDGFVTSVQTALFATAASLALGVPASLGLVRGRFPGRDAVQALLLAPMVVPGIVGGAALFIAFIEVEALLDIQVAGTLGGLLVAHTLIALPWTIRLVSASLASADRAIEEAAASLGADPLTVLRRVTLPAIRPAIVAAALFSFVISFIDLEKSIFLVGPGRTTLQIALVNYLEWNLDGTVAAVAAVQILIVGTALLVSDRYARLAQAF

SEQ ID NO: 1164 - protein, 613 aa, Methylobacterium sp.
MSPSQEERIAAEQLRLVLDGVTQSVAVGFLVSTLMLAVLWTLVPHAVLLSWYGAFLVERFGAAAYARRVRAAIGEPDRARRVERVIFLSKIVEGAILGSLIWIALPLQVPAVSILTMSLLGATCSNGVSLLAPRRHLYLALVVPVAVLAAGTLWSLGGAPYRALAICSILFVVGQYGQVVLASRRVRESIELRFENAALVEQLRAETAAAHRARRDAEHANTAKSQFLAAASHDLRQPVHAQGLFLQALSQTDLAAPQRRILQNAQTANVASTDMLNTLLDFSRLEAGVITPRPRAFELQPLLDKIENELAPLADAKRLIYRTPQTDLAIVSDPALLELVLRNLVLNAIRYTERGGVLIGCRRRRAGVSIEVYDTGIGIPVDKREDIFREFYQLGNPERDRHKGLGLGLAIARGIAASLDHPLSLSSKVGSGSVFRILVPRTLDAGRDARLDDAPAAAIAESGGLVGARILIVDDDAIVRDAMVALLSGWGCLCWAFEDPTDVTERPPQGPPPDALICDYRLRRGQTGAEAIATLRQHWGRPIPAILITGDTAPVRMREALDSGVPLIHKPVRPDLLQKALAALIPPGRPPVGPLGAEVRRGPETTDLVRAEG

SEQ ID NO: 1165 - protein, 268 aa, Methylobacterium sp.
MAQTETAAPPLLKIRKLHKSYGTNEVLKGISLDIREGEVVSIIGASGSGKSTFLRCLNLMETPTSGFMDFERFAFDYEQGARRQPTPQQLCELRARIGMVFQSYNLWPHMTVLENVIEAPIRVRRMPRRQAVAEAEALLQRIGLYEKRHAYPSKLSGGQQQRVAIVRALAMAPKVMLFDEVTSALDPELVGEVLALMGSLAADGMTMLLVTHEMAFARDVGTRTLFFDGGVIAEDGPPDAIIGAPRSERLRQFLRRVLHQPAAPGQTA

SEQ ID NO: 1166 - protein, 140 aa, Methylobacterium sp.
MQQQISVITLGVSSLGRSRAFYGDGFGWAPVFENDEIVFYQMNGFMLGTWQNPNLDQDMRRASEPSPSAFCLAHNVPNRGDVAPTIARLVAAGGTLLRAADEPPHGGYRGYLSDPDGHAWEIAWNPAWRIDERGRVTFGL

SEQ ID NO: 1167 - protein, 137 aa, Methylobacterium sp.; identical to SEQ ID NO: 89

SEQ ID NO: 1168 - protein, 53 aa, Methylobacterium sp.
VPTLLADEDELTRAIIALASEYGRYGYRRVTALLQAAGWQVGKDRVHPSRTSG

SEQ ID NO: 1169 - protein, 111 aa, Methylobacterium sp.
VVVLGVASFWCATGVLAQGAPVPNVNDCTFIRDPTALRDCIELYEGQRLAPGPRPAAFQQSPVIDQSLLDAAGPIPATGVSRRGKRRKLRQSRRPATPAQAVQVEQLAPPQ

SEQ ID NO: 1170 - protein, 406 aa, Methylobacterium sp.
MAGRKAPRIPDAILDQLLAGADPKTAFEADGLLDELKKALAERALNAEMDHHLAGEDAGNTRNGYGRKTVTTETGRIELSIPRDRQATFDPQLIARYQRRFPGFDDKIVSMYARGMSTREIVAHLRELYGIEVSPDLISAVTDAVLEEVAAWQARPLEPVYPIVFFDALRIKVRDEGVVRNKAVHIALGVRADGAKEILGLWLEQNEGAKFWLRVMNELRNRGVEDVLLAVVDGLKGFPDAIRAVFPEALVQTCIVHLLRHSLDFVSYKDRKLVAGALKDIYRALDAAAGEAALAAFETSEWGRRYPAIAQSWRRAWGEVIPFYAFPGEVRRILYTTNAIEALNATLRRAVRARGHFPTDEAALKLLYLVLNRSEKAWKMGPREWVMAKAQFAVIFGERFTRAMAA

SEQ ID NO: 1171 - protein, 137 aa, Methylobacterium sp.
MLTPFHLAYHVTDLDAARRFYGGVLGCQEGRSTETWVDFDFFGHQLSLHLGEPFATTRSGKVGDHTVMMPHLGVVLPLDAWEALAGRVEAAGIAFDIPPVVRFAGEPGEQRTMFFFDPSGNPIEIKGFRDLAGVFAH

SEQ ID NO: 1172 - protein, 141 aa, Methylobacterium sp.
VSLSPFHLAIPVYDLAAARHFYNETFGLPEGRSSDHWVDFDFYGHQLVIHEHPKTASQDEAHTNAVDGHNVPVPHFGIVLGWDEWEALADRLRSRDTKFVIEPYVRFAGQVGEQATMFLFDPCGNALEFKAFKDMSQLFAH

SEQ ID NO: 1173 - protein, 250 aa, Methylobacterium sp.
VTAPVGHAAVDPGAGETLRVHVRRGETVADYAVPRRANQTVLDVVTEIQRDQDPTLAYRFACRVGMCGSCGMTVNGRPRWTCRTRVAAVAPDGELLLEPLRNLPVVKDLAVDMEPFFEKWRRAHGFFEPGENPPEDFAVVEPESAARREVDAGIECINCGVCYAACDLVTWNPDYLGPAALNRAWTLVNDVRDRDRDRLAAVAGDAGCHSCHSHMSCTEHCPKGLSPTFSIAGLKRETGKAALRRFWRRG

SEQ ID NO: 1174 - protein, 109 aa, Methylobacterium sp.
MSPLLYLAQRGTAAILAVTVAVHLGTILYAVRGGLTAGEILGRTQGNLAFLLFYAVFVLAAAIHAPIGLRSVLREWTGWRGRSLDVAMIALSALLAGLGLRAALAVYAA

SEQ ID NO: 1175 - protein, 125 aa, Methylobacterium sp.
MRTAPGTAGRAGITRASLRRPGFAAALIHRLSGIALALFLPMHFIALGTALQGADRLESFLGLTHNGLVRTAEWGLVCALAVHMALGLRVLAIEWLRFRERNAGVVAGCLAAAFAVGLLFLLSGA

SEQ ID NO: 1176 - protein, 203 aa, Methylobacterium sp.
VAHHVLDMPAGEAEIRALRIGDTVTLRRWLFGIRDATLIHMFDRDRRTRLDLDGHAVIHTAPNVHRVPVSNEAPVGFAPFCIGTTTSMRMERFTDALMEREGVRLIVGKGGMGPATLDAFARRGGAYLAIVGGAAALETTWIETIVDVDLDDLHPESLWQFAIRDFGPLLVGMDSHGGSLFADVQRDVAARRDAVIASLEEAR

SEQ ID NO: 1177 - protein, 574 aa, Methylobacterium sp.
MSPEQVETDILILGSGGAGLFAALHAKKVAPDLDVTVAVKGLLGKCGCTRMVQGGYNVALAPGDSVERHFMDTIEGGKWLNDQALAWTLVTEAQVRIRELETELGCFFDRNPDGSVHQKAFAGQTFDRTVHKGDLTGIEIINRLSEQVWRRDVHRLEDHRALELIPARDGSGLAGVLMLDMRTGEPKLVRAKAVLLATGGGPTMYKYHTPSGDKSCDGLAMALRAGLPLRDMEMVQFHPTGLLAGAGTRMTGTVLEEGLRGAGGWLLDSTGQRFMEAYDPRAERATRDVVSRSIMRRLRDGFATPSGGVHIQMSHLGPEDVRRRFKGMVERCADCGFDLAGGLVEVIPTAHYMMGGLQFAVDCTTALPRLYAAGEDTGGVHGANRLGGNGVANSTVFGGLAGQSMARAVTREGRLAEPDPAAIEAGLARAYGPLGRPAESLPEIREALYETMWADVGILRDAAGLTRALATLDGLSDAVARAGAPDGDRRYALTWMDRLNLENLVLVSQAVARAALARTDSRGAHFREDFPEASDLATSHFTVVRQRGGALDLAMEPVHFTHVRPGGSLLDAAA

SEQ ID NO: 1178 - protein, 99 aa, Methylobacterium sp.
MAYFLLRLEPPRPSFPFDATEAEKALFSAHSGYWMEQAAAGIAIAVGPVFESGGTWGLALVEADDAARAEALGEADPVLMAQAGFRYTVSPVPSLILRR

SEQ ID NO: 1179 - protein, 441 aa, Methylobacterium sp.
MLVDRQISAARMIRRSRTTVIVLGVIAGAAVAALLIHLLLGLLSLDIAVAKTSTEDREAAQALTQLFETQHPRVRIRTIFEPDRLGASAALDKGETQLALVRSDAAPKDGQTLVILRRDAVVFVAPGGSPVDSVAKLRGSTVGLLDGRKLDPLLLDLILTHFGVPPSSVHRRILTIDQLTEAARSRQIGSVFVVAPVGSALWLPLFTALRKGSGAAKLFEVDEAAAIAKEHPVLDTIDVPKGAFLGSLPAPGDDITTLSVSHRLVARGAMPDWLPGEITREVLTGKPRLVALDDDLAGIEAPDTDDKVQALPIHPGATAYLTGNQPSLSDQAQNAAYWVGLMISALASLGAAGIGLYRRFRPLQPPTRVMRLLEIWLSVSSADPVELDHLEREADALAAETIRMEAHRRTESVEIRLVALLVAHVREAVQRRRRHVAQRMT

SEQ ID NO: 1180 - protein, 290 aa, Methylobacterium sp.
VITRDGAQIGGTGPQTVSAEPASLDHANRVITPSRLKPSTLAGEAGPYFLEHAIASANAQELDRPATIHFFVGTDPGTEIPARLAAHPQVTFARGARKGQIPALNAAIAAVDDSWDLVGFLEDDDRWLPPYLGVAVRALDRFDFVSSTQLETDEAGEVVRINDFATPSGWLMRRTTFAQVGAISPAAKWHYDNEWLGRLAETGLRRAHLVEATAPVTLQHASLVRPWLANVLQLGGPNVQLARHGFVLPLVCRLVHPGSGSSDVGQGGTSRAESEAEYRRLVDRFGRIPW

SEQ ID NO: 1181 - protein, 265 aa, Methylobacterium sp.
MRIAIITPSRLKPSTLAGKAGQYFLEHAIASANAQELDRPATIHFFVGIDPGIEIPARLAAHPQTTFARGPQRGQIPALNAAIAAVDDSWDLVGFLEDDDHWLPAYLGFALRALESFDFVSSTQLETDEAGEVVRINDFATPSGWLMRRTTFAQVGAISPAAKWHYDNEWLGRLAETGLRRAHLVEATAPVTLQDAIQVRPWLANVLRNGGPNVQLVRHGFVLPLVCRLVHPGSGTSDVGSGGTSKAESNAEYQRLVDRFGRIPW

SEQ ID NO: 1182 - protein, 195 aa, Methylobacterium sp.
MAFSFASLFRRRPAVAPAAIAVAHPVAPVPVVAAAPAPKAGSRLRRNAQVMLLCTTTIGGFEGVRQTAYPDPATGREPWTVCYGETEGVKRNDHYSLAECKAMLGRSLEKYAVRLEGCISRPMPDTTYAAFLSLSYNIGSGGFCRSSVARAWNAGDVRVSCDAMMKFNKAAGITFPGLTRRRTQERALCLQGANL

SEQ ID NO: 1183 - protein, 495 aa, Methylobacterium sp.
MLRYAACLLAGLALTGPAAAQTLRYGMMEDPDALDPTLARTFASRMVFAALCDKLVDIGPDLKPVPQLATSWELSPDEKALTMHLRPGVLFHDGERLDAAAAKFSIERHMKMPGSQRRSEIAPIDSVDVVDDLTFRINLKQPFAPLLAQFTDRAGMMVSPKAAERLGDKFASAPVCAGPYKFVERVPQDRIVVERFADYWNKDAIHIQRIEFRPIPDATVRLTNLRAGQLDLLERLAPTDVAQVKRDAKLKLDSTYELGFQEILFNPHKAGSPVSDPKVRAAFEAAIDRNAINQVVYNGEFLAGNQWVNPKNPNYVAEYPIPKRDVAKAKALLAEAGKPNPQITLTVYANSESPQVGQVIQAMTKEAGFDVKIQAVDFTTALDAADKGNYEAQLYSWSGRSDPDGNTFSFLACKAALNYPKYCSPEADAALQAERGTVDPAKRKAAWKALADQVLKDRPGIYILHRKLLWAYSQKITGFVPYPDGLVRFTGLKLN

SEQ ID NO: 1184 - protein, 309 aa, Methylobacterium sp.
MSTGSEIARAEAVGLEAAPSGAPAHAILQEPGTLAAFWRRLRARRSAVVGLVIVGLLVLMAVFAPWIAPYDPTATDWGNVRGPPSLAHPFGGDEVGRDVLSRIIFGTRASLGAGLVSVALAVSLGLPLGLLAGYAGGWIDGAISRLTDALLAIPFLILAIALAAFLGPSLVNAMIAIGLSATSTFIRLTRAQVRAVAAEEFVEAARAMGNPPWRIARVHILPNIVPAILVQATLTIAAAIIAEASLSFLGLGQQPPEPSWGAMLNTAKNFMDEAPWMAIWPGLSIFLAVLAFNLFGDGLRDALDPRQRT

SEQ ID NO: 1185 - protein, 342 aa, Methylobacterium sp.
MTAAMTKPLLDVRDLAVAFDTDGGAVHAVNGVSYTLHEGETLGIVGESGSGKSVHVLAMLGLIPRPPGRITGGQVLFEGRDLLALKERDLRKIRGGAIGFVFQDPMSSLNPGMTVAAQIVEPLRIHLGLDARAARARARELLDLVRIPNAAARLDQYPHEFSGGQRQRVMIAIGLSCRPKLLIADEATTALDVTVQAEIVALVQELKRELGMAIIWITHDLGVVAGISDTVQVMYAGRILERGPVDDIFADPRNAYTLGLLRSLPDLSGGRAGRRRLHQIEGAPPDMRHLPPGDPFAPRNAFATPRCRAEMPPLAQAPGAAPGHLVAAWYDLPKLLGEEAAR

SEQ ID NO: 1186 - protein, 307 aa, Methylobacterium sp.
MNASQQPVVSVRDLSKHYPLRSWWGGKGAVFRAVEGVSFDIRPGETLGLVGESGSGKSTIGRAVTMLNPPTSGTIAFEGTDLAKLSAGAMRKMRARIQTVFQDPYAALNPRMSAGEYVAEAFKLHRRDMRGPERREAVAALFQRVGLDPRFMGRYPHQFSGGQRQRICIARAIALKPSFIVADEPIAALDVSIQAQVVNLLQDLQDEMGLSYLFISHDLRMVRYLCHRVAVLWRGRIVELAEAAALYEDPRHPYTRRLLAAVPVPHPAEERARLAARDLTGHDQPPDGPLTEVAPGHWVALPRGQHA

SEQ ID NO: 1187 - protein, 84 aa, Methylobacterium sp.
MGDAAIQPAEFWDTVGGLVTAEVEPVIGRADKQRGPLIDYLRDLEALARRQCSSRETVQIIASGRRLLGDRSEIGPSDGPFTRA

SEQ ID NO: 1188 - protein, 389 aa, Methylobacterium sp.
MPIGLQDFDFGLGETADALRAEVERFARAEIAPRAAAIDASNAFPADLWRKLGALGVLGVTVEETYGGAGMGYLEHAVAMEEISRASASVGLSYGAHSNLCVNQIRRNGTEAQKRRYLPKLIAGEHVGALAMSEPGSGSDVVSMRLRADRRGDRYVLNGTKMWITNGPDANVLVVYAKTDPEAGPRGITAFLVEKDFPGFSTAQKLDKLGMRGSNTCELLFQDCEIPEENVLGAVGRGVGVLMSGLDYERAVLAAGPLGIMRACLDVVLPYLHERRQFGRPIGEFQLMQGKIADMYTATNAARAYVYAVARACDRGRATRRDAAGAILFAAERATTVALDAIQALGGNGYINDYPTGRLLRDAKLYEIGAGTSEIRRMLIGRELFAETA

SEQ ID NO: 1189 - protein, 76 aa, Methylobacterium sp.; identical to SEQ ID NO: 114

SEQ ID NO: 1190 - protein, 535 aa, Methylobacterium sp.; identical to SEQ ID NO: 118

SEQ ID NO: 1191 - protein, 213 aa, Methylobacterium sp.
MLVDDHAVVREGYRRLLERQPDMEVAAEAGDGAEAYRAYRMVEPDVVIMDISMPGRGGIDAIRQIRQVDPSARILVFSVHAAVSYALQAIRAGARGYITKSSASDLLIEAVRSVFANKLTLCAEISHLLAASRLAEETSPIDQLSPREFEILRMILDARHTDAIAADLSLSPKTVANYHYAIKSKLGVSSDVELVYCCIRCGLIDPFAVVGAD

SEQ ID NO: 1192 - protein, 267 aa, Methylobacterium sp.
MSAEAETQDAGEDLLFSVADGVATITLNRPERKNAFTFPMIEAWTEALQRCRTDAAIRVVVVTGAGSAFCSGGDIVEMGERLDQPPARRKEELYGRIQRIPLTLEDLDKPVIAALNGVATGAGLDLALMCDLRYAAQSARFAETYVRVGLVPGAGGAHFLPRLVGTAKALELFFTGDFVDADEALRIGLVNGVHADADLSPAVAALARRIAKAPPLTLSLIKRAVYQGMRNDLRTNLDLISSHYAVVTATPEHREAVQAFIGARDRT

SEQ ID NO: 1193 - protein, 129 aa, Methylobacterium sp.
VRAWYQADKEASIEVVVHKPDGQPYNAYLCETFERLAEHAGLADRKVGGISAKVTPHVFRHTIINWLLRAGCSLNSVADFAGCSVLTLVRHYGRQSMDGQAAVLTCIDRPILLKRLDVGAMGRSRTGSV

SEQ ID NO: 1194 - protein, 571 aa, Methylobacterium sp.
MTDAHAAPGYDADVIVVGAGPVGLTAGCALRHHGVSCLILEQRAEVRAYSRANNLWARPQELLAGIGLRDALAENAYAVRTINFFVDGAPTTPIPIADVASPYPDVLYSGQDVIERTLIDAFEARGGRLDRGCTVTGIDQDAAGVTVTLRRGADGPETRLRARYCVAADGARSTVRARLGLDFEPERLAGCMNRQVDARLSWRRGSEPDQLWFFYYPRGFAGIMPVWGGYHRLFFLADDAGVPDRDPTLAEIQALAREVTGDETLTLSDPQWLTHSRFAYGVSPGYARGRVFLAGDAGHLSLPIGGQGMNAGLHDAVEIAWRLAMTLRGEAAPAILDSYDGERGGEHARLSAQQVRGFRWTVYRGPVTDTVLGLAAKALPNLGSLLQGTDDMQQMGVAYPGSLLNADHLSGLANLTHLLRPGPKPGQRAPDAPVTRDGVRTRLFPFLYNPDGWTTGWALLCFDGRSPEAAPFLLEAVQAVAPWPWLRPRLVLAGPLIAAEMPVLSDLDGRAHGAYGLEGRPALVLVRPDGHIAFRSGADRTDRLIAYCRALFDAAGRAAGEVVRPEAACAG

SEQ ID NO: 1195 - protein, 484 aa, Methylobacterium sp.
MPDSISARLRAAIADHAGTGRTALSGSDVVSYADLGARIDAAAGAVRDWGAAKGDRVGLIAPKSAAAIVAYFGAMQAGACVCFLEPGLAPEVVAEQAALVGMRHLIVAQVDASPVALTGLDVRALDSLADGAAFAAEVSPRDEAMLLFTSGSTGRPKGVLLRHEGLICNAAGVLRHTGTGPADRLLHVMPLHHTNGINNQLIVPLLAGAEIVLMERFQAEAALDRLRSGGITYMTGVPTIYARMLPLLRPGERFPGLRFLRCGSAPITPTLHRQIEEAFGVPLLVSYGLSEATCTSTMNPPGRRRIGTIGTVLAGQNVDLFDPATDRPVEAGREGEIRISGPALMAGYLGSADQPIVDGWLRTGDLGRFDADGFLAITGRIKDVIIRGGENISPALIERQLAAHPAICDCCVVGAPDADLGEVPVAFVVLREGEGLDEPGLKDFVRGSLARIYVPAQIRRLDVLPVNGVGKTDRKALRSLLAAS

SEQ ID NO: 1196 - protein, 208 aa, Methylobacterium sp.
AKRVYRVMKVHGLLLQRHVGGAETRRHEGKVAVATRNTRWCSDGLEIAAENGERVRVAFALDCCDREAMSYVATTAGITGEDVRDLMVAAVEHRFGAVNQLPSLIEWLTDNGSCYVARDTRRFARELGLIPKTTPLESPQSNGMAEAFVRTLKRDYVRVSVLPDAESVLRQLPVWLAHYNDLHPHRALGYRSPREFITRSTQETLSGF

SEQ ID NO: 1197 - protein, 392 aa, Methylobacterium sp.
MLRRYAIIESPRRRRAGGAVASGSGPDAGGLRVLEADLSARDVREIGRDPNVEDHGLIMPTRLIRPVTTREIDTADAKPPAWGISAVGADRTTLDGSGIMVAVLDTGIDRAHPAFDNVDIEEEDFSGSGNGDRHGHGTHCAGTIFGRDVEGLRIGIARKIRKAYIAKVFPDDGRGDSLAVFQAIEQAAKKGANIVSMSLGFDFAGMVRDLVEDGYPVELATSIGLEHFKDNLRMFDSIMRVVEAGRAFGRGPLVIAASGNESQRSRDSRFRISASLPSAAAGVISVSAVRQADGAFEIADFSNGRAKICAPGEEIVSAAPGSGLATMSGTSMACPHVAGLAALWWQKIAASSVRANAETVGQKLLTSAITTSIKSFDPDDSEVGFALAPSSA

SEQ ID NO: 1198 - protein, 385 aa, Methylobacterium sp.
MRPLSGIRVIEFCSVAAGPFCAMLLADMGADVIKVENPEGGDSMRAWPPLNAGFSENFASLNRNKRSVTLDLKDPADKARALDLIGSADVVLENNRPGVMKRLGLDYVRVSAGRPGLVYCSISAFGQEGPRSAEAGFDLTLQAMSGVMSVTGEPGAPPVKCGVPISDFGTGLYAAYAIAAALLQVRAGGPGAHIDASMFGASLAMGALQTSEYFGSGRDPKRLGSAHPRNAPYQAFRAQDGYFAMAAGNDALYRAACAAIGRDDLAEDPRFASTALRAQNQGELLAILERDFADLTCADLLARFRAAGVPCAPINGYADALADPQVAHMGWVQPVTLPSGAETRTFVSPLKFSGEGFPIYREPPALGQHNAELFGEAAPARARTA

SEQ ID NO: 1199 - protein, 238 aa, Methylobacterium sp.
MDELLKERSGDTLTLTLNRPDKMNALSATLVDALLDAVAAAAGDGTRLLVLKGAGRNFSAGFDFGGYADLSEGDLLLRFVRIEQLLQALAHAPFDTLALAHGRNFGAGVDVICACGRRVSDPAATFRMPGLSFGLVLGTRRYAERVGGSKARLVLQEGRVFDAPEALSDGFLTAVAATDSWFDTVAAASEAATRLSSWAGAALNRAAARDTRADDLADLVASAARPGLKDRIRAYRAA

SEQ ID NO: 1200 - protein, 275 aa, Methylobacterium sp.
VSAGTQKIVPLADLAARVPDGSSLALGGSFLHRGPFAFVRELIRQGRRDLEVVKQSPGYDIDILCRAGALSRAKAGIVAMEGNFGLAPWYRRAIESGEVRLEEHACASLTAGLRAAAFGVPFMPCGGIHGSDLPALNGWKTIEDPYGSGEAVYAIPRIQPDFAVIQANEVSASGDVRVFGTSHWDRIMSRSAKRVLVVAERVAPDASFRDQPELTLVPHFLVEALSIVPNGAWPGSLWPDYEIDYPAVEAYMADAPGVLADHLAAGPEAREAAHV

SEQ ID NO: 1201 - protein, 251 aa, Methylobacterium sp.
MSEAPSNAIEAWSGFSYIVTNLARFVRPNEITFSGVNSALPMLACLLAKQAYPFAFTYINVAGGVDPNPSKVPISSSDPVLAEGSRAIFANEDFYDLCTRGLMDLCFLGAAQVDGLGRTNVSCIGDWHAPRVRLPGGGGGAVMLPTARRAVTWRTEHSRRTLVETLDFVTAAGGMHGVVTPIAVFTKREGRLVLASWHPEASLDEVRDRTGFAFSADGAASTPPPTPAERAALAVLDPEGRFEADAGIRLR

SEQ ID NO: 1202 - protein, 163 aa, Methylobacterium sp.
LICLLGFLGVTAALKLRDGMRPAPVALAVTPPPEPVPAVDAAGVALQAGRNGHFFVNALLDGRSLPMMVDTGASACAFSEEDAARIGIQVTPADFTRVWNTANGTVRVAPIRIAIVQIGSITVRDVDAVVIPRGLLSTSLLGMSFLRRLRDFGISGSTMTLRG

SEQ ID NO: 1203 - protein, 286 aa, Methylobacterium sp.
MFDATKMLADALGEHLALTYQRTFGSREPRYAEIIEAAARLTIERIVGSDALYHDGDHTALVTLVAQDILRGRFLQQGITPEDWLHMILAALYHDIGYVRGVCAGDRLQAFVIDAQGTTVSLPRGASDAALAPYHVERSKLAVQERFGTHDLVDASRVIRAIELTRFPVPEDDSHRETGTEAGLLRAADLIGQLGDPLYPRKLNALFHEFAEIGVNAELGYDSPADLAERYPSFFWGKIEPVIGDAIRFLDLTVEGRGWVANLYAHVFAIEHDRRRMGPHPGPGPL

SEQ ID NO: 1204 - protein, 326 aa, Methylobacterium sp.
VITGPCLIVQPIHAAGLDRLRAAGLEPRPASGTDPETLAREVADCVAVITRNTGFPARAIAAAPALRVIGVHGTGTDHVATAEATGAGIVVVNTPGANAVSVAEQTLALIFALAKALPEADRSVRAGDDSFKFTARLIELAGLTLGLVGFGAIGQATARLGATLGLRVLAYGPSRPDADFANAGALRAASVDALLAESDIVSLHVPLTPGTRGLIGRDQLARMKREAFLINTSRGGLIDEAALVEALAAGTIAGAGLDVFAQEPLPVDHPLARQPRAILTPHVGGSTGAALIRTAETAAARVVDALAGRRPGGLVNPAVWERRRGV

SEQ ID NO: 1205 - protein, 37 aa, Methylobacterium sp.; identical to SEQ ID NO: 129

SEQ ID NO: 1206 - protein, 269 aa, Methylobacterium sp.
MNRRHVLALAALCASLGAGILAAPATRAAEGKLELIEPGKLIVATDSTFAPFSMRTPSGELDGLEVRVMREVCRRLGLEYSPVNIKFDALLVGLMADQYDITSESMDITPARQKQVAFADGWLESGARIVTRKDTGIKGPADLKGRNVGALSASTFGKLAEENGATLKSYKTAADAMQDLVGGNIDAVINDAVAGNYAIKARKLPLVMIETPLSTVQKGFAIKKGKPNLHAAVNKALGEMVADGTYAKLVTPLIGYDPAPKEPIRTPAM

SEQ ID NO: 1207 - protein, 226 aa, Methylobacterium sp.
MKTLDAASYTTALSARREQSLGQMAYDRLLDMLVRRDLPAGTVLHERRLAEMLDISRTPTREAMSRLETEGLIERQPGGMLVVKEFSLRELIEILHVRRLLERESVALATGRIADAVLADLQRQMEALLAAGDPDAPGNWEVDRRFHDLIAEHSQNATLAKTIKDLRLKTQMFNLSRMPERFEAVHREHLAVVAALRAKDAAAAADAIAAHLENFKQGIIQRLSEV

SEQ ID NO: 1208 - protein, 252 aa, Methylobacterium sp.
LLLLLLTCAAPVQARPATFLAVHAVGMAALPPVPPAPAAMPAPAPVAADARARYLPLIAREAAGTGLPLAVADAVARIESGYDPTVVGSVGEVGLMQVRPTTAAMLGFRGTVAELASPEINVRYGVRYLAEAWRRADGDLCRALMKYRAGHGSEAMSPLSQLYCARAQAILGNPEARVVRASARAAAPDRLAARSAGPVHRTRVAAVPAKPMSFWEAHRARIARLNAAVVSRWRARGWSAAPDGSSGEPAGG

SEQ ID NO: 1209 - protein, 442 aa, Methylobacterium sp.
VASWIEQAVWWQVFPLGFVGAPDEADPAAPVTHRLAHLHGWLDYAVELGASGLALGPIFAASTHGYDTIDHFRIDPRLGDEADFDALVAAARARGLRVLLDGVFNHVGRAHPAFQDVLRHGPESERAGWFRLSWPRGSGPGIEPDYACFEGHRQLVTLNHDDPRVADHVAAVMGHWLARGADGWRLDAAYAVPPRFWARVLRQVRLAHPEAYIVGEVIHGDYARIVQDTGMDSVTQYELWKAIWSALNDRNLFELAHALDRHNGLLDRFAPLTFVGNHDVTRIASRLTDERHLPHALAILLTCGGTPSIYAGDEQAFRGVKEERVGGDDAIRPAFPPTPADLAPYGWPIYRLHRDLIALRRRHAGLHRARARALHLANAQIVLALGDGSARVLTALNLADADATLPVPEARAIEAGTGDLAEAGSTGARVTLPAHGWAVLTV

SEQ ID NO: 1210 - protein, 220 aa, Methylobacterium sp.
MPDAALLMRIRAILADSPFHGEGHRKVWARLRMKGVRTSKRRVLRLMRAHDLLAPTRVGTPRGPRNHDGTIIPDRVDTMWGTDLTTTWTAEGQVAVFVAIDHCSAECVGIHAARRATRFEALEPIRQGVRQRFGGFAAEIASGLSVRHDHGSQYMADAFQAELAFLGIASSPAFVRAPEGNGCAERFIRTLKENLLWVEHFDTVEDLRHGLLAFRDLYNE

SEQ ID NO: 1211 - protein, 210 aa, Methylobacterium sp.
MVLLGDLLMILDLHRQGLSVTAIARRTGRDLKTVRKYIERGLEPPAYGPRQAGRPSKLAPYLVYLRERVTAFPDLSAVRLPRELRERGYTGAYTAVKRFVAATRPPEAKPYEVRFETTAGQQAQVDFARFVVTFTDAPGASCIVWLFSLVLGQVAVLVQERAECRHALAVGHRLHVRPRDLFLHPSAKRVAVIGSIPVNAECIMVLPHFV

SEQ ID NO: 1212 - protein, 1301 aa, Methylobacterium sp.
MQRYELTAGTSAKFWEAGAEDSVLIVRFGRIGTQGQSKTKSFPSAQAARVELDRLVREKTGKGYRPAGEAAPAGPDPASGAGAAATGNAAASPAAEAQVAEARSAEVRSAETGAAGTSPAPAAGAEARRVPIFTGTPLPARSRPGAPLDAAADWAAFAARIRPLLAAAPDEARVPAEALAARLDGAPPALDPDEVRAWLEQLEAACPALSQRPWGAKPGPQGPAARAAFTHLARWLVARSGTGGTLVALLDRLRPRPSVRYGSLPVSAWDIPTTLGLRAALVAAPEAAYAEALDAALRLAASDPEPTLARWLAVIFADDRPGADHALSARAVLARCDPPDPKAYGNSHVALPLIVDLPPAQAAPWYAAPYHRATLATCDVGAEEAAATVIAVADAAGEPATPGLVWLLEGAVGPERTIVARALLETRAADALDALLPFVGTKLVRDALDAADAAFPDWMLRAYLGALQGKGEPAYGPRAVTLAARHGHETARAWAAAEGGRGAGRLDRLLAAGSAPQAAPEALPPVLRDPPWRRRGAARARSERAVAPIPTPFAHGFDPDEALDRSTFYFEAGTLVESMTDLAARIRATEAEALYDMPIPPPAEPVPAADADPATALAWLDRRLDLDRDAFTGFFYFNYGPWFRMVGWQPEPLALMLWEKTGPQRAHYVAWRRTIAVMLSRFGARAVPGLVRLVAADPAQLLPEVEPVDAADLAPVAARAFHRTRKLRPAAAAWLRAHPRTAALRLLPETLGAAGPDRDAADAALRFLSAEPAGRAALDAAVAAYAERDPGVPGAVAAGVDSDPLEQVPSKPPKLPDWVVPAALPRPVLRSGGALPDAAVTALCEMLAFSDPLAPYAGAAQVRAACTPESLDAFAVALFQSWIAAGAKATGEWAMQALALIGGDHAARDLTRQIRAWGQAGLKPRGKAGIAVLAGIGTDVALMNLSAIAEKSPLLQLREAARAAIVDAAEARGLDEVDLADRLSPDLGLDARGGLDLSFGERRFRVGFDETLKPVLRDAEGRRLAALPRPTKADDPESAKAASRHWAALRKDAEAAAGLQITRLEAMLASQRRVAPGVFWPFFAAHPLIRHLAGRLAWGLYPDAAPATPPGHVFRLAEDLSPTDAADDALALDVAAAEGVVGLVHPLHLDPEERTAWSGLFADYEIAQPFPQIARETFAFTEAERGAAETHRFDGVRVGGRRLRGLRPQGWSTDTGSEHVHAVQRPVALPDGTRLVAVLRFEDGFWHRPGPEGDGIQTLRTLTLSDTGWRAAAAHRFGDLDPVTASEVLRTPSLLAASGDA

SEQ ID NO: 1213 - protein, 1164 aa, Methylobacterium sp.
PRPAAVFAAVPLPTRLRPGPRPDAAEAWRAIAAPLAAALGDAEAARLAGAPPDRDGLAAWLDAIVDAAEARRQGNPSRAATGDAVLRGALEAVLRYAVAEGGTEAVARLADRRRPTPKTPRAYQRLSWAEPLHLALRAALVHAPEADYDAAVALLNARIAEDHDWPAACAFAFILADDRAAPHPLQPVAVVEAAASAGIDVAADTAYLPLLADAPPEAVARWRAKRSYHLYFVYCALDAAEAAATLLAVARAAGQPALPALDWLLHYALDEQRRTVALAILSTGEAGALPVLLPHLHEKPVAAALDAALEADPAAILPRCLAALAGGRSEPALRARVNRALDAHGLDTVRGWLAASGGRGAGILDALAEARAVPLAEPAAWPRVLRDPPWRAKARTRDDLVLALAPLPTPFAHAVPEVAPSYWRARNAVTLDGPEALRAFVAAAELSHPTQGWSRIPPPLSEPPRDDPPALIAWVAGRVAQIDEACHYWANSPYRQLVGSLERQPEPLALALWAQSRVVAGCFHVSQWPEIVWAMLSRFGERAMPGLVGLVEADPVGLLPAVLAVDDGRLAGPAARALTKLKKAREPALAWLRRHPETALTRLLPDAVGRPGALRDAGEHALRVLAQDRADGRAIIASVVARYADQAPDVTEAVAQVLDRDPLARVPAKVGKPPAWVVPSMLTRPRLRDGTALPDAAILTLCEMLSFTNPDAVYAGVPMVREACTEASLAAFAWDLFSAWIAAGTPSKDGWALRALGWFGTDATARDLTRLIRRWPGEAAHARAVTGLDVLVDIGTDVALMNLNGIAEKLKFKGLQEKARQKIAQLAEARGLTPEELADRLAPDLDLDERGGLDLDFGPRGFRVGFDETLKPWVRDAAGQRLKDLPKPAKADEAGKAAAAVARWGALKKDARAVASLQVARLEAMLAGARRVQPTVFGPCFAAHPLLRHLAQRLVWATFADADPRTGPGLTFRMAEDLTFTDADDAPLDLDLTGAAPGLIGLVHPLQLDAGALAAWGALFGDYEIVQPFPQLARETYAFTEAEAAASTTSRFAGTVVEANRLRGMAARGWPLGAPQDAGVVWWIERAVTFPGGAAGQASLTFSEGLFTGAVEFEDREQTLGDLTLGSPWSSRSDPGQRTFGELAPVTASELLRGPSLLAGTRLR

SEQ ID NO: 1214 - protein, 146 aa, Methylobacterium sp.
MCNLYSGMPSADYEGETRSIRLGGHSTSIRIEVMFWNVLEDIAAAQGMTLPRLVTLLYDEVLALHGEARNFASLLRCACLRHLEMKADRLASAQRRAVEQRGRVAGDVDGALDRIDDRDVGVGHVARTARALRGDAVRPRDARGEG

SEQ ID NO: 1215 - protein, 508 aa, Methylobacterium sp.
MDEPVDVVVVGAGPVGLLTAIELTLGGARVRVLERLTEPSTTIKALGLGPLGVEALQRRGMGAAIEAAEARSLAAMDRLPGQVGGGPRGAQFSGHFGFLFIRRGPQAEPDRRMRAVDQQSLEAMLLDRAAALGIDLRRGCTLTGFTEAADRVEVAWTAPTGDARVRCAYLVGCDGGRSAVRKMAGFAFPGTPPTLTMYQAIADLDDPAGALPVGWHRGPGGVYGHGPFPRRLFMLDFSGPPADRQAPVTRDEIETALRRVSGTDVRVARVAVANRWADNTRLVDTYRRGRVLLAGDAAHVHAPFDGQGLSLGLGDAANLGWKLAAVLRGEMPETLLDTYTAERRPVAEAVTANTRAQAAILRPDPQSGALRDLMARLLESDEVSRILGGLMRGLSARYDLGSPEDAVGRMAGDGPLGAGGATLYGAMQDGRGLLVDGSADGAASRMVAAATGRVSCVAVPDGPSTLVRPDGCVAWTGAATALDGLREAVGRWFGPSPAGPLGAPAPMC

SEQ ID NO: 1216 - protein, 377 aa, Methylobacterium sp.
VQLIPAEAGPTRSSCLGVEAHARAAPDWFATLYRFLFFAGSTVSLPLEHQGSRIGIVEADFDPDAVVGSAWIVLKQVSGALAAMTVVLCVLVYGAVAHALRPANEILIGIDRVAKGDLAWRLPSLRLRELRRIATVFNQLASHLQVATRERAELARRLIDAQEQERRWLSLELHDDVAQRLTALSLLARSIQEGARSSSPSVVAESAELATMASDAVRALRSTLAALRPPEIDDLGLRVALRSLIAAQAQRAGGRIHVTLAADAQADRLPSDAAAHIYRIVQEGLTNAVRHAAARTVAIALNVAETDGGAEVQLILTDDGSGAPVEALERPHSGLGLLGMRDRVHALGGQIVTETAPGGGFRLRVRFHAALAGDEVS

SEQ ID NO: 1217 - protein, 158 aa, Methylobacterium sp.
MASVVHRGPGPNAVIGGMRVSYLARSDETADGLGIYRVAMDPRTPGAGLHRHARLTETFSVEAGRLALHVDGADHDLGPGDFALIPPGVAHAFANRGDRPVRFTLSFAPALGREGFFEGLARLAVEGRLGDAAAMTDLMARYDQEPLAGFAGWSSVSG

SEQ ID NO: 1218 - protein, 97 aa, Methylobacterium sp.
MMAARRWLSATGLALLPTTSQAALPPSWQRVREVQAVAEAAARVLGSRPIDAVERVDGERYRVRAGDCRVTVRVVVRPRAQPGPQAFDAIPDAPDCP

SEQ ID NO: 1219 - protein, 812 aa, Methylobacterium sp.
MDKRALSERDICTKFITPALEKAGWDVVSQIREEVTFTKGRITVRGKLVTRGKSKRADYILYAKPNIPLALIEAKDNNHSVGDGIQQALEYAETLNVPFVFSSNGDGFLFHDRTGGSTQAEINLGLDAFPSPNDLWDRYRSWKGLNPQAEELVLQDYYDDGSNKAPRYYQVNAVNAAIEAVANGHDRILLVMATGTGKTYTAFQIIWRLWKAGRKKRILFLADRNVLIDQTMVNDFRPFGAAMAKLSTRSKTIERSDGTKADVPLALDNKRRIDTAFEIYLGLYQAITGPEERQKLFKEFSPSFFDLIVIDECHRGSAAADSAWREILDHFSTATQVGLTATPKETAYVSNIDYFGAPVFTYSLRQGIDDGFLAPYKVVKVHIDRDVEGYRPEKGQLDREGNEVEDRIYNAKDFDRTLVLDDRTKLTAKKVTEFLKESGNRFQKTIVFCVDEEHAARMRQALVNENEDLYGANHRYIMRITGSDKEGQDQIGNFIDPESKYPVIVTTSKLLSTGVDAQTCRLIALDRSVGSMTEFKQIVGRGTRVHEDTNKLFFTLIDFRGATSHFADPEFDGDPVQIYVPGAHDPITPPDETLPSSDNAPSPIPISAENGDEPPYAPNSSGGRIRKIYVNGVETKIIAERVEYLDEHGKLVTETLRDFTKAALKKRFASLSDFLKRWKAAARKQAVVEELAAEGLPLEVIADELGKDLDPFDLICHIAFDAKPLTRRERAEQVKKRDVFTKYGEQARSVLDALLAKYQDEGVLTLDNTNDLKIAPFDKMGTVVQLVKAFGGKTDFEKAVHELQDAMYQEVA

SEQ ID NO: 1220 - protein, 134 aa, Methylobacterium sp.
MDDRQMARGLAWFGIGLGLAETFAPRRVAAATGLDGHEGLIQLYGLREIASGAAILAAAEPERLLGLRVGGDLLDAGLLAARATPSNPRRNRTLAAALAVAPVVMLDAAIWLRARDRRSQSPGDPGRKPGAIAR

SEQ ID NO: 1221 - protein, 301 aa, Methylobacterium sp.
MATFARSEVLAPDRAPRARPRIPPGVGDVLPGTLLVVLALLGPLALMLRYSFNRFVPGELMVEGLTLANYAKFLHDSFYRDVLLTTLWVAALSTLICLVLGFPVAYALVRQVGQRWKSKLLILIILPLLMGNAVRTAAWMVILGDKGLLAALLSGVGLTPTRLMYTPTAVVIGLVSVTLPFMIVTLQSVLERIDPVLEEAAESLGAGHLTILRRVVLPLALPGLLAGTMLCFILSMNAYATPVLIGGPQFHMMAPEVYQQVAKAMNWPFGAALAFVLMSVTLVLTTTANVLVQRRYRRWSE

SEQ ID NO: 1222 - protein, 272 aa, Methylobacterium sp.
LAAIWLTALIRALTSGTVVVLASVLAEWLGPVWGALVVSLPVSAGPAYVFMAMEHDAAFVAGAALNGFAANAATGLFLIVYAHRAAGRDMTATLGPAILAWLAAALPVSALTWTPTTAFLLNALVYGAGALSTRHVVRATLVRSTVVARPRPLDLLIRASAVALFVAALLALSTALGPARTGVIAAFPVTMTSAFVILHRRIGGAAMARLASVAIRGVFGFGLTLLTLHLMIQPYGAALALTVALLVSLIYSAGLLVVQPRPGRQEPGIVTR

SEQ ID NO: 1223 - protein, 297 aa, Methylobacterium sp.
MSGLPRAAPDAVPDAVPDVIPDTAPAPAPAAAPLARTGIRRRGGILVPTVSAATVLAALGLWLVATRAGWVKPLFLPPPEAVLAAFGQAWRGEIDGAPLGLHIGDSLLRVLGAFALAALVGIPAGLAMGTSRIARGILDPPIEFYRPLPPLAYLPLMIIWFGIGELSKVLLIFLACLAPVALAARAGVRSASVDQINAARALGASRWQVLRHVVFPAALPEILIGLRIGMGVGWTTLVAAEMVAAQAGLGQLVLNASNFLRTDVVVMGILLIGLFAGLFELGMRGLERVLVPWKGRH

SEQ ID NO: 1224 - protein, 153 aa, Methylobacterium sp.
MRRALAALALALPPAVPLTAAADDLPPPVAASAARAEASCGSEPATLKPGFITRQDVNGDAVPDFILDFAAVQCGDDGSAACGTAGCEMQVFASTTDGFVDAFDAVAHDLRFRTVGGRPAVIVDMTGATCGRSGQDPCGAIAVWNGRTFGRTR

SEQ ID NO: 1225 - protein, 149 aa, Methylobacterium sp.; identical to SEQ ID NO: 151

SEQ ID NO: 1226 - protein, 250 aa, Methylobacterium sp.
MRILLLNPNTSAAMTARMARAAEAALAPDAHITALTAATGLPYIASRAEAQLAGAAVLETLAAHHSGHDAAVIAAYGDPGLVAARELFDLPVVGMAEAAMLTACQLGARFAVVTFAPALLPWYEDAVALAGLSARCAGLHAVRRPFQAVTDVQDELRPEILALAERAVGEGADVVILAGAPLAGLATVLRDAVPVPLVDPLAAALGQAQALVRLGTRPPRAGRFARPPAKPATGLAGPLARWIAHREEES

SEQ ID NO: 1227 - protein, 472 aa, Methylobacterium sp.
MNAPVPAPRTRPDAATIAGLAEALRAVLGDRVTASPAVREQHANQLTWAPCEPPDLVVFPHSTAEVQAVVRACAERDMPIVPYGVGTSLEGHVNAPFGGVSIDTGAMNRVRAVHADDLDCTVEAGVTRRALNAYLRDTGLFFPIDPGADATIGGMAATRASGTNAVRYGTMKDAVLGLTAVMPNGDIVTTARRARKSSAGYDLTRLLVGSEGTLGIITEVTLRLHGIPEAISAGICPFPSIKAACDATILTIQSGIPVARIELLDEVQVAACNRYSKLALPETPLLLVEFHGTDAGVHEQAERFGEIAADLGGGPFDWATGADERARLWQARHDVYWASVALRPGPTIKNMSTDVCVPISRLAECVEATKRDIAATGLTAPIAGHVGDGNFHTLPLVDADSPEEMSAVAGFLDRLVARALDLGGTCTGEHGIGQKKMRFMESEHGPEALGLMRTLKRAIDPRNLMNPGKLIP

SEQ ID NO: 1228 - protein, 158 aa, Methylobacterium sp.
MTRRYAADTSVPMDRSISEIRTTVRRYGASEFAHMESDTQAAIHFTMRGRRILFRLAMPDPTAGEFVLTETGKVRSARVAEAAWEQSCRSRWRALALVIKAKLEAVEVGIVVFEDEFLANTVPPGASVTFGEAVREDMRLAHEKRELTPLLPYLGGGE

SEQ ID NO: 1229 - protein, 484 aa, Methylobacterium sp.
MSVRNIVKSVQDIMRQDTGIDGDAQRISQLCWMFFLKIIDDQDQELELTQESYRSPIPAKFQWRTWAADPEGITGDRLLTFINSELFPTLKELSLTGQEGDRRRVVRDVFEDAYNYMKSGQLIRQVINKISSVDFNDLSERQHFGDIYEQILNDLQSAGNAGEYYTPRAVTAFMVDRIDPRPGETLFDPACGTGGFLSCAIRHMRDRYVKRTHEEWALQGGLRAVEKKQLPHMLCVTNMLLHGVEDPSFVRHDNTLARPLISWGKDERVDIVLTNPPFGGREEDGIENNFPAFRTKETADLFLALIVRLLKPGGRAAVVLPDGTLFGEGIKAKLKEHLLEECDLHTIVRLPNSVFKPYASIGTNLLFFEKGTPTRDIWFYEHRVPEGQKAYSMTKPIRLEHLQSCMDWWGGKDRKGRVETPQAWKVSADEVKARGYNLDCKNPHAVADDHGDPDTLLGDLVRAEAEAASYRDQLKTILAEALTR

SEQ ID NO: 1230 - protein, 368 aa, Methylobacterium sp.
VPVTDDITFEPDWFSKPGDTIVSLMERRQVTPCDLGGVIGGGIDTLRGILAGSVTIDAPLARDLSNALGGSADFWLRRQANYDRALDRVVRVATVSEGERWLELVPVPGPQPRPRPGVDGRMDAVRRRLVFFDVNNLRTWTTRYGSVRSETQFRTSPTLVSDEGAVAVWLRRGELDAALVVTCPWDADGLRGRLDEIRALSRIGQPSRFLPKLRDILASVGVALVVVRAPRGCRASGATRPLASGKRMLLLSFRFRADDQFWFTVFHELGHLLLHDGQTFVDDEETLQDDREQEANAFARDCIVPPQLRAEFERLPPSRKSILRFSVSVGIAAGLTIGQMQHGRMIGHEQFNSLKRRWTWDEIEPALG

SEQ ID NO: 1231 - protein, 252 aa, Methylobacterium sp.
MMRALEGQVAWVTGAGSGIGQAASVALARAGMRLALTGRGQEALARTAEMVRAAGGEALVAPADMGVADDVQRAWEAVHAAWRRCDLLVNSAGLNVPQRGWSEITPAGIDAVVGVNLNGPFYAARAVLPTMRAQRSGLIIHVSSWAGRYVSKLTGPAYSAAKHGLVALSESLNQEECGHGIRSCCICPGEVATPLLDKRPVPVTAEDRGRMLQPEDLAETILFVARLPASVCVNEILISPTWNRGYLEGVKL

SEQ ID NO: 1232 - protein, 536 aa, Methylobacterium sp.
VGVQVSSVGAVMMEGRKAAIRAQVESAHGIVAAFARQAEAGAVSADEARRRAAEALRAMRYNGGDYVFVYSSEPGNIGRNVVHPDPKIEGTRSRDDAAMKKTFVWTMIQHAREGGGFTEYRWARLGETEPAPKVAYSLAYEPWQWVINSALYVDDIHALDRARMVTTLLWLIPLAIGIGLVGFLLARSITRPLSAFTAALRRLAGGATDVAIPGLGRRDEIGQMAEAAGVFRDSMIEARTLSTEQRAEQERRQERAQWMEAVTRSFDTEASQLLARVDTAAAGMREACRAMADTAAQASRQAGSAAGAAQQAAANVQTVAAATEELSASIGEIGGQVTKSAAIAGQAVSEAERTDRQIRGLAGAAERIGEVVRIISAIAEQTNLLALNATIEAARAGESGRGFAVVAAEVKGLAGQTAKATEEITAQIAAIQGETTEAVGAVHSIGRTVDTMNAIASAIAAAVEQQRFATGHISQNIDEAARGTDAVSANVVSASSAAEATHRVAGEVGAAAGDVCRSAEALRAEVMRFLVEMRAA

SEQ ID NO: 1233 - protein, 401 aa, Methylobacterium sp.
MTRDRKLKVVAVAGSGTLFFHAAVLGTFLAASAAPTPLYRFYQETYALSPVLTTAVFAVYALALLKALLVAGSISDHLGRRPVIFGALLLELVAMALFTTASGAWGLIAARFVQGVATGIAASSLGAALVDVDRARAQLVNAIMPLIGMAAGALGTSALVQYGPHPLHLVYAILGAVFAAQAALLWLTPETGERRAGALRALRPRVVVPPQARRPLAAITPTNIATWMLGGFYLSIVPSLVVAATGSRTPLTSGVMVAALMVAGAFAVLQRRGRDAAANLTIGTLAMTAGLVIVLAGMHGGSVPVLIGGTLVGGAGFGTSFLGALGTIVPLAKPSERAELLASYYVESYLAFSLPVICAGYLVRRIGYVTTADLYAAAILAMSAAGFLARRALTSRRVSPG

SEQ ID NO: 1234 - protein, 88 aa, Methylobacterium sp.
MLRDNVERGRFELQVGGDVVFATYRREPGQLVISHVYAPPVLRGTGAAGRLMEGVAAHARAEGDRIVPLCGYARAWLRGHRTHRDLLA

SEQ ID NO: 1235 - protein, 513 aa, Methylobacterium sp.
MATSLIRSRRMITRTLDHDRWEEIADGAVLQKDGVIAAVGTYADLHARYPDAPVIGSGREILLPGFVNGHHHVGLTPVQLGSPDMPLELWFVTRMVARNLNLYLDTLYSAFEMVGSGITTVQHIHGWMPGSLEEVEARSNEVLRAYRDIGMRVSYCFAVRDQNRLVYQADRDFVASLPAPLQDPMKRWFERFQMSLEDNFSLFRSLHAGQEGASRAKIQLAPANLHWCSDAALEGLAGLSESYDVPMHMHLVETAYQKAYAEKRGGGTAVEYLDRFGMLGPLLTLGHGVWLNESDIDRVAATGTCICHNCSSNFRLRSGVAALNRFEAKGINTAIGLDEAGINDDRDMLQEMRLVLRAHRVPGMDEADVPSMAQVLRMATVGGARTTPYGDSLGTIEVGKGADMVLIDWDQIAYPYLDPETPLLDAVIQRAKTGGVTAVLCEGEVLYADGRFTRVDRDAALKALHDDLSRALSDDEVERRQLSKALLPHARRFYADYIDPSRHEPFYRPSSRV

SEQ ID NO: 1236 - protein, 268 aa, Methylobacterium sp.
LASDPASEDAVACRGVAKVWAAGTARAHEALRDIDLTVRPGEFVVFLGPSGCGKSTLLYLIAGLEPTSGGELLAFGEAVTGPSPERSLIFQETSLLPWLSVWQNVSFGLSLKGVPEAERRSVARAALQRVGLAEAFDKRPDELSGGMRQRVAVARALAMRPKVLLMDEPFAALDVQTRQKMQDFLLDVWRDSGASVLFVTHHIDEAVALADRVVVFTARPGRIKTIVRNDLARPRDPFSPEAEALRRHLTELLRDEVDRAFAEQEALV

SEQ ID NO: 1237 - protein, 309 aa, Methylobacterium sp.
MATFLARAAAVPQDRPRLPLGQRLALPEGFVPLLRRIGWMLVSVGSFAGLWELLWALGIADAKLLPPPHIFLGNLAEQARFFNTAQRWQIGTGMNTGPSPAMAVLITVLASTGRVLAGLALAASLSILVGVAIRYFKLFERLTLPTITLLAPVSPIAWLPVAIFMFGIGNAPAIFMVFIALFFTMVLSTIQQIDGVNRNFINVARTMGASKRQIYARVIVPAILPGLLAVLRLNLFGAWMVVLVAEATGVGYGLGQVIMLARNTFNPSLVFFTITLIGLLGFAFDLLFRLVQRRLLYWLPRDAGSSLGL

SEQ ID NO: 1238 - protein, 350 aa, Methylobacterium sp.
MCDRHGDYRVPDLTRFKPSRRRFLGGTAAALTLAVGPGLTSPAAAATGIRATHGTGFCNLNFFLAEAMQLAKDDGLTIDFVNTPTFSDQVTFLGMGQVDAGVMPYTSFMALYDAGAPVKIVAGGGIEGCVLVAQPGLDSPEKLKGKTLGTFQLDTLEVLPYDWLKKNGVAFKDITVRYMGSTPEAVEAFRAGALDIISTIEPYGTALLTDVKGAVKLSDGTDIYGKGYTDCVLAVRNELIAKNPAAVKALIKGMMKAQALAEGDPQAALNKLVGSYYKTSMSNAQLAMGRQPSVVDARNQTQFILDRTDSVAEMGYIKKKPGRDAIDWTLLEQVIAENPDLYGKLKLKSA

SEQ ID NO: 1239 - protein, 317 aa, Methylobacterium sp.
LADSAHTADRSIPPCPITGAPALRCVERLDAGFLTLLWHYSGRVDVGPLLRPAGTFRLWESPTGLIFFDPPVAGDAAFYRAFYGRIAAHDKLAGPETERLEFRQAAAHVPSGARVLDVGCGHGGFRAYVPDATYTGLDPNFSAEDPTGAILDETVEAHAARVGPVYDVACAFQVIEHVADPLGFARALAACVKPGGVVLIGTPLWPSPNTTVPNFVINAPPHHLTWWTPRALEALAGTLGCTPEAVHAIGMDRHDSLIHWMAKVSPVRCRDRFFRRTWSWAAALAFAYGVGAVLDRVLPVPKRTRPNALLLAARKAA

SEQ ID NO: 1240 - protein, 488 aa, Methylobacterium sp.
MQDEAPDATAEITLVKGARWVVAWDPDSGSHVYRTGADVAFADGALIHVGPGYAGPEPARTVDASGCLVMPGLVDIHTHLFSEPMNKGMWDEVGSQRLYNTSLYEYLPILRPDAEGTRAAYGVALAELALSGVTTVCDLALPSAGWLDLLGASGLRVCIAPMFRSGRWLTRNGHSVDYEWDAAAGQRGLEQALAEIAAAEGHPSGRLSGMLCPAQVDTCTAELLRDAHSEAVARDLRFHTHAAQSLSEFHEITRRTGMTPIEWLDDLGVLTERTIVGHGIFLDDHPWTHWHSPGSDLRRLAERRATVAHCPTVFARRGIALHHFGRYLQAGVNMGIGTDVYPHNMLDEMRLVSYLARVVAENPRDTRAADVFHAATVGGARALGREDIGRLEPGCKADFVLVDCGHPAMRPCRDPVQSLIYSAGDRAVRQVFVGGREIVRDGRALTIDYAAAAAALEEAQGRALAQVRQLDWAGRGPDAIAPPTFPGL

SEQ ID NO: 1241 - protein, 226 aa, Methylobacterium sp.
MRPRDTTEPARILIINPNASRAVTAAIDAALAPLRLPGGPILAVTDLPEGPESIATQRDADSVVMPLVRCVADDPSDAFVIACFSDPGLHAVREAASGRPVMGIAEWGILRALTLGERFGIVALSEGSVRRQRRTVRQMGLGDRYAGSRPVEARASETADAAMGPRLIAAGRTLVERDGADVVVLGCAGMVRHRAAAEAAIGCPVIEPCQQAAAAALGAVLLRAAP

SEQ ID NO: 1242 - protein, 511 aa, Methylobacterium sp.
MSAMPTRAPIPDQAFDVVIAGGGSAGAVLARRLSENPNRTVLLLEAGPAYAPGAYPDVIANANWVGGDAAHDWGYHTQDRSGLGHDVRAIRGKVLGGSSGVNAAVAMRARPSDFARWTARGLDGWSWDEVLPVFRALENTPAGDDARRGRSGPFPIRQRTMEEITPSMRAFVLAAEAAGLSRIADFNGAEQHGVSPYPLNVVEGRRVNTGMAYLTEDVRRRPNLAIVGGAEVDAVLFDGRRARGLRLLGGATVEAGRVILSAGAFGSPAILMRSGIGPAAHLRDLDIPVLQDAPVGERLKEHPFYYNVYALKREVRAMDPVAGAIIWTRSREAAPDELDLHISGTHIFDPAQSPTGGAIVLACSVTLPRSVGSVRLTSRDPRAMPLIRYNFFEDPADLRRMLEAVRLSRRIGRTAPFSDVVAAELYPGPDVRDDDALRRAVLSAVDGYAHPTSSVPMGGRDDPWAVVDGSGAVRGVDGLNVVDASIMPDIVSAPTNVTTIMLAEAIGRRLG

SEQ ID NO: 1243 - protein, 166 aa, Methylobacterium sp.
MKDRWLGLRADDCVTPSGHIVDPYYVLETPDIALVLGIDAADHVILVRQYRHAHGGPSLELPGGAIDPADPDILAAAEREMREETGYIFADAERVVTLNADPARYANRMHLVRARVTAAGPARPDPAEDIAVVRVPRAEALQLAQSGAIVGAVHAAMLLIGLSSTG

SEQ ID NO: 1244 - protein, 252 aa, Methylobacterium sp.
MDSMERANGTTRLGMLTPSSNSVLEPATAHLLAGVAGVSAHFARFRVTEIGLSAAALDQFDPEPILAAAELLADARVAAILWNGTSGAWLGFDADERLSAAITDRTGCPASTAALAFRDLFRARDFRRIGLVTPYTGDVQRRIQANWGAAGFDCAAERHLGLSENFAFAETGPEAIAGMVRAVAAEGVDAVAIVCTNLAGAALAPALEAELGVPVVDSVAVTLWKGLELAGCPTAHLAAHGRAFAADGAGRP

SEQ ID NO: 1245 - protein, 304 aa, Methylobacterium sp.
MDTAPDDPRRPENRLAYRAAVDRPRLTLPGGKHVAVWPVVNVEHWLIDNPMPRQILVPPTAASLLPDIPNWAWHEYGMRVGFWRFLEAFASRGIRPTLSINGSVCTAYPRVAEAAHAAGWEFMAHGFHQVPTHRIPDQPAMIARTIAAITQTTGRPPRGWLGPGLTETLDTPDHLRAAGLEYVGDFVVDDRPCRVATRTGDLVALPYSVELNDIPLLAIQHHRADEFVERALAHLDRLAAEAAGPGSLGGAKVMSFAIHPYITGVPHRIGLLERLLDAILARDDAVFMQGVEILDWYRATGDES

SEQ ID NO: 1246 - protein, 99 aa, Methylobacterium sp.
MSRQRKRDAVLRLLRGEDLESVSRGLGVTAATLSGWRDAFLAAGEASLSTRPLDADALESGRLKAKLGEMLLERELLEAKVAALEARGAGPLARRRSRP

SEQ ID NO: 1247 - protein, 133 aa, Methylobacterium sp.
MPKFYFHLRGPDGLDHDDEGLDLASVEAAYLEAFKAVPGMGSDLASTAKNPIRYGFEITDAHGTVLMAVPFAEVLDRGQKRTKQPAKLQLHKGRAEMRRTAGLIVELREAHAKLNVTLAETQRLLDIAKRTGR

SEQ ID NO: 1248 - protein, 120 aa, Methylobacterium sp.
MQRQTLRDWVHRYNVDGVAGLMDRPRPARPGLLSGAQRAEFDRIVEAGPDVAADGVVRWRRRDLKRVVEARFGVVMAERTIGDLLHARGFRHVSVRPRHPNCDAAAQADFKKPSPRGSRR

SEQ ID NO: 1249 - protein, 49 aa, Methylobacterium sp.
LDDYVTADNLVQVIKVFIDELDLGALGFTRFEPAATGRPAYDPAMLLKL

SEQ ID NO: 1250 - protein, 533 aa, Methylobacterium sp.
MMTRIKALLLGSSALMIPIGGAYAADLPTFKAAPVEFVSVCNAYGAGFFYIPGTDTCIRLSGRARYDFLYQTSKVRTGGGGDLTGYLGLMRLNLDSRTQTDYGTLRAFLRLDVANRSGPFLTSGSRQRESLAIAGLGADAFGRTQTYVNADKAFIQFAGLTAGRASSFFDFYAHDFELIGGTAGSDTFSTNLLAYSAILGNGITLTASMEDPTYRRFPIFGTGSAVGAFTAGGGFAGYSNAFNPFTPSTWLAPIVVGPGNVAFVDVTQKSRMPDFVGAARIDQAWGSAQLSAAVHEINAGDAGSTVAGITTATTGLGISPTGRASNAYGWAVQGGLKVNLPFIATGDTLYLQGAYGQGAIAYTGISNYTAPYDALGAAPVGGGSFAQYYADAVLDPATGRLELSTSFSAVASLLHYWSPAWRSAFFGSYAQIDYNSKGRNALGLLGFGFAPAGASASNALAFATSPILRGNNQMITGASLIWTPVKDLDIGVEGEYIRTALNSGVTPDISKNALRYVNSQDAAQFRFRVQRDF

SEQ ID NO: 1251 - protein, 97 aa, Methylobacterium sp.
MKNIVLACSMGAMLIAGPALAQDGGATIDPSLIVRTNGSGLDAWSASEGNDKAGGMWEGATGYSAAIQRPSAVETVPANRQWSHLNSRERRRGQPAY

SEQ ID NO: 1252 - protein, 461 aa, Methylobacterium sp.
VRLLEVRRTSGFRVACLFFATFGTASLALSGFLYVDTRSYGRKAAFEWVEWESKHLLNLSPRALRERIDASEDFAEGGRPLVLFGPDHVRRAGAPIAFPDRAPIGKPFILAQPLDHRSRTLFSQLTELPSGEYVLVSRSAQDLQSLEKALVETFVWGMAATIVIGLIGAVVFGAGSLRQNDAITKAVERIMRGDLSERLPTRGVSADLAHLTRVVNDMLDQLERLMLEIKGVNENIAHDLRTPLTRVVGTLERSLRKADSVAAFRAFNEDVLAEVKSIVVRFSALLRISEMEDRLRRSGFTQVDLGRLLEDAVEYYEPLAIERDIRLLWERPDGPCAIEGDRSLIFEAVSNLIDNALKFTPAGGQVTVALLRNPTGIQVTDTGCGIPAEELSAVRARYRRGALKTDKSGFGIGLSLVDSIARLHSATFDIASDGSGCRVTLSWTHSVAGHPSIDLLPAASL

SEQ ID NO: 1253 - protein, 222 aa, Methylobacterium sp.
LVVEDDRRVAAEIGSALAEYGFQVDEAPSGSIGLRKALDGNFDVIVLDRMLPEIDGLSLLTELRAAKVSTPVLILSALSAVNERVDGLRAGGDDYLAKPFEFIELTARVGALARRKMAAEAVNELVVGDLRLDLIERVLHCGNREIELLPKEFAIIEFLMQNAGTLVSRKMIFESVWGYSFNHQSSVIDVHIGKIRKKLDPDGLNPRIHTVRNTGFILRAPS

SEQ ID NO: 1254 - protein, 461 aa, Methylobacterium sp.
MTRFNDAPGSGAEAAARAHQHAVEIDPLRQDGAGEALVHAVPPPPRKRPFLVAFLALGSALGLGAWHHWETYQASLETQAEAVNFVPTVRTGPAQVDDGPMTLTLPGQTEAFDHADIFARATGYIAERRVDIGSRVKKGDLLVRIAAPDLDQQARQAEAQLGQFKAQLAVAQADVEQAKASVTLANVTDARTATLAGQGWASKQNADQTRAGMLTATATLAAAQAKVKVAEANITAQQATVDRLRTLTTFENVVAPFDGIVTARKVDVGDLVHGDAGSGTPLFTVDSTDVLRVAVQVPQSAAVGIRDGVKARVQVAQIPDRTFDGTVSRSSVALQSSVRTLDTEVDVANPDGILRPGLYVAVTFAVPRTHPRVIVPSEALIFDAEGTRVAVVGADDTVRLRPITIARDLGTRLELRSGLDSGETVVLNPPAGLQDGSRVVPRGSVASQVPTAKLSEQASAE

SEQ ID NO: 1255 - protein, 404 aa, Methylobacterium sp.
MASIRSCVLSVAIGFAALAGPAVAEPIRVKVGVLNDMSGVYADTGGKGSVVAAQMAVEDFAKTEPGVQVEIVSADHQNKPDIGAAVARQWYDRDGVDAILDVPTSSVALAVSQVTREKNKVFIDSGAGTTELTGKQCSPNTIQWTYDTYALAHGTAGAMLKRGGDTWYFLTADYAFGLSLQNEAKAVIDTGGGRVLGAARVPFPATDFSSFLLQAQASGAKVVGLANAGGDTVNAVKQAHEFGLTDGGQKLAALLIYAVDVHAIGLQTAQGLVLTESFYWDLNPETRAFSERFYPRNGNSMPTMNHAGVYAGLLHYLKAVAATKSTDPQKTMAWMKANPTDDPLFGKGVVRADGRKIHPMYLFEVKAPSESKGPWDLYKVLETIPAEQAFRPLAEGGCPLVAKP

SEQ ID NO: 1256 - protein, 541 aa, Methylobacterium sp.
MQTLRGADIVARTLEALGVTRIFTLSGNHIMPVFDALLETGISLIHTRQEAACVHMADAWGRLTGEVGVALVTGGQGHTNGAAALTTALAAESPVLLLSGHAGLSELGRGAFQELAQADIARPMTKAAWTAGSVAALGPDLARAFRIAREGRPGPVHLSLPVDLLETAVPAASVRIPDRAAAAIRIAEPAPDLVADLLAALAGAERPLIACGPALCDASGRAAMATLEETLGLPVVGMESPRGINDPALGAFAEILARTDLLVLLGKPLDFTLRFGAAPALAPDCRFAVVDPDPALLARAPADRLAVSGLADPRPVLAALTARATALPRREAWHREARAALAYRPPAWAELRGGGARLHPVELCRAVDAFLERHPDGTLICDGGEIGQWPQALVRAGRRLINGVSGTIGASIPFAIAAALERPGAPVVAVLGDGTFGFHMAEFDTAVRYRIPFVAVVGNDARWNAEHQIQLRSYGPERTRHCDLLPTRYDAVVQALGGFGVLVTEAAELPAALEAAQASGLPACINVMIASVAAPVIRRPG

SEQ ID NO: 1257 - protein, 247 aa, Methylobacterium sp.
MVNEHVAIRTEDGVCGTHVVAPDGAGPWPAVILYMDAGGIRPALVDMARRLATGGYLVLLPDLFYRYGPYGPFVPADVFKGDFRAILGPLMATTDNLKAATDTAALLAYLDTRDDVAGRAVGAVGFCMGGRMAITAAGTYPDRFAAVASFHGGNLATEEPASPHRLAPALRAEVYIAAAENDGSYPSAMAERLETALSRAGVRYAAETYPAAHGWMMPDFPVHDRVGAERGWAAMSALFDRTLRSTG

SEQ ID NO: 1258 - protein, 263 aa, Methylobacterium sp.
MPPAEGTPIWFELNASDPDAAQAFYEAVAGWRVAPSPMPEHGGYRIAEADGAPVAGIRRPMPEAPGLPGWAVYLATSDVDALASRAVDLGGAVRFGPVDIPHVGRFAMVSDPQGVVFAAMDPARPGASRAFGPVPLETERTRGHGVWIELATPDPAAALAFYGALFGWEKLGAMPMGDLGEYAFIGRGDLRPGAMMSSAATGAPARWNWYIHVADIDAALATVRAAGGTVLQGPDPIPGGSYAANIADPAGHQLGLAGPRQAT

SEQ ID NO: 1259 - protein, 48 aa, Methylobacterium sp.
MSKSKPPTNALLTPEKRTEDVDQTIRPLSLAEFIGQRAARANMQVFIE

SEQ ID NO: 1260 - protein, 477 aa, Methylobacterium sp.
MTRIDADGPLWTLSAAALGRRYAAGTASPVAAPRACLERAEAVNPTLNALVAVDPEGAERAAAASAARWRAGQPLGPLDGVPLTVKDSLNVAGFATGWGSRLYAGEGAGQAVERDETPVARLRAAGAVILGKTNVPELTVQGYTGNPVHGVTRNPWDPALTPGGSSGGAVAAVASGIGPLALGTDAGGSIRRPASHTGLVGLKPTAGRVPRTGGLPPIMLDLEVVGPMARTVDDLAAAMRLLGAVDPDAVAPHGFGPFGTTAVPERPLRILHVPAFGTAPVDPDIADSVAEAAGRLAGLGHRVEIGRFDAASAITEAWPVLGQAGIAWLMRAHPGGRDALGPDIRALAEAGAALSAADLFEVQRMALALRRDLAAQFADHDVLMTPAAAALPWPAEDTHPPRIAGVPVGPRGSATFTGFVNAAGCPGISIPCRPSGAGLPIGFQLVAPWGGDETLVAMAAAYEAAHPWRMVWEESAP

SEQ ID NO: 1261 - protein, 66 aa, Methylobacterium sp.
MAYDRPAWTGSTPYDVETTGSFGAPFGGRYDRDPWTCPQSSAAEGNANQQNFPVKQYGQTAGGNRC

SEQ ID NO: 1262 - protein, 414 aa, Methylobacterium sp.
MSLHLDDPVTDPVEDRLPPPPAPPHRIRSDAEAIAAARAVARIFAAGAAERDRDRRLPWAEIAAFTESGLGGITVPREHGGAEVSHATLAEVFAILAAADGSAAQIPQNQFGVLALVAAAASPAQQARIYRDVLAGHRIGNAGPARNGKAITGVDTRLTAGPEGPRLSGTRFYSTGALFAHWIPTRAVGPDGGPLLVFVRRDAPGVRVVDDWQGFGQRTTASGSVIFAQAPVEAELTIDLAPLAGRPGLFGPVSQLIHAAIDAGLARGAAAAALDFLRTRTRPYPFTAETVAEDPHILGEVGRLTVDLHAAEEVLARAGRALDRIAAAPVTAQSAAEASVAVAQAKILTTEAALEASERLLELAGASATRDGYNLGRYWRDARVHTLHDPVRWKYHLLGNHALNGVLPARHQWN

SEQ ID NO: 1263 - protein, 320 aa, Methylobacterium sp.
VPLRRRPTAARRPSEKRIAPTVSSPDHGLSELAQIEVNLETDTSTLWAFMRPQGRPCQNPEMLADFSRLQDGIERGFGNGSLDLNYFVFGSRFPGVFSLGGDLSLFASKIRAGDEAALVGYGNACVDVLHRNMNALNLPIITIGLVQGDALGGGFEGLLSFDVIIAEKGTKFGFPEILFGLFPGMGAYSFLARRLGTIRAQEMILDGRTYTAEEMHELGIVHVLAERGQGEAAVRAYIAGNHRRRNGQQAIYRAAREVNRISLEELRKIVSVWAAAAMNLTDRDLSIMERLVLAQDRLRGKAQAAQARTVTARGLAASAR

SEQ ID NO: 1264 - protein, 308 aa, Methylobacterium sp.
MPGPERDIVIGADGFLGRNLVPRLRAEGREVVEIGRAAGDLSAWANVERALRAAPPAGRIFHVVTRQRTGAVQYDIQGELLAINARVHLNVLEAWRLFQPQAKLVSTGSSCTYPESAEPLPEARFGQGPTHPSVIGYGLAKQVLATGSAAYAHQYGLSFLHCVLATLYGPHDNKASDRSHFVGALLNRAVREKAAGAAQFEVWGNPQTVREVLYVDDQIDAILAADRAFDNEILNCAANTPVTVEAVAQAALAALDWSVPLVSPPGSFQGAAYKMLDSSRFLDRTGWRPLIDLEAGLRRLAAAEYAEH

SEQ ID NO: 1265 - protein, 317 aa, Methylobacterium sp.
LPETVVVVGATGFVGRNLVAHLADRVPRLIAVSPSGRAVPGAHEAARFDALEALSVPADAIVVNVAAQRYDADKFETAQSDLLTGNAEIANRLYRFCLTKGIREVRAASSVAVYPAALDPLDDAQAVDLNAPPNRNEAFYAWSKRWSEVIADLHAERYGIHTISFRLSNPYGPHDSTDPRKAHVLPAFVMRALAPGERFEIKGNPLVERDFIYVGDVVDVFARSLEMRETSDALNLCRGETTTLLDLARTILEVAGEKRPVHAPDTATHGVLARRSTNQRLRERFGMSTFTGLADGLRPTIAWYREAYRGGAQHAGA

SEQ ID NO: 1266 - protein, 310 aa, Methylobacterium sp.
MRILITGGAGYIGTILVPMLLERGHHVTVLDTFKSGAPDLFSACQYDTFEPIKGDARDTRILDELIPKHDVLIPLAALVGAPLCKEDAIGATTLNRDAVIALVERAGGDQRIVYPTTNSGYGVGEAGKYCTEDSPLRPISLYGTTKVEAEKAVLDSGRGVSLRLATVFGMAPRMRLDLLVNDFTHRAVTDRALLVFEGHFKRNYIHIRDVAKGFIHAMDNYDRMRGEAYNLGLSSANLSKLELCERIKAHVPNFVYVEAPIGEDPDKRDYIVSNEKLEATGWFPDFDLDRGIKELIKGFRMIRNSRFANV

SEQ ID NO: 1267 - protein, 131 aa, Methylobacterium sp.
VAAATEPLTEGADALVLGTDFFGFLASRFPRFCSAAMISLLDTVTAPTTSSSPFGRRLVWKQPDRGRDGGLEQAEDGNEAVACPEFGMMPRDQTRCLPLGVAVVARRDDASREHATGRGEPVDLIGAARVS

SEQ ID NO: 1268 - protein, 81 aa, Methylobacterium sp.; identical to SEQ ID NO: 202

SEQ ID NO: 1269 - protein, 313 aa, Methylobacterium sp.
MALREPRADTADACSGLAGGVGRRARAVPLRRHLAVAAAGRGRLLAAAPLPLLLALAATTTPEPVTVGLGGLALAWLSLRVHRLRGAACAATRQRNNLARLTAPTVARWVAETDRAARRPGWEQEATVLFADIRGFTRLCEGMAPGEVAAFLAAFRSRAARAIEAAGGFVDKFVGDEVMAVFGVPDAAPGDAGRAVAAARALAAAMATWSRERGQAGLPPVRVGIGLHRGPVFIGVIGAERVEFTAVGDTVNVARRLEQMTRALPCDCLASEAVVRAAPSGGARIVAVGPVRGGRTVLRLFTLRLDPAGTRAD

SEQ ID NO: 1270 - protein, 364 aa, Methylobacterium sp.
MNLLKRLFGRADAAPAEAAPDEPLLVNAYATVRDLPALPFDHALNGRRDLSDPELQPHLDGFIGYVMGRGDGQMTAHRYHLWRHLQRVRNHVSFAVAASDLPRVEAWALAANAVLFLPDGSVRAPDMALLLSAAGETDAAARLPYPPDAVARRARTLEHLEDLDPKPPAGMPPALGEAELALRPPAEVLRRALALLYIAAWGQAFGAGTTLREPGQRTLNPIGFAALSPAERAQIEAADPKDAAAASWRYEAANTLLWALGVRAARIADSDATVDVDALWRAVAPLARDAGAADAARLRPPGEILEALDRAWRAHWVVRQARQKGTAPAGLNGDVVAERHVALNWLTGFQNDRDTPWDATDTPT

SEQ ID NO: 1271 - protein, 115 aa, Methylobacterium sp.
MQSSRWAGAFLAAGLVVAFAPPARADAALVLRETRLHTPPDSHEPQRAMVNLRNTGPDLATNVTVLCTFTGAGGTVLDTQQASVPEVVSLADVQAETIYYGWPRASSATCRLAEP

SEQ ID NO: 1272 - protein, 500 aa, Methylobacterium sp.
MRLPEELERACEGRIVLGTIEPSDLTLVVRRIVGSAPTTIVCPELAAEVGPIDLRIALHPARGPEGALERLKFVLERGRTHPTASKAPRLSDLHGYGAAAEWGLAAAADLMAYSRGQHWSSCEQGALLTGVPGVGKTLLAAAIASEAGVPFLAGSLAQWQAEGEAHLGTTLKAMRAFFGHAKKVAPCVALVDELDSFGDRRKLESHNHHYGVQVINGFLECLDGDGGREGVLLVGATNNPRWIDPAILRSGRFDRQIAIEAPSLTDLASILRHHLGSDLSGADLLEIARRGLGGTGADCAAWVRRARSRALRDGRAVAELDLIRELTGLTEGTCIDEERRAAVHEAGHAVAAYALDLPVGELVLRTPGHAGDGFMRFRPKRVGTRRSVEDLLTVVMAGRAAEMLVCGAPSAGASADLAFATAIARDLQTRWGLGKRLAVLHPNEPSSTFAPGVERALQCAAKAAFDLLAARREHLEGLAEVLSMRRSLSKLEVETLLNGD

SEQ ID NO: 1273 - protein, 881 aa, Methylobacterium sp.
VPLPLARLDQPGLDALLADARAAGTLDPDSLADLYPLTPLQEGLLFHARLAPGDAAYRNQVRLDLEPLDPDRFARAVRATLERHDVLRTAILDPADGPPLQAVLDPVPLPLARLDWTGAPSSQDAPHEDAPDEDARADRLTDRLAALAAEERARPFDLARAPLLRLVLVRTGPDRHHLVLTVHHLILDGWSTARLVAEVLARYRGEEPETVTGRFADYLAWLARQPRAAAERFWQHALAGLDAPTRLADTFDPPGTPGARDGQRPPGHGEVRHRVPPAAAGRLLARARAAHLTLNTCVQAAWARLVAARTGQARVAFGTTVAGRPADLPGAETVLGLFINTLPVVIDLDPARPLGAWLAGVQEAGLGLREHGHLPLAAIQRLAGPAGTGTGTGTGTGGLFDSLVVFENYPVDAALAAVRHGRDGDGNGDGDAADPHALRLGPAIVAETTHYPVTLVVHPETGPDGTRLALRLSYAADRLAPADAEALLAAFVAQLAALAEADPATPLGALPPPLPDSDRAMIGSANATARAYPDGAGDVLAAFADHRAHDPDAIAVTDGQGALTRRALDSAASALARRLARAGAGPDTLVGVGLERSCALLVAWLAVLKTGAAILPLNPELPRPRLVATAREAALRLLVTESGPAARMPGPAELPDLQILTPDLAEAADDPALPAAAPHPDALAYLIYTSGSTGTPKGCANTRAAIANRLAWMRAHFAVGPADVILHKTPVSFDVAVWEILLPLVTGARLVMAPPQAHRDPDALAALIRRDAVTIVHFVPALLEAFLASGRLAACSSLSRIVCSGEALAPDLAAAVRAQSRADLANLYGPTEAAIDVSAWTCGPERDAPRVPIGHPIANTQLHVLDDALHPVPVGVVGELY

SEQ ID NO: 1274 - protein, 553 aa, Methylobacterium sp.
DAVARSDTFFERGGDSILALQLVTRARQAGLTLTPRDVFTHQSLAALAAHAERQGARPALPARDAATDPGLEAGPVPLTPIQSWFLAAPMPRRAHWNMAVLLVPRARLAADRVAEALAALSTAHPALRLRFAQAADGGWRQTCTAADAVAAAESLWRREARDAAALAALAEAAQTSLDLARGPVLRAVLVDPAPDGGQRLLLVAHHLVVDAVSWRILVADLALVLAGRTLPAPATSFPAWARHLDTLARDPAEADRRRAWAEAWAAQLAPPAWGLEPARPDAPNVESAQTEIADSLDADTTDAFLRRAGRPYRTRPDELLLAALAVAVSRRCGGRAVRVVLEGHGRDADALADSLADSLADAAGEAARHDLSRTVGWFTTLVPLRLDPLGGEPDLPPDLPPDDAARGLALGPLLGRALCRVKEARRALPQPDLSHDLLRHGPVADLRHRIAAAPEPGILLNYLGQIDADRADPDAPFALAPESAGPMRAPHSPAGAELTLTALVRDGRLHLAWRFSPDRHDAAAIAAIARDTRHTLEALVAHCADPRTPRRPN

SEQ ID NO: 1275 - protein, 67 aa, Methylobacterium sp.
MFKTTARAALCLACLWSVTPALAAPKEMPQGKRDEMSMKDTKHEVVMQRKENKEANKNVDSLITNRK

SEQ ID NO: 1276 - protein, 460 aa, Methylobacterium sp.
LTKDARIVEIGPSFSPLAPKRDGWNTFVIDHAPRSELIEKYHDQTVDRIEEVDFVWTGGSIADAVPVDQHGTFDAFIASHVIEHTTDIVTFLRAAETLLRPDGVVILAVPDKRKCFDFYRSLTGTADAVAAFLEKRNRHTVRTHIDYALNMALKDNGTVGAWSGQDTRPAIPANPLTDEPQWLGAAQLPYYADAHAWVFVPASFNLMILELAQLGYIDLRVEDFLDRDATEFFVWLRKGRQQLAPDEIREQRTALMQRAIVELAEQVQQLPETSFVEMASARALRDQLLKATYRTEALRTVLAALRASIGRFGLDRAKFKRLIGAASQKVPGNLSAAVQHKILLTEATKILDGITNSAVETDDRDPAVIDGAVLVAPLGAAQFGDPLLAAELERERQRARAVRMVLDAVLGSLRGRALDKKRFRDLVTQAAARTPNDGPESARHAVLSEESRRVLGLPVA

SEQ ID NO: 1277 - protein, 228 aa, Methylobacterium sp.
MSVVATALLTGASLGLSIAAPIGPTSLLCVQRTLSGGLSTGLATGLGVATVHLTYGGLVMRWGAELAAVWSNGAVLSLISGAVLLALAVRVLRSVSVLQEGRACRDTLAVSYGSAVVLALTNPVTPVLFLAATPAFLERGTAPFPVLAAGVFVGSFGWWVVLNTAVSLFRRCVTSQVLNRMNKAAGLLLALLALSLLVRGLDGGTAARSSSAGVSGVSGAGTRAPSRL

SEQ ID NO: 1278 - protein, 236 aa, Methylobacterium sp.
MPEALLATTGLRAGYGGKPVLQGIDLAVRPGEIVAVIGRNGVGKSTLMRSLVGLLPASAGGIAFRGAAVEGLAAHRRARLGIGYVPQGRDVFPRMSVVDNLTVGASLLPKGERPDYERAFGPFPILRERRGQRAGTLSGGQQQQLAIGRVLVGEPALILLDEPSEGIQPSVVQQIGRTLVDLNHRTGVTIVFVEQNLDLIRAMAQRSYVMDKGRIVAELTARDLDDRDLVRRHLAV

SEQ ID NO: 1279 - protein, 330 aa, Methylobacterium sp.
MQWLDQSIMARKGVAGGKPGREYTITEVEQGRYHYVYGPFAEPVLTVDPGAVVTVETHDAFEGKIRHETDSPTQILNFPYLNPQNGPIYVNGAEKGDCLAVAIRSIRPRGPQPCGTTLIMPEFGGLVATGDTALLNPPLPERVRKLEVTAETGVRWNDRITLPYQPFIGTIGTSPEIEAISSLQPDYYGGNMDLPDVGVGAVIYLPVNAKGALLYLGDCHAAQGDGELCGVAVEHPTHTTVQIDLIKGWTFRWPRLETEDFYMTIGSSRPMEDAARIAYRELIRWLAADFGFDEIDAYMLLTQCGRVRLGNMVDPKYTLGASITKAIAHA

SEQ ID NO: 1280 - protein, 307 aa, Methylobacterium sp.
MDPASGGALAAAVSAAGGLGLIGGGYGDHATLDREFARAGNQRVGCGFITWSMARDPSLLDAALARSPAALMLSFADPAPFADRIRAAGVPLICQVHTLAHARRALEVGAAAVVAQGTEAGGHGLTARGTAAFVPAVADLIARERPETLLLAAGGIADGRGLAAALALGADGVLMGTRFWASREALIHPAAKQRVLAATGDDTIRTQVYDIARQRAWPKPYTGRLLRNAFIETWHGREDALRAASAERRRDVEDADAAGDYDVANVTVGEAVGLIADLPGAGDLVLRIAEEAEAAIRRISGMAAAAP

SEQ ID NO: 1281 - protein, 435 aa, Methylobacterium sp.
MRLLRSIYGQVLLGIALGIAVGVVAPDFAVGCKILGDMFINLIKMIVAPVIFCTVVVGIAHVGDMKSVGRMGLKTILYFEVATTVALAAGLLFVNLLRPGDGVNATVDSLDAKLVAGIAGKAHAQSPMEIVANIIPHSAVDAFAKGDLIQVMFFSVLVGMGLAMLGRRGEFPLKVVHAFGDVLMKVVGLIMHFAPIGAFGAMAFTIGKFGLGILAQYGMLIVSLYLTFIVFIAVFLGGVMRFYVGLSLWKLFRYSREELFILLGTTSSESVLPRIMAKLNGLGVDKSVTGLVMPAGLSFNMDGSCIYLTMAIGFIAQALNVPLTWEQELGILAIALVTSKGVAGVAGAILFVLAATLQASQLLPVAGIALIIGVDRILNELRCVTNAVGNMVATLVIARWEGKIDLAHARAVLDGRITPNLDLLDDEDEAADAIH

SEQ ID NO: 1282 - protein, 334 aa, Methylobacterium sp.
MRRRDVLAGAAAFLASPVPGRADEVGAVAIARQPSLGHLPLMLMEEQGLLQKAAAARGVAGLQARYLTLAGGAAMNDALLSGTIQFAAGGVPPLVLLWSKTEGTAMAVKGVAAMNSMPLLMNTSNPKVHRLADFTDRDKIALPAVKVSVQAMFLQMAAEKELGAGRRNDLDRLTVTLSHPDGMAALLGGSEVTAHFTAAPIQELELRRPGIRTVLNSFDVLGEPSTFNVVWASSAFAGANPRVVAAFNAALDDALAAITADPSEAARAYVRLARNGSDVGLITEILKDPQVSFTATPRAVGKVADFMARTGTIRRRPESWKDLFFAGVHDKAGS

SEQ ID NO: 1283 - protein, 248 aa, Methylobacterium sp.
MNTILITGCSSGFGLETARTFLERGWRVVATMRGPRSDLLAPSDRLSILPLDVTDHDSIDRAVAAAGPVDALVNNAGVGLLNALEGVSMDAAREVFETNTLGTIAMTRAVLPQFRARRAGVVVNVTSSVTQRPLHLLSVYTASKAAVNAFTESLALELEPFGIRARLVIPGRSPETAFGANARARMGMDIPEAYAAVAAKVFAGIQQADGDLTRSSDVAEAVWRAATDPSCPMRLPAGADAVAWAKAS

SEQ ID NO: 1284 - protein, 301 aa, Methylobacterium sp.
MPDPLTQVVGLLRPSAPLSKLVTGCGHWAVRRTDSGLPFYAAVLEGGCRLAIDGEAGIVLGEGDFVLIPAAHAFTTTSLEPPPPRRAAQRPVAVSPGVFRLGDAEGPPNVRMLVGHCVFASSDADLLVSLLPRYVHVRGAARLTTLLGLVNEETRADRPGRDVVLARLLEVVLIEALRATAGPAAPSGLLRGLADDRLAAALRRMHDRPTASWTVAALAREAGLSRSTFFERFRRAVGVAPMEYLLAWRMALAKDLLSREAVGMAEVAARVGYSSASTFSVAFARHVGRPPVRYARERPVP

SEQ ID NO: 1285 - protein, 376 aa, Methylobacterium sp.
VETVHSGGRPLTRAALAGRRRALEDGRTVSRRELSAAGRDAAKALNLRPALRSILSALCAVWGEQDWERLVVWPSNEHLCGMTGLSERALRYGLRDLVALEVITPRDSANGKRFAIRGPGGAVIDAYGFDLTPIVARKGEWATAIMEATARDAQRSRAFDLLTVRRRAVSEALAALRARFPATDAADLLAAQEALERSTPRRRASGVATDVVLDAWGELQVMAEDRFYQAASAGNSGRHLEQDTGSPSDPCAKAPEKEPEPTRRPEPSLVAAACPVAAEFGVTLRTEADVIEIGRLMRGGIGAHPSAWSEACEALGPFRASVLVLIVAQLHDDDVRRGEIRIKNPGGYFRQLVRLCSEGRYGLEAELMAMRRRKMT

SEQ ID NO: 1286 - protein, 338 aa, Methylobacterium sp.
MKTIGFLSFGHWSPTGGSATRSAADTLLQSIDLAVAVEELGADGAYFRVHHFARQLASPFPLLAAVGARTKRIEIGTGVIDMRYENPFSMVENAGAADLIAGGRLQLGLSRGSPEQVIDGWRHFGFAPAEGETDADMGRRHTEVFLDLLKGTGFAEPNPRPMFANPPGLLRLEPQSEGLRDRIWWGSASDATAIWAAQQGMNLQSSTLKADETGEPFHVQQARQIRRYRQAWQDAGHARTPRVSVSRSIFALVNDLDRAYFGRGTSSDQVGIIDNMRAVFGRSYAAEPDRLVDELRADAAIAEADTLLLTVPNQLGVAYNAHLIESLLSHVAPALGWR

SEQ ID NO: 1287 - protein, 282 aa, Methylobacterium sp.
MDDQDKQFITQQILDVGRQLYAALDSKIMTAHAQQLAQMQDVRRLAVVQLAPKNDFCLVTDHPIAYESNDHTVPRGTKDDNTRNQRFCHAVESHFGRKVRALDLGCAGGGLVFDFLIRGNAAFGIEGSDYSLRAQRAEWSIIPDYLRTCDITKPFALMDQRSGTKAKFDVITMWEVLEHIEESLLPQLFANVKSHLADGGLFVGSAATYDDVANGVSYHPTVKPETWWRELVRQHGLEFVPMTMFQFKDFCRGSGNENAFYDADFSKNPELGFHFVMKHRPA

SEQ ID NO: 1288 - protein, 215 aa, Methylobacterium sp.; identical to SEQ ID NO: 225

SEQ ID NO: 1289 - protein, 304 aa, Methylobacterium sp.
MSYPARVQVVEVGPRDGLQNEPAPVPIAARVALIEALAEAGLTRIEAGSFVSPRWVPQMAETAEVLARLRPRPEVGYSVLVPNLQGLERALASGVREVAVFAAASESFSRRNVNGSIAETLDRFAPVLEAARANDLRVRGYVSCVLGCPYEGDVAPAAVARVAASLHAMGCHEIALGDTIGTGTPRAARRLVERVAADVPLQAIALHLHDTYGQALANILACLELGVSAVDAAVAGLGGCPYAPGAAGNVATEDVVYMLRGMGIETGIDLDALAAAGRSIASRLGREPASKVARALAAAPPPTP

SEQ ID NO: 1290 - protein, 132 aa, Methylobacterium sp.
MSDGTEAAPAAEPDYDRLLRANLARIFNARDAGARAAALAELYVAEPTLFEPDNVVRGRAAIAAVAGALLDRFGPTFRFVPVGTAAGHHGVGSLRWEAGPAGGPVAVTGTDVAEIVDGRIARLWVLLDPPPP

SEQ ID NO: 1291 - protein, 299 aa, Methylobacterium sp.; identical to SEQ ID NO: 228

SEQ ID NO: 1292 - protein, 176 aa, Methylobacterium sp.; identical to SEQ ID NO: 229

SEQ ID NO: 1293 - protein, 160 aa, Methylobacterium sp.
VRLRAVALSRSVSMTLARDPDAHLSGTTDAAKLSLPLSWWRVLAPEALDMAAQCRLSAALNAVQPLPSPDWSAACRGDSAAAIHIALNVLAEAIAFPGRLDPAMSAICLCAVRGDGSCIDLLVHVLGRRARRRADLEVLCLAHAWCSVPRRGSDRVGVAR

SEQ ID NO: 1294 - protein, 242 aa, Methylobacterium sp.
MDVVARRRGRPRKAPVVPVAQLPRTGLHEQAAGRLRDMIVRGVLPAGASLVETDLSVALGVSRTPLREALKLLAAEGLVELHQNRSARVPDWTPEEILELFEALAGIERLTAELAAPRISETLMDALRGKQARLDRMHRDQVLDAYFALNQEIHRTIVEAARNRPLAEAHAALQARAQWARLRALSSGSRWEESAREHRDLFAALAARDAAEAGTVAHRHVLRTGVVIAETLQARRADPAAR

SEQ ID NO: 1295 - protein, 327 aa, Methylobacterium sp.
MEDAVMELVTKPLRDEGPLPLLVTPPEGAAGAALADALPAIRAAAEAHLHAAGGLLLRGFSLDGPDAFRSFAAGFGHDLLSYEFGSTPRSAVTQGVYTSTEYPPHQHIPLHNEQAYARDWPMKIWFYCQQAAPEGGETPLADSRAIYRAVPEPIRARFAERGLMYVRNYGNGLDVAWEQVFGTQDRGAVEAYCAGHGITCEWKPDGDLRTRQVCQGTARHPETGEPVWFNQAHLFHVSNLEPEVRATLLDLVDEPDLPRNVYYGDGSPIPDADLDAIRAVLAAHTVVFPWQSGDVVMLDNMLTAHARTPFKGPRKVVVAMAQAGRAQ

SEQ ID NO: 1296 - protein, 641 aa, Methylobacterium sp.
MQAVARSESLAAPCAGPADRTGRRGGWRDRWRAPRLRVVLALGFGTLGFLTTLTLAALVSREATRRLEAEVGGQLAEIAGQMARGLDIGMFERWRDIQIAAASDSLRDPGTGTAAKRAVMERLQATYPAYSIIGLIDADGRFSVTSTGALEGADVSGRDYFRGGRAGPYVGDVHPAKLLEALMPPDEAAARAAAREPLRLLDVAAPVRATDGRVLGVLAAHLDWTWARDMARILEAGLRGHRQGAEILILSRDGTVLLGPPALQGAPLPRSVLAGGRPLDPEGTSRVGPWPDGAAYLSARASTAGHRDYPGLGWQVVVRQTADRALISVAALRGGILAAGSAVALAAALLAWLLAGLIARPLLDLAVAAETLGRDQPLPTLPRSLVREGAMIADALAAAADERARRAETHRLLIDELNHRVKNTLATVQAMAAQSLKNLGAGAAAGRDAFEARLLALSRAHDILTRESWASADLRGIAAQAVRPFLGPDPVGGDPSNRDSSGRETSDRDPADRDAPGANTPRITLDGPDLRLPPEGALALTMILHELCTNAVKHGALSVPGGRAALAWTVEAGPDTETLRLTWRECGGPPVVSPSRKGFGTRLLERGLAGGRTASLTYEAGGLVYVAANPLPAARLHTGRA

SEQ ID NO: 1297 - protein, 272 aa, Methylobacterium sp.
MRTSLRRDLDWFSFHGAVLLLAGLCLVLLAAPTVIVVVVSFTSGFSLRFPPPGYSLRWYAALAEAEQLRAAAWNSLVVAGWTTLLSVVLGTAAALAIARSPRLSARLLDSLFLSPLVLPALAFGLAALMLFSLAGIPVSPLTLVLGHTVVCVPYVVRTTVAALSQMDPVLLESSTSLGASRLYTFRRVTLPLIRPGILAGGFIAFMASFDNVPVSLFLRDAATDMLPIRMWQDLEGRLDVTVAAASSLLILVTVVLAAVMERAAGLSRRMAG

SEQ ID NO: 1298 - protein, 299 aa, Methylobacterium sp.
VSAGPATAGPVAAPLRPGRAWTAAYDIRLALPLGAFFLVFFLAPLALLVLVSFYADPAMTRFGLDQYARFLLDPFSLRVLGATLWLGVEVTALTLLLGLPLALLLTWAPGRLRGLLTLIVLLPLLTSVVVRTFAWIVILGRQGIVNAALLGLGLTDAPLKLLYTEGGLVLALAQVQLPLMVLPLVTALSRIDPNLADASAALGAGAWRTFLRVTLPLCLPGIVAGCLLTFAAAITAFITQSLIGGGQMLFMPMYLYQQASSLNNWPFAAAIAIVFLVAVLACVTLLNLAGRLSGGRARA

SEQ ID NO: 1299 - protein, 347 aa, Methylobacterium sp.
MPLHRRSLLAGALTLGAAQAFPGLSHAQARKLVFATFTGSWEEAHRAVLVPAFRKSSGGDVILDPMLSVDQIAKVQAARANPPIDVMLHDPGPALTAIAQDLVEPYPVAQSAHYGDLIADAQEPMGPAPFFQIVGLTYNPEKVKTPPTSWADLWKPEYRGRVGITNLNSTLGTGFLVEIARMHGGSETDVEPGFKALEALKPNLAAVAANPGALAALYQQEQVDIGPGNFNAIQILKARGVPVEFAAPKEGIIAFKTTIHIVKNTPSKELAFKLIEAALSPEVQAKLMQSPYLIVPTNRKVAIEGEVAKVLAKDADELKRKSVFQDWAAINRGRPAWIERFNREIRV

SEQ ID NO: 1300 - protein, 85 aa, Methylobacterium sp.
RHGLNANQLFTWRRLMERGAFTAAGAGEEVVPASELRAAQQQIRELQRLLGKKTLETEILREAMERVAAPKKLPSRVTSWPGNGR

SEQ ID NO: 1301 - protein, 325 aa, Methylobacterium sp.
MSDHRPVLVIHGGAGTIASGQADPGEARYHAALAGILAAGAACLADGGSALDAVSVAVDLLEECPLFNAGHGAVFTSAETHELDAAIMDGATLRAGAVAGVSRVRRPGRAARALMEAGEHVLMAGAGAETFARRHGLEMVEPDFFSTEARRDQLRRALAAGQVALDHDTASGPLDETRKFGTVGAVALDRDGHLAALTSTGGMTNKRPGRIGDSPLIGAGTYADDRTAAVSCTGTGEAFIRVAAAHDVCARMAYGGQDLEVAARAVVEEHLPTVGGRGGLIAVDARGRVAMPFNTEGMYRGLVRSGEAPATAIFGETRRVPAPAR

SEQ ID NO: 1302 - protein, 294 aa, Methylobacterium sp.
MPSATTDDGIRLHYEESGQGTPLIFVHEFAGDHRSYEAQLRHFGRRYRAVAFNARGYPPSDVPESVTAYAQARAADDILAILDHLGAPKAHVAGISMGAFATLHFGLRHPDRALSLCLGGCGYGAEPERQALFRAEADATAAMLLRDGMAAFAERYAVGPTRVQFETKDPRGHAEFRRMLAEHSALGSANTQAGVQKGRPSLYDLTDELGRMTVPTLIVAGDEDWPCLAPSLMLKRVIPSAALAMLPNTGHALSVEEPDAYNRLLDDFLAQVESGRWPMRDPRAISATITGIRG

SEQ ID NO: 1303 - protein, 183 aa, Methylobacterium sp.
MARALPDVASIEEGVGLLRTQLLSISDAIARTRQEIADLRQEQETSRARDELLAVVQGTEDATNAILTASEKVDTLARGIVRRSGEDANRADAQAIQIEMQTIFESCNFQDLTGQRISKVVRTIVLVEERIGEMLRVWSGPGDPPSRPNPTADTRSEEAALLNGPVLPGDASVSQDTVDAMFP

SEQ ID NO: 1304 - protein, 93 aa, Methylobacterium sp.
MTRMIGPWRAPAAWPVRALAVCAALAGSGPARALENPASAFCATMGGQTILAKLPDGGTIGLCALPGRKIVEEWTLYRMLRGVKPAPGADPFR

SEQ ID NO: 1305 - protein, 473 aa, Methylobacterium sp.; identical to SEQ ID NO: 244

SEQ ID NO: 1306 - protein, 429 aa, Methylobacterium sp.
MSDDRYHRKALGDRPLRPETLMLGYGYDPALSEGAVKPPVFLTSTFVFTSAEHGKAFFDYVSGRREPPVGEAAGLVYSRFNHPNSEIVEDRLAVFEEAEAALVFSSGMSAIATTILAFARPGDAILHSQPLYGGTETLIAKTLAGFGIAPFGFSDGTDPASVRAAADRAAGAGRVSVVMVETPSNPLNTLVDLGLVRAVAEEIGARQGGEAPVVVCDNTLLGPLFQHPLREGADISVYSLTKYVGGHSDLIAGAALGSAARMKPVRLLRSAIGTGLDPHSCWMLGRSLETLSLRMSAANRNGEIVGRMLAAHPKVARLHHLAHLEPGSRQAQVYAKQCAAPGSTFSFDIVGGEAEAFRVLNGLQLFKLAVSLGGTESLASHPASTTHSGVPKAVRDRLGITDATIRVSIGIEHPDDLVADLAAALSVLG

SEQ ID NO: 1307 - protein, 182 aa, Methylobacterium sp.
VILPPLRRTAADARTVATVAHDGQVDKAGRPYIEHLARVAAGVLGLSEGCPFWSDLERDEALQAAWLHDVVEDTRYGFGDLAKEGFSDNVLTSVAMLTKPGGRVTYAAWINNIAKVGTLRATLVKLADLEDNSDPGRLALLPAETRERLHLKYEPAKAILRAAAAAKGWLGSPTTVEGSGPR

SEQ ID NO: 1308 - protein, 91 aa, Methylobacterium sp.; identical to SEQ ID NO: 249

SEQ ID NO: 1309 - protein, 286 aa, Methylobacterium sp.
MEWSDVRVFLAVARSGTLGGAARSLQTSHPTVGRRLRALEQAIGHTLFQRTADGLVLTEEGHGIIALAEQMEEGALAMERRLAGQEQNLKGSLRISSADWFGAYVLPPILADFSRAYPNVDVEILTGTRLFNLAQREADVAFRIVPFNTADVVQRRLFRLEYGVYIAEEAPDPGYGDGTGFRLITHETSTGHFPDIAWLIESFPNARPVLRSNNRNVQGRMCKQGVGIAVLPCVVGTQIPGIRRLETPTQPPARDIWMGYHRDLRRLRRLRAFISTVSDHLVNATV

SEQ ID NO: 1310 - protein, 460 aa, Methylobacterium sp.
MDDHYDALVIGSGEGGKFLAWHLAKAGQRVAVIERRWIGGSCPNTNCLPSKNEIWSAEIAHRARQADRYGIETGPVAVDMGRVVARKRAMVRDLIDMHLDRYRESGAELVMGTARFTGPRALTVALNAGGSRALTAEQIFLNLGTRATIPDVPGLREAGPLTHIEALELDAVPAHLVVLGGGYVGLELAQAYRRFGSAVTVIEHGPRIAGREDPDVASALAQLLEAEGLAIRTGTEVVRVRGRSGEAVEITVRGGAGEAVIAASHILVAAGRAPNTDGIGLDRAGVALTERGVIEVDDHLRTSAPGVWAIGECAGSPAFTHASADDFRVIRDTLAGITRSTAGRLMPSCLFTDPPLARVGSTETEARAGGHAVRVARLPMAAVLRTRTTGQTDGFMKAVIGPDDRILGFTMLGAEAGEVMAAVQVAMLAGLPYTALRDAILAHPTTAEGLNSLFAAVPAR

SEQ ID NO: 1311 - protein, 408 aa, Methylobacterium sp.
MEQDIGEGERPPASRRPSVSRSLDLLNLLLIDVNGAIKPYLNVYLYVHRGWNDASVGLVSTVSGIVGIVVQTPIGTAIDAVRDKRVILLGALVALSLATLLVALFPYFWPVLAASCVLAAVGGMLSPAIATLTLGLFPSDRIAGRFGRNAALERTGNVAIAVLIGLVGWLFPDRAVFLLVPACAIVSAAALYSIPRDAIDARRARGGGEGEQAPARWRTLLTCRPLMVFAACVGLFHFANAPLLTLVAQEIGQARPDWSSVIVSVCIVGAQGVMVPMGLIVGRRAERWGRKPLLVIGFAALPVRALLYLVWRDPYWLIAVQCLDGVGAGLLSAVKPLVIADITRGTGRYNAAHGLIGTVQGAGASLSFVIAGTLVQQAGFDAAYLACAAVAAVALGVLVTLLPETIPE

SEQ ID NO: 1312 - protein, 535 aa, Methylobacterium sp.
VPVIESALDPRAPEARANAEAMRALVADLRATADRVRLGGGEAARERHRARGKLLPRDRIRALIDPFSPFLEIGQLAGHGLYGGEVPSAGIVTGIGRVAGRECVIVANDATVKGGTYFPMTVQKHLRAQEIAQQNRLPCLYLVDSGGAHLPSQDEVFPGRDHFGRIFYNQATMSAQGIAQIAVVMGSCTAGGAYVPALCDESIIVRGQGTIFLGGPPLVKAATGEVVSAEELGGADVHARISGVTDHMAETDAHALGIARRIVANLNAVKRPALAPRQPEPPRYAAEEIYAAVPADRRTPYDVREVIARLVDGSDFDEFKHLYGQTLVCGFAHIWGYPVGIVANNGILFSESALKGAHFVELCAQRGVPLVFLQNITGFMVGRRYEAGGIAKDGAKMVTAVATAAVPKFTVLIGGSFGAGNYGMCGRAYGPRFLWMWPNARIGVMGGEQAASVLATVRRDGVEGRGGTWSAEDEAAFKAPIRAQYEEQGHPYYSSARLWDDGVIDPADTRRVLALGLSASLNAPIPETRFGLFRM

SEQ ID NO: 1313 - protein, 200 aa, Methylobacterium sp.
VGRTAGSNGPRTAAAIRRAGLRLIYRHGYEAMTLRALAAEVGIQAASLYNHIRSKQDLLFDIVRDHMETLLARTDAALATATGTPTDRLRAFVAHHVTYHLEKKQEVFIANFELRSLDPPHYAAIVALRRAYEDRLVALLERGSEAGELDVRDARVAGYAILGMLTSACTWYRPDGRMTKAEIVALHTDMALRGCVRRQP

SEQ ID NO: 1314 - protein, 72 aa, Methylobacterium sp.
MAERYYFRLRSDGETIEDETGVLAASVAHAEAEALVLIEEFRKAGELPDAAAGWRMEIHDANGTVLRTLPLS

SEQ ID NO: 1315 - protein, 134 aa, Methylobacterium sp.
MADAVASQRAVLIVEDNPVQLMDAAAALRDAGYEVAEAATVEAAQAHLAARPELVAMVADVDLAGEPLSGFTLAKAVAARWPELAILIVSGVAWPAEEQMPMGARYLRKPFTPEGLAGALGAVLAARGVGSVPH

SEQ ID NO: 1316 - protein, 74 aa, Methylobacterium sp.
MTAEERLAELKAADTRRQTRRREALKQKGMTQQNVWLKPSVKAVIDQAIQNGRFRSRTEAIEWALASAFEEKSA

SEQ ID NO: 1317 - protein, 388 aa, Methylobacterium sp.
MHEFTELRGREAAFPEAEFAARQAAARAAIAGAGHDALVVTGPETIYWLTGRQTAGYFAFQALLVPVDGDPALLVRQLELPGAAANTWLDDIRAYPDGADPAAALAALVRGRGVARPALERDGWFVAPALAARIDAALGSGPLPDGSGLLAPLRAVKSAAELAAIRAAARYAQAGLAAGLDACAAGTDENAVAAAMLAAATAAGSEAMAMEPLVASGPRSGLPHMTWRRRRLEPSDAVFLELAGSHARYHAALMRSVWIGPPPAEAQRMMDCALRALDAALGAIRPGHPCAAPHAAAQAVIDAAGYGPAFRKRIGYSMGVAFAPDWGEGALLSLFTGQDRPIEPGMVFHLPATLRRYGAWTVGASETVIVTADGVEPLSDLPRTLSVR

SEQ ID NO: 1318 - protein, 112 aa, Methylobacterium sp.
MGVDIARVKALIATLEAVTSAPHFHRTAFRTPRKTFATLDEVGHDINLMFDPDLRDFFCEQVPAAFSPVPGGWGRMGATRCDLAIVDEATLMSALTAAHRLAAPKPRTPRRP

SEQ ID NO: 1319 - protein, 110 aa, Methylobacterium sp.
VTGLSLHAVDAATGRPAEGMRVRVLRAEGRRRVIAEGRLGADGTLDHPVVRTRLAAGLYEVVFVIGEFVGAAGEGFLEEAAIRFRIDDPDRHCHLPLKFTAFGVALFRGC

SEQ ID NO: 1320 - protein, 416 aa, Methylobacterium sp.
MSNGLTPTADRIVVASEADWNDAWYLVCMKVSTIGFVVVDARERVATLDALRAAGITDIAAHLDAHPDVADRLRHGMVILDVNEAAVRMFGAGGRADMIGQRTQRFFDPLCTAQVNSARAFAAGATSFQQQAHSVRLDGSRFETLFCVVPRADGATSGLWLASFVDITEHVARQMSLEVLRDELAHVSRISTLGELSASIAHELGQPLSSIGMTAGAMLRLLDRADLDRDLLRRQCQRIVDQVTRAGDIIDRTRRMAAKRDSVRAPVSVAEVLAEAARFVAHDLNRTEIRLTVAPADAAAQVIADRIQLQQVFVNLLMNAIQIHRQARTPGPEIAVETVCRDGSITVDVVDNGPGLDPGTLDRLFDGFFTTRAEGLGLGLRICRTIVAAHGGSIDASPRDRAPGARFSVCLPLAQS

SEQ ID NO: 1321 - protein, 132 aa, Methylobacterium sp.; identical to SEQ ID NO: 268

SEQ ID NO: 1322 - protein, 189 aa, Methylobacterium sp.
VRQWRKETRAALIARRVGISAQDRAARSERIEQGLRAALPSASGLSIGLYWPFRGEFDARSLLTELRGSGARLALPVVVEKARPLQFRVWSPGERMIRGVWNIPVPAEGEIVDPDVLIAPLVGFDQAGYRLGYGGGFYDRTIASRSTKPRVIGVGFEFARLATIHPQAHDVPMDIIVTEGGVWPRTERP

SEQ ID NO: 1323 - protein, 410 aa, Methylobacterium sp.
VLSAGLAANIAANVLTRGTLIGPFLYSLANLAEVMLAVRLLRRTYEQDALLQSTRSALRFLAIAGLLAPAASGVLGGLTAHLVFGQPLLRSFGTWVASDGLGLIVFTPFLLSLFRGDYARALAERSWRDRLEAAALLVLAGSVAYATFFCTSRPLLFLIFPPLILIAFRLGRLGVTAAVMVVAVIGGVATMYGRGPMVLIAADAVTQAQAFQVFLAFILLTCLPVAAEVSARARLTAELAAHDREMTRSAFTDSLTGLLNRAGFEHQIETILPVRALPPVSLIAIDVDHFKQINDRWGHPAGDRALETLGSLLASQIRPGDLVARLGGDEFVILLRESDLARARAVCERIRASARAAAFSTSAGSEAPVSLSMGLAVARVGEGYEALAQRADSALYEAKHAGRDALRWAA

SEQ ID NO: 1324 - protein, 296 aa, Methylobacterium sp.
MTIVVPHPAAQRGGRQRLSTRGQPGSATTSRITVPLGSAAALGCGHVQPAIPQICAPELIAAAQAALDGAFRATFVPDPLLGPGLSQLGSVLASMVKRHGSLIEAAITDVLERSGRYIVLRNVAMPITVPTQELVRASSVAQLNQTSIELAGAVAQSVFLDLIVVDRKESRAIIAEVKRGSGKNEARKIHQVEWVLRCAQVQGRSFLASLGYEVAQIRAVLIDVYGRAGYGDDLTVSGPAIDQLFATPVLAALETVTAALQARLRAAVPDLLTMALASLAVPENVKHPHSPGPLAP

SEQ ID NO: 1325 - protein, 104 aa, Methylobacterium sp.
MARDGNRPHPSALARYPVPIELISALFRADDAERDRLLAPMPAYGRARIAAYCAEHARLEALGLKVARSCDEATLVRAAGVTVGADLFARSRAPAPAPIQLQAA

SEQ ID NO: 1326 - protein, 386 aa, Methylobacterium sp.
MPASTVISGASSTETQAALVSGASFAGLATAFWLNQLGYRVTVVEVAPGLRRGGTPVDIEGETIAILTRMGLMDAVSARTLPPRRFAFKDAENATLGDMAHHPDDEGGPRYEIHRDDLLDVLCGAIEGDVELRFNRSIVAIEERPEAVSATFSDGSQHEFALICGCDGNRSNTRRLVFGDGEQFAHFMGGYFYLKVVPDTGLLEPNSSELFAVPGRMAMLTGYDDRTDIGFGFRTAGEIEYDYRNKDQQRRLIRKNFSGLKWKVPDMLARMGEDNDFYFDRISQIRMPTWSHGRIVLVGDAGYCVSPFAGLGGSMAIIGAGRLADALARHPDNHAAAFQDYEEGLRPFVEQVQERAAIDSIQMLFPGDDGEMAERDRKLAIGDIGV

SEQ ID NO: 1327 - protein, 147 aa, Methylobacterium sp.; identical to SEQ ID NO: 274

SEQ ID NO: 1328 - protein, 755 aa, Methylobacterium sp.
MPEPDGQPFRLQVANARPQDGGRGIAHLPQAALDELGLHEGDIIEIVGKRHTAAVAVGPYEEDQGLSLIRLDGLQRVNAGASSGDHVEVRRAEIRPATRVVVAPAQKNVRLQGSGEALRRTFFRRPLIAGDFIATATQRGGGPDPRLPPQLRSYLELPAYGLQEIRLTVVATQPRGIVYVAEGTEIELRPLYEEPRDGHRADVTYDDIGGLGDTVDQIREMVELPLRHPELFQRLGIDPPKGVLLHGPPGTGKTRLARAVANETEARFFHIAGPEIMGSRYGESEQRLREVFQEAAQNSPAIIFIDEIDSIAPKREQVTGEVERRIVAQLLTLMDGLEPRQNVVVIGATNRRDAIDEALRRPGRFDREIIIGVPDQPGRREILGIHTRGMPLASDVDLDAIARNTYGFVGADLGALVREAAMDAVRRILPAVNLRDGIPAEVLEGLSVERDDFLSAMKRIQPSALREIMIQVPDVTWDDVGGLAEAQMRLREGVELPLRSPQAFRRLGIRPAKGFLLFGPPGTGKTLLAKAVAREAEANFISTKSSDLLSKWYGESEQQVSRLFQRARQVAPTVVFIDEIDSLAPARGGGLGEPAVTERVVNTILAEMDGLEELQGVVVMAATNRPNLLDPALLRPGRFDELVYVPVPDAAGRRRILAIHTKGMPIAEDVDLDAVAERTARFTGADLEDLTRRAGLLALRESLEATQVRRAHFEQAARETRPSVTPEMEREYEEMLRTLKQEGPQRQPIGFIQRS

SEQ ID NO: 1329 - protein, 50 aa, Methylobacterium sp.
VAITPEQSALLDRVPSPSALRRLPESELQAVADAVRAEMIDAVSITGGHL

SEQ ID NO: 1330 - protein, 74 aa, Methylobacterium sp.
MAELIELLGEFPGGRDRKRAEALSERLDGLLCKAREQGAPHTTLAAIRGAQTLLGMAEMRPLPALSIQATGAGR

SEQ ID NO: 1331 - protein, 314 aa, Methylobacterium sp.
MTIKHRDLAGIDLNLVVALDALLTESSVTRAAAKVGITQSAMSSSLARLRRLLGDELLTRTPDGMRPTPRSLALLEPVRAALRQFQGIVLREDDFAPSQVERSFTLAIPGSVEVRLIPRLLAFLACEAPGIRLHLVGLDYGSVLGDLDADRIDMAVGMISEGQVHHKVRPLYRFGFLSLFNPRLLGVSGPLSLDDFVRFPHILTYLTGVGPGVVDKALAKVGRTRRLAATTPRFATVPFHVQAAPLIATMADELATTFATQLGLATSPVPVPTGEIVISMLWHASYDRDPAHRWLREVMVRLGREAGSAREDAV

SEQ ID NO: 1332 - protein, 112 aa, Methylobacterium sp.
MATMMLVAIPLTHPPASKAARKAADRERKREAREAMRQAGVPDPRMLDAAIVDAMRDAIASGGVPDGSTMIPLREVLRLAARSLQGRTQQGIALDRAEMHRALANRLAPRKD

SEQ ID NO: 1333 - protein, 335 aa, Methylobacterium sp.
MTQHYDVAAVRQAFPAAEHVVYLDSGFQTPLSRPVKEAYERFLREGFETAGPKQVWLSRLEETRAKVATLLGAQPHEIAFTKNTSESMNIAANALPLKAGDKVLMIHGDHPNNAYAFLNLKKKGVEVVFIPMTQVVSRSMPRILCVEDDEETASLVAEALVDLGYTVERASDGEAGLSAIQMSPPDLVLCDVRMPGMNGLDLLEQLAAAAPHLARIPFVFLTALDDRGSEIAARRKGADDYLTKPVDFEMLAVVVEHRLRAGRGGQGQDAFGHLTGREREVLTWASRGKTSAEIALILDLRERTVNFHFDQAMKRLNVVNRTHAVARALSLRLID

SEQ ID NO: 1334 - protein, 76 aa, Methylobacterium sp.
MPRYFIDTADHVAVRDDEGTVLSDRVALRDLLRRTLTALLHDEGEETGVNDFTASAYDEDGRLVMRARASFHVVDP

SEQ ID NO: 1335 - protein, 509 aa, Methylobacterium sp.
MFERFLLAAGLLAAATAPAAAAGDPILAISGQPETLDPYNTNTTLTTAVTKSFYEGLFGFDKDLKVRNVLAESYETSPDGLVYTFKLREGVKFHDGTTFDAAAVKANLDRVLDPENHLARYNQFNRIKTIEVLSPTSLRITLKEPFGPFINSLAHASAAIISPTALKKYGKDIAFHPVGTGPFTFVDWKQTDYVKGAKFADYWQAGFPKVDTITWKPVPENGTRAAMLQTGEADFAFPLPYEQAKMLEASKKLKIEVHASIIERYLSMNVLQKPFDDLRVRQAINYAINKEALAKVAFSGYAFPAQGIVPQGVRYAHKMDPWPYDPAKARQLLKEAGYANGFEATLWSAYTTTTAQKAIQFLQQQLGQVGIKVQTLALEPGQRTEWVQTAPDPKTARVRLYYAGWSSSTGEADWGLRPLLATEAWPPKLNNTAYYSNAEFDALLAKALVSTNDAERAELYAKAQEIVMKDAPWAPLVTEQNLYATSARLSGVYVMPDGNIDSGEIAVAP

SEQ ID NO: 1336 - protein, 418 aa, Methylobacterium sp.
VLDHSAETHLAETNTAGPLAGVRVVDLTSVIMGPSATHMLADLGADVIKVETPEGDSFRHYRPARGAGMGGNFLHLNRNKRSVRLDLKRPAARAALDRLIATADVLVHSMRPDAILRLGYGYERVRALRPDIVFCGAYGFGADGPYAHKAAYDDLIQAGSGLAALQTAAYGQPGYLPTVLCDKIAGQAIACAILAALYERRAGGGGQAVEVPMFETMVEFNFVEHMVGYAFEPPLGPPGFNRVLSPRRKPYRTRDGHACILPYSDRNWRDFFIHTGRLEFVDDPRFAPLAVRVENIEILYALVEEEAPRRTTAEWVAFCDSVSIPCMPVLGLEDLPEDAHLKAVGFFGSAEHPSEGRYRTMRRPVSFSGSRFAIRRHAPRLGEHTAEVLAEAGLEPAEIAALMDAPDKPDTAPLEAAR

SEQ ID NO: 1337 - protein, 396 aa, Methylobacterium sp.
MGPLQDIRILDLTTVLMGPYATSILGDMGADVIKLEPPEGDLIRQVGPSRSGCMGPIFMHANRSKRSIAVDLKTSAGRDVALRLAATADVLVYNIRPKAMERLGLGYEAVAAVRPSIIYLGAFGFGQDGPYADRPAYDDLIQTASAIPALMAESGEEGPRFVPVNIADRAVGLHAANAILAALLHRERTGEGQRIDVPMFETMASLVLGDHLGGLTYEPPLDGGGYPRLLSRHRKPFRTRDGHLCVVLYTDRHWQAFFRLAGQDWRAADPRYATHASRIRHIDELNGMIAEILPSRTSAEWESTLGECDIPCMAVQTPASLLENPHLVATGFFESVPHASEGQVKSMRVPSHWSRTQPAPGRLAPGLGQHSRELLLEIGLSDTEVDKLVNQRAVSE

SEQ ID NO: 1338 - protein, 95 aa, Methylobacterium sp.
MTRRCLLILVSVLSLSLQTGVALSESEMPAGGAFMSSYTSDPYFDPRSRYSQAHATGDIRGQPMLVEPGDAPPPCKLFDTACAAAFERSRPHAYR

SEQ ID NO: 1339 - protein, 358 aa, Methylobacterium sp.
VRAPAVVGLVLLLMAGPGPASAQVEPSPTAEGTGSAAARGATVVVVRATTDEAEVADLLAGFREAHPGVAVSYTKMNSATLYDGFVEEAAAGAVEADIVWSSAMDRQIKLVNDGYAAHYASPEAASLPAWAVWRNEAFGVTAEPIAIAYNRTLLPPEQVPQTRADLIRALTDHPETWQGKVAAYDPERSGVGSLILAQDADVTPRTWDLVSALGQAGVKLYTRTETMLDRIAAGEAVLAYGVFGAYALERARHDPAIGLVLPTDYTLLVSRIAFIAKDAPHPVAARMFLDYMLSREGQARLAARSLTPARTDARRADDPVASATALRPVPVGPELLANLDQIRHARMLRRWRRAMEGR

SEQ ID NO: 1340 - protein, 466 aa, Methylobacterium sp.
VTRPRAPSIRRRLLVRMLLPALALALLLGFVGALVIRNVVETTHDRLLDGSVLAIAERLTVEDGEVSVDLPRVALGMLESQAQDRIYYSVTYGGALVTGYRDLPGLDVDTLPLGVTNHRDGIVRGAAVRIAAQARRVYGKPDPVLVQVAETREARQGLERRLLAGLALAELGLMGLIGALSWYSIDSSLRPLTRLSDAIDRRAVPGAINLQPLDVAGVPREALAPVLALNTLLERLEQAIAGERTFTSDASHQLRTPLAVLRMHVELLRRLTPGEPAHAAAIDDIDGAARRLERLLAQLIALARADAGAAATDAAAAITDLNDIAARVVTEQVPHALARGGEIVLDRPDGAVPVVGDAFIVGEILTNLVDNAIRYNRPEGTTVVRVRRTETGACLDVEDEGPGIPPEVREKVFERFYRVATRDGPDGSGLGLAIVRALADRIGGAVTLGSRAGGSGLLARASFRAP

SEQ ID NO: 1341 - protein, 212 aa, Methylobacterium sp.
MLDRRTRKRLATRQAISDAATRLFMEHGFDRVTVDEIAEAADVGRMTVFNHFPRKEDMFFDREDEVRGMVAAAIHGRDEGASPVTALRLLAHRCIEDRNPLLPLFGASLSFVATALASEALKARARQMCSEFTRVLAEMMAEAVDRPADDPDAHLVAGLLVATWSVAFFEGYKVAETPGDAAAAGRVFLRLIDRGFQAAAGAAAGTPYAEAG

SEQ ID NO: 1342 - protein, 335 aa, Methylobacterium sp.
MRRSILFLAACLLAGITPAASAGPAADGVADLGSYAARMEVHPFESLTLTDRQFLTGTSEGAKPVTVAGILRIAKAGTERLPTVILMHGSGGLGGNIEFWQRALAARGISTFAIDGFTGRGLTSVNTDQSLLARTNLILDIYRALGVLAKHPRVDPARIAVMGFSRGGQAALYASLKRFDAAWNRSGVIPALYLPVYPDCSIRFRDDTAVADRPIRIFGGGSDDYNPAATCAAYAERLRAAGADVDLTVFPGAQHVFDNPAGPTQPVVARGAQTVRACAISEAADGALVAGPDATPFTYADPCVQRDPHIGSDAAARAGILARVSHALDAAFRGR

SEQ ID NO: 1343 - protein, 845 aa, Methylobacterium sp.
LARELSGGGLRVVLLESGGLDRMESADALDAIVNVGRPRATQWAVRNRIVGGSSHTWGGRCAPFDTIDFEQRAWVPESGWPFQRDALDPYLERTAKYLGLAYGNHFSDARFWDLFGSQPGWSEPDPRMLLPFFWQFSRDDAESYPFEYTRFGRKLDEKLGPNVTLISGATVVAIDVNGTGDRVQGVQVAAPDGAIVKLPARHVVLCAGGIENARLLLASDHQVPGGLGNRFDRVGRYLMDHLRGPVAHFDPHRSRALQRRFGRYTIEDRLFRGGLRLSPDVQRSRQLLNSAVWLGETLAPDDPGDAIRRILVGKPRAKDILTLTSNLPLLLRGCWDHFIARNGFPRKLSELSLECMVEQRPDPESRVMLSDQRDHLGSRLPLIDWRSHEDEGRTMRETARLVASEFARLGLPVPELADWVREEAPIPLSFVDVAHPTGTTRMSDDAARGVVDARGQVHGIDGLFVTGSSVFPTGGHCNPTQMIVALAIRLADLLKVREQRDTVVSDLRTSPPVPGDLRVLVTGATGRIGRILVEDLQERGYAVRAVTSQPLTEAQPRTGRVEWRTFDFTADQDYAGLVHGCAAVMHLAAELGKQDRMQAINVEATRRLAEAAERDGVRAFCYMSTVSVYGSGRARTVTETAPVLTSSVDVKSEYWALDYVRAYGRTKLAGEEAIRRIASTLPYVILRPTVVVDLHNLIGLRDWSLSKRLFAAHRPSHHVYVRDVTDAAIWTMTRSLTGAWPAGEVQVFNLSDQEARDARIGDFMRRAFTISRDPRFRVIPMPALVDWLHDFLRNRTLPLRNPLWRMRFPNDRLRQAGYRHRYGMARARAMALDILRAETRERNRS

SEQ ID NO: 1344 - protein, 324 aa, Methylobacterium sp.
MPGTNRRDLVRAALAGGAVLGLGGRARATAPFGGAQAPGFYRTRVGSCEVTILNDGARSFPMPDRFVRNVPRDEALGAARAAYMPPGQVTVPFNPTLINTGAQLVLIDTGNGPVPGAPVGRLAANLAAAGIRPEDIDLVLLSHLHPDHTNGLKRADGSLAFANAEIRAAAPDWAFWMSDANMARAADPVTQGYFANTRRVLGDLKDRIGTFAWDEEIVPGITALAAPGHTPGHTAFAVASGADRLLIQSDVTNIPALFLQHPDWHVMYDHDADQAQATRHRFYDTAASERALVVGYHFPFPSLGHVERDGRGYRLVPIAWTGVL

SEQ ID NO: 1345 - protein, 95 aa, Methylobacterium sp.
MNITMVGSGYVGLVSGACFADFGHTVVCVDSNRGRIDALNAGRMPIYEPGLEALVAENVRQDRLSFITDLETAVGQADAVFIAVGTPSRRGDGFA

SEQ ID NO: 1346 - protein, 990 aa, Methylobacterium sp.
LGIVSTSYVGRSVERVEDAALLSGLGRYIDDLGTRPGTLHASILRSPHAHADILAIDVQAAKALPGVTAVITGRDLDAVTTGLVPALRAAVDARAIAVDRVRYVGEPVAIVVARDRYLAEDGCDLIEVQYRVRPAVVDPLAALSPDSEILHEGVGANLVSDRRFRYGDPEVAFADSPHSLSVTVRYPRNTGSPMETYGVVASYDPTDDSYDVLANFQGPFSIHAVVARALKVPGNRLRLRTPPDSGGSFGVKQGVAPYAVLIAATARLVGRPVKWIEDRLEHLSASVSATNRVTTLRAAFEADGRVTALDWDQVEDCGAYLRAPEPATLYRMHGNLTGAYAIRNVAVRNRVVLTNKTPTGLVRGFGGPQVYYPLERLMQRIAVTLGLDPFAVIRANLIPADAFPYRTATGALYDSGNYQRALDEAARDGGLVELKRRRDAARAEGRLYGIGLTAAVEPSVSNMGYITTVLTAEERTKAGPKNGAQSTATITLDPVGSVTVQVASVPQGQGHRTVLAQVVADVLGLPMEQVRVTADLDTAKDAWSIASGNYASRFAAAVAGVAHLAATRLRDRLARIAAAQLNLRPEDLLFADGRIASRLNPDAGLPFARVAATSHWSPGLVPEDLGAVIRETVFWTPPELTAPDAEDHINSSLCHGFIFDICGLEIDRVTGKIAIDRYVSMHDCGRVLHPGMVEGQVRGGFAQALGAAVYEELAYGDDGAFLSGTFADYLLPTATEVPDLRILHVESPSPFTPLGAKGVGEGNCMSTPVCLANAVADALDLEAIDLPLTPAKLAALAAGGDEPAPPAGRAAKAAAKAGDRTLRGDGAATVTAPPETVWAMLLDPDVLASVIPGSHGVRKLSDTRFRADVTLGVGPVKGRYKAEVILSDLDEPRAVTLTGTVTGGLGSGGGTGRLTLEPDGSGGTRIAYVYEAAVGGKVAAVGGRLLDGAARVIIGGFFTALARRAGGSGKRGLRLPAALRWLLARLGVSA

SEQ ID NO: 1347 - protein, 69 aa, Methylobacterium sp.; identical to SEQ ID NO: 288

SEQ ID NO: 1348 - protein, 323 aa, Methylobacterium sp.
MTIRHDDLIVIDGLIVSDFGPEVFADMRRGGITAANCTCSVWEDFATTMRTMARWRGWFREHADLITPVHGVADIHRAKAERRTGIIHGWQNTSAIEDRIEYLELFHTLGLRIVQLTYNTQNLVGSGCYESRDGGLSDFGHDVLAEMNRLGILCDLSHVGPKTSEDAIRASQRRVAYSHCLPAALKDHPRNKTDAQLRFIAEHGGFVGVTMFPPFLARGAASTIEDYLDAIAYVIDLVGEENAGIGTDFTQGYGQAFFDYITHDKGDGRKLTDFGEVLNPEGIRVIGDFPNLTAAMERRGWPASRIERVMGGNWLALLGDVWA

SEQ ID NO: 1349 - protein, 61 aa, Methylobacterium sp.
VPPRVTEEYRARLCRAGSRVAFDRVPGVGHLSMAKDAAPAALDRIGDRSAGVRAPSECGEP

SEQ ID NO: 1350 - protein, 297 aa, Methylobacterium sp.
AQAPAQAPAPAPAGPATKPESDPAQETIRKLNAYVGLLNRTLRAQESLGRYQSWVNMKTGPTGRERIIYGLYGLYDVRGEIAKAEAATAQPPAMPDLDGAVKTYIAAYQALAPTVTEAEGYYERQDYRADKMEQGKALHAKLAVAGPAFLAARAKVDAALRVEKEKSDALELAAIEAREGRKARWHVANVMTACRKVMDLLPTDAKPVVDMAAFDAALGRYAVAVKDMDGYSAANPNSFHVFESRPRALLGKLREFDDKLAKARGDARRGAGRDVTWIVNDYNMMVSTAQTATTFSR

SEQ ID NO: 1351 - protein, 672 aa, Methylobacterium sp.
MFGKILIANRGEIACRVIATARRLGIGTVAVYSEADAGARHTRMADEAWPIGPAPARESYLVAERILDVARRAGAEAIHPGYGFLSENADFAGACAGAGLVFVGPPPAAIRAMGSKAEAKALMERAGVPLVPGYHGAAQDVRALKEAAARIGYPVLIKASAGGGGKGMRVVEAAAAFEAALAGAQREARASFGDDRVLIEAYLTRPRHIEIQVFADSHGNTVSLFERDCSIQRRHQKVIEEAPAPGMDPVRRARMGEAAVAAARAVGYVGAGTVEFIAEGETFYFMEMNTRLQVEHPVTEMVLGLDLVEWQLRVAAGERLPLGAADLALRGHAIEARVYAEDPARDFLPAVGTLAHLRQPPEVPGRVRVETGIVQGDRITPDYDPMIAKLVVWGEDRAAAIRQLAAALAAYEVVGVTTNLSLLRAVAGHPAYRAADLDTGFIARHADDLLAPRATGAVDPALWAAAALTVLRDRLAAVAAQARASGDPWSPWADPDAWRMNGAGYQDLQFRHGDAPPFTVRACPRPDGSARLDLPGGTVLAALAEDAEGERLMLDGVWRRLRTVRRGAELTVIVGGRNATLVHVDPLAPPRTEASGSDRVTAPVPGRLTQLWVRPGDAVEKGAPLAVIEAMKMEITLRAPQAGTVAEVRHAVDDMVEEGTEIVTLAAEERPA

SEQ ID NO: 1352 - protein, 63 aa, Methylobacterium sp.
VPVVTCLRLFWLQNFRLNERDDYAPYADDGVRWHAETDGNPAAHTMVASPYDLDVHNAKKCMP

SEQ ID NO: 1353 - protein, 503 aa, Methylobacterium sp.
VSAAAPVLSEAAAAEEEPGLASGAAVTRRSFDAARWVAVASVGNVVLSFGVFLVLARLIGPAEFGMVAIAAVFIDILQIVARCGLPDAVVQRADLDEDFAATAFWVMLATGVLCAVGLVALAGPIAWIFDLPALRPVLCALSACFVITAAGAIHEARLQRSFGFRKLALRALGANVLGGAAALVLALDGYGVWSLVVQRLVAATATTLLTWAAARWIPPLRLHLASVREQIAFGSRLFCTYLLLVASIRSQEVIAAYFLSATDVGYLRLAWRCIDLVSQVAVIPLTTVGLTTYARLQDRPGELAAAFHGFTEASAFLAVPAFFGMAAVAPTLIPFLFGDQWHDAAPVLRTLALLAPEFVATSMLWMIFTALGRNGTALRLAGAQFGLGAAAALVTAPFGLAALVAGHVVRAYLFTPAIVASVGRVVPVTNGRLVRLLAPITLCAGAMAGLVLLVQGPIHAALGDRVGLFAAVGIGIAAYLGLAWIFMRGTLRTAVGLVLRRPA

SEQ ID NO: 1354 - protein, 408 aa, Methylobacterium sp.
MTEVLPADALAKRGLRDRAQAARSVVAARPRVLFVSHTGTMSGAELVLRDAVRPWAGSSAFLFEDGALTAALRDAGLEIRLARRQSALAGLRRDVSPLSALPVLGQLGALALEIARSARSCDVVYANSQKAFLLSSLAARAAGRPLIWHLHDILDGAHFGRAQRILQIRLANLCAARVIVPSEAAARAFVQAGGRRSLIRVVPNGLDVDPAPCSAAVLRAELGLPDGPLVGVFSRLAPWKGQDVLIEALATLSGLRCVVVGAPLFGEDAYAAHLRDLAARRGLSDRVLFLGQRDDVPRLMQAVDAVVHPSVDPEPFGRTLVEAMLVGVPVIATDAGASTEILDGGAAGTLVPPRRSDRLAAALSALFADPDAFRARAALARERALSRYGAESMQRDLADIILQVAGRA

SEQ ID NO: 1355 - protein, 389 aa, Methylobacterium sp.
MRVAIVHDWLYIVGGAERVLEQLLRIYPDADVFALFDFLPEADRARLGYTQAHTSFIQRMPFARTRHRNYLPLMPLAIEQFDLSAYDLVISSSYAVAKGVLTGPDQLHVSYIHSPMRYAWDMQHTYLRESGCDAGMKSVLARLILHRMRVWDFRTAAGPNAIVANSAFVARRIHKVYGRTAEVIHPPITLPIQQYDGPRGNHFLVASRLVPYKNVEAVIRAFALLPDLELVVAGTGPDAARLREIAGPNVSFSGFVPDAELRHLMATARAFIFAAEEDFGIIVVEATSEGTPVLALGRGGARETVQTRGPQRTGMFFDTPEPVAIAECVQRFLLQESHFTREACWAQAELFSAELFRSRFSTFVDDQMAMHRAACETRPRILPRLEAVG

SEQ ID NO: 1356 - protein, 770 aa, Methylobacterium sp.
LSHRTASQGPVAPAARRGAGAARWIPPAILAAGLLATGLSTALTWQAAALRDRMTFEHATEIELRTVEDQFRTYTALLRGAAGLFAAEGATVTLAQFRAYVQRIELQRLYPGFLGIGFTPTLPASARETFAARAAALGVENARVRPPTDNPMISPVLFAEPPNPRNLAAIGYDVMSDPVRRDMVERARDTGQPAASARIQLVQEIDANKQAGFLVAMPVYAGGAVPPDLEDRRRRFLGFVFGAFRADDLFNSIVAAEAEEDAAFAIYDGAPSEANLLHRSARASAAGAGRLTREAHLELGGRTWTVAFAQRVSPRRGSALPEIWLVCGGGLFATALLAFAAYRQRRTQDEIRQLNASLEARVEERTRDLRAAADRLRQAGEERARMEEALRQSQKMEAVGQLTGGLAHDFNNLLAGISGSLELIEARIAQGRSKDVGKYIAAAQGAARRAAALTHRLLAFSRCQTLAPRAIDADRLVRGMLDLIQRTVGPSVEVRHVGADGLWAALADPSQLENALLNLCINARDAMPGGGRITIETDNRWIDRQQADAQDMPEGPYLSLCVSDTGTGMPPEVVARAFDPFFTTKPMGEGTGLGLSMIYGFAKQSGGQVRITSTVGQGTNVCIYLPRHFGEADADGPDPARGLMAQAEAGETVLIVDDEPTVRMLVTDVLSDLGYTAIEAADGAGGLSVLQSGARIDLLVTDVGLPGGMNGRQMADAARVGRPELKVLFITGFSETALPGDGRLEPGMAVLTKPFAVEALAARIRELIAR

SEQ ID NO: 1357 - protein, 363 aa, Methylobacterium sp.
VAETTGGRDPRANNFGSLRLLFAGLVILAHAPELVDGNRSRELLTQVFGTLSLGEIAVDGFFLVSGYLITASYRAKRSFGDYLARRALRIYPAFVVASLLCIAVVAPLGGGNLAAASPLETLLRLSLLLMPVVPGAFAELPYPLLNGSMWTIPCEFGCYLLLGLVGTARALRRRGRYLGLLGGLGSLLALRWLFLPVGHPGDTLGSLSEMIRLTFVFCCGGAFRLFADRIAYTRRGATRAALLLLPLMFSRPLAEPAFAILGGYLIFWFAFAVRPTALSRATAQVDPSYGLYLYAWPVQNLLVARIPGISPWTVAALALAAAIPLGLLSWYLIERPMLRFRPGPGGARPEPGAIPAAAPALGA

SEQ ID NO: 1358 - protein, 195 aa, Methylobacterium sp.; identical to SEQ ID NO: 303

SEQ ID NO: 1359 - protein, 940 aa, Methylobacterium sp.
MSASVADIQADASPHHLPALTTGRDAWFLDTEQALAEEMDHFCGPPEPGDRAPWQARADQARLAALCLSGGGIRSATFCLGALQALASRRMLGEFHYLSTVSGGGFAGGWLQTFIRQCGSIAEAERQLGGSGNEIFAKLRRYTNYLTPEVGILSRDTWAGIVLYIRNTILNWLIIFPLLLFVPLALLAYRTALEAASGSTLWLPLVLGSAALFVATFSACTLLPSHRPRTGGVTAYASPARIAACIIAPTCVWALALPFTLRALFEQPLPVSGLSLCRLGLAYFAVQVAAYLSGLIWQTSKGHPGLWLYERNLGPWLASSLVSAGLICVCADASIGWLVGGSAAGFDAAKAEVSQILTVAAPPALIVIHLLQSVIFIGFRKSAECADLDREWVARVDGQFLLAAMGWTGLCLCCLVLSADALGRQDAQIPALFGALGALATGPAAAFLGKQVFVRAQSLAAKGRMDDLVMIGLSAMAAVFGISLFALMGWCLGRFLGQAHDWWGNCLLPRRALGGADTGADAGSVCGINPYGMIVILDVAVAAILAGAVWLFGRVNVNRFSMHGVYRNRLTRGFLGSARTRRDADPFTDFDEEDSPRIADLGTEKRLLPVVNMTLNLTDLLHTEWAERKAASFTATPFACGSAILDRADRARDRPGTVGPRGAYIRTSQYAGMETPGDRVSAGRGPLLGGLLTISGAAVSPNWGYHSSRLIAFLMTLFNVRLGAWLPNPAVARRDDLKLAKPRNSVLALLSELGGRSTDVRQAIYLSDGGHFDNLGVYEMLRRRCARIVVIDAGQDERCTFFDLGNVIRKAEVDGLAKVQMGEMRILPRATIEREGKRAGALGYARGTIAYPGGRDAASLIYIKPSFLDDIPAEVRAYGATSPAFPHESTANQWFSESQFESYRALGYYQVSKMFGSQLTTLSDWSVYLDSEIGRRTADS

SEQ ID NO: 1360 - protein, 236 aa, Methylobacterium sp.
LKLARGDRGRNVLLLGISLLFVAAGLGMIATGADGGVTTTVFFGVCAAVAVWQLRPDLLESESRSAGSLAAQFPGPVILRASVRKLLFLALMAAGFGGVTLWMVLHEAPSTAMQLLLWPGVALFLGGVPFLILTAIRGSALHLDETGFTVVQLGRARHVRWRDVSVFEPVSMPGSGQRLVTFDDANAGATRLGAMNRHQIGRNAGLPDSYGLDPDALASLLTAWRKRALQREDDGF

SEQ ID NO: 1361 - protein, 263 aa, Methylobacterium sp.
MIEIRNLSVRYGQGADAVAALSGIDLTIGPGEFVVALGASGCGKTTLLSAIAGFLAPTEGRILLDGAPVRGPGAERGVVFQRHALMPWLDVAENVAFGPKMRGVPRAERRRIALATLDLVGLPDCADRKVYALSGGMQQRVGLARALAGDPRALLMDEPLGALDAFTREQIQELILRIWHRTGKMAFFITHDVEEAVFLATRLVIMSPRPGRIVETLDLPFSRAFVEGRDARAVKSDPAFIAVRERVLARIRSGAAAAPEAVR

SEQ ID NO: 1362 - protein, 49 aa, Methylobacterium sp.
MQKIGLDLYVSAANKAGVLIWEKPGDGYGFPIPKNGRDLLVGADTTFEG

SEQ ID NO: 1363 - protein, 641 aa, Methylobacterium sp.
MAAPDGIRAVTLSSGGLAEVTLVHAVDGDGTIGLSVRPEQVDDILKSLVVRDPVGTVGALRLDGVDQADETLRTMPFTADDLSAPTRLVGKLQGVPIRVQSGGRTLEGRVLGVSERNAGTGTGDVSILTVLTATGTLESVPIEDGASVTILDPAMAAKIAEAIAAAGKTKVGDAHRVEIAVSGQGQREVRLTYVVAAPVWKTSYRIVDGGGGRANLQAWAIIENALGADWTGVDVTLSSGSPVALLQRLHKRYWRKRPEAPVMVEDVGMPDLDPGTVASKSVARLRAPAPAAAPLPAPMARMDTRDSRMEAAEPSYDAAAATAGAAASEGDVAANFTLPHPVDLRAGGTLSVPFLDTEIEAERVALWKPGQGVHPIAALRIRNSAGATLPAGLITLYDRKAGYLGDARLPATPVGEQRLASFALDRKVAVQAETAPSDALTKITVVDGVARATVIAREVTTYTIKGAPDAARSVIIEHPRRDGWTLTASARDGETPTAYRLKVAVPAGGTAETRAVLERVRIDAYDLVDADEALLVRWASLATDPELGGKLKTLSQARAEVAAATRTVEEIGERAAKVQAEQERIRSNLGAVPKDSELARRYLSRMGAQEDELAKLDAARTQAEDGLRASQARIRSLIAAL

SEQ ID NO: 1364 - protein, 178 aa, Methylobacterium sp.
MYRISAMLVLATSPALAAPAAAGDPGTRAPFIREHRCAVVERLDAIHRRGPVDVSRDRFIVVAPHGQAQRYVQCIFQDRDTRMFCEAASGAYGPPGRRRLRLDATARQALAALGYVQADPAENFARLVELGSPPDTGIAADLMLAALHDAYGARPGDILDIEAPHGGTPGRGCGAPES

SEQ ID NO: 1365 - protein, 321 aa, Methylobacterium sp.
MTARGPARATRRRVLAGGVLATGAAASGTVRAEVHPARAGEVRHGTVRADGVDVFYREAGRPDAPVILLLHGFANSSFYFRHLMPRLADRFRLIAPDLPSFGFTHVPEDRAYVYDFASLSRTTEAFVGALGLDRYILYTFDYGAPVGWDLALAHPDRVAGIVSQNGNAYLDGLGDAAWAPLRAYWAAPNAAAVAAIRARMTLDGVRAAYVQGVPDPSRIEPEAYTLDAAILARPGNADRQVTLKLDYKRNLERYPLIQAFFRARRPKLLAVWGRNDAFFIPPGAEAFRRDIPEARVTFLDTGHFALETDGDAIAEEIRRFF

SEQ ID NO: 1366 - protein, 90 aa, Methylobacterium sp.
VIFPRGEAALDVLSTVPEGPPRRFRWRARVHRVAHAEGPERIAAEWWRAPGADRDYYRIECEAGHRLWLYRDGPHAPDRPAAWYVHGLFA

SEQ ID NO: 1367 - protein, 309 aa, Methylobacterium sp.
LRILVATDFSTRSQRAVRRAGILAQQTGADVMLMHVVNGAGSRQVARDVREAQRMTVEQAAVVPELFRVDCRSLVVPGRLPDPVLNAAAARQVDLIVVGSDHGKDAQGLGQTVRDLIRAAPCPILVVNRSVVGPYAEVTVPVDLSAASARALHSVASLGLADRARVTVVHAFDVLGKPRLSGFGIPREQIEGYVESWRSVYAEETEAILEAEGLARRNWVRRTEEGRPDEVIASLAARTCSELLVMGTRGRTGFRRALLGSVTEAVLAAGQADVLVVPPPRPGSSSRSERSGWPLSAKAERTALQVVTA

SEQ ID NO: 1368 - protein, 210 aa, Methylobacterium sp.
MHPYVSDGLHADPFDAFRVRAHRGPMGGDPRGRHGPHGHPGRGPGDRRMFGRGGRGDLARFFAHGDLRLVILHLIAEKPRHGYEIIKAIEERVGGAYSPSPGTVYPTLTLLEELGHVTVTPGEGTKRLHAITPEGQAFLDGNRPTLEAILARMAEAEAARGDGPPPSVVRAKEGLKLALQMRLARGPLSAEQAAAITAALEAATAAVERA

SEQ ID NO: 1369 - protein, 190 aa, Methylobacterium sp.
VEIDLETYYQAARTGSLACIRSLDPIYGERFFFLRVREVRNGRIATARGIFWTVNGEKCDPGWGGDAHALVVPTLALLEMIEPNLERMAQFGVDRRFEIAVARAVLEGRLTEMPEMPQPPVPTLKEAQAELQAAMAYWEAVDVREAKPGTSVRIRREASERLVTARTNLERAKQQAGRLAGCGDRAGCPG

SEQ ID NO: 1370 - protein, 217 aa, Methylobacterium sp.
MKTYLIIGAGPGIGLATAERFAREGFRVVLASRDADRTRTLAAGLRDKGHVAEERTVDASDDASVAGLVAEVTASFGAIDVLHYNAAALRNQTVIDQPGDTFNADLAVNIGGALSAVRAVAPAMAARTSGTILLTGGGFGLEPNPDFLSLSIGKAGIRALALGQFEPFRAQGVHIASVTVVAQIKPGSAEATAVGEHFWRLHAQAPDAWTPEATFAG

SEQ ID NO: 1371 - protein, 218 aa, Methylobacterium sp.
MSTFLSIGSGPGMGLATAERFAREGFQVVLSARDEGKVRDLAEQLKAKGHKVDVRTVDAADPASVAKLVEGVERDFGGIDVLHFNAASMRNQTLADQPRDSFNTDLAVNIGGAAVAAQAAAPKMLQRGSGSVLFTGGGFGLQPHPEYLSLSIGKAGIRALALGIFEPFKEKGVHVATVTVAGFVTTAEDANAVAEHFWQLHSQPKGAWEVEAMYTPKG

SEQ ID NO: 1372 - protein, 1124 aa, Methylobacterium sp.
LQQGAALGLSPSPLFDGPSYLADNPDVAAAGQNPLLHYLESGRAEGRPISSCADADAVKRIATSPLFDAEWYRATQAPGVPADQAARHYLREGAALSLSPGPLFDGPWYLAINRDVAAAGQNPLLHYLNDGCSEGRSIAPFAEPAALASLEGSDLFDADWYRATHVPDLPPDQAARHYLCEGAARGLQPGPLFDGAWYLGNNPDVAEAGANPLLHYLRSGRAEGRPIRLACTRDAQARLIELRPVVLRESTSARVVVVVHAFYVDVFEELLPHLVRAIPHFHLLVSTDEPAKQCALEAAVDRAGLADQCRVVLAENRGRNFGPLVTVFARDILRYDLVLHVHTKKSLFSGAEQTRWRDEIYRALFANAACAAIALSLFEEDSRIGLFFPETSAHIVYWAHAWLSNIGTGYGLLDRLGLPYDGFDEYIDYPVGGMFWARVDALRPLLTAGLTPQDFPEEHGQTDGTLAHAIERVIPIVCRSQGYRAVCLDYDRGLARCGGSARNWHQYSARTQDQALLALQDVDLVSFDLFDTLVSRPARRPDGVLKLVEHRIAIEEGRPIPLFAERRAAENRIRARKHHQGDVNLSEIYAELAASGTIPGDVVARAQAMEKRIDLGALRPRPEVIAVLRAAHQRGKRIVLMTDTYYEDTDIRGILQAIGIADLFAALYVSNAVGARKDRGDLWRHVEEAEAVPRARWLHVGDNEHSDIQAACDRRIPYLHVAHPAKILAQSGFVRDEGDLARTWSSDLVIGHAMLMLCRNPFLDRPGPPYLSLGSARDVGYVVFGPLMLLFMSWLIRHEALGRVERLYFLAREGDFLVKVYRLIRERYGLRHLPEGRYFHVSRQVAIGAALGTGFRPDLVTGAGRYVGSIQSLLWNRASFTAPAHLGLDSRDVRLPADAPVVERVMTDLEPEIMAHGADLNARFRAYARQEGLDAGGLHAVVDVGYSATIQKMMQLALGQPLIGLYMTTFDAAQMVERDGGAAFSCFRAGAENPETSSLPVLAYGLAVEAFLTAPHGQVVGYESAGERIGPLFKADPRTPAEHGILAELHAGAEQYIIDTLDLYGPSLLQADIPSRGPQEFLRLLMQGLIATPSEPMRTLGVEDDFCGLPIHKVYAGAGSPASG

SEQ ID NO: 1373 - protein, 306 aa, Methylobacterium sp.
MLTFLLKRLLGLLPTMLIVSVLVFLFVHLLPGDPARLAAGQDADAQTVALVRTELGLDRPLPEQFVRYFANLARGDLGVSIRTRRPVSTEIGERFLPTLLLTLTSMAWAVAFGLIIGIVSAVYRNEWPDRFGMTLAVSGISFPAFALGILLMQIFSVELGWLPTVGADTWRHYVLPSLTLGAAVAAVMARFTRAAFVEVIGEDFVRTARAKGLKERVVIAKHCLRNALIPVVTMMGLQFGFLLGGSIVVEAVFNWPGMGRLLVDAVNQRDYPVIQALVLLFSLEFILINLIVDVLYGLINPTIRYR

SEQ ID NO: 1374 - protein, 331 aa, Methylobacterium sp.
LIGISVVSFQQGDLPKAVNYISAIVLENPFDSDLLGTCSALLRSFSVEEFADRVEAISDDAKKDARTITACLDGFLNMADFGSSGEAIVRVPSEIASAIHFISLDALSVGSNRSKFGRYSPINCVIAPTAGDYEFREKHFIYASSLLEDKQEILEAFGLRDLARVKAVHKVKAKRMSDALDEIGVSGLDYFKSDLEGIDGLVLRDARQHIAGAAVVQAELRFMPAYEGEPHFDETVAYMRGQDFEVLHLTNENWRYATRHREHMARGRTVFADTVFVKNIDTYLSLHGRSTEAVVRYCLACGVSGNANYAEFILEKHKALVPCDLGAALVN

SEQ ID NO: 1375 - protein, 263 aa, Methylobacterium sp.
MFDIWDRIAAEAVERAKAQSQAVALERKIRAPRNRRSNWTGDRQTLHEIGSVIHGRHLGPCDTDDGETYLRAALPWIVTKAGGFLADDLERHVTDWCRAAVPRLDLGAIRGCLAEAQERDGRQRLWWSAQDLGDLLRLKTDERERLRVTRIRPAGMTARKFATYQRARKAEQAKARRIAKGATPREQSKAQLEPWVALNMSRATYFRKQQAGTLPAQIRDRETVSSSPDTKYLEPVTGQSHVAEQTDRPPRGGPRSKLVQGWS

SEQ ID NO: 1376 - protein, 827 aa, Methylobacterium sp.
MSGGQGGSGADPVNGTGGQPGADEVANGTGAAGGNGGASAQGSGGGAGGSAGSVGGAGGNGGAAAGGTVTNTSGTGGAYSTNTGSSFFGGAGGAGLAGPNPGDGGGGGGGGSHGQYLSNTGNGVGFTFSRTGGTGGTGGAGNGTGGGGGGGSGGYGFVEPGPGSFIASAQITGGNGGAGGAAGGPGAFGGSGGEGGIGLFLYGSTGTNTGQITGGNGGLGGAANGGTAGIAGQGGAGLSGANIAITNTGTISGGFTGGSTTVRAVAINVTGGTNSLTPSTGTLNGGLGIAGGATTLRVLGNAPNNLGPVANAGTFDISGTTAGASITTLSGTGGTTLGAQALTITNGSTSYSGAISGTGGVAVTGGTQTLTGVSTYSGGTAIGSNGGAVSSTLQLGGPTSAGTGTITFGTMSGTATARLGLNVAAQPTNGGTFANTISNFGSGNEIALAGLTNSSVSYNSANSSITITGTRSGGGQVSENFVLSAPRTTSFAAVSDGQGGTIVRAATAPNPTNPTNPSQPANPAPCYVTGTRIRVLRDRVISDVPVEQLAVGDLAITIAGTPRPIRWIGTRAYRGSMVPPAERPVRIRADALSEGVPARDLLVSPDHCLWLDGLLAAAGHLVNGSSITRGEAVADLTYWHVELDTHDLLLAENAPAESFLAAPGVRGGFDGVQALDVGTGRMPYAPRAELGPDLAALRGRLALRAVSLDGAAEPGSVRAWLDRCVVTGDGLLHVGGWARDEAHPDTPLCLDVLVDGAVVAFAVAAEFRSDLAAAGFGDGRCGFDLGVHVRLAPHVHHRVEVRRSADGLLMCAKRMDAAGSWIALLAA

SEQ ID NO: 1377 - protein, 156 aa, Methylobacterium sp.
LKKLLRKAQVKPLKQVAALPFRVGADGRIEVLLITSRDTGRWIIPKGWPMTGRKAHQAAAREAYEEAGLEGQIAANPVGRYHYQKRFDHGRAFPCMVRVYPLRVEAQHERWPEQAQRTLQWFAPEEAARLVHEDELQELLTDFAARPIEIRGDGRG

SEQ ID NO: 1378 - protein, 478 aa, Methylobacterium sp.
MGFCQGGLFLAQFGTSLALARLLTPHETGIFSLAAAIAGLLSTLRSCGLSSYIVRADRVDGALLASVFTVNLILSGAAAILILAFSVFGSVLLGEPEVQRALAILAVVPLVGALEFRPAAMIERHGNFRGVALVNMLRGLVASGAMLALALLGFSYMSQAYGQAAGAVAAALAANGLGLRYVSLRMGLAGWREILTYGGRLFAIAGVAGIAGRMGDLVLGRMLGLSALGLYSRAASLNTLMWDHLHVVITRITFVDLANQQRNGQSLRTCYLHTLRMITVLLWPAFAGAAVLAGPIMRVLLGPGWEGAALPFCLLSLAAIVLTSLSMTWEVFLIRDQTALQARFEFLRHGAGLVMFSIGCLFGLGGAGAARIGEAFLAVGLYRPHLERMTDTFRRDYAPIYLHAAVLTGIAVAPAVLVMSAWGWSAETPLPSLAAAIAAGIAGWACGLWYLDHPLVAEARLLLAHMRPARPATSVSNL

SEQ ID NO: 1379 - protein, 304 aa, Methylobacterium sp.
MAGPVSECWGSMLRELKTFVAVARLGSFAAAGQAVGLTASAVSAQIRNLESELGVRLFDRTGRTAILNMNGKKALVHAHEMLATFARMMEVGDGATLRGELKVGAISTAQTGILPEALVLLQKEAPSLKIHLVPGVSLPLLGQVDAGEIDLALVVKPPFELQKDLHAEDLLREEFVLVTPTYVTESDPMEILASYPFIQYNRTSFAGRQVASFLNQQNLALDQILELDEIAAIVRMVQSGLGVSIVPWTGDCGASPERFRILRLGPLAFHRTLQLVVRYSQRTNPAVDLFLTCLKRATAGRQGQ

SEQ ID NO: 1380 - protein, 260 aa, Methylobacterium sp.
MVTISRRRALGAVAAGATAGLGPAAAAEAQPAPLFPLPQAIIPILGEAQVFPVRRIYCIGRNYAAHAREMGSDPSREPPFFFQKPADAVQVVAGGVADHPYPSLTQNYHHEIELVAVLKSGGRDIPAAQALDHVYGYATGLDMTRRDLQRGMGNQKKPWEIGKSFDQSAPITPILPVARVGHPARGRIRLAVNGTVRQDADLSDMIWSVAEQIAELSRAFELKAGDIVFSGTPENVGPVVRGDVLAGSIEGLPDLSIRIV

SEQ ID NO: 1381 - protein, 117 aa, Methylobacterium sp.
VRRFWISTILGLELLLGGTLAASARTAGVPDFNIRAICAPEHRAGSTAVDRASYRGCLSDEAAARRTLIKRWATFDVAERRTCATESQIGGAPSYVAMLTCVQLGSDALPINPSGQP

SEQ ID NO: 1382 - protein, 94 aa, Methylobacterium sp.
MLYMVHMQVNIPASLPKEEAARLKAEEKAYAQKLQQDGRWRHLWRIAGQYANYSVFDVAGNDELHEVLSSLPLYPYMAISVTPLAQHPSAIAAN

SEQ ID NO: 1383 - protein, 269 aa, Methylobacterium sp.
MSSAVTAAGITGRTRVYGILADPIYHVKAPEVMGALFARHGVDGVLVPLHVTADGLAAVMDGLRHLRNFGGFIATVPHKTAMTGLCDALTREAEQIGAVNCVRREADGRMVGTMLDGIGFVEALRASGLEPRGRSAALAGAGGAASAIAFALAEAGVARLTILNRTADRAQALAERLRAAYPGLAVAAEGVQAEHDLLVNGTSLGMRPQDAAPFDLGALHAGQFVAEAIMDPEITPLLAAALRAGCRVQKGLPMLECQIALMARHMGAL

SEQ ID NO: 1384 - protein, 349 aa, Methylobacterium sp.
LRKATAAFGADLVHVDAPAAPGTGRVTVAVAAAGICGSDIHAFEWTPGYGFMTAFMPVTLGHEFSGTVRAVGDGVTALAVGDRVTCWPTVPCGACAACAAARPQDCQGRRIVGLHADGAFADQVVVPADNCRRLPDGLPLTVAALAEPLAVAVNAVDVAEVGPGDRVAVLGPGPIGLCIAFVAQQRGADVLLAGLDDAARLDLARRIGIRHTVDLADIGLDDAVRRAFDGEADRVIEATGSARSVSDGLAVLRSGGVMVVAGIHSGSLDLDLTGFVRSKKQLRAAHDTTARAFDAALALLAAHAGTLEALITHRRPLAEAGAAFELARSRQAMKVLLLPEAAASRETER

SEQ ID NO: 1385 - protein, 197 aa, Methylobacterium sp.; identical to SEQ ID NO: 330

SEQ ID NO: 1386 - protein, 67 aa, Methylobacterium sp.
MKTVVATAVVVLFCAGARADELNDMPDIACAQASSAVERDHIGCPGTDRAAAGSRAAASPLDRAEDD

SEQ ID NO: 1387 - protein, 300 aa, Methylobacterium sp.
VTDILVPAAPTVAPVPTGIRTPWSEFWRKFRRQRVAVLALGFIGLLVVVAVLAPWIVPYDPVNDFDYDRINEGPSLAHWLGVDPLGRDILSRIVEGARISLATGFLSVAVGGLVGTVLGLLAGYYGGWWDRIVMRMSDVLFAFPGILLALGVVAILGSGLVNVVVAVSVFSVPAFARLVRGTTLVLKNSTYIEAARSIGAPDRTIILRHILPGTISGIVVYFTMRLGTSIITAASLSFLGMGAQPPTPEWGAMLNEARADMVSAPHVALFPSLAIFFTVLAFNLLGDGLRDALDPKIDRL

SEQ ID NO: 1388 - protein, 138 aa, Methylobacterium sp.
MPAAGGSPVGLRLTRSDAAGLLARIAPRIGRYATLRLALAGGEAVLFAPDTGSGRPALPWCATPLGWLAADGPLLLPFGCRLAVPAPWRAEVARRLLDRHGLGGPALLVPEGETLRLLDLAGSRAVPDIDTGRLGEAA

SEQ ID NO: 1389 - protein, 171 aa, Methylobacterium sp.
MLAVRLSKAALVGALALTCTLVVYGNVTEPAVNLAFVQHVLSMDTILPDSGIADRAITDPALQRGAFAMIVAAEAVTALLLWIGVALMLARLRAPRGDFDRAKTWAIAGLSVGFLVWQAGFLGIGAEWFGMWMSKVWNGQQSAFRFAMTVLGVMIYVALPEAEDPEAGRIG

SEQ ID NO: 1390 - protein, 405 aa, Methylobacterium sp.
MSRTSPSAIDRAPVADRSGTGNVVRLAVAQALAGANSTVVFATGAVVGNMLAPSKVLATLPISIFVVGMAACALPTGSIARRHGRRTAFMVGTGCGVLVGLLSAWAIVAASFWLFCAAMFLGGAYAAVVFSFRFAAADCVPADRRPRALSAVMAGGVFGGVIGPQLVTHTMDLWPPYLFAATFLAQAAVAAAAALILAGVRLPRPAAGSVSGGRPLAVILAQPRFVIAVICGAVSYLLMNFVMTAAPLAMRLCGHAQEDANLGLQWHVIAMYGPSFFTGRLITRFGASRVVAAGLTLTGAAALVGLAGLDVGHFWLSLILLGVGWNFGFVGASAMVLDCHRPEERTRVQSINDFIVFGMVAVGSFSSGGLLTSYGWDTVLWVSFAPLALAATALALTTGRGAKAW

SEQ ID NO: 1391 - protein, 225 aa, Methylobacterium sp.
MKNRTIASSIGTEIRRRILDGRYPAGSQLRQDGLAAEFGASRIPVREALFQLEAEGLVRILPHRGAMVAPLSAADAAEALELRGALEPRLLALSAPRLTADDYARADTLLEEYAAALRAGATARWGALNTELHLLLYGRADRPRALGLVGSLLAECDRYTRLQLSTDSAELERADREHREIVRLCRNGHVSAACALLTDHIDHVAAALMAFLGAAPVPARATEIV

SEQ ID NO: 1392 - protein, 953 aa, Methylobacterium sp.
VTGTVFSRSLRARLVGATLSTAAIALAALVFLVVLRSGQTLREQAQEVSTWSEAQLSDRLLSDAKLAAARLQMQREDVERRFATMAKRWDVAKAVFSGNTVAASELLRPALALADLDGAIAFDLNLRALTADRVEADLLAANAAFRTSPVAASLRAVLARNDREHAEGFALSLRWDDALARALAATESGTVADIFGEPLFDDFGEVIGGLVGYRVLRAHEPTLTAFASLSNRDVLILADQNLLSSAGSEVSNAQLGPASGAELHAVLGAEKVARCIPQPPDIRLCVAAPLRELQQLTGKVVGIGEESSRALLRTLSVVAGLTLCLVAVVMLFLSSRITRPLVRITQTVSEVARGNWHVSVPDIDRADEVGDIARAVVVLEHSLSERDQLRDDVFRQNTVLTERERQLQEQNERFDAALNNMSQGLCMFGVHGRLKVYNSQFCRIYGIAPGVLDLDPTQDEVHRLAGLTDWSAAESGPIRRTLTRTLADGRCIEITVEPMADGGWVETHEDVTASVTAQARIAHLATHDALTGLSNRALLADRLAAAFADHAVGGRAVTVICLDLDDFKGINDTLGHPAGDELLRQVGRRLTGLCPSGGTVARLGGDEFAMVLFEADLPDGVLALAEQILIQLRRPFFLAGQFVSVDGSLGIAISGTEDADGDDLLRRADVALYAAKADGGRRVRVFEQEMEERQNQRRWLERELRLAIGTAQIELHYQPLFDLATNAVTSFEALARWHHPESGMISPGEFIPVAEATGLIDALGAYVLERACADAMTWPGSLRVAVNISPIQFREGNLDRFVEEVLLKTELPSHRLELEITESVILSQDQASFEMLSRLRSLGVRFSMDDFGTGYSSLSSLNTFRFDKIKLDQSFVRNLLEKDEAAAIVHVVAELGRSLKITTTAEGVETPEQLARLRASGFSEVQGYLLSRPIPAAGVAAFINAQEHIHVAA

SEQ ID NO: 1393 - protein, 269 aa, Methylobacterium sp.
MALLFTSLRRIIAGGIILLALPAAARADDLAVVGTGDGIEMLQAVAAAYNAERGDARVSVPPSIGSGGAVAAVGGERQRLGRVARPLTEAEKAQGLVEVPLARIPSAIFVHQGVGVTNLTSAQTAAIFAGTVDNWSALGGPDLKIRVVRREDTDSTLTFLRATMPGWRDLVLTSRSKTATTTQDAIATVRETPGAIGFGPYSPALAGDLAVLTIDGRAPRDPAYPSAVTLALIYKAATRDAAASAFLAFATSDRAGQVMAERGGAPLRP

SEQ ID NO: 1394 - protein, 345 aa, Methylobacterium sp.
VAERVTLVINGRRVSASAGQTLLDAGLAAGQAIPHDCATGQCDTCRVRIHAGAVDDAGTRIGETVQACRARLTTDAVIEFDEVPETVRRAGTVDRVVDLTAEIVEVTVALRKRLTYLPGQYVRVSFAGLPARDYSPTLRADGSGELNELIFQIRRQPDGAVSPLLGGRIGPGTAVKVEGPFGTAFHRLGRGRLVIVSSGVGWAPAWAVARASRMREPERDLLVVAGARHPQNLYMRPALDWLRARGATTVLTCSGGNPPPDARPGRPTLHMPMLTRDDTVLAAGAPEMVAAVQFLAAATGATCYADPFYAAARGADGRPPSDTNFLQRFLQRVAGHRTAKTEPVA

SEQ ID NO: 1395 - protein, 590 aa, Methylobacterium sp.
MSEPLTLAPHQPGGAETAPGWRSTAAAQVDRHPRSDVGTIVIHWVVAIAMVASLLTGLRISADAPVARTAKFLAPLLPQGEVWTVHFVAGLTLFFGITAYLVYLVRGRLTDRNGLSRLRALRVSGRSKAARKARWGGINVALHWLIYAVTLVLTGTGVALYLGYGGWVVWLHATCALVALAYIAVHTLAHFMYGGLWQLLRLFRPAALADGAARRRRPLLAAAIIGLPVVGGLAFADVRGRSTLVIDKVSAGPDLSKLLDDPVWRTARPVSVRTMQGANFGGTGETTVEIRAVRDATNVYFAFRWWDPSRSLKRVPMIKKADGWHLLDADAARADVTAYYEDKLAVIFSRSDAFGSGGSTHLGARPLPDAPAPLNGRGYHYTTDGSYIDMWQWKAARGGMLGVVEDMHIGPPTDPTAAERAVKGRYQAGYWGDPGTSAYRYNFKFEGPGGYAGAVEPLRLPKDWQATVAKLGTVDLDFDASTSPGSAWWMVEKTETVPYSAAADAEIPVGTVMPGVLMTDGYTGDRAGISAAADWADDHWTLVAARKIATGSKYDVDFLPGNTFYLYVSAFDHTQTRHTRHMRPVEVLLR

SEQ ID NO: 1396 - protein, 750 aa, Methylobacterium sp.; identical to SEQ ID NO: 340

SEQ ID NO: 1397 - protein, 268 aa, Methylobacterium sp.
VAGVSSMNFVTGKTTSVRAAEPGRKRARKAVKGASQEAPQEASQGASYAAGGNDDLPDLTLTDRAYQQLEEMITTLVLPPGLVLGEQNLVQRLGIGRTPIREALQRLARDGLVVVMPRRGILVSDINVRSQLRLLETRRVLERLIARLAAERSTREEREVFAGLAQDMRDAAAASDDLAFMRLDRQFNELIATASRNEFAVRSLESMAGLSRRFWYQHYKQAADLPLTANLHADVCEAVARRDVEAAGAASDRLVDYIESFARKTLDL

SEQ ID NO: 1398 - protein, 194 aa, Methylobacterium sp.
MIAAPTATRAEPVAALLRDWTTANGLCRGGSGDDPRTQVACERRDGLDRRLAAAGWCHGRPADTGAQRTWQPCGDGTRQPAQAGTETPQGAARRVLLDVARGPAEAGRGQPVQFVVHALNQVGPWAFLFARMQRPDGRPLPRAADDLDSNDYAALLRQDGNGWRVVDFAVGPTDVAWEGWDRRYGAPASVFAVR

SEQ ID NO: 1399 - protein, 406 aa, Methylobacterium sp.
MKRLDVAVIGGSIAGLTTACLLARSGHAVTVFERSAAALTGRGAGIVTHPGLRAVLARCGAPAGAGDLGVTVEGRRVLDRDGTVIAERSLPQVLASWGRLYGLLLDAAPPDSVRYGAALAAVEPDGARVVAFFEDGRRISADLLVGADGQFSTVRSRFLSGVAPRYAGYVAWRAVVDAAALAPATREAIGGHFAFCLPPGEQILGYPVPGRADEAAGLCFNAVWYRPTEEAALAALLTDTGGVRHALSIPPGRIKAAVLESMRADAARILAPPFAEVMLRAEQPFLQAILDIETPTMIPARGVALIGDAAFVARPHVGMGATKAMEDAAALADALDAAGADVDAALTAFEARRRAYGAAVVARGRDLGAYLQAQQRGAAERAAAERFRSPEAVMAGTAVPPDVPRA

SEQ ID NO: 1400 - protein, 402 aa, Methylobacterium sp.
VIIGGSMAGLFTALLLRRAGWDVDVFERAGAELSSRGAGIVTHAELYEVLQSAGIDRQAAEVGVSVIGRRVLGANGSIVGELPLPQVLTSWGHLYGLLREALPTECYHHGRSLTRIEEDADRVTAHFEDGSSASADLLIGADGIFSAVRTQLAPEVLPSYVGYIAWRGLVNEDDLSAGTREALLEHFAFALPDGEQMLGYPVAGSDNSMARGRRRFNFVWYRPAAADTALRDLLTDVDGVEHQLSIPPSRIRPEVVAAMRSDGRRLLAPQFAEVVEKTGQPFIQAIQDLETPRMRLGRRVVILGDAAFVARPHVGMGVTKAAADARGLVDALVANPDSLDDALAAFEAARLRYGAAVIRRARELGAYMQAQILTPEERAMAERHRRPEAVMAETAVATGIAA

SEQ ID NO: 1401 - protein, 106 aa, Methylobacterium sp.
MPKRLTITVPHDLGTAEVRRRIDLHMDWAFRRLEAEKIRVEAEDWLGNRRSFSGSGYGQSAHVAIQVADDALEVEALVPWMASLFAPVIESVGRHYVGRLLSDEAA

SEQ ID NO: 1402 - protein, 465 aa, Methylobacterium sp.
LIDAGSQTASASDAAASVAGSIAAVSRRLDSLPMTRLHAAALAVCTLGLFTDIAEVALSNALAAIFLAPPHNMSRGSLSLLLASVFAGGAVGAPVFGMLGDRLGRRRALQASLALMAAGSLAAAASQGLTALTIARTVSGFAIGGFPPLVATYLAEVTPARRRGATLLVCAGLGLLGGLAAIGLVQMMAPAAPLGIEPWRWALILGGALAALGGVLFARLPESPRWLASVGRSAEADAACRRFERAAGRSRVAAPADPDTDPPATGPAGFRGLFAETRQLRRTALFVGLYTLAPLATIAFPLLSAVVMVEKGFKVDQSLVFAALSMLGPPLGTLLTALAIDRLERRAVLTALAAAMAALGTAFAASGTFLTLVLVGIAFNTAAATYGSILAVYATELLPTPLRASAMTCAWAGGRVAAALAPIILLPILSAYGPHAMFAVITLVLAASAALLLAGPRGLSGQALA

SEQ ID NO: 1403 - protein, 135 aa, Methylobacterium sp.
MVAAPGPILAGALVVAGLGFASAAEAQVPTRVGTCAATTIARIGTRFSDTLVKPKGDGIGDGTSVDLKNGVYGVSYAYVEAVARSRVGDRVMTCLVLVPTGCPKGDDRGKMYTTTNLRTLDSWTLPDSQHMCGGA

SEQ ID NO: 1404 - protein, 426 aa, Methylobacterium sp.
MQDLSDPVTLSAGAVLFDEGSIGHCAYLILSGRIAIFRRRDGGEAVLARRGAGEIFGEMAILDALPRSAGARAEADCVLVPVSAAQIQQRLAGADPILRLCLEGLIARFRETLPRLGPAVAEGPPAPLSPSARADFDATVASLAQERALRRALARDEFALFLQPIVRLATGRLAGFEALIRWHDPERGLVAPASFIPAAEANGLILAITAWVIDAIGRIVPRILQAGLQAPAAVEPSLFVSFNVTAQDLARSDIPTLIDAMLRRTGIAPDALKLEITESALMQDPAGAAAALARCRAAGLGIAVDDFGTGYSSLSHLSTLPITTLKVDRAFVRAMLAEPRDRRIVQTILRLAEEIGVVAVAEGIEGRAEAEALAALGCDLGQGYHFGRPMPEADALAAAAAWNAEAWRVGLPRGTGQGRPRVRAQG

SEQ ID NO: 1405 - protein, 63 aa, Methylobacterium sp.
MSDDDGFDRMVEATILAHQLVVAHGTATMQLLSRLLLMEIGTEIAARRDPDPAANDNPDALAD

SEQ ID NO: 1406 - protein, 427 aa, Methylobacterium sp.
MSVRETLEARLARIAAGDPAVFTRLYPEQARAAADAADARRRDGISLGPLDGAMVSIKDLFDVAGETTRAGSVLLADAAPARSDAPVVARLRRAGAVILGKTNMSEFAFSGLGLNPHYGTPGNAADPARIPGGSSSGAGVSVGQGTSDIAIGSDTGGSVRIPASLNGVVGFKPTASRVPLEGAFPLSYALDSLGPLARTVADCAAADAVMAGEEPAPLEALAVAGLRIGVPRGLLFTETEAPVAEAFERVLSRLSRAGARIADHPIDDHLAAMDAALPDGSLAAIEAAAIHADWLDSAAGRYDPRVHRRIVAGRNATAAGYIRTMRRRAALIAAFDRHLAPLDVLALPATAATAPLTAPLAADDAAFLAANRLMLRNTAFGNFFDLTGLSLPMPGLPRPAGLMLLARHGQDRRLLAIGAGIEAALAG

SEQ ID NO: 1407 - protein, 96 aa, Methylobacterium sp.; identical to SEQ ID NO: 352

SEQ ID NO: 1408 - protein, 149 aa, Methylobacterium sp.
LSKWYLYGIALVAGVANAIEPGQNATLAKVTGQPMLAGLFCFGLAIACFLAAMAVARLRGRSQAEAATPVPWWAWPGGVLGAAVVLAQLYISEKVGAAPFLGCVITAGVVGSIILDHHGLVGFARHRAGRWRILGGALMVAGVALVAAF

SEQ ID NO: 1409 - protein, 433 aa, Methylobacterium sp.
MRVGDLSIRTTMSLVLVVMATIMLGFATGTVREARQHAAEAERVIALVRASRALLQTLNVTRFERGATLQFLAAAEPVEAETRAALYADRERAIAGLAAARPLLDGLELPAVAATLGRLNEASGRLDRLRPRVDAALDVPGARRDGAVTAEARAALQAMLDALIATSDAVDAAIPLSDGLLRRDLALKRAAWATRMANGAVALRVQTSLAAGASWSLDETVAAAEERGRLDAAWNAAIEAAAEASGTVQAAFQRARENNFEGAPLARRRAVAQALARGAPPGLTLAQARKLDTPEQVTLVDLAFVCLDEMVARAEALSGAARSTLWRDGAALVATLLLVALGLLALFRGVLRPIRRITAAMEALAAGDSAVAVPGLRRRNEIGAMARAVQVFKDNLIRTRQLEAEAEAARQDAERQRGLAMRQVADRFADAVG

SEQ ID NO: 1410 - protein, 76 aa, Methylobacterium sp.
MTRTLTFAALAALLAVPAVQAEARPRHTPAKAQPSAAIKARQTVLNDFNARMSRLDALMGTPSRSSVRARSAEAGR

SEQ ID NO: 1411 - protein, 38 aa, Methylobacterium sp.
METTMTWTNRIALVATLIAGAVALVTYAQALSLPAHFA

SEQ ID NO: 1412 - protein, 38 aa, Methylobacterium sp.
METTMTWTNRIALAATLIAGEVALVTYAQALSLPAHFA

SEQ ID NO: 1413 - protein, 258 aa, Methylobacterium sp.
MFADGQVAVTLSGEGPPLVLLHSLLADRTSFDRVTPALGRDFRLLVPDLPGFGASAPAPGGLEAVADRVGAALRAATGGRPAAGLGNGYGGFVLLLCALRHPDLFDRLVFADCGACFPEPGRAAFRGMAGAAAEKGLAALADTAMRRLFAPAFQAAHPDLMAERRAAFLRTDVDVFRAACAALAGLDLRARLSEIRAPALVLVGEEDEATPPAMARELAAGLPDARFVTLPDCAHVPQLQAPELFAREVLAFLRPGSA

SEQ ID NO: 1414 - protein, 105 aa, Methylobacterium sp.
VRLRARLAAALRPPARAGVQHLPRRVWPGEEAAWRDENGVRHPRAVRRALAALAALEPRGRYGARIEGRGKVVTGPASALVLRDAEAEIGFVLGLTPDGYGAELF

SEQ ID NO: 1415 - protein, 287 aa, Methylobacterium sp.; identical to SEQ ID NO: 358

SEQ ID NO: 1416 - protein, 222 aa, Methylobacterium sp.
VQHFGVTVQNMDRAFAFYTEVLGGTEVMRDGDFKGEPVHFTLMADQEIVARERRVDPRTIGVPDLKGGSQRLDVRFVQFENVVIELLQYRDATQPMGGGDSWAEPRDHMSPAYPRSMHICFYVRDDVNFDKFIADLEAECARRGMTQVRANRTVPVHSEEQRRAAPRDTNTIKIHEGPSNGWSIIYCKGPEGEQLEFVQVLGPVKKTFDDAAEARRAATNRG

SEQ ID NO: 1417 - protein, 171 aa, Methylobacterium sp.
MAYHPVPVTHVGLTVTDIRAATEWYTKAFSCRHIIGPLHVRHDGSHIGEVFKGIFGDRFEEGYVSHLATANGVGIELFEFVTPKSEAVDDNFRYWKTGVFHFCLVDPDVEGLARRIAEMGGKQRSKVWTLFEGEPFKAVYCEDPWGNLIEIYSHSTELMYANRSATAARAE

SEQ ID NO: 1418 - protein, 117 aa, Methylobacterium sp.
VVRADPTRRSGPRRRSRWRGTRSSAGAPKAPLADPRRGCHLPRFFLNVRRHGTLIADREGDDLPDRTAAEHLARDILREMRRLPHVYGAPRGWRADTFVITDEAGAVVAEVPYASVL

SEQ ID NO: 1419 - protein, 262 aa, Methylobacterium sp.; identical to SEQ ID NO: 362

SEQ ID NO: 1420 - protein, 91 aa, Methylobacterium sp.
MIGAGYVGLVSGACLADFGHTVVCIDRDPDKIASLNAGRMPIYEPGLDVLVAENVRQGRLAFRATMRDAVAEADAVFIAVGTPSRRGDGFA

SEQ ID NO: 1421 - protein, 86 aa, Methylobacterium sp.
MTRLPIIVLATLALGGSAVAAEQGASSKTPGHEMQDRGSRAGSPGASGYAPGHEMKSGGTDSTGSTSRSGGSTTGTTGTSSTGTRR

SEQ ID NO: 1422 - protein, 317 aa, Methylobacterium sp.
MLDTDDLRFFVAVAASPSLAAAARSLNVSPPAVTQRLRSLEKRLRVHLVDRSGRGLTLTDEGELLAERGRDLLGAFDDLADALAERVGAVTGHLRVVAPLGFGRRYVAPVVTAFRLRHPGVRIDLLLSDRLGRIPSETWDLAIHVGEIREATPSLTVRALAPNDRILCAAPAYLARHPAPRVPADLRDHTCIALRENDEDVTLWRFRAAEGAEVRVRVDAALVSNDGDVVRGWALAGLGVIVRSEWDVADDLRAGRLARLLEGYALPSAPVVALLGSERRSRAARTERFLEALRRSFDPLPWRPPAGPGAAAGDAGP

SEQ ID NO: 1423 - protein, 206 aa, Methylobacterium sp.
MIDLYAWNTPNGRKISVALEEMALPYRVIPVDITQGAQHAPDFLAISPNNRIPAIVDPDGPDGSPIPVFESGAILLYLAEKTGRFLPEDRRQRVAALEWLMWQMGGFGPMPGQVHHFLSVAEADRAYGLARYSKETHRLYGVLDRRLAQVAYVAGPLSVADFAILGWAWRHERHQVDLADYPQVRRWYDRMMERPAVQRGFTVPLS

SEQ ID NO: 1424 - protein, 184 aa, Methylobacterium sp.
MDDLLREFLTESGEHLDTVDAELVRFEQDPNNETILRNIFRLVHTIKGTCGFLGLPRLEALAHAAETLMGRFRDGLPATSDSVTLILLTLDRLKAILADLEATGTEPAGSDDDLISALERMAEGSPEPEAAAPPPPPEPVLPDPVVRELKPGEVSLDDLEAAFLAAPGPDESDFLPPPAPVAAM

SEQ ID NO: 1425 - protein, 498 aa, Methylobacterium sp.
LRQAFPFLTAPQIAQTMFTTATHLGDGPANAPNAIYGWGLLNLGKAIDGPGQFTSTWTVNTTYNGQAYYGRFANDISGVGGLIKVGLGTLELAGTNTYAGGTAVLGGTLAVSRDANLGAAGTGLTLGGGTLEVLADGFATARPITLAGPGTLQIDLGTATFAGPIDDGSQPGVLVKTGPGTAVLSAANTFTGGALVGTGTLALTATGSLTAPVLVGSAASFLNAGLVSGNVGNFGVLANSGTITGGLANAGLALNTGTVAGGLANAGLALNTGTVGGGATNSGSLINAGTLAGGLTNTGTALNTGAIAGGVISSGILSNSGAIGGGVANTGLLATSGTISGGLTNAGTVLASAGRIDGAIANNAGLLAVAGSVASSGPFANAAGATLAVTTGGSYSLAGPLANAGLVAVAQSASLTASGGLSNAGLVASDGTLTADLTNTGVARLSGQFNGTLTNTGLVQITGPLAGLTGLTNTGALDLGGTALTLTDLAGPASAVLG

SEQ ID NO: 1426 - protein, 433 aa, Methylobacterium sp.
MKVLLCSTPATGHLNPLLAIAHMLIADGHEVMVLSGSAFRDRIVAAGARFMALPGAADFDGRDLRAVVPELAEIAPGPDWLRVAMERVFVDRIPDQARGLRAALRAFPASLVIGDDMFFGALPLLLGPRAERPAIVLCGTSILHCARPDRAPAFLGLPPAETPEQEAAYGRIAEAYEAAVDRPVGLSLAAKLAELGRAAPPWPLFDAVVRLADTYLQLTVPSFEYPFPLPPTVRFIGALPIVPGQAALPPWAGDLDGARKVVLVTQGTVANHDFGLLVGPALRALADETDILTVVTGGGRGLDAIPGPIPANARLSPYLPFEWLLPRVDAMVTNGGYGSVNQALSHGIPLVAAGLTEDKADVNARIAWSGAGIDLAANDPTPEAIRKAVRTVLDAPGHRREARRLAAEFAAYDAKAEILRLLSSHGDRARSAA

SEQ ID NO: 1427 - protein, 379 aa, Methylobacterium sp.; identical to SEQ ID NO: 377

SEQ ID NO: 1428 - protein, 475 aa, Methylobacterium sp.
MLPVLVARKGALVGMLLAVLAVPVAGEAGWKGPEAQPLFVNESNPAGYNYAPSVITENGTTDIWWCGQGKTDVIFHRSYTPQTGFSPARIVFQPTPNSWNRQYVCDPSVIRGRFVNPADGQTYAYAMYYSGADNLPGNNNQTGLAFSNDKVTWVDYPEPVIKPINPVIAQGNYGTGQPATFSDGRSGLFVFTTDLTGPQGVPGFGDLYVRHTADGVHFGAPARVPNATTDGSTINPNSDFAYDPKTGEVYVITGLPGRVCQQVACKDPGRNPDRETYQMGLFRMPLKAVLSGAPAAWTPLGYLNSDVTGFYLNHSPGFQRDGAGFLTPFLPDITVFFSGGDPYPGTWRVAEARRPKGADRLPLRRAFGPGGHWVTTGYIGPGYTIERSLGTVLTLPAPGTAMLMSCAAGQDHFLSRDPRCEGQTPLGQTGYVYEAQRPGSHPIYRCIAGGRDHFVSTVPDCEGHMSEGMLGYALD

SEQ ID NO: 1429 - protein, 98 aa, Methylobacterium sp.
MKFGVLILAGACGVLVGIVIGYVAGTRLSQAFAQLPVTDRSPAAQALRIVDRIATEHGLARDALLRAMLDQQGGRTGTARPSEEPGREPGRAPGEPAR

SEQ ID NO: 1430 - protein, 71 aa, Methylobacterium sp.
MTAALAAPATQVCAFMLGCALIHVARAHADLITRLLAVTAVGAAVLVLLVASLDYAPEGGIFDEVTVYAAS

SEQ ID NO: 1431 - protein, 156 aa, Methylobacterium sp.
GPPTPDDLDELLTLVWKKPAFFVAHPRAIAAFGREATRRGVPPVVVHLFGAPFITWRGVPLVPSDKLPIDLDPVTGAETTSILLLRVGEGEQGVVGLQKSGVTGEIEPGLSVRYMGTNDHSIASHLVTRYFSAAVLVEDAIARLDNVLLGNYHDYA

SEQ ID NO: 1432 - protein, 169 aa, Methylobacterium sp.
MPGYVEADLIQARKPITDQAGRGLAYCVLGHLEVEQREAPTSDRAETIRALQVNIATFDGVEPEAEDVPPDPAPTQQPAASISSLTPVPSPAPPVSAPVATDTRAVGAASMRRTLARAGITPVGGQQGTASSSQALGSVYAGQGSQKPVDLVADMRRRYGITTNTGGRS

SEQ ID NO: 1433 - protein, 40 aa, Methylobacterium sp.
FVQRTPRGRVLTRHAYRHMQMPEPKRETPGQFGFFGDGEP

SEQ ID NO: 1434 - protein, 98 aa, Methylobacterium sp.
MAEAGEPGSGRLWIRDPRAVLAEAAGGGIVVAGTRIVECVAAGARPAAPVDATFDASRHVVIPGLINTHHHAFQTLTRAHPLALNKPLFPWLEALYTV

SEQ ID NO: 1435 - protein, 248 aa, Methylobacterium sp.
VGYEGYAKFRAALVLGYEKALAPVEKLRGSRDQPATASGILDGALADIVRNIEATRRGLDGQTCAQAVEAIRRARRVYVVGLGSSSWPAGILARNLDVNREDVHLLATLEGPGFAARSLRRLTTDDLVIALATPRYFADTVRLAEIARKHGAAVLALTDGPHSPLVATATVALYAQTDCHYFAASDASLTALVEALASAFAHATEDLVPAATRVTEAVLPWLDRDYAAWPPQGGADDLPDTPPPGAVP

SEQ ID NO: 1436 - protein, 358 aa, Methylobacterium sp.
VTPAAPPRPAPRVGRLPRGPRDAITDVPGVTVGHCTLAEGDVQTGVTVVRPHGGDTYRDRVPAAGVVLNGFGKSVGLMQVEELGVLETPIALTNTFAVPAVVAAQIRAAIADNPEIGRALPTLNPLVFECNDGYLNDLQRMAVEASHYRDALDAAGAAVAEGSVGAGRGMSSFGLKGGIGTASRRVRARARGRFTLGSLVLSNFGKPSQIRVRGVPLAAQLRAAAGEPESGTEPPEKGSIIMIVATDAPLDARQLRRLALRAGAGLARTGSVFGHGSGDIALAFSTAYTVPQDPGRPMPAPALLHDAELDPLFEAAADGIEQAIVHALWRAEAVTGRDGHRRDALTDLLPGWADILGV

SEQ ID NO: 1437 - protein, 146 aa, Methylobacterium sp.
MTHRTITLTAALTMTVASLLPAAASEVTLDTAAHGAFSVPAVIGAAHHTPGLALSAADVRAQGGHLVPALTRWQEARPAIASVEPFKAPATITVAYRSRDVATHAAQVLKQGGFATAGVVRWLPDAPVAVEANTNTVKLGSLEAMN

SEQ ID NO: 1438 - protein, 105 aa, Methylobacterium sp.
MRRLLLAGLFAAVTGASGAYAQATLRVIDTAPNDVLNVREFPTSDARIVGMIPPDGRGIVPTGERNGNWVFVRYRRGEGWVSRRFVYLGAPPVRRGGSLDPDVSE

SEQ ID NO: 1439 - protein, 42 aa, Methylobacterium sp.
MSRFAFQIHPMILCGGTGTRLWPASRESMPKQFARLVDAERS

SEQ ID NO: 1440 - protein, 47 aa, Methylobacterium sp.
MLNTILALLAVLAVMAAHALYKLVRLPFRLLRGLFQHSSKPARVTAH

SEQ ID NO: 1441 - protein, 87 aa, Methylobacterium sp.
MKAIVCLSAVVVASTPFVGTPARADDAEAARLCRGDAFKLCLSEIPDRDRITACMVRNRARLSPGCQTVFNKPSRPATVEAASHTIR

SEQ ID NO: 1442 - protein, 499 aa, Methylobacterium sp.
MRLAVLQFTHETVTFLPNDTTRDDFIYPGSPAAGAALLATDPKGYMGGFVQVAREYDGVELVGITSPLWPRTGTASGWITADAYAHFLGQMVAELRAQGPFDGVYLALHGAMAVRGVPRPEADIARQVRAAVGEGSILVGTFDLHGNEDAAFLDHADMAFAVKYFPHYDGHLQGQRAARMLVRAVRGDFRPAHRTLKVPILSPTVVQWTGAAPWSDLVQRALVWEAREPDVYVNVFFGFPWGDAPDGGMTVQAITDDDPALAERVARDVADFAWRQRRALLEATRIHTIADGVRLARAAVAEGAAPVVLADHSDRSGRATWLLREILRQCLARTLVATVASPDIAAGSLAAGDPFDAPVGGGGDPSAGDPVRITGTVLRVVAAPEPGVAGSGGGGTWICVAFGAGNVLVLSPQLAQIVEPDELWRLGLDPADFDVVAIKSRVHFRRGFDDSGYARTILLVEPPEPFLGTVRLDHLAYAQMRAADFFPYGDPPGPVPSDP

SEQ ID NO: 1443 - protein, 51 aa, Methylobacterium sp.; identical to SEQ ID NO: 390

SEQ ID NO: 1444 - protein, 105 aa, Methylobacterium sp.
MPFDSQSAEAATTAFAASVAGRCMTDAERIQEDAIERDRRATRAAVWATVPTTAEGRAALVRYAAFQAELAFGADWRAKARQEFCGDFLVAALAAVEAETERGEA

SEQ ID NO: 1445 - protein, 62 aa, Methylobacterium sp.
MIKTLSPQTGSVQGLVRRVEEVGIIVAQEHLKAGMLPAEVRAWHIGFQAGMSLELGDFMRRF

SEQ ID NO: 1446 - protein, 180 aa, Methylobacterium sp.
TWTGAYFGINAGYAFDASDRNTGNTFAVPFPYAAPGTVASFRNRSQDGFSGGGQIGYNYQFTPGSGVVIGFEADAQYLDFGRSRNNAFISGALAPGYYVTDPRGLSSLDFFGTVRGRLGYAFDRTLVYGTGGFAYGSGSADRSFGGFAGNDSFRTGWAAGGGIEYALPTDSFLNFFRSSA

SEQ ID NO: 1447 - protein, 180 aa, Methylobacterium sp.
MGDEIRFQIRSKPARMEEQTRVALALLRSRGGWPQDWAALQSGAASCPGAWRLGAGVAKDATALEPKLVKGLDGKEGLDLGDGTMKMPDGSIRSIVPAAPAGGIGGGGGRGMSELREHVAELGRHIERFGQSGFHAQIEVTGLRQAGLRATSMRIKARGGLSADLGVTEPGAKEDMSDWT

SEQ ID NO: 1448 - protein, 575 aa, Methylobacterium sp.
MSEMSERANMTGAHALAAALHRHGVRDVFGQSIPSALFLAAPHHGIRQIGYRTENAGAAMADAYARISGRVAVVAAQNGPAATLLVPGLAEALKASIPVVAIVQDVHRRFTDRNAFQELDHLALFAGVAKWVRRVAVAERIDDYVDMAFAAAASGRPGPAVLLVPLDLLDERPDFEAAAPRRSASLGTYPLDRTVADPARIAEAADLIAAARRPLVIAGGGVHSSGAYPELAALQGLGLPVATTVMGKGAVAETDPLSVGVVGYFMAPRARSSHLRSLVTEADVVLLVGNRTNQNGTDSWSLYPADARFIHLDVDGGEVGRNYEALRLVGDAKLTLAALAEALRQRDLAGLEGRRAPLADTIARAREAQAGDMARLVDMEAAPIRPERIMAEIDAVTTAETVVVADASYASIWIANFLTARKAGQRFLTPRGIAGLGWGLPFALGAKAARPDAPVICVTGDGGFGHVWSELETARRMRLPVIVVVLNNQILGYQKHAELSLFGDFTDVCDFEAVDHAAIARACGCAGTRVERPEDLAPALRDALAGGAVTVIDVITDQRAYPPITSFEGKDALAY

SEQ ID NO: 1449 - protein, 222 aa, Methylobacterium sp.
VPDWVRPIVKESLSERAYRELRVALMRGQLRPDTRLRLRPMSARFGISATPMREALLRLVAEKALALDARGSVVVPRLTLDQLLEIRAIRTDLEGRAAAAGAASRAAEVDDLEAIHAQISHCHASRDFARAVNLNTEFHLTLCRLGQMPILYEIVELLWVRCGPILSHLYDDGVPDWEPHPHRRIIDALRRGDPEAARDAVREDIERGGSGLFAHVRATATG

SEQ ID NO: 1450 - protein, 215 aa, Methylobacterium sp.
VLVMGGLPIGLSRFRRDERGIAAVEFALVLPLLIVLYFGTAELTRVVDATRKLTLFARTLGDLSGRVDNALATQNGMALATQDGMTKITSAATAILRPLDASGLQIVVNAMGVETVNGSLKGFVCSSWPQNATKRPANQANGSNGLPATPAAYQFDGARYILAEVTMPYTPIIGSALYRWIFGGRGLTFTRQIPWSERTPSEIVMPGGTACPVYN

SEQ ID NO: 1451 - protein, 991 aa, Methylobacterium sp.
VPGRLRPPPVPDAREPLAALRPRGWMHAGTIPLDGILMARGSAGPDWRARLLPWLEHAAEVRSRGDRVLVLFAAPVTRDCAALGPVLPVVRSAGILTAVPLAEPEPPVAAALRDHVVHMTGGRLAAEPLAAFASLDIAGWWDLDAIAVHPAERLPVLRPAAPARRLVSAPALVADADPLAPVRDAVTRRPRRRTKHVLGDLVTRFRRLIGGALGLLWTAYVVLLASIMVGAMVLGFAENVRTTAEHGAAAAHWGSLALPVLVLLVIAWFAFRRRGARAGREGAAPSASQPAGTGSGRTPIWCRAAAWLAWRSPYAVHLRRLYARRLTEVERLFAAGRVDEALYRAIGLGGAARRGSAFADLPLTGPGLRRSLDLDLGPQRASGLSLAPADEIRLAALYRAQAVAMAGRGDTDRAAFVLDSLVGNPHEAVRLLAESGRLETAARLAEARRLPPATTVPLWFRAGQTERALALAARHEAHAELWKELGADDPFRPVLAEAWAARLVGIGALDRAAAVTFGLPALAERRLDWIRQALDAETPVPAAPLARALRALPWEGRDGDRLHAAFADLVSATGAEAAARRSAVAALLLDAQFEGGPERPPTPAFALLCRGLARRLAADDGILGHDAERARLAGRFAEAGGQVALRQHLRQLRTRTAPSASRLAGPLVVPDGPALSEIADAALLSGGRLLLGYRSGLVRLLGRAGRERWRGQVDGLTGFARLGAGDRALVLRETLDGPDVQLFDAGTGRLLPLGPLPITHWHGQADETGWLVFDGEALVRLDTASLLGRAGGAPGSDGALAHHWRLPMTEPGRPLLLAAFADASALIYARHDGLIEWWSLSSRTLAVTCRFWTPPDRGVGVLGLTEAVAWSLEGTGAHPHLRAHPHAFTTASREQERALIEAAARAEPADPPRLVAAENGRLWAATATEEGTLWASVPGANRIRGPAVLWQGSGSLRARFAPEGDAAAVFDGRGRLIVFETVTGQVILRLI

SEQ ID NO: 1452 - protein, 367 aa, Methylobacterium sp.
VSAASTGPRTTLPPALASWTTLFSDMAEPDLRILAALVEALRPLVERADGAGGQPQGEIDGLGGLGTRGGIERLVASEWLWRDLDSDAFLQRAAERDLLTLEPVYRQAADAGAVLVVVDAGPELLGAPRLVAFAALLCLAGLARRRGARLLWASTATPERRWLGALKRSDAAVLLRESAATSLDAVELERVVAEPVATRAAGRPGASLWLIGGSDLPEAARPCRRITIEERPRLGPDGLAVAADVTVLDATGPVAAARLDLPPEREAVALLRDPFRPRPAPGRPPPRRSAPDRSAAPPDWAPRGLAFAPCGEHLLVARPDGILIVPVTGTSGALRLPVAPHERLVGSPSAGRGSGPRASTSTPTTRA

SEQ ID NO: 1453 - protein, 357 aa, Methylobacterium sp.
VHLALVAREHLLLIGPPGTGKSAAVRACAAGTGARCFEYLIGRFTEPAELFGPLDLEALRAGKLRPDISGMLPEAEFAFLDEVFLGSTAILNALLGVLNERRYRRGHFDTAVPLRCCVGASNALPEDPGLAAFADRFLVTAFVDPLADTDLEALLAGDPVASVEPGDGEAPLTLAEIDALAEAAARIDLSPVRPAYAQVVRKLRARGVRLSDRRVVRGQSLVAAAALIAGRTAAEEADLWPMIHLVQDRIAQDEARDLLRVELGAAASPVLPAAAKAAGYGPAARAADLAKEGEALAASAPDDRTAPAFEAWLVRAESFLVQIDAAFGAEERPRALAAARDALLTRCRAPVAGVTPA

SEQ ID NO: 1454 - protein, 777 aa, Methylobacterium sp.
LGRSGIARRVLVVGAIPILVAAAIALGAWILLYEAERARTGAVVATETAQTLTSMNRARADAVSGGTARRDEAERRFDERAATAAGQLERLEGLARTRGQSALVATVTGDLNSQVTRMRSLLLSERTANATIADMARRADALVALTDVARRRQQQDNAQLIAVLAVKDAELERNQGVVTALRELREAISTAELNRARIGRPVFPIEFDELAADLRQLDAVGDRLRRVLRVDGEAGAADRATKLLKAYRDRSRTEDGLNRVLSEGFELTRATQAGRVLVEWCDQLVQVNVTRQNRLYEEVALLIRHSVLSNEAELSAQDIALTALRLARRTDAALARRDTAEASRVLEAGAELSGTSRTLLIPVSIRDEMAEAIDGWRTQLAATIGKIGEQNETIADMDSRAATMSANAQTLSRAFIDDADQFGSVIRQLLVVGAVGALCLGIGAAAAVARSITRPLHALQHSIVTAAAAPAPEDIGRDSHLLTRRDELGDIARATNAFLEQIRRREADRRNASQRADDALTTLRQAQEDLIRAERLASLGQLVAGVSHEISTPLGIALTTATQVQSDSAAFARMVGDNQLSRSRLTQYAGRMREGAQLLTSNLMRAADLLYSFKQVAADQAIEDRRPLNLADWIDELLKSLRALARPGRHVFEVDCPPDLVVDTLPGILAQVVSNAVKNAIEHGFQDREGGRITITGIRSGDGIGLSIADDGRGIDGADLGRVFDPFFTTARARGGTGLGLHIVHNLVVNRLQGRVELQSSAGAGTVLRLWLPERLA

SEQ ID NO: 1455 - protein, 295 aa, Methylobacterium sp.
MPASPSLARDRSRIAALALATLIGVGDPRPGWSLDMPDSPRPARPSRPVPPELAAALAAYRTYVVAQADAFVRETARFVAAIQAGQLAEARRLYAPARAPYERIEPVAALFPELIKRLDVRSDEFELRERDPAFVGFHRLEMALFTLGTTEGLGEVAERLTAETVTLRDRLAALAIPPARAVGAASALIEGIAATKISGEEERYSRTDLWDFQANIEGSKVVFTLLRPLLTDRDFVARVERSYKRVEDLLARYRSPDGGFQSYDNLTARDRNALKGPITLLAEDLSTLRGRLGLD

SEQ ID NO: 1456 - protein, 413 aa, Methylobacterium sp.
MRFLSPVPTRRRFLGGLGAAALLGPARAEDATPTIATEGTLVAQPFYGPHQAGIVTPQPAAALYVAFDVLAERRGELPRLFRTLTERLAFLTRGGAVPDLHPQLPPRNSGILGPTILPDNLTATVSVGASLFDYRFGLGRARPRHLGPMERFPNDALDPAQCHGDLLIQFCSNTAETNIHALRDVIKATPGLLTPRWKMEGFLPPHVVKTMGADTVRNMLGFKDGTANLDVRDLRMMDRYVWVGAGQDEPAWTTGGSYQVVRIIRTLVERWDRTPLGEQEAIIGRHKGSGAPLRQGHERDVPDYAADPDGEAISLAAHIRLANPRLPGTEGSLILRRSYNYSRGLTAAGQLDMGLLFVCYQADLAAGFVTVQNRLSGEGLEEYIRPIGGGYFFALPGVPGPGSFLGEGMLATT

SEQ ID NO: 1457 - protein, 446 aa, Methylobacterium sp.
MIGFLAPAAHRPPIQTDRVDPTYRKLRWQIFAGIFLGYAGYYLLRKNFSLAMPYLVEQGYSRGELGTALSAVAIAYGLSKFLMGMVSDRSNPRYFLPIGLVLSALVMFLFGFVPWATSSVGIMFVLLFLNGWFQGMGWPPSGRTMVHWWSQKERGGVVSVWNVAHNVGGGLIGPLFLLGLAWFNDWHAAFYVPAAVALGVAVFAFITMRDTPQSCGLPSVEAWKDDYPDGYDANHEREFSTREIFVEHVLKNRMLWYIAFANVFVYLLRYGVLDWAPTYLKEAKHFSVDKTSWAYFLYEWAGIPGTLLCGWLSDKLFRGNRGATGVVFMFGVMAATLVYWLNPEGNPGVDLAALICIGFLIYGPVMLIGLQALELVPKKAAGTAAGFTGLFGYLGGSVAASALVGYTTDHYGWNGCFILLLAACVLAIVCLSLTLRHSSTAVAQPA

SEQ ID NO: 1458 - protein, 377 aa, Methylobacterium sp.
MDHAAEAGDPVDGIVLDQVERLLAQHLTPALLAACDGAAGATARAADLWPADLWTALAESGLPLALVPEAEGGIGLAATTAARLIRRCGRAALPLPLPETVAGAALWAATGGQVAEDALSLVPGGGPVRIAPHAEGFVLDGRVAQVPWGGSVAALLLDAVDAAGIPHLVRIAAPGTLRDTHHNLAGEPRDTLDLTGCIVPAADVRAAPGWAAGAGAPSVESVGAWVRAQQMVGALETCLGSALAHAQERQQFGRPLAKFQAIQHMLAEAAGHVAAATAAADLAAACWGDPRFVLATAIAKARCGEAAGHVAAIGHQIHGAMGFTQEHPLHRATRRLWSWRDEFGSDALWQERIGRAVCAGGGAALWPMLVRLRGGAG

SEQ ID NO: 1459 - protein, 383 aa, Methylobacterium sp.
MHSFRFSAEPLPPEAEAARASVRAFLDAERAAGHFVPHRTSWTTFDAAFSRRAGAAGLIGLTLPEAYGGHGRSGLVRFVVTEEMLAAGAPCGAHWIADRQSGPQIHRHGTEAAKRAILPRICRGECAFGIGMSEPNSGSDLAAVRTRAVRDGDGWVINGSKIWTTNAHQVDYLLALVRTGEPGPDRHGGLTQFIVDMAAPGVTVRPILDLSGHHEFNEVFFTDYRVADAMRVGAEGAGWGLVTEELAFERSGPDRFLSDYRLLVELVDRIGPEPDRFQAVETGRMVAQLTALLGMSASVARLLDQGVVPGVEAALVKDVGNGFERAVPEIARRLVPVEPSLTAQGDAFREALGGVTLRAPSFTLRGGTREVLRGVIARGLGLR

SEQ ID NO: 1460 - protein, 253 aa, Methylobacterium sp.
VALVKSAGRVLQILELFDEIQREARVSEIAERLSVPQSSTSVLLKSLVRLGYLDYDPASRSFLPSPRVALLGAWLDKGPVRDGSLVRMLEHLSERTGGTVILAARNAIFSQYVHVLQARTAMRFHVPPGTRRLVVWSATGTALLADSPEAEIGPLVRRTNAEAPAEQPPIAVAAVLTNLARLRRDGHFLSRGLVTPGAGSIAVPLPRRIDSKGRPLAVAVSGLLDEFERREAEIAATIHDAVARFLPEDPSRP

SEQ ID NO: 1461 - protein, 478 aa, Methylobacterium sp.
MALTDLSRFYIDGAWVEPVSAQPFPLIDPATETAFGTLALGDAADVDRAVRAARAAFPAFSETAPAERVALLRRILALFEERFEIFAETIRQEMGSPIGFARKGQAARGPAHLNALIAVMERFAFEEDRGTTRIRREPIGVCGLITPWNWPINQIVVKIAPALAAGCTMVLKPSEYSAVSAMLFAQVLHDAGVPPGVFNLVNGDGPGVGAAIAAHPGIDMVSFTGSTRAGIEIARAAAPTIKRVAQELGGKSANILLEDVDFDQAVRRGVAACCTNSGQSCSIPTRMLVPRARMDEAAAIAAEAAAVFRLGPTADPETDLGPVVNRTQYERVVGLIRTGIAEGARLVAGGPERPDHLDRGFYVRPTIFADVTPDMTIAREEIFGPVLSILAYDSEDDAIAIANGSRYGLAAYVQGRDRDRARAVARRLIGGQVHINYPPPDVHAPFGGYRQSGNGREWGEAGLQEYLETKAMIGFGLD

SEQ ID NO: 1462 - protein, 317 aa, Methylobacterium sp.
MAFDRHIFSGTIPALMTPCRPDRTPDLDALARKGRELVGAGMSAVVYCGSMGDWPLLTDEERMAGVERLLAAGVPVIVGTGAQNPKRAAALAAHAKAAGAHGLMIIPRVLSRGSSAAAQEAHFGDILEAAVDLPSVIYNSPYYGFETRADLFFRLRARHPHLVGFKEFGGAASLTYAAEHITGQSPDITLMVGVDTQVVHGYVNCGARGAITGIGNVLPREVLHLVALCEKAAAGDVRARRRAEELDAALAILSSFDEGTDLVLYYKHLMVLEGNPEYALHFNATDALSDGQRHYAETQLRLFKAWYAQWSEAGAGA

SEQ ID NO: 1463 - protein, 313 aa, Methylobacterium sp.
MLDDHFRARITLLRSERDFRPAVAGYCQGMIEPAQIVWPSHKLLNQIGRYVVSFMLIHNDYAWRHHGGPRPTLTVLQAMVGSSPRQTAGFVSALKAGRFVTAVADRGDGRVKCLQAAPALVTEIARSGRLFVAAMDAVTRRDPGHAGMLDGPDRLGELVRLSAAHVLRHGTLIAPFPRVLHFAGRDCGYPLLTALVGAHYAATVPGAPAAVSLSLRSLAERLDVSRAHVGNLLGEAEAAGWIRIAGGHLTAFDPTLLAEFEVWAAGQMLFYDDLAAAILADLPAATAPVRASGRAGLACVPVDPGIPTGRTAP

SEQ ID NO: 1464 - protein, 317 aa, Methylobacterium sp.
MPVRLDARLAGDLFFFRVLVEAGGFARAGDRLAVTQSAVTQRIQRLERRLGYPLLERGTREIRLTAAGHHLFAAARSGFDGMGEALLRGERREGRATLRISCVPSLASEWLAPRLKAFSDTHPDIDVAVFGETHDLDPGRMAQSGIDVAIRYGPAPPPSATVVFDHPEPVYPVCAPAYRDAADPGGAVVLLHDATPWEAAASVSEEWDRWIGVHGAPWGGRVQNLYFNLAQLALRASLGGSGIALGRSLIVAPYRADGRLVPACDAALMNGLRYFVLVRALPPAGPAAAFVDWLGRTMAGPPGSPEAPRRGGAAECG

SEQ ID NO: 1465 - protein, 147 aa, Methylobacterium sp.; identical to SEQ ID NO: 411

SEQ ID NO: 1466 - protein, 597 aa, Methylobacterium sp.; identical to SEQ ID NO: 412

SEQ ID NO: 1467 - protein, 261 aa, Methylobacterium sp.; identical to SEQ ID NO: 413

SEQ ID NO: 1468 - protein, 206 aa, Methylobacterium sp.; identical to SEQ ID NO: 414

SEQ ID NO: 1469 - protein, 87 aa, Methylobacterium sp.
MDDGSDLILEAVDALRGAGVAVAPIGDELESWQIGDFVYSDADLWRLAASRRRSRMATRGSPAPCRRPHRLEAPGRARTSGRACWRR

SEQ ID NO: 1470 - protein, 172 aa, Methylobacterium sp.
VQTSVQAAVRALLTTTDRSEITVPLVAAAAGVTPSTIYRRWGTLAELLADVAVERLRPDGEPADTGSGRTDLEAWAEQYADEMSSAPGREMIRDVLAAADANCAQRCCSFTRDQIAIIADRAVARGEAFPDPEAVLDGVVSPILYRILFGTALDRERILELVDRTLTAREAT

SEQ ID NO: 1471 - protein, 142 aa, Methylobacterium sp.; identical to SEQ ID NO: 418

SEQ ID NO: 1472 - protein, 138 aa, Methylobacterium sp.
MTRQKISQWPVPPADWPPELRQDFAAGAGRGQVGSRLVSETDRVRVWSLSLKPGERIGFHTHVLDYFWTAVTGGRARSHYADGRVGEVVYEPGDTQHHTFPAGAFMIHDLENIGETELTFTTVEFLDSANAPLALAGR

SEQ ID NO: 1473 - protein, 138 aa, Methylobacterium sp.
MKRLAIALTALSSLVLFAPSSEARPHGRGFHNGPHHLGHGVWRGRRHGLHRYRHHRLHRHYRRHRGYRGYRGVHFRPAGYGFRPHAYRSGGWGGYRGVGFATGAGLGLAAAARPGLYGAAYGRPYGYGYAPVGYGCAY

SEQ ID NO: 1474 - protein, 99 aa, Methylobacterium sp.; identical to SEQ ID NO: 421

SEQ ID NO: 1475 - protein, 377 aa, Methylobacterium sp.
MTEWLDRAEALDALGIRAQTLYAYVSRGLIEARRAPGRRHSQYRAADVATLADRRGRSRASAAIAAGAMAWGEPSVVTAISTVHRGSLIYRGRDAVAFARDASLEATADLLWDSPEATLFEVPADAAATPFLALAGLLQEAEAALGRGHHRLCRDARRAVAHLAASCGIPEGRAPLHQGLARLWSLDAATADRVRQALVLLADHELNASTFATRVAASTGAPIAACLMAGLSALSGPRHGGAAAAVLRLVDEADATNPREAVRACLDRSGALPGFGHPLYPDGDARAAALGAVLPADPLLDAVRDCAEAATGARPNIDFALTALVRTAGLPRSAPFTIFLLGRSLGWAAHAMEQGRQGTLIRPRARYEGRRSPADRP

SEQ ID NO: 1476 - protein, 279 aa, Methylobacterium sp.
MLRTAIAVTLLLAGAPAWAGPRWQDLPPTPAPVAGTVSGRAAVNGIRLYYATIGNGPPVVLLHGGLSNSDYWGHQVAALAARRTVILVDSRGHGRSTRDDRPFGYDLMTDDVVGLLDVLKIPRADIVGWSDGAILGLDMAMRHPDRVGKVFAFGANADPSGLIEGVETNPTFAAFIDRAGKEYEALSPTPKDYAAFVDAVGRMWGGQPRWTEADLKRIRAPVLIADGDHDEGIKRAHTEYLAATIPGAGLLILPNASHFAFLQDPALFNAALLGFLDGP

SEQ ID NO: 1477 - protein, 119 aa, Methylobacterium sp.
VHFMRMMGLVALVLSGLGLAGPASAAPLSPAPLAGDASGLTRVGYWCGPGFHLNPWGRCVPNARRFYGPGPAFYGARYYGGRRFYRTYNYRWHRNYRWHRNYRWHRNYHWHRSYHWRRR

SEQ ID NO: 1478 - protein, 65 aa, Methylobacterium sp.
MPPRSRRGAHRRAAQVHEDLAAPRTHPPDRAASEATMTLALIITGFLIVNFVMAGLFSLVALWAD

SEQ ID NO: 1479 - protein, 403 aa, Methylobacterium sp.
MAEDGIADSGRAWRRLAAATALGTVGGVGMWSVVVVLPAVQAEFGVDRAAAALPYTLTMVGFAVGGLLMGRLADRIGIVPPLLLGTVCLALGYGLSALATNLWQFALVHGVLVGALGSSVAFGPLMADVSRWFSRRRGLAVALCASGNYLAGTLWPPVVERAVHAYGWRATQAGIGLFCLVAMLPLALAMRGRPPRASATCAAGPQAVTTLSPAALQGLLVVAGTACCVAMAMPQVHIVAYCSDLGYGVARGAQMLSLMLGFGIVSRVASGFVADRIGGLATLLAGALLQAAALALYLAFDDLTSLYVISALFGLFQGGIVPAYAIIVREYLPAEEAGARIGAVLMATLAGMALGGWLTGAIFDATGSYRAAFVNGLAWNAVNVAIVLWLIHCRRARTSPAAL

SEQ ID NO: 1480 - protein, 234 aa, Methylobacterium sp.
VAAMAKFHFVEDYEAYVRQLMRDLPLDEAMSVAVGGDYDRIGAIECEILQHFGLRDGQSVVDFGCGSGRLAVHLARTASVAYLGLDVVQDLLDYAKRRCPRDYRFARNTALSLPVADGSVDLVSAFSVFTHLLHTECYIYLEEMHRALRPGGRVVASFLEFGMASHWGVFTKTVGEQRTSTVPHLNTFIERSVWQTWADHIGFDSVTFLDGTAAPWPSGVYLGQSLAVLGKAPA

SEQ ID NO: 1481 - protein, 468 aa, Methylobacterium sp.
MSEAVSPAVNAGGRLDRLPIGPFHRRIMWLIGIGMFFDGFDIYIAATVLGATLKSGFSTLPQNAWFVSATFVGMMAGSFLTGFFGDRYGRRFTYQANLLVFGLAAIGAAFAPNMTVLIVLRFIMGVGLGAENVVGYSTMTEFVPARSRGRFLGLMAVFVVTGLPAASLIGYLIIPTFGWRAMFALGGLGALAVWYARKSLPESPRWLEAVGRHAEAEALMRAIEAEAARGAPLPPAAAAAPVTQLGLAALFRPPLLSRLLLGCLCLVVINTLLYGFVTWLPTFFIRQGLSVATSFGYALLMGLGAPVGSAIGALTADRWGRKPTIIGASATAILFGILYPMTLDPVLLPLVGFGLTVPIYVLVALLFGIYIPELFPTEVRLRASGLCNTVGRGATIVTPFLVVTLFETYGIAGVTGLMIGLLALQIVAVAAFGVEPRSQSLESLEAGVAPAEGGPAARARGTVPRPIH

SEQ ID NO: 1482 - protein, 507 aa, Methylobacterium sp.; identical to SEQ ID NO: 429

SEQ ID NO: 1483 - protein, 210 aa, Methylobacterium sp.
VLLRDNIYAAIRADILACVLRPGAEVREQELAQRYAVSRQPVREALLRLERERLVTVHARQGYQINAISVADARDLLRMRLALEPACAAEAAAGAPASVLASLDAFRAVADGADFIAENRAFHIALAEASGNRRMAATVRDLVEQADRLVRVSLDGIRGRDPAQLVDEHAAIIDAVQRRDGRGARRLVRAHVAQAERRILTALERSAIVL

SEQ ID NO: 1484 - protein, 137 aa, Methylobacterium sp.
MQDIPLGAKGSFAMLVGPSHLASQFKDNILPPVFATPMMVLIMENAALNAVRQYLDPGESAVGTKVDVTHMAATPVGHRVRAEAEVVGVAGRQIQFRVAAWDESEQIGSGTHERMIVDIERLGKRLAAKQPAPSKRA

SEQ ID NO: 1485 - protein, 154 aa, Methylobacterium sp.
MSFMRVTICAVALCLVAGLGHAQEAGQTVAGEGDWVLRKSAAPSSGDVACVLAPKARSRIQIVGDRIEITGLPKNSIFNYQYRIDEGPVSNAMFPTTQMQDAGVITLNGDVLKDILAGRRFSIRLLDRWHEAITEEISLSGLRGLIDKRAEACR

SEQ ID NO: 1486 - protein, 80 aa, Methylobacterium sp.
MAFPDANEPSAPSISALELVNTLIERKESGEPVDADILSFLTDMERLGLTDTDAYATLDAYRPGPARGATGGDDASEADA

SEQ ID NO: 1487 - protein, 235 aa, Methylobacterium sp.
VATWNCDAGPSGHGIAAVPPGRPGRPPPGGSWNLAAFERHRAAYLARARRILGCPAQAEDVVQDVLLRLIADPPPAETAIQAAYVGRMVRNLALDRARRQGLERRLFTGLDAAPDPADPGTGTPEAAAASRESLRQVEAAVAELPEPVRTAFQLHRVEGVPQIEIAARLGVSRALVCGLVRRGHLHCLAALDRRCAACPARAEAPGRQRRRTAPVGQDLGRGPAQAIISPPATGP

SEQ ID NO: 1488 - protein, 266 aa, Methylobacterium sp.
MARLQSSGFFDLGDGRLEYHFVGRQPEVAPTLVLLHEGLGSAMQWGALPETLAQTTECGVLAVSRQGYGASSPVPLPRPADYLEHEARTVLPRLLDAADFRSGVMIGHSDGASIAALALAEGDARLRGGVLMAPHFFVEEVTLSAIRRTRAAYERGLLRTRLGRWHTDVEGAFRGWNDAWLDPARRGWTIEAALTRLTVPVTLIQGTEDAYGTQAQIAAARRSCPPSLLTVREMPGVGHEPHREAFADTVALISAFVEYVLKDEPG

SEQ ID NO: 1489 - protein, 449 aa, Methylobacterium sp.; identical to SEQ ID NO: 436

SEQ ID NO: 1490 - protein, 268 aa, Methylobacterium sp.; identical to SEQ ID NO: 437

SEQ ID NO: 1491 - protein, 519 aa, Methylobacterium sp.; identical to SEQ ID NO: 438

SEQ ID NO: 1492 - protein, 177 aa, Methylobacterium sp.; identical to SEQ ID NO: 439

SEQ ID NO: 1493 - protein, 285 aa, Methylobacterium sp.; identical to SEQ ID NO: 440

SEQ ID NO: 1494 - protein, 234 aa, Methylobacterium sp.
MAFNTELDSALEAAFAEARALYKERGFQRRVGFGRRPALINVDLANAWTRPGNPFTCENIDEQIIPGVQALLAACRRNNHPVVHVTTCYQVTDVDSPKTDMGLWHRKIPVEVVDQNKPELWAIDSRIEPVPGEQVLVKKRASAFHGTYLAGFLRANNVDTILVTGVTASACVRTTLCDGLAEGFRTIAVQECIGDRVPGAVAWNLFDIDAKFADVEPLERCVAYLDEVGLRNAA

SEQ ID NO: 1495 - protein, 354 aa, Methylobacterium sp.
MRAVRSLDRFSPTRRQALLGSAAAILTAGAGREAHAAAGTVVVSNWGGDWNQRTVRFVEAPLVEAQGLTVVRDLGMEPERKAKLLAERRLRRGSIDVIHLNDSDGFEMMNQDVLADLDRARIPNYGDVIPALRKDYFVPWLYSGVVIIYNKDKIKDPPKSYAELWDKKWAGRLGLTNQLYFNYMMMSGLIQGGNMTSVETGRERLVALKELVQPRLYAAHQQLGAALATGEVDIALNYKARGLQWINEGSPLAIQYPKEGAIAITFGAGMPKRAPNPDGAYVYLNAMLDRKAMAELAAASFYAPANGAAELSPELRARIDFSPEEREHLNFPDYAYVSKNTAEWLEWWNKTMAR

SEQ ID NO: 1496 - protein, 385 aa, Methylobacterium sp.
MSANTYDVIVLGVGGMGSAACWHLARRGIRVLGLERFDIPHAMGSSHGFNRIIRLAYFEDPSYVPLLRRAYENWRELEGRFGEQLLFITGSIDAGPEGSAMVEGSVAACRTHDLPHRLLDGAELRRVAPGYNLPDTHRAVLQPDGGFVSAERAIVAHVMQAQAAGAEIRAREPALSWEPTASGVRVRTERGTYEAGRLILSAGSWMGEFVPQLKTVAVPERQVLGWFQPREPALFAPDRFPVFNMEVEEGKFYGFPVWHVPGFKIGRWHHLGETGGADTLSRECEAEDEAVLRPCVSRYFPQANGPTMAMRACFFTNTPDEHFVIDTLPDLPQVVVASPCSGHGYKFCSVVGEVLADLALGRKPGFDLSLHALNRFAPRSYASTD

SEQ ID NO: 1497 - protein, 316 aa, Methylobacterium sp.
MRPFSYERVASAEAAVAAVAARPGARFIAGGTNLLDLMKFQIEAPAHLVDIRHLPLKAIEDLPDGGLRIGALATNTEVAAHPRVKRDYGVLARAIVAGATGQLRNKATTAGNLLQRNRCPYFYETSLPCNKRQPGSGCSALGGVTRSLAVVGTSPHCIAQNPGDMAVALRVLDATVETVRPDGSQRRIAIGDFHLLPGDRPEIEHPLEPGELVTAVTLPRPPGGTHHYHKVRDRASYAFAIVSVAVVLHKDGTGRVAFGGVAPRPWRVEDAEALLPGGPAAVVTAAFQGATPTAGNAFKIPLAERALALVLSEGRV

SEQ ID NO: 1498 - protein, 881 aa, Methylobacterium sp.
LKVNIAAIRRALEGAEPEKRFIATVSGQGYRFVAPVDVMSWPISAAARRHNLPKPTDLLGRSEDLAVIATKVLQRPLVTITGLGGVGKTSLAVTVGHALVGQFPDGVWMVDLCVIDSDRYLASAFAQEMRIAIHADDPQAALATALADRQCLLVLDCCENALDQAARLATMLATAAPGTHVLATSREPLRMAHETVHRLQPLPAPTAFGTLNAKDVLTFPAVALFVARASAAAPDFSLEDDDAWAVVEICRRLDGLPLALELAATRVGAFGLRGLLRLLNERLDLLDDGRRAGHPRHRGLTATLDWSYGLLSQGEQTLFRRLSVFHGVFPLDAALAIGRSAGEAEHACIGHLADLVAKSLIVAIPGWSARYQLLDTTRAYGLQRLAESGEDDAVRRRHAEFCVAQCRDVSARRSAKAASDPREELVALVQNVRAALDWCLTDRRDPVLGRTLAAEALVVWDTLALLQERIEASEWALASAAPADGPEDRYEITLRASLAAALLQVEGPTARIAELWSGALARAERLSDRDGQLRALWGLCDFQTWVGDHGASFALTERIRTLAAASGDRAAGAAVDRPAATALRYLGRLDEAREAAERLLARAARRDSPGRRLEDHGLIAARGTLANVLWLQGRPDHAVAAARRALVEAEANGQAFALTNALAHTVIPIALHGGDLDEAERGLARLGDHVARHAMRIWQVIADCLEAIVSLSRGDAGGLHRLEDALVEMGEIGFRMRRPAYLGSLASGLAAHGHLPDALARIDDALAASEHGGELWCQPELLRIKGEILLASTGVAGEADAARHFLQAIDLAGSQGAAIWRLRAATSLAALDDRYGGPAALAAVLGGFDEGLNTPDLRAARARRAGRGGLGSDAGRPVSLA

SEQ ID NO: 1499 - protein, 360 aa, Methylobacterium sp.
MAQTVSWGVLGTGVIAQRFVSDLLGRPDARLTAVGARSTGSAQAFAAAFSQASGAPAAVAGVEALAARPDIDVVYIATPNSDHMDSALACIEAGKSVLIEKPIALSGGQARRIAEAARRKGVFCMEAMWMRFTPGVVRAKAMLEAGEIGDPLHLDARLFFPRALNPPGRTDDPAEGGVILDLGVYPVSLALHLFGAPTEVSGVGLDRGGAAAQQAALALGWNARTATLSCGSTGEADNAAVIVGTRGRIHLHRQFLCPPFLTRVRTAAAPAPADRAPPRRQAVDRLAFAKRLLQPLDFRRVALIPTPYLGFGLRHQIDEVHRCLLAGARESPIMPLADSIRTLDILDRVRARPQPLEAVA

SEQ ID NO: 1500 - protein, 414 aa, Methylobacterium sp.
MAGQALPIETRAPAASLLADRVAVFLLGAALNFNVLTSTFGLPFQRLSDLLPFLLIPWLGLRRAVVAEALRQAAPLAGILALIAASLVLKAHKQAGDVYLTLVLLLYVVQAFILLVMFRDRRVEDAFCVGLLAGMLASLAVLLLAASGMPLDRFGLAVPTDGLDEELKLFVQDKQGGLWASGNETGHVFALAGAAALLLSLRYRLKIVYLAYFAALLASFPFTNNRAGLFMPILFLGLLMRRNLKAPAVLAALGVLGVLLVAWAVTGEIPLPGTLSQAIERRFAEDHNVTGNFDERFLSGVTALQLVLEYPFGVGEVARREELQALTGLVTPHNGFVSLALQSGIAAALLLVAGLGRILLAPAAFGSFLTYSAVFLIPSLMFEELSVNQYFLFFMGFVLASLALPPDRAQSTPD

SEQ ID NO: 1501 - protein, 445 aa, Methylobacterium sp.
MMTPTLSSSYARVLSEEPRAQDRDRPRDQAAARAVTGPLRILHLSALYPPYIVGGAERSVEHLAEELVAAGHTVAAACIAREPEPKSVRGGVTVYRMAHHNDFWLEDWPQASRFGRAWAKLKQQWNFAVAAEFGRVLDDFRPDIVNTHSLLDVSTLVWREAAKRGIPIVHTVCEYDLICGNAAMFRDGKPCDRWHLGCKVVNAAKQITNRSVDAVVSVGTEILKTHVGHGLFAHLAPERRRVIFYSCTVPEGDPEARRRIDRTGQPMTFGYLGRINNEKGVGTMIDAFRRIGPGDWRCLVAGHAMDDSIERFKAQAEGLPIDFVGWAKPAEFLSAIDVLIVPSFWAEPSPRTIYEAYTMGVPVIGAGSGGIPELIGEDNADWLFTPGDDADLAARLRTVIARGRGDLPDERAFQHVIRESTSERVAEKYLDLYAELVAERRASRP

SEQ ID NO: 1502 - protein, 418 aa, Methylobacterium sp.
MRILHLSSLYAPEQVGGAELMVETLARTQADLGHSVAVACAARTEGGPVLQDGVTVYRIGYGTPFHILDWPQRGRVERLRYKVAAQWNRHAVDRMERAVRDYAPDLVNTHSISELPPALWPMLRRLRVPVVHTLHDFTSLCTNGAMVRHGRPCARQHLKCRLYAAPHRRCQRAVTAVAAVGSDILDRHLAAGLFAHVPPSLRRVIWNPIPPGSPVTRAKRAPGAPVRFGYLGRIEGAKGLDVLLEACRRLPETGWHLAVAGRAVDGLDRYRALAEGLPVTFPGYAERDAFLDDLDCLVVPPIWPEPFGRTVAEAYGRGVPVIGTATGGIGEQVGSGPWLVPPGDAPALAAAMARIIAEPARLAEGLARAARIRAGTDPVAVATAYLDLYAATRDAASIEPLPEPSARAERPHLSECRS

SEQ ID NO: 1503 - protein, 731 aa, Methylobacterium sp.
MSFLTVDLADRTPVRALAQEPARGGPLAAALARIWHRRYLFAAVFATVLGLAVTALLMIQRQYVASGSVIVAEAEPGANNASMAWIQKIGDPADIESQILVIRSPRLLRLAIDDNLVAAVLAECRYAATGGHPDRISEKKDAACTKLTTDRNALVDYLQKRYTVLSSGRSRIITIGYKSPLPETAQTMANGLINAFLDDQREAQASSRKAAADWLHTEISQLDASIRADETRIQTFRRRKGLLKGSLAPISAERLTSISQQLAAAETAKADAAARLSEIEAKGARGADSAPAVLASPTIVSLKQQLSGVSAQLANQSTLLGANHPVIRALETEQASLRARIEQEIGNVAKGLRKSYEASNALAKSLRAQLETAKTDAAAAMDDEASIEGMVRNAEIKRTRYADLVKRAGELETERRILTGSTRLVSLAELPQEPFSPKAVPFLAGGIVLAGVLAAAAALLRDYTDRRVRTSAQLMAGTGAPVFAQLPSLEPAGLVGRFSERQRELDLAEALARARVDPVMQNVLRNLHAHLVLAGACKSRVILVTSAKPREGKSFTAFALAGIGAASGRRVLVVECDLRRPNFEASLGLGRGPGLGGVLRGEIDPADVVVQAGRFDVIPAGTPTADSTELLMGDRMADFLKWSRRYDLVLLDTPPTSLLMDAAMLARHVDGVLCCARYGRSQLSDTVETVANLRRAGGHVLGIAMTMVRPGIQSTYDVMPLPDPRTAASAR

SEQ ID NO: 1504 - protein, 427 aa, Methylobacterium sp.
VTRLTRRSALALAAGVFAAGRAAAAEPLHRCEALIDSIGVNVHLGHRGTPYVDRFAACAQALDELGIRHLRDDIVLVGDEPAGQFERIADLADRGYRFSLIFYDGLTPGPRVPPERFAEIAGWAGDGLIVAEGGNEPPVAARPGLARLSADHQAALFRAVRADTRAEAVRVAGPSYIQGNVAAAQNLAAVVDLANIHAYPGAEHPETDGGGSLARFVAAARPVFGDAPVIATENGYHTALATGSPPLPISPGLRARYLPRMLLWSYLQSVRRTYLYELISSFDRGDADPESRFGLLAHDGRPTPAFAAVRNLVRLFGAPAGEIAAVPADRDVTLGSPVPDLITARFARRDGATLVPIWLGLDGWDRRSRAPRPDLPAQTAELRLSRQPRRVRLHRFDDDGAVSVVELPADRRVPVPVTDRLGVVELT

SEQ ID NO: 1505 - protein, 76 aa, Methylobacterium sp.
LDFSRPGKPTDNALVESFNGRLRDECLNANWFLSLADAKSKIGTWRRHYNEGRPHTALGWLTSQEFALAAARQAAE

SEQ ID NO: 1506 - protein, 530 aa, Methylobacterium sp.
MADVLIVGAGPVGLTLACELARHGARCRVVDAAARPSPYCRAIGVTPRTLEVWEDMGLAREMIDAGLWLTGLRTILHGQPPVDAVSPPLDLPYASLGLPQFETERVLNRQLERFGARVERGLRLTALEQDGAGIRARLQEADGAVAEAHFRYVVGCDGAHSTVRRQLGIAFEGEAYPWPFMLGDVHIAWDVPYGLAVRALRLNEDAPPDMFIAIPLPEPGRYRVSMLAPQHLVPAGGSDHGIQAELQGPSLADLQAVADDLLPDGSRLSDLRWSSVYRISMRLAAAYRRGRCFLAGDAAHIHPPTGGQGMNTGIQDAYNLAWKLALVLRGASPEALLDSYEGERRPVGADVIARTRTASEGYGRERGGAPDRLADTQVLVSYRNTAWIAGDATEPTEAGPRAGDRAPDVNGLVRDGLGFPTRLFDALRGTEHVLLIHAAGMSDAVAGPDLPIWAREHRSRVRVVVIGSEVPIPGVTTLADPTGAFGKAYGAGTMACLIRPDGHLAWRGRTWREPGLHAHLRRLFPSAFPQ

SEQ ID NO: 1507 - protein, 564 aa, Methylobacterium sp.
MSDRAVSYVHGAIGEPLLGLTIGQALDRAAAAWPDHLALVAHAQGVRWTWRELRDQADAFAAGLLALGLRPGDRIGIWSLNRAEWVLTQFAAARAGLILVTINPAYRLSELEFALNNVGCTALVTATAFKTSDYLGMLDTLAPELAASGPGRLSAARLPHLRTVIQIGGPPAPGTVPFDAVAARGDAAGTGALRDLADAMQFDDAANIQFTSGTTGAPKGVTLTHHNILNNGHFVGRAMRLTAEDRICIPVPLYHCFGMVMGNLAALTHGCAMVFPGEGFDPRATLETVQAERCTALYGVPTMFIAELDHPEFAQFDLRSLRTGIMAGAPCPIAVMRRVVEQMNMRDVTIAYGMTETSPVSFQSSSDDPLERRVTTVGRIHPHLEVKIVDPEGRVTPRGTRGELCTRGYSVMLGYWGDAARTAEVLDDAGWMHTGDLATLDAEGYCNIVGRIKDMVIRGGENIYPREIEEFLFRHPQIQDVQVFGVSDPKYGEELCAWIRLRDGETLSEPAVRAFCAGQIAHQKIPKYIQFVDAFPMTVSGKIQKFVMRRCVEEQLGLARSETA

SEQ ID NO: 1508 - protein, 412 aa, Methylobacterium sp.
MPLQPHETAFTQAPAPPRPVPVLPDAAAALAVADRLAEAFAEAAAERDLERRLPVAEIARFTESGLWAITVPREYGGPGLDSATVAQVIARIAAADGSLGQIPQNHFYALEVLRNGGTEAQKRALYGRVLAGERFGNALAETGARDHTRRTRLVRDPAGWTVEGRKDYCTGSLYAHRIPTLANAEEDGRAVAYLVFVPRDAPGVTLVDDWDGFGQRLTGSGSVLFDRVAVEPDWVVPFQASLERPTALGPFAQILHAGIDLGIGAGAFAATLPFVRDRARPWIDSGVARASEDPLTLHALGDVQVRLAAADALLARAGRYVDAAQEAPDADSVAAASVAVAEARAASHRAGLLAANKLVELGGTSATDRAEALDRYWRDVRTHTLHDPVRWKYHWIGAYHLDGRQPPRHGAL

SEQ ID NO: 1509 - protein, 183 aa, Methylobacterium sp.
LQDASAPPEIQAAAAPIAADEPDQAPAPAPDQSPDHFAEAVRTGAETAPDGAVDVPSDPVATAAATTSEAEFEARSEAESGTGAVIDIAPRPVPGAGPGLVAAANRISFTPDRLDVVEIGSIIARYVRGEGEAAVAHLRALSGARSPADVIRLQVGEVQRAADASLTCWVTVVGQASRVVAYR

SEQ ID NO: 1510 - protein, 661 aa, Methylobacterium sp.
MARPDLRALTDDGLIQLANAGLVKRALREVAAGQGPDLAEAGDGTVEARFADGTVTRLGPGRPPGEASCTCPASGMCRHRVALVVAYRAAPVADGPADGSSAGAADGAAEGAAVPAAAPVAWDPGTLDGAALEAGLGGAAAAELRRLLAGGITVGLERGAVPAARLPTATVRFLVPDAVGYARCDCAAGGGCAHVALAIRAFRDSAGAPEIRLGGAAPAGAEAKPAETDLAEAADRVVAGLLEAGVVSGPEAHGAALVRLRRAAERRGATQLLLAEADLDGQVAAYAARHAAYDAAVVLALATELLGRVRGGEAALGLGQPYETAMGKTRLVSLGARLLARGRGATARVALADTDTGALLALERAFAPGEAEADIAASLPGRLLSPGLSVSGTGQGQILTSVARRRADGLLALGQGARGRTALLPRDALVALPAPLAAPDVPSILRRLADRPPVFLRPRDRLEAFHVFPVEAVLGQAWAPGAQTWQAAVALPGAGGTLHLARAYDPAAPHALDALAGACAGRWGPVRQVAGPVRIADGTLVCDPWSVSVDRLVVPDLAVPDGAGHPIPPAPDLGPATLLDEAAALLANALHAGRRAFAASARAGGADLVARLAATGYPATAARLSAFLSATLAAPGAQSEPFARAALWVAAMRDDPGPEEA

SEQ ID NO: 1511 - protein, 118 aa, Methylobacterium sp.
MAVKRIVTNIRTTQVEAARSFYAEVLGLEVVMDHGWILTFAAPGMSATPQISVASAGGSGTPVPDISVEVDDLAEVLARVRRAGLPVLYGPAREPWGVERFYVRDPFDRLVNIVAHLA

SEQ ID NO: 1512 - protein, 441 aa, Methylobacterium sp.
MLALLGLCTIALLLAAILTKRMSPLVALIVIPVAAALIGGFGFDTGKFVLAGLQSLAGVVGMFVFAILFFGIVSDAGMLDPIIDRILARVGTRPTRIVPGTTLLALLIHLDGSGAVTFLITIPAMLPLYDRVGIDRRVLACAASMAAGVNFLPWTGPMIRASAALKLPIPEIFSPLVPVQAVGLVFIFAASYWLGLREERRLALVPGATGSAGAAPGPATTARTLSDAERALRRPDRFWINIVLTAAVLGTMVFLAEKVPPALMFMLGTALALVINYPQVDAQRQRVDAHARAAILMASILLAAGVFTGIMQGTGMLRAMAQTAVTFVPPEMGRHIPFGLGLVSMPLSMLFDPDSFYFGVLPVVAEVAHQLGVPPVQVAQGALLGQMTTGFPVSPLTPATFLVCGLTGIDLADHQRFTFPFLLAASVVMTLACVVFGVFPI

SEQ ID NO: 1513 - protein, 445 aa, Methylobacterium sp.
MRTVRLGAGAGYAGDRIEPAVELAERGDLDYLVFECLAERTIALAQQAKLRDPEGGYDPLLEARLRAVLGPCRARGIRIVTNMGAANPVAAARKAGALAREMGLAGLRIAAVTGDDLLDAVRAGDFVLEESGEPVAGLGNRVVSANAYLGAAPIVAALADGADVVITGRVGDPALFLAPLVHAFGWAMNDWERLGRGTLAGHLLECAGQITGGYFADPGCKDVPDLARLGFPIGIVAEDGTVEITKVAGSGGRISLATCKEQLLYEVHDPARYIQPDVVGDFSEIEMEQVGPDRVRVRGATGAPATGLLKVSVGYVDSYIGEGQISYAGPGALARGRLALSVVRERLALTGVATTELRCDLIGVDALHGAALSGGREPYEVRLRVAGRTDTHAEAVRIGNEVETLYTNGPAGGGGAWKSAREVVAVQSVLVPAALARPRVHVVEA

SEQ ID NO: 1514 - protein, 114 aa, Methylobacterium sp.
MKLRALAHARTGDKGNTSNIALIAYDAADYEHLAAHVTAERVWAHFRGIVTGDVTRYALPKLGALNFVLTGALGGGVTRSLALDAHGKGLGAALLDLDIPDLGAGRAARGSPRP

SEQ ID NO: 1515 - protein, 172 aa, Methylobacterium sp.
VTLRSRTWITEIGRVAPVAREIAVPQPQSASSAMLFHMVSGGPQPVAPFSHAVEVDGFVFVTGQMPDTPDGPGVLPDGIEAQTRNVMANLATVLAGLGLGLENVVVARAFLTEFKRDYAAFNATYKSFFPPDRLPARTCVGTTGLAYDALVEIDLIAHRGGATSPSSDARSG

SEQ ID NO: 1516 - protein, 138 aa, Methylobacterium sp.
MTNKLLLSLATAGLLALPAAAQAQGTLRGAAEGAAVGADAAGPVGGIVGGAVGAATGTVGGILGVDDRPRFRSYVRERGARSYSWGGPVRVGTVLPEDSVTYYDVPTEYRVRPGYRYTIVNDQPVLVDRGHRIVEVID

SEQ ID NO: 1517 - protein, 52 aa, Methylobacterium sp.; identical to SEQ ID NO: 469

SEQ ID NO: 1518 - protein, 309 aa, Methylobacterium sp.
MLSAGPAVTRLPAATLAAAIAASLAATLLAPSSARAIDCRKAASPLERMICADPALRKADAALGAAYSGLLHSTDDAEIRAMLVASQKRWVAARDTWLGDPDAADARAVVLEAIRARTEDLSGRSKSDPARPHWIAAALRQRAFAARFTGGPFAGFDAACDFLPVGQDRVYGCFGSRRYQNGDRVCTLSDDWASGHTSETRTVARVVDGAARTVATCTIGGGDDAECPGPDNADGRWARPAAPAAAGAAAAPAGPRPVLDVELAPDADAETWLSTCLTDPAYPPPDPVPAARTAPGSSPPAPAGAPSSR

SEQ ID NO: 1519 - protein, 430 aa, Methylobacterium sp.
MRAAAPETPCLAFLEALPVAERWQRARDWIARAPQPFFAQLRARRTALDCGAAILVAGRAEVEEILSLPQVFSVALYKPKMGEFMLALDGTEVNYRDKAVMRAVLSWRDLPAIRDLAGAETDAALDAGLDQGGGSIDVVASVSRRVPLRIVQRFFGFAAPDADLLRWSYANQFDQFNNLPFDERPDADAIHAAADLARQEMRAAFARIIPARVAAIEAGADLPDDVLTRLLRLHLPAATGFGMDRVVINVGGLLIGAIETTSEAVVHALAELLGRPQILAAARAAARTGPAAFDGYVWEALRFAPIVAFMFRQAETDHVLGRGSPAESGIAKGRVVLPLSLSAMFDATGVPDPDRFDPARPEQTYLHFGRGHHECLGRYVAGAMVPEIVRRILLRDAVRAEGAVEDGGTPFPTAFRISCAGRPAGAAGPG

SEQ ID NO: 1520 - protein, 88 aa, Methylobacterium sp.
PETATPHPAPAPAPGAAPAQAAPRTANSARAERRRRSYAACNRASHQRGLRGGKRRRFLIRCRLGYERTRIPGGQPAAAAPAQPGRKP

SEQ ID NO: 1521 - protein, 94 aa, Methylobacterium sp.
MRILVLAALAGVGLGVLAVPASAVPAGPATGLSSPSDMLTDVRMRRHHVRRHSMSRVQRRYPGASFVRNKTPGSAGGSSRGNGVTGSYAAPSGR

SEQ ID NO: 1522 - protein, 85 aa, Methylobacterium sp.
MANNLTVSELRKAAEISDQEIDAAVDAVLADLATESYPLAKGWTLDLVETRRTNTRATEALTTDKPAWKRNMVRTAILLAHPVKG

SEQ ID NO: 1523 - protein, 76 aa, Methylobacterium sp.
VAETFTAADLAACAERELAQRRRAYPRWVEAKRMTQALADRQTALMEAIARKLRAEADAEGAKGDLFGAAAEMCRE

SEQ ID NO: 1524 - protein, 97 aa, Methylobacterium sp.
MAQEVKLTVTLEAALADRLKVAATERGWSPESLAADCVAQALEVAIRHRVLIERMEQIDGAILDMAQAVGDLGAPSGGIDLSKVCRLRAGAAADPAR

SEQ ID NO: 1525 - protein, 92 aa, Methylobacterium sp.
MRGGRRPARLDHSLRLWAPQGVSALPTTDTRRGPVIGVVDPQAAIKRDIAGHNRHAEPVIWTRPATDILAAVSLAYWYPFGNGSGLISSGLV

SEQ ID NO: 1526 - protein, 395 aa, Methylobacterium sp.
MAIGLLLLSEVAAMATWFATTASIGAIRTQWTLSPFQEALLTNSVQAGFVAGTLVSALLGLADRFDLRRLFCGCAVAAGLANLLMLAFAPTSPMVPLLRFVTGACMAGVYPVGMKIAATWAVGDLGLLIGLLVGALTLGSALPHLVAALGQLDWHLPVLGAALGALLSAALIRFVQLGPIRSEAPPLRLENALEAWRNRGVRLANLGYLGHMWELYAMWAWIGAFMAASFRERYGNAPPFPPELAAFAVVAAGAFGAMLGGWAADRLGRTLVTGASMLASGCCAIAVGFLFGGPAWAVLAVGVLWGVAVIADSAQFSAAVSELSDRRLIGTMLTVQTCLGFLLTLVSIQLIAFAGTFLGWRFAFALLAVGPFLGLASMLRLRRLPEAKRLAGGRK

SEQ ID NO: 1527 - protein, 115 aa, Methylobacterium sp.
MVEILALPVRPHGTHQFDRLHADLAAAHERGADLGPRAPHIQAGGDRLLELTCALERAIEDLDLTLIKLGLRDPDMREALRDFVIKTESLANTAQSFAHTVHGLAGLAQRYPATL

SEQ ID NO: 1528 - protein, 70 aa, Methylobacterium sp.
MTITTTINAIGLVKATEMIQSARAEAAIEHKAGLHTVSMPAPPPNDAGIQRQKNDPKLLASQERVVDITV

SEQ ID NO: 1529 - protein, 101 aa, Methylobacterium sp.
VAVPRRDETRDESASAAWPVSLRAGSNSGRVTFLIAYIAQTGGTLMRIRYLLPLVGLLALTACKDEKKAEPPPPPPPPAGTAPANPAPPATTTNPAPANKP

SEQ ID NO: 1530 - protein, 451 aa, Methylobacterium sp.
MASFQDFQDGYERTWASLQIRPEKLATVRKLAQQLAAGKPRYQEIEARTGVPWWFIGLCHYRESAFDFDTYLGNGQKLGRRTTIVPKGRGPFTGPQAFVEGAVDALRLQGLVGLGDWSVARALYRLEGFNGYGYHGRGVNSPYLWGGSTAYGPPGARGGKFVRDHVFDPNVVDTQIGTAVILRSLIDLDATVALAAPRAVEAAVSREPDDELADSTLWVQQSLNRLGATPPLVEDGRNGPRTMTAVATFQARCGLDDTGLADARTIAAIQEALRPAAPDHAVLTRIQDLERQLAARAVTPMQPAPMQPASMPPVVIAPAAPPADVAARLDEFLQALRRQIDGARLPTAPILPGPPAARPDGAVLGPVNGALGQTIGQLLSGKKSAIGIIGAVATQILSQVPLNTGLGQVLAQLTPAFGLSPYTMPIFIGLTAWGALGKFEKWNARAGQATP

SEQ ID NO: 1531 - protein, 39 aa, Methylobacterium sp.
GVSLTGAVAEGVRLSVGYTGDVRPGATAQVFTVGLQAAW

SEQ ID NO: 1532 - protein, 39 aa, Methylobacterium sp.
GVSLTGAVAEGVRLSVGYTGDVRPGATAQVFTAGLQAAW

SEQ ID NO: 1533 - protein, 39 aa, Methylobacterium sp.; identical to SEQ ID NO: 1532

SEQ ID NO: 1534 - protein, 142 aa, Methylobacterium sp.
MVEHMVEPPRTVRRLEVITTASGRRRWSQSERRRILAEAMAPGAVVSVVARRNGMSPQHLFTWLREARKAPTVGGMAAALVPVLLDEPASASSASSPRAGIRPLGSPVTGIEVEMAGAVVRIGADASQAQITAVIRALKACP

SEQ ID NO: 1535 - protein, 59 aa, Methylobacterium sp.
MTDQTGRPAREGAEAPVAAKTETPREKLGQMEDKARSDTDLGEAIDRATAAVGQDDGKR

SEQ ID NO: 1536 - protein, 250 aa, Methylobacterium sp.
MTFTAHNIRLADGSETLPEAGWLIGDSPWTQAALRSLRLFYGHRLAGRSIVDLGCLEGGYTLEFARAGMRATGVEVRRSNFENCLRVKEGTGVPDLAFVNDDVWNLAAHGPFDAAFCCGLLYHLDRPAAFIRLMAECVRDVVILHTHFATETNEALFQLSPPAENEGLPGRWMHEHDLDDTSQLEAHKWTSWSNKRSFWPTKPALIQLLKECGFDMVYEQYDMLGHDIRGSMESGYYHQQGRSMFVAMRT

SEQ ID NO: 1537 - protein, 236 aa, Methylobacterium sp.
MFATSLALWVIAILLLLSWLHLQERLTERCRRAIRPQIERLIIENRWMEHHARGAAAFEALWDRELVRLHRAHLSRPLRAVVRFRGFRRLVSAEFASILPAEVASWTFLDRVSASQAHYEALMLRCLKAAGWRLDYQDQDHFVLLRARTRVVVCLHWADRDVACLPISDVAAAAERAGSTTACVMTNGRFSGAARAMAEEQNVLALHCSQIDLLLPRDKSTVAPRTARGIGFRLAA

SEQ ID NO: 1538 - protein, 399 aa, Methylobacterium sp.
VAAAAFGAAALTALPASAQYADGGIKIGILTDMSGGYSDLAGRGSVTAAQLAVEDFGRPINGRKVELVFADHQNKADIASSIARRWFDTEGVDAIFDTNSSVAGLAVREVARSKGKIDINSGAGSMALTNAACSPTGAHWSWDTHSLAAGTAAALADDPKNTWFFITADYTFGHDLEAQVTRVVKAKGGTVLGSVKHPFPNPDFSSYLLQAQASGAKIIGMANAGADTINTIKQASEFGILQGGQRLGGLNIFLTDIYSVGLPAAQGMILTTGFYWDMDDQTRAFARRFGERMGGRMPTMVQAGDYSAVLHFLKAAEAAGTDDGLKVMAKMRELPIQDFFARNATLRPDGRMVHDMYLAQVKSPAESTGPWDFYKILKTIPGDQAFQPLSESTCKLVKG

SEQ ID NO: 1539 - protein, 95 aa, Methylobacterium sp.
MIETFDKAGSLDVRRANRAEHLVYLDRIKDRLLACGAKLNDDGSDAGGGLYVVDVETRAEAEALIHADPFYKVGLFERVEIRRWRKAYLDGRSYL

SEQ ID NO: 1540 - protein, 268 aa, Methylobacterium sp.
MTERQTNPEAIVRRASHAGRRVLVTGAGRGIGRAIAEGFGARGALVGVADVNPDDVAATVAAIEGGDGRALPLRLDVADYAAVEAALSEAAAAMGGAFDTVVNNAGISPKHDGAAHRVWEMDPAEWSRVVAVNLTGAFNTVRALAPAMCPAGRGWIVNMSSVAAKTHSPIVACHYAASKAGLIGLTKHLAAELGPFGIRVNAIAPGRIETPMVRAVGRAVNDEQVRLTPMGRLGAPEEVADLALYLTSAEASFVTGQTVDVAGGLYMT

SEQ ID NO: 1541 - protein, 569 aa, Methylobacterium sp.
VAVPVAVGNPFIYHVFITICVFAALSTAWNIVGGYAGQLSLGHGIFYGLGAYCGMLLVGAGISPWIGMVAGAALAVLVALAISYPCFRLHGPFFSLATIAFLEVFRVLALHFRDLTGGATGLMIPLKFGWTWMVFRDRWPPLAIAFGLLLLTLAVAWWMRSHRIGFYLVATRERESAARAAGVRTVRVRLVAVAVSGALTAMVGTFHAMYLTFIEPAAMFSLTLSIQIAMFALIGGLGTVFGPLLGALLLVPITELARGWLGAKALGLHGLVYGLVLVLVVLFLPNGLMGLVSRFARARAGGRGAQAASVPAVPRAPERPPVGADLIRVEGLQKRFGGLHVTNDVGFTLREGEILGLIGPNGAGKTTVFNMISGFLKPDAGTVSVRAPDGTWHRPGRPSDFATLGVGRTFQIVQPFAAMTVEENIMVGAFHRHSDVREARAVARETAERMGLAPWLGSEARGLTIGGLKRLEVARVMAMRPRVLLLDEVMAGINQTDVRRAIDLMLSIRDTGVSIIAIEHVMQAVMALSDRVIVLSSGQIIAQGSPQDVVRDAAVIEAYLGKEFAHAHA

SEQ ID NO: 1542 - protein, 336 aa, Methylobacterium sp.
MGMRAVIADGQGGPDVLRIVERPRPEPGQGQVLVRVEAAGINRPDVMQREGRYPPPSGASDVLGLELAGIVEALGPGAGRFRIGDRVMALVHSGAYAEWAVVDEAVALPVPEGLPAVEAGAIPETYFTVWSNVFERARLQAGESLLIHGGSSGIGTTAILLAKARGARVIVTAGSPEKCAACLTLGADAAIDYRREDFVAAARAATGGSGPDVILDMVGGPYIARNLDAVAVDGRIAQIAFQQGSRVAEIDFQPLLMKRVTLTGSTLRARPVALKARLAEALAEHVLPLLAAGRARPPIDSVFPFERVADAHARMDAGQHIGKIVLSMDDAAQGSR

SEQ ID NO: 1543 - protein, 120 aa, Methylobacterium sp.
MTYVSGFVTPVPDANREAYVASARAAWALFREYGALHQMEAWGDNVPEVERTDFRRSVALRDGESVVLGWILWPDRETADRCEAAMRTDPRFRDLTMPFDGARMIFGGFTAVFEASRGAA

SEQ ID NO: 1544 - protein, 104 aa, Methylobacterium sp.
MPDLAEVELYCAEARDILAHAENIVADLDRRGACEGHCLMANQGLAALRNLDRIIERHRRRLAFLALPNAVGPSPPPSPPRKRNWLLFLRRRGGYAGHGIEAHS

SEQ ID NO: 1545 - protein, 384 aa, Methylobacterium sp.
MGLSHHRIGILFSADGPYGLVGRAMLNGALLAVDEVNARGDCVLEPVIRDPQGALAGYVAGAERLLDAGIRHVVGCYTSSSRKEIIPIFEKRDALLWYPSHYEGFETSANVVYTGAAPNQHIVPLVRHLLARGGRTAFCVGSNYIWAWENNRILRETLAIAGGDVAGERYLAVGETAFDQVIAAILAAKPDFVFNTLIGISAYRFFRDFRSACAARGIDQARTMPVASCSLAEPELEAIGPEAVDGHLSSSVYFTSIDTPRNRAFMAAYAARFPEGPTPSADAESSYIAVHLLARALARAGTEEAATVRRAACADEFEAPQGPVRLDETTLHACLTPRIGLSTAAARFTIVAQAEAPVAPDPYLVRSDPRVVPVSRRPHLKVVP

SEQ ID NO: 1546 - protein, 213 aa, Methylobacterium sp.
MTTPRLIQNFSGAQALLIAPPSTATDVLAGTLMKLGLTVASVLPAGEAPWLDFEILDPEHHIVIVDGDLPLPGLAASAVPDLPPVPVVGLVGVEAPSRLKGLLQLGATGLLRKPIHGASVYAALFLAVNEHNRRRLLEERLARHEERRRGRRHVVKAILRLMQEHGLDDDAAYETLRRDAMRARQPLEAYCEALVRARPSVAAPALSPRLARS

SEQ ID NO: 1547 - protein, 206 aa, Methylobacterium sp.
VAALRARGVAATGRAVDVADSAALRGWVAEAADELGGLDIVVPNVSALAVGSDEAAWRSGFAVDMMGTVTAVEAAMPYLERSEAGAIVVISSVSGREIDFAEGPYGAFKAALIHYAQGLAFQLAPRNIRANSVSPGNTYFAGGVWHQIETGNPALFAEALRLNPTGRMARPEEVARAAVFLASPAASFITGTNLVVDGSLTRGVQF

SEQ ID NO: 1548 - protein, 48 aa, Methylobacterium sp.
MIASFLAIFVAFAACQALLTVKFADFLSADRARNTVEPTADVANAKLA

SEQ ID NO: 1549 - protein, 32 aa, Methylobacterium sp.
MKLKALSYVMIGAFVSGLLMTFVGSATALLGQ

SEQ ID NO: 1550 - protein, 101 aa, Methylobacterium sp.
VEEVEADIEADVEADVEADVEAVDADVAAGRDAPPGGLDCPGLPGAASGFQPPGPGLSASLGGGVTGKSSNSSASPRPPSTAAAPGARARYGGPASLSPRG

SEQ ID NO: 1551 - protein, 249 aa, Methylobacterium sp.
MLELSLDADTIDAQGPRLPDSVQYHLGHLLAATYAQDNVEPTIADRFAELLRLLDGAFGRAQDGREKAFQASLLSLVPNLQRFARSLLRSHVGADDLLQNTLLRAWRSRASFAPGTNLEAWLFTIMRNQFYNEHRKRGREVQDEDGAQAERMVSLPEQGGHLDLSDVQAALDRLAPPMRQALVLVAIENLTYEETAAVMQCRIGTVKSRVWRARTQLAEMLGYTGLEVGSDDIMLAAAGPKGRKSTAVS

SEQ ID NO: 1552 - protein, 433 aa, Methylobacterium sp.
LRWLMIGLCMAANAINYIDRANLAVAAPSMTKELGLDATDMGLILSGFFWTYAIMQLPFGYVADRVGARLSLVVAVVWWSACTALTAVGRGFLSLLGLRMLLGIGEAGAYPSFAKVAASWFPRSERSFASSIFDSGSRVGSALAIPLVSWVIATLGWRESFVVTGVLGFVWAVFWMWLYREPENHPKVSPEELARLRAAQERPKTIDAADAQNQVPWLSLFRYRTVWGMMAGFFCLNFVIYFFITWFPTYLVKARGFSLAELGTLGSLPALASIPAGWLGGFASDALYRRGWSLTAARKTCLVGGMLMSSVITLSIIAPNIYVALLCFAVAYGSLAFTAASIWALPGDVAPTPAHVASIGGIQNFASNVAGIVTTTFTGVMLTVTQGSFVIPLIVAGGFCLLGAFIYLFVVGEIAPLPVRDARAPALRPEAAR

SEQ ID NO: 1553 - protein, 215 aa, Methylobacterium sp.
MAAIAAAAQKAPPGEATVLTPARDVNPVAAPDPRSIYTLTPEAAGAVFALVENRIQVIDAALDVTDRRGTQVAAAAMATATATTPVVSPETTKTIGAANRNWSEDVRLDHSPSRLVGADTVVAYDSPRVTAAWSLAFPDVPGRRFRAVQLPGPSLRSVLREAEAGLDDTGSDIYLLCNSAHFETIRQAHPRTHINWINVDNDEIVVVWRKPSEAG

SEQ ID NO: 1554 - protein, 87 aa, Methylobacterium sp.
VSTGAAPPCRGDAASPPGTAPPGLSIQPLAGRCRVCGLAYGGILGREAGVIRLDRARWRRLCPGAAWLTVPAACAGLRASFGGDAGS

SEQ ID NO: 1555 - protein, 101 aa, Methylobacterium sp.
MIEQGPRIAREFNVGVGGDRWALMRDLQTGQPYVSHSPGDDAPEVQLDLGSFLVLFTGEEREKLLRLIGSLLPDEDARADADGRAGTSRPLTFVSRWLPNR

SEQ ID NO: 1556 - protein, 83 aa, Methylobacterium sp.; identical to SEQ ID NO: 502

SEQ ID NO: 1557 - protein, 386 aa, Methylobacterium sp.; identical to SEQ ID NO: 503

SEQ ID NO: 1558 - protein, 432 aa, Methylobacterium sp.; identical to SEQ ID NO: 504

SEQ ID NO: 1559 - protein, 75 aa, Methylobacterium sp.
VTDEQKGYLQALSDVRSWHRWELAQCLGDVRAMEAHEKAIAWLDMLIATKRQQAAEDEDGRRAQRHQPASPRSLP

SEQ ID NO: 1560 - protein, 192 aa, Methylobacterium sp.
MSNTISSALSAGTISSTDATALAGALSSIDRSLSSTSAASTSATSRSGLDPSSMKDRIDGLIADQVSSGSLTADQATELKNLFASHGRSTQSADATGDGTGDVAGPDGPPPGPPPGPAPTDAAGSAGSGASVSASASTSTSTSTTDAARTTNDLLSTFIQQLQSGQSGRVGYGASGTANSGAVSALLLDFRS

SEQ ID NO: 1561 - protein, 122 aa, Methylobacterium sp.
MKSTTQQDQLEIVSDLAASLADRMLMERLTQGKLPLANASRLWTASLLLEEHARPIPRIVTDVLEQVRHVEPDDEDAVDGDDADGIGAGPEPDLAAARRAARPARRRGLTRLLRPFRQAAEG

SEQ ID NO: 1562 - protein, 106 aa, Methylobacterium sp.
MDKVYAGDRTIDGIVVTVNGAPLPDRAEAKCYSRNGFEWSYEGPEPSQLAYAILVDHLGDAAEAERLQPRFMRGVVANFQNEWEMTTADVARVLERLDSGGAARSG

SEQ ID NO: 1563 - protein, 71 aa, Methylobacterium sp.; identical to SEQ ID NO: 510

SEQ ID NO: 1564 - protein, 129 aa, Methylobacterium sp.
MDMIEPNVAALAWFALFAGVACTGFYVLAGMFPLETRPDLRARPLGLALIAANVLLLAALTGGMLAYGAAELRWSSLVIVGGFAILFAPGLFNVWPQRWRDGVAGLAIVLAALCGALGLLQQVGTVFVL

SEQ ID NO: 1565 - protein, 263 aa, Methylobacterium sp.
MELANTRMSERQRNYRANYRQRVAGWYNGFLHIAIIYTIGLTALYIYVSNIHAPSWIELATVPVVFLFCNFFEWWLHRYVMHRPQSNPIGRAVYNRHTLQHHQFFTDHEMRFADHRDYRVTFFPPYALATFTLMSIPGAVVLGNIFTPNVGWLFITTTTSIYMIYEFMHFCCHVEENWFVRNMPFINTNRRHHTAHHDQSIMMERNMNLTFPIMDWLFGTSDLNRGLIGTLFNGYDTRHVKNDMRKTARTPGAPEPRAMQAAE

SEQ ID NO: 1566 - protein, 221 aa, Methylobacterium sp.
MRVLVVEDDAALARGLVAALRHGGYAVDHEADGADAVQLALSEPYSLIVLDLGLPGLPGFEVLKAVRAAGSTVPVMILTARDAISDRVRGLDLGADDYLLKPFDLAEFEARVRALVRRGQAVPNPVLRCGALELDRAAGTVTLGGAPVALRRRELAVLTILMTRAGKPVPKERLSAEIFGFDEAVAPNALELYVARLRKKLQPDGPEIRTIRGLGYLLMPV

SEQ ID NO: 1567 - protein, 77 aa, Methylobacterium sp.
MPFANFKIPQGMMTGPQKADLIHRTTDLLVSFFGEAARPHTMVLVDEVVDGGYGRADEVFDLEALRRLRAHHETGSR

SEQ ID NO: 1568 - protein, 364 aa, Methylobacterium sp.
VSFSALMIAPAARAASTLEAALRAVPDSVLATPDPMPIVFMDVQALSRAAGGALSDAGLRRMAFAQSIRPLNALSYGGAQTWTEKAGIPFEDISYFAAFGQPPARVTHWGLATKAAADTLVAKLKDRNFRPVPTAPRILANGEPRALNLRARQPTDPWSGPMGETSAILAIDRVVAQASAAADLETRVGVGRSAADHEAVATALTGLAAADERDPGAILQAAVVTPLMGITPDDPAALLSATTDLAAQRKAIADQRERGRDGVPAYAGGIVADYQGKNGPALLVSLAYPDCRTADRAVAALKARWRAGMAPAASVDGRSVESPQRGCAAVLRVDRAAGANTPFGEFLGTSLQRGFNVLQIGSQR

SEQ ID NO: 1569 - protein, 91 aa, Methylobacterium sp.
MAGEAKRAGPKRRRDDPDPARAEGEKVGARIDAAFEKLAGKLRARADRARAKLDAATKAEKRAVLLRRYELYADAAAYLEERLVDRGGRSA

SEQ ID NO: 1570 - protein, 75 aa, Methylobacterium sp.; identical to SEQ ID NO: 517

SEQ ID NO: 1571 - protein, 319 aa, Methylobacterium sp.
LFSTADFKPKDSFRLWRETIFERIVPVELTPAVAHAFTGTLEAAEVGPLLITRVTQSAVTTVATPDTIRRHGKYETLNVAITLKGRVFSAQDDRTAIQNPGDIVVMDRRPATMASDVDTQTLFVELPRAALERALGSTRRFTCLTIGADQVGTSMVTTFFQELVRNAERLTPDMSNRMASVGVDLIVASIAERLAHETPKNIQGVLIFQRALAHIEAHLGDLNLDPARLAAAVGVSLRHLQALFREQDRNIADWIWRRRLETAAQRLADPGFAHLAVGELAYSCGFCTQSHFSRRFKDSYGISPSEYRWRNRGADQLAG

SEQ ID NO: 1572 - protein, 147 aa, Methylobacterium sp.
VSDSSLVSPQSNIVLTAGLVAAYVSNNRVPTADLPTLIAQCHDAITALAANGAASIEAAGDTDALRDRPTAAQIRSSIRPDGIVSFIDGRRYKTLKRHLTAHGLHPQSYRERYGLPADYPMVAQEYAERRSALARSIGLGVPGERAA

SEQ ID NO: 1573 - protein, 74 aa, Methylobacterium sp.; identical to SEQ ID NO: 520

SEQ ID NO: 1574 - protein, 618 aa, Methylobacterium sp.
MAGEVALSDDAPGLLQRLAAWWPREAAEAVRIALTAIAAIWLAMWLELALPHWAGWTVISVTLATRAASLRKSLWRAGSTLVGVTVAMVLVANFAQATLAFDLALALWMGLLTAASSVESGQRAYGFASMGFTVPIIALADVQNPEAVFQIGVDRCSTILLGIGCAYASNVFVAPGVPAVSRALAGRLEAAAEACDAWMAALRRGERPGPMPIAAVMTLGEEVTDTFTEQPSLRSGGRGIRNAAPRLRRVLAAGLLRALLPDRPGSRSTDLIGAGGAIAVRQVGRVRVSARLLRAGGRVGRRRVPFRPHLLLWNDLDWDGWHAFDNALRTAAAVLLVNGFWYVTGWSHGAGAATWASLVCVLLAAHADPRAESRAFLVGALLAGVVGLTVRYTLLTTTGSFALLAAVLLPVAMLAVVGRADKRAIYGIGFGFFVFGVLDPKNPMTYDLADSLNTVLAELLGMAVAAIAFAALPPPVSAATLRLRARRRLVRSVRGAALDPALLLPPLDRYLARGFGRLALIGADDAAARSGERLLVIGLLLLALRETDDREGRRVGRAVWARLAASRPAGPETVPDPLRALADRATLPLQAERIGALAALVSDLDRAGWPNLDPGGRA

SEQ ID NO: 1575 - protein, 132 aa, Methylobacterium sp.; identical to SEQ ID NO: 522

SEQ ID NO: 1576 - protein, 76 aa, Methylobacterium sp.; identical to SEQ ID NO: 523

SEQ ID NO: 1577 - protein, 137 aa, Methylobacterium sp.
LRKNQDQLEPTISDVALRVVTAYLSNNALPHTSIPPLLLTVHGALSALTDRPAVVEAPPEQPDAAQIRGSVRQDGIVSFIDGRSYKTMKRHLTAHGLTPELYRARYGLPDDYPMTAPGYAERRSEIAKAIRLGSKAA

SEQ ID NO: 1578 - protein, 116 aa, Methylobacterium sp.
MLAALLGGMLAAPFAHGQGADDLEAEMRARVAAAFPDAGLVRFRKIRPIPAEAESAVAFCGQVSSGPVGQGRSDFQVFLYDRTASAETVRILGSESLNGYRVGRKLIGALRRVGCL

SEQ ID NO: 1579 - protein, 90 aa, Methylobacterium sp.
MEVRMCARKTFYIFVSASDEEQFCAVRQDQPIPSLIDGVRWMYVGCIDTTRDRPYGFDVDAAHAAMRHRGVYFYRRELMFRRANFLLEAA

SEQ ID NO: 1580 - protein, 348 aa, Methylobacterium sp.
MPPPRDLQLDAARGLAVLLVLSGHLLQPVFYGPSGPEPGPALAVWRVIYAFHMPFFFLLCGMVDRIKGEAKLGEACRSALRLVAVTLAFGTLALVPQALAGTLSPGDALGDALCGRDFGLGVLWFLVALGLVRVIDAAARAATFPGGYWIVLGGALALSWTCSARAFPYWQVHALVGALPFYVAGLRLGPRAFDVSALLGACGLAVLLLCAPRNFVHVATGQYGDPALFAVTAAAGSAFALAIVGRLRGPSRAAAAVLGRASFELYIVSGVFLLLAPHWPAWDRWDGLVLLAAIGLPLHLIAARGLRGPIRAVRAAADSVVDSAVDGLVDGLAGRRRRARPGLSGADP

SEQ ID NO: 1581 - protein, 72 aa, Methylobacterium sp.
MTAPQVIATIFFLVSVGSATTLALMAAASAVLDAVAKTCDRARPDAGRDRSRRVTEAACRLRRAALARAAIP

SEQ ID NO: 1582 - protein, 73 aa, Methylobacterium sp.
VQHLFQAVAIFAFGCLLIHAGRAYARATTLLLSATALMLSVTLGTVLCQRIGLPGRSVAAGPSYTVALGRPAP

SEQ ID NO: 1583 - protein, 47 aa, Methylobacterium sp.; identical to SEQ ID NO: 530

SEQ ID NO: 1584 - protein, 270 aa, Methylobacterium sp.
MARRPTYHNDGRGPEHLIMRGTLVVATLLAFSAVPAAIAANPVRDVLWVALQGCVLAKKAADRSFPCLAVDLGDAARPGTAVLRAPGQPTHTVVMPTDSVSGIEAPVLQGPRGAAYWRAALAARHYVSDALQGRLPPSAVGLEVNSVGGRSQDQLHIHLDCMRRSVTAALKAHGDAVGDSWAPFPVPLAEVSYLAMRVPADAVAAFNPFAALARAPGWQGHLHDASFAAVEADPGDPRGGMILLAYREPEASAEYLMDHGCRVARHGRAG

SEQ ID NO: 1585 - protein, 101 aa, Methylobacterium sp.
MTLTGRFWFRRTWTGKLVLLVEEERGRWFRRRLGRTLRWRDARLLDLAEGPLRGLMTLERTYRAEFGPGEPRRPAGLTAVPGGRALPRGGPEPGTRPSLSG

SEQ ID NO: 1586 - protein, 74 aa, Methylobacterium sp.
MTERDPYRHEDPIWYDRIEADEPPGVILDLLAHAFVPIVAALGAVRALYWLPTRLWCRAARSILRDRTTAAKRL

SEQ ID NO: 1587 - protein, 66 aa, Methylobacterium sp.
MSDVPDPKRKAIADSVLVRLSTFALGIGLYDGIARSIVEKAVADMPEATVEQVAAAARMMMLFVSG

SEQ ID NO: 1588 - protein, 44 aa, Methylobacterium sp.
MRPWMDRFLTMIMVAGGVATVVWIAAMLVVGWQMAVVLMGLSAV

SEQ ID NO: 1589 - protein, 38 aa, Methylobacterium sp.
MTKPITLTNRLVDAVVTAAMAFSLVVHAQVMILPPHFV

SEQ ID NO: 1590 - protein, 159 aa, Methylobacterium sp.
MTLNLHRPGRTTRLDRLAPGSVYLIAGRDGPDLALVVQREGRREALLLNRRHAVDGHLRVASEIAPEADVLALPGAVLAPSGALADVALGVTAAPAALHLGDGRAYLRGRISDGRLATFDVGTGRASAIDPGDLPRARGWRVMVPEGRGVVTVYEAEPG

SEQ ID NO: 1591 - protein, 148 aa, Methylobacterium sp.
MSKLSLSLNAVRPGADDHPRPHVALRDEASAIAAAVRVFEDGLTDLRAGVRAADDAASAAAAADAATGLLAGIAGQTSLMALRAAIEAARDGGEGRGFAAAAAEVRDLAGQMVRATDTIVAQVGQIQAAAERAQDTATRGQRQAASAH

SEQ ID NO: 1592 - protein, 95 aa, Methylobacterium sp.; identical to SEQ ID NO: 539

SEQ ID NO: 1593 - protein, 90 aa, Methylobacterium sp.
MTSTALAVMMAGVLGAFCTIVFAVDWVPGSVVGLPNLPSRRVIGLWVYNGVLCLALAAWLVCTYFCTVDGYDDIPAVRDSYCRPHATVGA

SEQ ID NO: 1594 - protein, 81 aa, Methylobacterium sp.
VIPMSGGMLGSLALAAVFTLGCFGIHSARRHPDAVTIGLFLLLGLLASLYVGQHVGPDAHHPTWQHEALYRESAPTSHPTM

SEQ ID NO: 1595 - protein, 63 aa, Methylobacterium sp.; identical to SEQ ID NO: 542

SEQ ID NO: 1596 - protein, 50 aa, Methylobacterium sp.
MLARPFRLLAPALAALGLVALRLASPFIGPVSPAQPAATDDAGVVFRHYL

SEQ ID NO: 1597 - protein, 225 aa, Methylobacterium sp.
MSVNTVSGSSLQRDLVSALRQARAANVARLDVGTAATANQETGKQAAADDTAPSTGTASTPTLSNDLMASLLQLQSDFSQMGLQNGVTAPAEAAAIADDTSTTGTATGTAPGQAAGGASAVHHHRGHHGHRPASDAEQSEGAAQAGTATDASAASSAASSASTSTSTSTSTSTSTSATATADPATATGSGSDLQSFLQQVTKAVTAYAAGGPLGIAAALTSTTKA

SEQ ID NO: 1598 - protein, 73 aa, Methylobacterium sp.
VPSRFYFDIENGEETIRDAQGVEAADLAEALAEARSVIDEMAGELEVAGPAGAWTLVVRDATGAEVGRVPIKG

SEQ ID NO: 1599 - protein, 75 aa, Methylobacterium sp.
MPLSQNVPHAARQADAMAAQMALAAHALRMRGDVGTAESLLAMARHNRILALKLRIAQDLAPGQDRAERRATAGR

SEQ ID NO: 1600 - protein, 71 aa, Methylobacterium sp.; identical to SEQ ID NO: 547

SEQ ID NO: 1601 - protein, 51 aa, Methylobacterium sp.
MVAALAGLMIWQGETAPPDYASQSQAAARKVVTGSESGSISAPPAGTRSTP

SEQ ID NO: 1602 - protein, 65 aa, Methylobacterium sp.
MRGRDGPDKPPPEPAPAARRRGFFRRVLDGLEAVELLVQAGRLVWWLLRGLWLAAGAIARLFGDR

SEQ ID NO: 1603 - protein, 403 aa, Methylobacterium sp.
MQAHVAGIDNPNPMIGPARLIRAAFEGADMAALAAEILAEGGDSALDAGTALDMATILLLKHRFTEGLALQREVLDGQRVFSLRSNPDQARIRVLVLVTAGDLMANTPIDFLLNDGDFGLTYLYLRPGEPIPHDLPAHDVIVTGIAYARTAEPLLEALAAAADQWTRPIVNHPRHVLKTSRHGIADALRGADEILAPEVVRVSRSILSAAASRRAEGPTYPLLVRPLDTHAGNDLQKIDRSEDLHLYLAQTEAEAFYVTQFCDYRGPDGLYRKLRIVLIDGVPYLCHMAIRDHWMIHYLNAGMLEDPVKRQVEAAAMATFDTDFAERHRAAFAEIHRRIGLDYLIIDCAESADGRLLVFEADTGMVVHDMDSAELYPYKAPQMRRVFAAFQDALRGRARGRTA

SEQ ID NO: 1604 - protein, 251 aa, Methylobacterium sp.
VPSLEKVGAIEVAASEVRIKQYRLILLSDTPEHRDGNEAALANTHARLRDARRAYEPLITTAEERRHYDAFGASWTRFAEVDQDVRRLVEAGRQTEATALLIRPDVVALYDGARAALARLADHDEKAAQQDADAAMTRVEAASAAAVASIGLALVSALAAAIFGLLYISRPIAAMTAAMTRLARGEAGTEVPFRHRRDEIGAMAAAVQVFKDNLIRTRQLEAEAEAARQDAERQRGLAMRQVADRFADAVG

SEQ ID NO: 1605 - protein, 72 aa, Methylobacterium sp.
MAGRVTDRASEGEAGQARPETAPAPEGPGPRPGMTEAEVGPEIGAEAEAVERHKAETEIAAGDVADDLADFA

SEQ ID NO: 1606 - protein, 243 aa, Methylobacterium sp.
VVKDRISGRGGRRLTATLAVLLSLALPVTAATLHSTYVDPAAMALQRVLPPPPEAGSESAKADMQAVEAAVRARTPDDERRITANLPCTLDRFTGVLGPAFTAETMPDTAALIESVFQDGELAVLAAKAAIARPRPYTVKPDLATFGHRSDSTSYPSGHATFGYLAATVLSRLVPEKRQALFAFAGTYGENRVIAGTHFPSDLEAGKIAAAVIAEALFHDPRFERDLARAASEVAAQGGASGR

SEQ ID NO: 1607 - protein, 265 aa, Methylobacterium sp.
MILSPLNALFVGPLEGYRDRIVSAEDPRPSVRGADLLDPRVLTDQLDRFARTFAAPEPRAVASIWAKQHFSMLVVPALAANIVLDLVLPVALDAVEIVPDDGGLTRALKLRDPAAGSDGPGGHTGARAPADRFGALIDAHLAPLVGALAAVSGVAPRVLWSNAGNIFEFVVRRTEGLPQAGRTGHAAAASVLTSRRRSGAPNPLFAPIRYVPEAGDAPAGAPPRRVRKVCCLRYLIPDQSLCGACPLPARPEAGPAGTDGPRRPA

SEQ ID NO: 1608 - protein, 95 aa, Methylobacterium sp.
MRKLALISAVTLSLGALGATGAQAQGYGYGYGGHHGYGYGRGYDRGYGHRRDFGYRRHRGLSTGAAIGLGIAGAAAGAAAAGAFDRGPGYYGRGY

SEQ ID NO: 1609 - protein, 59 aa, Methylobacterium sp.
MSALVTFVGCGLVLSGFAAEKFAERRWLAASRPAPLDTLAVLALALPAVGLTLMATLAV

SEQ ID NO: 1610 - protein, 54 aa, Methylobacterium sp.
MLDVAFWWCVAVALTGSVGLVGLAIVAGRSGRSQPRGLKLTRTEPLVLRHFGRA

SEQ ID NO: 1611 - protein, 65 aa, Methylobacterium sp.
MHFEIRATDTRLWTWVLLDTTQMPVLTSDRTFPSEAQASAAALAFAKLVTRAGRTLTAAPPGGLI

SEQ ID NO: 1612 - protein, 175 aa, Methylobacterium sp.
LRAAGYVGAWTADVSAGQSLLDEGTAALLAGDATLAGRPLPIEIALRCTHPDDRDWVFARIARVRRTGGPVSAEYRVLTDGGEVRWVLDRGSLTPDPAGRMRGRGIIIDTTDSHRGPFLPSAAGDLPADDPMIIAVDHLLQARAAIVAMGHQRLQQVSDLALFEVGRALARRARA

SEQ ID NO: 1613 - protein, 160 aa, Methylobacterium sp.
VLAAALVTALAAASTARAEPANQVLGTWRMVSARLDPEGRNAPAYGARPSGLLVFTRDMHFVEVLTDADIPRFASSARGQGTAEENRAAMAGSIGFFGTYTVDADGAFSGNRVEGSTFPNWVGDVRTTEQLRLTVEGDRLSESFRRPDGTRIAITWERVR

SEQ ID NO: 1614 - protein, 100 aa, Methylobacterium sp.; identical to SEQ ID NO: 561

SEQ ID NO: 1615 - protein, 544 aa, Methylobacterium sp.
MRRDEGDGRTVSDGIQHERSPMRRREVLAALAAAAVARPAVAQPAKVLRFIPESDVAVIDPIWTTATVTRNHGYLVFDTLYGQTAGYEFQPQMVEGHAVEADGRLWRLTLREGLRFHDGAPVLARDAVASVRRFAARDAFGRALIDATDELAATSDRVVQFRLKRPFPLLPAALGKTGTSMPCIMPERLAKTDPNTQVTEMVGSGPFRFKADERVPGALTVYERFDGYVPRPDGAASFTAGPKRAHFERIEWRIVPDASTAASALAAGEVDWWQNPTPDLQALLRSRSGIRLEVLDPAGGIGCLRFNHLHPPFDNPAILRALLGAIDQTEFMSAVAGDERALWKDHVGVFSPEAPMATRAGTDGLVGPRDYAAVRRALAEAGYRGERVVMLDPTDYPATHPLALVAAEAFQKCGLAVDLVAMDWGTLVQRRASRQPPDKGGWSTFVTYLNGTNNFDPAGQLGIRGNGDQAWFGWPRAPRLEELRAAWFTAPDSAAQKAICAEIQRQFFIDVPYLPLGAYYEATAYRGLTGVRNGFPQFYDVRPA

SEQ ID NO: 1616 - protein, 393 aa, Methylobacterium sp.
MRTAPAFSSRHLDRLGDRLTADVDSGAIAGADMLVGGADGAIWRRTVGYRDRVAHAPLGPDALWRIYSMTKVVVSAATMVLAERGALRLDQPVAAFIPAFEHLSVLDPDGGLRPARARPTVQDLLRHTAGIAYGYLGDGPARRAYAADGLLAEDLDNAAFADRIARLPLEHEPGTVWHYSHATDVLGRVLEISGGADLQRVLDATVLEPLGMADTLFQISAAMGSRVAQPLPQAPGQRPVFHDPAQPRRGQRGNGGLVSSTADCARFLRMLLAGGSLDGARVLAPASVRLMTSDHLGAAIAKAAYYPPGPGYGFGLGVAVRLAAGEAPFPGNIGDWFWSGVGGTYFWVDPVEGFFALLMMQTSSADQRQHYRTLTRTMVYAALEDRRLSETSP

SEQ ID NO: 1617 - protein, 84 aa, Methylobacterium sp.
MPQNVEYWITDRPDGHFDVVVKLESGKIFRRSGCISRAEADTWIEGLRMLMAAIGAPVSAADVTSDDPSPLGSQTVDGADHSTS

SEQ ID NO: 1618 - protein, 129 aa, Methylobacterium sp.
MPRPLDWNAFADAWCAAWNAHDVERVLAHFHDDAVFTSPGAARIVPASGGTVRGKDALRAYWTEALRRIPDLHFAVEQVFAGIDTLVIQYRNQKGVSVSEVLVFEDGRVRAGHGTYPIGVDNPVGAAAG

SEQ ID NO: 1619 - protein, 191 aa, Methylobacterium sp.
MRELVYGPRRFSEIRANLPGISANVLTQRLESLGAAGIALRYRLPSPANVQVYDLTDWGREAAPLMRDLGRWAARSPRHDPSLFMSGASAMMSLEALVDRGRAAALSATVAFHFPGEDFVATVTGDGIRVRRGVAEAPDLAFTGDTMAMRRTVYGKAPLDRDGAGGTLAVAGPADLARSFIDLFTLPAKAG

SEQ ID NO: 1620 - protein, 60 aa, Methylobacterium sp.
MYDLIHTLRLWLWRRQVRAMARECRMSGTSDGDWIAATVAASATSSGPGAPVSYVSGTGL

SEQ ID NO: 1621 - protein, 91 aa, Methylobacterium sp.; identical to SEQ ID NO: 568

SEQ ID NO: 1622 - protein, 82 aa, Methylobacterium sp.
MRILTRTTLLAVLLAGATGTVHAAEGRGKAGQDAGARTTSMGAGGLSGTGATRDGARTGPVESKGQPGGAKPPSAPKAGTGR

SEQ ID NO: 1623 - protein, 367 aa, Methylobacterium sp.
MTRLRLIADDLTGTLDTAAGFTGLCGSIPVAWPEILAGDGFGCLAIDSGTREGSAAEADRIVGALASRLDGADIAFKKVDSLLRGPWAAELAAVLRAGAWKRCVVAPAFPYQGRRTEGGRQLARRGAGFEPVSGDIAEALRAVGLPARRADVSDGPVAGVAVYDAASDADLARVADLGGDGPVLWCGSGGLAAALARGVAAPGDDRLAGPVLGLFGSDRPETAAQLAACGPHHLVLSARHPDHAGAVAARLDRDGVVLASLALPEGTAREEAAARIAGTFAGVIDRVPRPGTLLVAGGETLKALCLALSVARLDVTGQITPGLPRSTLRGGRWDGLAVVSKSGAFGTEGVWRDLLHGNGFPRSRSDA

SEQ ID NO: 1624 - protein, 125 aa, Methylobacterium sp.
MPAYHLRRTLEHADGRCGLAFASDRLEADDAEAAIRRARDLCRTAANMLLTGAVLTDSLRPDPVVVHPGAGPGAALRPADELRAPTEPARIGAPRNARGPRAVVPHGRGPERPRARPSELPGELP

SEQ ID NO: 1625 - protein, 64 aa, Methylobacterium sp.
VFAGRGQWRGPDGRIVREAARIVLIVTEPTPEAVATLREIREAYRRRFVQGAVGLVLQRSCALF

SEQ ID NO: 1626 - protein, 362 aa, Methylobacterium sp.
MNAAETRQLSLWEQSLRRPEAGADRPTTRLGPALDGRMDVSFLHKGFCIAGLPLRRPKNTMEPWNRRDGRFSLTVEPARFVLPNGRQIEVGVPFGPKARLLSMWLATEARDPRRSAGDRWMEMGRITEWLKAVGLPVTGGERGSIGPTKDQLVRLSFPIFTMVLNGDEGGHVFKRESLIEGGAFKDDDLEVWAAGGHSAMRWPEALMLSQNAYDRFTRHSIPVPTARLRQVAHNAMAIDILVYLCYRLPLLSRGESELLTWRDLMAQFGSSEFASRFKQAFSESIKRTLDAYPEANVAMTAEGLVLRHSDPAELRRAFVAVAGGPTRRARAAPRARKAARVPDQMGPCESADLLTPAGAARA

SEQ ID NO: 1627 - protein, 62 aa, Methylobacterium sp.
MTRILTSVLDGAVWVADALDDILVEAALGFGAAVPLIADPSGDPPTGATTGQSETSPSPIRT

SEQ ID NO: 1628 - protein, 117 aa, Methylobacterium sp.
MFDGVWRSQAGAELRLLQMGEAVSGTYTAADPGFAQTHRSRILVGTAEGDIIGFVTSTSSPQEITAWTGRLVRTDEKTAEAIHAVFHAVERSSQPKAVADHVALETTIFSKVENACS

SEQ ID NO: 1629 - protein, 114 aa, Methylobacterium sp.
MKMISTKMLMVAGLAAATLAGGAASADARGFGRGGFGHGGFGHHGGFGHRGFGHGGFRHGGFGHHRHFYHRGFRRRFGGFSWGYPANSSFLGPNFGDCRAIYNPVFFGHERVCG

SEQ ID NO: 1630 - protein, 86 aa, Methylobacterium sp.
MADLIDFPGKRRGSGSAYRLHRFGADGSDRGTVLIRARDDAEARHQADRLAEGLLAELWSGDRLLDHFAPAGHPVAACIGPLRDGP

SEQ ID NO: 1631 - protein, 395 aa, Methylobacterium sp.
VPRRSAGRRRAGAAGVLSLCLCLSLCCAAAAPLAPGPVQAETREAAPALRTGEPETWRVATHPVPPLVMDEDGRLRGFSIDLWNAIARDLGVRTAYLRVDDLPALFAAVSDGRADLAIAAVSITAERERRFDFSVTMLETGLRIAVRSESDATGSATARALQALLSDAAFLQVLLGLAALILAVAALVWWLERRHPGGMAARSGPARGFAHVVWWALSSLAAQAEEMPRSPLARAVTVLWLFTCIALVAWFTAGLTSTATVERLRGAINGPQDLPGKRVGTVADTTSVAYLADHFATPVGFATLEEACAALQAGTVAAVVYDAPALSYYATRPGHDALRLVGTAFNRQSYGILFPANDPRRKRVNQALLGLREDGRYDEIYGRWFGSESGESQGR

SEQ ID NO: 1632 - protein, 80 aa, Methylobacterium sp.
MRAKILVLSLGLICAGAGPVWAARPILDRLPSAVAQATPGTGSAPILSAGIAGAPALTVLARRKPARRPRGARLGSFRPL

SEQ ID NO: 1633 - protein, 58 aa, Methylobacterium sp.
MRPSSRAFLGCLVLALLIGGLGLGLRRAVAVTPVDPAFRAVLRAYAVPDASGGPQQHE

SEQ ID NO: 1634 - protein, 345 aa, Methylobacterium sp.
MAKFESRALGGTRAAVTSLGFGTVPLAGFKAKVSFADAQAIVQAAYDGGIRYFDCAPLYGFGKAEYNLGHALRELGIRDAVTVSTKVGRVLKAKSRTKALDTVYGIDWVEPLPFLDTYDYTYDGFMRSFEDSQKRLALDHIDILYVHDLGSAWHGDQADVYWKQIRDGGYRALDELRRSGAVKAVGLGVNETEAVVTVAREFDIDCAMIAGRYSLLNHAPLEGAFDELHRRGVSVVAAGVFNSGVLASGVGKGGASYDYGDVPEDIAKKVAAIEDVCAAHGVTLSAAAIQFVAAHLAVATVVLGAKDVEQTRQNIESFSQVIPAGFWADLKEKGLLPGTAPVPHA

SEQ ID NO: 1635 - protein, 49 aa, Methylobacterium sp.
VPEYDIKIVAPRDRKAPDAERETPPKRKLDWDRAMREAAEAELSIQSHD

SEQ ID NO: 1636 - protein, 97 aa, Methylobacterium sp.
LNEPEQGSAEAVYISAMVGEMMRRVLEDALAELARTRGAAFLEIFVARELARCADLFRERPGDTPETTDMLRAWFVMEGGEALRAVVDRASVEAARD

SEQ ID NO: 1637 - protein, 73 aa, Methylobacterium sp.
LHEFDEQLAREFVRGLVQSAVARGLDPAIRLDQFRALQQAVVALSRDAAVVRTSEQIIRAIDCALQELTAVRS

SEQ ID NO: 1638 - protein, 75 aa, Methylobacterium sp.
MLDGDAFAHEIAALLIADIKTSGARTRGEIEEACRISLDSLLGGTAVPPQIAVLMPIGLERWPRVVVKGRPLPDV

SEQ ID NO: 1639 - protein, 32 aa, Methylobacterium sp.
MLRKLLTAFIVPKLIAYLGRRYDRRRGTGRTY

SEQ ID NO: 1640 - protein, 232 aa, Methylobacterium sp.
LPAPAPPSRFDAVLLDLDGTLVDSLADLRTALNATLAREGLPPVGTAAMRAMVGDGAVALLRRALRASGGDPERAPDLLPAFLAVYEPLAAAGTALFPNAAAAVRDLRAAGYALAIVTNKPARATGLILDAVGLAPLIDTVVGGDTLPERKPDPAPLREALRRLRVEPGRAVMVGDMHHDIAAARAAGTAAILARYGYGRPDDARTADAVLDDIGGLRAMIGALPAGGTPAS

SEQ ID NO: 1641 - protein, 523 aa, Methylobacterium sp.
MRRRTFLAAGAAALAAPSVGRAQGARVLRMVPQANVTSIDPIWTTAIVTRNHAYVVYDTLFGLDADLRPQPQMAAGLKVEQDGRRVTIPLRAGLRFHDGTPVLARDCVASIRRWAARNGFGQTLMAATDELAHDGDTDIVFRLKAPFPLLPQALASVSQPAFVMPERVAQTDPYKQITDATGSGPFRWKADEFNSGSLMVYERHPGYVPAPGTPSLTAGGKVAHFDRIEWRIIADGATAAAALQNGEIDWYEQPPPELQQLLARNRDIVVEGLDRLTNPAILRMNHLQPPFDDVAVRRAVLPAIVQSDFMAAIVGDDPGAYDDRCGIFTPGTPMASQVGLEALTGPRSLEAARAALRDSGYDGAKIRLIGPTDLLAPAALTQVAADLLPRIGFNVDLALSDWGTVIQRRVSREPVEKGGWSVLLTTFSSFDNADPAALQPLRASGPNAWFGWPSVPRLEALRTAWFAAPDAEARRAICADMQRIALEEVVFVPVGSYRSMTSYRRDLTGRLPGFPILWNLRRA

SEQ ID NO: 1642 - protein, 1051 aa, Methylobacterium sp.
MTGAAMTGAAMTGAPASLAAPTRALTPEQRACLDAAGAAPSLVAEIDLPGPVEADRLRRGLAAVAARHDVLRTAFVREPGFRGLRQAEAGAPAIPLDTGAPQGDVGTVGLAPERGQTLAAVLLPGATPRLRLVASALAVDAGSLDRVLSEVAAACADDAAPGADPEAATYAQYAEWREAVAADDADGEGQAYWRDQIGAGAAPLRLPYRRGAAADAVEEPAAAIRLSRAVDAAVTDAFARALARPDLAAAGAEAVLQAAWWLLVARLAERTEILGGWAHDCRRDYAVFAGTVGVFTKTLPLRLVLPPETSVSEAAAGLAARLDEHRAFQELCPLDAAGGDRRPAVGFALAAQGAAQDRLLPGPAGFELCLEPALDAEGHLAALTLHADPRRYAVEALETLLDQVETLLARLPAKAATPFATYPLVGAREEVRLRAFGRPAARALPAETLPVLVARHAATAPDAPALAGAGRTLSYAALEDRVARLGAWFAARGVGPERVVALDLPRSVDLVVAILAVWRAGGAYLPLDPAWPQARRDRLIALARPALTVALAADPAAGRHALGAILDGLGEARHPAEARDPSDMACLLFTSGSSGTPKGVVIEHAQIRAYAEAVIDALDLSGYGRFALTSTVAADLGNTMLFAALRLGACLVVADEAEMADGPAFARFLRGNAVACAKLVPSHLAALLDGVEDPALPALLVLGGEPTPAALVRRIRAAAPTTRIANHYGPTEACVGVLVHPDAATAPPDESLPLSRVLAGSEAYILDAAGALAPTGAVGVLHLGGAQICRGYLPGTEAGGAGAFSPNPFGAGRLYRTGDRARLLPGGRLVLAGRADDQIKLRGHRVEPGEVEAALAGLAGVSQAAVRPFTGPDGATGLAAYVVADPERTPAALLAALAETLPAAWLPAPILRLDSLPRLANGKIDRAALPRPDVHPDADTGVPPRTALETVLTDAMAELLGLPAERLGAAGDFFAAGGNSLLVIKLTARIRKLLKVEIPPSLVFDHSTPATLAAALGTYAPPDAIEETASLRLELAGLSETERAGLAGVGA

SEQ ID NO: 1643 - protein, 430 aa, Methylobacterium sp.
MDSRIVVIGGGFAGLWAAAAAARARTEFGLGDRVAVTVIAPDPFHVIRVRCYEADLGALRVPLDDVLGPIGVERREARAIDIDPAARTVTVESAAASAVSSAVSSAASSGVVETLAYDRLILAAGSLLWRPEIPGIAGAFDVDTFAGAQALAAHLDRLGDAGGPDEAGRWTAVVIGGGLVGLELACELPARLAAARDRAGATGPVRTILIDHAREVGSAMGAAALPGIREALRDAGVTCIGGARVGAVDRTGVTLADGTRLPAWTSVCATGMRASPLGGTLGLPLDPLGRLPVDAFLAVQGLAGVYAAGDIASAAADDAGHRTVMSCQHARPMGRFAGFNAVCDLAGRPERRLRFAAPDYVTVLDLGAWGAVYTAGWDRGTLVSSGAAAKATKQIINGTRIYPPLDRDAASILAAAAPIIQAAPATQAAR

SEQ ID NO: 1644 - protein, 374 aa, Methylobacterium sp.
MPRSVSRASPRPAAGLLILACGVGLAGPACAEPAPAPATAAASSSTTSGAGAADGTPVAAAARARRQEAGVAVAAATVMAAPPPSFFNFSDTVVSYRFQGPSAEPGLRVQRPDGQFVGREVPKTVINLFHANAWAYGTNLLSLDILRSGSQDPAGNQVRRFEGVGATEFYLIYRGVLSLNKVFDTQALAIPGFVKDVGLSFGADVNTKDTTFDSEKRAGTFGLSFAFDVPAGFVNLKVQGYKEFSRNGFAGYGPVPGFDYAHFRSVEFKMTPEFEITYTIPLPFTGLPLSLAGFNTIVLPKGRYGRFNENDTQLEFVSQTNLVLDVGQLVAGTPNRVEVFAGFQYWHNKFGGDPRRTLNTEEKALIAGVAYHLK

SEQ ID NO: 1645 - protein, 246 aa, Methylobacterium sp.
MGNRREFLTATAAGLAAAAAAPARAAEERTAAPKSTPAGAPPFGMPRDMVLLNMRRGDGYALGVKTKDGVLDVEAAGRALGMPVPADMDDLLQNGRGPALRALIDAVEAAPDGRFVLAEADVAYAPVVTRPEKIIMMGFNYRHHAEETGTPIPKDPPLFNKYNNALNHHGGTIALPTQAAREFDYETELVMVFGRECRNVSEADALDYLAGYCTGNDFSARDLQTLTSQFMIARPRTGSRRSAPTW

SEQ ID NO: 1646 - protein, 340 aa, Methylobacterium sp.
MRSILAAALLPAIAVPAGAQSLSASLEPITPVANPGQLSLGGSSTTGQFPTVSAQTGGLVNAGQLSFGGGGGGGGGRIGASGGLSAGTTLGATTAGSGATGQLGGLGSTATGGAGVTGTTLGTGGTIGATGARSGLSGASRTGLGSTAGSLLTPTLGTGGLGGGSGLSPGLGTGLSGAGLGAGVGAGVGAGVGAGVGVGVGTGLNAAGSLGSSLATGSSGVASAGLGSGVAASGIGATGATLSPGGLFGLFGLFGLGTGTAASGATAATVSGTGGAGTGGAGIPGTPGLPADDPAQAARTLPTGGGAIGGAGIGGAAAAPVRTGDLCGGPFAEACLGQGF

SEQ ID NO: 1647 - protein, 73 aa, Methylobacterium sp.
MAQCMAQSSGHEVPTQIRDVAGTGLAQARTAFGSVVGAARRAPDTVRTKVVRGQDAAREAAAAARDAAGAASH

SEQ ID NO: 1648 - protein, 59 aa, Methylobacterium sp.
MTRETADPTSRGPDAREADEPPAERVKAAPATIPTEDPEVGLAQKGSGEEAIVRRETEI

SEQ ID NO: 1649 - protein, 84 aa, Methylobacterium sp.; identical to SEQ ID NO: 602

SEQ ID NO: 1650 - protein, 47 aa, Methylobacterium sp.
MDWFDLPEDPQPPSAADASRMRLYIAAGLIGIGALGMVGGMLHILPA

SEQ ID NO: 1651 - protein, 86 aa, Methylobacterium sp.
MATPETQAPYRLQCMIHRESAGGIIIHDEQIPGPLVEAAVAAAKARFAELRAGRAGSAALRDSAGRVVWSARQDAATPGTGGSAGR

SEQ ID NO: 1652 - protein, 31 aa, Methylobacterium sp.; identical to SEQ ID NO: 605

SEQ ID NO: 1653 - protein, 30 aa, Methylobacterium sp.; identical to SEQ ID NO: 606

SEQ ID NO: 1654 - protein, 541 aa, Methylobacterium sp.
MTSLTFVIVYVLLLQVGAIDAASRTLAQEIGAARALGTMKQRTQELGASERLARAVSTEADPREDIDRTIEPHEAFLKAWTAYVSTIRTADERERARGLWDAWQHFLAVEAEAAALDRAGERDLADRVRATALQADAAAVARDVDALLTDRDAAVAEQLGAVDAAGSTLRPSLVAGLSAAALAALVLVQAILRGVAQPMTALACAMQRLADHDLTVAVPAAAVCTELGVMAAATRAVQETLRQAVLRDAEADRSRAQSEQRRAVIEYATERVETMIGGMVEAVSSTAAALRVTADDVGQAIRDGAVRTTTLGAALAQTRSKVRQITVSADTFGAAVEEVGAQAEATAALAGSAAADAARTTTRVQALSSAVDRIGDAVRLIAKIAAQTNLLALNATIEAARAGDAGRGFAVVASEVKALAAQTREATEIIGQHVSEIRGSTDAAVSAIAGITARVEDMSRAANVIVESVERPGATAREIVTAIAEATDGTEEFDAEGAGVTEIPEAAEPTTAVLTAADGLTQDAARLGEALAGLLESLRAA

SEQ ID NO: 1655 - protein, 274 aa, Methylobacterium sp.
MLSYLGDTIVGLTLAVLNALAPLEVHVDKGVPYADGSAHRADIYRPAAGKPRPVAVFLYGGGWRTGSKDEVAYVGAAFARRGVVAVIPEYRHVPAASLQDILADNAAAVAWTLAHAAEYGGDPARVTVVGHSSGAWAAAMLGLDATWLQRAGSSPAKLAGIVGLAGPYATSALTDPLDRQVFAGSDPALQPINHAADPHPAMLLATGAADLDVNPAGTLSLDRALRGFDGRETIKIYPGLGHGQIVHAMSFPFSLRYSVADDVARFVKGARAGP

SEQ ID NO: 1656 - protein, 135 aa, Methylobacterium sp.; identical to SEQ ID NO: 610

SEQ ID NO: 1657 - protein, 37 aa, Methylobacterium sp.; identical to SEQ ID NO: 611

SEQ ID NO: 1658 - protein, 90 aa, Methylobacterium sp.; identical to SEQ ID NO: 612

SEQ ID NO: 1659 - protein, 323 aa, Methylobacterium sp.
MPADILDELGPLFLGSRLKRLADRFQADAARILRDEGLGIQPAQFPLLAAIDRYGPLTIGDAAAALGVSQPAATRTAASLVALGLLEEARSDADLRQKALSLSGAGKALMARAKDALWPRVDRAVASLCAGLSGPLLDQVAALERRLDAVPFAARIRQDGAAGDAATGLTIRDYTDALADRFRDINAEWIEAMFALEENDRRILSDPRGEILDRGGLILFVESADLGIVGTCALMRTEAGCYELTKMAVSARARGRKAGEHLLRAVLARAAAMEIETLYLLTNTKCAAAVHLYEKVGFRHDPEIMDRFGRRYARCNVAMRYPL

SEQ ID NO: 1660 - protein, 414 aa, Methylobacterium sp.
MDMQVEKAQGRPLKGIDRNKVIAQSLRQFARLPGLPDTKKGVRSYQSHVKSDPWLPLLFVVCFVLPTLAAGIYYGLIASDRYVTEARFAIRPTIGTADKATPDTVGTNAGVIKATVAQETLIAQEYIHSRPMVEAVAAELPIRAWFGRDDIDMFSRFNPEKPVEKFLRYWRRRVDVDVESASGIMSLTVEAFDPDESLAITKAVMTDTERMLNDLSLPSRKDALDVSTRVLKLAEEREAKANAALNELRNREGVLDVIKSNTATIKSVSELRETRTKLAVQLAVLQRDLGPQSRSIVDLKQQIGDLDANIARVQQQLAGTAPTEKRRLSDALTRFEDLEHERENAEKYHRDVQLAYDRARIVAQQQVVALVPIVEPIKAGSSTEPRRILMTSIITAGAAVLFAAAMFTRRMLIT

SEQ ID NO: 1661 - protein, 79 aa, Methylobacterium sp.
MYKLPPGSLYRLRTLAQTGARFYQVSGYMRRMEVLGLVLATGRTDPDTKTVEYRITEAGRAELEERHGPAWPGSAEDEA

SEQ ID NO: 1662 - protein, 125 aa, Methylobacterium sp.
MDSGEALSDRRVGPALRAVVALLALYALLLQAFLGGLMPVPAATDGLCAQHADASAPSGAPVPHDHGDCCTAAQATGPALPPRPPSVGFRWVATADLRPAWPLNRSVGARAPPGTIASPRGPPTA

SEQ ID NO: 1663 - protein, 516 aa, Methylobacterium sp.
MLLRATATAIRAHLDDRASRLIAAAGTCLLLCLALLGVYLCLDLRDVAWHNARRNAGNLLAVIEEGVGHSLRVYDLSLRNSARLASRADIAALDPDIRRLALFDTAVAGSGLGPIAVTDAAGDVRLTSDPGVRTRPNMRTLPEFEFHRSNPEGGLILSGPTVSLMTGEPIIRMTRRIWTPDGSFAGIVSGSIRLAHFQALFERLHFDDGIALNVFHRDGTLLIRAPARPEALGQNISASPGYKMYRAKARGEFQGRSFLDGVERVYSFADLDDLPLIVTVATDVDSIRSGWIYKAAIVAVLILCLCLLAFGLTILLHREVGRHVAAEASSREANAALAVLARTDGLTGLPNRRSYDEHFAVEWKRAAQLRTPLALLIVDADHFKQFNDRFGHQRGDEALKAVAECLQRTLDTAGLSFRIGGEEFVALLPSVDATAASVAAERVRRAVVNLRIPHAPEVGGIATVSIGVACADPAGGDPPEGLFTAADAALYAAKKAGRNRVRAAAPADPVALALRA

SEQ ID NO: 1664 - protein, 96 aa, Methylobacterium sp.
VLDTPLAAEPVRETAAIRPVVDAFESRAILEGPVHAAAFFGAAAGPHRLDGMDEWRLDAAGRIAEMTVPWRPLPEAIAVRDRLARAAETPTSAATG

SEQ ID NO: 1665 - protein, 120 aa, Methylobacterium sp.; identical to SEQ ID NO: 619

SEQ ID NO: 1666 - protein, 72 aa, Methylobacterium sp.
MEIKRDLMDMAHADTIVKSLKSRGLTRDEFEDVVSGLAADGLLSLERSQVLTLNFERTDPQSPSLVDNRDAR

SEQ ID NO: 1667 - protein, 73 aa, Methylobacterium sp.
MPTLPDAYLRDILAQAEQDLAAAELRRAQQARIVAGPLNSPETRAAAELLLREIDRTITSIWANRHLIEVILA

SEQ ID NO: 1668 - protein, 72 aa, Methylobacterium sp.
MGSSDPETRRRQLDRLRAAYEARAGRPDLTAIGSGARHSRVLLGRILVVLGGLPDGAGLPAIGPGGNGRAQT

SEQ ID NO: 1669 - protein, 136 aa, Methylobacterium sp.
MRNAFIYATILSTLPLPAAAAETCRDHYRSEGTPMLQAITYKTWMIFPSVSPRAAFDRVTRAVLAEGFVGVHVEKALGTLTAQQETSGSGRPQTLRVVVRKAGAGSRVDALFMVQAGQIGQDVDQNLCRIVDAAAQ

SEQ ID NO: 1670 - protein, 165 aa, Methylobacterium sp.
MPLVVILAALCGGLPVLAFGWQTFGFYTIILASCVASAAAVLVGGGLALLKVARSRTSQDPAKIFDIDRLTSGDRSDFRLVPRRLYFDIEHGREIIKDEIGIEATSIDQALDDARSVIRDMVQELADEGYAEDWVLVVRDARGASVARLPIERTPAQTRPDRRSA

SEQ ID NO: 1671 - protein, 46 aa, Methylobacterium sp.
MDQIAPARTGRTRRRPHPALVVASVALAIGLWFVIYAVAGRAIWFW

SEQ ID NO: 1672 - protein, 622 aa, Methylobacterium sp.
VTRSQAARQTARHAARVVALTAAILLPAQAGSRAADRGPTDGPGDGPADGPSDRPDGTPHFLEQSWTPQERAWFYRASQGSQIMPYAWFMSLERPDDDTLFVADGLARFGYLPNPYDGTRGSDRSGLPIGFVKDVDDRGEWIGLTCAACHVNRVDLRGRSILIDGGPADADMFAFIEELGRALARTRDDPARFERFARRVIPTELSAPGTGPSEPDRRRLRASLTRLAEDFSRYVASSRTAVPWGPARLDAFGMIFNRATGIDLRDPHNIAPPDAPVSYPFLWDTSWHDRVQWNGSAANGLAVERLGRNVGEVLGVFARTDIREPTLPPLWFETSADRVNLLRIENQLGALTAPAWPDRIAPRTEAQARDAAAGKVHYDRYCLSCHAIAPTGANRTLTVTLTPLAEIGTDPKMATNAVSRRARTGILEGIRMPFLATTPPLAAETSSLELVATLVAGAILAPLDRGPDPAGVGADQTVILDRLLKRGTAALEARNAMLDDVSTAGGKGLVAAFVGARRDRDLMVYKARPLNGIWATGPYLHNGSVPNLYELLLPSSRRSRTFRVGSRELDEDRIGFRSDLGPFLFDTALPGNANTGHEGPTYGTEQLDDAQRRQLLEYLRTL

SEQ ID NO: 1673 - protein, 312 aa, Methylobacterium sp.
MRLPVTGDGRFWALAFLGLGLPACLALAWIGLTGESPSALAVCGRLAGIAAFLGLGLAALALATRGRAALFALLCFPASLAAATGPDAPVLALAALAAALLSPRPMTGRHGSARRAGAALAIALVVLARPACAPLVGMLLVPFPPPGRRVRAWRERLPLAALALLPALLSALLPALLPAASPGLPPPGAAGSGLVSLPVPLPGFLTGVWAAALLVPPVALRRGPLPPRAERLWLSGCALLGLWLAVLPQALAPAGGLGGMQARDLLPLAPMLILAFARGRIGTAAALRWPALLPVLAAALDAVVLPMIALRA

SEQ ID NO: 1674 - protein, 72 aa, Methylobacterium sp.
MTVRLFAAAALAATLAAALATPASAQGSAARHGLSDVTAVMLPEISVTYHRPVPADRSAGPHVAGPAGRQPR

SEQ ID NO: 1675 - protein, 68 aa, Methylobacterium sp.; identical to SEQ ID NO: 631

SEQ ID NO: 1676 - protein, 233 aa, Methylobacterium sp.
VLQPSETSLGLASIGQTLSLREQAYDSIKQSILAMDLYAGSAQIRLHEHQIAQDLGISRTPVREALTLLEREGFVSTVPRRGLFVTRKNKREIVEMITVWAALEGMAAHAAARNAEDADLRALGRAFEAFDIATLPDHLKAYDEANLDFHRTIIRLGGCGLMVEMTTNLFIHMRAIRSAFLHRAGRLEDSMREHAAIIAALQARDADRAAILVRDHALGLIAHVEAHWVWPEG

SEQ ID NO: 1677 - protein, 95 aa, Methylobacterium sp.
MIVLIAAAIVSGLATATILAPVSALAALIIAPLAASASAILACIFIAWRNTRDDVGPPDLETQADAMVAVLCEVAQQGKIVPVAAPVRVRGHRSA

SEQ ID NO: 1678 - protein, 37 aa, Methylobacterium sp.; identical to SEQ ID NO: 635

SEQ ID NO: 1679 - protein, 93 aa, Methylobacterium sp.
MKTLISLTVAGLLATGAAATAAENTGTRMQGSPNAAGYTGQGATGKGETTGTTTGSPGSEMPKQDGRMKGPPNAAGFQPGGSDGGSAGTSGRR

SEQ ID NO: 1680 - protein, 213 aa, Methylobacterium sp.
MTAHRFDAVLFDLLTALLDSWSLWDSVAGSTEAGRRWRAEYLRITYRTGAYQPYEDLVAEAAAAVGLPRRLAADLEDRYGELRPWPGVTETLQALAARSVRLGVVTNCSERLGRIAAGCLGVELDAVVTAERAGFYKPDPRPYRLGLQALGVEPARCLFVAGSAFDLVGTAQVGLATYWHDRVGMAAPDGASPPLAHETTLDPLRAWFDPGAR

SEQ ID NO: 1681 - protein, 90 aa, Methylobacterium sp.
MIPTVQADALLGRLAEALGSPVEIFFAECAPATGRTSGDASPDCDALPTLELLRLWESLREPVRRERVLAAARQEARTLRASRAEDAAAG

SEQ ID NO: 1682 - protein, 46 aa, Methylobacterium sp.
MATPIRTVAQGSGAAAAEPDQTIRPLSLSEFIGQRAARANMQVFIE

SEQ ID NO: 1683 - protein, 88 aa, Methylobacterium sp.
MRRDSDGTGRISALTRMRRRLGRLRDPLATPAALHRRWAGAATGADLEARLIAALAPHFDTAFYASWYGITADPVRDYLVHGWRAGRD

SEQ ID NO: 1684 - protein, 42 aa, Methylobacterium sp.; identical to SEQ ID NO: 641

SEQ ID NO: 1685 - protein, 246 aa, Methylobacterium sp.
MSPARSLPAGHLRTSLAALFALAPVLSLGPGASRADEAPAAPVFNKAEAAEIAAPLRQDPALLRSFGTCPADTFARERPLWRWAFAPRRPTERRCAREPASCYALCTRWSNAPACFDLALALEHHSLDVADILDKERLYALACAGGFPAGCTNRAAGIRNGGYAEDPFRDAPRADTDACLARSFRLDCDRRGAWGCAMLGQAYRLGEGVAAEASRARAAFDMACAINPDFAACTFAKRQLAEMGAP

SEQ ID NO: 1686 - protein, 132 aa, Methylobacterium sp.
VSAGDAGPDSDALRALYGRVDPEPEGPPAPGHARASLCVDVGDWDDVAAAERWMLAHAGRLTRVRSTGCGCCVIGWDIEGPAALIATLPAALGATSDWAGPAAAPWRAASARGRRLWEHGWERWWERWVRRR

SEQ ID NO: 1687 - protein, 63 aa, Methylobacterium sp.
MSRGIETDALPETPEAEEPRIPSAPAHPVTGEPAAFDPTDLNPPAPPTPRPASQTDSGFGSFG

SEQ ID NO: 1688 - protein, 189 aa, Methylobacterium sp.; identical to SEQ ID NO: 645

SEQ ID NO: 1689 - protein, 295 aa, Methylobacterium sp.
ARLVAGHFDHGFYRARYGLSEAEDAVRDYCDTGWRNGRNPRPDFNGWAYRAHHPSAEATGIAPFVHHLARALLRGDDLAGEAFDPRYGAPPAEEDAELFEQGRLIEPFFDAPWYVKRYPDTRGFENGPVIHFLSHGQEEDRDPNKTFSTRFYRRAYGHLLGPGESPFLHYVRTGRAAGLMGCPEDLGTYPPMEAPAADAWDRLPRALPIDQARVVVIVPVYKGRGETLRAIHACLSAPQATPFTLLAVNDRSPDPELTAELAALAARGLFHLVENERNLGFVRSVNRALGLRQGR

SEQ ID NO: 1690 - protein, 66 aa, Methylobacterium sp.
MPRTVDRPHPARRRAVRLPRPRAGAAATGLFLAGLILSAATVPLVEPADATTGGGTAQAALATPAR

SEQ ID NO: 1691 - protein, 65 aa, Methylobacterium sp.
MSALEADREATVERLMERLSGFVQGIGMSGADAREIIARVIDSEPLAGDGDLMAKARTWMLIALG

SEQ ID NO: 1692 - protein, 119 aa, Methylobacterium sp.
MTERLPVPSRLAAAFDGRTTLTLQETASALEMDQKTLRREVDRGRIKYVLRGTGEKRKLRRFLLSDLLDYLHDERRSECPSISVPTRRPTGANFGSKVTDIASLRARLSSVPRSSPKSS

SEQ ID NO: 1693 - protein, 59 aa, Methylobacterium sp.
MSKLKTEDREDLSNSKFALPEDRKYPVDDKTHARNAKARAAQQEKAGNLSAADRKKVNA

SEQ ID NO: 1694 - protein, 114 aa, Methylobacterium sp.
MRRILRALPLIAVTGLAATAAVAAPIPPCAADAERQALKLLRFHSDGDARATVDPASVRSVGTVASLVGTRRFQVIEVEGSIYKGAYRIRLIYAPMPGSCVLMGQEILERSDPY

SEQ ID NO: 1695 - protein, 434 aa, Methylobacterium sp.
MRPHEPVHLTIGNRALDLGTLLGLWRAGAVAVPVHRAAAPLTRAAVERATRARFRADGLSLEKIAEDAPPVRPLLDGAALVVFTSGSTGVPKGVVLGHDALARKLAILDRLLGFRPDDVVAVPLQLTFIFGIWASLLAIRSEARLVLVPKFTPATLEGLLAAEGTVLAAVPTMLRALLADGVPPAPRLRAVLTGGEALSPSLTQAVRGGWPKAELVDLYGSTETGSCDFCHRPRDVSEAGSIGMPTEGVSFRIVRDDGALAALGETGELRIRTACGMLGYLDGAELTRSALEADHFRTGDLARLRQDGHVELVGRSKEIIARGGNKIAPLEIENALCAHPDIAAALCAGVPDPRLGEAIHAVVVLKPDRALSADELRRWASAHLERYKVPDVIVFSDTLPSGATGKASRAMVSTLTLIHAETTSADLQGAPVSS

SEQ ID NO: 1696 - protein, 273 aa, Methylobacterium sp.
VAFKTITYETLAPVARITLNRPERTNAISATMLDELAQAMDAAEADDAVRAVIVRGAGTAFSSGFDLKDQMALRPEGVSQWRPILRKDFDVPMRFWHCPKPTIAAVRGPCLAGACELALACDVTVAAEDAFFGEPELKFGAGIVVMILPWIVGPKIAKEIILTGEDRIPARRAYEIGMVNRVVPIAELDASALRLARHIAAIDPNLVKETKRALNRSIEARGMLEALETALDIDLLIEGEGSPDKRAFMDIARSQGLKAALAWRDSRFPGAGS

SEQ ID NO: 1697 - protein, 406 aa, Methylobacterium sp.
MKGVFALAILFGGLSAVQADPLPTFRIGVLNDQSGLYADIAGPGSVEAARMAVEDFKPDVRGFRVEVLSADHQNKPDIGAAIVRRWFDVDQVDAIVDVPTSSVALAVSNIASEKDKAFLIASAGSSDLTGKNCTRTNVHWTYDTWALGNSTARAVITQGGKSWYFLTTDYAFGHALERDATEAVTKAGGKSLGHVLAPFQSTDFSSYLLQAQGSGAQVVALANSGGDTINAIKQASEFGLTDGGQKLVALLAFISDIHSVGLKVAHGLTLTEAFYWDLNDGTRTWAKRFAARNGGRYPTMNQAGTYAAMLHWMKAIAALDKDKAHRGTDIVAQMKAMPTNDPLFGHGSIRADGRTIHDLYLFQVKDPSESKGPYDYYKLVDTIPGDQAFRPMADGGCPLVAHTAAK

SEQ ID NO: 1698 - protein, 327 aa, Methylobacterium sp.
MFKAILIEKDEAGYRAGLREIDEAQLPEGDVTVDVAYSTLNYKDGLAITGKGPVVRKFPMVPGIDIAGTVRESRHHDYKAGDRVVLNGWGVGETHWGGLAQVARLKGDWLVPLPETLTPRQAMAIGTAGYTAMLCVIALERHGVTPDKGEVVVTGAAGGVGSTAVALLSRLGYTVVAVSGRPEEADYLRRLGAAEVLDRAAFSDPGRPLARERWAGAVDAVGSHTLANVCAAMKYRGVVTACGLAQGMDLPASVAPFILRGVSLIGIDSVMCPRPERIDAWNRLVRDLDPVKLEAITDEIGLTEAVATAERLMSGRVRGRVVVDVHR

SEQ ID NO: 1699 - protein, 258 aa, Methylobacterium sp.
VKQLLVDSVTGETVDRDDQVKGCEVAKDDLVPVEDEELSEIALESTHTINIEAFCRREEVDERYLDKPYYLAAEDKVSREAFAVIRDAMRKKGMAGLGRIVIYKRERIVLIEPYGKGLLATLLRYQDEIRSPTAYFEDMPDGNPTDEMRSLAEELIARSTRKFDPSKFEDRYEEALIALVKGKAKKPEKGKGRSKAAAPSSGNVVNLMEALRRSIDSEKGGSSAQPAAARKKAGSKRSRLNSTRGAGKATSSKPRKAA

SEQ ID NO: 1700 - protein, 164 aa, Methylobacterium sp.
MTSLLQISSTDTSPILALNNTHAAELSLLDEEGLSELVAGSFHARRIGRNDAFLIALDERHPTYASPNYLWFRRRYPRFVYVDRVVVAGIARGLGYARRLYEDLFRKAREAGHDLIVCEVNSMPPNLGSDAFHARLGFEEVGAATIHGGAKTVRYLALRLPGPR

SEQ ID NO: 1701 - protein, 411 aa, Methylobacterium sp.
MAGSKLELSITEARRIALTAQGLGMRPLSDGIAVSRMRRQIGRLGLLQIDSVNVLVRAHYMPLFSRLGPYDRGALDALAVAGSKRFFEYWGHEASLLPIDLQPLLRWRMDRARQGHGVWNQLKAFAGERRAEADAMLARIGQEGPLAASDVSGPKASKGMWVWSDAKHALEWLFWAGLVASTHRRGSFERVYDLPERVLPRSVLARPTPAPVDARRELVARSAEALGVATANDLRDYYRLSPTEARLPIEQLVEEGVLIPVTVRGWQQQAYLHRDARPGRRHRGAALLSPFDPLVWHRPRTERLFGFRYRLEIYTPAHKREHGYYVLPFLMDGALVARVDLKADRRAGALIVLRAHQEPGAPAATMERILAELRLMASWLGLSDVVISSTAGLESRDHRVSSRMSDRAAME

SEQ ID NO: 1702 - protein, 80 aa, Methylobacterium sp.
MKGLSGCVALLLLGIGPASAQTVLAPSGDSAVTQPGGTAGRAARRNIQEAYRNGDVVGHRHAPAAPAPRPDRPRRTSPRF

SEQ ID NO: 1703 - protein, 108 aa, Methylobacterium sp.
LIVSFQTKELLVVCSNLEAAEKRLGPELARVLTVQLADVEAADHAGELLDLLAGAAEIVGENSVVLWVGKDHRATFVPVGTFGRREPNGTPDWPTVRRLKLMDIAQCP

SEQ ID NO: 1704 - protein, 321 aa, Methylobacterium sp.
MEISGEGLDEVLIKLYEKLLESGDTNVGSRGSTVEMLGVSVRIAKPRARLSRSESRGKPFSALGELLWYLSGSDKLDFIRPYVPEYVKDATDGVIHGAYGPRLYAMRGIDQIANVCSLLTARPSSRRAVIQLYDAEDIAEHHKEIPCTTTIQLHIRGAQLHLSVTMRSNDAYWGLPHDVFCFTMLQEMLARRLGVEVGEYYHYAGSMHIYEDYIDGARAYVGEGHQKTVEMPPMPAGDPFALVDALLRAEEHVRAGRTVAAAELFADPYWADIVRMIQVFWARGRDDELAALKAELAHPIYEAFLQGRIGMKPRQLRPPTS

SEQ ID NO: 1705 - protein, 306 aa, Methylobacterium sp.
MSWPSWEPERLRLVDALRQHAAHVRPLPGISEAHALDTLARQFVASLRREAYYKQVQAKPVSARRADPNDLSFDAERAVARHIQLGDVDEAGWLAFLMTHFARPADTGWLRLRDVYGQLGEGTWDWPTVRSDPAAFEAWLAKNWRRVRGKFGNHRKYQSLRPDADTGTGRVIRSYVEWIGPQGHRAMLAEVVRRNGNHPHAIFDALYREMPIVGFGRLGKFDYLSMLGRYGIAPVEAGSAYLDGATGPASGASLLFDGVRNGPTSRTGLQSMLDELDRDLRVGMAVTEDALCNWQKSPGRFVHYKG

SEQ ID NO: 1706 - protein, 74 aa, Methylobacterium sp.
MTKLTALLANMQACEAAREARGEPPAYVIEAEASGTTVTWILPGHGHVRREPGGRCVRLSDGAVLPTAGWGYPA

SEQ ID NO: 1707 - protein, 101 aa, Methylobacterium sp.
LEPARAPDSATAEPPADLRRLEDGHVNLVLETPKGSPNKYAYSEPFGTFQFKLVLPECTSFPYDFGMVPPRRVPTATRSTSSSPRTRLPFPDVYWRRGWSA

SEQ ID NO: 1708 - protein, 292 aa, Methylobacterium sp.
MQTLDSVVRAIEAAPEAEAEIIVVDNGSEDGTDAALKRWSASISIDRRDVLLLTQARPGVAGSRNAAIARASGDIIAFIDDDCVVSDQYLRDLIAHYAGDTESVIRGGRVELGSTQDIDFTTKTEALASRLTYPAHPGGFVHGCNMTCSRAVIERIGGFDAAFGPGATFRAAEDTDFIYRGWAAGVAVEYVPDMSVKHFHGRRDPRTIDRLHWNYQFGNGALYAKHIGRSPWLIKHLYWSARNAARELVGGPCFDAQLGLTWRAIVTANLSGVLAFAWHSARTLLTRPPARA

SEQ ID NO: 1709 - protein, 102 aa, Methylobacterium sp.
MSSKTPPPSALHHEEECWVSTLRQQRTERLLSRIAEAVQVPPSAFYRPPNAVDAGASAAAIPVAPVASDAECAELLAAFNLVRDPEDRRRLLELMQKTAERA

SEQ ID NO: 1710 - protein, 96 aa, Methylobacterium sp.
MTITSTKTAILSCLALAALATVPGRAEARGFGQGSFGHHGGFHHGFHHGGFHHGFHHRFGGHGWWSPAGGYAAGGFFGDCRLFFSPVWGRYERACR

SEQ ID NO: 1711 - protein, 242 aa, Methylobacterium sp.
MHHHGLRILLVDDDAEVQRVVSGYLDGHGVDVVPASTRAEARGELADPSQFNLVVLNLRPGAENGLDLLRDLRAVSDVPVILTTAHRCEEFDRVLGLELGADDYIVKPYGLREFLARVRVVLRRVAAQASSRPAEAPCRRFDGWVLNRRRRRLINPDGKEVVLGKRDYALLAAFLDAPQRPLTREYLLQVTRVHDDVFDRCIDVQILRLRRKIERRPSDPKLIVTERGVGYVFAAAVESTSH

SEQ ID NO: 1712 - protein, 58 aa, Methylobacterium sp.
MNRDPRARSRQADGEARTAESDRENDARARAAVVDAWRRALLRMRERRATEDRTDPGH

SEQ ID NO: 1713 - protein, 140 aa, Methylobacterium sp.
MPIMPWIHDALSVGGLAALVLVARQALVRRDLGLSGLPGLERLRRSLGPGTGFRERPRFTSPRTSGNTAFDTWRDGEIGRIEGERRALGTRLRDFEGFVDALKRAKDRATFERFVAEHPAGSGAAVDIAGTADQAEHRKG

SEQ ID NO: 1714 - protein, 92 aa, Methylobacterium sp.
MTPDKMDDRLEHHRIEDPRSGLKLFLRRLSPQFRGERDGLTTDAAWLLDAFSGTPDRRDTKLRRGTHLMHLEAGRRVLWRASAACLSEPVPA

SEQ ID NO: 1715 - protein, 92 aa, Methylobacterium sp.
MSISKTACLTAVLGLVSNMAFAQPQASQENLKRHCIGDYLEHCGQFSPDGGEVQACFRERAGLLTPNCSMAIAAYQEEQKAANPIRKVRAAR

SEQ ID NO: 1716 - protein, 97 aa, Methylobacterium sp.
MTFLKTLLASLALCAALLVWAGLSIGPERPTDRTSPGLTTAAVLASDGMGPDGRPGEPAAAPGGPDRGDLDRAALDRLAKRVSGEVRDASAAGTPAG

SEQ ID NO: 1717 - protein, 94 aa, Methylobacterium sp.
MLSQISAGPARAVATPEAATAREIRASIQAEGLISFIDGRSYKTLKRHLTAYGLTPEEYRAKYGLPRDYPMVAPGYAAKRSEIARSLQLRHRAG

SEQ ID NO: 1718 - protein, 89 aa, Methylobacterium sp.
MRHVIGTSSAAAFGTLCVLALVGWTQAASTVPMQASGGAKASAAARDGAACGGAAWPYPPGACAGAGPVGDPAGRRVRLIAVDAAPGRR

SEQ ID NO: 1719 - protein, 71 aa, Methylobacterium sp.
MPHFSDDPGADEDPDLLGALRRMLHGGERAPRRLPTCAERFGVPAPRDRARDAQDAVLAGPDPRPPRSRHR

SEQ ID NO: 1720 - protein, 61 aa, Methylobacterium sp.
MLDVIARLLLSAGIMVGTTYLPALSQAVTGQPAGTRSYAADAPACPVKPAMAGIRARSCLG

SEQ ID NO: 1721 - protein, 338 aa, Methylobacterium sp.
MPMSIRHAAVAARLLAATLLLPALGGAARAETTSVRIGLQYGLVYLPVMIAQSEGLFDKRAKAAGLDGLSVTLTRFSGSTAMNDALLSDSVELGTLGSAGALIAWDKTRGSQQIKSLTALSSVVYTLFTGKPGVAALKDFTFGDKIAVPAFNSPQAILLRVAAAQQLGGSAKADALMVSLPHPDATAAMRAGQGIAGYFATPPFTQVLQADPKIRTVMTSTGLIGSGDITAATLNAKQGFVDANPKVAQAIRAGMEDAVALIRSDPKRAASIYLASEQVQIDRAQVEAILTDGSIVYDVAPKGMVALAKAMATQGFLRKVPGDWQEIFFPGLEGRDGS

SEQ ID NO: 1722 - protein, 458 aa, Methylobacterium sp.
MSVTSAALATDTAGARPAASQSIEEKRKSAIRGAFFSEYIDMFDIYLPVVALAPVMFMFQPKNLSPQMETVLASLVFITTLLGRPIGALIFGLIADKVGRRAASIYSVAGFGVITLLIGLLPGYETLGLASYILLVLLRFLDGIFLGGGYTGAMPLAIEYSKKDKRGFVGGLIIAGFPAAYVSINLITMLMFYLFPLDGPGSPYTVWGWRIPFIVGAALAGLLALYYVHKVSESEVWKKEAAAGAEQAEASPMAGLFSGKGGRDLLQVLLLMTGFWTTQNIITIYLPTGLLVKTLHLNGFALTATLMICYTILFFSYIGSGLLGQVIGRRRFFVIVGPLIATVGAYILYTLTVTPEMAFGTRVLLVSLLAVIVTSPWGVIVTYINERFATDVRATGFGIGFSLSVVIPSFYAFYMDWLSALMPLALTPVALLIVGGLIGTVGALIGPETKDVDFGTGH

SEQ ID NO: 1723 - protein, 301 aa, Methylobacterium sp.
MNGNRIGFIGLGNMGGRMTRRLIGAGIDVVGFDTDREAAARWGATDAGSIAAVVGETDVVLMSLPDSKVVERVVLGAGGVLAGCRDGQIVVDLSTASASSTRRIAAALAERGVAYVDAGISGGAAAAEKGTLTLMVGGDPAVIDRLGWVFAPIAQKVVVMGGSGAGHTTKLLNNFLNAVSLAATAEVMVAGRKAGLDLHRLLEVLNASSGVNFATLNRFPKIVDGDYLEGGLTGKLMTKDVVLYTDLLHELGVASLNASGPMASFGLATALGYGDVISNRVVDAIGDVSGGVRLHGNRHEN

SEQ ID NO: 1724 - protein, 254 aa, Methylobacterium sp.; identical to SEQ ID NO: 669

SEQ ID NO: 1725 - protein, 36 aa, Methylobacterium sp.; identical to SEQ ID NO: 670

SEQ ID NO: 1726 - protein, 55 aa, Methylobacterium sp.
MASSMLVTLGWLALSIFVWAQFDAEKVLLLFAYLTALQAGYLVGAYISTDTGPSR

SEQ ID NO: 1727 - protein, 90 aa, Methylobacterium sp.
MPADDVPTRDARAPEPARTRAPPAGESRLRSIAKAVSWRVVGSLDTLLLSYLFTGSVLVAGSIASTETVTKTVLYYLHERGWGLIPLGRA

SEQ ID NO: 1728 - protein, 44 aa, Methylobacterium sp.
VPTIPSPRHAARRSLFQSGIGLRLALAALLSALVWLTIAWALAT

SEQ ID NO: 1729 - protein, 119 aa, Methylobacterium sp.; identical to SEQ ID NO: 674

SEQ ID NO: 1730 - protein, 88 aa, Methylobacterium sp.; identical to SEQ ID NO: 675

SEQ ID NO: 1731 - protein, 114 aa, Methylobacterium sp.; identical to SEQ ID NO: 676

SEQ ID NO: 1732 - protein, 55 aa, Methylobacterium sp.; identical to SEQ ID NO: 677

SEQ ID NO: 1733 - protein, 116 aa, Methylobacterium sp.; identical to SEQ ID NO: 678

SEQ ID NO: 1734 - protein, 145 aa, Methylobacterium sp.; identical to SEQ ID NO: 679

SEQ ID NO: 1735 - protein, 189 aa, Methylobacterium sp.; identical to SEQ ID NO: 680

SEQ ID NO: 1736 - protein, 430 aa, Methylobacterium sp.; identical to SEQ ID NO: 681

SEQ ID NO: 1737 - protein, 179 aa, Methylobacterium sp.; identical to SEQ ID NO: 682

SEQ ID NO: 1738 - protein, 84 aa, Methylobacterium sp.; identical to SEQ ID NO: 683

SEQ ID NO: 1739 - protein, 71 aa, Methylobacterium sp.; identical to SEQ ID NO: 684

SEQ ID NO: 1740 - protein, 87 aa, Methylobacterium sp.; identical to SEQ ID NO: 685

SEQ ID NO: 1741 - protein, 155 aa, Methylobacterium sp.
MIANTEDMSGGSGHDEPVREPSFQPQDDNVRKHKLHMIAGRIAELRRDRGWTQAELARRAGLNRNVVNTTENETSFPTRENLARMASALGIELNELTDVFVIEAHHRAPAALSLTEAKGRPGYMAVQINRMLKTATALKIFQLIAEDDADAADRG

SEQ ID NO: 1742 - protein, 332 aa, Methylobacterium sp.; identical to SEQ ID NO: 687

SEQ ID NO: 1743 - protein, 150 aa, Methylobacterium sp.; identical to SEQ ID NO: 688

SEQ ID NO: 1744 - protein, 163 aa, Methylobacterium sp.; identical to SEQ ID NO: 689

SEQ ID NO: 1745 - protein, 536 aa, Methylobacterium sp.; identical to SEQ ID NO: 690

SEQ ID NO: 1746 - protein, 239 aa, Methylobacterium sp.; identical to SEQ ID NO: 691

SEQ ID NO: 1747 - protein, 219 aa, Methylobacterium sp.; identical to SEQ ID NO: 692

SEQ ID NO: 1748 - protein, 360 aa, Methylobacterium sp.; identical to SEQ ID NO: 693

SEQ ID NO: 1749 - protein, 342 aa, Methylobacterium sp.; identical to SEQ ID NO: 694

SEQ ID NO: 1750 - protein, 741 aa, Methylobacterium sp.; identical to SEQ ID NO: 695

SEQ ID NO: 1751 - protein, 135 aa, Methylobacterium sp.; identical to SEQ ID NO: 696

SEQ ID NO: 1752 - protein, 385 aa, Methylobacterium sp.; identical to SEQ ID NO: 697

SEQ ID NO: 1753 - protein, 434 aa, Methylobacterium sp.; identical to SEQ ID NO: 698

SEQ ID NO: 1754 - protein, 106 aa, Methylobacterium sp.; identical to SEQ ID NO: 699

SEQ ID NO: 1755 - protein, 50 aa, Methylobacterium sp.
VLLDASHMTVNESDWTFPSEAQALAAALAFSKQMTRAWKTLTAPMSDGLL

SEQ ID NO: 1756 - protein, 92 aa, Methylobacterium sp.
MLDGSHLLFHGSDTTHFFLRIYPLLRPSVIVHVHDIHLPYEYPEIATGFFWNEQYILAMMFYYKPASDIIAPIKYRHREGMCDEGAGFWFEV

SEQ ID NO: 1757 - protein, 110 aa, Methylobacterium sp.
MMRPWPILVLLAALLGGLASAPARAAPLPVPASAEAAAPAPAVQQAHWRHRRHWHRRHHWRRHWHHRRHYWHRRHHWHRHHHFRRHWHRHHVWHGRPYARPYGHRHVTFY

SEQ ID NO: 1758 - protein, 121 aa, Methylobacterium sp.
MRSLVFGAVLAVVMPFAAQAQDAGDAAAGEKAFAPCKACHNFQKNGVGPDLKGVVGRKAGTYEGYNYSAALKNSGITWDEANLHEWLKNPKAKVPGTKMIFQGYPDDKKINDVIAYLKTQS

SEQ ID NO: 1759 - protein, 54 aa, Methylobacterium sp.; identical to SEQ ID NO: 707

SEQ ID NO: 1760 - protein, 100 aa, Methylobacterium sp.
MRVTSAIGLASVLLSAGSAVAFAPALFAAGPAAVAQLCTESAGTVSCANGYAGFRGPSGKLWIGKDRRGTVIVSIDDRRNDQEPSRREQDHGRFVLEQAW

SEQ ID NO: 1761 - protein, 32 aa, Methylobacterium sp.
MAVWSIVDLPSVVGSRPADEARITAQADRIGD

SEQ ID NO: 1762 - protein, 88 aa, Methylobacterium sp.
MTTVVTESAMQEIQLRDAKATLSAVIDQAKQGAPSIITRHGRPEAVLLSFEDWQRLSRVPSFGRLLMAAPVAADDLAPPSGGLRSAEL

SEQ ID NO: 1763 - protein, 448 aa, Methylobacterium sp.
MQSTPPYGEPPLPISSDAIADGPKVPGAARRRSVVAGAIGNTLEWYDFATYGYFSAVIGRNFFPSDSPTTSLLSAFAVFAAAFFMRPIGGIVFGHIGDRYGRKTALLLSAGLMAVSTFLMGCLPTYASAGLLAPVLLVVLRLGQGLSVGGEYTSSAIFLSETAAPARRGLTGSLACIGAAGGILLGSIAGTLVTGLLTPEDVHQWGWRLPFLFGIVLGVFIFALRRHIDDDHVETVFREDRAPTDQRSPLRTAVEIDGSAMLRAFAMNLGLACGFYVVFVYLVTFMHTVSGLPQHTAFLINSLAMVVQAVCIPIAGALSDRFGRKRVLVLTGAGLTILSWPLFMLLTTGDTLLIVLGQVAFAILIAGNAAVVPTAFVEMFQHRSRCTALAISFNASMALVGGTAPMAATWIVHHLAWPTGPGLYVAVLSAISLAAVLTMRDRTGESLA

SEQ ID NO: 1764 - protein, 223 aa, Methylobacterium sp.
METPTGDHSGAFEASPLATIAAAVARGEVARIAALAPGLDLSVRGGRNLTLLEWAIWNARPRALSALLDAGADPSVPGLDQETALHMAAMVEDPTYLEILLRHGAPVDPVSPRGQWTPLFRAVQNRREAQIALLLRAGADPNRVDATGNSLLHVAAQVGAANPWVLRLLEAGIDPTLRNAQRKTFQPYFFTTPERLLNDSGRETRAAVRAWLARSGVPADPEG

SEQ ID NO: 1765 - protein, 28 aa, Methylobacterium sp.
VRSETMLTALSPLHLAALSLIVAYLGWG

SEQ ID NO: 1766 - protein, 82 aa, Methylobacterium sp.
MRKALGRPVQRARSWYRRYGRLGAPRTPRPVKQGPQAAPGRSLEDWARFGGGLLGPESADAPRPEIRADRGAALGIPISPPG

SEQ ID NO: 1767 - protein, 173 aa, Methylobacterium sp.
MRLTTRTPSRPRSLIVGCAAAACAFLVVSSEAPGQAGPGSAEALVNGIQTIRRGDTVTKVDRTGKGAVLCMRGILQAMRAVGQACHAGADPDFQQELRAALARIDRFIADNAPDGAGPPRDGTTEPEQRPGAVCGRDAEALYEALRTGGAAGLRAQVDDLLSTPREPVMNPCL

SEQ ID NO: 1768 - protein, 153 aa, Methylobacterium sp.
MFEIARDDLSDTQTRALLALHLAGMHASSPPGSVFALDLSGLQAPDVTVWTARRGGRVASVGALRMATDGTAEVKSMRTHPDFLRLGAGAAILDTIIAAAAARGARCLSLETGCGPAFAPALELYRRRGFVNGPAFGTYVPSDFNQFLHLAIA

SEQ ID NO: 1769 - protein, 157 aa, Methylobacterium sp.
MFYDRDEEGRALLRETLRQCDPRVAPVETLRQLAHRLVTGRNPVVEFSARSGAFVATAAGSETLKARARAIRDELAGVVRVALAESIGRGPEDPDADLAAGLLLATWSVAFLRAHRTFRATRRTEAANAAFLAVIDRGTAGLAAALAGTPYAEAAAP

SEQ ID NO: 1770 - protein, 37 aa, Methylobacterium sp.; identical to SEQ ID NO: 718

SEQ ID NO: 1771 - protein, 522 aa, Methylobacterium sp.
VNTISTAVQKPVPKPDRDVAPSPHPAGDLQALPDAAVRGAFDLVLRAVSGGTPAARPETDGGEMDEPEGATGEDRRPEAGASPAPPPSPGDPGSAAAALAEILSAAVLSARPELPAGHGTGAPGPAPSAASPAGPDAAPETSLVGNLEAARADASPRAGPSPGTLLQGGPPQVEVLDRAVHFKPILPEAARHALPAAAAATSALPAVPNAADAQPRPVRPGPVAPAVAGPDPAPIAPAAQIAAQIAAQVATQIAGTVAGKVNAAPPKATVALATDPEPRAGDASARADASARTATGIDGPGGLTAREDNRSRSGIAGLLLAPTGRQGPPGVPIPGPGNGSGTEPARLAAVLPTIAAAITEEIERATAAGPERRVGADPAIPAAQDGPLRVLKIQLRPESLGIVTVELRLVDGQLETHLRAARPETAAMLQRDSAILTELLKHAHYRPEIIVEPVRPGDAGFSAGGSPSQGQSGLTDGGARPGHGGDGQRQADQRAAQRPTLGRRDGERTDETVRPRDGGVYL

SEQ ID NO: 1772 - protein, 44 aa, Methylobacterium sp.
MAEICITEDQNGRWTVYTAGLVVTDLTREAAEAFAASYRRVTAG

SEQ ID NO: 1773 - protein, 66 aa, Methylobacterium sp.; identical to SEQ ID NO: 722

SEQ ID NO: 1774 - protein, 170 aa, Methylobacterium sp.
MRGLVSTATLSGVLALVFSMPASAASDITVAAIATGRLYVVGTTDRPHTAVILDNRFKTESDENRKFQYELVYHPANCVVSAAIDGTIHEAVVSNCGQQVVPGTWLDPKPAMTRPTPLERVLSPTVEVPSTVFCPSVQTERSQDPARIELADRTPPVFTVVTGMNFSPRY

SEQ ID NO: 1775 - protein, 31 aa, Methylobacterium sp.
MILRAEQISTGFVGGRIRVRAAEQQDARRRN

SEQ ID NO: 1776 - protein, 314 aa, Methylobacterium sp.
MTKPRWVRRDLLKSCFRDLPICAAASLLPTSGSSAAIDASVDPTQGRTLVFDEPFAEINGRIWNGGPKATTGPSGFYGRSAFAPLAGAEGFKPYEIVADAEATGGTALQISAKYIGRKMSVVNYYGNNTSDYQWISGNLQTGSRSGVVSVGWRQGYLEARMRFPRHPLTWPAFWLLNRDGITNAKRSIEVDIVEHKGFEPKLYGAYLHEWGQPGEHNEGTGVPTPVDMTEQYCRYGVLIQDGQCIPYFERKPIINPKTNQLNIWTLTRASEMEQAGDVFWPLLTLALRTDVPAPQLTEAQKLTHMRVDYFRVYA

SEQ ID NO: 1777 - protein, 294 aa, Methylobacterium sp.
VRDAVRGRPGTVSPRGSTGRARTGLSRRSLGILLVLAATAVWLAVALVPNLLGKGGALWAIVHGACVPHALRGQGPAPCSLVDLEGGVEKGYAILKDLRGRAQFLLIPTARITGIESPVLLQPGTTNYFAKAWRARTFVEERLGHPLDRRDVSLAVNSRLRRTQGQLHIHIDCVRQDVRDTLRRLAPTIGDRWAPLAEPLVGRPYRAMRVLGEDLGTADPFDLLARDDGARSAMGEHALAVVGAEFPGAKPGFVLLDGLVTSRFGKASNGEVVQDHTCAVAAEPASSGFRPLED

SEQ ID NO: 1778 - protein, 99 aa, Methylobacterium sp.
VRNAGAAVEAGTGRGDAAALFALRKPRGPFSDTYPMGHALRGLVIGAGLGHACPHPDAVGGRNRSGGAPPGTRRERQGWDDAREDLLDARSGSREPGDR

SEQ ID NO: 1779 - protein, 54 aa, Methylobacterium sp.
LLFSRQAEPTIRTSDLVGATAGVALLGGLCLLLVALLTSEAQGFTDLTSILTDS

SEQ ID NO: 1780 - protein, 79 aa, Methylobacterium sp.
MLTILFAVTFREVHVVWPTSIDDGLVDRVKPDPMLTEMDERLLHLTVDGGFAVAVHARGRFGAELSGVSRRGSPRMPRP

SEQ ID NO: 1781 - protein, 55 aa, Methylobacterium sp.
VESETATAEPFTIPTGHHVDVAEAIEMRSQATSLRAGAALHVAESAINMSFPRTT

SEQ ID NO: 1782 - protein, 88 aa, Methylobacterium sp.
MSEAILARDQRTEWLPRSRLGLLIFVPGALLWISIVLCMLPITVLAFPAEWMFKNRPNLHATAVMILVCLGAANVVIAPATVLYLLYA

SEQ ID NO: 1783 - protein, 74 aa, Methylobacterium sp.; identical to SEQ ID NO: 732

SEQ ID NO: 1784 - protein, 94 aa, Methylobacterium sp.
VAKPAAPPQQAEGAPGSGQPPASPGQGVDLNTASVEELNALGAGMIGRRIVAFRPYGSPEDLVTRRVLKKADYEAIRAAVAVRQTESAGAGRPD

SEQ ID NO: 1785 - protein, 84 aa, Methylobacterium sp.
MEAIGVEDRGGGRRDASARLRRIAAATGVPLAAFFGAPAPRPLAELSELIGLWQSIADQEGRNAILAVARARAAGTKDGPGGPA

SEQ ID NO: 1786 - protein, 97 aa, Methylobacterium sp.
MGLTAFAVFVIPWVLLAVFLTRSPSTLRLGTASAPWRSIPTHKEMARANRHALHPHGQRAGETDGVSGRDQRGRTDPPAGGALGTSVEPTEPDDKLS

SEQ ID NO: 1787 - protein, 59 aa, Methylobacterium sp.
MLTMTLALLAVLIAGALCLGMISAFLPFQRPREEIELAEFTDDEFFDIGGPIIDLQATR

SEQ ID NO: 1788 - protein, 223 aa, Methylobacterium sp.
MNTTVTAIASAILAGALLGAPTGAQAQAGSFANHGFGNHNFGAAAVGGGGFSSPGVGAGAAGGGFANRGFGNHAFGPAAGAGGGSFANNGFGNHNFGRPAVGGGFANPGFGHGLGAHRGYGHHRHYGYNRGYYGRPYGYGYGRGGYGLGLGVAVGGLYGGYGYPGYGYDTGYYGGYAPVTYGYADTETYRVADDDRYCARRFRSYDPQSGTYLGRDGRRHRCR

SEQ ID NO: 1789 - protein, 43 aa, Methylobacterium sp.
VTGIDGPTTRGRHQQIDTHALLTTGRHRRRATVGAAPEPEPVP

SEQ ID NO: 1790 - protein, 58 aa, Methylobacterium sp.
MSCVEGEGHRRVPGGTRAGPGATRPVARSEAAGKIVNRHGDHACRLRLTAGAAPMLTR

SEQ ID NO: 1791 - protein, 50 aa, Methylobacterium sp.
LLVVLVFAALIGGAIGFAVVLPKGFLLALLAAQAGAAVAVGLVVLLIRRR

SEQ ID NO: 1792 - protein, 48 aa, Methylobacterium sp.
VQGGPFPATSGGRDGAVGPLATERMPRPVLHRDLARRIDGARAPQPGH

SEQ ID NO: 1793 - protein, 45 aa, Methylobacterium sp.
MDRHGQEAGADTAAEASPGTAGDTARDTAEARAPSPARASARTAA

SEQ ID NO: 1794 - protein, 46 aa, Methylobacterium sp.; identical to SEQ ID NO: 743

SEQ ID NO: 1795 - protein, 295 aa, Methylobacterium sp.
VLAQELHFGRAAQRLATTQPGLSRLVAELEAEVGVKLFRRTTRTVEVTEAGRAFLAECRIGIDHLERAVTLARRTATGMAGVLRVGYMDFAINGRLPELVRAFSELRPAIRLELSHVPSQSQREALLNDRIDVGFTLSAVENEHFESLLFDRDSYVALLPVTHPLSNARSLTLKDLADEPFVLGSGGSWSAYREAFFTICHRRGFHPTIGQEASSSEGIFGLVAAGTGVSTYASCVRNVQRRGIVIRSLDDVPDTIATYATWMKPARSTSLEAFTTFLATVWGSAPARSNTRSKF

SEQ ID NO: 1796 - protein, 273 aa, Methylobacterium sp.
MKLFDAEPVFPRVPAIMPSPWMPLEVGRTMGAICKPHDAGGGTSFLGLHFDDYCFGPAPEHVAHAVLALPVRAFDLERDTRREDLRKAFYLAAPGFGRRPDFTLGAGAFMVRSFEGADPRDTVYLIWPVRCDEGEAGLDCRNGMGRKAFRFAADGALRDVSADVLPADPVLSFDDRVRQTKYGGSVLFLLDDKLPYAPTMRWIMEFDPDSPPLEKDDPKAAGPWAHFGFVHWTGSRFELVDRIARSQWPCRKLNDAPACSTYPDGFEDPFVIP

SEQ ID NO: 1797 - protein, 117 aa, Methylobacterium sp.
MAVESYGDYRDYFDAKPVTAKRAPRSASQKKAPIDITTDLSAVRRRADGDHREMYRYETGSRLIADMRPRNWDGGHVPVQPHSWSPDGFWSPMVQSHEGRERPDQSFEGRGRPERFR

SEQ ID NO: 1798 - protein, 149 aa, Methylobacterium sp.
MRPAVAALLVAVPLAAAADDLPPPVAAAIAEVEAACGSAPARIDPFVIDRQDVNGDGVPDFILNVGGLRCGDEEVSQCGLMGCPKIVLASSKNGFVLVLDIYAHDLRFRALNGRPAASANDEGWNCGSVRRGPGRTTFLWDGTRFACAE

SEQ ID NO: 1799 - protein, 29 aa, Methylobacterium sp.
MAWSAPVVSEICVGMEVTSYESAEIDTFH

SEQ ID NO: 1800 - protein, 31 aa, Methylobacterium sp.
MKPTTIAPISSDRRGNGPDRQSLPVAQGEED

SEQ ID NO: 1801 - protein, 26 aa, Methylobacterium sp.
MMEFMNFVSTTSPYFGSGMISRFSAE

SEQ ID NO: 1802 - protein, 47 aa, Methylobacterium sp.
MTDLLVTLQEPAEPAGQAGPGSETSALRAHIARILRRLPPAKATKTT

SEQ ID NO: 1803 - protein, 72 aa, Methylobacterium sp.; identical to SEQ ID NO: 752

SEQ ID NO: 1804 - protein, 122 aa, Methylobacterium sp.; identical to SEQ ID NO: 753

SEQ ID NO: 1805 - protein, 624 aa, Methylobacterium sp.
MIIRHTRRLQRSGEAVASRDGRLVAPAPTEPDWDVLGLIDLGGRVTVVALLGPNDARAFRFLNPDGTPLASCAADFLAAPWDGAGPLDWQAEALHTDDGDASNTRAMIEDLHLLIEALARAAAASPEHAVRVVTGGGSDPRAQAMHAALARLNAAPAGAPPHLPELVTKAIVARGGQETAHPDGGDLRFSIYLPMPGFRFVGYAADRNETLCTLIGKNSRLASALLDVRANTAYARPNLGSVGFDAATLVQVRLWRQYLLPALIDGAARSTRVGVVFEHAHISHAIWNELAAVDDVLSLGRAPAVFLFASCNEPISPVDAVFPELAGQVYRGIEGPLPLLQAAVAGAATFLPFRSYRVSQRLADRLAALARSAEPALDARLTDAARRATIVLIGLRLENRQWVRQLDGYVALIRRLGRRRGERFLVIVDGHNTLAGAEGGYVESYCESLVPAEGSVPSIVRKELELIGALRARVADVSNVELMPLVPCSMGASLVAALHTDLFVTHFGAGLAKYKWVANAPGCVISSRSVLSGKDDLRIYDTEIFRENVSACHYFPAERVTDLDTSTNALHVPGSREREDFDLDLEEFASFVEQNLPKRRAARPHWLRRLTLFRTRAATDAARL

SEQ ID NO: 1806 - protein, 32 aa, Methylobacterium sp.; identical to SEQ ID NO: 755

SEQ ID NO: 1807 - protein, 68 aa, Methylobacterium sp.
MRVPATVRRAAILPRGPIAEGTAMLEPLLFIGLIIAAVAAATRLGIAAAAPMAPSRLDAWDGRADADA

SEQ ID NO: 1808 - protein, 43 aa, Methylobacterium sp.
MATKMMTKGMTVTDHIVAWSMLTGLALAVLQLALTAALPTHFV

SEQ ID NO: 1809 - protein, 210 aa, Methylobacterium sp.
VVDEGIRGEDHGREHDQPDLLPVAVALIGIARVARFGRPVLLRVARVRGLRRALGRSLPVIRAGVVGRQAQGRSRDESREQRRRVNRELRPAGILRDREKLGIASGDLVDEGAEVAASHRAVQDIGRDDVAAVDPGEMHDGVAIRPAEDEPGIRLVAQALLAADLQAGSDQRGLDAVEFREFLLRPAALARRCGSEERDDRAHRDLTSAQ

SEQ ID NO: 1810 - protein, 111 aa, Methylobacterium sp.
VARRGGTPAGTFAGPRRAWIGSACLSLRQTRRFIRTRAAGRVQWNGRRVLVMAWRIGAPARPVAILTAALIGDLPPDLREARCWTRARIGCCTGVAGRAVQLPFGCTCADA

SEQ ID NO: 1811 - protein, 46 aa, Methylobacterium sp.
MAGIPGVRRRVLDMFRRHPAPNRSLASLPVIRFGGSGLDLQVGCRC

SEQ ID NO: 1812 - protein, 38 aa, Methylobacterium sp.
VNGGTLCVRSIVSEVPGRLAASIVLPVAWIGSARLRAG

SEQ ID NO: 1813 - protein, 221 aa, Methylobacterium sp.
MRKITGSLFQSLDGVIQAPGGPEEDQTGFAHGGWTFPYFDASLAGPMGKLLGGDYELLLGRRTYEIFAAYWPHNAEQPIGATFNAIRNHVVTGSDAALDWNNSRRLAGDPVAAVTRLKESEGPDLLIQGSSRLYPALLPAGLIDRLVLITFPVMLGRGKRWYADDPAAARTWTLVEQSHSPKGVHVAVFARDGAVQTGSFASKPPSADEIALRERQAAGRW

SEQ ID NO: 1814 - protein, 114 aa, Methylobacterium sp.
MAVACPVLTPEERKASEILDAAQRAMMETVQAAVAEAAARVRQQNLDAGLDLAPPPRAYFESVVHQRMYLTLCGAAVGTFAGGDARTAIGLIRNQQLIANRYWGAGIAVTPRAP

SEQ ID NO: 1815 - protein, 32 aa, Methylobacterium sp.
MALKIFSYAMIGAFVGGLAMTVIGSAGVLMGL

SEQ ID NO: 1816 - protein, 841 aa, Methylobacterium sp.
VGDARPRQTTARVLLASLIGTTVEFYDFYIYATAASLIFGPLFFPAALQSAELISAYASFGLAFVARPIGGAVFGHFGDRIGRKATLVASLLLMGLTTSAIGLLPTFALAGWLAPVLLCLLRFGQGLALGGEWSGAALLALENAPPGWRARYAMFAPLGAPLGFFVANGLFLVLTLTLSAEQFADWGWRVPFLLSVPLVWLGLWVRTNLGETEEFAAAVKDAQPPRVPLVALMRDHAGQVVAGMFGVVACFSLFWTATAFALGYGTTTLGYSRASFLTVELGAILFMAAAIVVASWLSDRLDPARVLIVGCAGTIVSGILLAPMLGSGSLVTIFAFLAFALWVMGFVNGPLGAWLPSLFPPQVRYTGTSVAFNVGGIIGGAFSPMIAQALAAQSGLTAVGFYLALTGGISLIAFDTSARRRALDALARSERRYRALFEQSHVALCEVDLSEAQAHLAEARAAGALGPDLRGQADAALVAACARRIALVDVNDATVRLLGCGSREAVLGSMSRFLPPGNDLVLPLLQRIDRAGGRFEAQGRLIRADGREVTAILVVALPDDEAALDRVACAMIDVTERERAKEALLAAQAELARAGRVSTVGAISASIAHEVNQPIGAMVMSAEACLRWLRRETPDLEAAARAAERAVRDGMRASRIVQRTREQLRRDRSQPEILDLGALLAEVAALLDREILAAGATVRTVIAATEARVLADRVELQQVVVNLVTNGLHAVRDLPEPRRALRIALTAPAPGRLRIAVVDSGTGIDPEQLPRLFSPFFTTKRDGMGIGLAICRTIVESHGGTLTGGNNDGPGATFAVELPAAEPGAAGGAAAEPAAVAGAAG

SEQ ID NO: 1817 - protein, 58 aa, Methylobacterium sp.
MLRQIAHALGVPEDAFLDESEALATIDMTGDLLRVWHALTLSDRRLLLQMARGMISRG

SEQ ID NO: 1818 - protein, 65 aa, Methylobacterium sp.
VAALLLALATENAELRQQLATAQDMLMETAIDAGHLHARIEALQAERDAWQAEAERLARRPPRSL

SEQ ID NO: 1819 - protein, 64 aa, Methylobacterium sp.; identical to SEQ ID NO: 770

SEQ ID NO: 1820 - protein, 42 aa, Methylobacterium sp.
LIALSGIDRARTAPTCGGAAILDLALCLILSVTVVGLLLLAL

SEQ ID NO: 1821 - protein, 74 aa, Methylobacterium sp.
MPKHARLALAAALLSAIAAGAARADGTSAFGAANAAQLRGYTASPAQVYVPAGGPSAKPAAPAPQRPKAPARSR

SEQ ID NO: 1822 - protein, 112 aa, Methylobacterium sp.; identical to SEQ ID NO: 774

SEQ ID NO: 1823 - protein, 33 aa, Methylobacterium sp.; identical to SEQ ID NO: 775

SEQ ID NO: 1824 - protein, 89 aa, Methylobacterium sp.
MLKSLAAAALLAVGIAAPASALPVAGSPLPAAQDGLIQHVYGGCGPYGHRGPYGGCRAGGQWGGYVGRACPRGFHLGRGGRRCWPNRYW

SEQ ID NO: 1825 - protein, 45 aa, Methylobacterium sp.
MTLLTALALLPFAVIANFAFVVALANHFDADKPATGFTGPVPTLA

SEQ ID NO: 1826 - protein, 63 aa, Methylobacterium sp.
MSVSAGQEDQMTAPFSLIRRWLDCRRARSELASFSERDLADLDLVGCDVKRIASARSVRRGAA

SEQ ID NO: 1827 - protein, 48 aa, Methylobacterium sp.
MRYRAVSVLDVSAMASEENPTDETLMLREHIRRILRKLSRARAELQYS

SEQ ID NO: 1828 - protein, 54 aa, Methylobacterium sp.
MAGGFDARVSAIAEAVVALENRSGCRSSAERMPCAASEIDRKQGTRQSDTIQLS

SEQ ID NO: 1829 - protein, 224 aa, Methylobacterium sp.
MDHAADPDPVLIRLREGFERVALVLRADLWAAAGDAGLNPTQAQVLALLARRPAGLRAKEIAAQLAVSAPSMADTLAALARKALLTRAPDPADARAVIVRLTDEGRALGRALAAATSQVMSALARLTPPEQADLLLTQIKLIRTLQQAGAIPVQRMCVSCRHFRPNAHPAEAQPHHCAFVNAAIGTRDLRLDCSEHEAADPDVQAATWTSFANGSPPLRAPRET

SEQ ID NO: 1830 - protein, 239 aa, Methylobacterium sp.
MTRIKARGVGLVAAALCALSTGASAGPIRAQPSPAVLASFDIVETTIATKGDTAVFTTRVRGEAGKDKPNATGKFEGSSVYAYVWPTTLDSDAIGFDKAQGIVALAVTFHPDFDDAAYGARNRHVWHPHWVVLAKDAACGGGLKVVDIPDGAKPKVPPTWPKVPLLIDSPDYPTTFRGDTVQVEIPVSLITGIKGASFDGVTSGLKVNGNLHAPLLCVSDVFKVASGNLSLPGKVTPQK

SEQ ID NO: 1831 - protein, 67 aa, Methylobacterium sp.
MRGTPTTIVIDRDGRVREHAFGQVDDLALGILVGSLIAAPVTGSVRGELVPDGCDEAGCRLTEEARP

SEQ ID NO: 1832 - protein, 540 aa, Methylobacterium sp.
MSSFDESVARQQRFMGPLLVAAILFGLAGLPVAVWLDLRGLSERMLATQAIETGRIIDQMRSFYASDVVQAVNAATGRVETRHDYKGVPNAIPIPATLSLELGERISGGDGAVKYRFVSDLPFKDRKPHDLDSFETQALADLRAHPKTGFVSETTGSIFDRQVRIAAPIRMESACVRCHNAHPLSPKTDWKVGDVRGIQEIVLHQPIAANVFAFKYLLGYFILAALAGTTFLLLQARQSRLIDRMNRELTESNGFLASVSVQIAKYISPQVYKSIFSGERDVSVATERKKLTIFFSDIKDFTATTERLQPEELTALLNEYLTEMTAIAVKHGGTVDKYIGDAMLVFFGDPESRGVREDAQACVRMAIEMQKRLGQLNARWRRSGIERPFQARIGINTGYCNVGNFGSDERMDYTIIGAEANLAARLQAAAVPGGITLSYETYALVSDIVQASPQEPIRMKGISREIVPYAIEGDLTAEAPETIFSEHARGIDFYVDVDALEMEGAARLRKRLLDTLAAVDRRMTGAGTHSDDGTRPSAAG

SEQ ID NO: 1833 - protein, 629 aa, Methylobacterium sp.
VTTPLDRRRLNLRWLCASCLIATCGAALMGAALRMSVDTDLAPAKPTFRQGPAQVAEGQGVVGQRGDRLVRRQLVASDREEFSAPVTHQVGEREIIRTQPFVRLVTSLSSGDAVDGQIPPFDPTRQLAADGEVAPVADEPVDDPSGTTVTITRSALEGTPVPDDAPGLSDEDVTALVERQSDEARETGPRIAAPLAPQRLLSQILVAAPADAAATAAGADTGRDPFHAIEVRVVPENITDLAETQPASGLSLTETRDVVLKRGETLADALAANGAEPASVTAILAAFSEHARTGLAEGQHVDLLLVRSRAGEAARRIARVTLYGAGGVEEIVAERDSGGFVTVAPPSAQVAASRSGDDGDGEGSGASLYRSIFEAVLRNGMPGILAERIVGIFAFGLDMQRRIAPSDRLEVLFSPSEKVGGPPEVRYVAVTLGGVKHRAYRFEAPEAGTASYFSETGNSLRKFLMRMPIADGRITSPFGTRVHPILHYARFHNGVDWANKAGTPIMATGDGTVAYAGPRGGYGNRVEIHHANGYVTAYNHLQRLAHGVQVGATVHQGQVIAYMGSTGLSTGPHVHYEVSVNGRFLDPMTIRLPDSQGVSPRLMTAFERQVAATNALRHHGALAMSALPL

SEQ ID NO: 1834 - protein, 403 aa, Methylobacterium sp.
MNGVAPSIRPAARAGDPDAAFLATVAALRPLIAEHRSALAVGPDLPEPVAEALIDAGLAQLWLPRGLGGPEAHPLSVLAAIEALAELDGSVAWCAAISSGGASRFADLIDADVMRSLIPAGRKFAGSGSGQPTGTAVRHGSGWRINGRWSWASFCRYSSVSALMCVEIEGERPKLDENGRPSLRGVFIASKDVEVVGNWNAGGLRASGSHDVACTDIWVPNAQTIDGASLMMPRDRRPLYMLPMASAAAIAAIGVPLGIARASIDAFIDLAQTKTPHGGKVPLRLREDVQVAIARAETSLEAARAFARDTVSEFWWEAENGRPITLAWQAKLRRACWYAGHVGKQVVTSMYEAAGSSAVLEDLPFARQLRDVYAACQHMHYQDRLLVPTGRILLGLEADAPFI

SEQ ID NO: 1835 - protein, 54 aa, Methylobacterium sp.
MPVGIGIGRGDPLRPAVTRTARFSGPEGFHPGALWLAAASPLLATLLLLVRLAA

SEQ ID NO: 1836 - protein, 31 aa, Methylobacterium sp.
MLKAFSYAMIGAFLGGLMMTVVGSAGVLMGL

SEQ ID NO: 1837 - protein, 72 aa, Methylobacterium sp.
MRLLWDRVLDRAWLGLAAAAAVTVAVHEGAAVGRRAWTLGSGGVAQAAPAGTGRAGPPARAAACGPAAAPPP

SEQ ID NO: 1838 - protein, 776 aa, Methylobacterium sp.
LGLYSKLRAALAEDALLARGVKRSLVDGLYQPFASLAVGAASGTIVATAAAFWSDDRAITVTAFAVGLIGLTRIVLARIYLTKGPQKHDRYELWETYFSLGAFAYAASLGILSFLITTRSSNLALQVITPTFTIGYAAGISGRNAGRPLLAIAQVLLSAMPLSAGLLVSGDGERASLGILSLLFAYGMIDITLSTREIIVSALVTTREKEALAEKFQAQANLFDIALRNMSHGLCMFDARGRLQVWNDQFLSISGIPSNRIHTNSTAKSLYALSRAIIDERTAGRGATLSTFSAASNALRSGNLVLILPDDRVVSLMQRRTAEKGYVIIFEDITERRRSEARIQQMARYDDLTGLLNRSSFKAKVSQALKASASSKGDFAVHLLDLDHFKVINDTLGHPAGDRLLQMVADRLRGIGALSGSVARLGGDEFVIVQQSVTSPAVAEDLAQRVLHELERPFDIDGTHVTVGASIGIAIAPFHANDEDRLLKCADIALYAIKGAGRSGFKIFQHEMEAATRARHALESDLRAALTNGELELHYQPIVDASTGAIVSCEALLRWQHPVSGYIPPSDFIPVAEDTGLIVQLGDWVLNEACREARNWPSTVSVAVNMSPRQFGDPQLAFHVIGALNRSGLPAHRLELEITESVTLGATHKIVETIHTLRQLGIRLSIDDFGTGYSSLSSLRNFAFDKLKIDRSFVWDLDRKAESTAIIRAIVGMGRSIGMAIVVEGVETETQLSILRAEGCDLIQGYVFSRPVAASQIRAMLAAAEPVTKLAS

SEQ ID NO: 1839 - protein, 29 aa, Methylobacterium sp.
LRGIARRRPDGAEEESWPFVDKADPYSVV

SEQ ID NO: 1840 - protein, 62 aa, Methylobacterium sp.
MIGIFQPFGVLHVWTSIGRPDTAAMLCLLLDPIVGGAVVLRRFRIAPAVKTISRPRSRAPRP

SEQ ID NO: 1841 - protein, 274 aa, Methylobacterium sp.
MAGIGVARARVDRRTWSVHGAAKRNSAIIQAGLARIVEDEILPRLALAHRADPPSPASTTRSPTPERVASLAQALMEGEPHAEWVRALLEEGLSLDALLLDLFAPAARYLGELWEDDAADFLDVALALGRLQNLTRALCADLEGVDVTANGRRVLLMPCPGETHLFSLALVASFFREAGWDVVLTNGADEDPASLVRAEQFDLVGISLSCDILLPVMAVSVAKLRAASCNPDLRVIVGGPLFVREPASARVVGADAVAADAQSAVRIAEATLAR

SEQ ID NO: 1842 - protein, 78 aa, Methylobacterium sp.
VEVQTLPDFDEHLAREFVQGLVQSAIVRGLDPAVRLQQFRTLQQAAMVMMPDPAAVRTSKQIVDAIDLILEELTAAKS

SEQ ID NO: 1843 - protein, 229 aa, Methylobacterium sp.
MPDRSLRAVWSDSLMAEVGARLPLFDDLSPDTIRRLSAEGFGRGLLTASLRARLRKAGFPDLGHLAQSSPVAIATIRKFGPIRVERVRHFILDVLARWLPGAREMHTPEATRARRLGRLRGLPAGCLPLAADQIAALRFADASCADIATCSRLGLLRTGAVTSGDVDHVVATLTRLARAPDPVPPRPLEEARAAPSCDAASAAARRAALLAGQDREWDEAAPIARRPQT

SEQ ID NO: 1844 - protein, 69 aa, Methylobacterium sp.
MRKLTRLVVRMAQRPGLLESGRLIDQLTDLETEGLARNISWRSIETIRATRLKLRVEGLMPTSSLPLAP

SEQ ID NO: 1845 - protein, 104 aa, Methylobacterium sp.
MRDMSDMPERIPAMIRVRDAARSARFYRTTFRLDTADRPGFETFTPIDLAHAASGLASALTVNTGHDGACGLGVGAARVTARSCFIDDPDEHKIEVLARGWRFA

SEQ ID NO: 1846 - protein, 261 aa, Methylobacterium sp.
MDLQLTGRSALVTGSTAGIGLAVAKRLAAEGAEVIIAGRQQAKLDAAAAAVAAAGRARAILADPATAEGAAALVRAAPAVDILVNNLGIYEAKAFPDIADDDWHRLFAVNVVSGARLAQAYLPGMQARGWGRVLFVSSESGIVPPPDMIHYAVTKSAQLTIARGLAQLTKGSGVTVNTVLPGPTRSDGIGDFLKSVASDPDLSPEAMEAEFFRLHRPLSLIQRLIEPDEVAAMIAYLASPLAAATNGAALRVEGGIVPTIA

SEQ ID NO: 1847 - protein, 73 aa, Methylobacterium sp.
MPRWLQFALGLVTLIALAAGIVRTLVRHMPGAVASWLGPWAYEALILLLAVSVVAIIVRAAQGYRSPRSDKVR

SEQ ID NO: 1848 - protein, 128 aa, Methylobacterium sp.
MLRRLAILLPLLVSTVAHAAGPGARAVGTFEHQEDGYEQGVEVKAAGAAGFTAQFSTGTKGCGGEVTMKGRPTGPDTVVFSKTNGGQTCRITARYASDFRSVVLEEQGCTMWHGASCEFQGTLKRTGR

SEQ ID NO: 1849 - protein, 86 aa, Methylobacterium sp.
MCMILCRFSMEFLSAFRPTTPRHGLHNAAQMLREVVAINLLHVLLVGAECSSNLAERHARPHAPRREGVAQCARQFSQVELAPDNA

SEQ ID NO: 1850 - protein, 320 aa, Methylobacterium sp.
MPVTIPDRLGLGVADAGNGLSARAAEARSRLVRWIVGNRAQARVPTRILTDDEIAAFRRNGFVTVPAITTAEELDTLRGAYDRLFEEARGWKDGSLFDLVDVDRGASEARSPQLLNPSRFEPLLRDILFRANAQAMSRQLLGNRAALVFEHAIRKPPKIGAATAWHQDEAFYAAYTNYRAITVWMPLQDVSPENGCMLYVPGSHREPLLPHRSIGGDPRIHGLEALGVPVERAVPCPLPAGGATFHDCRTLHCAGPNLSAGPRRAYALGFGVRAPEHTLRHEHPWNAEKRTLRQERERQARGGLARLKAGAKQQIKALIR

SEQ ID NO: 1851 - protein, 104 aa, Methylobacterium sp.
MSIIDSGAHMQHVSADNDRVARWCAAHPVLLAFGLCAFGLAVVAAVWGFGILTPATATVIAFIYVACLGGFLMEYLGINELIRGVRFLWFVLTGVWWLLTFWRA

SEQ ID NO: 1852 - protein, 79 aa, Methylobacterium sp.
GGVEYALPTDSFLNFFRSSAVTLKVEGLYVSLDRQKNSAGGVFYGNLLPPNGTAYLNGAAAKTEFAVVRAGLNYKFGSY

SEQ ID NO: 1853 - protein, 111 aa, Methylobacterium sp.
MVHRRQRRGIGRTASDPTFDAKGPLIVRWIGAAARKRGRAADREAPPAPTPDNVTRLSWADTFGRAISADPQRPEGPATVLAMRPRASRRACGPFVRTRQAVSAAIPTSLP

SEQ ID NO: 1854 - protein, 39 aa, Methylobacterium sp.
MRYRHSSINALPIAESDREFHWPLGRRPDDHPDLSQFVF

SEQ ID NO: 1855 - protein, 105 aa, Methylobacterium sp.; identical to SEQ ID NO: 809

SEQ ID NO: 1856 - protein, 68 aa, Methylobacterium sp.
MSTSANPPDPCAETAALRKDKLRAHIRSVLSTIRSHHMGRGAPSIRATGYVLGGWFCGSAAATIPLFT

SEQ ID NO: 1857 - protein, 70 aa, Methylobacterium sp.
MKHGARNDIPATVTAIKRGDVMAQVEVELVGTAYRMASVMTVDSLEELGLREGDTVHVLAKAVNVLLVKP

SEQ ID NO: 1858 - protein, 58 aa, Methylobacterium sp.; identical to SEQ ID NO: 812

SEQ ID NO: 1859 - protein, 107 aa, Methylobacterium sp.
MDENGLEFLRTIADRKVESSAARALNRIAQSLDLPIEAFYGFDQCGSVDRPAIERETERLLMLVGAHLRRLDPAARRRFGEAVLALVGPEPTDACARTAENAERGDP

SEQ ID NO: 1860 - protein, 105 aa, Methylobacterium sp.
MLWSCLILIAEQTFVPVQWERAPVRREAVLEGLMLGAVAATVGTGALVFSMGAIEISGITHCVDWQRRHDLVRLDDGPLPPLAPVCQGPQLLKHHAAGPDRTDRM

SEQ ID NO: 1861 - protein, 113 aa, Methylobacterium sp.
MAPDISRYRRLPGEEPRYVLAEARTLIAERAYLFSLYAVDVVASDGLTGRHVLAVPVAISAVSITVGLVLTEADSRRAEAGDLAGVASLAQAVQGGYRRFRTFPANELGRFVL

SEQ ID NO: 1862 - protein, 89 aa, Methylobacterium sp.; identical to SEQ ID NO: 817

SEQ ID NO: 1863 - protein, 50 aa, Methylobacterium sp.
LLGFGQRLEEGTGIPGPGPDEAIRPDRDEMLESYGDRIELAAGGWSSAGP

SEQ ID NO: 1864 - protein, 312 aa, Methylobacterium sp.
MPPGRGDGTAAFEAHRPRLLRIAYRMLGSRSEAEDVVQDAWLRWVAADRSGVAAPDRFLARVVTRLCLDQIKSARARRESYVGPWLPEPLIEPLVEPGADGVDEDDLTLTLMLALERLSPLERAAFLLHDVFGLPLGDVAETLGRTAPAVRQLAARARRNVRAARPRFPVTRDEGERVARAFFEASASGDVAGLRTLLADRVTLSSDGGGRVLAFVNPIRGLERLLRLYAGARRKWGDGRAALVGFVWIDGLPGYVTRERGGLLQTTALAIENGRVDAIYITRNPDKLHHVARAVAAGPGPGDAAGPAARRS

SEQ ID NO: 1865 - protein, 255 aa, Methylobacterium sp.
MHPAVAAANAFRAVHDAGQVPDYERILRQGYSRFLAPGDVVVDVGAHTGLHLVAFVDIVGPTGKVHAFEPIPFLMKDLVGRFGRRPEVELHDVALSDAAGRTDFTVASVPGESGLLARYFSSPAITSKTIKVRTERLDTALSHVPAVAYIKMDIEGGELNALSGAAQLLRRCRPIVSVEYGWAGYSAYGHAQDSLYRFAESHGYICADITGNLIDDASTWLAVSDYVTWDFFLVPQERRADWAALFARRPEPGPA

SEQ ID NO: 1866 - protein, 110 aa, Methylobacterium sp.
VALLALYALALQGVLGGLASAAAGPDHVLCLADGGPTDPAPAGKQLPAPHRGDCCVACHAAGPATLPAPSTVAAVPVARPAAAAAARPRRVALPRAPPRPGLGARAPPVV

SEQ ID NO: 1867 - protein, 84 aa, Methylobacterium sp.; identical to SEQ ID NO: 822

SEQ ID NO: 1868 - protein, 445 aa, Methylobacterium sp.
VEFRFDRKEPGVWISAGTHVALLALALVSVAAPALPEAQEGVPVEVITENQFSEITKGERQADKPMPNATSRADRKAEKLEDREPENSKQDAPTAPTRTAEMKLANADEMPLRAEPDPQEAAQAAKAAEKAAQEKRDAEKAAAKAAEKAAEKATAEKAAAAKAEAKAKAEAVAKAEAEKREQLEKLIEKQEAEAAAAAQKAAAKKAEAAKEAAKEAAKKAADAKAKAEAEAERQKEIAEAKAEAEREKAEAAAKAKAEAAKAEAAAKAEAAAKAKAKAMADAKAKADAEAKARKQAELADKFNAGDIRSVLASKAPSQSTGATGHAVQKVAALGAATGNAQRLSPSLRDALVGLLQQQIERCYSAPPGAAQGVVLPVLDIRLNPNGSLSTEPRIMRGGASAVDQSIAQAALRAVRRCAPYNIPATYAPYYNDWKAINAEFEFTAT

SEQ ID NO: 1869 - protein, 60 aa, Methylobacterium sp.
MTILMAVALAIALLGIALTSAAYRFAPVSKHIASGDIVLVCGISTAALGSLGVLLQIFTV

SEQ ID NO: 1870 - protein, 28 aa, Methylobacterium sp.
MVGADHNGTRILGHTVGEPAAYVQAFRR

SEQ ID NO: 1871 - protein, 105 aa, Methylobacterium sp.
MAYDCAMRTGMRVRGVDNRELRQWFYDSRPMVFGFCLTAFVAIFWQVSRFEGFQPIFSCARTTDVDRQLLRLGMDACMGNARTQSDREGCMRTVHLLACMKERWR

SEQ ID NO: 1872 - protein, 65 aa, Methylobacterium sp.
MHFRIQATGQHLWTWVLLDETEMTVAESDRSFPSRTQASAAALAFAKLVARASRSLNGGASSGLL

SEQ ID NO: 1873 - protein, 28 aa, Methylobacterium sp.
MGIHMNLRDALAAYLDVGTQHIVVLLKQ

SEQ ID NO: 1874 - protein, 101 aa, Methylobacterium sp.
MGSKSPVRSGSSGAAAPEDDLFERTAPPHAPGAGRLLQRIADALQVPATSLYGPLSAERGAGVAGGRADEADALLHAYRRIDDPEIRRRVLTLVQDLAAAR

SEQ ID NO: 1875 - protein, 202 aa, Methylobacterium sp.
MPKTNASVGQTCPEAFQIALDSADMIGHWAWDPATDRVRVDALVALLFKVDPTAAESGIPLAVYEEAIHVDDRDRVDTLIRRSVAAGSSYVAEYRVISVDGRMRWVLARGRFTSDRRGRPTGGRGILVDITALRAREAIGGATAPDLGDMPLDRAVEHALAAQDAVAALGDPALKAEADALLMALGRRLARRQVAERRRRLN

SEQ ID NO: 1876 - protein, 158 aa, Methylobacterium sp.
MPTVQDIDRLVRGTAEHGDVISAPGATSCTSRRENFPEVAELEENSRLRRLLDRLSEAADAAEAEGQVPVGFGAALVDAVPDLRRRALMLTRDAIAGDVQGDDLVRLTLLKAWERRAAFRPGTGMPAWLDTFLRSRPAGGRAGPTGLSRNGVSAGMAR

SEQ ID NO: 1877 - protein, 55 aa, Methylobacterium sp.; identical to SEQ ID NO: 832

SEQ ID NO: 1878 - protein, 27 aa, Methylobacterium sp.
MLRGGLLWLLGIPLPIILLLYFLGVFH

SEQ ID NO: 1879 - protein, 76 aa, Methylobacterium sp.; identical to SEQ ID NO: 834

SEQ ID NO: 1880 - protein, 26 aa, Methylobacterium sp.
MTILDPITGELVTIAVPRPRPQAGPR

SEQ ID NO: 1881 - protein, 37 aa, Methylobacterium sp.
MAPGTMMRGDAPANVGVTVQGHDALERGRPGPFRPLP

SEQ ID NO: 1882 - protein, 71 aa, Methylobacterium sp.
MQAGAAARTRLGTTRDDCIGIIAQHPAVTLVRGLAPLGLECARCSLRSVTGGLDEVREVLSGCCSHSTTLS

SEQ ID NO: 1883 - protein, 244 aa, Methylobacterium sp.
LNFRLVGASTFQQHGREAVQGTGDLTVIDHHPGVLDARTDGQTLVMALPRERLESLLGPARLFAALTMPAGSATTRLVTTFFGDLLRVNRQLSPEAAERMATIGVDLIVAALADRMAREVPHALHGSVVVQRAKAHVEANLGDQTLDPPRLAAAMGVSLRRLQELFHERGQHISDWIWERRLAAAARRLSDPVSLHRPIGVVAYECGFATQAHFARRFKDRHGLSPRAYREAAILRLSGSRPDP

SEQ ID NO: 1884 - protein, 137 aa, Methylobacterium sp.
MAQEMRWQKREGDGRVHLAYEIPDSGAQSLALTCDTRGGQLSVDYYDDRDRARDGTRAEVEFASEGGTLSLPMRAKQLELDDQIVLQTTTTLTQDWVRILSGKTLRVTLSGDTQRIPLAGARTGLAALVAGCSRPSR

SEQ ID NO: 1885 - protein, 254 aa, Methylobacterium sp.
MARRVTTGGAGGTGILVGLLGLCLAGPALAGSTSVTARPGERVRLDGYATHETRPGCPSVPAAAIELVTPPRGGRIEQRREFLVLGQNIDGTPSRDGCQDVERDARTLYYTARPDFAGHDTVSVIVTFVTGEEATYTYRITVPEGEGRRAPAVSQAPAPRDAGLARPAPAARAAPAERATPAATPAATPAPAPREASTGDFLRDAVRGAVPATRPAPAAPPPKAAEAAAPVSGTPAPPPQQQLAPPRPPAAPQL

SEQ ID NO: 1886 - protein, 66 aa, Methylobacterium sp.
LSDLSAVGDGGAPLPGSRAATRQGDCTMKRQRETGAGTARFRADAAGSAPAERVPSLGLGVAAGRA

SEQ ID NO: 1887 - protein, 145 aa, Methylobacterium sp.
MAQAALSLAAFQTAYPSAESRRPAPPRPSYVETAYDPVVRTRAPYPSAMRRARRRARLTTLIALTGVSLAGWAVFSHPQGPARPEAESVAAAGPAAVPVPQAAAAPRPSLAWMLDRSPALGAGTATAFGGETPPVAGFQVAAAPS

SEQ ID NO: 1888 - protein, 31 aa, Methylobacterium sp.
MKKLLLASTVLAGMTAAASAADLPRRAAPPP

SEQ ID NO: 1889 - protein, 88 aa, Methylobacterium sp.
MAHDDSFTLDQAITAQKALRSSLGMKEEVFEAPEFVGMISDEIEQHRKAGKTDQEIAAIINQATGKGITAEAIAEHYASPEQRHPHGG

SEQ ID NO: 1890 - protein, 63 aa, Methylobacterium sp.
VAQRIGVSATTLKRSVIEGNARVLIVPGSWADARGARVTVHHYDGGWQGTFDQSGQLVAEHVW

SEQ ID NO: 1891 - protein, 328 aa, Methylobacterium sp.
VKTPQKTAKPATDLVALARTGTDLDALDAALAKARSQIEVATRDRDAAEASYREQILDASPAELEQIQAAKARAVVDLDRAEALTAALTRRIASVRNDREQDARRAQHADAVAKCDAIRQRLPAEYRRHALALRGLLRDLAEAEVAREQAEPLQADFGPIPPIENELRGLQSIPEQIIERTEIDLWVIDGRAEPMSADKQDDVQSKPGTNKGVYYSKNAGSHVGTGHPLHCTRRRFTRIRYHEAVREPWNSGSLLRLVNLPAFYAFGDDFVTSEQVRSAATALDHLSRELVERPEDQRPVQERFELVTAPLGDGRSGVRVSPPLRSVA

SEQ ID NO: 1892 - protein, 127 aa, Methylobacterium sp.
LRRAAPRPAGASLYRPGSGKPHAPAPPRAALGDLTGTVTLVPGSRIQQVLNTGRMLGHAEQAGQPVGDAPENGIGLLVIVLALYDDETHLRTRMVRSGPQLDTLRRVAWACRKSSDDYANPHVMNVM

SEQ ID NO: 1893 - protein, 159 aa, Methylobacterium sp.
MLRGVDILADAVKVTLGPKGRNVVIEKSFGAPRITKDGVTVAKEIELADKFENMGAQMVREVASKTNDIAGDGTTTATVLAQAIVREGAKYVAAGINPMDLKRGIDLATQAAVKDIIARAKKVSTSDEVAQVGTISANGDKEIGEMIAHAMQKVGNEGV

SEQ ID NO: 1894 - protein, 131 aa, Methylobacterium sp.
VLGGYLAAVAAAVTTLMLASAAGALFGTPPSPAAEPTLPSDLISVAITFVIATLFVTVFATPAFLLCLAVSIRTGWRHPTIHVACGGAIGLALGHLFAGMVERPLQAVSAGVVGGGVYWWLAVRERRWSGS

SEQ ID NO: 1895 - protein, 218 aa, Methylobacterium sp.
MRAVSDFHRTAARIGASAAFAFTAPVAHAASFDCARASTGMERLVCGDAALGSRDEILARLYSGALKVGKREAVEARQRAWLGKAQACATAACLAEAYDERNAELQRSEGGVKVGSGFFCEEPKGNHSTLNVVGPVHGFASVSLMSNYVGPGGVEAGDVDTAATDAFLDLQKGTATVLNGRCRLTFERLGADGWKVIQAGTCELRGGAVFAGVYRRLP

SEQ ID NO: 1896 - protein, 40 aa, Methylobacterium sp.
QGAFVINAANNFPVVYSGVGRRDDQFAVVRAGLNYKFGTF

SEQ ID NO: 1897 - protein, 76 aa, Methylobacterium sp.
MEADRPLSWIEAIIATNEDVVACERRFHSQCILVAHLAKRGQVAAEDEMLLASYETSLALLRAHRDNLLADALVGG

SEQ ID NO: 1898 - protein, 374 aa, Methylobacterium sp.
MAAAAGIAVANIYYNQPMLGLIERDLPGEITGLIPTATQLGYAVGLFLLVPLGDIVERRRLIAIQFGGLSVALALAALAPTASLVVLASLVLGLSATVAQQIVPLAAHLAAPERRGAAVGTILSGILTGILLSRTLAGFVATHGGWREMFWLGVPMALAAGALMMATLPHSRPDSTLRYGALLGSLAELWRSYPALRRAAATQALVFAAFTVFWTILAFRLQGPPYGYGADVAGLFGVVGAIGVFAAPLSGRFADRHGSRPVVLGGSVLTLASWAVFGLWTSLAGLVIGVVLLDFAMQSTLVANQHIVFALRPEARARLNTVLMGAMFLGGALGSAAATSVWQIGGWNAVVALGIVLGASATAVQALGGPGRDG

SEQ ID NO: 1899 - protein, 72 aa, Methylobacterium sp.
MSTDLPQGRVTFRGRGLAFAHGAKLVLKVCPLCSQWNAPRAADLGQCGWCAYTPSCRDVEPAPSRHDTDVTS

SEQ ID NO: 1900 - protein, 147 aa, Methylobacterium sp.
MPTVDHGALVGADLDRTWSVLRRFGEIATWHPAIAESRIEGDLPDGMPGCVRVLRLSDGGTLRERLLAMDEANYGFTYRFDDAPLPVDDYHLTVSVMPVTGEPRSFVRWTARFDVRPGHDAAGQVAVIRSLVAGGHEALAEHLASRK

SEQ ID NO: 1901 - protein, 69 aa, Methylobacterium sp.
MPDKPTTANTQDLAETEYDAERWARVGTVQRSIPPISPKAPSDPLEGPDVGLTQKGTDEDAVVKRKTEV

SEQ ID NO: 1902 - protein, 94 aa, Methylobacterium sp.
MVGRDDARFASTVAENAVTTCEWFRDGRRFAVADRQQIIADMERELLAAMPASSSANLAQACNRILSSIPDRGLPVPRVAGIDTDEGFIRMRPS

SEQ ID NO: 1903 - protein, 67 aa, Methylobacterium sp.
MLERLGYDPLGFSSNKDAEAWLEEDTPEAAIVDDPCDRELEGLFGVLKARNVDLIALDGPPPQPYRA

SEQ ID NO: 1904 - protein, 31 aa, Methylobacterium sp.
FVQRTPRGRVLTRHAYRHLGLPEPEPAPVAA

SEQ ID NO: 1905 - protein, 138 aa, Methylobacterium sp.
VFGVVIGGTGGRQTQDYFLEGGAVLTGTFPGRPYDTLGLVFAMEKLSPLGTANIRAARASVGLGTRNVESMQTILELSYGIQLTPAVRLMPNLQYVIDPDQTRFPFRPKPIPDAFVIGAKLSVDLFTLAGLAKGPGSQ

SEQ ID NO: 1906 - protein, 58 aa, Methylobacterium sp.
IDMRDPNSLFVSQAFRMRNRDLIYVSNAPFTEVQKVLTAFNGVTGPVASAATAYAYAK

SEQ ID NO: 1907 - protein, 366 aa, Methylobacterium sp.
MLPQYRWLWALTLLLASGGAGLLYNLLFVGGASMLAGLVYALAVGGTVLAFVPGLALSGVQTRLRRLPALVYMLAAELLYVVLITLGCALGGLVVWTFGLTDDSLSTAVRITPRFLAYSLAVSALLVFVMRMRDLIGGEVFVNFMIGRYHKPVQEERIFLFLDVVGSTAFAETHGDLRAQEYLSTVFATLAEPVRRNAGSTDDFIGDLAMITWPMKRGLKDARCVTCVFAVLDRIEADAAAWQARFGTVPRLRAALHGGPVVTAEVGVDRHKIAYFGDAVNVTARIEALCRPLGVDILISQDLLDRLDRLPDGVRARALGTHALRGRGAPLAVATLERGAAPDRLIPEQRPAPPVLDRAEAVAEPR

SEQ ID NO: 1908 - protein, 80 aa, Methylobacterium sp.
MVAGNSGAAAMTCRPCSITNGPDGTETPNASGRLAHWQLGLCTALMDRCIDRLGDVAETARRDSEADLLATAAEALRTRL

SEQ ID NO: 1909 - protein, 131 aa, Methylobacterium sp.
MPYLQLDVTGPHSVASKKRLAAQMSQTYAEMMSVDIRRISVAIRELGEGGVWRIPEAGGAPVPVSVMMLDIRKGRSAELRMEVAKALCAHCIEILGLHKDRLNVEFTQHSGDEMYHPTLGGYSPEWSPDER

SEQ ID NO: 1910 - protein, 152 aa, Methylobacterium sp.
MNETFDETSNTLAVMTAELVAAYVSNNPVPAAELPALIARVHGAISGLVAGTPAAQAGAAPQAEVEKPSAAQIRKSVRHDGIVSFIDGKLYKTLKRHLASHGLDPRSYRDSYGLPTDYPMVAPGYAEQRSALAKAIGLGQPGAMARRGGTDH

SEQ ID NO: 1911 - protein, 110 aa, Methylobacterium sp.
MSLTPTARCLAALALIPVFAAAAPESMRFTSQHVEWPTSDQVFPAEPGAEAISNTCLACHSAGMILTQPVLSKAQWSGIVDKMIHSYKASVDPADRQAIIDYLAALKPRP

SEQ ID NO: 1912 - protein, 345 aa, Methylobacterium sp.; identical to SEQ ID NO: 853

SEQ ID NO: 1913 - protein, 33 aa, Methylobacterium sp.; identical to SEQ ID NO: 854

SEQ ID NO: 1914 - protein, 37 aa, Methylobacterium sp.; identical to SEQ ID NO: 855

SEQ ID NO: 1915 - protein, 384 aa, Methylobacterium sp.; identical to SEQ ID NO: 856

SEQ ID NO: 1916 - protein, 38 aa, Methylobacterium sp.; identical to SEQ ID NO: 857

SEQ ID NO: 1917 - protein, 107 aa, Methylobacterium sp.; identical to SEQ ID NO: 858

SEQ ID NO: 1918 - protein, 64 aa, Methylobacterium sp.; identical to SEQ ID NO: 859

SEQ ID NO: 1919 - protein, 281 aa, Methylobacterium sp.; identical to SEQ ID NO: 860

SEQ ID NO: 1920 - protein, 82 aa, Methylobacterium sp.
LKQIRGLYHRWARSGPVRASGNPLIRLAARRGLPAADDLVTADAQIAALAPHVDAAFYASWYGIAADPVRDYLVHGWRAGRE

SEQ ID NO: 1921 - protein, 33 aa, Methylobacterium sp.
MPTMISVVATGNRMNGAEMPPFMAGPRAGTRPP

SEQ ID NO: 1922 - protein, 77 aa, Methylobacterium sp.
VSDTDAQPDEIQEILRLATALAEQFLQSEAEESARPERLKALISAAQFLHDHDVAWPTVLREAVGKAVERMEAVSGR

SEQ ID NO: 1923 - protein, 270 aa, Methylobacterium sp.
MMMGDDRTQGDAEVTQQVKTIEDVLGLRRAGAGALGEDVGAVASDDLDARMGAQPSGDAPGVTIGQEIEDGVTFEVDEHGAVAAPAPPSPLVDADDAGLGLCRQRRRTHEAHEGIATHGHRETMGHTGGGCTTEGETEMTLEHAQPLGSAGVSDSDVTDALAEGPPRAGWVRTAETSQPEAQADGPALPGQIGEGALAVTVLAACGRSTGGTARRARTGYDAHDERVSRRLDADDGQAIGHEGQDTAGHGVLREADLRRWGTSRWPAHFA

SEQ ID NO: 1924 - protein, 133 aa, Methylobacterium sp.
MTVAPDRLSPADSALLVRIVQDPDAATLHRLIQRFVVFVREAGRKRNGSSAHGDRRLAAFGAWIVEAKASGIRAAQTFASGLVVDAAAVRAALTMPWSYAQSEGQITKLKLIKRLMYGRAGFDLLRRRVLLAP

SEQ ID NO: 1925 - protein, 392 aa, Methylobacterium sp.
MSSPKSTSSTSSLQQSGSDTAPGSVMALLRRGLGRWTALLARIPTLGPAAAAASIPVTLPADGQFTASVGLPADAAAASDTGVASLTALAKRALGNWTALLARVPALVAGRVPVDGSGVTQPVSAAALPLPAGASTAAAQGTGNASLASIDGKVPALVSGRTPVDGSGVTQPVSAAALPLPAGAATSSLQTTGNTALGAPADAAYTGAGSSSIVAALKGLYAAMVAATPAGANIIGKVGIDQTTPGLTNGVVVNASALPARAAQDATLSARLGTLGQKAMAASTPVVVASDQSRLPADTVVPAVATARSGTIAAGGTAQQLMAANASRRGFVVQNQSSGDLWVNGTSTATADQNSLRIRPDAYYETPAHHVGTGAVSILGATTGQAFYAREF

SEQ ID NO: 1926 - protein, 135 aa, Methylobacterium sp.
MRTALAALALVLAAGEAQAAGKVALTVSELLAEPKGHRGETVVVRGIRCVDPGPGGFICEDAAGGQQLRLDASGLGGGTTEAIAEKLIGPCNGLAALAKPTCTFDVTFVPTGSGFEDGVTIINTPEIDMSVPRRR

SEQ ID NO: 1927 - protein, 65 aa, Methylobacterium sp.
GYGGCYGGGGGGAYGGGGGYRNDGYDDRRDAYRDRRDYDRPPPRRSYDDDYGPGPRRYRGDPDEY

SEQ ID NO: 1928 - protein, 318 aa, Methylobacterium sp.
MAGRRPTRAQIELRHLRYFLTVVDELNFGRAAERLRIAQPGLSQQIKALEEIVGTPLFDRSRRAIRLTLAGELFAEEARRALSQVERGLLLARKASRGELGHITVGYVGSAAYTGVLTTIVGQFRQAFPDVQLDIAEMEMSRQLEELGEGRLDVGFVRPPVELPPGVMTVSILQEEIVAAVPARHPLADLPRLPLAECRDDIFITPHHAPDVSFAHHTISACRAAGFSPKLGPQGRDFTTIVSMVSVGLGIALVPHSVGCIALPGIRYRSLEGTAPTSELAVAFRRNDPSAAVRAFARHVRNGAHSDPSDKSAFSIMP

SEQ ID NO: 1929 - protein, 67 aa, Methylobacterium sp.
AGGRARAGAEALQAARALRAAGLPALVVDTGTRGDEARSVADAMGARYLKLPRAEAGQLSAAVRAAL

SEQ ID NO: 1930 - protein, 89 aa, Methylobacterium sp.; identical to SEQ ID NO: 879

SEQ ID NO: 1931 - protein, 57 aa, Methylobacterium sp.
MTPADRDRFEKCLALADQGATAGERAAARAAAERIARGAGLTLAAAAEALRRSGQAS

SEQ ID NO: 1932 - protein, 47 aa, Methylobacterium sp.
MPTTGECWRRPHTRNAARTVERDRYLPNGSPGRMVDEEADLESNTIG

SEQ ID NO: 1933 - protein, 354 aa, Methylobacterium sp.
MFATRFIRRGATVAALPRGCEISPLDPDGHPVSVEDVMARTRTAGLLVLKRGEIVLERYGLGLTEDARWSTMSMVKSLTSTLVGAALQDGHIVSLEEPVSRYVEALRGSAYDDVAIRHLLTMSSGVGWSEDYTDRRSDVNRYSKSLGDKVPGGVLALMRSLPRVAAPGSRFNYNTGDTYVLGCVVTAATGKTLAQYMSETFWTSLGMEQDAFYTLESEGGQEIGGSRAGMTLRDLGRLGAFLCGDGTVNGRRILPEAWLDEAGRRHFAVEPTMNSFGATGYGYSWWIPAEGGIAAVGFAGQSLVIDRRTGSVIVTLACRPQPPFDAAYGIDFKTEATAFRQALLRSLMDVAAAR

SEQ ID NO: 1934 - protein, 79 aa, Methylobacterium sp.
MERYELVEGSAAKFWEVGVSGPTLTVRFGRLGTQGQSKDKTCVDAAAAVKEKDKLVREKTAKGYVRADGAAPAPAPAST

SEQ ID NO: 1935 - protein, 136 aa, Methylobacterium sp.
MVLEACPDVVLYARDGIRSWSDLAGAAEVVRPALGIGPDVWEAALAAMGRDHALSALSAILQRAESIGAPGAYLRDLTRKSRSGRFSAWPMLFALWRQRRRASADGPSGPVRVAGVDRGQHARPLGSGAARASTFC

SEQ ID NO: 1936 - protein, 274 aa, Methylobacterium sp.
VAQKSGHEVRLVPAVYVKPFVKRQKNDRADAEAIAEAAARPRMRFVAVKSAETQGRAVAFRTHQCLVRQRTQLINALRGHLAEFGVVAPKGPAYLKVLEEALADEVADLPVAVRAMGTIYLDQIAGLTQVIERLADELETASRTDTDLRRLCTIPGIGPVTAGAVAAFAPDLDTFASGRNFAAWLGLVPRQRSTGGKAKLGSVSKMGQTDIRRLLIVGAMSVIRWVVRKGGSANRWLATLVTRKPKMVAAVALANKMARMIWAVTTKQEDYRMA

SEQ ID NO: 1937 - protein, 44 aa, Methylobacterium sp.
MILWQSRGRGLPVAGLTRESQHIRAARAPKGLRGRGAEAKSREP

SEQ ID NO: 1938 - protein, 64 aa, Methylobacterium sp.
LIVFDFPGFGLRVGAGGSRQRIVQYRNAIGQTKRDTLGRVVLLDRCLASGERAAGAGQARVGFA

SEQ ID NO: 1939 - protein, 33 aa, Methylobacterium sp.
MAESVARALFAASGSFSFKITPRRSATVARLTA

SEQ ID NO: 1940 - protein, 145 aa, Methylobacterium sp.
MKTLTIAGTALCALILATPSAEAGGFRGGGFHGGGFHGGGFRGGYRGGYGYRGGYAARGFYGRGYGYGYRGGYGRALGYGLAGAGIGLGLGLAAGSVYGGYGYGGYGYGYPAAYGGYGYGYGYPAAYGGYGYGGCYGSFTCGCGC

SEQ ID NO: 1941 - protein, 57 aa, Methylobacterium sp.
MTSTVRVTLAALVTASLAACASAPAAQPELTPVPRPRVDAKTQLEYGNPPPPPPGRY

SEQ ID NO: 1942 - protein, 37 aa, Methylobacterium sp.
MMLGGAIRPATVFEIAGLCPCVQVALLLSVFIFLIEY

SEQ ID NO: 1943 - protein, 42 aa, Methylobacterium sp.
LIQLKAGAVNLRASARLRWIKALARATRDILQASTLCCLMAH

SEQ ID NO: 1944 - protein, 46 aa, Methylobacterium sp.
MATPPVIEANDLSHPADVTANAARADLCRARGSARAFRPSGAARAD

SEQ ID NO: 1945 - protein, 64 aa, Methylobacterium sp.
MISSATSAATSAICKLRLIYFDANCLQAAKHHASNALSSIDAHVSNLSTHRFRHHHLDRDFFIV

SEQ ID NO: 1946 - protein, 91 aa, Methylobacterium sp.
VTLAELHDLDASDRAEAYRLRRDTRIDAILGAPEAEAEERKLVAFALALRLDLTPDAAVLLLRQAPELRTVDAVSSWVGAIPVQPHPETRH

SEQ ID NO: 1947 - protein, 88 aa, Methylobacterium sp.
MRRHIGPAAGRLVASGRFRTFRAMETAVVLFQDPALRTGRNQIHLCEVDAASFRGFGRELDALTDSDAPEGGFAGVFADLAPMRTIPR

SEQ ID NO: 1948 - protein, 115 aa, Methylobacterium sp.
MADDTETGADHGLRSPLRRRLLMGLAGAPALALLPRTAWAAPPTAAVNTTGLAVTDSEVTVGILHSVTGTMAISETGAQEAEKLAIQQINDAGGVLGRKIKIIQEDGASDWPTFA

SEQ ID NO: 1949 - protein, 88 aa, Methylobacterium sp.
MCPRARANPLLAIITKADFFESHSDSAAGARTHAAAVMLAAGHMTIVIGSSDPPTDSQRERASRIPMTGSILPQKNAEYCSARSAGPA

SEQ ID NO: 1950 - protein, 44 aa, Methylobacterium sp.
MHVRRFNAWRRLSTRRVALLRLKRGAIPQIAITAGSAPSRAAPS

SEQ ID NO: 1951 - protein, 35 aa, Methylobacterium sp.
MALSLCDAAGAPSARGALMAFSAGLARLVHIVASV

SEQ ID NO: 1952 - protein, 27 aa, Methylobacterium sp.
MDTRMTILGQIRVRDGRIGRSDAVDCI

SEQ ID NO: 1953 - protein, 279 aa, Methylobacterium sp.
VEPDRAGDRGADRQAESHVPERRDAQTRDRAAELGPLTGVEAADSAADGAAVAGTGTAVPFAGRTATAALGTGRVAVAPLGSGTRLAATPIAGTAFTRTAFTRTAFTRTAFARTAFARTAFARTWIRGRAAPVRRSVALGRAARATRSLGAARPTLGTAGTAHRPAFGRAAPHPAAGAASRAAGRAAAGRTRARAGPTTRTAGAAARTTGSGPAAARSALRERRRRSGDDDGGRDRVSQNSLHGFFLLWWSERHRRPRRPATGPRAEPFPPAAPWTRGR

SEQ ID NO: 1954 - protein, 26 aa, Methylobacterium sp.
MFVMRITFSGSKLLIEDGIADFPPDA

SEQ ID NO: 1955 - protein, 68 aa, Methylobacterium sp.
MADAAIRETIHLDEGDVIVLLPGNLSPASIGLLQAKLDGLAADLNARCLEESRASLSGLAGLAAFLAS

SEQ ID NO: 1956 - protein, 112 aa, Methylobacterium sp.
VPPTRRGGFLPVRHRHRRGQPALRPEAGFGYETEIALDPVTRRGATDAPRPLAQENVLITDPQALRAQAGARASRRQDRAARWSPAFRAIAGGVRADIGAPPRGTLGTVARS

SEQ ID NO: 1957 - protein, 249 aa, Methylobacterium sp.
MKIVVIGGSGLIGRHLTAELKRAGHEAVPASPSTGVDAVTGAGLAQVLVGADTVVDVANAPSFEEAAVRDFFERSSRNLLAAGRQAGVKHHVALSIVGADRADGNGYFRAKVAQERLIAASGLPYTIVRATQFFEFVATIAEAFAVGERILVPDADFQPIAAADVAAALAAVAVGAPVDGTIDVAGPERLPFRAFVARRAAAAGDGRAVTVDAAARYFGAALARGSLVPDDAAAARLGDTRFETWLTTA

SEQ ID NO: 1958 - protein, 183 aa, Methylobacterium sp.
MTRIALVSTALLAAVAFAPTVADARGFGGGGFHGGGFGGGGSRGGSVGGGAFRNGGFGGGAFQNGVGGARAGGLGGDFRGAGLGVAGVGGVRTGGLRAGGYNQAGRFGGVGNRGIAGRGLVNRGYYGHRYGRGVGYGLAGLGLGLGVGYGLGGLDYGYDNCAYTYDYGAYDPAACNGYYGYGY

SEQ ID NO: 1959 - protein, 47 aa, Methylobacterium sp.
MQPGSPHAIQRHLGRKLQGMYAQIPATPLPDRLNQLLAQLDTAGGTV

SEQ ID NO: 1960 - protein, 29 aa, Methylobacterium sp.
MRSEIAAKLVTGRGPRADTPCGAAAVRQR

SEQ ID NO: 1961 - protein, 27 aa, Methylobacterium sp.
MKWLGFDRRVQREGVIAAAVSDIVEAV

SEQ ID NO: 1962 - protein, 33 aa, Methylobacterium sp.
VTQGSATSGGVARLDCFAPLAMTAVPFLDSADG

SEQ ID NO: 1963 - protein, 97 aa, Methylobacterium sp.
VTADRVKDPNNLKLKTLVNGRVRQDWSTDDMIFNCRQLISFASRVMTLKPGDIFYTGTPQGVIFGEKIPRKDRAWLKPGDEVVSELEGLGELRFRLV

SEQ ID NO: 1964 - protein, 89 aa, Methylobacterium sp.
MIIAAALLAALGSAVAIPASAAPIGPGTGVSAPAGMVSTVQMDPVERHMMRRRMERRMMRHRMERHMMHREMRREMRHREMRREMMRRM

SEQ ID NO: 1965 - protein, 200 aa, Methylobacterium sp.
MTSKLRGTGQHGHAPPVAPDAGRRAFLGAAALGVALSTGARPASATTAAPATAADETFMRAAIAEARRADFPFGAVIVAEGEIRARGLNLGKQQRDPTAHGEMVAIRRFLAEHGPEALRGTTLYTSGEPCAMCMGAIVWCGISRVVFAASLQQLATKIDQIMITCTEVADRSPFRPIAITGGVLAEEALALFPPGDRPSK

SEQ ID NO: 1966 - protein, 200 aa, Methylobacterium sp.
MPTCDTAEVQPDRSPAPTLPELFLLFNRLTLVSFGGGLTAWARNLIVEEKRWLDDTEFLSAYALARVLPGANQANFAIYVGHRFRGAAGAVAALLGLTLVPFCIIVSLAWMYFGDGATPAVQDVLRGVTAAAVGLALSAGLKAGEGLGRQPAALAFIVLAFAGSALMHIPLPAVLAILAPPAFLLAWRHVRRRDRGPAGP

SEQ ID NO: 1967 - protein, 43 aa, Methylobacterium sp.
MAARVTEIVDRAGDALRAAALGLMPAPAPVPVRVRARGPRRQD

SEQ ID NO: 1968 - protein, 42 aa, Methylobacterium sp.
MLRKTACTALMAALAAGSAGGCTYMPAAGPTASAIQAGAEVA

SEQ ID NO: 1969 - protein, 36 aa, Methylobacterium sp.
VIVMMLERDGSSPVRFRTALFGRAPLLRPLSPVSLL

SEQ ID NO: 1970 - protein, 301 aa, Methylobacterium sp.
VPAEIETPDGLPFQGRLDVTCIGAMPISHFWHTTVRTRITDAEARRRGNPDRVFVLLKLSGRDTIQQLDREAKTKPGDLILLDSSSSVMEAETGDSLVIDLPRQRFETVLGPSRLYTALTAAADLASTTLTGSYLQELVRVSDRLTPDAAERMASIGVDLIVASLAERMAQEAPRSIHGNVTVQRAKAYVEANLSDPNLDPPRLAAAMGVSLRRLQELFHERGRHISDYIWGRRLEVAAKRLTDPACAALSIGLLAYGCGFSSQAHFARRFKDRYDVSPREYRQAHRPDVEVSASASGLSS

SEQ ID NO: 1971 - protein, 116 aa, Methylobacterium sp.
MAASGSRPHRGAASGRPPEPVAGCAPRRGRSAAVSRAVEAASPIRGWTVPIRSVAVAALALALPLCGCVSGRVPSADIAVAEPPTAAPAAARPPDPALDPAIVADSSGWRLRLTHL

SEQ ID NO: 1972 - protein, 28 aa, Methylobacterium sp.
VRGRRALGRALLTALVLVGVAWVAFHLR

SEQ ID NO: 1973 - protein, 174 aa, Methylobacterium sp.
MKGAVLGSALLAAGALALAPASADARGFGGGGFHGGGFGGGFHGGGFGGGFRGGGFGGFRNGGFGGGFRGVGFRPGGFGYGRGFYGRGYGWRGGYGYRGGYGYGLGGLGLGVGLGLAAGGLYGGYGGYGYPGYGYGGYYAPAAYDYGYGGGCYTVPRVRWTPYGYRRVLVERCY

SEQ ID NO: 1974 - protein, 89 aa, Methylobacterium sp.
MEEILASIRRIIADDQAAKPAEVAAPAPEPDDVLDLAEVAEPVMRPRVVEPEPEPEPAPDLLDFDAIDFEDPVTAAPEPEPEPEPEPAP

SEQ ID NO: 1975 - protein, 39 aa, Methylobacterium sp.
VSRPGRAPARRSGRDYTAVTLIGAGLTVLALALLLVGIP

SEQ ID NO: 1976 - protein, 47 aa, Methylobacterium sp.
MPPHVTAARHALRAGPRAAASLPARGVEAARVAGDRAERPRRAEAVG

SEQ ID NO: 1977 - protein, 233 aa, Methylobacterium sp.
MHARSGDMNAPDLFSFEPAVRTFPVVEVEGIRAIVERDQWCCFYAIDAGRPFPSETGFRSAGNDRPGPAEDILAAVIAEQRKDKKGPFPIPATVYRQPFAGEDRPQPANGAMVALRQLAEAPLNVDLILAVYANDQVGKAWGTGDPEKLVEITQRILGEGFRAESSPDGDGFAVIAPSGLRLPARGFFPAVHNLRCHVARITREATRATMPALFQARKRSARSAPAPLFTPAE

SEQ ID NO: 1978 - protein, 43 aa, Methylobacterium sp.
MASNPTVSALHEAAELSDEAIDLDPRQRGRRRRRASPTFIARR

SEQ ID NO: 1979 - protein, 47 aa, Methylobacterium sp.
MTEIADESSETLDRIGEALGSGLLSKMMTIIYIEPRRARCRVDRRAI

SEQ ID NO: 1980 - protein, 56 aa, Methylobacterium sp.
MTTAVMPGLSPDQSSPHRHRERSEATQGGAPSLSMALLDCFAPLAGTGATVSASGL

SEQ ID NO: 1981 - protein, 81 aa, Methylobacterium sp.
MIGAAPAAPTRESGTDHAAGPMAGVDGPARAEGRTLSVAVRADGAAPGGRSLRSGDLRGRRADDARTRIPTPDCTEAGRRT

SEQ ID NO: 1982 - protein, 96 aa, Methylobacterium sp.
MPKGVMKPVAVGTDNGSTRRTSAGLTPGKCSEVFRRVDRAEASRRTAGHGLSLIAAVADIPGAPVTQDFPPAGGELGRPRGGIDEVSRIADRDAGM

SEQ ID NO: 1983 - protein, 31 aa, Methylobacterium sp.
MTKLLASLTAFTALTAAASAADLPRRAAPPP

SEQ ID NO: 1984 - protein, 293 aa, Methylobacterium sp.
MITAEEAFETYRQRLELSETERRSTIKRHNEVRDVIRADFAVDRDLLTGSYKRHTKTKPLKDVDVFFVLGQKERDAYRSRPPGDLIDAFVKSLRAAYGERAVEPGRRCATVAFERNTTDEEGKVLSIDAVPAFDLGDCYEIPDRVRGDWVKTDPEIHMEQATAKNKELGGKWIPLVKMIKRWNRSAGKPIKPVFLIEVMMQDLVDAPFTTYPSEVRRFFAAALDAIDRPWPDPAGYGPPVSEQMTPQLVAAAKERLRQAEMKAALAVRLEKQGKQGEAIALWREIMGRYFPTG

SEQ ID NO: 1985 - protein, 445 aa, Methylobacterium sp.
MVAVLAGVALATLDTAIANTALPTIAADLGVDPSASVWIVNAYQLAVVATLLPIAALGEIVGQQRIYFHGLILFTGASLVCALAWSLPALVAARVLQGVGASALMAVNIALIRFIYPARHLGRGVGLNAFVVGVGFAVGPTVASLILAVAPWPWLFAVNVPIGLAALVLATSALPVTGRSGHTFDLPGAYLTAATFALLVLGLGEAAHRGPLWRTLAEVAGGLACGAILLRRQAGHPAPMLAADLLTRPLFALSAATSVCSFAAQGLAFVSLPFLFQHALGRSQVETGFLMTPWPAVVALMAPLAGRLSDRFPPGLLGGIGLAVLAVGMALLATLPADPSVAAIGWRMAVCGAGFGFFQAPNLRAIMTSAPPARSGGASGIVATARLLGQTTGAALVAACFGISDARGPALALGIGAAFAGVASVVSFLRLTVRPGTDAAAERSA

SEQ ID NO: 1986 - protein, 77 aa, Methylobacterium sp.
VGPLARALRDETETTGQPRDFYLKLISLRFLRLQIIYNMSGRRFVRQREVFCSTAQPAAFPPWLLIRSLISAAEIGD

SEQ ID NO: 1987 - protein, 29 aa, Methylobacterium sp.
MPDERGENHRAAERARVAAAVRALIAGTQ

SEQ ID NO: 1988 - protein, 119 aa, Methylobacterium sp.
MTTRLCIVGGGPARTMAGLLFVRASLDVTVLETHADFLRDFRGETIHPSGRWTSRASPSASAPSPRQSRVIAASLAADVPVRAPLALRLFDALPRLQVLPALRIGMDVRPEHVRVSLRA

SEQ ID NO: 1989 - protein, 29 aa, Methylobacterium sp.
VRAPNRPEWPGPMNEEERAALKAGWSFVE

SEQ ID NO: 1990 - protein, 255 aa, Methylobacterium sp.
MASRPAKGVDWAAMAPETADLIRQAGTRITERRDNRLGVKRDWLRDGFDIARIREAAPHGTFHLLIAELTPYVPHHARDLARAADMLAEAVKTEIISQIPDAPATVCVELAKPATPQHVRDKFLPLVLAGERVRVTDIKAACNPEADQEVTPDVPVEVPVVPARDVVEAVDSMSDTAFRTVIAALTKGRTEELVRALEWRAAKPAVPHADRIAEKAKAAVRTLPLLEGVLPEETVVAPTADDDGASDAADAPSLH

SEQ ID NO: 1991 - protein, 119 aa, Methylobacterium sp.
MERKSRHFRTFADDMKQFADFSDVADRDLDGRTPLLPNGYFSYGDALALTTVLATRRPAQYVEVGSGNSTKFARRAIGKYKLDTKIECINPIRAQASATLRISGFLTASSMLTRPTFNR

SEQ ID NO: 1992 - protein, 49 aa, Methylobacterium sp.
VKQGIGSATGNDKLKAEGKAQELKGEAQKTTGNVKDGAKHVADKLTGKV

SEQ ID NO: 1993 - protein, 292 aa, Methylobacterium sp.
MTALETIHGADALHPRLGETVLGAPHRIGSNFSAAHFSEEAFDGRMDPLLMVDHFVMTGPTFEPHLHAGISAVTVMFEDATGHFLNRDTLGRDVALEPGDLYWLAAASGAAHEERPAEGARVHALQVFVNLPARLKAQPARALHVRAADIPVLEGRGHRVRVVLGQSGDVVGAGGTPEEMTLLDGFLQPGGAFAHALPEGRQAWIYAVSGRVSVRCREEERLLPEGGALAVGAGSAAEIILEAAEAAHVVLMAGRPIREPFVKRGPLVMSTVADVERALAGYARGAFGRIPA

SEQ ID NO: 1994 - protein, 33 aa, Methylobacterium sp.
LDAGIRHPVALAADGDRPRLRTPSTDPAEIARA

SEQ ID NO: 1995 - protein, 303 aa, Methylobacterium sp.
VLDLNDFFYFVQVVDRGGFTAAGRTLRVPKSTLSHRLQQLEAALGVRLLNRTSRRFGMTDAGEDFYRHAVAMLREAELAETTIRQRLTEPTGTVRCTAGIATMQFALADIIADFLVRHPKVNVVAHGADRTVDIVGENFDIAVRAHTDPLPDSNLVQRTLAPAPWFLFAGSAYLDENGAPDNPDALRDHPSLFMMRTGVAPVWRLRHASRAGDEAVLPLSPRLMGDDMVGLQQAAIRGIGVVALPSYICRQAVRSGALRRVLPDWVAGDSTLTALIPYRQGLLPSVRAFLDHLAAEFPKAVLL

SEQ ID NO: 1996 - protein, 37 aa, Methylobacterium sp.
MTTIIARLLIVISVIGAIACAPMLTPASAAGLLAQTR

SEQ ID NO: 1997 - protein, 29 aa, Methylobacterium sp.
MGMQSVILLVIAGNFACAFLIPYLAMTGA

SEQ ID NO: 1998 - protein, 82 aa, Methylobacterium sp.
VATTIAAAVEQQGAATREIVRNVGQAAQGAAAVTGHVAGVAAASGATEAAAGEVLGAAAALSAQAAHLTEEVGRFLDGVRAA

SEQ ID NO: 1999 - protein, 62 aa, Methylobacterium sp.
MAEAAVRQATYADLEAVLAHRVAAKVDGAPDPRPRPPYDAVPFPLDDLFPFDDPAAPALPET

SEQ ID NO: 2000 - protein, 68 aa, Methylobacterium sp.
MQSDIAEVKRDVAAIKTTLTGHTEKLEELEIYVAYETGLGTQAKADLQSIKKTIKAMEQRLSALETSS

SEQ ID NO: 2001 - protein, 255 aa, Methylobacterium sp.
MNGYPTCRCRKPRGRPSAAVASRSPASAPSGWPWRALDAGAISGLRLTAVAVHDAARARAALAALAEPPEVVTAFDALEPRADIVLECAPSQHLPAIVRPFVAAGKTAIVLSCGALLDHEDLVATARAHGGQIVVPTGALLGLDAVTAAAEGTIRTVRMITRKPVRGLVGAPYLAENGIEIGGITEPMRIFAGSPREAARGFPANFNVAVALSLAGIGPDRTELEIWADPGLERNTHRIEVEADAARFAMTSRTS

SEQ ID NO: 2002 - protein, 144 aa, Methylobacterium sp.
VGDIMRAWLVAGVAFSTLVGSIDTVEARGRGRLFFGRSSTAQRPASPPSVAATDTAPSGRAGYRPIIAIAPAPIAAAVPAAAAAAVANTPAEAREPELRPQPTLLRPPPETPRVQAVRAVAPSCETGRRVGGVDRAEAGFCLIN

SEQ ID NO: 2003 - protein, 89 aa, Methylobacterium sp.
VFGQGEHVSQPELQAPGYGVIADLDNVGDVEGQMRQVGLVFIRVALLGGIAVRVHTVGRCPSIISRTTTAPQVGEVVCTTAAAEWNSQW

SEQ ID NO: 2004 - protein, 30 aa, Methylobacterium sp.
MQHTAQDKARNMARDMARRADPLRAGSFSA

SEQ ID NO: 2005 - protein, 65 aa, Methylobacterium sp.
VTELESVERDIALLRARVRYSRLAIADPNITPEAIDREHAGLDLFGRRLCALLTLRDDLRFLAED

SEQ ID NO: 2006 - protein, 231 aa, Methylobacterium sp.
MVVGFALLILAGLAAAAAALASADADAWAVHSAEVRRAEARLSRLIQEAETGQRGFLLTGDLTYLDPFTTARRELPAAEAELRYLTGDNAEQQARLDQVRPIISEKVAELARTTERMQAGDQAGALAIVRTNAGRDLMRRIRATVAEFDRAEIELQATRAERAAFRRSILVAVIVIALFLAAALAWLFIRTDRHRTRQLRSANDALRDEILQRERAEAQLHAQRLLQQREA

SEQ ID NO: 2007 - protein, 80 aa, Methylobacterium sp.
MEIVMKLHLLAAVALVAVATPALAQGIDSKHSPYPASAYSGYAGNASVVLPEISVTHYRPALAYRYSGQHAGGPADALAR

SEQ ID NO: 2008 - protein, 75 aa, Methylobacterium sp.
MTLADLDKPAELTVWPGHAPAHVADARSFSTLRAALAAAAEAIDAEDAKPWIITESGDILAPNWIRANTGSSRLQ

SEQ ID NO: 2009 - protein, 60 aa, Methylobacterium sp.
VVNMSIAILMALVAGALCLGMLSAFVQLRPKADEGEDAPFGFEDEFFDLGGPVIDMEPSR

SEQ ID NO: 2010 - protein, 84 aa, Methylobacterium sp.
MTPREQAAFAAGIETARQMALTAAVTIEVRGDGVALHGRMHRVLHGVVGVPMPLAVRGMRLWLPSGRREHLRHAGLRDRAAPDP

SEQ ID NO: 2011 - protein, 95 aa, Methylobacterium sp.
MRSDHLVADHASSEDIASSPAFARAPEGNGCAERFIRTLKENLLWVEHFDTVEDLRHALLAFRDLYNETWLIERHGFRPPADIRAAQLLPAAIAA

SEQ ID NO: 2012 - protein, 161 aa, Methylobacterium sp.
VARYCESAAELLAGNASLAGRDLSMSEALAGVYTDDVAWLRSQMRQAVSGSDVRIREHRVCSEQHGVRRVLCRGRTYFDVQGRPTFTLGIVIDITEVEADGRRRHADGPDKLDAAAEHGVAAYEAIQAAEIEGLIAPARALLLAIGREIARGLTRGRKPLH

SEQ ID NO: 2013 - protein, 35 aa, Methylobacterium sp.
MCSSAKFRLDEAITRQIVEEVAVNVLMRMDEEQLI

SEQ ID NO: 2014 - protein, 149 aa, Methylobacterium sp.
MTEETFDRVPNGIELAGDIVAAYVSNNPVPVAELPSLIRSVHSAISGLTSASASVAAAPGAASEAAINKPSASQIRKSVRDDGIVSFIDGKTYKTLKRHLTSHGLDPRSYRDRYGLPADYPMVAPSYAEQRSTLAKAIGLGVPGGRGAA

SEQ ID NO: 2015 - protein, 50 aa, Methylobacterium sp.
MLGPRHIPAWFAAVILDEVGAFRVALQIGDLLPSSQCEETDTADRAEREK

SEQ ID NO: 2016 - protein, 53 aa, Methylobacterium sp.
MIALETFPILDSAPPPDLITGRRGLVLFLTVGAGTRRGPRCRMGEGGWLRLNA

SEQ ID NO: 2017 - protein, 51 aa, Methylobacterium sp.
MLASDLAYHALDLVYSGLDRFGQLLQILDFYAARFFLRPPNAVVDHAQHAT

SEQ ID NO: 2018 - protein, 150 aa, Methylobacterium sp.
MAGRTFDEWTVGDTIHHDIRRTVTETDNILITTLTHNPQPLHLDAEYAAETEFGRVVVNGTFTFALMVGISVGETTLGTLVANLGYDKLVMPKPVFVGDTLRIETMVADLRPSKSRPEAGIVVFEHLARNQRDEIVCRCLRTALVKRSVA

SEQ ID NO: 2019 - protein, 40 aa, Methylobacterium sp.
MFAPALTLALLLATGLVTGLGLVIRAETTASGTAPGRGLI

SEQ ID NO: 2020 - protein, 40 aa, Methylobacterium sp.
MSPHDYTWLLFATPAAVALLGAFVYVAIGLQDRIDGRCDR

SEQ ID NO: 2021 - protein, 143 aa, Methylobacterium sp.
MPSVGAGAIHPICFSRGPSRKTNPKLGLLFIDFETPHRLRLHGTARIARDARDLERHPGAELVLKIDIAEVFVNCPRYIHRYRREAASGFVPGRARAGEVPAWKRIDLFADVLPDRDRRAIDPRDTGTMTLADYRLLLERGET

SEQ ID NO: 2022 - protein, 40 aa, Methylobacterium sp.
MAARARLGSITATVRLVSVIVARYGAGLLLEAGPARAAAS

SEQ ID NO: 2023 - protein, 261 aa, Methylobacterium sp.
MSPEVSPEISAGATGPGARRGTWPDRRPGSLIARLFGPDADDALPSRYRLQVRAGLLDETLKLATYSAVTHLIIALAVAYFFWGSASHTYLLGLLAVVAVLITAATYATWLYWRTHGDTASAHTVRWGCRISAGLAFALGLAWATLPVVLFAPSGGDARLLVVAIVAGLISDAYVVGPLLSVSYLFAVPVIVGSFVGLARSGEPVALSIGFLLAVYAIFVVTSVSRMSRLSRQRILDRVRVEDQSETIGLLLNAFEANASD

SEQ ID NO: 2024 - protein, 756 aa, Methylobacterium sp.
MLDQSFPRDTAEAISDGALRAAPDALRGLRVAVVASSASTTQRFEGSPAGTAAHVVSLFSLIQAETILIEYGRATPQERQERMTLWRARGLGYITINMLDQLPADRPELRSYFLYQTLKEYDFDIIVFLDQGGAGYYCALAKRQGLAFSNCMIAVIGTELHQVDGRFYLPSSALDLTSDFLERSTIEQADAYWPTTPAIADSLRAAGWALPRDTAVRPEILLNLDLVSEARNSRPSSDPHVVICYVSEQPYADDFVDFLRSTSELFQSFGEDVRQLGTPLVLVCGLPVSPLERAALAAFAEQMRDLSVRWELSDTISWRQLRAFAQNGRVLSIVGGSGSAFACAQLAQAGSVVLMRDSERMHGLFDFSRRVHTTFALGRCNLVEAMRAMLQGPDDVASVRPRAPDHARAAWSAAVQTLVATPSALEAATAQTSPDEAGLSAPAILKAGVAVSVCMPTFNRVEELREAVNSLENQTDGNFELILVDDGSTADAALAAQAEIVASSSFSCRRFEQANAGPSVARNLAAEHAAGEYLLFMDDDNVATPNAVEIFRRSATASGADFLTCVAGIHPSSEWGLSGSLETFYVKEVGSDCRFWGPPVGPNASVGLLFNCFGDCNSLVRKTSFLSLGGFKSFMYEDLELFMRAALEGAKVTVIPEILYLYRFHRASRSRTERLLEACIESVQPALARVHPALHSTILMARSRMLSEVVNDRFRVLEAGVVPPSGFDGSLAAFLWQIGANAQADAIHQFDQRGRR

SEQ ID NO: 2025 - protein, 36 aa, Methylobacterium sp.
LIVLYGLPSSKLIYASCLIDARIWAGVTLLLPDTAD

SEQ ID NO: 2026 - protein, 195 aa, Methylobacterium sp.
VKRHPKLFVDQRPRDRVADLIEEGIDVAVRVGELPGSRLLSRRLAPHRLCAFASQIYLEQRGTPQHPDDHIHHDRLNFRFQSAGQALRWPFRIGGRAVDLTPNAGGVADFSDAVAAILVVGGIGISLSYVVAFHVERGALVPVLRKFSVERSVVTALRPESRHGNQNMNAFPAFLGGMFHSPTPRDKLLKSPAGK

SEQ ID NO: 2027 - protein, 156 aa, Methylobacterium sp.
MFGIGGARRDISFTFDALDRSQAVIEFEPDGTIITANANFLTMMGYALPDIRGQRHALFVEAAHRETPAYHAFWDALRQGTHQVAEFKRIAQGGRYVWVQASYNPVLDRSGRVVKVVKVASDVTAQKLQMLDYAGQIAALHRSQAVIAFDPTGTIL

SEQ ID NO: 2028 - protein, 88 aa, Methylobacterium sp.
LSQFGRLSADLAAAHARGEHLGSRVPYIHAGSERLLELSRAFQGALDGLDRSLTEVGLLDPATCEALRCLVGAVERLAGTAQRFPANA

SEQ ID NO: 2029 - protein, 215 aa, Methylobacterium sp.
MTLPIDLYTEVTCPWCIIGHHRLDKVLAERFPELDVDIRQHPVLLLPDAPAEGLHIPDLLRSRYGVTDPKVSSARPEAEARASGLDLDLSRQAWTYRTQAAHGLILAARERGTQHRLAVAITGAHFLEAKNISDADILADIAVAYGFERQEARALAFDPAQHRRVEQEAARSAAAGVRSVPHFVFGGRFAVSGGRSEEEIALAIQQATGGATTNH

SEQ ID NO: 2030 - protein, 58 aa, Methylobacterium sp.
MIRTGRLARSLGPARRCTVHDLYDDIAPAELPDLIVGDVAGLTSEPLRATGALFLFLT

SEQ ID NO: 2031 - protein, 40 aa, Methylobacterium sp.
MDLSLHELGLQDAATIEALRSFVSAAEELANSTQRFPPTL

SEQ ID NO: 2032 - protein, 132 aa, Methylobacterium sp.
MTANLVAAYVSHNRVAASEMPALIATAAAALTGLQPTDPSTADGDRKATPKMVRASITREALISFEDGKRYKTIKRHLTACGLTPETYRAKWGLPNDYPMVAPAYAAKRSRIARSLAQGRSQRDPGPETAAG

SEQ ID NO: 2033 - protein, 67 aa, Methylobacterium sp.
MSSTTDKIEGLANEAVGNVKQAAGKATGNDKLVAEGKAQELKGEAQKTVGDVKDGAKSVADKIIGKH

SEQ ID NO: 2034 - protein, 40 aa, Methylobacterium sp.
VRSFTVVVAVVLVGREVRSGARPTGIDGPRMHAGAEGITG

SEQ ID NO: 2035 - protein, 55 aa, Methylobacterium sp.
MTELRLDIRDDGIGRAGRIALFDSGLHGEALGSMGWRQRRDGHDISREGCELISG

SEQ ID NO: 2036 - protein, 42 aa, Methylobacterium sp.
MMVRFSTAAMARPMRLGSLMVSLGRMPHCPVAETLVASHRRT

SEQ ID NO: 2037 - protein, 71 aa, Methylobacterium sp.
LRDHVGRASAESNRASDLVALRPARFLSAHPDFGVRVAARMDYAHLITDAFDADNVSGSPRGENLMRMPLG

SEQ ID NO: 2038 - protein, 42 aa, Methylobacterium sp.
VGLGAVKLGLPTGARRPGMNRAPRLTGSAAARNPGPLPAPDR

SEQ ID NO: 2039 - protein, 208 aa, Methylobacterium sp.
MIDTQKEDHRREELGSLYVITAHEFNHVARSTSIDRRFFDRDLPAKFYFVDKTGAPRDFRSAYIEERILNPSIIDAGSRFIAEWSFLLTEFEKPFAQYPFFVVSSRFFEKNLSLPLELQTLLAFAFPCLKCYGWGYLPSYDRKANFQDLQFYKEVGYLGIKDEGIAFLDGLYGVRFVDQYRMISDFSATISASNRVNILSSTSNSIFH

SEQ ID NO: 2040 - protein, 42 aa, Methylobacterium sp.
MASHLFFYKNNLRFCGVSYDGIHEVDERETIMRPIITWDQAG

SEQ ID NO: 2041 - protein, 44 aa, Methylobacterium sp.
MLQVGGRECFDEAKIRLLRGVGCVGRVPEFAKKEPLEVQVLTAM

SEQ ID NO: 2042 - protein, 75 aa, Methylobacterium sp.
MAQDQSGGANPSAAERAAAERVARKRLGPDGCPEPAPDRRSPSGQARRSEAAAPDRRAPPGRPVATRHRPERLPE

SEQ ID NO: 2043 - protein, 150 aa, Methylobacterium sp.
VYVDCATCKRSGRYTVVSLIGRYGADISTLDLLRHLTAACRYQRARVPLTRKYEHLCLAAITLPPAAKQIPPVPPGVPYTVEIWRETSGNVELHLATIYPLSMAEAAFDAACLEWPTHEVTLRDRARVIVRRERPPRWALSRRTKAATSR

SEQ ID NO: 2044 - protein, 84 aa, Methylobacterium sp.
MKDRTGMIAQERGDEAKIVMRRCVSRIEIKASSVMLIGFVQAPGGMMGGGHIENGSHQSLRLPQGLAPAHRKSFRRHGTIGQHA

SEQ ID NO: 2045 - protein, 154 aa, Methylobacterium sp.
MPALLSAIHGALNGLNNPAAPAEAKVDRATPSQIRKSISNDALISFEDGKSYKTLKRHLKGVGLTPDEYRAKWGLPVDYPMTAPSYSEMRSALAKNTGLGNLRRNAAPKAAVTDEKVAEAPKARGRKKVAEPAVAPAGKPVRARKAKKAAVAAE

SEQ ID NO: 2046 - protein, 78 aa, Methylobacterium sp.
VRLVDNIECVLKHAWTVRLLVLTTVLDAAQASVSFFAGTELVSAPVLASLNVGLSVAALGARLVAQEKVSGPATGGDA

SEQ ID NO: 2047 - protein, 170 aa, Methylobacterium sp.
MTSDPGRTAYYARFAYARPREFDSWDSLTPEVRAIWAQVEVAVLTGASSGIHPGQAREVADDPDRPSTISTAAIVPSVVAGETFVVIQDEHVQLLQRIDRGPFFVPLLELAYVKLIPWNGDTLIPRLVSCGWAEMAPRESRAVRITDAGRQALADLDEARLKGQGGGSVA

SEQ ID NO: 2048 - protein, 111 aa, Methylobacterium sp.
VRTAFGALALLAAGATAAPAQPSPLSVNDCTLLPDPGALRRCLDQAEGRVVTPLQPVANPALIDRPEQPAQSVRGAPAAKPATAPPGDFLSNRGPSLRSAQPSSRNVIELE

SEQ ID NO: 2049 - protein, 142 aa, Methylobacterium sp.
VTQNGTNGQAQFQQRGNRNQATITVDSNVQNTYAGIFQDGNDNKAGIYQHDGSKDAYAVVRQVGSGNEGYIDQYGQTNYAALLQVGNGNYATIGQAGTAGVGAFGYQNGNGNTGAITQYGSYYSNAGFAQIGNGNTARITQR

SEQ ID NO: 2050 - protein, 109 aa, Methylobacterium sp.
MPIMPSFTVDPPVICRVVENRSADVARLGLRIETPRRTAGRYNLIVRKIDPAGTATMQQGGGFDLADGDTREVGKLTISVRPDGQLSVEASVHVDGRRIDCAYDSTQDL

SEQ ID NO: 2051 - protein, 177 aa, Methylobacterium sp.
LFVAVPLAVASAAGSAAAQERVAIEQIQAAAQRPAGPPGRAIQESDYILGNQSGILLLNPSGPPQSAQANQARALQIGSGNTGTIDMSGYANVAVQNVIGSRNTVTQQQAGSYNQSAVSVFGQSNTIGTQQDGSGAAATITVRGDNNAISAQQQGTNPTPISITRVGNGPSVSVTQR

SEQ ID NO: 2052 - protein, 159 aa, Methylobacterium sp.
MLRGVELLANAVKVTLGPKGRNVVIEKSFGAPRITKDGVTVAKEIELVDKFENMGAQMVREVASKSSDAAGDGTTTATVLAASIVREGVKYVAAGMNPMDLKRGIDLAVAAVVKDIGSRARKVASSDEVAQVGTISANGDKEIGEMIAHAMQKVGNEGV

SEQ ID NO: 2053 - protein, 66 aa, Methylobacterium sp.
VTQPDDAELSGQLVLFYAAITTSEDEALAIVRRAVKADAAVEPTGGRLSQQTASALVLEAGLARAL

SEQ ID NO: 2054 - protein, 72 aa, Methylobacterium sp.
LPFGLSRRITRPAATSWASARRSVAGDGPCDRSDNSRFDGKTTSGEPGDSAVSGWNVSSALSTARARSETAR

SEQ ID NO: 2055 - protein, 222 aa, Methylobacterium sp.
VLDDALHPVPVGVVGELYIGGTGLARGYLARPGLTAERFVPDPFGRPGARLYRTGDRAARRPDGALDYRGRADEQVKIRGQRVEPGEVAAALRAQPGIAQAAVLARRKPDGPARLVAYAVPAPGAHPDPQELRRALARDLPDALVPAAIVLLDALPLSTSGKLDARALPEPDADVPARDADPPRTATERRLADLWAAVLGLPGPDAVARSDTFFERGGDSIL

SEQ ID NO: 2056 - protein, 53 aa, Methylobacterium sp.
MVEIRRVYEANFRVYGVRKVWRQLAREGIIVARCTVVRLMRTMGLAGVVRGRR

SEQ ID NO: 2057 - protein, 113 aa, Methylobacterium sp.
VVVLAGDQAVFSIDAAGNIQVPATYALRSEVGVALARAAAVLAAQPEPNSSQQILSTVFRQLGEIDTDAAREALTNLEAAVNGQTAALAAATVAMKAATAETGASIPTAPGTH

SEQ ID NO: 2058 - protein, 229 aa, Methylobacterium sp.
MKLQKDTNIAAARPRWYDDACGAAHGLEILGERWALLIVRELMFGPRRFGAIRGALSGISAKVLTERLQGLKQAGIVAQRTLPPPASTPVYELTPWGYEAEPIFSVLGRWAARSPSHNPALPLSAASLMLSFRTMFDPAQASGFEATIGFRFDEDAFRVTVSEGELHAARADPLGAHAVVGAAPPVVAAIVYGGLPLADAEASGQVSLEGDRDVVQRFAGLFPLPGKAF

SEQ ID NO: 2059 - protein, 90 aa, Methylobacterium sp.
VLLNALILITTLVPSAEAGADALARALPPPATVSAQAGSPPPRFDPATRSVSNWHAQTGAQLTPRALAITASLTDDPPYVARCVRLNNGS

SEQ ID NO: 2060 - protein, 37 aa, Methylobacterium sp.; identical to SEQ ID NO: 917

SEQ ID NO: 2061 - protein, 88 aa, Methylobacterium sp.
MTIRPPRSGGPTGRKPQAGKSSASKFRGGKAQADGRARTGPRTSARDAAERAARNRGEDAGTRDPWGAQAAAAPAPARPPKPRRDAAA

SEQ ID NO: 2062 - protein, 294 aa, Methylobacterium sp.
MQIGFIGLGSMGSAMAMNLVKAGHEVRAWNRSRIVQDRVHGITLVPLVADAFQADAVFTMLSDDPAIREVILDAGVLARARPGLTHVITSTISVAFARELELLHAKAALGYVSAPVLGRPNVAARGQLNILAAGKADAIDAVEPLLASISKKVWKLGEDPVRANAAKIACNAMIAMAIEAMAEGVVLTESVGLDRAVFFELILGTLFSGRAYESYSAQITNRSFEPGFKSKLALKDMRLAIEAGNQIGRTLPMLEAVHEGLTRAVSAGLGEKDWSIMADMTVRNMAIAAAYSER

SEQ ID NO: 2063 - protein, 283 aa, Methylobacterium sp.
RGTPSPSGAPAGDHVLIEVRDTGQGIPPELMEKIFEPFFTTKEIGKGTGLGLSTVFGIVKQSGGTIDVQSKVGEGTAFRIYLPRHVPVAEPEEVPVAAAEPALPRAEPLAPASTTAHPDSGSDAKPVTAPAAGGDAAVPNGKTPPAKVDKPAPRKPAADHTGQGTILLVEDEDPVRAVNSRALSARGYTVLEAASGLEALAIVREGAQTIDLVVSDVVMPEMDGPTLLREVRKHQPDLKVIFVSGYAEDAFRKNLPEGETFNFLPKPFSLKQLVETVKKTMAD

SEQ ID NO: 2064 - protein, 102 aa, Methylobacterium sp.
LLGAIQALIADLPTYGYRRVHALLRRQAERDGRPAPNAKRVYRVMKVHGLLLQRHAGGAETRRHEGKVAVAVRNTRWAGPRPVSDRVACPLLGRAGDRSRER

SEQ ID NO: 2065 - protein, 144 aa, Methylobacterium sp.
MSDSPDDLLSLTAGIVAAYVSRQAVTADALPGLMRTVRDGLVALQDLAPAAAAANPEGFRLTATEIRKSMKPDALISFIDGKPYKTLKRHLTSHGLTPKDYRTRLGLPDDYPMVAAGYAAKRSALAKAIRLGVPGAQMGRQTKE

SEQ ID NO: 2066 - protein, 95 aa, Methylobacterium sp.
MKFRPLHDRVVLRRIEGEEKTKGGIIIPDTVKEKPQEGEVVAAGPGVRDEAGQIIALEVKAGDRVLFGKWSGTEVKIDGQDLLIMKESDILGIVA

SEQ ID NO: 2067 - protein, 40 aa, Methylobacterium sp.
VSAPSPHGSGGPAPRRVLVTGAAGFVGGHVLPLLAGAVAA

SEQ ID NO: 2068 - protein, 58 aa, Methylobacterium sp.
MNETDPITKAAEALAAAGHSVEPMGAGFAFWIVDGKGLSGRDLLAMAARLGLIGSSSG

SEQ ID NO: 2069 - protein, 28 aa, Methylobacterium sp.
MRGTPLLIAGLLAPTLAFATPPATQAAK

SEQ ID NO: 2070 - protein, 47 aa, Methylobacterium sp.
MSSITLSAATRQNLLSLQDTAQLMSTTQNRLATGKTVNSALDNPTNF

SEQ ID NO: 2071 - protein, 105 aa, Methylobacterium sp.
VVTMTVPATLDHANIRTIPVSVAEANAAIAVAVAFAHDHARMAVTRTVAVAIAATPLMGLSGRDCTQQRGAGDQGRDKLLHTPTLFIELKREMQSPIIAFQGSRV

SEQ ID NO: 2072 - protein, 110 aa, Methylobacterium sp.
MLDRAEAVVAFAVLAAEGSPETAYAAAGIARAEMFDAASDLALTLGAPDGHAGPLGAPPATAYPPDWAALADLAGHPVELDAWREAERRLPYWADADPVDAPHPWKSTSP

SEQ ID NO: 2073 - protein, 230 aa, Methylobacterium sp.
VHLDADRAAAADRLAELEAGRDAVLLTDDDAKAEAHDAEMQRVRRAIERADLKRPGIVAAVEAAVAREEANAFARRQAEASAAVEAVIARLAKEYEAPAKIIAAFLADWQRAAELAEAAKVPGPDARVRERAPQMVAPAGEDTFLVYIDEQGRDTDQPYPPGAYTPGMPTRRQQRRTRERPARYDNGIYLGALAGRANLPAARVGQDAPWTGGDLALKSDLPQPHTRRFL

SEQ ID NO: 2074 - protein, 58 aa, Methylobacterium sp.
MRNFGPPLAAGCARDGVAHAAARQTGATRPMTVRVNMVETLQHLRRTSPIGDDGARHD

SEQ ID NO: 2075 - protein, 31 aa, Methylobacterium sp.
MTTAQLLLLLAVPIGGGVLAFGALWLAQRAH

SEQ ID NO: 2076 - protein, 387 aa, Methylobacterium sp.
MKGRLKLGLAALGILGVGLGVARYREAAAPAGPEASSPAVPVVTAAVQQEDVPIILKGVGTVQALNRAVIRSQVTGYLESVAFTEGQSVRKGDVLARIDRRIYQAKLDTAEAQLGRDQALLTNRQVNLQRNEPLLQRGFASEEAVTGEKAQIAQSENAVKGDQAALDYARTELDFATLRAPFDGVTGLRLIDIGNVIQPSDPSGIVVLTQVQPISTVFTLPTDDIPQVQAALARGPVTVTIYNQAGTRMLDTGPLLLIDNEAEPKSGTVQLKVNTPNAERQLWPGAFANVEVTTSVVKGALTIPTNAVQQNDQGQYVFVVGSDHKVAIRSIKVAQRVRGVALISEGLKAGETVVVQGQYSLVPGTEVVAAPPNQVSDTTTASAGMLP

SEQ ID NO: 2077 - protein, 354 aa, Methylobacterium sp.
MDLPLLFALVAAGAVALYVIADGFDLGIGILFLLAPRGRDRDLMMQSVAPFWDGNETWLVLGGAGLWAAFPMAYYVLLPAFYLPIMAMLFALILRGISFEFRFQATRFQRVWDFAFAGGSLVAAICQGLILGGFIQGVAVENGYFAGGPFSFVSFLGLLCAAGIVGGYALLGAGWLIWRTDGPTQVFAREVAHAALLLAVAMMAVVSAWTALTEPQVAARWFAWPGTLWLGLLPLAAAGVAVLIWRSLWGRHDSRPFLLAVALFLLGYAGLIISVWPNVVPYHATIWQAAADEATLRFALLGIFVVLPLVLAYTVHAYWVFRGKTVPVSHGADEGAYGHAGQRPNALGTDLHLC

SEQ ID NO: 2078 - protein, 472 aa, Methylobacterium sp.
MDALVLSRIQFAFTVGFHILWPAFTIGIASFVAFLSFLTWRTGDPAYRALMRFWIRIFALGFGMGVITGIVLGYQIGTNWSGFSRSVSNVLGPFFMYEVLSAFFLEAGFIGIVLFGEKRVGPGLHFFACLMVATGTLISASWILASNSWMQTPAGHIVDKDGIFHVTDWAAAFFNPSYPYRLMHMVCASYLTGSFVVAGVSAYHLWRGTHVKASRVAFSMAMWACLVLAPLQAVLGDAHGRNTLVHQPTKVAAMEGLWDTGRGVPSLIFAWPDMTQARNLYEIAVPIKGFASLYLTHSWDGEVQGLKAVPAADRPYVPFVFFAFRIMVGIALLLIALAFTGAFLRWRGRLFTTRWFQLACMGATPLGFLAIVAGWTVTETGRQPFVVYGHLRTADAVTVQPAGAVLSSLILFFVVYNTLLLAFFWYGAWVAMRGPDPLVDEPPNAVRPGLEQAGPAVVGGAPAYARALVPGE

SEQ ID NO: 2079 - protein, 300 aa, Methylobacterium sp.
MADTDTFWPNGARLAVSFSLMFEAGGQPISGAGGVIPDPIEQGLPDLPTNAFFQYGVYEGIPRLLDLFDRHQVKMSSFMIGRAVEKAPDLAREIVRRGHEAAAHGRTWQNSYFLDPDAERRFIADSVEAIEKATGQRPVGWNAYWMRNSPRTLDILQGLGFRYHIDEPSRDEPFIIPLKGGDFVTVPYTFHLNDIVSFPFQGWNPAAYEQALRDEFDQLYEEGARRRRMMVVSLHDRISGHANRVRSLDRFFAYARTKPDVWFARKDEIAAWALEHRAQTPIYERGAPTVTGLPGPGPGA

SEQ ID NO: 2080 - protein, 37 aa, Methylobacterium sp.
MEGYDPPEGWGWCYVDEVFLDLGTDITPQDGPIPRFV

SEQ ID NO: 2081 - protein, 140 aa, Methylobacterium sp.
VPDIRSYPDGQTAPSPSAIDFTPGHLLGDVSGELGLRKFLEASGHTLVATSDKEGPDSELDRELVDADVVISQPFWPAYITRERIEKAPRLKLALTAGIGSDHVDLKAAAERAITVAATPRVHAKSWRTSSPASRSATST

SEQ ID NO: 2082 - protein, 328 aa, Methylobacterium sp.
MHATQLIVQPDHGIEPVVALMRGAEHEILLKQFTFDHPALLDELIARHREGVTVRVMLNSAKATGERINDATFARLEAVGVPVRWAPSHFLVTHEKSIVVDGTRAMIATFNFMEKYFSKTRDYAVILTDPAQVSAIRDCFDGDWAGGPFTPSGGSGLSWSPGGARAVLCGFLDGARHTIDLAHPKFAEPVIFERVHAALERGVRVRLLCGGKHGLHQPDLMYSFALWRLFRQAGGRLHKQRGLRSHGKIAIVDGDRVHLGTQNLDQAAFDLRRELGVTVRDAGVVRAITDVFEADWRESRRYEPPYPTAKPDDAENAEFEPDADLRHS

SEQ ID NO: 2083 - protein, 47 aa, Methylobacterium sp.
MDQAQPRRRVGIASGFTSRLQSDERTARLTSLPGMRLTPRAHAQLEA

SEQ ID NO: 2084 - protein, 243 aa, Methylobacterium sp.
VSPRLPKAVLPPLGTLKRRNRSWLLAADGTAFLVSETRLIDYAPLAGELPLAVTPAGLLMRDRADGVIARRPSDGKVVARFPGRAGSLRPGGGLALCAVRGQPTLGIEQAGGHWHVVSAADGAVAHLGPQGRIIGIVPPYDGVSAQAVEGPLALHLDRDEAGSARLTFRTPDGAAACDPLTLPDATLEAVRVAVDADAVPCIAAARCDAAGFVDALAFGQLDRGWSHLRDLGAFAETVPCLGA

SEQ ID NO: 2085 - protein, 564 aa, Methylobacterium sp.
LRVVTGTHNALLAFDLGETKRADCLGFSIERTDLDTGDRRWLPNMLRFPSDTNPERVTTARAPLQKFRWGDYTVEPGKRYRYRAVARYGTAADVFREGVSAEKPGAFDVIGGGAIVDVRAENSRDDHTAVFFNRGAAASEAYVRRFGDNDPANIPDALVWLSRGLEEAILAFLAKAIDDRFALHAAIYEFQKPNLLQGLMQAKRRGVDVNVIYHGRDNGAKDTTREKNGAAIVSAGMTFAAPRKANPQAAIMHNKFVVLLRNDTGGVPRPIAVWTGSTNWTEGGIYGQLNVGHGIYEPGVAATYEAYFQQLAQDPDAAASREAMQALTPVPANREAVAHGITPVFSPQGSLDMITLYAEVCAKAKVLMVSAPFALHPKIRAVFDQRSPDTLRFLMADKEGSFGKKGQMEIMERDPGNAAAVATILHNPLNDYQGHLLEHAEGFHHAGVHIHSKIIAADPFGPDPILITGSANFSSNSTMENDSNSLIFRGDTAVMDIYATEFMRMFEHYWFRYKQKREEDDAKAAGRTAGTVLALKEDASWADPFFVPGSKEMLDRQAFAGIAV

SEQ ID NO: 2086 - protein, 332 aa, Methylobacterium sp.
MEISGRILIACLVAAAWTPTAHADPRYERYDGACDASAAIGLAADRFVVAEDEHDVLHVYRFGGGKPVAEINVTDFLGNRRPGHKPKEADLEGAAKIDRTIYWISSHGRDRHGDYEPTRHRLFATEMVTGASPTVKPAGMVYKDLIRDLSAAPQTRSLNLAEASAKTPEAEGGLNIEGLAASPEGHLLIGFRNPLPAGKALVVTLTNPADVIERGGKPDFEAPHLLDLGGRGIRSMERVGSRYVIIAGPFGDSPGGTSDFALFSWGGNDQAPERLTADFGSLRPEALFATDVADEVYVLSDDGDEDIDGMPCKSSEVPLIKKYFRGMRLRIR

SEQ ID NO: 2087 - protein, 289 aa, Methylobacterium sp.
MDAIVENLPLPQPAFELAWNAIKVDGGVKDRLVAQSLLSLRLRQHYPFETMPMHGLIVLSGPPGTGKTTLARGLANEVGKALGKARYVQLDAHALGSASLGKSQKEVSRVFQQTIPELAALGPIVVLLDEVETLAADRQRMSLEANPIDAHRATDAALAGIDLLCRKHRNTLLIATTNYPKAVDRALLSRADWIEDIGPPSAEARKEIILDTLALLARTWPKVDDLKNQVAAFVHASDGMDGRRLRKAVMSAAAVSIETAKDLNKLRPEHVIATLKRAASQPDVREDAA

SEQ ID NO: 2088 - protein, 153 aa, Methylobacterium sp.
VKVRRDIASIPRRSAAETWREIVGLVTGDGSVDAGTLEAAASVMESLIADEHPAEVPIVVKGVGPRLVIYCLFGEDAMDADLGVPGLNWNPTAGDWAMTAPTGAVDLAWMNRTLKERAPRIAAHDVEAAPTDDEDAAAEARELTIDWGAIGGS

SEQ ID NO: 2089 - protein, 747 aa, Methylobacterium sp.
MQSYMAMDRARRSQTSVPKFGIDPDEPRLVEALSSFSRGKCAFCEAIGPLTAHRFRPSGNAQPAADRKDAHLFYVWLADAWQNLLPICRGCQPVEPTFPVDGTRCRLPSPQQITSYIQRGAGLWPSYPPNEKNLLIDPSRETAFDGHFKPKLDGTIVPTSPRAALTVETFDLNREERLLQRGSRYRDQLDRLKNLLGTRKKALSVEQKAWTDLFDFRAMEFGGTCLLLMKRVAARIDLPNGSGLSSSSRDLRHAFRQLASASDARERFDKALLELSREDPSLLPASPGRPRVHRVRSQLRTVEVTNFKAVERMHLELLSTGPETSDAKPLAPALAILGENATGKSSLLEAVALALMTEDARRSLELDWQTIPLDPSQMGVEGSLKAPATEVRLTFDSGQTAALSIVDGLVAARSEFGSERVSVFAYGAFRRFSGDVPATMSSRHVRNLFDASPLANPEAWLRSLQPQTFDMVVRTLRDLLSIEGDFDVIQREGRSRRLRVVTAVAEPDGTIRYSRTPFQAVSSGYRSMLGMLCDILRGLLEAAPEEEFTSFERIRGVVLIDEIEAHLHPRWKVQVMTSLRQTLPGVTFIVTTHDPLCLRGMGTGEVIVLQRVASSDSGVESNLPIAVERMRDLPAVADLRIEQLLTSDFFQLFSTTDAAADRKIARIGDLVRRRTEGQTLTTEDARVLAEFERDIASALPVGSSEVHRMVQEAVAEFLEKRRAASSATLARLSQKAKDEILAALETL

SEQ ID NO: 2090 - protein, 114 aa, Methylobacterium sp.
VGEQIDGSFELDSQTYLVEAKWLNRRVGVAELGAFHSKLDQKASWARGLFISFGGFTEEGIRAFGRGRRVVGMDGRDLYQSLERGIPVDRVISRKVRHAAETGEVFAPLENLFR

SEQ ID NO: 2091 - protein, 44 aa, Methylobacterium sp.
VRWRTSICDQVCRETVIQMAPAVSVTASIASRMTFVDRVILRSE

SEQ ID NO: 2092 - protein, 475 aa, Methylobacterium sp.
MNAITPVEADTRLLDALTVQRTAFLRDGPPSLRERRADLKRLRAAILDRRADVEGALNADFGHRSRHETAIMETMTLVQEIDYLHRNLRRFMRPTRRYVALAFRFGSARIEYQPLGVIGIMSPWNYPFSLALAPLATAIAAGNRAMVKPSEFTPATSALLVDMLAGLFPEEQVAVVTGDAAVGAAFSALPFDHLVFTGSTPVGRAIMKAASDNLVPLTLELGGKSPVIVAKGHPADHAAARIAYGKLANGGQICVAPDYALVHEDDVGPFLAAYDRAVAALYPDGPASADYTSIINDHHHGRLTGLVDDARAKGAEVRLVGRNPDRAGGRPHTMAPTVVLGARDDMRIMQEEIFGPVLPILTYRDLDEAVAYVNAHPRPLALYYFGRDDGDRAKVLTRTTSGNVTVNGTIMHYAQDDLPFGGVGPSGMGAYHGIEGFRSLSHAKGIYAQGRWNGSGVLRAPFGKLADLTLGLMLR

SEQ ID NO: 2093 - protein, 75 aa, Methylobacterium sp.
MATATSSDEAVLDVATPIIDARALLRASRYEPLFVRSSASRSPVEFRAVERHRRELTRMPAVRGSSVSRQEWRSK

SEQ ID NO: 2094 - protein, 97 aa, Methylobacterium sp.
MKQTSGPARKPAETMIKDIRRATRRQFSAEEKIRIVLEGLCGEDSIAELCRRESIASSMYYGWPKEFLDALLVDRHPSRLARRAQSGRGASRSVTFD

SEQ ID NO: 2095 - protein, 778 aa, Methylobacterium sp.
MPDIYPQPDASHVIDTAWYLSRYPDVATAGQDPAEHYELYGRAEGRFPNAAAAESANLRAQVDQDWYRQRYSDVAASDMDPADHYVSHGRAEGRFPNAAAEEMAALRARVDPAWYRQRYPDIGAQDADPVYHYILYGRAEGRFPNAAAEEMASLRAQVDPDWYQQRYAGEIDQTEDPIDDYVLRGRFAGRFPNEKAEIRRLLAQRVDGAWYLRRYPDIANAGSDPVEHYLNFGILEDRAPNSLAEELSYESRPIFDALLRQIFVATTGRDATGAEREIWYRKLKLGLDYSSIQAILEGSRDLTGQAAQTPLEGSAGGTNALSEADFRDYLLMFHDRFLGRAPKADEYLKLTELKEQGRRLSDILEAIEYGEEAQKIRYRPDLALLPEGQFVQLLFEIAVGRGATPSEVEHYANALAQKTVERKDLIESFFSYAATEKLNPTRAQFGLAQAHVAHLYGERDNLTIDRWRERRDRLQADPKADFDTTRRHPRLLYSRSTKPEVSIITSMYKGAKYIRNFMDNITSQTIFEDCELIIVDAASPEDEISIIQPYQAKYANIRYHRIDYIIGIYDAWNYAVERSTGRFLTNANLDDCRSAESLEIQAAALQTLPFIDVVYQDVFYAMERDLSFDEIRRFGFATNLPIVSRYNLLEFNSPHNAPMWRRSLHDELGLFDTNYKSAGDYEFWMRCQVAGKTFFKSNVPHVAYYVNPEGLSTRPDTRGIAEANEITKKYCRQLISDHLTSTESDYFHSLPGYDAEQDGGKSRYEVVQACLRRLASAT

SEQ ID NO: 2096 - protein, 103 aa, Methylobacterium sp.
MATDDPAHFTLRRRLLLGLAAAPLAASLPRVAAAAEAGALAVTDSEVTVGILHSITGTMAISETGPSQGEKLAIQQINDAGGVLGRKIKIIQEDGASDWPTFA

SEQ ID NO: 2097 - protein, 33 aa, Methylobacterium sp.
MRAIWIRSPLAASPTAQALALRRLMSASTISVI

SEQ ID NO: 2098 - protein, 79 aa, Methylobacterium sp.
GGVEYALPTDSFLNFFRSNAVTLKVEGLYVSLDRQKNSAGGVFYGNLLPPNGIAYLNGAAAKTEFAVVRAGLNYKFGSY

SEQ ID NO: 2099 - protein, 41 aa, Methylobacterium sp.
LLDRVPSPSALRRLPESELPAVADAVRAEMIDAVSITGGHL

SEQ ID NO: 2100 - protein, 53 aa, Methylobacterium sp.
MERFVVGAERDQTTLFPPYLEDRIAEDNPVRVVDAFAASRGTQTERWLRDREA

SEQ ID NO: 2101 - protein, 50 aa, Methylobacterium sp.
REPLDAAAGAVFADVPNLILTPHIAGVTQESNVRVSAVTAAAVRRHLTER

SEQ ID NO: 2102 - protein, 103 aa, Methylobacterium sp.
VAALRQKGVEHHVLAHFQFRVFPDHILKRLAPSNPGVALYEIVEPEQTIQIIPLEEGKLRPLFDLDPQRSGEILCSTEYAGIIFTPHCACVGHDAFSIFADGV

SEQ ID NO: 2103 - protein, 85 aa, Methylobacterium sp.
DAVARSDTFFERGGDSILVMKLVAAVQESLGPRLPLRAVFDHPTLADLAARIDADGSTGGAGAADLTDMESWLDAIETAAGATRT

SEQ ID NO: 2104 - protein, 294 aa, Methylobacterium sp.
ARLVAGHFDHGFYRARYGLSEAEDAVRDYCDTGWRAGRNPRPDFDGQAYADAHPGMRETGLAPLVHRLATALMHGTDIAAGAFHPRYGTPDSREAALADEARTVAPFFDAAFYAKRNPDAAGAPGGPLAHFVAYGQHEGRDPSKAFSIAFYRETYGHLLGPGESPFLHYVRTGRAAGLMGCPEDLGTYPPMEAPAADEWDRLPRALPIAQARVVVIVPVYKGRGETLRALHACLSAPQATPFTLLAVNDRSPDPQLTADLAALAGRGLFHLVENEHNLGFVRSVNRALGLRQGR

SEQ ID NO: 2105 - protein, 217 aa, Methylobacterium sp.
QRGLAMRQVADRFADAVGGIVAQVSTAAASLQATARGMTETAAETAGQSTTVAAAAEEAASNVGTVAAAAEELGASVQEIGRQVDGSAGLARAAVAEADRTGALVRDLSEAVARIGDVVGLISTIAGQTNLLALNATIEAARAGAAGRGFAVVATEVKALAEQTARATEEIAGQIGRVQASTGQAVAAIGTITARIRDIDGVATTIAAAVEQQGAAT

SEQ ID NO: 2106 - protein, 33 aa, Methylobacterium sp.
VTAWDGGSAAGGGRVIAGGDPRLHEAALKVLNP

SEQ ID NO: 2107 - protein, 32 aa, Methylobacterium sp.
VRAGPTTDERERIKALERENRELRQANEILRK

SEQ ID NO: 2108 - protein, 622 aa, Methylobacterium sp.
LIISKSHLFDPDFYRRSAQQAGVPVKNSDPIAHYLSIGDKRRIATHPLFDTFYYHDRYRDVEPSGMSALFHYLQYGALEFRDPHPLLNSKFIATQINLGSENPLIAYLRLPPGTVDPHPDIDDEYLAEQLKENGLLKSNALVDFLADRTYSANPSRNFDVRSYARFHPDACSYHPFYHFVCFGRSEGRRYESLEDDVSGLLSQIDEISSLDVDIIPPHTDVTDLPKVRSISAAREVSSLLKVLQKISGGSRINHLFFVPHLVFGGAEKVLVNIVSVLSRDPRTEVLIIITDSSEEVAINWLPKRDNIKIANIYPFTKHVDRFDILQCLGIYLQTGRFDNVYSLNSKIGWDLFERYGLALSQLMKIHGFAFCYDFDIYGRRGGYAWTHLQHCIRFMETVITDNDPIVKVFGKELRLAESEIRKFRVLRQPVEIKANHVYDMQGFSQIDSRRTRPTVLWAGRFHKQKNVDCGLKIAALLPHIDFLFAGGSFNDLSDPSPEISANVTFLGLYDRFESLLDRRIDLFLHTADWDGLPNVLLEAASHGIPIVARDVGGVSDLVDSDTGWLLPQSAAERDFATVVSSALSDQQALRGKVEAMTSKLHATHTWDIFSREVVKVLSEQEI

SEQ ID NO: 2109 - protein, 656 aa, Methylobacterium sp.
LTRQWIDDYDFAKICRTSIAECRYGSLGPARNHGISIARGDYIATVDADDLVSFNMFAGLHLAAQSAGRNAIAIQNYILAFGAKNFLVEYFGTDTVNKLGFFSYHPGVSRILAHRSLFEQIEYADTKLGSGYAYEDWHFSCEALSRGYEYVTAENTILFYRQRRNSLLQAADQHSVRQTPPTALFQPRNFLGVCRRDYKRFRNGEIATKDADAVRRQFDDNRALWEIVRAAASIDPAITMRSATSLPIYTNLSEALNAGSAYFRACSLLGERQFTDVVLLPFLSKGGGDKYILDVIGALSELDPDRSFLVLAGEPFNQHAWMDRLPDSARFIDIYRHCRGCTEAERLLVTLRLIENFAPSAVLHLKSSVYAVRFIETYHAVLNALTIVFYRFSDHHYTYNDIDFCAGYVFDFISEYGEMFWKIITDNATILRHDTERFDSFADRWVVLKARCVGASARSHADNPGTATKRILWASRLDPEKRPDLLIKIAAAVQGRNPELSIDVFGTAATDHFDVSRFEGLPNVIYRGGFSNFSEIDSDQYDAFLYTTAFDGLPNVVLEAMASGLPVIAPDIGGVAEVVKTGETGWLLDPSPNDETFIARYCDALGDIYAKSTDLSLLRRGAIDLVSQRHSAEQFLNAVGAIFACRPEQRARVDAI

SEQ ID NO: 2110 - protein, 49 aa, Methylobacterium sp.
MTKGSAHLAWDVGGQHALVRSEMLNSVSAAGERHGLAEPGRVWSQGDGS

SEQ ID NO: 2111 - protein, 30 aa, Methylobacterium sp.
MTDGSAHLAWDVGGQHALVRSEMLDSVSAA

SEQ ID NO: 2112 - protein, 156 aa, Methylobacterium sp.
MTRTRAFWWGYVAAVTLYAGAAAAFHYGPGIEAKRFPVRVDQTVHDIERDGAGLCWTWSSLKVRDRRSDDMDAYLWVRGQRYVVAIHRASDGEPWSQAGALPVGGPHHLRYCTTLPPSVRPADDLRLEQVAWFPGLLGLWRVPLRIPDVVSPGSQS

SEQ ID NO: 2113 - protein, 117 aa, Methylobacterium sp.
LAPGQWLYTVRDFEDFRSRYSQQLACLDADDISDEIDRLAGGRIPVLCCFCKPSTRGTAYCHRSLASAWLEYRLGLIVEEHGVPGGHGVFHPLLPDSHRRPVETPTASIYPVQLDLL

SEQ ID NO: 2114 - protein, 55 aa, Methylobacterium sp.; identical to SEQ ID NO: 1006

SEQ ID NO: 2115 - protein, 164 aa, Methylobacterium sp.; identical to SEQ ID NO: 1007

SEQ ID NO: 2116 - protein, 74 aa, Methylobacterium sp.; identical to SEQ ID NO: 1008

SEQ ID NO: 2117 - protein, 48 aa, Methylobacterium sp.; identical to SEQ ID NO: 1009

SEQ ID NO: 2118 - protein, 289 aa, Methylobacterium sp.; identical to SEQ ID NO: 1010

SEQ ID NO: 2119 - protein, 100 aa, Methylobacterium sp.
MEGPGMISRSLQLDDFLWALDNSRRRYRVRPTRLGDLTFRFGETYPGLITVVSMNGIHRVVMTARCEVSPGPWLDTDAYADFRLLAINRKRALRNYGGAR

SEQ ID NO: 2120 - protein, 66 aa, Methylobacterium sp.
VPQHLGGESLSLHQGYTANTVADLMETSMTLVARFALATAVAAATVAVLAGTYVEILDRALPMHFV

SEQ ID NO: 2121 - protein, 112 aa, Methylobacterium sp.
MVPNALNMLLGVALLLAPWYLNLGYETAAARNAFVTGGAITVVALLALGVTCAWEEYLNVALGFWAAMAPWLLGFADATAPVWVHGLTGLAVAALAAYALWRLFVSPQARSV

SEQ ID NO: 2122 - protein, 47 aa, Methylobacterium sp.
APARVPPPAASGPTSGQGPSPRSTAGRRTNELRLGERWKRRLPHFMR

SEQ ID NO: 2123 - protein, 80 aa, Methylobacterium sp.
GGTAEIVNAGGRITTEGDSAFGALVQSIGGSGGSGGGAFPAGAFFAVGLGGSGGGGGDGGLARFTGRAGAIETGGAGSTA

SEQ ID NO: 2124 - protein, 56 aa, Methylobacterium sp.
VHWKEPAQSLAIAGASGDPIQHVALSRATDERQAALTALFGRAVRPRGSAAPHRMR

SEQ ID NO: 2125 - protein, 64 aa, Methylobacterium sp.
LLRLKVETDLARAVEAAARQRGQTMSEFTRQSLRAHLARCGVRLSPDDGPRAPTLDAPAQRQAA

SEQ ID NO: 2126 - protein, 60 aa, Methylobacterium sp.
MRYRATKTPHVQTAIYAPGEMFDPVLHDLPQHEVDWLLKQEAIEVLKDPPAPQAQNSRGR

SEQ ID NO: 2127 - protein, 1142 aa, Methylobacterium sp.
MASKTIEAKLLITAESRVEAEMAKVAKAIQQGLDVTKYTAETAKLSRAWEQQAKAARAAAAVMDARKPLEATVQGMQRVGAQATRLAREYDVAKKAAAEYGKAQTFIKGSEQAEQAARLAAEVRRLGDAHRAAVNDSKALTAAFSAETAALRAAESAASRYGVDLSRVEQQQRSLTRSTDLAAAAFRRQVAAEEAGARAATARAQRRQAQDVAAGVVATATGAGLRGAYVRSRDGWIEMDEASRRQRAVLGIDQAKQSTLNTQALKIGQDTRFSNPDVVKAQTRIGSSLPDHLKDPKVLVAITENAKDYALAMGTTMDEASSAVLGRMLGLRMNMSNPEAAAASAKHATNRLVQFAKSSGADHNDLMGYTKFGAAPSSVGGFSEEFTDAMAAQLRRIGYEGSMAGNFVRAAATKLAVPTAKGLGVLAGSGLNHSDYVAPGKALSADNLGSALRLKFGKGLNDSQRSRIRELMEDEDIVGNREEFVPKVSAIIQETLARRTKKGAVNAQDAERIAKSVNEYLSASAGAVDIERLMRDVIAKGITPAMAKYLFGQEHGGRAQALDLKTLNKDVETFRNTPQDRAQKIGEDINAGTYGAYQRMIGSVETFWMKLGQVNDGPLTMFYDKVGNAVDAVTNLPPNVIQAGTAIGGLAGAAIAARGAFGMFRVGRDLLGFGGGAAALNGSAVALNAAAAALTEAAVLQGAKTAAGALPDAAKKGGKLAGLAKGALGITAIGGLSELAQQYDTLKMPEFTKDGIGRGLLGALDPNLPDMVLGKKADEVGKDAGTKVGKGIAEGVKEKAPEVEAEGKTLFQRLNEQFREGIFVPINFAPGAGMGGGGSGGLIQRASFSPDGGGGGGINLGGVGAGVPRFGGGTGTGGGSGGGSASGGSIPGIPSSVDMTDAERNMLGLIQLHESHGRNTLNYVGTRQGLDPMTARGATAQGYYQILNSNWRRLAPGLGIKTRNAMSSTLEEQTRVALALLRSRGGRPQDWAPFNPALRAAIRRGDRAPLGAGVAKDAAGLEPKLIKGLDGKEGLDLGDGTMRMSDGSIRSITRSGLEIPDAPAGGIGAAGNGRGSIGAHVEEFGRHVDRLQDMGVHAQVEVTGLRRSGLRATALRVRGRGGMSADLGVSEPGAKEDLSDWS

SEQ ID NO: 2128 - protein, 157 aa, Methylobacterium sp.
MEPCSLTPDLFHGRTRTETAALHPPPLRYTAVRRVNALIPRDEWQYVGCQQRKLPLVLRRIEYSDNPLSLCVTPEDPEQIEEVWEILHSNDPDRSYNVLLKRRIPAVGYPLWCYWDGAYEQQERRLGDAVWEAMNDQQVDRSSTGWRKDRYPTPPEY

SEQ ID NO: 2129 - protein, 39 aa, Methylobacterium sp.
VAAMRHPGSMIKGRRGGRPADTTMVAPGDMLAAYPHALP

SEQ ID NO: 2130 - protein, 173 aa, Methylobacterium sp.
VMARAGWVRPSGVLAACTRLAGRESRVACRLLFGGAGNLLLRLLGGQTVGLGLGAGLRGLDLSLTLDLGGQTNGFPFGRPQVPGLDDRAPRGLPSEDDRIIGRRACPEPGQCGLPRSGRLRETIDEVIGFQRLHELSVGAPDVSPRWRDMDEAAPRRNGFEARHEWTRETQAA

SEQ ID NO: 2131 - protein, 222 aa, Methylobacterium sp.
MRPTSGPVLGQRVEWEDLGRASLMTVLAGFVDAVGYAATGHLYLSFMSGNSTQFGMALARGDAQVIGWAGAVIATFVLGAFLGSLGVAVEAMVRLPIVLAGELLCFVSAWMLLGPWTAEAALLFLSLVMGMQNAIRTSVAGAAIGRSFVTGSLFGVGNALARACLGRARLAEAAADAASWLAFILGVTCGALAIGALGLANALIGAASVVAALMALAMIWRR

SEQ ID NO: 2132 - protein, 277 aa, Methylobacterium sp.
LLSSNHGAQVMIIENEHVASLAEAFSIKDAGQLARMAEMGARSSSMAHDLNNLLQIIVGNLDFVAAGPLDEKAARHLSLARAGVERCTHLARRTLKQGCSRETAGLLQVSRFLEEVADRLGFAGGHGITLEIVAVDSALAIEADEAELENALLNLVLNARDAMHGQGRIRISCHASPAGGSRSDGSTVALGEVVLLVEDSGPGIAPEIQGAVLERFFTTKAHGTGLGLANVRAFMAEAAGTLAIGNRPEGGAVVTLSFPQAQAESPPTYVRSRIHVD

SEQ ID NO: 2133 - protein, 76 aa, Methylobacterium sp.
VDLHRRIAEAELRSTAATRALTALIGTEADTTEAERRLNGELDRLLVLRRQLADLLLLGEAGSILRLAPPPTGRET

SEQ ID NO: 2134 - protein, 227 aa, Methylobacterium sp.
VHDGGDTRRSRHVQRPAVQNLVEQVLLGDDADQLVDDAPAHHHPRMVARADGGVDGTRLAVEVEPLDVVARGHDVPGPTPADREDSLDGFLLRLLDQARFLARLDKEVQFGRRVPRALAVARAQADQAQHPVAEAVEDKDRRSEHEQEQAQRPDDRQGRALASLEREALRRQFSQDDMQARDADEGESGRGAVRGGRPEGARKPSQGRLDQVGGRARRFSRAPTTRG

SEQ ID NO: 2135 - protein, 68 aa, Methylobacterium sp.
MPLREIDVLGVFIAPFALGLLIATICTLIVGATLKRVLPTTSMTRSPILELTLFVATLSSFVLLLGRL

SEQ ID NO: 2136 - protein, 173 aa, Methylobacterium sp.
MAMKSEIARSIRSAPLMTPSDFSSADINSLSAELRVLLADVFAIYLKTKNFHWHMSGPNFRDYHLLLDEQSEQIFGMVDDIAERTRKIGGTSVRSIGQVARLQRVLDNDADFVTPKDMLAELREDNRQLVKSMRAIHQLSDEIGDVATASLLENWIDESERRVWFLYEICRSL

SEQ ID NO: 2137 - protein, 175 aa, Methylobacterium sp.
MKVSDLIALASFFGTLSVLSIGGSNSVVPEMARHAVGERHWLTGDAFSDIFAISQAAPGPSNLIVAMIGYKVAGFAGAVVAQAAMMLPAGLLMIGVARFWQASSGTQWHVALERALGPIAVGLILASGWIVAENAALSFRGYLVTALCTLVFWRTKLNPVPILIAAGFFGWAGVI

SEQ ID NO: 2138 - protein, 208 aa, Methylobacterium sp.
VSHRPLRQRPSGSVGSGSPVGVLGRVELGGRLPIIGAPEMDVLGQGVHAFLAADRTDRSREDRFLREGMVLDRWNVAGHVGWSSLVGAADRLWAFLDRRFPGARLRREVPVFATVGSQVIVGRVDLLVEIGDRFAVIDHKSFPGRESLWDARAIAAASKLESYARAVTLATGRACAGLLAHLPVVGALSEVGSVSPRRLLPLAEAART

SEQ ID NO: 2139 - protein, 30 aa, Methylobacterium sp.
VAVLAGSANQSSGITIVEIARLWVASPRSR

SEQ ID NO: 2140 - protein, 98 aa, Methylobacterium sp.
MIVDRAMSDPMIPLISAAAFVSVGWLIIHAGRQYDDAIRHTLTVFALVFGLLVLIGVTAKLRSMMGVGRMSHRIEAWSQNDPASPIRAVRKLDAGLNP

SEQ ID NO: 2141 - protein, 219 aa, Methylobacterium sp.
MAESSTITREMIEAGARALYLKDRGVPDDAWGRDLPESTMELWRGYARAALTASAAAMFGSKRRPYYGDACLGVDGMGANLRLTDGSLQLVFKDEEMDLINEEGRDLYVARLAASEVIHLRQWLIDFLPASEAEISAGHGVSPPVSVTVPAAGSEERHFWLEAAEQHGFEQTSGEEELPAFDPPAYLATEDEVLKLMAAAREQGRKDVLDTLATGGARG

SEQ ID NO: 2142 - protein, 76 aa, Methylobacterium sp.
VSSPRRAGAPRRIAAGIAAGIAAGIAAGIAAAIAAKAAAKAAAKAAAKAAGPVGRRVRARADPRYPATGLTTTSSA

SEQ ID NO: 2143 - protein, 147 aa, Methylobacterium sp.
MAGHIGISKSIDVFVNMSLFGNLSGKEKGPPTMSDALEFTTRFTGSANPALTFLPGVPATRLASAGIMSTSYREDKHKVIIGLSLPPEDSKLASATEVFTGQIVTLAQTATPAEVRAGNAVSQYILRFEIGRRDPTPVVVQSLIPLL

SEQ ID NO: 2144 - protein, 186 aa, Methylobacterium sp.
VARYVPKNLRVYFQSENGIIGFGARPPEGMEDVHLTDAGGAFVSALPGAVAFDSATSFALIRCGHLDMTVLGSLQVDRHGHLANWMVPVKIVPGMSGAMDLVSRARRVVVAMAHTQKGDPKIVEILTLPSTSIRPVTLVVTEMAVIEPTFSGLVLRETAPGVSVDAVRAATGAPLSVAEDVRGMAL

SEQ ID NO: 2145 - protein, 503 aa, Methylobacterium sp.
MEATSIVALIGLFAAAANDRRIFGSNARGLADEAISAWTADHAETVARAAVAELQRSEVAPSLGDSVAFPANPHVRGTAAIQRVFLDRESQLAELEAICTVKADAADRVFDISCRSLTWAIIDCGIAANHPAFDEFEAAPDGAQSRRLGRRRIRATFDLTRIDRIRNLDLTTSDPQLREMVIEHILADLRELPGSRAPNFDQVTRENLNLIAEQLRRRLLPDWALIEPLIRIIEDDGEGLSSDHGTHVAGILAADWRERRVDGAPEEVVLRGVCPDISLYDLRVLHPKSIKNTEFAIIAALEFVRHLNSRAAGPPLIHGVNISLSIPHEVRNYGCGVTPVCVACDDLVQSGVVVVAAAGNRGWNEREMGFGNFVFCSITDPGNAQRVITVGATHKAKPHTYGVSYFSSRGPTGDGRVKPDLVAPGEKIRGPTRGGADDELDGTSMAAPFVSGAAAMLMARNRELMRNPQRIKEILCSSATDLGRERYFQGHGLVDVLRALQSV

SEQ ID NO: 2146 - protein, 64 aa, Methylobacterium sp.
MPIPLPPLAEQQRIVAKVDMLMSLCDRLEASLDVASESRSRLLDALVSEALMPNQATELMVAAE

SEQ ID NO: 2147 - protein, 195 aa, Methylobacterium sp.
MYKITSRTLDAVGPQRGLKAREDAARARMAAPIPEHVLENLRIAAERDQAERDAAAANIAESERLRRETACPCPACSGGQKDLSIDEAAFIMTALAYYRSHGFKVDPEMVKRMTYYAANPTFVVRGTAVVDPKTYDNAPNIGAMNTASAPVTVHADADLAAVADAVREQIAPVAETAKPAKAQRKHVAPPFLDGD

SEQ ID NO: 2148 - protein, 141 aa, Methylobacterium sp.
AGEAGRGFAVVAAEVKTLAEQTARATEEIAGKVAEITGSTEASVRSIGGITAVIRDLARIGAEIAAMVEQQGAATAEIARTTAQTSQDTRGVSGHMAGVGAAAGTASQGSAQVLRAAADLSRQAGDLRGAVEGFLARVRAA

SEQ ID NO: 2149 - protein, 192 aa, Methylobacterium sp.
MHVLPIVTDYLDAYPTMAARTLFVDRQVNVVEEGIDVAVRIGHLSDSGFTAARVGSVRRVVCGSPAYFERHGVPQTPQDLRDHRVAMSTGAWASTEWRFAGDQRVTVHPALMSNTNEAGIAAALAGWGLTRVLHYQIGSALMEGRLHVVLADYEEEPLPIHVVYPEGRQAPAKVRTFVDLAVARLRANRLLN

SEQ ID NO: 2150 - protein, 46 aa, Methylobacterium sp.
VPDIQLQAMQDVPHYPLGQYLQPTAYRSRLTGILDGFPTFWNVRPA

SEQ ID NO: 2151 - protein, 32 aa, Methylobacterium sp.
MPDQLVTKALQPPSETGPFRLRRCSIALNSTA

SEQ ID NO: 2152 - protein, 32 aa, Methylobacterium sp.
MPTRCSRSAATWPSASSGAEFDGTISSTVSPP

SEQ ID NO: 2153 - protein, 104 aa, Methylobacterium sp.
MHAVWSIPPQRARRIAGLLKGGCRWLTRSMVTKPVGSRTRVLTPLAACRSAIWSCEAYSCQSVSPAISAEVAVEVSPMTRHSTRSKWTTFGPEVQVSGPSGRGT

SEQ ID NO: 2154 - protein, 115 aa, Methylobacterium sp.
MSSGTCWNGSMAARRSGIMAQTGTDALPSAIGSSGNGCFRRNRIVRSSGAESSSVASMREPPNGSRFAQRRSDATQSRASTGVPSWKRRPARRIKSQRRPSASTQWPSTICGVAR

SEQ ID NO: 2155 - protein, 79 aa, Methylobacterium sp.
VPCFTPVRSPKSNGVSEAFVKTLKRDYARVQPRPDANTVLARIGAWITDYNEHHPHRGLGMRSPREFIRAQMQPAPCPV

SEQ ID NO: 2156 - protein, 99 aa, Methylobacterium sp.
VNSARISSHPTFRRLCFERNCLGITLAAAMATAYFAYVLTIAFRPDLLGIPIRDGSIVTWGVAVGVALLVLGFVLTVIYVLVANTRLDGLSRRLREDLR

SEQ ID NO: 2157 - protein, 554 aa, Methylobacterium sp.
MTGVRFLLSAAAILVAGQARADALTGPVTRQPLNATAIAMFLGFVAVTLAITVRAARSGTRTASDYYAAGGGLSGFQNGLAIAGDYTSAATFLGVTALIYTSGYDGMIYAVGFLVGFPMILFLVAEPLRNLGRYTFADVAAYRLSEVPVRLVAGLNTLVIVLFYLIAQMVGAGKLIELLFGLPYVAAVVLVGVLMMAYVVFGGMRATTWVQIIKAVLLLTGSALMSALILARFGFSLEELFARAVALHPKKQAIMAPGGLVKDPVSAMSLGLALIFGTAGLPHILMRFFTVADARQARFSVLVATGFITVFYTLLFVLGFGAIALVQGDPAYKDAAGGVIGGTNMVALHLADKLGGPLLLGFISAVAFATILAVVSGLTIAGASAASHDLYARVLRRGRASEQREVWVSKASAVAISLAAMGLGVLFENQNIAFMVGLVFAIAASANFPVILLSVAWRDLTTRGAVAGSLAGLVSSLLLVALSPGVWTATLKLGVAPFPYDNPALFSVPLAFVTSWAVSRLDRSAAATSVRAAYAAQHVTAHTGFDRPAAPAAH

SEQ ID NO: 2158 - protein, 1637 aa, Methylobacterium sp.
VAPLALIPAQDGPVLVFEDAAGSSAAIDGAPLSIERFLEIAVGATSALAHAHERSILHRDLRPAHLLVQDDGVIRLAGFGRGIALDEPDVQWSDLPVTDDALPYAAPEAARRADPYADARSDLYSLGITFYELLTGRLPFAASTAAEWLHAHVAVQPPRPSHSRDVPTVLEEIILKLVSKEPVDRYPSASLLLADLVRCRTEWAEAGSIKPFRLGRETRPKLALSERLFGRDSETGALLDAVERVRRTGRSELVLISGPAGAGKSALVGAVQARSERADTIFTFGKSGQHQGDIPYAVVAQILRSLIDRLLSASRDELQRRRNLLLATLAGHGQLVSKLVPELELVLGRQPPVADLQADQAQRRVNAAILNTLQAFAQNDETLIVFLDDLQWADDSTWAFFTFLLTESARNILLIGSYRDGETARSAELQALRSHMSARSLPVSELSLRPLAIGDVATLIAVATKGREELIEPLARTVHEKTAGNPFFVGQLLRTLVDEHVFRFDEHGGGWSWDLAAVARHHSTDNVVDLMVRRLGRLPKEGRKILRCLSCVGSGCDEALLARVLETTPAWIREHADGLRAAGLLTRDGTTYGFAHDRVLEAAYASSTPAARSEVHARIAMTMVEMWQAAPDDSPFAIANQIERAKIDGLPIEITTSFARLLLAAARRAKSAAALDQALGYLDTARRLLTETSWKDQYALTYQATALRCECLIIKAELALAATEIDHLLANSSSAIDRAGAFRLKAALQTLRSDYESAITSVLTGLDALGISLKRYPSSEDLSHTYQHIQNRMQGREISNLVEIPVSMDPELEAAMGLLVTCQASFFVDDGISFLHLAKIVELTLDHGATAASPYGLSWFGVYIAHHYDAYDDGLSFAKVAAELLDRHGWEYSRAATLVAMDQVSVWTQPLPSALANAREAASAGVMSGDLGMACYAGNHIVSNLIFMGEHLSRVVDEAEGRLNLTRQIGFRDIERLLNSQIGFAERLWRGGDSAMMPLPDPGQAESGEAGATPVSQPTLFWEWLYAGMSAAYFKDYRAAALNLAMLKQLEWAIPAHINLADYHFFSALTAAHIEDAFAGSTLRIEKLGPHRQRLVSWATLNPASFANKLLIIDAEIARLRGADLEAMQLYERSAAAAAAVGFIHEQALAHELAAAHCESNELRTAARQHLRTAIECYRRWGAEEKVRRLEAENPLLGAERREETSPSRSGQASLDIAVWAAAARAFSEEIVLDQLIRKLMDSMIVHAGARYGVLLLMREDSPVIQAKGHVIDGAIAVDLSQAEPTAESVPLAIINMVIRTRKTIVLEDADGEGRHASTLDLGDRSPRAVMCLPLLKQGRLVGILYLENDLATGIFTPGRTAALELLAPQAAISLEAARLYAELLEENARRRETERALRSARAELTRTAHMTVLGGLAASIAHEINQPLTGVGSNAAAGQRWLRRDAPEIGEALANLQAIQENAVRAADIVRALRSLAKQTPPKLGNVQVDDVIREVLNLTSTELEAMQVALDVHLASEDCHVVGDRTQLQQVVFNLVTNAIEAMGSKDTAGRKLTVRSACRDAKITVHVHDTGEGIPPDVIGRIFEPLFTTKSSGMGMGLAICRSIMEAHGGMLSALPASCGGTTFIFSLPAATGM

SEQ ID NO: 2159 - protein, 398 aa, Methylobacterium sp.
MSLPKIILALLGAGLACCGPAAAADPIVIGVLTDMSGVYADFNGRGLVRAVEIAVREHGGTVLGRPVRVESIDPQGKADNALTAARQWIDRDHAPVLLESVNSVAAIALQKLTEEKKTLFFSFSGTSALTNEACSPYGIQYVWNNYAMSGGAGKSETQPREKWFFVTADYTFGKTLEEETRKVVEARGATVAGVVRHPLGIADFSSYLLQAQAAGAQVLALANAGRDTQNAVLQATEFGLPAAGIRVQPLLMFDTDIRGIGLKNAQGTHFVTSFYWDQNDRARSFSKTFFEAHQAMPSMNQAGAYSATLQYLRAVEAIGTLDPDAVRKQLGKMRIDDAFVSGGTIQPNGNMLHDLSLMEVKSPTESTGPWDIAKLVRRIPGADVYQPLAESNCRFLAH

SEQ ID NO: 2160 - protein, 566 aa, Methylobacterium sp.
MSDWRARGGSSFTCEKTAVRASRGMAVTNHPLASAAAVEILAAGGNAIDATVAALFTLTVVEPMMVGIFGGGTALIRLADGRETVIDGLATAPAIARPDSYTPVSDTWPDYMEAAGRENRVGPKAVAVPGNLKAWCEVAERFGRLGLDALLEPAIRHAARGFRITPYLTACIEDTAPDLSLDPTIAGVFLPGGRPLAPGSLLVQSDYAATLRRIASKGPDLLYGGALGREVAAYLESVGSFVRLDDLAAYGTVEREPVRGTYRGVEIVGPPPPCSGAVHTIQILNMLEAFDLRASGFGTPETLHLVLECLKVAAADRRAATADPAFVDVPQARLISKDYAALRRTEIDLGCAGAYAAGVGSNESANTTHVTIADADGNIVTSTQTINSLFGARIMVPGTGIIPNNYMSLFDPHPGFALSLQPGKRITSGITALIGKRDGRPLFALGLPGAHRIPASAMQAVLNFVDHGMSVQEVVEAPRVFTWGQEAEIERGIPTDVRSALSRLGHDVAPVDHVAGGMCAIAFEPDGVMTGAACWRADGVPMGLGGGLARSGTSFWPDPRRSRPTN

SEQ ID NO: 2161 - protein, 93 aa, Methylobacterium sp.
LTAHARLAVAARIALAIFGGYGLAALATATLALALPMGQADASSTATMLSFAIYAVAVLWAFGARRLATAALGLLLPALLLGGLVWVLHGGAL

SEQ ID NO: 2162 - protein, 521 aa, Methylobacterium sp.
VKATFRQSMAWLHAWCGLVVGWVLFAVFLTGTLSYYRTEISQWMRPELRAVQAIDAPGAAERAVAALSVRAPDARAWFMTLPTPEIPATRIVWRTAPGAPFSVALLDPTTGAPLSARDTRGGDFLYRFHYELHLPPLWGRWIVGGCAMVMLTALLSGIVTHRRIFVDMFTFRPGKAPQRAWLDAHNVTGVLALPFHLMITYTGLVTLMLLYMPWGVDTAYRGDRERFFQDRGQSIAARPPVHAPGELAPLGPMLRAAMRVTNSEPTFVAIHNPRDARSTVVVTMDEPEGLAHLHPAVGFDGVTGSLLATTTPASAVTTAHGTMVGLHEAHFARAPLRLLFFLSGLLGCAMVATGLVLWTVARLPKLGVPTRWSFGHRLVDALNVATVAGLPIAVGCYFLANRLLPLALPGRPEAEVHVFFAAWLSTALPALLLAPRRAWVVALATAAAAFLAIPIVGGLTTGRHLIASFREGDVVFLAFEAIALSAGAGFGLAAYALRRPGKRWLGRTASPDGIMGTSSSS

SEQ ID NO: 2163 - protein, 86 aa, Methylobacterium sp.
MHYTSGLTHGSSSTHLAPSSETSGAFFLGSGTAGSFGWKLDEVCSGGPSARKARWTLSVAGDTMIASIARGFKAGEPFTLKRCATR

SEQ ID NO: 2164 - protein, 59 aa, Methylobacterium sp.
VIGVPELAFVAAQVNNRAMVYPAEIFLFVGAVYGILCAGLDGLAARLTNTGKVAAHRTP

SEQ ID NO: 2165 - protein, 82 aa, Methylobacterium sp.
VATTIAAAVEQQGAATHEIVRNVGQAAAGTGEVTRSIVSVAGAVEKTGQAAGQVLAEASRLSEQSEHLNGEVARFLDRVRAA

SEQ ID NO: 2166 - protein, 182 aa, Methylobacterium sp.
VTSDWWDFEDEEIEMPPAFPVKVAPPDYMIALERCWLATGFPNRKRCLIGIDGFDLAGKSSLGAWLAWQLGTPCIFLDDYRMRWKPPRSWRAKEINRLLDARFDLNRPVVIESIFLLEALRQLGREPDLLIYVENQKRDPDDAMEGLVNYVAWEGLPGRADVVVHWSSDNPTADHPWTAAKA

SEQ ID NO: 2167 - protein, 75 aa, Methylobacterium sp.
MADHTLTPEEIGALKLALARVLVEGKKTAERVDQATDDPSLYDQAHTSIAAERRQAERLMEMLENADAVVVQMPD

SEQ ID NO: 2168 - protein, 352 aa, Methylobacterium sp.
MSTTALNPFDVASLGGDIFGPGGLIKAGLGTLELAGTNTYAGGTAVYGGTLAVSRDANLGAAGTGLILGGGTLEVLTDGFTTARPLTLTGLGALQIDLGNATFAGSIADGSQSGTLVKTGLGTAILSASNTFTAGTVISAGTLALTATGSLTAPVLVGSAASFLNAGLVSGSVANLGVLANSGTVAGGLANAGLALNTGIIGGGATNTGSLVNVGTLAGGLNNAGTTLNSGSITGGAANTGSLVNAGTLAGGLSNTGTALNTGTIAGGATNSGVLSNAGAIGGGVANTGTLSTSGMISGGLTNAGTVLASAGRIDGPIANNAGLLAVSGSVAGTGPFANAAGATLAVTTGGS

SEQ ID NO: 2169 - protein, 40 aa, Methylobacterium sp.
MRSGHDQAAEVAVSGSGLPKRQPSWPPMWMGVIIGPPRRR

SEQ ID NO: 2170 - protein, 72 aa, Methylobacterium sp.
MKAISSEDNGKKWQEELRLAQQTWMRFRDADCGDLITDEWHGGTGTYPAIATCLLGHTEARTAELKRRYDRW

SEQ ID NO: 2171 - protein, 91 aa, Methylobacterium sp.
MPRARFHRARMLWRRLSGWRTFIFFTPAFLLALLDALHAVDFRQLLIDMGAPEGTAKAIVAGCFLMGLVMRAYTTTPPMRAPDRDAPGGPR

SEQ ID NO: 2172 - protein, 153 aa, Methylobacterium sp.
MAWRVRARSAWTSRSPGCQGLPSGRRKIRATFAWPANSFVPDSRMSVSPRVSTNPSRASAIAGAITRASGRVPYAVRAVLRPSTVPGTPAAFQPRRLAPFTTLPAASRYMSRVAAAGAVSRKLMKRLRPSALWSTRKPPPPMLPQQGFTTASA

SEQ ID NO: 2173 - protein, 90 aa, Methylobacterium sp.
MPKSSTLISVCALIVMIREPPGEPATSATLPSRSTIVGAMEESGRLPGWIAFFVPCTSPNRFGTPVLTVKSSISSLRKNPVSPAITPAPK

SEQ ID NO: 2174 - protein, 50 aa, Methylobacterium sp.
LPDDAASGRAGAAARTAMSSCAPQGLCSTIVWPMPLRMAWVSAESAKGSA

SEQ ID NO: 2175 - protein, 53 aa, Methylobacterium sp.
EYALPTDSFLNFFRSSAVTLKVEGLYVNLDRNTRNQGAFVINAANNFPVVYSG

SEQ ID NO: 2176 - protein, 41 aa, Methylobacterium sp.
NLYGPAEAAIDVTACDVAAWDSTCADGPVPGPRVPIGAPIA

SEQ ID NO: 2177 - protein, 87 aa, Methylobacterium sp.
VAGQDNVETLVVLQPISIDTASPDQVGMLVMANGLLVAVLVRLDAPEHARCGSWFLEVGLGRLAGARAPTFDTLEDATRWMRQRLKR

SEQ ID NO: 2178 - protein, 301 aa, Methylobacterium sp.
MPFDVIVVGGSFAGLAAATYIARGRRSVCVVDAGSPRNRFAAASHGFLGQDGSDPRTMLAQARGQLAAYPQATLVEGEAVDVRAGRNFTVTLASGEALDAARLVLAYGLTDVLPEIQGLAERWGKSVLHCPYCHGYEFADGKLGVLAVSPMSAHQALLIAEWGPTTLYLNGGDMPDEATCARLARRGVGIEPAPVAALVGEGGTLSGLRLSDGRTAAVDALYLAPRTRMNSPLAERLGCALDEGPFGPVIRTDAAKLTTMAGVYAAGDIARAPHSVSWAVADGVTAGISVHQSLVLARLAA

SEQ ID NO: 2179 - protein, 595 aa, Methylobacterium sp.
MSLSSPRRAGAVRRVLAFVVRGWRKRWPLVAGLSGAITLATFAEVMLPLYAGRLVDALTRPERQAALEAALPAFLAMTALGLATALLRHVAWSLVVPLTLHTMSDMARDGFARVQRFSTEWHANTFSGSTVRKISRGMWALDGLNDTLLLALLPALVVLLGTALVLGLHWPALGAVVALGAAAYVGATALLATRVIAPASALSNALDTRLGGALSDAIGNNAVVKAFGAEGREEARLGRLLGKWQRRTHRTWMIITWSGTGQLGLLLALRTAIVATALWLWWRGEASPGDVAYVLTTTFVVHGYLREVGGHINHLQRAINEMEELVALAAEPVGVPDRPGAVPLAVAGGTIRFADVRFHYGAHGNPLYDGLSVTIPAGQRVGLVGRSGSGKTTFVKLIQRLYDVSGGRVTIDGQDVAAATQASLRAQVAIVPQEPVLFHRSLAENIAYARPGASAQDIERAARLANAHDFIARLPKGYATLVGERGVKLSGGERQRVALARAFLADAPILILDEATSSLDSESEALVQEAMARLMHGRTAIVIAHRLSTVQALDRILVFDRGRIVEDGPHAALMRRPGGAYRALFERQSVLAESA

SEQ ID NO: 2180 - protein, 145 aa, Methylobacterium sp.
MTQAVNDERLSLDYVSVEDLNAALRVFRRLPLELLGFLILLPIVGFGLSWLSAALAPPYGLYIFGEGLVTWGLLLMCALLFGLLWWRGRQVGRLLNDPAILASPVMSLLSVPGVVAERAQALGMEWSGFYGPLRPCRESVNVEGR

SEQ ID NO: 2181 - protein, 117 aa, Methylobacterium sp.
MTTRDTTKRRAPPLSDAEEALLQAAIANNPDSEELTDAELARLRPARDVLPPAVYAALTQGSPSQAESGRVQLTLSVDPDVLAAYKAGGPGWQARMNEALAQGIARGKRRSRAVKRG

SEQ ID NO: 2182 - protein, 466 aa, Methylobacterium sp.
MDARTNRLLTGAPLATLLRLAAPNILMTTVQASVGLIETYFVAELGTDALAGMALVFPLLMFVQMVSNGAVGGSILSTISRSLGGGRRDDANAFVWHAVAIATALGLATTLAARLSGGLLYRAMGGADASLDAALTYSNVVFSGAVLLWLFSALAAVIRGTGNMWLPAAVMCLGALVLVPLSPALIFGWGPLPRLGIVGGGIAVVGYYAVGAVIFAGYLWSGRGVLHPSAKPPALSAGAAWVILKVGAISAVVSASTNITIAAATGIVGVAGPAAVAGYGTGARLEYLLVPVVFGLGAPLAAMVGTAIGAGDLSRARRVAWTGAAMAGVLTGGIGIAAASYPDAWLRLFGNDPAMLATGSQYLRLVGPFYGFFGVGLALYFAAQGTGQVGWPLVAGLLRMAVALIGGSWAIGAGYGARGLFVALGLGLTTIALVNAGSLALGAWPRRAASAVPAAAPRRTAIAADL

SEQ ID NO: 2183 - protein, 386 aa, Methylobacterium sp.
VVRAAADSVVRRNEFLGRIQAVDRVDVVARVTAYLDKRLFEEGAEIATGDRLYGLERGPFEADLEAKKAVVSQLKATLVNANLTLGRAQTLLNGPAGQQSTVDAATAQSLSLQAQIQAAEAQVRIAQINLDYTDIRSPIAGKIGRTNVTVGNVVTPGNGVLATIVGQDPMYVSFPVSYREFLDLRTYYADQGGLRAVAIRVRLPDGRTYGEIGRLDLVDNTIQSATDTIILRGTIANPLLGSARSGAVARQPRPANLAVRELADGEFVTVSLEGVRPQEVVSIPRSAILTDKEGDYVFVVGPSDKVEQRRVRLGQSTSTVAAITSGLEVGERVVAEGVQRVRVGQVVAATPAREAMAAEPREPSSKTSADAPGRESASAAATRVSH

SEQ ID NO: 2184 - protein, 261 aa, Methylobacterium sp.
MTLLRNLVPPLITLALVLAVWAYATGPGGLPSYLLPDPVSVGRALWTGLVSGEYGPHIQFTLTSTLLGYGIGSVAAVAIGVLVAESRTFERFVFPYIVAIQAMPKVALAPLILVWFGFGLASKVVLVALICFFPLLVNTIAGIRRTDPELIDMARSFSRPSWWIFLHVKLPAAAGAICAGLEIGIVLALIGAIVGEFVAAEKGVGYLIGSATVNMNVATMFAGVLLLAGFGIAGSALVRFAQRRIVFWEWAPDPSSRGERA

SEQ ID NO: 2185 - protein, 183 aa, Methylobacterium sp.
MAEIAQAVGGKPIEIWFADEARVGQKNTITRRWAKRGTRPAAPKDQRTASAYIFGAICPALGKGAGLVMPRCTTEAMALHLEEIAQVVAPGAHAVLLLDQAGWHTTKKLVVPANITLLPLPARSPELNPVENLWQFMRDNWLGNRVFKSYADILDHCCHAWNTLIDRPWSIISIGLRAWAHGF

SEQ ID NO: 2186 - protein, 240 aa, Methylobacterium sp.
VRNLRERLGSAILLGGAILLWGANWPVMKIGLGHISPLWFSASRFAVGAACLFAWQVMRRELRLPRRADLPVVASIGLLQMMLFTALGAIAMTHLPAGRSAILSYTTPIWVLPVAVVLFREKISQRQWVGIALAGIGVLVLLNPHAIDWQDSRVVGANGLLIAASAAWAVCILHLRYGRTPSSAIQLAPWQMLLAAAVLVPLAYTAEGPFTGDGTGVFWACLAFVGPVATAFCFCAVNAA

SEQ ID NO: 2187 - protein, 213 aa, Methylobacterium sp.
VTDGRRLTGTAGRAHAMASPSRLLDRMAQPLDRPRLLEAFEALGADLAEHGRFVELAVYGGGALMLQFAWRRATEDVDAVVRAGYDESALAPSVIRVAARMGLEADWLNDAVGMFTPLEEDETLFAVSGTYPTGGTPGLRTVLASPTYLLAMKLHALQSLDRGDRDLNDARALSAHLGLGDVEALERLYRSIYGEDPSPEVRARFPAVIRSAP

SEQ ID NO: 2188 - protein, 43 aa, Methylobacterium sp.
MSIEKQRGNRETKKPKKPVPKMNAAAPSQKNTVASVVKRSEGR

SEQ ID NO: 2189 - protein, 152 aa, Methylobacterium sp.
LSYRTITVALALACLSVPALAQTTPTTPAPGTAMPASSDMGMKMADTATVKLKYVTVKPADVMSSKLVGTTVFNNKNENIGEVEDLVIENGKTVTGVVVSVGGFLGMGESYVVLDPSTLAISDKDGKWAVHADTDKDTLKNAPKFTYSKKKS

SEQ ID NO: 2190 - protein, 99 aa, Methylobacterium sp.
MAASPRARFTPLARADLEEIWRYTFGRWSPDQADRYHQAIVDAAGELATGAKVGRPVEIRAGYLKYAVGSHVIFYRRTESGIDVIRVLHRRMDVPSRLS

SEQ ID NO: 2191 - protein, 148 aa, Methylobacterium sp.
VFIRNPEARFPPQALLCADPTREPAQIVGWFVRRWSVKVTFQEVRAHMGVETQRPWSDTAIARTTPCLLALFSIVTLLAAQLPARQRRRVAIAAWYLKPRSAFADALAAVRCAIWRERTSATSPRRRAQTKPRFRLPAPWAYALCHAA

SEQ ID NO: 2192 - protein, 45 aa, Methylobacterium sp.
PPAEPPAEPVPAPRPEPKAAGNPFSVEEIEAEFARLLGRPLDKRS

SEQ ID NO: 2193 - protein, 107 aa, Methylobacterium sp.
MTGKRAFKSDAFESIHATAMAFHEVGVTDAETMRAFDEICLAVPPTIKPAQIKQLRENLNVSRPVFARYLNTSERNVEKWETGAKKPSGTALKLLAVVQKHGLQVLA

SEQ ID NO: 2194 - protein, 495 aa, Methylobacterium sp.
VSARRLLRLLAVEIRLILRERTTWAIIAALMVALWFGAYTGVARVASERAAITKAAEDAARAVREAKAAHERYGRPGPLKVSYWQDPTHAFGYLTQFLTVYAVKPPTPLAALAAGQSDVQPALMRVGFGPSTVFDDTAYELGSAAKIKLGPFDLAFVLVYLVPLAVIALVGTRLSAERDAGILRMIAAQPVSPRVVAGAKFGAATAVCVVSVLGGTALSLWLNGGLEPLGGWEATLALLAVALACYTVLWVLACALIASLWRGAVTALTLLVLAWACATIALPTALGLTVDGLAPTPSRIAAIDASRVAQDRFYNGDEGPRIMESWLATRAPEAAGRVDLRDAPEIKRLARDAFYDVALAEHRDAMQAHALDADVWSWRLTLLSPATTLARALETAAGTDGGRHATFLAAVAEYRQSLRGFFEPLILAQALKPAPICPGCQARLDFDAYDAVPSFPGVVAADKAERQALVSLICLMVSATVLSALVYRRYADWPA

SEQ ID NO: 2195 - protein, 461 aa, Methylobacterium sp.
VSAELALIWGDARLRWIGAVLILLQAVAGLGAWQAAERYGAEVARITAAERARWLGQDAKNPHSADHYGLWVLRPSSPLAVLDPGIEPYTGRMVRIEAHLFNDAVYRAVQDAGPLDRAGLRDVADLVGLVVPLAAILLGFSAFAADRERGTLRLALGNGAAPGRLFAGRFCALLLALGAVVGLPLLVLGGLAATYRETEAWQAGPRLLVWVVVQVAYAAVFLLIAMLASLSARTARGALATALAAWVVLCIVAPRLASVGVEEIAPTLSYQETRARIDAAFRTNRTAEASDARVREVLARYGVSDPDELPMNLHGLTMTENEQRNFAIYDREFGAFFDSLTRQERAFGWAGLASPRIAMQTLSQTLAGTDFAQHAHFVWSAEAYRRGITERMNAEIRDHPQRGSQSLVSGPDLWRTIPPFVHTPLPFARSLADARVPALVLALWLTLLAGLSVPLVRRLQP

SEQ ID NO: 2196 - protein, 244 aa, Methylobacterium sp.
MAGTTDDAVLALRRVTKRFGARTALDNLALNLRAGEVFALLGPNGAGKTTTINLVLGFHRADAGEVCVCGIDAGAEPIAARAQIAYIPEQVALYPDLSGVANLRYFATLAGLDLDGPAARRHLDEAGLAPEAQMRPAASYSKGMRQKVGIAVALARRARLLLLDEPTSGLDPSAAADFSEMVRAAAGRGTAVLMATHDLYRVREMADRVGVLAAGRIIEELDPRSLDHVGLERLYIERLAGAAA

SEQ ID NO: 2197 - protein, 272 aa, Methylobacterium sp.
VTSDANGTLFVSSIADGGVLKVAADGAVTSQFLKLGDHGTRSTFGLLADPKRGVLWVASNDATALGAKGPTDTEGAWIKAFDVATGAMKTSVRLPGAKALANDMALDGDGSLYVTTTFAPQILRLKPGAAEFEVFVENPALAKGLDGIAIGGDGNLYVNTFLGGELFRIAMNQGVAGEVTQLETTRPLEFPDGLRTFKDGFLMVEGSGALSRVTVSGNAAKIEPIHQFAGPTGVTIAGHKIWVAEGQLGLMSKPVEAGSEAPSFHLRSVDAP

SEQ ID NO: 2198 - protein, 574 aa, Methylobacterium sp.
MEQRERMLRLMSQGAWRAALRGRHLGGIPYGYRRGQEVGDLVVEANEAAVVKRIYHLFDSGVSATQIARLLNGENLPPPSGSGQWTRSVILGGPSHGNGILRNPKYVGVYIYGKSRRVRRPGTSSKMVQMRPSTSWVYGAKPAWSFVDRDLWLRVLCRLKLMHDDKGLRKPREKLSGKATLLFHGRYRCVCGATMHGIFRGASTTRSLRCYSQAEGGTCERSRSFSSTFVECEILRVIRDTVLTSADLPAYIREYTAQLGRMEEEIAREKRERLNRIAELDRWLEKSIDSAINKGGADEDLERARIRKRAERSDERLALAALPDIASMPRVDPEAFVSLRDEMDGLIRRMPIAATSEADLLLVQTLRGLVEKVVIDQTDEERGYALEITFTPSALVARNYRLPLAGLDPVTIRRICPPSRTTIANLAEIDALLRAKADRREYTLSDEDWEIVREKAQSWPFDDARWAMDATLFYLRSGRGLRSLPPPFSGPKVRQRVRSFVQRGFWRLAYDALVEAASPAVRALDTSRLASMERVALSRRAGLPEIVGRRDAGGEPAGGSRLRPSGPPAPSGGT

SEQ ID NO: 2199 - protein, 159 aa, Methylobacterium sp.
VFIDRQLAGPYGEGARLYMKGPFAEGTKTQGQQSPLRPAARFRAGLLALDAHCRAAFGATFADLASDRQVEVLKGLETGTVKFTGSVAAKPFFELLLARTMEGFFADPIYGGNRNMAGWRMIGFRGTRYDYTDWIERHDVAFTDPPTSIMGAATWTQRG

SEQ ID NO: 2200 - protein, 212 aa, Methylobacterium sp.
MRRTLAAALALIIATMALAAQKMWDGTRWVARTLSGMPTPSSTGVEDALDDIAYEAAPVTPSAPAAESTVTPSAPAPKAETAPVAKAAQIVELDPVLARGRLAARFVECTFSLEPEENILAECDDVLRAWLLSLNAQEMMAVHCAGAHRVAAHLAGKRLLEGVPEIATVQEYRHYMGQAARITPQRRAEIAEFDAAFEDLINDEGYELNCGV

SEQ ID NO: 2201 - protein, 240 aa, Methylobacterium sp.
MTNTLQDRTVVIFGGTSGIGLAAAQQANTAGAKVIVVGFNAEGAERVAAENGFNGWRAADVTRPETIAAALADIPHVDHLVLLAGTFVAGKILEAEIDYLKRAFDERIWAALHTLRTLDGRLAPDGSVTFISGALADRPSAQGTAVLAAASAAMEAFARGLALELAPIRVNTLSPGTTDTPLLARTLGAHRDAYVTALTEKLPQRRLGTAEEAGAAVVFLMSNGFMNGETLHIDGGARLV

SEQ ID NO: 2202 - protein, 80 aa, Methylobacterium sp.
MLSIRDEEVRTLAETVMRKSGAPNLTAAIKLALQHEIRRADEAVPLTQRVAAIRAKALAKATGTPQPPLSEAERDALWGA

SEQ ID NO: 2203 - protein, 215 aa, Methylobacterium sp.
MDDETVQEQLKGKAPASGAMRIAIVFHSGYGHTARQAEAVAAGVRLVDSTEALLLPVEDVDRSWAILEASPAIIFGAPTYTGAASAAFKAFQEATSRAVMAAGYLWKDKIAAGFTNSGARAGDKLSTLVQMALFAAQHGMHWVSLDLPPANSSTTGSEQDLNRLGYWLGAAAQSNTDEGPERAPPEADLATARHLGRRVAQVTRQFVRGREALSL

SEQ ID NO: 2204 - protein, 209 aa, Methylobacterium sp.
MKLYYIPASCSLAPHIVAHELGLDLTVCRVDHATHRTEAGEDYGAINPHGYVPALALDDGSVLREGPAILQYLADLKPEARLAPENGSLARYRLQEMLGFLNSEIHKGFIPLLYARLAGRWVETAKPRLAARYAWIDAQLAGRDFLMGGTFTVADAYLFALTGWGQAPWLTSYYRADIQFDDLHNLRAWYGRVRGRPAVRQALQAEGLR

SEQ ID NO: 2205 - protein, 99 aa, Methylobacterium sp.
LCAAIREVEQGQADDLGGGVFKKRLNKNMHRSVILAKIGHYWLYQYLFAKKDRANIEDNELKAFRLLAKDLGRTTDADIARLIAAGHIMEICDDREAGL

SEQ ID NO: 2206 - protein, 266 aa, Methylobacterium sp.
MKIAIITPSRLKRSTLVGKSHLYFLEHAVASAAAQELIDKQITIHFFVGIDADTVIPARLADHPQLTFVRSDCKAQVPALNAAIRAVDASWDLVGFLEDDDRWLPQYLAVAIRALEGFDFVSSTQLEVNEADEPVRINDFPAPSGWLMRRSTFEKVGAINPASKWHYDNEWLGRLAETGLRRAHLVEATAPWTMDDAFQVRPWLANVLRFGGPNIHLVRHGFVLPLVYRLVHPGSGTSHVGGGGTAKTESNAEYQWLVDRFGRIPW

SEQ ID NO: 2207 - protein, 159 aa, Methylobacterium sp.
VPQRLKTTRHEDDVHAWAQEQVHFLQAGAWARLDIEHLADEIADVGRSERHALTSALSVILLHLLKWDHQPTRRTRSWVTSIRTQRVVVAERLEDSPSLKSRIDVLVARAYHRALIEAAGETGLDEGTFPPACPYDVETIMTREIPWPPSDGQPRPQRG

SEQ ID NO: 2208 - protein, 389 aa, Methylobacterium sp.
MLNGLKGFDFGLGETADALRAEVARFASVEIAPRAAEIDRCNDFPADLWRKFGDLGVLGVTVGEEYGGAGMGYLDHVVIMEEISRASASVGLSYGAHSNLCVNQIHRNGTEDQKRRYLPKLVSGAHVGALAMSEPGSGSDVVSMRLRADKRGDRYVLNGTKMWITNGPDADVLVVYAKTDAEAGPRGITAFLIEKTFPGFSTAQKLDKLGMRGSNTCELVFQDCEVPEENVLGQVGRGVNVLMSGLDYERAVLAAGPLGIMQACLDVVLPYIHERKQFGQPIGTFQLMQGKVADMYTIANAARAYVYAVAKACDRGQTTRKDAAGAILFAAEKATWMALEAIQALGGNGYINDYPTGRLLRDAKLYEIGAGTSEIRRMLIGRELFNETD

SEQ ID NO: 2209 - protein, 31 aa, Methylobacterium sp.
VSDVLMIPLLRITVTRNPSGEWFVTITLGLA

SEQ ID NO: 2210 - protein, 53 aa, Methylobacterium sp.
MGLVQAIAPNPHAALELGLGMAARIACCGPLGIKTTLASARAAVVGSEGMGLL

SEQ ID NO: 2211 - protein, 591 aa, Methylobacterium sp.
MLALSGAPSAVESRPAPRFCFELSPLDYARLVHPRAPGAVLFGAHLPSTKLRKADGSPKVAWQDRRWSPGALANRAVDLARFKFMSFATYPYHRPGEPKPVKIEANVVSIGASWVDLDFYDQSEWEDVPPATVLENVRNICQDRGWPAPSYATHSGRGLLVVWLYPVQPAQAVMARHKALQQTLHEAFRHMGSDASARTMTKQFRMPKTFNEKSGLPVSIIWPAMVREIERTTFDELCRVVLPFKRMKRAEREAKEDAAKAKRTAARLAARAPREGHFGARLTGTSYWATIRADLEKLLAHRHGKKGVVDGVARSEYGAGRNAWLTSLVYAAAWDMTPEELEAYVLECADRLGYEHAEAKDKCCSIVLRAKQAARGMRKTFKGRPVDPRYKLSPARFIETLAITPREMRRADLRILVDETRRSENAVARVVASRRAKGVKARSSQQDLRRQVGEQTLEMVAEGMTVKGAAELYGASPRWMDNALRDARAVAGIGCVRKERPASMPESETTIKQPLLVVDDVADTLDTIPQATHEVLRGIRPDAVEGVVAGAVVTYSAAVTTKGSTLLRPTPAARQPARRALSCPDLVGVGA

SEQ ID NO: 2212 - protein, 168 aa, Methylobacterium sp.
MAYRSPLSLVAITSNDLGEVNAVFDDLTTYSMQVDGVPKREDAAFAFVTARPSGCELRNKHAFLAKCSGAVIGLLDLIDGYPAPGTAFIGLLAIRQSAQGAGFGRALFQAAEHFAREDLRARTLRLAVVETNPVLGFWARMGFEPTGETRPFHGERLTSQAVLMEKQL

SEQ ID NO: 2213 - protein, 394 aa, Methylobacterium sp.
VLEVADVFRAAGPAYRAARAGHLSPHQRKVMAAIETCRTAALGGHVEACDGCGHTRIAYNSCRNRHCPKCQAAAARTWLAAREADLLPVGYFHVVFTLPAEVAQIAFQNKAAVYDLLFRAASETMLTIAADPKHLGARIGLTAVLHTWGSAMTHHPHIHMIVPGGGLSRDGIRWISAKPGFLLPVRVLAKLFRRLFLAGLIALHAAGRLAAFGSLSPLAERGAFLRHLAPVRTKRWVVYAKPPFAGPSAVLAYLSRYTHRVALSNRRLVGFDTAGVTFRVKDYRRDGPERYGVLTLAADEFIRRFLLHVLPRGFHRIRHYGLLASATRRANLARIRDLLAAAPPANPPEPASPPDRLAPCPCCGGRMTIVEIFGRFRQPRGPPTASASTRMRAT

SEQ ID NO: 2214 - protein, 282 aa, Methylobacterium sp.
MFDTTKVVANALGEHLALTYQRTFGSREPRYAEIIEASARLTIERIVGSDALYHDGDHTILVTLVAQDILRGRFLQRGVTPEDWLHMILAALYHDIGYVRGVCAGDRANAFVIDAQGTTVGLPRGASDAALTPYHIERSKLAVQERFGTHDIVDAGRVIRAIEITRFPVPEDDEHRETGTEAGLLRAADLIGQLGDPLYPRKLNALFHEFVEAGLDGQLGYASPADLAERYPAFFWGKVEPVIGDAARFLDLTVEGRVWMANLYAHVFAAEHDRRRMGPHPG

SEQ ID NO: 2215 - protein, 147 aa, Methylobacterium sp.
LSAIYEGGSRSAAAALGGVGLQTVRDWVVAFNAHGPDGLIGGKAPGARPRLNVEQREALRALIEQGPMPAAHGVVRWRLVDLAQILFEDHGVSVSEQTLSRVLRAMGYRKLSARPRHHAQDPDAIPVFKKPSPPAWRRSRRPSAASR

SEQ ID NO: 2216 - protein, 547 aa, Methylobacterium sp.
VIYDVVIAGGGPVGLLLACELRLAGVSVLVLEQAETCTTLLKGPPFGLRGLSAPSLEAFYRRGLLGDIEALAATSPIIRTFYQRDEGAEAPTTQRPILSRTPAGHFAGIPFFQEDIDVSRWSWRLPSPAGPRMAVYLNALEPALVAWAEERGADIRRGCRVDEIAASEDGVVINAGGQTFRSHWLVGCDGGRSTVRKLGGFEFTGTEPEFTGYSIEVELADPNQLPGGRNETAHGLYIYTKPGSIIIGEFDGGRSHRAHSLTREFVQSVLRRVSGVEVEVSALKVATTWTDRAYQATTYRRGRVLLAGDAAHIHSPLGGQGLNLGLGDAMNLGWKLAATIRGEAPDDLLDTYSNERIPVGAAILDWSRAQVAILGPSRSSQALRAVMRDLAATTEGATYLAERVWGVGLRYELGSDHPLVGHSLPDFTLTDGRRAGELLRSGRGLLLDFNVFAPLETLARRWPRQIAYLGCDAVDRLGLNAILVRPDGVVAWIGVGEPDVHAAAAAAIRWFGDPRGERHFADGEALNAAGDPHALRRFKREARAGSA

SEQ ID NO: 2217 - protein, 142 aa, Methylobacterium sp.
VFAPVTSLGLLTELCPGVGIQACMLVGCGADRCSTVRLLTAKDWHRRIVALSNGRSRCGSHHVLLLGGLPSREPERSAALSGIEQAVHRGGNTRLVFSTLRKRSEADRSVHSQDHSREMLAMIELAFPGLVDVPAPAGGAQR

SEQ ID NO: 2218 - protein, 250 aa, Methylobacterium sp.
MRILLLNPNTSAAMTARMAQAAEAALAPDVQITALTAATGLPYIASRAEAQLAGAAVLETLAAHHAGHDAAVIAAYGDPGLIAARELFDLPVVGMAEAAMLTACQLGARFAIVTFSPALLPWYEDAVALAGLSARCVGLYAVRRPFQVVIAVQDELRPEILALAERAVADGADAVILAGAPLAGLATVLRRAVPVPLIDPLAAALGQAQALVRLGTRPPTAGRFARPPAKPATGLTGPLARWIAHREGEA

SEQ ID NO: 2219 - protein, 290 aa, Methylobacterium sp.
LRQRLIEEMNLRRFSHETQRNYLRDVGRLATFLGRRPDTATAQDLRRFQVEQRQAGVPVPTLNGIVSALRFFFTHALDRPDLARRLVRLAYPRTLPVVLSRAEVARLLAATTCLKHQAALAVAYGAGLRVAEVAALKVTDIDSARMLIRVERGKGGRYRNALLSADLLALLRQWWRAGRQQGVMLGDGWLFPGQHALKPVSTRQLRRVVIEAARAAGITKRVGPHTLRHSFATHLLEDGTDIRVIQVLLGHAKLDNTAFYTRVATRTVRTVISPLDRLGLCEAGGIAAGG

SEQ ID NO: 2220 - protein, 265 aa, Methylobacterium sp.
MNPKPDHGETSYRGHGRLEGRKALVTGADSGIGRAAAIAFAREGADVALSFVEDEMPDAKEVAKLIEAEGRKAVLLPGDITDKAFCETLVRKAVTDLGGLDILVNNAGKQTNQKDIGDITDEQFDRTLKTNLYAMFWITKAALPHMPAGASIINTASVVAYNPPQILVDYATTKAGIVAFSKALAKQQIARGIRVNAVAPGPFWTALQPSGGQPQENVEKFGSEVPLGRPGQPVELAPVYVFLASQEASYVTGEVYGATGGNGTA

SEQ ID NO: 2221 - protein, 252 aa, Methylobacterium sp.
MLRDIEGQVAWVTGAGSGIGQAAAVALARAGVRLALTGRRAEALEQTAEQVRAVGGEALVAAADMGCADAVERAWDAVHAAYRRCDILVNSAGLNVPKRSWSEISPVDIDAVIGVDLNGPFYASRAVLPTMRAQGGGLIVQVSSWAGRYVSKLTGPAYSAAKHGLVALSESLNQEECGHGIRSCCICPGEVATPILDKRPVPVTADDKARMLQSEDLAETILFVARLPSTVCVNEILISPTWNRGYLEGVKL

SEQ ID NO: 2222 - protein, 513 aa, Methylobacterium sp.
MTTSLIRSRRMIARTLDYDRWEEVADGAVLQKDGIIEAVGTYADLHARYPDAPVIGSGREILLPGFVNGHHHVGLTPVQLGSPDMPLELWFVTRMVARNLNLYLDTLYSAFEMVGSGITTVQHIHGWMPGSLEEVEARSNEVLRAYRDIGMRVSYCFAVRDQNRLVYQADMDFVASLPAPLQDPMKRWFERFQMSLEDNFSLFRSLHGGQAGSRRAKIQLAPANLHWCSDAALEGLAGLSETYDVPMHMHLVETAYQKAYAEKRGGGTAVEYLDRFGMLGPRLTLGHGVWLNESDIDRVAETGTCICHNCSSNFRLRSGVAALNRFEAKGINTAIGLDEAGINDDRDMLQEMRLVLRAHRVPGMDEADVPSMAQVLRMATVGGARTTPYGGSLGTIEVGKAADLVLIDWDQIAYPYLDPETPLLDAVIQRAKTGGITAVLCEGEVLYADGRFTRVDRDAALKALHDDLSRALSDDEVERRQLSKALLPHARRFYADYIDPARHEPFYRPSSRV

SEQ ID NO: 2223 - protein, 268 aa, Methylobacterium sp.
LASEPASQDAVSCRGVAKVWAAGTARAHEALRDIDLTVRPGEFVVFLGPSGCGKSTLLYLMAGLEAASGGNLFSFGKPVAGPSPERSLIFQETSLFPWLSVWQNVSFGLSLKGVPEAERRSIARAALQRVGLAEAFDKRPDELSGGMRQRVAVARALAMRPKVLLMDEPFAALDVQTRQKMQDFLLDVWRDSGASVLFVTHHIDEAVALADRVVVFTARPGRIKTIVRNDLARPRDPFSPGAEAMRRHLTELLRDEVDRAFAEQEALV

SEQ ID NO: 2224 - protein, 309 aa, Methylobacterium sp.
MAIDLARAAAVPHGQPRLLFAQRLALPDGLIPILRRTGWMLVSVGCFAGLWELLWALGVADAKLLPPPHIFLGNLVEQARFFNTAQRWQIGTGMNAGPSPAMAVLITVLASTGRVLAGLFLAATLSILVGVAIRYVVLFERLTLPTITLLAPVSPIAWLPVAIFMFGIGNAPAIFMVFIALFFTMVLSTIQQIDDVNRNYINVARTMGASKRQIYARVIVPAILPGLLAVLRLNLFGAWMVVLVAEATGVGYGLGQVIMLARNTFNPSLVFFTITLIGLLGFAFDLLFRQVQRRMLYWLPRDAGSSLGL

SEQ ID NO: 2225 - protein, 350 aa, Methylobacterium sp.
MCDRHGDYRVPDLSRFKTSRRRFLGGTAAALTLAAGPGLVGRAAAASGIRATHGTGFCNLNFFLAEAMQLAKDDGLTIDFVNTPTFSDQVTFLGMGQVDAGVMPYTSFMALYDAGAPVTIVAGGGIEGCALVAQPGLDSPEKLKGKTLGTFQLDTLEVLPYDWLKKNGVAFKDITVRYMGSTPEAVEAFRAGALDLISTIEPYGTALLTDVKGAVKLSDGTDIYGKGYTDCVLAVRNELIAKNPGAVKALIKGMMKAQALAEGDPQAALNKLVGSYYKTSMSNAQLAMGRQPSVVDARNQTQFILDRTDSVAEMGYIKKKPGRDAIDWTLLEQVIAENTDLYSKLKLKSA

SEQ ID NO: 2226 - protein, 481 aa, Methylobacterium sp.
MTTGVTLVTGARWVVAWDPETGGHVYRTGADVAFEDGALIHVGPDYAGPPPVRTIDASGCLIMPGLVDIHTHLFSEPMNKGMWDEVGSPRLYNTSLYEYLPILRPDAAGTRAAYGVALAELALSGVTTVCDLALPSEGWLDLLGSSGLRVCIAPMFRSGHWLTRNGHRVEYEWDEAAGRRGLEDSLAEIEAAQVHPSGRLFGMLCPAQVDTCTAELMRDAHAEAVRRDLRFHTHAAQSLSEFHEITRRTGMTPIEWLDDLGVLSERTIVGHGIFLDDHPWTHWHSPGSDMRRLAERGATVAHCPTVFARRGIALNHFGRYVQAGVNMGIGTDVYPHNMLDEMRLVSYLARVVAENPRDTRAADVFHAATIGGARALGRSDIGRLTAGCKADFVLVDCTHPAMRPCRDPVQSLIYSAADRAVRQVFVDGREIVRDGRVLTVDYAAAAAALEEAQGRALAQIRQLDWAGRGPDAIAPLTFPGL

SEQ ID NO: 2227 - protein, 226 aa, Methylobacterium sp.
MPNPGVISPARILVINPNSSQTVTAAVDAALALLRLPGGPDITVTALPEGPESISSQQDADRVVMPLARRIAEDSADAFVIACFSDPGLQTAREAAAGRPVMGIAEWGILRALTLGERFGIVALSEGSVHRQRRMVRQMGLGERYAGSRPVEARADETVGEAIRARLIAAARILIERDGADAIVLGCAGMAPHRMAIERAIGRPVVEPCQQAVAAALGAVLLREVP

SEQ ID NO: 2228 - protein, 525 aa, Methylobacterium sp.
MSAAVYDVIVVGAGSAGAALAARLSEDPGRRVLLLEAGRDWRSADAPPALRSANIVPFMYDPSHQADWQWPGLMSRRTRTQEPRFYWRGRALGGSSTVNAQIAIRGVPAAFDAWAAQGCTGWSAEDVMPLFDRIEDDAEFATEAGARRGGPLPVYRAPLDAWGAVDRGLREAALADGYVWKADLNAPQGEGVSCNPINSRDGHRITTNDGYLEPARNRPNLEIRCEALVDRVLFEGRKAVGLRVRFGTDAWTELHGREIVLCAGAVHSPAILMRSGIGPAEPLRALGIPILHAHEAVGGNFMDHPILRATMDLKPGRRALGPDARHTNCCVTYSSGLAGGGERDMIVVAYNHRGLTGLEPTPQGAVGVGLYDAFSRGSLHLTSADPEINPVIEENMLDDPRDRLRLRDAVRRLARLTTHPALADLATAIRFGESPLAPGEAARLPDSELDDLMLAEAGDIQHAAGTCRMSGWQDASGVVDPDLKVREVGGLRVCDASIMPSDCRANLHFTCVMIGENLARRMSNH

SEQ ID NO: 2229 - protein, 256 aa, Methylobacterium sp.
MMLAASETYAMAEPNGTTRLGMLTPSSNSVLEPVTAHLLAGCAQVSAHFSRFRVTQIGLSQAALGQFDPEPILMAAELLADARVAAILWNGTSGAWLGFDADERLRDAIEDRTGCPASTAALAFRDLFCARGYDRIGLVTPYTGDVQRQIQANWGAAGFDCAAERHCGLSENFAFARVGPEAIAQMVRGVAAEGVDAVAIVCTNLAGAALVPALEAELGVPVLDSVAVTLWKGLDLAGCRHADLAARGSVFAEARP

SEQ ID NO: 2230 - protein, 141 aa, Methylobacterium sp.
MNASHAAFFERPEAAALKQILIQPAKIPQYELLSRLEIPAVQAVIWDIEPIIEGFDPATRNHAIQSTGALIGDLLTARGFRVARDARGKKRRGRVRKAKFVKSGTIWELPAEPNNGHAEKVASIMDGIIDRYRHTLAELAK

SEQ ID NO: 2231 - protein, 321 aa, Methylobacterium sp.
MIFAEALGRLEGLGRSAAALLPGLAIALVLFGLGLLVARGVRAAVRRAAELRDASPGSASVLGRIAGGVTILVSFLVAASVAFPSVSAADLFNLLGIGGVAIGFAFRDVLQNLLAGILILLTRPFVIGDQIRAGSHEGTVEDVWVRATVLRTYDNQRVLIPNATLFVDKITVITAHDKRRLAFPLTIGNGDDMREARRVIVEALRGTEGVLADPPPEALVTGLGAAGVDMTARFWIDPPRRRDAVDALDHAISNVKEALTEAGIDLPYPTSQVLFHDQTEETDGDRTSQREGWPAGKGPPRARWRVLREDDAVSRRAEDRA

SEQ ID NO: 2232 - protein, 119 aa, Methylobacterium sp.
MSAHQIASTFDRAGLSLAGVAAGFAADARARQAAADAEQADRDLSAAERARRAVARQRAELQASVDENAALRAQVARLQRELAASKAATASAEARASAARQETIRAKTLLRGAVGMRAA

SEQ ID NO: 2233 - protein, 156 aa, Methylobacterium sp.
MLDGTAYDERRARLGAIRTGWYGDAPAVSPHGRRIYKEGGSVEHLSDQNENRQPPPSHEAGRAFLRSLLRDWRTENALLAQWDVEHGGALRRCLVAAGVALRDETDDGRERADHLVRLACRAVTASGLARLDAGVADLAAVPRGPWRLGWLGPASV

SEQ ID NO: 2234 - protein, 408 aa, Methylobacterium sp.
MALIRNCVLAAAIACSALAGTASAEPIRVKVGVLNDMSGVYSDTGGPGSVVAARLAIEDFARDSATTGAEVRVEFVAADHQNKPDVGAAIARQWYDRDGVDAIFDVPTSSVALAVSQVTREKNRIFIDSGAGTTDLTGKACSPNTIQWTYDTYALAHGTAGAMLKRGGGTWYFLTADYAFGISLQNEATAVIQKGGGRVLGAAKVPFPATDFSSFLLQAQASQAKVVGLANAGGDTINAVKQAHEFGLMDSGQTLAALLVYAVDVHALGLQTARGLVLTESFYWDLNPDTRAFSERFAQLHNGSMPTMNQAGVYAGLLHYLKAVAATKSKDAQTTMAWMKANPTDDPLFGKGSVRVDGRKLHPMYLFEVKSPAESKGAWDLYKLLDTIPAEQAFRPLADGGCPLAGKG

SEQ ID NO: 2235 - protein, 254 aa, Methylobacterium sp.
MSAEEHPMPNQQITIRTRDGDCPSHVVIPASGGPWPAVIFYMDAGGIRPAMLDMAQQLANAGYIVLLPDLFYRYGPYGPFVPEEVFAGDFRAVLGPLMATTGSLTAAEDAEAMLVYLDTRDDVRGREVGVVGFCMGGGMALVTAGTYPDRFAAAASFHGGNLATDAPTSPHLFAPKLKAEVYIGAAENDGSYPSAMAERLQRSLTEADVRYTSQTYLAAHGWMMPDFPVYDHAAAERGWSAMLALFGRTLHGGE

SEQ ID NO: 2236 - protein, 476 aa, Methylobacterium sp.
MTRTERMGDSGPLWTLSAAALCRRYADGTASPVAAARSCLERAEAVNPTLNALVAIDSDGAERAAMASEARWRAGTPLGPLDGVPVTIKDSLNVDGFATRWGSRLSGEHRVDQDETPVRRLRAAGAVILAKTNVPELTVQGYTGNPVFGVTRNPWDPALTPGGSSGGAVAAVAAGIGPLALGTDAGGSIRRPASHTGLVGLKPTTGRVPRRGGLPPIMLDLEVVGPMARTVDDLTAAMRILGAADPDSVAPNGFGPFGTAAVPERPLRVLYVPAFGAAPVDPEIADSVAEAAGRLAGLGHRVETGRFDAATAITEAWPILGQAGIAWLMRAHPGRRDVLGPDIRALAEAGANLSASDLFDVQRMALALRQDLTALFAGHDILMTPTAAALPWPAQETHPDRIAGVPVGARGSATFTGFVNAAGCPGISIPCRPAGAGLPIGFQLVAPWGGDETLVAVAASYEAAHPWPMLWEDTDP

SEQ ID NO: 2237 - protein, 308 aa, Methylobacterium sp.
MPGPEHDIVIGADGFLGRNLVPRLRAEGREVVGIGRAAGDLSDWANVERALRAAPPAGRIFHVVTRQRTGAVQYDIQGELLAINARIHLNVLEAWRLYQPQAKLVSTGSSCTYPESAEPLPEARFGQGPTHPSVIGYGLAKQVLATGSAAYAHQYGLSFLHCVLATLYGPHDNKAADRSHFVGALLDRAVREKAAGAQQFEVWGNPQTVREVLHVDDQIDAILAADRVFDNEILNCAANTPVTVEAVARAALAALDWSVPLVSPPGSFQGAAYKMLDSTRFLDRTGWRPRIDLESGLRRLVAEEYAKR

SEQ ID NO: 2238 - protein, 320 aa, Methylobacterium sp.
MGALPETVVVVGATGFVGRNLVAHLAGRVQRLIAISPSGRAVPGATEAARFNAMDALSVPADTIVVNVAAQRYDADQFETAQSDLLTGNAEITNRLYRFCLTKGIREVRAASSVAVYPAACDPLDDAESVDLNAPPNRNEAFYAWSKRWGEVVADLHAERYGIHTISFRLSNPYGPHDSTDPRKAHVLPAFVMRALAPGERFEIKGNPLVERDFVYVGDVVDVFARSLEMREASDVFNLCRGQTTTLLDLARTILEVAGEDRPLHAPDTATHGVLARRSTNRRLRERFGISTFTGLADGLRPTIAWYREAYRDGAHHAGA

SEQ ID NO: 2239 - protein, 310 aa, Methylobacterium sp.
MRILITGGAGYIGTILVPMLLERGHHVTVLDTFKAGTPDLSAACLYDGFEPIKGDARDTRILDDLVPKHDVLVPLAALVGAPLCKEDAIGATTLNRDAVVALVQRAGGEQMIVYPTTNSGYGVGETGKFCTEESPLRPISLYGTTKVEAEKAVLDSGRGVSLRLATVFGMAPRMRLDLLVNDFTHRAVTDRALLVFEGHFKRNYIHIRDVAKGFIHAMDNHGRMRGEAYNLGLSSANLSKLELCERIKAHVPNFVYVEAPIGEDPDKRDYIVSNEKLEATGWFPDFDLDRGIKELIKGFRMIRNSRFANV

SEQ ID NO: 2240 - protein, 337 aa, Methylobacterium sp.
MRDFFEAARKAAPCVALIDELDSFGDRRKFADRDRRYWTLVVNGLLECLDGAGGRAGVLLVGTTNDHDRIDPAILRSGRFDRCITIPLPSISDLAAILRHHLGRDLADADLIELAKRALGGTGADCAAWVRRARGRARRAERALSPADLLAEIDATDASPNRADDLRAAVHESGHAVVAHALGFEVQTIALHRTSERGGLTGLRARDMYPTADGLRDLLAVYLAGRAAEILVFGDPSNGSASDLAVATAICGRMHCSWGLEGRIAVRPVETASDEVAAAIERDLRRASDVAASILLERRTGFDRLADVLVARRALDRAEIEATLAIMPERRSVSNAS

SEQ ID NO: 2241 - protein, 465 aa, Methylobacterium sp.
MIGGACLAAKFSDVVVVLPGLIGSVLERDGKQLWGVSPGGLWGIVAGNNLDQLRLAAADNGDDDLGDGIVATRLVPNIELIPGLWKQGGYDRMGRGIVDRLGLIPGENYFEFPYDWRRDNRVAARRLAARASDRIKAWREKSGNPDAKLVLVTHSMGGLVGRYFVECLGGWRIVRTMVSFGAPFRGSGNALGYLCNGFTWDVGGVPLFNGTDALRSFESVHQLLPVYPFVDAGGGTLERVGELDLPNLDRSRAIAAAAFHKEIADARAANANDPAYRDHGTRVRPVIGFGQPTCQSAVLAGGSLTPSNRMPGQNLTGDGTVPSVSAIPIGDDEMGAMYLPTTHSALQSRPAGLDHFLGMMTQANVDDPRFRSAGRHIALSVRDANPSTEPVRVAAVPSDYRQTLGGSIERLDAPASIRRITLYPKGDEFVVDVGLAPGLYRVTVEGNDLPAVEDVFLVVDPGEIS

SEQ ID NO: 2242 - protein, 630 aa, Methylobacterium sp.
MTHPGGGEDAWTWTWRTDALYLGDAWIQLGLKDTGGPSIEAGGWAQVRSLVHASARNIYWLDVVRSGPTVTLGGSVASERVKSRLHAAFERMAPEVRNTLEVAAVFESASDDKEAAPVAKDAGHVASITRFPSITPRSEAKAGHAFRFEVDLGAAPDPATESRPVEIRDLPAGWSSVRVGVEVYCSEIVFDAPEDEVGVIVVSKDGSSIAACFNGRIRDDVPPGKPFRLKVIFDQDGRPAGSAVRHVEVEPSRAGGTGVGSPAAAAGVAGTVELKAEVSAAMLRITIIADSEPGSFHWRVGTPRGIRCKAPVGKDKIVLGGDVRNYARGLLRRCPNLKPGERHENALRGIGETIWKQTPPAFRLFYAEMRELYGPGFPIQIITEEHYVPWELMHPVESETMTDPRHLCITHPIARWFGEEETRMRSELAMGGIASFVPDYQSGNSSLPAAREEGRRLVEEFGAVAHEATYAGFTGFWVEPLPEEEVAVLHFAGHAASPLDDREGGSEGLRMVDDWVSASDLHSGVRLGDRDGTFVILNACSAGTADEMLGAVGGWPTRLAERGFGGVLAPIWAVQDEHASAVVVDHLQGMLEGKTLGVAMRDARAFHSNASGTPFAYLCHGDVMARMGRG

SEQ ID NO: 2243 - protein, 85 aa, Methylobacterium sp.
MASITIRNIPDAVHRALKVRAARHGRSAEAEIRAILEQAAQPECRVALGSLLTSIARDAGELSDAEVEQINDLRDTRASEPIRFE

SEQ ID NO: 2244 - protein, 890 aa, Methylobacterium sp.
MSSVFAPSAAVEHPRHGAGRVVLQSGDLVIVEFESGLQRVPAGELTAAASLAAALAEGRAGDPVEAVLRAQALAITSVNEQWGVFSRSRVQILPHQLWVCRKVTATWPFRWLVADDVGLGKTIEAGLILMPLLAANRVRRLLVLAPAKLVPQWRARLKTMFDIRLQQYAAAADSARGNFWDTATMAVASFHTLRADGRGARTRLLEAEPWDLVIVDEAHHLNLDERSGDTLAYGLLREMQERGRVSSLLLFTGTPHRGKDYGFFGLMRLLRPDLFDPEADREGQLAALSQAMIRNNKATVTDLKGERLFRPVVTESRDYAYSGAEDLFYRTLSDFILDGRAYADTLTGRAQTTRMLVLITLQKLAASSIAAIQSALTRRRAKLERALAAGGGRDRSPPSEAEPGDEEYAAAEFAALLMENEIARLDELIALAAAASPETKIARLLDLIETELDPGEPVLFFTEYKATQALVLNALNARFGADTGTFINGDERLDGVRTATGLRTISIGREVAADAFNGGKVRFLISTEAGGEGIDLQERCSTLIHIDMPWNPMRLHQRVGRLSRYGQREEVRVYLLRNPATVEARIWDLLSAKLERIQAALSNAMEEREDITRLVIGIAGEAFFNELYAGAEELRGNRLADWFDEKTATLGGRDVIDTARDLFGNVARFDFQAVGRDVPKVDLPALEPFFAATLQRHGRRVSRSDDGSLAFKTPTPWRERSWSVDDRYEGLVFDRTLRGENAASRVLGVGHQLMDLAVQEARELPVRLASLDSLDAPLLIASVEDEVTGTGGTVHRLIFGVQQLGGSATVLQDWELLTRLNDLPLRRPLTSFEDLNGESARAAGESTDRLLTALRLKLPRTAAIFVRPMARAEMLLVPAAVVPDRPAAPP

SEQ ID NO: 2245 - protein, 1023 aa, Methylobacterium sp.
VESVEEANGVPLVDLVSVDDDSQGETLRLTLSPEIGVEIIDSQDWAPLLHTSFEGPDRLGAFLRATEWRTASAADRKLFQAPFRAGIRLDAYQLLPLAKALDLPRVNLLIADDVGLGKTVEAGLIVRELLLRRRIDFAVVAAPASMLLQWQDELAQKFGLDFTIVDREHLLDTRRSRGFAANPWSIGSRFIVSHSVLADDTYIGGLRDLLGEFRGRSLFILDEAHHAAPSAGAAWAVESQMTRSVRQVARRFEHRLFLSATPHNGHSNSFATLLEILDPQRFHRGIAVEPEDLAPVMVRRLKDDLRRLGQPFPERVVEPIRIADLPPDAPELRLSEMLEEYRASAEGGARARFLFANLQQRLFSSIAAFDRTLATHRRTLLRKRVEEGGPAPEVAEDDDLLGSATEGARGELGDIDAAIAHVDRMLAVTRAARDLPDARVEKLLDWIEAEMLDGRQRWRDRRLILFTEWDDTRRWLVERLKEGLLQRSRGAIDLDGRILVFTGQTGLEERDRIKIAFNAPFANEPVRILVCTDAAREGLNLQARCRDLIHVDLPWNPSRLEQRNGRIDRKLQPAKTVSCRYFVYDQREEDRVLDALVRKTETIRRELGASGEVLRLNIEGRLARGGIRRGEAARLAREIEGETSRRTALAERELGEAQERRIARLKEEQERLHAALERAKKRVGVAGADIRRVVEIALAQDGAALQPGGFSVAEATLLDPEQAAFAKDPSWASLFDELRPGRPARPKDRARWRRETPVRGLVFDPPLVAEGEPEPQDVVQLHLEHRLVRRLISRFASQGFRASVGRVTAMVARDPRMRVVLIGRLSLFGPGARRLHEEIIPVTAQWRDVRRETEPLVPYAETGEATTIAELDEALRRGVSPSEGVLARLRASVAADIADLRPHLEARAEAAEAAAVADLAENGEREAGALADLLRRQIEKVREAMRDAQAPAQFELDLASAEDRQQRERELRQFEADRRSWDDKLLRLQNDLDAEPLAVREGYAVRARQLEPLGLIYLWPATN

SEQ ID NO: 2246 - protein, 79 aa, Methylobacterium sp.
MDLNKGEQIGAIDGDEQVKPALRRVDLGRIDVEVAERVGLEARSFGLVTVDLRQSADTLALQVTVQRRTGQVQDRGLEG

SEQ ID NO: 2247 - protein, 374 aa, Methylobacterium sp.
VERAANLTTDDFRALADALPQMAWVAEPSGDIIWYNRRWYDYTGTTIEQMRGWGWRDVHHPDHVERVVDRIGEAFRTGEPWKDTFPLRGADGEYRWFLSLAQPHRGPDGRILRWFGTNTDITERKGMERRLARHAIDLRRSNEELEQFAYVASHDLKAPLRGIENLVGWIEEDLEDSLTGDVRTNMELLKSRVRRLDSLLDDLLAYSRAGRADATMDTVDTKALVEELAVLVSPPEGFAITADASLPTLQAARAPLTQALQNLIGNAIKHHDRPAEGHIRVEAGSAGDVVEFVVTDDGPGIPEQFRERVFGMFQTLKPRDEVEGSGMGLAIVRKLVDRQGGKVWLADGPDGRGLAVHFTWPRDGRKGQADGLDG

SEQ ID NO: 2248 - protein, 858 aa, Methylobacterium sp.
VLTYGDTRTRLSAALFDLIEAVDAYNASGGATLEARVQAWMPVQQALRTTLGPDVAADAYTRGLTLYQAGAFALDVRETREGLTFEPRLMARESAASLTDDAPDALLPDADSAVEGEAEGLLPPEDHRAFLRHALEAAGATRDAYVVGRNRFVLIDPHLKPLLDVVRTKRAAPDAERRRFVANPRAGLAEALGIDTEQTRLFIETSAYSSRVLELGIWEKPKLPWLTRRGHAWLPEGGWHDAEGQPVAAPDLSDTERWALAEAIGIARAQGHAQVSIKGVPVPIAAAEAFLSALEVDAVASGEPVREGDTNKDLPAEKAVLLIKSNYDGVDYEQPLTPRRAVISAEPVAERLGLTRFKPHQRKGFKWLVEAWQAGWPGVLLADDMGLGKTFQALTFMAWLRSNQEAAQTARTERGPILVVAPTALLKNWEAECALHLSGRGLGDRLDAYGSGLRYLKRPPERRADPGETLDVAQLRAADWILTTYETLTDHEQTFARVRYSLVLFDEMQKVKAPDTLNTKAAKALNADFVLGLTGTPIENRLEDLWCIMDRLTPGYLGDLKGFSSTYREEDADRLRALKRKLDEPVGAAPPVMLRRMKSDVLEGLPRKDEVRYPVMMPAPQAEAYRRIVAQAQRAPTGRKPGDMLRVIHALRGVSLHPEDPEAARLDEARAFRDYAARSARLGASLEILDAIRAKGEKAIVFIESLAMQAVVARGVAELFGMPALPGVINGGTPGEQRQRVVDAFQARPAGFDLLVLSPKAAGVGLTITAANHVIHLSRWWNPAVEDQCNDRAYRLGQTRDVTVHLPMAIFADQPEASFDRTLDALLQQKRALSREMLAAPVGANDTRDIYARTIGHV

SEQ ID NO: 2249 - protein, 459 aa, Methylobacterium sp.
LSKDARIIEIGPSFNPLAPKRDGWNTIVVDHASREELLQKYHDQTIDRIEAVDIVWTSGSLADAVPPEQHGTFDAFIASHVIEHTTDIVTFLRAAETLLKPDGVVILAVPDKRKCFDFYRPLSGTADAITAFLERRDRHTLRTHIDYALNMALKPGGAGAWAATDIQPAEPVNPLTDAPQWHAAAQRPDYTDAHAWVFVPSSFSLMILELSLLGYLDLRVEELQERHATEFFVWLRKGAARLSADESRRERTALMQRVIVELADQARQLPDGPLSESAALLRDRLLRAEYRTQALQRVLSAVQASLGRFGLNRRRFRQLIALAGQDVPANALAPIQHHILLNETTKILNRRKGPDDVTAAAEDDPALAENAVLIVPLGAAQFRDPLLAAELLRERQRSLAVRVVLEAVVNSLRARSWDKERFKAMIAKAARETPTVGPEAVRHAVLAEESRKVLGVPRA

SEQ ID NO: 2250 - protein, 247 aa, Methylobacterium sp.
MNTILITGCSSGFGLETARLFLDCGWRVVATMRTPQAALLPESERLTVLPLDVTDAGSIARAVAEAGPLDVLVNNAGVGLLNALEGLSMESAREVFETNTLGTIAMTQAVLPQFRERGAGVIVNVTSSVTLRPLPLLAVYTASKAAVNAFTESLTHELVPFGVRAHLVIPGRSPETAFGSNARTRMGMDVPAAYGDLAGRVFANFQQATEELTRASDVAEAVWRAATDPACPMRLPAGADAVAWAAA

SEQ ID NO: 2251 - protein, 309 aa, Methylobacterium sp.
MVDPLTQVVGLLQPSASFSKLVLAGGAWTVRRDDHGQPFYAAVLEGACRLAIDGEADIVLAAGDFVLIPAASAFAASSLVAPLAKQTPPPVKVGPGVFRLGPPKVPPDLRMLVGHCTFASDDVELLLSLLPRFVHVRSVGRLAMLLGLVNEETRADRPGRDAVLARLLEVLLIEAFRSTAGPTAPSGLLRGLADERVAAALRRMHERPTAPWTIAALAREAGLSRSIFFERFRREVGVAPMAYLLAWRIALAKDLLGREGAGVAEVAERVGYGSASTFSTAFARHVGRPPIHYAREQRGQRRSPAPLNA

SEQ ID NO: 2252 - protein, 199 aa, Methylobacterium sp.
MIDEVPPKTHAPSRSRTVEWADPRTIAAAGQDLAGIDFLRALLAGEIPPPPAIQLLGIEFVSVDPGTACMRMQAGEYLFNPLGSVHGGSLATLLDSVMGCAVHSTLPFGRGYTTLEFKMNFMRAATGRSGLLTASGQVIHSGRQQAVAEGRLSDESGRLVATASTTCLVFDLPGAVKQRRPADRAKALTPTVHAREFHR

SEQ ID NO: 2253 - protein, 141 aa, Methylobacterium sp.
MGSTVNILLVDDDEVDVQGLKRAFKKSKIGNPITVARDGIEALEILRGENGRERLPKPHLILLDLNMPRMNGIEFLEAVRADEDLRSAVVFMITTSKADEDRMRAYGHNVAGYIVKRDPANTFMEAVALLEHYWKVVEFPA

SEQ ID NO: 2254 - protein, 350 aa, Methylobacterium sp.
MTASPALKDPRRYFEAIGADRASEAVAPPVCLYLEVTNRCNLLCETCPRTFETLEPPADMSWDLFTRIVDQVPNVARVVLHGVGEPMLVKDLPRMVRYLKDRGTYVLFNTNGTLMQPKRFRELIDTGLDELRVSLDAADRASYRRVRGKDFFDRIVRDVGRFVAFQKASGATTPRVSLWLTGLKETVDQLPAFVRLAAEMGVTEVHLQRLVFDEAGYGMARADLSLFESALTEEAAAIAEAEALGRALGVTLDASGATEPGISLKRQEDRAWATCRRPWSLMYVTAHGRALPCCIAPFSMRGYANYTLGDATQSTLREIWNGAAYRDFRSELLSDAPPAPCRNCGLRWSL

SEQ ID NO: 2255 - protein, 304 aa, Methylobacterium sp.
VTYPERVRIVEVGPRDGLQNEPTTIPTAAKVALIEALADAGLTSIEAGSFVSPRWVPQMADTAAVLAQLRPRPGIRYPVLVPNLQGLERARACGVREVAVFAAASESFSRRNINCSIAESLERFAPVVETARAAGLRVRGYVSCVLGCPYEGAVAAAAVAQVAEALLGLGCYEISLGDTIGTGTPLAARRLVEGVAAAVPLERIALHFHDTYGQALANLLACLDLGVSVIDSAVAGLGGCPYARGATGNVATEDVAYMLRGMGIETGIDLEALVDAGLSITRHLNREPASKAARAILSRRQAAS

SEQ ID NO: 2256 - protein, 207 aa, Methylobacterium sp.
MIVRGVLPAGAPLVEKDLSIALGVSRTPLREALKLLAAEGLVELHQNRSARVPDWEPEEVLELFEALAGIERLTAELAATRISDALLDELREKQAQLDCMHRDKVLDAYFALNQEIHRTIVTAAYNRPLAEAHAPLQARAQWARLRALSTGSRWAESAREHRDLFAALDARDATEAGAIAYRHVLRTGVVIADTLRAQRAKAPSART

SEQ ID NO: 2257 - protein, 268 aa, Methylobacterium sp.
MRRDFDWFSFHAVVLLLAGLCLILLAAPTVIVVVVSFTSGFSLRFPPPGYSLRWYAALTEAEQLRAAAWNSLVVAGWTTLLSVVLGTAAALAIARSPRLSARLLDSLFLSPLVLPALAFGLAALMLFSLAGIPVSPLTLVLGHTVVCVPFVVRTTVAALSQMDLVLLESSTSLGASRLYTFRRVTLPLIRPGILAGGFIAFMASFDNVPVSLFLRDAATDMLPIRMWQDLEGRLDVTVAAASSLLILVTVVLAVVMERAAGLSRRLAG

SEQ ID NO: 2258 - protein, 301 aa, Methylobacterium sp.
VTAVFAPMAPDPVAAPGRPGRPWMAAYDIRLALPLGAFFLVFFLAPLALLVLVSFYADPVMTRFGLDQYARFLLDPFSLRVLGATLWLGVEVTALTLLLGLPLALLLTWAPARLRGLLTLIVLLPLLTSVVVRTFAWIVILGRQGIVNASLLALGLTDTPLKLLYTEGGLVLALAQVQMPLMVLPLVTALSRIDPNLADASAALGAGAWRTFLRVTVPLCLPGIVAGCLLTYAAAITAFITQSLIGGGQMLFMPMYLYQQASSLNNWPFAAAIAIVFLVAVLACVTVFNLVGRLSRGYAQA

SEQ ID NO: 2259 - protein, 347 aa, Methylobacterium sp.
MILHRRSLLAGALTLGATQALPGLSHAQARKLVFATFTGSWEEAHRAVLVPAFRKSTGGDIILDPMLSVDQIAKVQAARTNPPIDVMLHDPGPALTAIAQGLVEPYPVAQSAHYADLIADAQEPMGPAPFFQIVGLTYNPEKVKTPPTSWADLWKPEYKGRVGITNLNSTLGTGFLVEIARMHGGSETNVEPGFKALEALKPNLAAVAANPGALAALYQQEQVDIGPGNFNAIQILKARGVPVEFAAPKEGIIAFKTTIHIVKNTPVKDLAFRLIEAALSPEVQAKLMQSPYLIVPTNRKVAMDGEVAKVLAKDAEDLKRKAVFQDWAAINHSRAAWIERFNREIRV

SEQ ID NO: 2260 - protein, 97 aa, Methylobacterium sp.
MSERIGSSFESFLNETGSKEDIYAAATKRVLAWQIEQAMEAQNMSKTQMAKKMKTSRSQLDRLLDPTNMAVQIDTIQKAAEAVGRKLVIELREPAPV

SEQ ID NO: 2261 - protein, 591 aa, Methylobacterium sp.
LDHCRQIGASIDAEHHIYIDRNRSGRTTSGRLSLHALLAAARDRLFHILIVQGLERLTRSMTDAVAIQAELEGLGIAIHIAGRGPVSASEILLSSFQHQKELDALVERINDGRRRTARSGSMIGKRVPYGYDRLADGSGLIVNTEQASVIRRCFESIDGGVSRSQLVRTLKDEFVLGPGGRPWQFEQFYKPDGYGRLQDPIYKGVWTWARGTSNPVTVEVPHLAIVDGGLFDRVNAKLRASKGRSWKTGIKAGLLTGLVRCMCGRPMVRGTNHILCSRRPHMDLCRAGTTIRLIDAERQYYRFLLDEVLDPTRFADWQAVRAANFSEMQQAAARESARMKGRLDEITVELNAFDDDVGDDQILSAIAGPLEVEFHDLWERRERLSSLQALRIDRAEADELRSMISRMILRVPYKPTDPQEIAAVARMHELVPRIVVERRGEGIVLRFLLGVLVAGTEKQLPQAGSDRWIERPCPKSRRGAMRRPEAIVRHHRDAEAGRFAFTDREWATVADLFEPTGRVNGGHRLYAEAMIFVARTGVPADMLPERYARSRLDMAPIRKMGIWPRLLAALDALGSDLVRDIDRDRFAARHR

SEQ ID NO: 2262 - protein, 476 aa, Methylobacterium sp.
MAQQHYRDQIAFDEEMRQADSRYAQGFVDEFYVDDLKRAVSGAASNEELRAVLGRIVDRFHQHGHTTAQPGDTEFRKVAMALAVAELESLKVSAARDEGDSVAATAHPLLIKEQPELGRALTSQRILGPQSTQPLSELIPMLAEEKGARPGTINEYKVAARMFEEFMGEPRAAYAITRQDVIGYKRALMETPANYTKRFPNKTLTEAIKLNKSRAAPFPALSSKTINDKWLTHLRAILNWCVRNDVIPDSPASGVKVEQVKATSAARLHFSPGDLSKIFAPPLFGSAKDYGERQWMLLTALFTGFRASEIAQLRLDSIRHERRVLVFAVEEETKNQASKRLTPVHSTLLRLGLEGRVAKLRAAGETHLFPEWFKAAQSMLTAEDGRDVNQPYSQFLPRWFNRTYLPKVGIHDERKVFHSFRHTLKTAIARAGVPRSVSDEITGHDDRTSGARYVHETSIEVMKEALEKIHFDGFNL

SEQ ID NO: 2263 - protein, 289 aa, Methylobacterium sp.
MFAWDDVRFFLAFAESGTLSGAARMLKVDHVTVARRVTGLEQSLGETLVDRVSKRWSMTDAGREIADLALAMQSQAYALERAVRARKVGSSAVVTVSAPPTLASTFLAPRFAELRARHPELELSLLGTPATVSLSRQEADVAVRLAQPTEMSSVARRIGRIAYGFYAAPGYVQIPPEQWEFIAYDGSLDHVPQQEWLRAFAGGRRVVFSSNDLTSQLAAARQGVGIAALPSFLAAPDAGVVPVPAETAPLARDIYLVVHADLRRNHAIRIVMNFISEQIGSALPPDAGR

SEQ ID NO: 2264 - protein, 290 aa, Methylobacterium sp.
VGAAMEWSDVKIFLAIARSGTFGGAARFLQTSHPTVGRRLRALEQAIGHTLFQRTTDGLVLTEEGHGIIALAEQMEEGALAMERRLAGQEQNLKGSLRISSADWFGAYVLPPIVADFSKAYPNVDVEILTGTRLFNLAQREADVAFRIVPFNTADVVQRRLFRLEYGVYIAEEALDPKYGDGTGFRLITHETSTGHFPDITWLIESFPNARPVLRSNNRNVQGRMCKQGVGIAVLPRAVGNQIPGIRRLEMPTQPPARDIWIGYHRDLRRLRRLRAFISTVSDHLVDAAV

SEQ ID NO: 2265 - protein, 535 aa, Methylobacterium sp.
MPTLDTTLDLRSAEARTNDAHMRGLVADLRATAARVRLGGGQTARERHLSRGKLLPRDRIAALIDPFSPFLEVGQLAAHGLYGGEIPAAGIITGIGRVSGRECMIVANDATVKGGTYFPLTVQKHLRAQEIAQQNRLPCLYLVDSGGANLPNQDEVFPGRDHFGRIFFNQATMSAEGIAQIAVVMGSCTAGGAYVPAMCDESIIVRNQGTIFLAGPPLVKAATGEVVSAEDLGGADVHSRTSGVTDHYAETDAHALGIARSIVASLNTVKRPSMALRKPVPPRYAAEELYAVVPSNLRTPYDVREVIARLVDDSAFDEFKRLYGQTLVCGFAHVWGYPVGIVANNGILFSESAQKGAHFIQLCAQRGIPLVFLQNITGFMVGKRYEAGGIAKDGAKMVTAVATAAVPKFTIIIGGSFGAGNYGMCGRAYAPRFLWMWPNARIGVMGGEQAASVLATVRRDGIEGRGESWSQEDEEAFKAPIRDQYERQGHPYYSSARLWDDGVIDPADTRRVLALGLSASLNAPIAQTRFGLFRM

SEQ ID NO: 2266 - protein, 204 aa, Methylobacterium sp.
MSRIAGPKGLRTAAAIRRAGLKLIYRHGFGAMSLRDLASEVGIQASSLYNHIRTKQDLLFDLIREHMEALLAQTDAALAAAPDTATDRLRTFIRHHIVYHLEKKQDVFIANFELRSLDTPHYATIVAMRRAYEGKLMAVLDAGVATGEFDIHDTRITAYSILAMLTGVCTWYKPEGRLSKAEIVDLHTRMVLHGCIAQREHALP

SEQ ID NO: 2267 - protein, 110 aa, Methylobacterium sp.
MTGLSIHAVDAATGRPAEGLRVRVLTVGARSAVIAEGEIGADGTLAHPIVRTRLVAGLYEVAFDIGDFLGEAGDGFLDMASIRFRITDPASHCHLPLKFTAFGIALFRGC

SEQ ID NO: 2268 - protein, 62 aa, Methylobacterium sp.
MVLVDSRDLIRMLEADGWIWHSTTGSHRHFKHPVKPGKITIPHPKKDMHPKTVRSILRAAGL

SEQ ID NO: 2269 - protein, 234 aa, Methylobacterium sp.
MGGSSANIEALLVDGNDPDNPTPGQLPAIFRDIVGRLDAGGYTYAVLGHVALALHERPRFVRAIEIVADLDADGRERGAELERATRARFAAHLDPSLCAKPISLMLRPCVCPLEAGLLSGAITCPWFGVPARLASAEHLLWLWCRSDAIKHHVDAAALIAGGTVDLYRVQGLLRETDDLAETGQTRLRLAIGDAVLSTTSSFSRYMDERRARLDPRYVPVWRRVLEDCDEAKPR

SEQ ID NO: 2270 - protein, 303 aa, Methylobacterium sp.
MDKLDAMRTFVRVVENGSFSQAARDLGVGQPKVSKQLAALEAHLGMQLLARNSRTLAVTPAGQDYYEATVRILQDLDAVEERLVEGQSAPSGLVRVTLSPAFGRMLVIPRLPDFRDRFPDVAVEMEVSGRHVDLIEEGIDVAIRIGRLSDSALVARRIGDMRMITLASAAYLARHGSPRTLDDLRAHQRIGYVHQGDLVGWGFDVDGRKVTVEGGGAFRTNDAEHVRGAVLASLGIAHHASWLFTDALASGEVVRVLDRYAPPPFPISAVTAAGRRMPSRVRRFIEFLAAICASEPELRVGEA

SEQ ID NO: 2271 - protein, 390 aa, Methylobacterium sp.
VTNPTRILLIDDDAVDRAAVRRALAKSGLKHTLTEASGGEEGQRIASEATFDCVLLDYRLPGIDTFALLRTLLASESEARAVLMLTGEADPELATRLMRAGALDYLDKAEVTPSGLARAIRFAEARRAFQDELAAARREAEAKSLELDTLNRQKSLLFSIIAHDLRNPFQALLGLSEVLGKAVAAREPASIERRAKGIHEAATQAYALLESLFSWASLQMDTMAVTLTDVDLDAVTTEVVRGAAEAVSDKGLTIEVSCGGIIVRAQRDMLTTVLRNLVGNAVKFTLPGGTISVAGRQDGDDVEISVTDTGVGMPPGKVDDLFRLDRRTTTNGTAGERGSGLGLLLCRDLVERQGAVLTVTSAIDRGTTFRFRLPAPLVARQVPASAASAS

SEQ ID NO: 2272 - protein, 210 aa, Methylobacterium sp.
MPPVDYHRNALRILFILVKGSRSYSGEPVAGFDRVFRGETKVQALDFWVRYPDYLADELLSLFELTGDRQHLDAADRIFADEEPDLRRVPMLRRYFGAYEPLDTVLGILKSRGLVLPRSRQMERGTDEHDFLVATKASELIPRVVADLPELGWYDRRVDLVLDVAAGRGGYALKERQHRQKEYHDAATGDLIPTTAERVRTRLETLKERA

SEQ ID NO: 2273 - protein, 149 aa, Methylobacterium sp.
MPKRNVEPKLTTAQLQDLINLAQKTRESMSTMDGPNQALMLLRTFNMADRVYGLWPDSSRPCGYAYKIMKGELGSAAMKRVARNAEISVAGVFQESEDHAELTREIYVGLETSGDAYPETYAQAFNFWMDIVPAHFEDTKARIRVHILG

SEQ ID NO: 2274 - protein, 152 aa, Methylobacterium sp.
VCLARAGGILLEGATDMFDETSYMLAGLIEQMPEEIHLDPEPVRAPETGSARTARERREAAERKRRERARRKAEGMPDPALVDRAIATAVGDLSRRGDMRARVKDRKSFVGLSYGLTDVVGQAMEELVERRGVGQPQAKAALMARLGLTRQG

SEQ ID NO: 2275 - protein, 238 aa, Methylobacterium sp.
MSRTFLVTGASKGIGLALAHRLAGDGHHVVGLARGGLDDFPGTLVPVDLADGDATDAVLADLTGRFAFDGVVNNVGLVRPQRLEAVEIPALDEVLHVNLHPALQAVQATLPGMRRRGWGRVVNIASLTVLGSVERTAYAAAKAALVSFTRSWALELATTGITVNAVAPGPTETELFRANNPPGSPGEMRYLAGVPMGRFGRPEEIAAAIAFLMSDGAAFMTGQTLYVDGGASIGRAAL

SEQ ID NO: 2276 - protein, 90 aa, Methylobacterium sp.
MARLAEKRPARPGPVRPGDAGRNAASARARRYVLALQPLIETIARETGRTAQGIASEMTRRDIGKPRGGTIWTPADVRRLLRRLGSDVAR

SEQ ID NO: 2277 - protein, 192 aa, Methylobacterium sp.
MARVSREQARLNRERVVEVASRLFRERGYQGIGIADLMAEAGLTHGGFYNNFTSKDALAGEACAYAFGDTDFDLAVSAGKQEPGSLAALVDAYLSPSHRARPGTGCPLPALAADAAREPQGSPLRHSFTAGLTAMVDRVAAVLPTATKARRRKRALGSIATLVGAIALARAVDDDDLADEILEAARAAAIPG

SEQ ID NO: 2278 - protein, 310 aa, Methylobacterium sp.
MRTTTWLILTMLFGGSPALAQEPLPTGRMTKPDVSPEQATVRKLNAYVSLLNRTLRAQESLDRYRSRVNMKTGPTGRERIIYGLYGLYDVRGEIVKAEAAMAQPPAMPDLDGVMKSYIAAYQVLAPTITEADSYYERQDYRTDKMEQGRALHAKLAVAGPAFLAERAKVDALFRVEKEKSDAAELAAIEAREGRSARWHAANVMTEARKVMDLLPTDAKPVVAMPAFEAALGRYAAAVKDMDGYSAANPNAFHVFESQPRSLLGKLREFDAKLVKAKGDARRGAGRDVTWIVNDYNMMVSTAQTATAFSR

SEQ ID NO: 2279 - protein, 676 aa, Methylobacterium sp.
MFRKILVANRGEIACRVIDTARRLGIATVAVYSEADAGARHTRLADEAWPIGPAPARQSYLVADTILDAARRSGAEAIHPGYGFLSENAAFAQACAEAGLVFIGPPPAAIRAMGSKAESKALMERAGVPLVPGYHGEAQDIPVLREAAARIGYPVLIKASAGGGGKGMRIVASADDIAAAIEGAKREAAASFGDDRMLIEKYLTRPRHIEIQVFADTQGRTVSLFERDCSIQRRHQKVLEEAPAPGMDPLRRKQMGEAAVAAARAVGYVGAGTVEFIAEGDAFYFMEMNTRLQVEHPVTEMVTGLDLVEWQLRVAAGEPLPLGEDRLALRGHAIEARIYAEDPDRDFLPAVGTLVHLRQPQDVPGRVRVDTGIVQGDQITAHYDPMIAKLIVWGEDRPAALRRLGAALAEYAVVGVTTNLGLLRAIAGHDAFAAGELDTGFIARHAPDLLGGASAGPDSDGSETAALAAAALSVVSDRAAENAGQAQATGDPWSPWAAVDAWRMNGEAAQDLRFRQDDAPAITLRVHPLADGSYRLAWPGRSVQAALTADAAGPLLAIDGVSRRLRVVWHGAECTVILAGRNHTFVREDPLAPPRTEAAGSDRVTAPVPGRVTHVLVRPGDVVERNAPLVIVEAMKMEITLRAPQRGTVAQVRHAVDDMVEEGTELVTFAAGEPGP

SEQ ID NO: 2280 - protein, 530 aa, Methylobacterium sp.
MKRRTLLQGAGAVVANAVAAPALVRAATASTLRFIPQQDLVTLDPVTTFAYITRNHGYMVFDTLYGMDASFRATPQMVDGHRVEADGRRWDLTLRDGLLFHDGTRVLARDCVASLRRWAKRDPFGGSLLEATDELSAPDDRTIRFHLKRPFPLLPIALGKASVPVCAMMPERLAVTDPFQQVPELIGSGPFRFKADERVPGDRTVYTRFEGYVPRKDGPLTWTSGPKVAHYDRVEWRVIGDTSTATSALIAGEADWQEYASHDQLGLLKAAKGVSTRVLDSTGFVTMLRVNHLQPPFNNPAIRRALWGAIDQTSCMQGVVGADDPGLFHVPLGFFCPDTPMASTDGLAPLTTPRDPAQVRADLKAAGYAGETVLLMVPSNSAPLLALGQVAADLLQRVGMNVEVYAVEFNAMLQRRNRKGPVSEGGWSAFVTNWSGTDWLNPAGYIALRGTGETGYAGWATTPRIEALREAWFTAPDEAARAALCRDIQLQAMEDVPYYPLGQYLQPTAYRSGLTGILDGFPTFWNVRPA

SEQ ID NO: 2281 - protein, 230 aa, Methylobacterium sp.
MAKAPRSGRSKTRLCPPLTPDQAALLSGAFLRDTTANILEAARSAPIAAYAAYAPRGAEALVSPHLVIGTQLVPADGDIPAPAAVEGFGRCLLQAVGGMLAEGHAAACVLSADIPTLPTRLLVQAARILLAPGDRAVLGACDDGGYYILGLKQAHARLFADIAWSTDTVAATTRARAHEIGLALVELDPWYDVDDAASLAQLCADTSGYAAPATRAVLARLTETSEAVPA

SEQ ID NO: 2282 - protein, 232 aa, Methylobacterium sp.
MHPVSIVIPTLNEAEAIGVVIREIPPAYAGDIIVADSGSTDGTQAIARAAGARVIEAVRGYGRACALGAAAADPASRVIVYLDGDGADRGDLIDRIAGPVLAGSHDLVLASRTLGSREPGSMLWHQVLAGRLAGLGIGLRYGVRYTDMCAFRAIDRAALRGLDLRELTYGWNIEMQMQAARAGLRIREVPMPYRRRLGGSSKVAGSLGGTLRAATRIGATYLRVAAGPVRGA

SEQ ID NO: 2283 - protein, 302 aa, Methylobacterium sp.
MAAGLGPVGAVAAETRPAEVAEVRHGTVRADGVDVFYREAGRPDAPVFLLLHGFANSSFYFRHLMPRLADRFRLIAPDLPSFGFTVVPDDRGYVYDFASLSRTIEAFVDVLGLRRYRLYTFDYGAPVGWDLALAHPDRIAGIVSQNGNAYLEGLGEVAWAPLRAYWEKPNEAAVEALRARMTLDGVKAPYFHGVPDPSVIEPESYTLDAAILARPGNADRQVKLKLDYKRNLERYPLIQAFFRERRPKLLAVWGRNDPFFIPPGAEAFKRDIPDARVRFLDTGHFALETNGDDIAREIRAYF

SEQ ID NO: 2284 - protein, 1241 aa, Methylobacterium sp.
LGAVARIAASDLFDAEWYRATHAPAVALDQAARHYLQEGAARGLSPGPLFDGPWYLRSNADVAAAGLNPLLHYLDSGRAEGRPICPVADPEAVARIAGSELFDAEWYRATQAPAVALDQAARHYLQEGAARGLSPGPLFDGPWYLRSNADVAAAGLNPLLHYLDSGRAEGRPICPVADPEAVARIAGSELFDAEWYRATQAPAVALDQAARHYLQEGAARGLSPGPQFDGPWYLRTNTDVADANQNPLLHYLNDGRAEGRPICPFADPEALARVEGSELFDAEWYRATHVPDLSPDLAARHYLREGAARGMSPGPLFDGAWYLGNNADVAEAGANPLLHYLVSGRAEGRPIRLAVARDAGASRIETQPIVLRESTPARIVVVVHAFYVDVFEELLPHLVRGIPRFDLLVSTDQPDKKAALEAAAERAGLADRCRVALAQNRGRNFGPLVAVLGQDILRYDYVLHVHTKKSLFSGAEQTRWRDEIYRALFANAACARLAVALLDEDPRIGLFFPETSKHIVYWAHTWLANIGAGHTLLARLGLPYDGFDEYLDYPVGGMFWARVDALRPLLTAGLAPHDFPEEHGQTDGTLAHAIERAIPIVCRSQGYKAVCFDYDRGLARTNSSARNWHQYSARTQDQALQALQDVDLVSFDLFDTLVSRPARRPDAVLKLVEHRISSEAGRPIPLFVERRAAENRVRARKRHQGDVNLSEIYAELTASGPIPGDVVARAHALEKRMDLGALRPRTEVIAVLEAAHALGKRIVLMTDTYYEEADIRAILSGAGIADRFAALYVSNAVGARKDRGDLWRHVEEAEAVPRARWLHIGDNEHSDIQAACDRRIPYLHVAHPAKILAQSGFVRDEGDLARTWPSDLVVGHAMLALGRNPFLGRATSPYLSLGSSREIGYAVFGPLMLVFMSWLIRHEALARVERLYFLAREGDVLVRIYRLIRERYGWDHLPEGRYFHVSRQTAIAAALAQEFRPELVTAAGRYVGNVQGLLWNRAGFTAPAHLELDRVAVRLPGDVEVVERIMTDLEPEIAVHAADMHRRLLAYARQEGLDPDVACGVIDVGYSATIQRMMQTALGRPLVGFYLAALDKANAVAAEGGSAFGCLCENVATLTASMPALNHSLSVEAFLTAAHGQVVGYDTAGDRVEPLFKADPRTPEEHAILAELHAGAEQYVIETLDLYGPELLRAEIPLMAPQEFLRLLMEAAIATPSEPIRKLGVEDDFCGFPLHKVYAAV

SEQ ID NO: 2285 - protein, 348 aa, Methylobacterium sp.
MTAEAYATVIRAPARDRLDLFLATANRLGAPIGNVEKDFWVCWTLEALYHRLPADRPRLLFKGGTSLSKAYGLIERFSEDIDVTVFRDDLEQAASVEELESLSGKKRRARLDAIRDACREYVTGPLRESLTALLTDATNGAGRIEVDDADPDRQTLLVWYPEVEPRDDAYVRPAVRIESGAKSALDPNQSVTLQPYIADETPDLDLSVPDVTTIEAGRTFWDKVVIAHGLRRWYERRGELRQEGQRISRHYYDLHQLVRSEMGQAALSDVELAGDCVRHARMFFDRPDYDLASAQPGSFALAPVAGMTDALRRDYVNTAGMIFGEPPTFDAILDSMRQLEAAANNKSA

SEQ ID NO: 2286 - protein, 124 aa, Methylobacterium sp.
MTDPSNILLYVTDPEASARLYARLLGREPVEASPTFVLFALPSGLALSLWARNGVVPAPTQAGGGGEIGFQVDTAARVDAIHAAWQAEGAEILLQPTDLDFGRSFVAVDPDGHRLRVYARAEAQ

SEQ ID NO: 2287 - protein, 196 aa, Methylobacterium sp.
MRVETMIPASSWLWTTMLTPMSRAVVVRDPIHPCRHERIDGRFMSLHDLDYPEGTVLMTTDAGLIQRHGTSFVVLNDRLQHVWEHEAQDLLEPAGATERLYERLRRYAGLDEVSRRFRFPDGLDMKAGEFRVRGGWYAVVTAVTTRQAWMRAATTNEILAAGGVLPVAPLGADLLDAIRIEAAQDAAEAAAAPAAA

SEQ ID NO: 2288 - protein, 141 aa, Methylobacterium sp.
MRSLVALILALLVASPAYAKLWPTGSTGWRYALTVPSGPGRQRYGYVDAAPRPPGGWLVTITCGEESTRDGRVLSRVVGHGLSTRGASPGFGGNWDWDDGRRGGSFVVTQDLRTPEALRLPGEFTAPECPRRGTGDLSTGD

SEQ ID NO: 2289 - protein, 296 aa, Methylobacterium sp.
MFMPSVLAPGTHSIAVNGVAQHYHVSGIGPYCIAHAGGPGIDASYLRLPLLEESLTMVYLDPIGTGSSGRLATHPQGYSVDRFSEQLLAFIDAAGIPDPYLLGHSHGAFVVLEAALKRPGGLAGLIMYAGAAYTGGAFMADASAEIAAFVARHAGMAEAKAVERAWASIPTIRTDAAYTAALSDLLPAYMSDFRRWPDMLATLQRRLQATLLVGDGQVFDVRDRLATLQVPALVVTGTDDFILGPRHAALLADLLPQAQMRIFEQSGHFAHIEEACAFAEAVLRFTGRPGRALSGI

SEQ ID NO: 2290 - protein, 262 aa, Methylobacterium sp.
MTETILEAVDARGVATLTLNRPDRHNAFDDALIADLTAALHRLGDQPGIRAVVLASRGRSFSAGADLDWMRRIARQSPDANRADAAGLARLMHTLDRLPKPTLALVQGAAYGGGVGLVACCDVAIASERASFCLSEVKLGLTPATISPYVVSAIGPRWARRLFQTAELVPAARAREIGLVHEVVAEEELTAAGAAVLQAALQGAPGAQADAKDLVFLCEGRPIDADLMGETGRRIALRRASAEGQEGIAAFLEKRPPAWRQD

SEQ ID NO: 2291 - protein, 452 aa, Methylobacterium sp.
MTRLLASPAHRLAALGLGLLVVNVGALAIHVPGADTVGSVARANVFVGVVAVGLGIYLLAVRLVLRERLPPAARWTILGFAVAMRAALLPGPPFLSSDIYRYVWDGQVQAAGINPYRYIPADPALERLRDAAVYPLINRKDYARTIYPPAAQMVFAAVGQVSHGVTGMKLAMLGFEALGVLAMLAILRGAGLPSARILIYAWNPLALWSFACDGHVDAIAIGLLGLALLARTRRRYGLAGALLGAATLVKLLPVAVAPAFVRGGRLWRPMLIGAAVIAVLYLPYLGAGRDVLGFAGGYGAEEGYETGAGYWLLAGLGHMGLSPPGLLRTYLVCAGLTLAAIAVRIAFGSDRAPAPDAVALCGDAGLLAALTTCAASPHYAWYYPWLALPAVVAPAPALIWLGAAPILFLIDPFNDRFLWPSLVFVPALVLAVRALWQTRTAPQASLPQGTAR

SEQ ID NO: 2292 - protein, 435 aa, Methylobacterium sp.
MKILLCSTPATGHLNPILAIARMLADEGHEVMVLSGSAFRDRIEATGARFAALPGIADFDGRNLVAIVPELARTPPGPDWLRVAMERIFIERIPDQHRGLQDALRAFPAAVVIGDDMFFGVLPLLLGPRSKRPAIVLCGTSILHCSRPDRAPIFLGLPPAETLEQRDAYARIARAHEAAVDRPVARRLAGVLEEIGVPAPSWTLFDAVVQLADTYLQLTVPSFEYPFPLPPAVTFVGTPPIVPGQAPLPAWANDLDGVRKVVLVTQGTVANHDFGLLVAPTLAALAGEPDILTVVTAGGRARDAIPGPIPANARLADYLPFEWILPRIDAMVTNGGYGSVNQALSFGVPLVAAGLTEDKADVNARIAWSGAGIDLGTNNPTPEALRRAVRTVLDEPGHRREARRLAAEFTAYDARAGILQVLARHAEPGRVRSAA

SEQ ID NO: 2293 - protein, 121 aa, Methylobacterium sp.
LTFVAAQPLDALFVSCVTFAELRFGIERLPDGARRIELADWLANRLRPMFERRILPLDEDVIVRWRFLVEEGRQRGHTFSQPDLLIAATALEAGLTLATRNTSDFAQTRVPVFNPWTDSLA

SEQ ID NO: 2294 - protein, 135 aa, Methylobacterium sp.
MFIDTSAVVAILADEPEAAAFLTRIEAAERRETGAHVRLEATINLARILGLAVPDAQEMYDAFLAAARITVVPISDVIARRSVDAFAIYGKGRGHPAQLNFADCLSYACAASSSVPILFKGRDFSRTDLVSALSL

SEQ ID NO: 2295 - protein, 1317 aa, Methylobacterium sp.
MIDHTRLDDTAEWLNYLQPEGLVVGANVLRERELSPVRQTAPDTDEAARALGLPSGAEREDDRHFVLADPWRFFEKVLGWPAKLVAGAPGGPALPADLARTVPEHGTFLEPAMALLWNGPGEEGVPAQALVALHPDLDPDGRHLFGAGEWEASPHARLERLVRETGIGVGVLVARNCLRLIYAPRGETAGWLTFPLAALGRVEGRPMLAGLKLCLGRSAFFTGAPETRLRALLKASREAQDKVSEKLSGQVLGALHELMRGMHRADPERIEALAENRPHHLYEGLLACLMRLVFLLYAEDRDLLPSSSEPRLRQLWESGYSIRTLYARLLADEALNPDTMDQRRGGWGQLLAVFRLVHSGHPGWVTGRGGKLFNPDAFPFLEGRAPGENRSAASVLPISDGTVLRILHGLMTVEGRSLAGQRIRERLSYRALDVESIGSVYETVMGFTALRAEERMIALRDEKRLPTFVGLNTLLAQKPAERQKWLKEQAVKLSGKQQKGVREATDTTALLTALGSAIDERASPDAVPLAPGSPYLQPTEERRRSGSHYTPRSLTEPIVRHALEPAFTRIGIEAAPEAVLALKVLDPACGSGAFLVEACRQLGARLEQAWTMHPAEKPQIPADEDEATHARRLVAQKCLYGVDRNPMAVDLARLSLWLATLAREHEFSFLDHALKSGDSLVGLTRKEIQAVHWDASKPGLPLFRGMIDQAVARVSEGREAIRNAADDVTLAVQTARHRRVEDEVEPARIVGDAVVAAFFSGDKPRARETERAKVESWIAAKTSPDWVQLRAVALDFLERQGWRPFHWDIEFPEVFSRENPGFDVIVGNPPFAGKNTISASSGPFYLSWLQNLHDGAHGNADLVAHFFRRSYGLLRKNGAFGLIATNTVGQGDTRQAGLAAILSLNGQIFRAVRRYQWPNEGAAVVVSIVHLMKGQSVSSAVLNEKVVRRISAYLVEGNFDDTPFRFFRNSRLTFQGTNPVGAGFMFSDEGAQRGETESISTKENLVAYNPDIAKFIKPYVSGENIANSIHHMHERYIIDFGDLKEKEAETAAPELFNILKNLVEPIRQKDNREHRRRNWWLFGEPQKGLYAKIESLPHIIAAPQTSPHLQLAKRPNFGVYASTIIVFAFYGEAPFAVLQSRVHEIWARVFSSSMKDDLRYAPSDCFETFPFPPGYENDLALETAGQTYHDHRAALMVEANEGMTKTYNRFHDAEERRPVIARLRELHDAMDRAVLRAYGWDDLADTLRPEFLTPESEDDHTYQGRYFWPAGQRDLVLSRLLALNAERHAEEVAARIAPARGRKTAAEAEGQDAFDLT

SEQ ID NO: 2296 - protein, 395 aa, Methylobacterium sp.
MSTREVVLCHPVRTAIGAYGGSLKGTPATELGAAAVRETLRRAGLDPAHLGSVVMGNVVQAGNRMNPARQAAIGGGVPVSVPALTVNRVCGSGAQAIATAADEIRLGHHAAAVAGGMENMDRAPYLMTGGRWGYRMGAAEILDSMLTDGLHDAFSDAHSGWHTEDLAAHSQIGRAAQDAWAARSQARFAAAQADGRFAAEIAPVEIKGRKGAETFARDEAPRPDTTVEILAKLKPAFRPDGTITAGNAPGLNSGAAAMVVAERGFAETNGIEALGHLVAYGVGAVEPGMFGLGPVPAVRQALERAGWRLGDVERVEINEAFAVVPLAVAAELGLPEEIVNVDGGAIAHGHPIGATGAVLTTRLLHAMRRDGVRRGLVTLCIGGGQGIALALEACR

SEQ ID NO: 2297 - protein, 94 aa, Methylobacterium sp.
MTEADRSDIIFELHLADGEADRNATLVRLVRTYPYLREDLVDHWCEIVLMELRAAAYLEPPCQPVDEDVAAQALARFREREAALAGRCEPHRVP

SEQ ID NO: 2298 - protein, 2071 aa, Methylobacterium sp.
MNLVRPTAAFDTLDRVAERSTSAVLGWSALRSQALRSHLLSAMPTSGDPNAFLAEPVIEAAHGWATAPETFGSLAGSLLSESVVAALDGGDWPDLDGRERYRLPRDRHPYTHQLEAWRQLLDETPRSVLVTSGTGSGKTECFVVPLLEHLARAARARAAPLRGVQALMLYPLNALINSQRERLSDWTRPFNGDLRFCLYNGETPKDLPSAEQEKAPEEVRSRYLLRRDPPPILVTNITMLEYMLVRREDQSILQRSQGQLRYVILDEAHSYVGSQAAELSLLLRRVVRAFGVDPEQVRFVATSATIGHADDPSTHETLAKFLSDVAGVPRARVCVVEGHRRPPNLPPTRPDLALPTLEELHASDPTTLFDRLGATPAFRRGFELLKTSPRTATQWFETVGVERAYGSALLAAAARAQTTLPDQSPQLLQPLKVHGFHRTQGGLWACADAGCVGRRETPLDAPDWPFGPVFQERLDRCPRCEGLVFEVVFCSQCGETALDALRETDTEGVERLTAALSPLAEDEFLSELVEAAPESGGDEEPTGRQTVDPDRVLLASPDGRIARAVPIARATGVILDAGDPDALSLTLGDPGQCPHCGVPFDGRGMRLQNFRVSGPFLLGSIVPELVSDAEPMRADRGTVGPLPADGRQILTFTDSRQGTARLAAKLQRDAERNHVRTLLYHAVQAQPFITADQQAQIDEHAAKLAEIDATIAAKPEFASMLALGRETIAGKIAALQPSERRLSWSDALHLLQKDETCRRWIRDEIWAEREAAFTNETAFARFLVLREMIRPPAKANSLETMGLLRLCFRQIDETITRLPNEFERHGGTLADWRDFLTIALTRVFRGNVAVNTDRETLHWIMPDIPARFIVPPGTSTFGDTKRLSWPQPRPNSKRPAIILALLAAGLKLDLDNPTHRDDVIACMGRAWEAIWPVLKTDAVAGTQLDPDKIILAPVRDAFVCPVTRRIIDRTFRGLSPNPRGAGGAFLPAEPITLPQFPFSFGRSGPHGVEPEAIETWLREDSQVVELRQRGYWSDLHDRIARRDTFYRSAEHSAQQAGRKLRSYEKAFRRGHINVLNCSTTMEMGVDIGSIGTVLMTNVPPSAASYRQRVGRAGRRGQAVALSLTLCKHRPTELSVFRNPLSLLTRTIAAPSVALDSAVIAQRHVNALLLARFISASGAELPKLEAGYFYGLHADGERLEDGQSPAEQFIAWVDAPTTRAEPSLIADLRVLVRGTPFENREAIALDGARDQLKDLRTAFEREWDVVRADLLVAAKERAAAETALKIAMRRLTGEYLLTELASHGFLPAHGFPTDVVPFDNSNAFIKERRSPDQDDDAAKRTRFREAPSRQLDLAIRDYAPGSEIVLDGVVFRSAGVRLDWKRPASETSVPEIQALRYAWRCERCGATDTAHRQPEACSSCGEAGRALTWHRYLRPSGFTCDPVTKPHSDIERVAFVPPRLPWVAARGGAWTTFSDASTGRFRASRNGMVFHYTSGATEHGYAICLCCGRAAPESGSRDAAPPLPGDLQQVHRPLRTSRKEQPVCDAQDRPFAIQRHQFLGHETITDVLELQLTGLKGPAVGYPIAAALRDALAQKLGVEPGEIGFGITQTRDAEGADPRWSIFLFDRAAGGAGFSVWAAPRLVELLEAVRRILDCRHGDHCQHGCVDCVLSRDLENQTIDRIGALAFMTEAVLPRLSIPAADRLFSPQPTLAEMQPLADAIMREMEKPGVGLTLWIGGNPRDWDLERWAAVQLIRRLVLRDRTVEIIAPSAVVEGADAGLRVSMFGLLMKSGAAVRQAPDPLRVGSGLALAYVGDDKEGVVWASRSPEAIIPSSDWGTASAGSIVRGGLDEAFDHGVVLEPGSFLQTSPDTVLIDVGPELDGPISAFGPNFWRLLAARAPTLAARMTDKTPLTALAYSDRYLLAPLPLRLIYELLAHAPGRTKQTELKLETAFGGGNRHPSSPYTIEHDWQYDPHCAQVTDALIKSLAKASVHRIDKRALPHSRTLILRFATGPAVRIVLDQGVGYWRANPRSTRFDFTQAPPNQAITLRSALVRLQASSLNRTWVVVATVK

SEQ ID NO: 2299 - protein, 306 aa, Methylobacterium sp.
MAFDGRLLAGMSVLAAVVEGGSFTRAAEMLGLSASGVSRAVARLERQIGVRLLDRTTRSLSLTSEGARLYELAAPHLEGIEAAANLASGTAGTVRGTLRASVNPIFSRHVLAPRLPEFVARFPDLTTIIVQQPDAGDLVAEGMDVAIRFGPQPPSSLSSRLLLRTRVLTVAAPAYLERRGRPSTPAALAGHNCIQFLDPQRRRPFAWEFLRDGETLPVATQGPLTFADVDTMVAACVAGAGVAQVLALGVESLLTSGALVELFPDWPGETFPLYAMRPSRRLSPAKVEAFLDFCEAVARPDACSSD

SEQ ID NO: 2300 - protein, 310 aa, Methylobacterium sp.
MPYDGRLLAGVTVLMAVVEAGTMTRAAEALGLTQSGVGRAIQRLETRVGVRLLDRTTRTLRLTDEGRRFWERVGPHLDGIEEAALEAAGSASTVRGRLRVNVDPFFSRLVLSRELTRFLALHRELRLELIMRDQIGDLVADGFDMALRFGDPPVAGFTARKLLETRILTVAAPAYLAAHGRPAHPRDLRDHACIDYQDPLTGRPFAWEFRRGDEVVPVRQPARLMVSDVETMIGACCEGAGIAQVMQLGSRNFVASGKLVEIFPDWPDETFPLYAIYPSRQHRAAKVRAFTEWCLQLVGGDNELDAAATR

SEQ ID NO: 2301 - protein, 257 aa, Methylobacterium sp.
MSRIFITGSSEGLGLMAGRLLAEHGHEVVLHARNAARAEDARRGLPEAKAVVEGDVATLAGMHAVADEANRLGRFDAVIHNVGIGYREPRRIETADGLPHVFAINVMAPYVLTALIERPRRLVYLSSGMHHGVRPALDDLTWTKRPWAGAQAYAESKLYDTVLAFAVARRWSDVLSNALEPGWVPTRMGGAGAPDDMDQAHRTQAWLAASDDAAARVTSGYFYHLRQREPNPASRDEAAQEALLAACATLSGVTLPA

SEQ ID NO: 2302 - protein, 256 aa, Methylobacterium sp.
MALIFITGSSDGLGLMAGQRLAREGHDVVLHARNTDRGEVARRALPNAAQIVIGDVVTIAGMRSVAEQANAIGRFDAVIHNVGIGYREARWLETPDGLSHLFAINVLAPYVLTALMEKPDRLVYLSSGMHPGGVPDMDDLQWTRRRWSGSQAYAETKFLDVLLAFGVARRWPAVRSNALEPGWVPTRMGGPGAPDDMAAAPVTQAWLAVGDDPATRVTGRYFYHQREKLPEPSTRRVGLQEALLDRCATLSGVPLP

SEQ ID NO: 2303 - protein, 574 aa, Methylobacterium sp.
MAHQNRVVDVIADGLVRHGIEFILGQSVPSALVLACEDRGIRNITYREENAGGVICDGFARVAGKVAVMICQNGPAAALAVAPFAEAMKAGIPIVAIMQEVDRAHIGRNAFQEYDHKTLFASVTKWFRTLESVDGINDHLDQAFIAATSGKPGPAVLMLPVDLHKAQAGTAADRRDRLNTWPVDRPRPSDAAIAAAADKLLKARSPMIVAGGGIHGSAASAALATLAERIGAPVATTNMGKGAVPETHPLAAGAIGNLTGPGSLGRHTKAMVQDADAILLVGTRTNEDGTDKWTLLPPGIPIFHIDIDPQEIGRNYEAVRLLGDARETLAALTTAIGDRTPASDRKAAERRVAAAWAKFEEERAPFLADTAPIRPERILAAIQQRLGSDSVIVADASYSSSWIVGQLRTHHATTRIVSPRGLAGLGWGLPLALGAKLARPASEVIAVVGDGGFSHVWAEMETAVRSGIVVTVVVLSNGVLGYQKDAEHVKFGRYTSAGHLGRVDHAAIARAVGATGLTITVPDQLGEALAQAASATTLTLLDVDTDPGAHPPISLYDGTLDMIRDGVATQLAVA

SEQ ID NO: 2304 - protein, 237 aa, Methylobacterium sp.
VTADRASRSGEVEAVPLSANEQILHQLREALASGAFTPGQKIKIRDVAAAYGTSMTPVRAALSRLVEQGALEDDGGKSLRVPLMTLDRWHEILDMRIALEGLAIERAASRIDAAALAELRHLAGELAAARRAGDVERDRTLIARFQLGAYSASGAPLLVTTIERFWLLTGPYLNLIFPDYVQTVPHGWRERLCDMLQAGEAAAARAEIERDLRDARDHVAGLADPDGLIRLKRATPG

SEQ ID NO: 2305 - protein, 231 aa, Methylobacterium sp.
MLIHNDYRQRRNGGPRPTLTALQALVGSSARQTAAFVATLKAARLVTVEAVPEDARVRCLRAAPPLVAEIGKSARLFVAAMDRLARRAPGRAAALDDPDRLGALIYRSGAHILQHGMLTAPFQRILSLTERDCGYPLLAAVMGAHYAATVPDAPAALPLSLRALADRLGVSRAHVGNLLQEAEADGWFRTEERRLVQLDPTLVDEFEHWAACQMVFYDDLAAEICAEAAGP

SEQ ID NO: 2306 - protein, 192 aa, Methylobacterium sp.
LIEDLSGSDRLRHAFAFMIEELVNPSLGTQEVTSALMKQCLTILLRIHLKEKGAESPIFEALRDPRLVPAIAAVLDAPGAQHTVDSLAALCGMSRSGFAERFSATFGEGPIEYLQRARLQLAAKLLTSSPMPVKVISESVGYASRSYFSHAFKTAYGCDPSAYRAQATNLVRSLEPQSDLGIDGARRKSERP

SEQ ID NO: 2307 - protein, 176 aa, Methylobacterium sp.
MSARAIRCARGVVLLTLALAGPAQAQTAGPPPAPDHMPKPGMTPPEMAGRAAGRFPQPVRVGDLPGRLLLQPEESQPVLGRVTGLVRRNDGGADVIVRLDGVLGLTWLGLQPVAWSGVGSRLVAVPVEAVALLGEHVALMGLTPERLRALPAFAPGSATAVQPDETLRLGIVRPFH

SEQ ID NO: 2308 - protein, 410 aa, Methylobacterium sp.
LAMALEDDAGPGLWAGTRTEEVGLDTGQDYGIATSRTFALAAYLDRWSGCAHHALAASDSEPLTLTALLHLAGPEDRLRWREADLGYAEPRGASWLRAAIAARYHRLEADDVLVSAGAQEAVTCVLSALLGPADHAVVVVPIYQPSELVVTRLCAADGIALQPDQNWKLDLNRLAAAIRPNTRLVLMNFPNSPTAAVLDLTTLDGLIELCRRHGLWLVNDEVYRQTELDQERAVPPVVDLYERGISINGLSKGFGLPGLRVGWAACRDRVLLDRILAAKNLLSSCLAVPSQILAHVALRAEPRLTGRARAIGHSNHRRLRTLLDRYPDLFDPDEPTNLAFACPRFRGREGATTFARTLASEDGVLVLPSTLWHSALASIPMDRLRLGLGRVGSSAALGILADHLLRRAGR

SEQ ID NO: 2309 - protein, 564 aa, Methylobacterium sp.
MTDQVLSYVHGAADTPLLGQTIGQALARAAADWADQPALIAPAQGIRWTWRELSDRADAFAAGLLALDLQPGDRIGIWSLNRAEWTLTQFAAARAGLILVTINPAYRLSELEFALNKVGCAALVTATAFKTSDYLGMIGSLAPELAASVPGRLAAARLPQLRSVIQIGGPPAPGTIAFEEVAALGGAGERARLRGLADQLQFDDAVNIQFTSGTTGSPKGVTLTHHNILNNGFFIGRALRLGAADRICIPVPLYHCFGMVIGNLAALTHGSAMVYPGEGFDPHATLETVQAEGCTALYGVPTMFIAELDHPDFARFDLGTLRTGVMAGAPCPIQVMRRVVERMHMREITIAYGMTETSPVSFQSAVDDPLERRVATVGRVHPHLEVKIVNAEGRVVPRGEPGELCTRGYSVMLGYWDDPAKSDEVIDAAGWMHTGDLATLDADGYCNIVGRLKDMVIRGGENLYPREIEEYLYRHPKIQDVQVFGVSDPKYGEELCAWIRVRDGETVSEDEVRAFCRGQIAHQKIPRYIHFVESFPMTVTGKVQKFRMRHIVEDQLGLARDGTA

SEQ ID NO: 2310 - protein, 227 aa, Methylobacterium sp.
MLHISDMSSPAVQPSSDLRTRLLARIAGQPDEVWTPSDFADLASRHAVDKSLQRLAATGELRRIDRGLYDRPRINSLTGRPTVPDYRAVIRAVARRDKARFVVDGMTAANDLGLTTAVPARIEMLVDARLKPIQLGKQEIHFKPAAASRLYWAGRPAMRVVQALHWLQDVLTHEDERTRIADTLRRLFADPKHGPAIRGDLRNGLSALPIWMQDFLRPLIVGKAPPA

SEQ ID NO: 2311 - protein, 578 aa, Methylobacterium sp.
MIKAQDRTLEEWFTRIRLGQLRLPRFQRVEAWDLDNVAGLVDSVLAELPVGSALVLEVGVDEPFVTRRLAGAPEPRERCSEQLLDGQQRLTALWKSTHDLYEDSIFLVRLEEPAADEEGTTPPRTVRITRWTHRDGRRFPLWVDQPTEVLGRGFVPASLLQPSDVAGRRLEWCRAALGNDFEKILEIEGKIRTLHERVKRFNIPLLRLDLTTPPATALDVFVKMNTSAVALSAYDIIVAQFEARTGRAMHDLMRDLREQVPALEAYTTPEQLILQAAALRAGRPPVQASLRDLDLTVLDTDWESFVAGARWMVQFLEQEGVFDEQRLPTTIVLPVLTALHADVPDRLDAAGNAAGLLRAYLWRAFATPRYEYTSAGRALQDFRGLRDVLQGKAERASVPIFSPEWELPSVERLMQTGWPKRKDTLARAVLAVSLREGAFDFADQRRADRDSLRSREYHHLFPVALLREYGRIEDREINRVLNCALITMSTNRNVGAKEPIAYLSERIARASLGEAEIRDRLRTHRIPFAELNVGGYDDLGIERADRVQSDYAAFLRARAIHVEAALTALCAGTQPQSI

SEQ ID NO: 2312 - protein, 694 aa, Methylobacterium sp.
VDALDAKMEELLTAGRMPSAADFGGLDQILGEAQAVARSHYAPEFMSLVLDGSDDGDASAMAFASELVERLDSDLAINAIVDWAAGRPPLPAATERRFFKRWLSLADDRDAATSVRTAALRGALLMKRRDERLALQLAGFVAASELDDEPDYLAHAARVGGFLHAESPHPGIVRFLEDLLAVTDAADEAAFELGMDRVGLALRTSDGPQVLSRLREARARFDTASAGREARSDARVLSLAIALLDDFYGERSDGWPERLQELAREAFAYSAYYGQGDDFLNGAKTAEVAAWGALAVRLGSLAPDLGKPAWWDAARIIEGELLAVYSASRTIFRRGEDGGLEWVVRPRIEEYVSQQRQQLYVLRDWLGANPLSEHGAAATELIRRAEAALGMEGSSDPQPAAAEGSTVAAILEQGELPIELQERIVRETLADVNAFEFRQVSPPLMEAVTAVHLTFKGLQYYEQPKVRAIVRSLVYKTLLFLEDRLDLTAGVDPAVAYLFVEEGQPNPHEKALQQDYMASLRRSRFGTVDEVRGVGGGRADVAHQVDGIRFVTEVKREEKDASFANLLASYGDQTALYQNTNIPVGILLVLDLTTSEGLPGHIRTLYHPEVGELFGDGMLRGVLVVRVPARKIPPSAATERAKRAISAARAEKRRQERAAKKAAAGAAGAKGQGRKRQAAEPILKRPDGGSDEGG

SEQ ID NO: 2313 - protein, 647 aa, Methylobacterium sp.
MADDPKLVDAASLLAEIADKSGRTVDEVRGILSRHGVAYRPSIAVPKHLCIRSLAFTGEKLGEKSGPISFAWENLGPGLMAMLSDRNFRGKSTLLGMMRWCLTGRRENNIPTEMAEWFDAVRMTFTLDEQAYEVDISDAITPAGTLWRVEGDKRLVQAPFGSHEGFEAVMSDFFMGQLGLQTMVVHVEQGGKGIDQAHHWPWLSGALVIEPSPKHLFGSAQHLRVRMMQMYLGVPWADATSDVLSAKNRIGTETRQVTAEIERTRARRKARLAELDAELSSLRSKLAKLPREEDKRLALRRANREVAAAEARLRAGERALAAVGEDLDAAKEAHAEARRDLNDFRDGRAARRVFRSLDPLSCPRCEEVFDEERRKETRERHVCVVCGTDEIPEGNPAAQEAGLKDAAARAAAELQAQKTRHEKAQEAVSQAKADGERFETECRRLEAALALPSGAGALEMEIMRKEARKEELEGEDVPAPETMDDTAVLEIAEKVTKQAFKPLQEELLDEVSELARDYAVRFGVESLQGVELRGNCTMALQKGGGTAFFGTQTDGERARLKIATTIAIITVAERRGLGRHPGLLLIDSPGANEMVGQDYASLVAGLAELVDEIGHIQVFVAAVNNDTIRGHVSGNNLRYASGDEYLW

SEQ ID NO: 2314 - protein, 73 aa, Methylobacterium sp.
MGGNQRSHAMAVHADRFRQTYEAQPALFLHVLRARLADRDLRIGVSSTSRFFKRHGITWRKTPATQLTRNAKT

SEQ ID NO: 2315 - protein, 742 aa, Methylobacterium sp.
MTQYLVRRANLLVLGVLMAIVALVGAVTWERLNASRAAREWSQHSYRVLSTTKDLAIALRDAERGQRGYVLTGRDEYLGPYDAARDRLGLLQGELQKLTADNLTQQERIRALAPAIQHKLEELAQTLQARRDGGLENALRIVNGDAGRNHMREAETLLDGMLGDEQRLLDERLAQNDARAAWVRWMVIAGSVLAVLTLLWAARLLNRAWSRSYATEAEQRALALRLRTTIDSLSQGVAVFGPDLRLANWNHCFQVLLDLPKAMLRPGTAYGSFAEHTGEPGRPALESEDQIRHGSRNPREAVTYEREGADGHHLEIRRTPMPDGGFVLTISDMTKRAQAEAVLREAQKMQAVGQLTGGIAHDFNNLLQVILGNLEFVRAKLDGDARLQQRIERAAWAAQRGATLTGQLLAFARKQPLAPAPVDLAATMPDLIPLLRRTLGEHIEVRYVETAGLWPAMADPAQLESAVLNLALNARDAMPGGGRLTIELGNKVLDEAYARDNAEITPGDYAMVAVSDTGHGMTPDIVRRVFEPFFTTKPDGKGTGLGLAMVFGFVKQSGGHVKIYSEPGEGTTVKIYLPRAVGAVAAAPLTGAPVELPRGSATVLVVEDEAGVREIACAILSDLGYRVLEAVDGEDALRVFGTNAASVDLLLTDVVLPGKVRGRELAERVQALRPEVRVLFMSGYTENSIVHHGRLDDGVHLVGKPFKREQLARKVAEVLGSVAAAKEAANVVPLRPLRDASS

SEQ ID NO: 2316 - protein, 114 aa, Methylobacterium sp.
MNRYDLTNMSPTKMREHIRLAKDNRRAIEAKPDPEAELGAMVRVCDVMWVVWPDKGPGTRLGHGLCIVKGTLMFEAIVSAGSGVAVMETTQWFPSFEAALDAFDQDGDGFLLAA

SEQ ID NO: 2317 - protein, 82 aa, Methylobacterium sp.
MTQQAIYAALTQIFRDVLADDTIELRPETTADDVEGWDSATHINILLAAEERFGIRMSSAEIEKLTRIGALADLIQAKAGRI

SEQ ID NO: 2318 - protein, 355 aa, Methylobacterium sp.
VTAAIEWARAQVRRLDGEGEGGVTEVPSVRTAVEAYVAARSARAPAAGRDAEKRLGKHVLSDRVLADTHLAKLNAGTVRAWRQRLSGELQPTTVNRLLNDLRAALNAAAEHHRRALPATLAAEIRAGTKANAAGSSARKQVLPDAEIRRLVDAAFAVDDTGDFGRLVLVMAATGARHSQVARITVGDVQAARGRIMVSPSNKGRAGKRPTPIAVPVGADVIERLQVALAGRRGHEPLLLHWRHRQVGPVTWERVDRAPWATASAALRLWDRARTRAEAPPGTVMLCLRHSSIVRALSAGVPVRLVAALHDTSVQMIEAHYSAYIVEATEEIARRAVTPLAPSTVAALRSVDEAAA

SEQ ID NO: 2319 - protein, 104 aa, Methylobacterium sp.
MKTISTTTMMVAGLALATLAGGAASADARGFGHGGFGHQGGFGHRGFGYGGFGHHRSFHHRGFRRRFGGFNWDYPAGSYFLSSDFGDCRFVYNPLFFGHERVCS

SEQ ID NO: 2320 - protein, 95 aa, Methylobacterium sp.
VAAVLVAGGGIGVSPTYIAAPYVEQGVLVPVLQEFVVERSVITALWPESRRGNPNVKAFLVFLGEVFPSPTPWDRLLSARVGDKQDASPMGARPA

SEQ ID NO: 2321 - protein, 69 aa, Methylobacterium sp.
MRLIAVAFIGLVTVATVPARASGGDAAQRMLDAMTRHDLCARDDAQLRKLNRSLAATPIRHPAAGTRAQ

SEQ ID NO: 2322 - protein, 281 aa, Methylobacterium sp.
VDNPTASTATIPVNIRPSPPIDGNLLLEALDAADRALLAPYAERREVRRGDVLFRAGDDVSHVTFPAHHCVVTLLVPLMDGKSVETATVGREGAMGGVVSHGYLPAFGQAVVQVGGPVIRIDAARLSEAKQASKGIRDLFVRYADCLLAQVLQSVACNAAHTIERRCLRWLLTLQDRIGTPELPVTHELLADMLGVRRAYLTEVLGRMQRDRLITIGHGRITLPDRERAEAGSCECHAAVRKHFEEVMGAVYAPSGRIVAVDVGEPERLRPPSVLVKDATP

SEQ ID NO: 2323 - protein, 175 aa, Methylobacterium sp.
MPTIRRPSWRARKIHGYDVESFKTHDNRLLEVDDQFRMANLTPEARALFLRMRLDIYFIRRPKGQQIATLIKIDANHQETYDLLNGFDSKNAPLVHITADNKDRPWNSRPRGEGFGVIMYGAYHYSFVSGHVKSYMNGNPEWLWDAVKRAFRWHDASEQDKRAIDAVADAFRAEL

SEQ ID NO: 2324 - protein, 494 aa, Methylobacterium sp.
MRLNLMLTEGLAFASATELVRRLKAREFTARALLEFHLERVARLNPEINAIIYTDLPAARDRADAADAALARGEIWGPLHGLPMTVKETNNVVGWPTTYGDPVLAEAIPTHSAVIVERLQAAGAIIFGKTNVPINALDWQSYNAIYGTTRNPWDRDRTPGGSSGGSSAALAAGLVPLELGSDAGGSIRFPAHFCGVYGHKPTPGIVPVAGNERGASLLDNDLVVSGPLARTVADLTCALDVLAGPAGPAAKAWRLDLPAPRATRLAEFRVAYVTDSPVAEVDEPVRAAIRALAERLAGLGARITADALPFDDHAAHHATYLQLLRGSASARLPQAVYEEAVLRLTEPGTNATPYVARMAQAHAQRHRDWILAEERRAALKRDWATFFERYDVLLAPVTVCAAFLIDEARPREERVLQINGHAVDYNDQLFWAGLATLPSLPATAVPIGYDGHLPIGIQVIGPHLEDRTTLAFAAELERLHPFAPPPRYAPSTGR

SEQ ID NO: 2325 - protein, 264 aa, Methylobacterium sp.
MTAAPASDHVRLEAVRFTYGGSAGAPILENLSLSVEEGAFVAILGPSGGGKSTVLKLLSGLVRPQGGTIRIGGTPVTGPRRDVGMVFQKPMLLPWRSVRDNVLLPAGFARAASAREVARADALLETVGLSDSVKLYPGQLSGGMAQRVGLARMLLHDPRLLLLDEPFSALDAMTREHLSLELQRLWMEERRTALFVTHSIPEALFLADRVVVLAGRPGRILADMPVPLPRPRTLETLSGAQFGTLALELRRLFDEAARPGARAA

SEQ ID NO: 2326 - protein, 362 aa, Methylobacterium sp.
MCRKSPPLLRAAAATVALSLYLSAPVHAIESVKVGLAIPPTVTDGSVQAIADELGFFKQEDLDVTYVVLPGAGALLPQLLQKTITIGLPLPETLLAAHKAGEPPLPVAYFYNAGPRNTLELAVRADSGIRSLADLKGKRIGVGALTWGTIPQTRALMRSVGLEPGRDVSIVAAGVLGAGFHALREDRVQALNFNSSWIDIMEDQGIPARRLDYPPVFRRMVVNGFLAHRSTLEQNPALLERFGRAWTKALIVCDLNPKACIEAFWRKTPSVAPQADRDKALDASARLLRRWIEPVMRDESGAARVPGAFDLTLIAAYVREMHRYGEFATADLPLDAYFSNALAPGFARFDRAALAAQARALQ

SEQ ID NO: 2327 - protein, 54 aa, Methylobacterium sp.
LEPKDIRRTIKGWRPEEHYRVTSGFYDCDISLRRAYQLAAAVGLKRTKTLPWSL

SEQ ID NO: 2328 - protein, 493 aa, Methylobacterium sp.
VRAVLEAEIVTLDPYFTTAYITRTFGFMVYDTLFAPDAKGQFKPQMVDTWSVSDDRLTWRFTLRDGLRFHDGTPVQAADCVASLKRWAARSALGGRLMDVAAALNAVDDRTFVLTLREPYGLVLDTLGTTSSPTPFIMPARLAATPPTTQLTEVMGSGPFVYDRTVHITGDHMLLRKNPNYRPRSEPADFLAGGKVVKVDALDIRVIPDGATAVGALGAGEIDLMQYAPFDLIEQIERNKNLAVMNFTGPHRFTGHYRINTAAKPFDDPAIRRVLLRLVDQREVLDGFGLDPRFSQTCDAFFICGSPYETHVGAELLHDPSVAAARAALKATAYKGEPVIVMAANDLEAARVSSTILADRLKQAGFTVDLQVMDWAALLARRTKKTGWSVFGIHALGLDLSSPLTNSAINFTCKDAASSGFMCDTRMVRLFDRFAREPDPDKRRDIAGEIQSIVYGEGLVVPFGQFAQPAAYRTSLTGLIPSAIPLFWNVEKP

SEQ ID NO: 2329 - protein, 74 aa, Methylobacterium sp.
MARNREPTIAEIERGVVFMAYVVETYGERFAPILDSLIVDLEGAKRRDSPHERARRILDQAEADGIVVPRRSKQ

SEQ ID NO: 2330 - protein, 301 aa, Methylobacterium sp.
VDRYQAMATFVQVVESGSFSGAARLLNVGQPAVSKTIAQLENRLQVSLLVRSTHGLSPTEAGLRFYERARAAIAEADEAERAARGAGAGLSGRLRVSAATTFARLHVVPMLPRFLAEHPDLDIEIVLDDRVIDLVGEGIDLSLRMGTLPDSAAVARKLATGGRSVLATPAYLARVGEPRSPADLAGHEAVVYSRQPDAWSFTRDGAEISVAVHGRVRVSAAEGLRAAVLADIGLTIASDWMFAPELESGAVRRLLQLWALPMIDLWAVFPTGRMASAKARLFAGFVEAVMAETREPHSATA

SEQ ID NO: 2331 - protein, 296 aa, Methylobacterium sp.
MTKSMMLVTGATGETGRCVVRELSDRGHPVRALVRTEDDRAAALRRAGAEVVVGDLLNHDDVIRAADGVEGAYFCYPVRPGLVAATAYFAEAAKRANVKLIVNMSQISSREDSESHAARDHWISERLFDWSEVPTVHLRPTFFSQWFLYPFARKTIVEDGVIDLPYGEGRHAPIAAEDQARLIATILAAPDGHAGKTYTLHGPVELGQAEIARAIGNVLGRDIQYRPLTIPAYRERLEKFGLPEHLIQHFCAIAVDYRNGIFSGKDGIIGELTGKPPMTVEEFVLAHRQAFERTPA

SEQ ID NO: 2332 - protein, 180 aa, Methylobacterium sp.
MTSTDTKPARKAGSARATAKRGTPAAIEMRKPKVHLDAIDKMNREDRARMIGLGQLIWGDRWRTEMTRALGGQLGRKISPVQMAHWISGTRPIPDKVVAVLSRVARSMVNTMQSRVDMVANNDWYFAVECDDESVVVPARWERRVFNEAPDGRTRVITGNHFEDTWIDLKAKPATGDGDA

SEQ ID NO: 2333 - protein, 298 aa, Methylobacterium sp.
MIEREDVDFPAEDGIRLSAWLYRPHRAAGPAPAITMAHGYAGTRHHGLDSFARAFAEAGFVVLLHDHRNFGASGGEIRGDIDPWQQIADWRRAISFLETRPEVDPARIGVWGTSYAGGHAIVLGATDRRLRAVVAQVPTISGFEQGLRRVAPDAVAALERVFADDERARFRGEPPRRQAIVSDDPAVPASYRAPDAVGFYLQPVPAGAWENSVTVRSTRAARMYEPGAWISRVSPTPLLLVVALEDTITVTDLALAAFERALQPKKLVTIPGGHFDPYLSRFDLASNAAAEWFREHLA

SEQ ID NO: 2334 - protein, 287 aa, Methylobacterium sp.
MTRPQKVNLLASFSPVMRAVTRALLKGHADNKTHATNVVRSLSKQDTSGFVMTRHLDEALALATACRKRHRAKPGYGSGRGFCSISLYGIRPRLQRNADYTRSHDRVRLALRLQKPIRTRLKDLRDEMVIPAAKAVMKHGAPGGTVFLVNVEPEAEYRVETEKEWARVNAGKDTWARLADTHYIAVKPTWIGAVRKLGTATVDRFFILDATPFVEAPGRSVWTALLARTGRGYRAVTEQAFPSVYGADITVHGTLQRALSAKPPAEPVQARSPIPAEDLEALDIAFA

SEQ ID NO: 2335 - protein, 218 aa, Methylobacterium sp.
MRLIAGRAALVVIDPQVDFMSPEGAAWALVGESVTEQGLMSNLTALFEAAKDARMPVFISPHYYYPHDHKWEFEGPAETVQHKLCMFDRRGPLTLEGFANSGAEYMPEFKKFIEDGETIVCAPHKLYGPQGNDLVLQLRKRRIDQIILVGMAANLCVESHLRHLLEQGFEVAVVRDAVAAAKLPDGDGYLAALINFRFLANGLWTTSVARERILSLRS

SEQ ID NO: 2336 - protein, 206 aa, Methylobacterium sp.
MFDNLIKACPDELFLDLGCGYRQRMFENCLYLEVYPSRSADLIVEPNCLYPIRSGTLSGIGCFAVLEHTRKPWLVVEEMARMLKPGGRAFIDWPFLQPVHGYPSHFFNATREGLVSLFEDNGFTTDQAFTGAHQTAAYTVQWILARFCHHLSDPKLRRQFTRMSVRQLVTMDRQDPLWWKFLNALPPDAFSELACGNMLVATKVAS

SEQ ID NO: 2337 - protein, 47 aa, Methylobacterium sp.
VISAEEFRRLTGAATGQSLIDALQASPHRDIDLEPESVVMPVRDVGL

SEQ ID NO: 2338 - protein, 224 aa, Methylobacterium sp.
MTLQSKLDAFKADFEAGKPPYTVPPSVIRTMHRATAELIATGAATRALRAGDRAPAFTLNDPEGRPVSSDALLARGPLVISFYRGVWCPYCNMELRALQEALPQFEKLGASLVALSPQTAANSRKSVRQNALEFLILSDLHNAVAAAFGLRFALPDYLVDLYMSLKNDLPAFNGDASWTLPMPGRFVVGQDGVILYAEVNPDYTRRPEPEDMLPALRRAASIPA

SEQ ID NO: 2339 - protein, 211 aa, Methylobacterium sp.
MFEVYAFATPNSIKVLIALEELGLPYRLHGVNVRQGEQKAPEFLALNANAKVPVLIDPAVADGRLVLTESAAILVYLAETSGRLMPPDGEGRARVFEQLFFHASGLGPAFGQAGFFQRQAAEPQPLAIARFSAEANRTLGVLDGVLAERRHVAGDAFTVADIAHFGWLWRRDFAGVSFENTPHVARWYDAMAARPAVQRAIERVNALVPQA

SEQ ID NO: 2340 - protein, 256 aa, Methylobacterium sp.
MARFETYRDAFPNARLTRKPNGVLEVMLHTEGGKLVFNGHTHEQFVDLFHAIGEDRDNRAVILTGAGDAFMDAISPEGFDFFTPRGYDKILREGRKVLSNILDIEVPMITALNGPVLLHSEYALLTDIVLATPETVFQDKPHFEFGIVPGDGMHILWPDVIGSIRGRYFLLTRQVLDAQTAKDWGVVNEIVPQDRLLARAHEIADDIAALPPLTGRYTRIALTQRLRRLVEEGTGYGLALEGISAADVARTMAAQN

SEQ ID NO: 2341 - protein, 53 aa, Methylobacterium sp.
VPLRDVIGRAGFCALLLAAAPARAADFDGPYAPHGYGGPAESYERERRPPPPP

SEQ ID NO: 2342 - protein, 40 aa, Methylobacterium sp.
MSPHDYTWLLFATPAAVAAIGALVYFVAIRQDRPGSQHGR

SEQ ID NO: 2343 - protein, 154 aa, Methylobacterium sp.
MLLSAFLAGLVAGSRALLAPTAASWAASFGFLDLSDGWLAFLGYHWTPWILSLACVVELVNDKLPATPSRKVPPQLGTRLVMGTLAGAAFAGENWHLGALLGIVGALVGTFAGAAVRGSMATAFGKDLPAALMEDLVAIVLAVMLAATAGHVVA

SEQ ID NO: 2344 - protein, 256 aa, Methylobacterium sp.
MATRKPDPRQIGFEFTMPALITPVPAWVREIFKPEALPSYPLHIPSSAEEAEAIAAIPFGQRWENHVAVGAVPFGQRCENHVAVGAVPERIEVPLPRKNRLDLSITGTRLGWTAGYHLTFRRPVGPGANPRAGTGQFGEGCGGGLHADVNEHGYFLRTSRDAALRTAAHRAWWACWKLDEKIAGEVERAVLRAFGFSKVQAAGHDHRRWLVSRADGDASLEQRRSQPREDVPESPAIDEYRRAAGLSDTAAWSAAA

SEQ ID NO: 2345 - protein, 623 aa, Methylobacterium sp.
MAEITQSFSQLLLTYGPGAMLDLPDHAVVVAGLQGWRYAGGWDELREDRLVPLLRQQLAGKISPTFHGLRRPPAQDEERHDPNAPGVEVVLFPTWFTADEGDAAEPAEGSGPARAEKRRRMVTYSDLSVTQGGKLSYGGGGRKSPVNPIRFVAACPRGHLQDIDWRFLVHRGRDGTCRKEMFWVERGVSSDPADLFVRCTCGASVSLGDLYKPKFLGRCGCHSPWLQPRRLAEEVCETDLRLLPRSATNTYFAQTVTVISLTSEHSRVREVIQQHGAMIESLRPLPNFLTVLRTLPATKEAFQEFSDDDITRALEEGDAGAAASAPNPRIAEFDLLASGKPTIGEDREGSFLFAETLERDRLALTPPWSELLHGVARVHRLREVTCLYGFTRLEPPPTGAESELDEIQLSVDGADLARDVEWLPAIEQYGEGIFLHFKPDFLKAWLARPEVADRAQVLRDGEARDARRFNREPRHLGIAYWALHSLSHALLSELALECGYPLSSLKERIYASGTGQANRFGLLIYTSTAGGQGTLGGLSSMAEQVPHILERAVRHLVLCSNDPICAEHGPENDHDDRPLHGAACHACLLVPETSCEARNTRLDRGLLVETVVGADYSMFDVSR

SEQ ID NO: 2346 - protein, 1147 aa, Methylobacterium sp.
MRRDLVGPHPDCDGDLAREVLAGISPSTWYLTGYLGPRRGMRAPAPMKGAAADEEAAELGLAAQRASEGMEQGAPGPGAAADDGATERPPARSFEPSSLGLTVLLPRDIKEVTARVTWGDYVTEPPLDLAVVVPSARIAAAATGELPKTPEAGKLHWRRIPREAHIPIRLDVHRNGAPQTITIPESAAPQVPGGGLQLVVSARPTRTAGIDGVHRDLTALSVFLVNARSETLRRFGDVAFCFQARLELSCEQGFAARDDRASYSAEEFDERLADLHYRDVCSFAVGHNTSGDWAEPDEDGRVRRVFTNPLPVQEVEKLGADIDLPGVTRGMEALAQAAGDSATLSAALAALPDEYAVWAAGQAASVAAIEGQRRQAVARECLENIATAQARIAGGLAHLLSDPVSREAFAITNQVMARANRQRGMTLNGKPPAEQRAPTWRLFQLAFVLLNLEALAKPNHPDRPVVDLLFFPTGGGKTEAYLGLAAFAIARRRLSHPGLDGAGLSVVMRYTLRLLTLDQLQRAAGLVCALELERRASGRLGTWPIEIGLWVGGAATPNTLGSSKNVKPGTAVHWHREYRAKRGPAPAPLKACPWCGTSLKPESFYLYPNGTAPQRLDIRCDDVDCAFSSSERLPIVVVDDEIYRRLPAFMIATVDKFANVPWEGRAGAFFGHVERADATGFYGAAEPGGGTPMSAPLRPIDLVIQDELHLISGPLGTVAGLYETAFDLLASRTIDEVRRGPKIVASTATVRRAEAQIRSLFGRARTAIFPPPGPSRHDSFFAKTDQESPSRLYTGIASPGRGPKLVFLRTLQTLLAGAQALSSSAESDPADPYLTALCYFNALRELGGARRIVDDEVRTHLATYGVQRVRLEPPGQPFADRALREIQELTSRYSTDQVSEARTRLGRPARAKDAVDVALATNMISVGLDIGRLGLMVVQGQPKTAAEYIQATSRVGREPEKPGLVVTLLNVHKPRDRTHYEQFRSFHMSFYRAVEATSVTPFAARALDRALAATLVAAARHFEPDLTPRSAANRIARNGHAAAAVRAAFEEKMRVAGVETAAIERCLARIDALAVAWAEIADHQTANGDQFVYANEEPVRRLLQDPLDDPPNMAANRAWFAAGRSMRDTEPVALLKLRGPDGAPLSK

SEQ ID NO: 2347 - protein, 202 aa, Methylobacterium sp.
VVRTIVDAGGSAEAVVTDVTQEEAVGILFDRAFAAAKGRERPDLVVYNAGNNRRMNFLNVTAAEFEAFWRIGCFGGFLVGREAMRRLLPLERGTVIFTGASGSMRGKAGYAQFAAAKAGLRMLSQSMAREFGPKGIHVAHVVVDGGINGDRLRASQPTRVAEQGETGLLDIDAIAQAYWFLHEQHPSAWTQEIDLRPFKEPF

SEQ ID NO: 2348 - protein, 102 aa, Methylobacterium sp.
MSNRAPTPENNVILRQMSGMRRDMSEISVTNARVIELLGRMNLRLDEMSERFDRRLRELQGDMVLMENRVVTAITEVRNISARLDDDQADPSLPHGNERTPK

SEQ ID NO: 2349 - protein, 41 aa, Methylobacterium sp.
MGVPEIRRLKQLEDENSKPKRLVADLTLDRSMLQDVLKQKW

SEQ ID NO: 2350 - protein, 262 aa, Methylobacterium sp.
MPHLRYDEDDAIACITLANPPQNRLSPEMIMDFEAALERLGESSARCLLVCADGNDFSFGGDIVPWNYMEFRELRSLFDRYMAAFNRFERLGIPTVAAVQGLCFGGGLELAIRSDVIFAGETSRFGHPEQSLGIVTLLGGIYRVAERAGRSKAMEWALTSTQVPAAEMERHGVVNRVVPDADLREAAVEFARTVARGPTRAHAVHKTLLRIWATGGTAAADEAMWESAMPLFETHDTRLALPASIEAFKAGRPRPNFDFQGS

SEQ ID NO: 2351 - protein, 238 aa, Methylobacterium sp.
MIIEADTLDATQAYKLLIATIVPRAIGWVSTLSTDGVANLAPFSFFTAVGRKPPMVSIAMQHRSDGVTLKDSFVNIRDTGEFVTNLVTLPLADAMHKSAFEHAPEIDEFAVTGLEKAPSSVVRPPRVANAPVAFECKLERLFTVGDHDDHVVWGRIVAFHIRDDLYLPGGRIDTAAIPAVGRLAAEYTLVDTVFTTPVDPEILAARDGRRMRRLDGHPDDFSPIDGKGWSPSGSVLSE

SEQ ID NO: 2352 - protein, 223 aa, Methylobacterium sp.
VWRGVEAGLKKDGYRTVSVDLPGRPSNPQAPDRINLATYRDVVLDKLSDEARPVVLVGHSFGGIVISDVAEHAPTKVRTLVYVAGLVPRDGDSLASMAQSDGGSSAGRYIRFLPEKGIATVPVEARGDLFANDGNPGQKRAVSEAIVDEPLAPLAEAVHVGARFAAVDKAYIRTTQDRVVSPAAQSAMIAGASIRKSFTVKSGHTPFVTAGPALVAAIEASAN

SEQ ID NO: 2353 - protein, 413 aa, Methylobacterium sp.
MYKAVIASSIGNALEFYDLTLYLYFAVTISKLFFPSSNPTTSLLLALGSFGISYLMRPLGAIVLGLYADRVGRKPALMLSILLMMVGTFMMVVMPSYESIGIFASIGVLAARLIQGFSVGGEFGASTAFMVEHGPARKGFFASFQFASQGLASVMAALSGVILSATLSPDQIASWGWRLPFAFGLLIGPVGLYIRRNIAETPEFEDSTEGEATNSPMRDLFVQQWLNILLATGLVATSTALNYMISYTPTYAVNQLGLPSWIGFVASFVGAVMLMTLAPLVGHWSDNIGRTPIMRAVVIAVFVLMFPAFALLISYPALLVLVPVLALIGALKASYSAALPALMAEIFPTRTRSTGMNISYNVGVTLFGGFAPFWIESLIAITHTALAPSFFLMFAASVSLLCIVLVRRTFGLR

SEQ ID NO: 2354 - protein, 958 aa, Methylobacterium sp.
VAVGYNNSAGNPDYNSTAIGTSNSANGAYGVAIGYGNTADGRSTLSLGTGNQASGDIAIALGRQSYAVGDFSFAQGFIASAYGQDALAIGRLSVAGEKGASSTASNIAIGDNTSAQGGSALAIGSGAKASSKRAVAIGSNAMALRGTISGMEAYSGTALSSANTEFSVGDSGTERQITNVAGGQKDTDAVNVRQLRGLGNTLGTTLGSSFDQTTNTYTPPKYSYAKRNYSTIPDLVGSIDSLALRYDTDGGGKRLASIDLTRSGDLGSAVSITGLAPATTDSGAVALSQMPLRYSTASSPTIANPAVPSNDVTLVGSNARQTVLLHNVGPGDITTSDSTDAVNGSQLYTTNQKVAALQNGSLGLVQQDQTTRTISVGKGTDGSAVDFTGTDGARRLIGVAVGTSDSDAATLGQLRATSDALGGGAGYDATGVFAKPSYSVGGQIYRDVGSALAASNNLAVQYVPDRNGNPTNVVDLAKGGTTAVSLRGVASGLVAVGSTEAVNGGQLYAISNSVTDLQNGTSGLVRQDPTSRAISIGGATDGTVVSIADLNGTARTLTGVGTGQIAAGSTQAINGGQIYAVGASVASALGGGAGIAGDGTLRAPSYAIQGATYNTVGGALGGLNAAVTTLSTNGSRYVAVRSTGAAAQALGADSVAIGPAASASADRGVALGAGSVASRAGMAGAAEAFSGAAVNSTQGAISVGFEGGERQITNVAGGTQDTDAVNLRQVRALGGNLAGALGGGARFTADGGFTAPSYTIGGQTYASVGAALGAVDTFGVRYDVDPSTGGRGQSMTLAGGDPNQPVMIRNVAAGVLATDVANTGQVAQAKAEANAYTDRSVAVASAASAAYTDAAVAPLQKQMSSFGSQLLDLNRQVGEVRADARRGAAIGLAAAALRFDDRPGKLSVAAGGGAWRGEAAASFGVGYTLPDGTARVNATGVAAGRDFGIGAGASFTLN

SEQ ID NO: 2355 - protein, 95 aa, Methylobacterium sp.
VRDWILGLSADDRKIVGTDIAIVEFGWPVGMPTCKSLGNGLWEVRSDLTGGKIGRVIFVMHQGQMVLLHGFVKKAQKTPLSDIRIATKRQKELQR

SEQ ID NO: 2356 - protein, 84 aa, Methylobacterium sp.
MDMKTPTIPGSAASPRALGKLQDLAEVLGCSTDLFFAASDGPSTGQTAQLLQMWLAIRNPEDRQTVFACVREVLKAQSDGHRER

SEQ ID NO: 2357 - protein, 40 aa, Methylobacterium sp.
LAFASITAEKQQSARAATQSTPLAVRIVRLDMSPKVGGFG

SEQ ID NO: 2358 - protein, 143 aa, Methylobacterium sp.
MTDTTEADIRHIYERWHATVRGRDIDGLTALYTEDAVLESPLVFAESGGGASGILRGKAAIRGFFDASLRKPGSVLGRWYRTGTFFSDGRQLVWEYPRATPEGDQVDLVEVMDLAAGLIARHRVYWGWVGFRALAPGLNGPVG

SEQ ID NO: 2359 - protein, 184 aa, Methylobacterium sp.
MMRTTLTAALLASGLAFAAPAFAETAPMVGGAPMMADKTIVENASKASNLTTLVAAVKAAGLADTLSGKGPFTVFAPTNAAFKKLPAGTVDSLLKPDMKKTLTAVLTYHVVPGKLDAKELMAKAKMGGEAANLKTVEGQVLTVKMDGDRLALIDQKGGGAFVEQADVNQSNGVVHVIDSVLMPK

SEQ ID NO: 2360 - protein, 45 aa, Methylobacterium sp.
MGEGWVTTIEVPEGSVHGYLIYDETGVEVSNWTTLDVAVERAAKG

SEQ ID NO: 2361 - protein, 285 aa, Methylobacterium sp.
MMVEAEVPAHGDAEEENYFISMTDMMVGVLFIFIIMLMSFALNFQKQADRQEDKISVAEEVGRKLEALEQRVSQRLSEIREAASARAQLLHDLRDALSREGLNVTVDEANGVLRLSEDAILFPVNGADLVGRARDNVDKLARVLAHVLPVYSPCPAVVEGPCLSRSRAYVETVFIEGHTDSTGIDANNWDLSTKRAVNTFRELIVAAPDLRRILNGRGSETLSVSGYASTRGIDPDKTPLAYSRNRRIDLRFVMEVDSESGLREIQTLIDGMKGEIAQLSRPAVP

SEQ ID NO: 2362 - protein, 219 aa, Methylobacterium sp.
MPSKGDQALLLGFLTPRFGDPRVKAGNWIGMEAAAGIVKRWLTEIALRQFFDVVDTIAPERMWRFRRAFWSAYHARDAILNAWVVFGPDGAREARRAFGQGIAFGQFMKGGRKQLLEGHAVLLLDLGRCIVADWSHTGYCNIWSTDDPDKPRHLNANSYTTDDVRRPVPEDRSERSLTAHDIYSHGGSDNYVWQHRVAARIGELTGVRLRAGEFAAGLE

SEQ ID NO: 2363 - protein, 96 aa, Methylobacterium sp.
MGAAGLLGVTRQSLSDLLNEKAALTADTAFQIEAAFGCSMEMLMEMQKQFDIAVIRRRERSVRNAAFAKAWSKVAVTRLQAAQKRSKVPSQKQMGG

SEQ ID NO: 2364 - protein, 345 aa, Methylobacterium sp.
MPFVQAAPAMQTIFSTAGMAPKDRFRRWRDVSEDRIVPMEQAYLGEEAFDATIDAARVGGVDFTKFSFRNLRASTTPRTLRHENHRTDHLFISMVLSGTVRADQNDRSSTDKAGDFAVRDTNTPWTIEHNGYSEVLAIAVPRERLETALGSARTFAGLTVDGDLPATLLARSFLANLLREGDRLPPHSAERMVGIGIDLIVACLAERLAQDAPRPMHGTLVIQRAKAFIEAHLGDPTLDPPLLAAAVGVSLRRLQELFHEHGQHIADWIWQRRLEAAAARLADPGCTHLSIGTLAYSCGFANQAHFARRFKARYGLVPSEHRHAALMSTDKVRRRSRQLSPACGS

SEQ ID NO: 2365 - protein, 116 aa, Methylobacterium sp.
VEATLQLIDGKWKGVILFHLLMGPIRFGALRRILQDCTQRMLTNQLRDLEADGLVDRKIYPQVPPKVEYSLTARGRTLEPVILALKTWGEMHGVASIPDAARRDAGAMSPLGAGEL

SEQ ID NO: 2366 - protein, 104 aa, Methylobacterium sp.
LSPEIEWRVLESFPSGGIYRGRNDVLDRFFPSVKAHFSLYETHPKTFMADGETVITTGHYRIASKFGVPAEADFAHVWTVRDASIVAFRQIADTAAINARLGRS

SEQ ID NO: 2367 - protein, 264 aa, Methylobacterium sp.
LLDPAALDPSSLVLDARAEEDYRQGHWPGAVRVPVSDWEAAAKQADTGLSEDRYWRTLIGDLGVDGRRPVAVYDDGRMTEAARVWFILQHFGVRAAVLDGGLPALSDRPDAHMDRTPIVPTPVPLDPVPTSHVPVGLVTRHELRDRLDDGTRIFDARTAAEFAGEDLRRNARGGHLLGARRVGHADLLTADGRMKPAGELRAMLEAAGFRPGDRIVTHCDGGGRAALAALAAVQAGFAQVDAYYLSFADWAMDESCPVVPGTAT

SEQ ID NO: 2368 - protein, 81 aa, Methylobacterium sp.
VLQKGRHYDPTDLFLRKGDTITLVNGDDSVVHHAFIEADRFAFDAGDQEPGKQATLTLKEPGNFIIQCGIHPKMKLTIHVQ

SEQ ID NO: 2369 - protein, 294 aa, Methylobacterium sp.
MQIGFIGLGSMGSAMALSLVKAGHEVRAWNRSMVAQDRVHGITLVQLAADAFQADAVFTMLSDDHAIREVILDAGLLASARPGLTHVVTSTISVAFARELELLHEEADLGYVSAPVLGRPNVAASGQLNILAGGKGGAVAAVEPLLASLSKKVWKLGDDPACANAAKIACNMMIAIAIEAMAEGVVLTESVGLDRADFFELILGTLFSGRAYESYSAQITERSFEPGFKAKLALKDMRLATEASSQIGRTLPMLEAVREKLAKAVSAGLGEKDWSIMADMTVRDIAIAIDLDRR

SEQ ID NO: 2370 - protein, 126 aa, Methylobacterium sp.
VTETIIPLRLKRDEASALAGFDVLAAELLAEGQAPNLSAARLDAILGKLREQQTQLAVILADLEDRVPSCDARIEAINADLCRFPREGLTQIDLYIQQAMSCRTKVEPTCITESGALPFAMGYQDH

SEQ ID NO: 2371 - protein, 655 aa, Methylobacterium sp.
MAKIVKANAWCNNEVGYLAWRTDGPIQDCLGFMITRIHSDLNGNEVERRILPAWVAFKSQSNPKGEEQDTSVWPVQKFSWRDLTLRRSRNETVLREGEFKARYEIVPVGLAGHGRMPVPSSPTAPYRDAHGEPRYNGDPIQLFFCGKPIETNEILVTNRFGAATVAFNNGILSTQNLRKQLQTPDGRAPGKKEVLDRMADPKDSLRRFLSGDAIKIFRRFFNRAVELDANIHLALYELHDDELIALIDKHCARISLILSTAGKSKDSKTWDTTNHDARDRLGKRLGKRLQNRMFNNSKHIGHNKFGVLVSRTGEPLAVLTGSTNWTSTGLCGQTNNAIFIEDGDLAAAYLEYWGRLHDDLLPEPDPLSAPNKVDQGAALREADAEPNRLSLDSVTVGAKASVWCSPNTEKVAVPRTNPATPPDIEEVFALMRSAKDALLFLSFYPAQQGRNSIIGEAVKIAQGKPELLVLGAISAPQAMPNYEAPMRDDDEDDQEDGEKVPAPSIYTLKQAPRVLMVRASAVRDLIGDFQRELLTAGTAIIHDKVVVIDPLSETDCVVITGSHNLGFKASYANDENMLIIRGAPALAAAYAVHVLDVQDHYRFRAVLEEQRRRRILSRSSTEPSSVGSGFLHVNDEWQTPYFDGRKGDELRYFAR

SEQ ID NO: 2372 - protein, 268 aa, Methylobacterium sp.
LDAGLPVRAVVRDADKGAAWKARGCTIAVVPDAADAEALTDAFAGAAGVFLMNPPNYDPAPDLSGSRRAAAAAAQAIGKALPGRVVLLSTVGAQATAFNLLNWAGIFETALVGTGRPVALLRAAWFMENAAWDMPAAREGRIASYLQPVDRAIEMVSTQDVGRTAADLLREDWTGTRIIELAGPRKYSPSDEAAGFAAALGRPVEAVAVERESWEARFRAEGMRHPEARIAMLDGFNEGWIDFAREGTERRTGTVAFETVLRHIVERD

SEQ ID NO: 2373 - protein, 270 aa, Methylobacterium sp.
VGVQQQVQAVVGTGLQVVPTPDWVTLGKSKEWADQWSRVVRNLFRNWSSTSDCDASRQESLGFMAGELLTSTVISGAGVVVPYFQPGNGLTQFGTCYRIVEADRLCNPNFGPDRDDLRRGVHIDPETGAPLGYWLCTRHPGDFYGQLARGVPRDWVYIPAFTSWGRRRLIHVFPRRRPEQTAGVSALATVAGDIRDVTESRRAELRHQAVTAGLSLIVNSELKPEQGRPHPLDEILHLTVEPRAVDGDAELHGRQLAQRPCTGPHMPPGR

SEQ ID NO: 2374 - protein, 134 aa, Methylobacterium sp.
VGQAAFPFLASRSHANHSGETMRMMLVSLRKPVIWRSSTVSRPRRAASRIAFFTVERHTPVTAAMFSIDNRQSFRRATSAATRERTACSVRVNRATIACGMRPEAAQRRRRSMLASVCRGREPTPGLLELLWRS

SEQ ID NO: 2375 - protein, 30 aa, Methylobacterium sp.
VGFDARGILRLLPDRGGRITLDTQAPRKPL

SEQ ID NO: 2376 - protein, 61 aa, Methylobacterium sp.
MSSVVRVTLSGILAGLVAASLAACASAPAAAPDLTPPPRRPVDAKTQLEYGNPPPPPPGRY

SEQ ID NO: 2377 - protein, 459 aa, Methylobacterium sp.
MSLQAALLLRVDRQAELPTPTHENPNPSFRKEALMVRRVVVTGLGIVSPLGCDLGTFWDRLVAGRSGIRRLPDDLVPDVEAKVGGTVPARSEDPAGFDEAAVVVAKDRKKMDRFILFALEAARQALEQADWRPASDDESGRTATVIGSGIGGFPAIADAVRTVDNRGARRLSPFVVPSFLANLAAGQVSIRHNLTGPIGAPVTACAAGVQAIGDAMRLIRAGEADVAVCGGAEACIDRVSLGGFAAARGLSTGYNDEPARASRPFDQDRDGFVMGEGAGMLVIEALEHAEARGAEPLAEILGYGTSADAFHMAASPPDGAGAQRAMRRALAMSGLPPDAIGYVNAHATSTQVGDASELAALRAIFGTRVGTGGPAISSTKSATGHLLGAAGGLEAVISILALRSGVLPPTLNLERPDAAAAGLDLIGPEARRSAVEHVLSNGFGFGGVNASLMFGAATR

SEQ ID NO: 2378 - protein, 504 aa, Methylobacterium sp.
MTSNTAGTLKRLTAGMVVPLGGDRAAVVDAELAERFRPGDHLLLLREHGELLLVPSVLKGEIDRMVERAHGAFRELGRQTDDAISAFFEAFAANLEDQTTWGAVAAANLEDCERARAASRSTTRLVATERARRDMIDGLRVWRDRAPMRGRTLERVVHAGLTIEQQGAPLGVVGFVFEGRPNVLADAVGVLRDGNTAVLRIGGDALGTARALMRYALHPALERAGLPTGSVVLIDRAEREAAWALFSNPNLSLAVARGSGAAAARLGSIARQTGIPASLHGTGGAWLVADVSADVQRFESAVRNSLDRKVCNTLNVCCIPKTRVDDLVPAFLDVLEDLGRELGHGCKLHVVDGDPRVVPSEWLDAEINIRRTDGHRREPRVGIVAQTELGREWEWDEAPEVTLKIVDDLEHAIRLFNSYSPRFVASLISRDPDAHRRFHDSVEAPFVGDGFTRWVDGQYALGRPELGLSNWETGRLLARSAILSGDSIYTVRSRAIQTDPDLHR

SEQ ID NO: 2379 - protein, 119 aa, Methylobacterium sp.
LGVPLVVPASGAAVLPAPADFAAAFETVALFADVALAAGVLADAVLGAALGAVAAVAPWSAVVLAGARLTGARRCGGLVASGRRGSAASSAASRSMGFCVDSIPIPVLARRGAFSILHP

SEQ ID NO: 2380 - protein, 566 aa, Methylobacterium sp.
MADHHMLTNPGTKYRPFVSPIDLTDRTWPSKRLVAAPRWLSTDLRDGNQALADPMDVARKLRFYDLLLDIGFKEIEVAFPSASQTDFDFVRMLIEGDRIPEDVTIQVLTQARADLIARTFASLDGARQAIVHLYNATAPLFRRVVFGMERHEIVALAVSGVTAMLEESLKRPDTLWIFEYSPETFCFTEPDFALEICERVLDVWQPTPEHPAILNLPTTVEVAMPNIYADQIEWFCRRISRRDAVIISVHPHNDRGTAVASAEQALLAGADRVEGCLFGNGERTGNVDIVTLALNLYTQGIDPKLSFPAIREVVKTVEHCNGLPVHPRHPYAGELVHTAFSGSHQDAIRKGFAAHARRNDGVWEMPYLPVDPADLGETYEAVIRVNSQSGKGGVAWVIEQDLGLKLPRALQIDLSRRVQIVADRTSRELSAADIAATFREAYHVDDTTIFALNDDGGGLRRHAGAERIFSGRIRHRGQDVSVSGRGNGLISALLAALNDAFGIALSVVDYSEHALRHGSDAQAAAYLECTRGDGGRVFGVGIDDDVATATVKAVLSAASGAASLAR

SEQ ID NO: 2381 - protein, 132 aa, Methylobacterium sp.
LPLAMTDAPDAKKALVVEDEMLFHLEVRDLLEAKGYAVVEAGNAAQALERLDGTVTLMITDVRMPGTMDGLALAREVIRRRSDVAVVVVSAQVTPRPEALPGHVPFVERPFIESRFHAAIDRAVSARTESRS

SEQ ID NO: 2382 - protein, 459 aa, Methylobacterium sp.
LTKRIVSVAAVLGVLCVGVTLPEGLDWPARAALLAFGGAAVFWTLTDLSGAYVAVAAALFLVAVRGVEQQALIDGLGSKVVWLVIGTFVLGAAVERSGLAGRLTALIAGRGTTVGGLMWRLTLGIVPLAFLIPSTSGRATVLLPLYRRLTEADEDERVAKAVGLLIPAVIVVSTVCSLTGAGSHLVAVDLLERLSGQTIGFGRWMLWGLPFGLAASLTTTFLVSRLFLDGETRARAIGEVDAPAGPLSPAEWRTGAVVAAMLGLWLTEGYHPFGIATVAVAGAVLLTMPGLGVLDWNEGVEAVNWSLVLFIAASLVLGRALISTGAAKWLITSALGASGVDGGSSPFLVMLGLLALGMTAHLYMVSHTARVAALLPPLLLLSHRLGLNPVAVAFLANVGMDYCLTLPVSSKALLVFQDGDRPTFAAQDLLRLSAFLAPAYAALFVFAYYALWSQTGLRL

SEQ ID NO: 2383 - protein, 107 aa, Methylobacterium sp.
MRETVTGCSVEHAMHLLGGRWRLLLVSYLIDGPKRFNELRRDMPGISQRMLTLDLRALEAAGLIKRTVYPTTPVKVDYALTEDGLRLKKVVAVVQEFGLWLKQRNAV

SEQ ID NO: 2384 - protein, 85 aa, Methylobacterium sp.
VASPDNLTPRSGNVFDVTPQSGDPRVNFANVGGRGSIQSNSLEDSNVDLGNELATMIASQTGYGANSKVFQTGTEMLETLVNLKR

SEQ ID NO: 2385 - protein, 254 aa, Methylobacterium sp.
MAMRNNPYQLSLFDAKGQAPAPPPAAIPPAPAEGREPLSLHVGDTFLKRVEGYQFGEASFWQSVADGAGDGFLQHDCYVLVRFHQDPDAKIYRRKVRAKDIERDLDWAIEVTLFHEAQSFFYLLTGNATPRRLSDRDLRDRVPPATIRAVEKPAALVRVKGGPAPEELAYVEAAIKDALPAGYPSYAEEILSIRKTNGMRIVRMRLFDGAIGVLRLSGRPGAHGYGWDVGEVDQRPFHYDEAAGAWVRVNEPEA

SEQ ID NO: 2386 - protein, 1105 aa, Methylobacterium sp.
VYAVVARPFAWYGPVRAILFFITAFAAGALLARITPFSNFGVIVDVAHEMSHGTYDRVSDRVFAFALASFVVQVAGALAITYLLLHVVLIRLALSAARRDLRRVGGPREFAERFDSVRANLERNALIGHAWGEFAETLVPEPRAVRNTMRPQTFINIGAARERLFGLKMMGAVPGYFVGLGLLLTFIGLVFALNKAAGSTAAGSAEEMTRSLSELLSAATFKFGTSIAGLGSSLALALFFKSYAISIEAGFDRLCRDLEDRLLFYPPQAIAAETKTILEAQRDQLKEINSERFFTRLGDTVAPGIESAMAAAVQPMTESLHAAVGQLTQTSQNGLDEMLRRFQDNLQGSAGAELKQLAETLAAMQGALEGVQRDLSGSGQDFSRQLSEAAGNLDRLVTQAGTNLGASADASRSLLEDVARELRAAFEMANRQVTENLAASTRGAAGLVEDAMGRVLERLETQTMAFGQSISALQATLADGVAGSARSAQTASESASHATQQAAEAAAAAMRGTVDALAASAAGSAAQAERLMEQMSARLDAQMTAMTAAVETLQRSLANQAEESARAAREAGLAATDSTTRAAEVAARAMEGTIGDVSASVRASAAQAEDAMTQMATRMDAQMRALVDVVGTLQRTVEAQAQESARTAQEASAAASQSATQSAEAATSAMRGTIDGVSASVLASAAQAEGVMNQVVVRMDAQMQALTELAASVRQSVEANAHDSARVAGEAGVAASRSAAQSAEVAARAMEGTVGEVSASVRASAAQAEGAIAQMAERMDVQMRALVDVVGTLRQTVEAQAHDSARAIAESSAAASRSATQSAEAAAQVVAGTVGDISRSVSSAAAEAERSLGQVAAQLGSQLASFNDTVAALQRSAAASAEDAARAAREAGAAAAASASQAAREAAEAMRVTMNAIVAEMRGSVDALSGTLRAVETAFSGQIRQVDGVAARSRETADAFSQASRAIQGASQPLLQTSERIAGAAETMAGSVHVSADALRAGQGAAIALAERLERHLERAGQSLEAYEQRFAHVDAELGQAVGRFAEQVRQQQDRVADFVTEIDRHLSATTDKLARMVDDLSSSNEELGAALSTLARPIRLAAAE

SEQ ID NO: 2387 - protein, 798 aa, Methylobacterium sp.
MAKRVCTDLEFLSDPPRTLRSHIVYAYDPRSKLMRNDLEARAKFLLEAQTGKTLTSWRLRSKSLAQEVQQPTLLGPRLILCDAEALGLGKDADDELMVLSAGRSENVESHAFVSIPMGRSVIARLKQDETANTTIVEETTITDVTLRPALVFFMARSSLYDFSLLCNRQEFLASFDDFIHARPRPLVDLLRRFEDATLTGINVESNRFDTARHAGRRIAKSGALSLAARVSSFLHAPADRWAILGLVRELDRRQNQLGVRPAVLVTQIYRATAGLIAGKGGRLPPDLAIYWAVLLLGWEERLDSGPFPVIFDGLWRALRSGAARLDAARELDGCWGAIAERVAITVPEPVGRRDQARAQLIETIERHPALQNPAPDAPWLRRLHAILADPRRGSTATWLGEDGAASSRPRGVLAESPPKRPPAATLPRWASSEPERFDAFLGNDAAVQALTARVASGDTNRHVVFHGPAGTGKSAVAKLYARALRCERVSPSGSACGVCHTCKISAADQDFELRTVDLSRATASAERIINAFAKLDDSTRFSSTDARPRVIVVKHAELATPVAADRILKTMERPRQAVFVFTTADFGRLRFAIRSRCDVYAIKPLRPSQARARALELCRLAGLRFEPAALAVVAAAASHKAGTLATHLARIAQEGDVTFDRTRAALGLTWTDAGLAFWEAALSPDLSNHGASFERPSVEALGGAPEAIARMQAIAHMLEVLASGTKPVADTAVHPALLHLPREAWAHLPERLNACARRRGVDPDALWGDILRFWAACDAREPIGFSSALRTFEEMVTG

SEQ ID NO: 2388 - protein, 166 aa, Methylobacterium sp.
MNEIRFYRASDKPYGPFSNLYRRSIEFEGEEFATSEHAYQAGKARKPAVRRWLMEAPSPALLAMAAHGLYYWDVAPGWSTSKFDRMRAVLRAKFTQHTDLRDLLLSTGDARLVESATVDNEVNRLWGEVNGVGRNMLGVMLMELRDELRFENGEEAAETQFTVAAE

SEQ ID NO: 2389 - protein, 70 aa, Methylobacterium sp.
MSLSRFVSELAALDARETRARYAAVLKAAKARAGTGRWADERLQIHVATAEASVLMSVRFAIASIEQSMA

SEQ ID NO: 2390 - protein, 45 aa, Methylobacterium sp.
MRAAGYPDVRVVFKDGAVIVEPALKDDSTHQGPVPPADQEEFDIL

SEQ ID NO: 2391 - protein, 70 aa, Methylobacterium sp.
MRIERTGARPRKDARGRVLASLNDELATATQIAGRAGIPGRERRREAARVLCRLEADGLAIREIDRQVPR

SEQ ID NO: 2392 - protein, 48 aa, Methylobacterium sp.
LSGQHSSDLEQRGINQLAQDWRANLVHQRSNSDQSVYDTIDGVHLLIG

SEQ ID NO: 2393 - protein, 181 aa, Methylobacterium sp.
MEAWPEIELDLDFTDRLVDVIDEGFDAVIRTGEARDSRLMTRVLGSYDLKLVGAPAYFAAHGIPESPGDLAGHRCLRHRFPTTGRLEDWLPDPGDPIELRTAATSNTIEPLVCLAERGLGIACLPDFAVRAQIEAGTLMSVLDGAVHRCGTFRILWPSSRQLAPKIRVFVDFMAENLFAPP

SEQ ID NO: 2394 - protein, 83 aa, Methylobacterium sp.
VHAAVLEEARRAGLLDGEKSEHVSFRVPPALVDAAKREAGITSTAELGMVALALLAQSDPVADFLGRTAGRLGPDHDLDTGSR

SEQ ID NO: 2395 - protein, 187 aa, Methylobacterium sp.
VDLRGALRRRKPDKRSARLVPRPRHELADWAAYGESAPVALVLDTGVYIHSAAGRMPKALQQLIERALLFHCVVALAELSVGIAAADPRRPNWAALRDHYAELFAQIPHTRLLTPDAQTFADAGLVAGTLARLQGYQSHQRTACLADALIFLTAARAGLPVLTANREDFDLIQQLAPEGRFLAYERE

SEQ ID NO: 2396 - protein, 46 aa, Methylobacterium sp.
MPQPEPISTTIATAFVQCMIRTGHGCKRRLDLIAFIFMIAGALRVF

SEQ ID NO: 2397 - protein, 40 aa, Methylobacterium sp.
MSDGFLSAAIITPLMLAATAGFVDWFTSRQDRRDASEHER

SEQ ID NO: 2398 - protein, 278 aa, Methylobacterium sp.
MIKKLLLASAATALLTGAASAADLPRRAAPPPVFTPVPVFTWTGAYFGINAGYAFDASSRSNNSTFGVPFPYAAPGTTATFSNRSQDGFSGGAQVGYNVQFTPGSGVVVGIEADAQYLDFGRGRNNAFVSGAVAPGYYVTDPRGLSSLDYFGTVRGRLGYAFDRTLVYGTGGFAYGSGSADRSFGGYAGNDSFRTGYAVGGGIEYALPTDSFLNFFRSSAVTLKVEGLYVNLDRNTRNQGALVVNAANNFPVAYSNVGRRDDEFAVVRAGLNYKFGSY

SEQ ID NO: 2399 - protein, 278 aa, Methylobacterium sp.
MIKKLLLASAATALLTGAASAADLPRRAAPPPVFTPVPVFTWTGAYFGINAGYAFDASSRSNNSTFGVPFPYAAPGTTATFSNRSQDGFSGGAQVGYNVQFTPGSGVVVGIEADAQYLDFGRGRNNAFVSGAVAPGYYVTDPRGLSSLDYFGTVRGRLGYAFDRTLVYGTGGFAYGSGSADRSFGGYAGNDSFRTGYAVGGGIEYALPTDSFLNFFRSSAVTLKVEGLYVNLERGTRNQGALVVNAANNFPVAYSNVGRRDDEFAVVRAGLNYKFGSY

SEQ ID NO: 2400 - protein, 292 aa, Methylobacterium sp.
MMRTSSCRDKPEAKMVQTWFITGVNSGFGREMAVQLLGRGERVAGTTRRPDDIADLKAKYGTSFWTAQLDLTDTAAVVDVVNRAFHDLGRIDVVVNNAGYGQFGAVEGLSDEQIARQIDTNLIGPIHVVRAALPHLRRQGGGRLIAMSSYGGQATHPGASLYHASKWGLEGFFDSLAAEVAPLGIGVTIIEPGAARTAFRKTAGTLLGVDVDAYRNTSIGAMRAMLSDPGAVAKGDPGKIVQIMIDSVDLYPAPKRIALGGDAYTMIKRALVERLAALEAQKDAAFSTDVAR

SEQ ID NO: 2401 - protein, 292 aa, Methylobacterium sp.
MMRTSSCRDKPEAKMVRTWFITGVNSGFGREMAEQLLGRGERVAGTMRRPDDIADLKAKYGTNFWTAQLDLTDTAAVADVVNRAFHDLGRIDVVVNNAGYGQFGPVEGLSDEQIARQIDTNLIGPIHVVRAALPHLRRQGGGRLIAMSSYGGQATHPGASLYHASKWGLEGFFDSVAAEVAPLGIGVTIVEPGAARTAFRTTAGTLLGADVDAYRNTSIGAMRAMLSNPGAVAKGDPGKMVQIIIDSVEMDPGPRRIALGGDAYTMIKRALVERLAALEAQKDAAFATDVAR

SEQ ID NO: 2402 - protein, 168 aa, Methylobacterium sp.
MDRNGQTYKGRRKLDAETRLDAIDFVNRVNFYFDRWETENLLAAFDDDVIVDHPLGRSVGKDELRKFLVDYEPITLGVRRHNCNHVVDGLDNGEVQIAYYILLIRIAPSAKAGDLKTKPMEIMHYDEHLPKLISYAMVTDVLTRSDTVDWRVRHKRVENVSEDRVFHF

SEQ ID NO: 2403 - protein, 180 aa, Methylobacterium sp.
MSFFPKIKPAAEISPDIRAAAVDYVNRVNWLFETWDLEAMVDAFLPDARVFHFHGSLDGEKQIRTFLTETYPYLVPGVSRHASNHIVDIEESGLVAVRYQNLLVRHAEPEAAATLGAGQVIETRELPALWLYSPMLDRLKATESGWKIAERHIGGSATNVRYTPADTSRAAMEPFLPKIS

SEQ ID NO: 2404 - protein, 134 aa, Methylobacterium sp.
VVEAPQRAFRDIAMDGTVLCFVEELGWDDLLPHAGGEEMQKRDGVGRYCFACGLDRAPVRCAIEQGAWIMTGDRAHRQEVDDPVERICIGFERAGTIIQQRVEQPEQKVEALCAEFGGPGPRGLQQAIEAGGHV

SEQ ID NO: 2405 - protein, 134 aa, Methylobacterium sp.
VVEAPQRAFRDIAMDGTVLCFVEELGWDDLLPHAGGEEMQKRDGVGRYCFACGLDRAPVRCAIEQGAWIMTGDRAHRQEVDDPVERICIGFERAGTIIQQWVEQPEQKVEALCAEFGGPGPRGLQQAIEAGGHV

SEQ ID NO: 2406 - protein, 910 aa, Methylobacterium sp.
MDATTPEGGSGNRPTIDAGAPAPKVAVPAQPPTSSLPQWETEAAVAFLIALIGSGLIAVAAIHPEAGGCHGATFALPVQREALSQWIEARQGKYNLYYTLNEPVPPEKQQGKNGRVCKADIVRIRGVAIDCDPQFDPEAADGGLAKERLRLFAQAVEWRKRDAVSAAIDSGGGYQGMWLLREPLPATPANVAAAEAQARGLAHLNDGDNTHDVSHLFRLPGTVNLPNAKKQACKRVPAAVQGKVFDDPRRLHTLEDLAILAPPIATRQAAKARREFELSAAWEARGKPEKLPPELITRLTAARTTQPQLDKCLKEDTVQGDRSKRDFAVAAAVIRAGFLEPPEIAAIVAAYSPEKFEAEAEARGGGRAEYYLRRTVANALAQVKPDAPSPGRTKPAAQPSDFFEMIEDITAEPAEAIGEPVDLFGEDDPADLSTPPPNSLPDVVEAFARTIAVQMGVPQSFSAVTTVAALAGAIGNALRLQVNQHSTDFRVPASLAMVLVARPGRKKSPTIDAVLAPHRALDRELHRASGQARSAWRAAHCTPKGSPKVGAPPPPPERQILVDDATLEKQVRIHADNPAGIIRAPDELLAFLGSMGAYKRSSEGDRGTILKMLDGSAVKMDRVSGTVRADSALMGLIASTQPDKIRTLTRDLGSDGFLQRLIFITDDGLDRLPRDVPVDRGAVAEYERAVRAMFTLRSSSCGLVQLSPEARAILSQTWSRVRALGRLPGASEAWAGHISKWEGMTYRIALTFHALDSWACTGGVPTGPGTDVTAATARRASRFITFLVRHALRFYGEFYEPSEHTAEAREVAGYLLTRPDILSVTARDIEKVRRPLAGKRSLTQAAMRELEHLGWITVAERGAEGPSRWTVNPRIHERFAAHAAREKLQRAQAQAQIAAALSAKQGLRDV

SEQ ID NO: 2407 - protein, 224 aa, Methylobacterium sp.
MSFESSALYYRMINEAVRKRLGGWRSADLLMHSVDFQPVVDMQREGRWDDAGRHLAEAARGLEAAGAECIVVCTVTMHLVAPAIEAAVGVPFLHVIDVTAERLKAAGRRRPLLLATRYTMEQGFYQARMARHGIEVVTPDPDRRRLAHDIIFDELCAGKVLDRSRDALVDLVARAKAEGADSLILGCTEVGMILDPDGTPLPGFDSTAIHAAAAVDFALGGHVA

SEQ ID NO: 2408 - protein, 115 aa, Methylobacterium sp.
MSLILGALLACAAGLAGIVLCPDDSTRRSRLPLLATFLLGGLAWHAPARAAEPLRGPARVLDGGTVMVGPHRVSLYGIAAPNADQTCSDAQNRPYPCGLAVRDRAEPACAAADRA

SEQ ID NO: 2409 - protein, 57 aa, Methylobacterium sp.
MTDRAALDVVIVNWNGGALLRACLASLASVREAASVQVIVVDNASQDGSADDLPALP

SEQ ID NO: 2410 - protein, 59 aa, Methylobacterium sp.
VVGVPELSFVATQVNNRAMVYPAEIFLFVGAVYGCLCLLVDRLAALLARQRRRPRAGRA

SEQ ID NO: 2411 - protein, 44 aa, Methylobacterium sp.
LPTIATPRRAAPRSLFRSGIGPRLALAVVLSTLVWLVIAWALAA

SEQ ID NO: 2412 - protein, 139 aa, Methylobacterium sp.
MGRSVGDQCVALGSEQRDEAARHVVRRSTLRADQHRLDGQAWFERPQHDRQMRERACRNRIDDGKPETFRHKTAAGRRVLSHERKARRDPGSCQKTLEFALKSARRPRYQCLAGKILDRDHRPARQRMMPGERADGIDR

SEQ ID NO: 2413 - protein, 130 aa, Methylobacterium sp.
MYRHASARKLGTQAPDSPRKQRRRERRLARDTKRAGPDIANLARDVAQMFKSRIGSLDLASESLALTGGRRASVTSDEEIEPDIGLELRDCATDMGLPDTECGRRLRHSAMTQDGAEKVEMTGVHHAPYA

SEQ ID NO: 2414 - protein, 46 aa, Methylobacterium sp.
VLENAEAPRSRIGRRTGWNGLAKLLVESITHPAYLDWRIRPGTAPR

SEQ ID NO: 2415 - protein, 69 aa, Methylobacterium sp.
MSTDTEKHRALLGALKDAQGKGDGSFETAAVAAFEHVFEHLGRLNDHVAQGGPDGEERRLKDGESATLR

SEQ ID NO: 2416 - protein, 161 aa, Methylobacterium sp.
MCGAKARSTGEPCRQTPAKGRNRCRFHGGATPHGDGPAGWHTPGFPDGLPTGKPRSDAHKARKRRQRRAEIAAMTADELARLEAWRRMNKPGSGRDRAHGRHAREARRWLEAIMHEAPAAPTPDRIELDALRARLRAHLAQLDAEMAEPVEDEPLVGGLFD

SEQ ID NO: 2417 - protein, 335 aa, Methylobacterium sp.
MAGTEAKVPVTVLTGFLGSGKTTLLNQLLAQGEAEGTAVIVNEFGEVGIDGQLVVGADEDVIELNNGCICCTVRADLVSTIGRLLERPKPVSRILIETTGLADPAPVIQSFMLDEHLRARTELDALVTVVDARHNPLWLAMGEETEAAGGENVAREQIAFADLLLLNKTDLVDEAALEACETELRRINPLARIRRMRDGSVPAAEVLGIGAFDLKNALAIEPELLSDVDHEHDDAIASVAMRSEGDLDPTTFFKWLNGFVQAKGADILRIKGIVAFVGEARRYVFHGVHMTLDGRPGRPWRPGEPRRGEIVFIGRNLDAQEIERGLARSRAAEAA

SEQ ID NO: 2418 - protein, 244 aa, Methylobacterium sp.
MKLQHTLGGLEGLDPVQPELRVFVEPWEERIFGIHTAMMALSPPLNLPQTSSTFRTVWTWADLRKGAEAMNPFDYFKYRYYEKWLGGISGYFVANGYITQAELDARTDEYLADPAKPLPSGGTPEVDDRIHKYLMDGDSPWHRWADKPRFAVGDEVLVADPPTVEHTRLPGYLRNKVGVVETVYDDAFSYLCSTGPDGIGPAMPVYCVKFDPQHLWPGNAEPGFFIYADLFDAYVRPVQDRAAA

SEQ ID NO: 2419 - protein, 207 aa, Methylobacterium sp.
MTDRFAYPQDREARNAARVRALEALLIEKGVITDQTVDKVMQTFATEMGPFNGAKLVARAWTDDAFKALLVTDTMAAVAQLGLPTGAAGAEGEHMRAVANTPQVHNLIICTLCSCYPWPVLGLPPYWYKDPSFRARAAREPRAVLKEFGLDVEPAKEIRTWDSSAQIRWFVVPERPDGTQGMSEDDLAKLVTPEAMMGVAVALPKAA

SEQ ID NO: 2420 - protein, 106 aa, Methylobacterium sp.
VQTSFEHFAVASMMGQPDTPPRANGSLCFHQPWERQAFGLAVALARDGHFEWEDFRQALIAEIAAWEATHSRDDPGWDYYECWLAALERVTQEHVAPGRAVEEPAP

SEQ ID NO: 2421 - protein, 209 aa, Methylobacterium sp.
LEYEATVLASVCGAVRLGRHEELRSLLARRDLGEDAVSALRFREADLEYGVILPTERTWNLPRLQGPTFDVGFEMSAAGHRILVVPPADVRLQPRLGNAQHVFHAKKAPACGDLDVLIRRIETQGGEAPLDACVAALDSPGARERIFGLVFGGHLSLDLASTITNMSIVRLGSRCRMSSWDKLGWHILRTDRAPASTSPDAAELEIGSA

SEQ ID NO: 2422 - protein, 38 aa, Methylobacterium sp.
VDSICSDGVTGNAGLSFLLGTEPVIAQDTTVGFIRSLI

SEQ ID NO: 2423 - protein, 205 aa, Methylobacterium sp.
MIVQFSTGGRGRDPSERSSALYLGPDMASLSTGSVNFPTVVYQNPTSLVDDLAGKMRDYGIRPEIEIFDLSHLHGARRLIEKGLMDDRPHVQFVMGVQNAMPADEHLLDLLLAELRRVLPHATWTAAGIGRAQATVMEWALARGADGVRTGLEDNIRVTRDRLARSNAELVQLAADAITRHGGRVATPQEARQVLGLRPAAEAVH

SEQ ID NO: 2424 - protein, 91 aa, Methylobacterium sp.
MSAAIAHQIEREDGRVRLTVHRHEIGFFFYTEDSFEAWDDTPAVWREAYPPSGLFATAEEAMAEARAIIPWLQAASTKGHAPPQPKSSDDD

SEQ ID NO: 2425 - protein, 89 aa, Methylobacterium sp.
MSGDDAALAQMVDSLRAHLPKAGLDQGEMQQVGARLPASLVRQAKRRTGLSSNTDLLIVALANLALEDAFADAFEAAHGQLDPELDIGF

SEQ ID NO: 2426 - protein, 43 aa, Methylobacterium sp.
MKILVVSAHPDPASLTNALRGVAVEQLKADGHEVRVTDLYAAG

SEQ ID NO: 2427 - protein, 225 aa, Methylobacterium sp.
MSLETRSDRRAAPLSKAQIVEAAIGILDQEGEDALTFRALAKRLATGSGALYHHVSSKDDLLAAATDDLIAHVARRAAAEATPDERLRALAGGVFDTLELHPWIGSALSRNPWQYAVVRLIESIGQQIQALGVPGPAQFNAATAVMSFILGLASQHASRARLFPREADQTALREAALEAIAARWMTLDPSEHPFVRQVAEILPKHDDREQFLGGVDIIVRGLQCL

SEQ ID NO: 2428 - protein, 211 aa, Methylobacterium sp.
MITLYTWSTPNGRKIPIMLEECGLPYTVVPVNIGKDEQFAPDFLKVSPNNKIPAIVDDEAEGGPLSVFESGAILTYLAEKTGRFLAPSGASRYKALEWLHWQMGGLGPMLGQLGFFAVRSDEKAPLAIKRFTDEADRLLHVMDRRLSEGPYLAGADYSIADIACYAWTLAATSFLKEPLKDTLGGIPNVHAWLARVGERPAVRRGMEVPKT

SEQ ID NO: 2429 - protein, 275 aa, Methylobacterium sp.
MSSPKRKHVVFVGNCNASDLASFFSEINSLKDDFAFHPLALHITPTPSPELQAIVDTAHAVFIQGIAEAERYERESVPPGVARFGYPNLLRRAFWPFDGLIYGRDRLAEADAVKGGLVRFSDGLLAKLREDIPDPEERFAVYRDLDVRGLVKNFSRFLEMEDETLGFLDTTYRCHLGAFVRENTKTRQLFHWLGHPSGILYRELMAYCCEKLGVAPELPDPAALDGWGTMQVPVHPAVADQLGLEWARPGRRYHYVPMGHVTWEDFTRTYIRHLG

SEQ ID NO: 2430 - protein, 449 aa, Methylobacterium sp.
LDSLATRRFTAGDQCAFAAMSGDRNPMHMDAKAARRTQAGRPVVHGVHAVLWAIDAAGDLLTGAEALAVQFDRMIYVGDLCRLRRGRHGAEGARIEIVLDDAVVTRISLQPRSDRSPPPPGAAEQTLVLEPRAGDIAAAFPRASAALGIAFLVELVGLSKLVGMICPGLHSIFRGFSVIRTAGPVGTAMRFSVLRDDDRFNLVTIRVTGTALTGQVDAFRRSPPTAQPSIDALRGSVEAGAFAGRRALVVGGSRGLGELTAKLLALGGAEVTITYAVGDSEAGRVADEIRAGGGLCDILRLDVRQPPIAGQLPTGKAFDQLYYFATPFIFGKRGRELDATLLGEMMAFYVHAFYEICTCLRGGGAHDIDVFYPSSVAVAQRPAGLTEYAMAKAAGEVLCADLPRLLKGVRAHVRRLPRLQTDQTATVQPVEIGSAVDEMLAAIRSVQPR

SEQ ID NO: 2431 - protein, 299 aa, Methylobacterium sp.
VKESSKTGHKRVLDVLRRAALTANHHGIGFMAAGVAFWSALALFPAVALLVWLAHHLLGVADVRNTLLTVTHVMPDSVGDIVARAIQAASDANPADRGTDLGWPVGPAFGLLVSLWSVTVAMQALFHALDRTFETENRRSWVRLTAVSLAFTLGALIVMACALAATVALSQVLASLDGALPGIILRWGTVFVTSLLTVAVLYRVGPSGRREGWPFVTVGCVAAAIILVADCSLFTWTVGHFATLEITYGSLSTVAAFLLWLWVSVAIVLSGAELDMAIHRVMDCYGGRSVGGRMRLTVR

SEQ ID NO: 2432 - protein, 303 aa, Methylobacterium sp.
MEAARTEGLPARLAAQILDWAQSQGLSTGAHLREQTLADTFKVSRTPVRLALNLLRDANAVEQRPNRGFFLREPTGVLPQGAEGRGPVVDDPVYLRIAEDRLAGTLAERVTEVELQRRYAVTSARLRRILARMTDEGWIDRLPGRGWIFQPVLTSTAAYEQAYRYRLLIEPAALLEPGYVVDAEAFARVRSQQLAMLDGGIERFPDSETFRIGAEFHETLVACSGNVFMLEGLRRVNRLRRLMDYRAHRDRRRLPHECRDHLTMLDMIEDGRMGQASDLLRVHLAKVSVLKARLVDVVDFQES

SEQ ID NO: 2433 - protein, 94 aa, Methylobacterium sp.
VFSSWAQRVSVDAMRMSATKKSSWPMFQVSPCTTATCEPSTEAPWASRPDADPTKEDMTTARRDGRGIETDIGSTLGFEDVTSCQASPAAPNEA

SEQ ID NO: 2434 - protein, 35 aa, Methylobacterium sp.
MSARSLEASFEASAALRHLRMRGLDRMQVSRSAAP

SEQ ID NO: 2435 - protein, 258 aa, Methylobacterium sp.
LTVIVGALCSDGIVIGADSMSTSGNGRNPLIQVRSDDKIRIIDDKVIVVGTGSIGLAQRFEAIVEQSWRGEVFERGCHECGASIAAHARQEFTSSGVHFSSSAGLDFGAMVAAPIHDAPELVEFNTFDLQPERKTRRRHWVAMGAGQTLADPFLAFVSRVLWDGREPTVAAATVGLCWAIEHAIHYAPGGVGPPVRLAVLRREAGEWRATLLEDDALQEPRQHIAEIEKRIGFYAADGLAIAPPPPPPAPVTETHEHG

SEQ ID NO: 2436 - protein, 147 aa, Methylobacterium sp.
MTRRDLLLSILAAANGQPYEPVQVQKATFLVLTNLPWLLDEGPAFAFEPYDYGPFDRAVYAEAEQLARDGLAVVRPSASGRWKTYAASEMGVARGREVLNGLAPQFARYIDDIARWVRAQEFGNLVRSIYVAYPSMRANSVFVDHGH

SEQ ID NO: 2437 - protein, 157 aa, Methylobacterium sp.
VPAVRTIEDADTVSRHVYAPRMLGAADEFVWHEIFQFPSDRGMAESVAVRNVVPADADVHRLGCEKQDKDRERERAKGRTGPTYRGCTDALAGGIRRQSSTRGHGFSVTHEPAEGDWHGHVTVLLAAGCSKLSKSDKDDVRELMAGVFGPLKPHACP

SEQ ID NO: 2438 - protein, 149 aa, Methylobacterium sp.
MNFARASFADAMPVMSTGTPFELYSDLDLTADGASERQRRAHLLDAIRQLPAYADALGYPKVKPMTVRLAQDFVLRLPHNRALPKVAVDDEGDILMRWSGPTGRCALTFEGSVLHMTVNPGATSQHVEPTIYNGGHIPPGLLLHIPTRG

SEQ ID NO: 2439 - protein, 258 aa, Methylobacterium sp.
VVCGVYFQSLDDLQVAHVGALWERLRRDFPRTETLPPLPPAIVANGLADFQIQFQFGPIEASPFPRVWFVSADDATLVQLQRDRLIINWRRRAEDSPYPSYDAIVARLRNVLGLLVGFLEEQSLRTPDLVGVELAYVNALQFGRDLDGPADIGSVVPFLAWRPPAGSLDRLALSGLSWNAQLDLADGEGNLHIGLNTTQRPSDGQGLVRLDLLARKFSPALQTHAIWNWFDLAHASIVTTFSDITSRDVQNKVWERHT

SEQ ID NO: 2440 - protein, 67 aa, Methylobacterium sp.
MNMPEDMTSAHKGAFNLKEFLAWSGIGRTKALEEIAARKLQAVKVGRRLLIPVDAAKAWLADQPAAR

SEQ ID NO: 2441 - protein, 372 aa, Methylobacterium sp.
MINALALNLIADVMNWDTEEATREYAWLRLMSAVKYDGYSDFRAGVRFLESLSTWLRQFTPADRPAAYDFVKTRLVYLSQAEMQRIIEVFIPETVTPHLRKAAAAEVGIRAWEVWGSADGVAAFNRLLRRSLFVGLSDGSRIDILRRANSPRLVQDQFVPMLDIGDEKWLDLGKELSKAQGEDARFDNVYLIDDFTASGTTFIRQVDGVWKGKLNKFNELVLKARVSLGDRFPVADKYVLHIHHYISTDQARRNLEERIDDAKSNLSNRSFNEVTITEGLRLPASLKMTGGTDAAMLDLCERYYDDHLYQRLKKHCDEAGQSDMKRGYANCALPIVLEHNAPNNAIPLLWAETSGRQGHAMRPLFRRRDRHG

SEQ ID NO: 2442 - protein, 370 aa, Methylobacterium sp.
MSRAHWSNCITHFDDEVRSFVRDYFADEGRRCLLVAAAGFDPRSQVIARMLAGTLGNRLSALFIREERGRPDANLVADADANEAALAAIVPNCRVERVDIFGDDGAAVGGSNVAAMLSKVGIDPTTTDVVLDMSALSIGIGFPVAKLLLGDCEAAGGRAFHILIVSNPELDDRISSEPSERAMPVKGFSGLGGLSQTLDQARIWIPQLVKGRKAALTNISLSVGECYKICPVLPFPARDPRRADALIGEYENEIVNEWQVDPRDIVYVSERNPLDSYRIISTLKERYDQTVEGTYEPLVILSPIGSKVMAAGALMAALEHDLAVQYIETARYEFDGSDPRNDDPPEMIVHVLLSGPAYGDYGAIASADSE

SEQ ID NO: 2443 - protein, 646 aa, Methylobacterium sp.
MMPIFTEKLDALDGTVRLLETFDVASIAGGLADGRGHYSIAVGSGGSAIAARFFARCRESLGLGPTSVETPMEVVLGTHDISGTDIWLFSAGAENADVAAAATAAFQRRCRRLHIMTRGPSGAAAVAVANSGGRIHSVPVTTDQDGYLATHSMIATIGALLLASDAVGHEARGHAKLVQELFGRLRKVRDPARRSATAERFASLGHRDTVMLLADPQLRPVTTLLETSIWEASICTVQSTDFRNFAHGRHGWLHHRADETLVLALTGLETQEVWARIGAALPPTIRTIALDLGDSGRLSNALGIIDGLGIIEAMGQAVGIDPAKPGYGEFGPVVYNDRSLEAVTSGLPPSIRHKRAAMARSDERGSSPDPLPVQARARLDRLASATIGGLVFDYDGTLVATADRYSPPRPEIVEQLIRLDAAGVRLGVATGRGNSAGKDLRAVLPPEMHSRILMGYYNGGHLALLNVDIKKEPPTEDPAISETVEWLRSHGELFVSAEYEVSPLQIMINAELLHQPYRFRRDMAECPAVISGRVRVTGSGHSFDIVPAAATKLRVVEAVRQVIPRETEVLCFGDSGSLIGNDHALLTHSYGISVGEVCGAPNGCWSLFGDHPTGPDALLNALRALVSSQSVGEIRLDVSSMALDRP

SEQ ID NO: 2444 - protein, 299 aa, Methylobacterium sp.
VAGTGFTVLDRIYTNGCLADESLGGSCGNVLLSLAMLNRQVAPVLVLGDDVEGDQLVGEFISAGALTHYIHLRTDLRSPILAQELDTASGLHDFSFVCPETSADLPRYQPIGETELESALPVLARCSVFYADRLSKSILKAMKTAWSAGAIIFFEPSDIDDEAMFGEAMGMVSVLKYSADRLGNLLSDGSSQCVRIVTHGAAGLEVRHGEGTHWCRAVNAPVVLDTCGSGDMVSVGIIDWMISKRIEPDRLDAADLIGGIVAGQRLAAENCAYAGARGLFRMRGAGYVRRMLGGDSSTP

SEQ ID NO: 2445 - protein, 81 aa, Methylobacterium sp.
MRRLLLAGAVLSSLCCVPAFAFPGGSYAASCRRIHMEGPYLTALCGDGYGGARWSRIFARECGGTGVSNQHGHLVCGGYYR

SEQ ID NO: 2446 - protein, 68 aa, Methylobacterium sp.
MVSWPDGMAISGGRTEWSVPAIRRLDPEQEGGSLFGAPGPDMILADPHRPGRRRARAERSAWTRQDRA

SEQ ID NO: 2447 - protein, 56 aa, Methylobacterium sp.
MAIFEVTKVDDVISTARPTRMSGPRPPLPLVVASVLSAAAIWVPIYNLAGRVIWFW

SEQ ID NO: 2448 - protein, 40 aa, Methylobacterium sp.
MMAEERDDEAGGYRLLIVKAEGGAAVDAALGLIKAALGKA

SEQ ID NO: 2449 - protein, 122 aa, Methylobacterium sp.
MPAWRIEGEVTMLPTPTAATMLRTNRLILRSALDRAAGDARLLAEGVLYVSDLEARVAAGDLDAEAAVADASRVARALTQMGTHRERRRAPRPPEPTPVQIRREDCVVRDPGGPWRPVTDTQ

SEQ ID NO: 2450 - protein, 75 aa, Methylobacterium sp.
MTCIAILLETPQGIRFLVAATPREAALKAESVIATIPQTQLPVPAWVAGASSGTADRLMNYLADVQMERVLEGAL

SEQ ID NO: 2451 - protein, 355 aa, Methylobacterium sp.
LAFLKKSIGGNVVVIFGFSLPLLLGAGGLAIDYGNAVRVRAVESSIADATALLVANADTVAAATEGLRLANAQLTSRLGLGNTSSGFQVNGTWVDGSNYRVTITTTLKTSLLHLLPGMPRQIMVSTATTVNRVAPVYQTAPPTVSQLSPEAADYNRIYMYCYSSDPKRQAEADKGRRGMVAVADNGSPPTDYSKNTMPVCGANEAPSYMLRNVRNARDTRSAWDEKNQEIYQYYTDTTIDTGLRIQSMSMKGYRVYANGSLNSLDMNANPILETIVCDNSNQCKNKSSGGILPNSHTTHNPATATTSCSDGKYMYYGWEDRPPNAGSDRDYDDIRVIVSCPTLVKVSDKKLRIVE

SEQ ID NO: 2452 - protein, 55 aa, Methylobacterium sp.
MALRLEKAFGFKMEAMMEMQKQFDIAKVRKREMARQSQLHAQTNASEKGRLRAFG

SEQ ID NO: 2453 - protein, 67 aa, Methylobacterium sp.
VAARSATLEGALQRPTRSLGGSFEAERSAIARHLRMRGMGGIGRLLECYLDGGDLNFQAPRVTAWAA

SEQ ID NO: 2454 - protein, 145 aa, Methylobacterium sp.
MNVVDANIIKSGLLSRNGASNVVLLGMLEGTIPFAASTAIILEYEDVLMREGERSVLPLLGSDGVATILDALCRMCRRTSIFYRFRPFLADPKDDLYIERALASQSDTIITFDGHFRHCDLRAFGLRKAIPKDILTEMGLARTPS

SEQ ID NO: 2455 - protein, 27 aa, Methylobacterium sp.
MTEISRRSMIAAAGGAMMASPALAQTA

SEQ ID NO: 2456 - protein, 74 aa, Methylobacterium sp.
MEDFSTEDAVIQWILSPFKDETERGRLKAYLDTLTQDDVSDEELRKLWWSSEADIVFYDGAELRAFLKRVRDRL

SEQ ID NO: 2457 - protein, 45 aa, Methylobacterium sp.
VLAMAGVVSTGAGFEQLCTRIPGRDFSAAQLWWRVVSQAEARTVS

SEQ ID NO: 2458 - protein, 296 aa, Methylobacterium sp.
MLYDTSLSEDAKFIYPFTDPEHLGHHDLAETILRSDARKLAELSSKIRSTDKACVLSSEEFCYLPPSALKTFGDYLQPADVSIVYYVRDFLTSLHPWWQEQVKHGGTQTFLEFALGCLAQPHSLHLLIPDVMLTNWASAFGLDNIKIFRYDAIPDVARQFADDMLNLALPLDSFTAVNKSYTYIETEMVRFWNRLGVRGEDLIQSPNVGGLSADIVTESRDFIQNFSLSYAMPSFAAIEEILLTRWRDRIGGSFGQYLFETRERTYAYVHPDFWVVRSDLAERMRAFASGWPPKSR

SEQ ID NO: 2459 - protein, 46 aa, Methylobacterium sp.
SPERDGIRVSLGMFNTPADIDRLIEAIRARNVRSTPARAAVLSNPG

SEQ ID NO: 2460 - protein, 39 aa, Methylobacterium sp.
RDLVYVSNAPFTEVSKVLTAFSGVTGPLSSAATAYAYAK

SEQ ID NO: 2461 - protein, 46 aa, Methylobacterium sp.
SPERDGIRVSLGMFNTPADIDRLIEAIRHRENPAASEARTSALAKL

SEQ ID NO: 2462 - protein, 179 aa, Methylobacterium sp.
MRPICRVLPIAPSTYHAHAARRADPGKLPARARSDAALMVEIRRVFEENFHVYGVRKVWRQLGREGIAVDRCTVARLMRVMGLQGIVRGKKVRTTIPDPAAACPLDRVNRRFKAPRPNALWVGDFTYVATWTGSVYVAFVIDAYAYESASKHDPGKNFANALSDLRKSRSGWGHDRRRS

SEQ ID NO: 2463 - protein, 302 aa, Methylobacterium sp.
MRYDAIIVGGSFAGLSAALYIARGRRKVCVIDAGAPRNRFAAASHGFFAQDGENPLAMIATARAQLADYPNATFVTGEAVSARAAGDGFAVSLAGGQRLAASKLVLAFGISDILPDLPGLAERWGASVLHCPYCHGFEFSGRVLGVLSAGALSVHQAELVAEWGPTTLFLNGHPAPDAEACARLAARNIGIEPGPIRALAGEGRALSALVMADGRTLPLEALFAGPRYRLNSPLAEQLGCAVDEGMLGPVIRTDAMKETTVPGVYAAGDAARSPHSVAWASADGVTAGVALHQTLVFPRLAA

SEQ ID NO: 2464 - protein, 185 aa, Methylobacterium sp.
MTATAAKEIVQTFEKVFEPIDRERLHALSEKGRADPSVVKTVRARTVAEGRRFRHLNYIRSLDPHIVDEPPALLGDDTAPNPTEALLAALGTCVAVGLQANAIARGWTVKGIEVESEGDINITSVWGTGDLSEKPVGLTAVRLKVHLDVEGATAAELDELVAHAGQWSPVLNTVKNPVSVTLARA

SEQ ID NO: 2465 - protein, 177 aa, Methylobacterium sp.
MAPTPTDKPSLDPVIAEGKPDPAAVRILRCKTVAQGRLNQLNYIRGLPPQPVMEDEPEGLLGESVAPNASEALLAALGSCLSIGIHANALAQGIPIRSLELNVEADINMTSLWGSGDLHPKTIGFESIRVSVKVDADASRKALATLVKHTVLWSPVANTLHNPVHLDVALARSVVLA

SEQ ID NO: 2466 - protein, 3585 aa, Methylobacterium sp.
MAVKLNLQDLTFILKQIKIAEAHASGIKLTELRLDAAGTLLTDRGLYDATGNWLGDAAAPKAIADPHVPYGLRTVDGTYNNLVPGRETWGSSGQPMPQLFEPTYLNDADGDTMALGPGAPVITNTNYGLPGSVADADPRIISNLVVDATLDNPAAIAAALRIAGSENVIADQRAITAAHEALKAAQAANPAGDHAVLQSNLDALLEQTGVTVTNGSIDVLNVSPDEGLSKPFNAWMTFFGQFFDHGLDLISKGGNGTVYVPLAADDPLVLGQDGLAGTADDLAPHLRFMTLTRAAQVEGSQRNVTTPFVDQNQTYTSNASHQVFLREYALVDGRPVATGRLLGGADGGLATWADVKFQARTILGIELTDADVSAVPQLLVDAYGEFVRSANGLPQVMVGVGPGGQAVYASGSLAEPLKLSAIQLPVGTVLVGPNGAQNVIEAGETVAAARTFNAFLDDIAHNAVPVAVNGVLRPDADVLTGNAVQMNPQTGRNLEYDNELLDRHFVTGDGRGNENIGLTAVHHIFHSEHNRQIDAHKLTILQSGDLAFINDWLATDIAALPGNFAQMTALGQLAYANTLSWDGERLFQAARFATEMQYQHLVFEEFARKIQPLVDPFVFNPVTEIDPSIFAEFANTVYRFGHSMLTENMPRLGPDGQALDADLGLIDAFLNPLAFDNDGGLSHDESAAAIMRGMTIERGSEIDEFVVGALRNNLLGLPLDLAAINIARGRDTGTPTLNEARAQLYAATGSTFLTPYTSWVEMAANLKNPLSVVNFIAAYGTHGTVVAATTLAAKRDAAMALVFGGEGAPTDRLDYLNSRGSWAGRETGFGAVDLWIGGLAEKQMPFGGMLGSTFNAIFEAQMENLQDADRFYYLSRVQGQNFLNELEQNSFSKIMLANSSLSLPGPDGIRGTADDIVPRHIGVDAFADYDFELEVNAANQLDQNGAAPDRDPTGNDPVLEAMGLGKVVRDDPGTAADEGASGFHASVNALVRRYGADGSQTGALVDGSEDGVGGAGSPVTWADLKANAAKLGIALTQADMLDAPVLRIGADGRLAFAPGSSVPEAVAVANGSFEGLALVAGQEGVILDGNGNYTTTNPAGWTIAGGVGGLFAPADAVVDPAGRDGANVVWLRGGATLSQEGGTTLQAGVGYTYSFKVGDRTDFTWPGAEARLVAVGGANPVTLGTLTLTEPADGQWGTVTLATGVVPSALAGLQLRLEIRNTGSGDAQILVDDIELVRTAPAYRSDLTPAQTPGYDPAADPFLRDGAGNVLRTGQSIASPAADLDATVVDPAALNQPFATGHYLRFTGGEHVLVGGTDGNDTIITDFGDDGIWGDAGDDRIEAGAGVDLVNGGAGDDIITDSGDTGDFLKGEDGNDVIANSNGVDILMGGRGKDAIFVGVDATEVFAGEGDDFVIGGDDADLLMGNEGDDWMEGGGGFDTTAGDNSELFFNSAIKGHDVMFAGGDEHDFDGESGDDIMVQGESVMRNEGMFGFDWAIYKGNQIAANADMRIPIFTTEEADILRNRFDKTEGLSGWRLNDTLIGDDRTAAANADAEAPAGAPITAANEGVFFNDGLDAAGIARIAGLDQIVSLASGQQFFEAGNILLGGAGSDTLQGNGGNDILDGDRWLNVRISIRNPADAGQEMATADSLKHVFDDSAANQARGWAGKSLFELMIDRVISPTQLAIVREVITTGATAADVDTAVFNDIRANYTITRAANGTLTVTHTTLTNPTVDDGTDTLRNIEKLRFADGTADVALVLNQPFDSLTIRPFDADGDDSSTLVATLVNRVNATTRPVTLQWQVLADNGQWRNVTGADGQVTNGGTFFTPTGATGVEIRVVANWSSTVAGNTGLQQTASVQSAFVGTAAAEDITGSASPNVILGRDGDDDIEGDVGNDAIYAGSGDDRVDGGAGDDTLLGNDGADTLIGRTGNNTLDGGNDDDQLSGGHGNDRLIGGAGTDTAIYSGPIAAYSFERNAQGEVVVSDNLGAEGDGVDTLTTIEQIQMGNDLTPYALVANGTAAVDIVVGTAGNNTLSGGAGNDLVFAGAGNDNVLWRTGDGRDFVDGGAGTDSFRIMNGTGPVQQLTLAQARAQFANLSFRDDTQTVVVRNGIVIAELKNVEQVAVNAVATGAPVVTDPTPTNGLVSPTEGQPLGALVAAIQDADGLGAFSLRWQQSGDNGQTWTDIAGNAAGTLNYTPGQAQVGDVLRLRVSFTDGAGNPEELFSAPTGVVGDSFTGTALNRTFNGTAGDDIANGADTALFGIQPNDTMNGGAGNDILNGRGGNDTFIQVSTDGRDRVDGGAGTDTYQLNGTAGPETFRIYSRSAWLQVAGNTEAQLAASTEIVITRNGTGAAAIVAELDNVEEIRVNTLQVTSPGGQNGGANGGDTIQVIGSFTGTSLNFNTITIDGSSGDDTVDMAALTSAHRIVFRSNGGHDTIVGTLRPQDVIELPAGSNRADYIAAAGANGMTTLSNGSHTITFSAAGGMPRITVESGADGGDGEGITGAFAYTAADIDGLEALVRGQRPDNASDDDVPTGYRELSGHGNNLDHPTWGSADQAFIRLTQARYGEADANGNRAINPIFDGLDARTISNILGTQEAGLPKAGNDANIFFMAMGQYIDHGLDFLPKGGNGSIVIGAPGGGAPGSNNPADLTRGTVMAVDANGVPQHKNQTSPYIDQNQAYGSNALVGQFLRESDGAQGVGMRLLAGAPDPSNPAFNLLPTLRELVNHHWQADTIFAGPAGPISFRTYYTNFALSEGVTGTLFNTETGAFDPQVLTKLVGNFMGSGHPLLLDTNPFISVLDHFVAGDGRANENFALTSIHTVWARNHNYHVEKLLESGFEGTPEQVFQAAKMVNEAEYQRVVFDEYLETLIGGLRSDGTHGFEAYDPSVDVAISHEFAAAVFRFGHSLIGQTLNVKGADGETVPVSLFDAFLNPSNDPSVFTAPLPPGYVPQPGYAQYGVGGIIGGTIEQAAEDVDFNIVDAVRNDLVRIRADLFAFNVARGWDVGLGTLNQVRADLAASTNPYIRDAVGFAGGDLSPYASWEDFQARNGLSDAVIAQFRQAYPDLVLAAADIAAFRAINGDIAIAMQADGTGVVKGIDRLDLWVGGLAEKHINNGVVGQTFWVVLHEQFDRLQDGDRFYYLERFDNFDFYENLVDGQGFSDIVARNTGLTVLPEHIFELSDEDRPGTEPGDDDDDGDTDPVGGDPDEDEDGPTDPVGGGGDAGGDEDEDDGVTDPVGGGDDPGDDEDDGQGDGDGTTDPVGGSDGDEDGPGTGPGTNPPVNHAPGVIAGGANGDVLNGTAGADTILGLDGDDNILAGGGADVVRAGAGNDFVDAGEGRDVVFAGDGDDDVLSGGGADMVYGDGGNDRILAGAGNDLVTAGAGRDTVIGGEGDDLFVAETGDGDDTYWGDEMGGGLGSDTLDMSAITANIAVNLGTGLAGRGSATSTQSGRDVLWGVENVVTGSGNDDITASDAANVMDGGEGSDTYRFGSAGAANGDTIEGFRPGDKIDLSAIDADAGQAGNQAFTLATGAAFTGVGQLLVTQETRDDGDYVVVQGNTAGDASPEFKLAIKGNTAPTAADFTL

SEQ ID NO: 2467 - protein, 91 aa, Methylobacterium sp.
MKALTFALASTLLLAPAAFAAEGTGASGTSRSGTADSTGPNDAGSGASPGAAGSGPTSGDKSRSGTANSTGANDAGSGSSPGASGKGHEAR

SEQ ID NO: 2468 - protein, 114 aa, Methylobacterium sp.
MWAVVAFRHHRRSAADLRERVQCNSRWDTMSNDTIIWTQGGIAEVPLQRFTGRIGAIEVATVEYDGSNRLWTWWSPLAEDIWGHAQEPEGAKQAAELWLRDWLENFRPFFEAGR

SEQ ID NO: 2469 - protein, 358 aa, Methylobacterium sp.
MAASARIAEPPSLDVAGIVRETLRPRLGAIDAGEYPADILRALGAAGAYGHHADGTAAGLLAAIDAMTEAGQACLSTAFCMWCQDALVWYLAQGDEAGPRRHLAAIASGAALGGTGLSNPMKAFSGIEPLALQGERAGDGYRVRGRLPWVSNLGPGQRFAGILSLPDGRRVMGLFEAGADSVSIAANARFIALEGTGTYTVMIRDALLSDEDVITHDAAAFVPRIRNGFVLLQTGMGLGLARGVAAMMRADARGRANAAFLPLGPDAIEARADALRERVAAAAQAHAEADRATFLETLRLRLDVSWLALEAAQAAMLQAGARGYLEGAETFRRLREAQFVAIVTPSVKHITTELARGG

SEQ ID NO: 2470 - protein, 251 aa, Methylobacterium sp.
MSRSVPRLALAAVAYRYGLSPVLDRIDLEVAAGERIGILGRSGVGKSTLLQIMAGLVAPSAGSVRLDGMPSRGPVPGCTVMFQRPALLPWASVLDNVLLPARLSGRLGRDRAAREAEARRLLDDLGLRERVGAKPHQLSGGQQQRVALARALASEPSILLLDEPFSALDPEMRASLRADVLRLAQARDLTLIVVTHDLADVAALAARAVVLDGRPARIAADFSFGDDAEAELRRRLGSVARDASGITGRAA

SEQ ID NO: 2471 - protein, 358 aa, Methylobacterium sp.
MSLFERFLTLWVALCIVAGIALGHVMPGVFHAVGAAEVAKVNLPVAVLIWLMVIPMLLKIDFVALRQVGRHWRGIGVTLFINWAVKPFSMAALGWLFIGTLFRPYLPAEQIDSYIAGLIILAAAPCTAMVFVWSNLTRGEPHFTLSQVALNDTIMVVAFAPLVGLLLGLSAITVPWGTLVLSVVLYIVIPVVIAQAVRRILLASGGQAALDRLLGRLGPVSLVALLATLVLLFGFQGEQILAQPAVIGLLAVPILIQVYLNAGLAYLLNRAAGEQHCVAGPSALIGASNFFELAVAAAISLFGFNSGAALATVVGVLIEVPVMLSVVWIVNRSKGWYERGASARGTALQSVSRETRVG

SEQ ID NO: 2472 - protein, 606 aa, Methylobacterium sp.
MRATSKTAEGLHAMNDDDWLELIPDEAAEAPTRAGTWTIAVVDDDPAVHEGTRYALAGYSLDGRGLDILSAYSAQEARALLAERRDIAIVLLDVVMETDDAGLRLVDYIRRELKEETVRIILRTGQPGQAPERRVIVDYDINDYKAKTELTADKLFTSLTAALRAYQQLRRLDETRRGLEIIIDAAPMLLDHKSMQRLAEGVLTQVASLLNVDCAGILVLRESEDAADRREGGFCVLAGSGLYGGYVGRDPGWPLDPGIQPLVEQAFAARCHNFGDNLSTLYVQTASGSEIVALIDTDRPLSDTDRALITLLAGRLSVAFDNVILYERLQRANVTLEQRVVERTAELIRANRRLDMQRSDLRRANSLKTEILGTIAHDLKNPLSVILGRSEMLTDLIGLDQGDASGVEKAQAAMLTQVEHIRASATRLIDMIDSLMADAMNDALDITLRREPVDLAGLAREVCEANRPLAESKGQSLVMDLAGPLSLCGDAERLREALDNLVSNAIKYSYPGGAIAVSVREEAGDLVCAVADQGPGLSPEDAGRLFGRYQRLSAKPTGGEGSTGLGLSIVKRIAELHGGRAEAFSDGPGQGAEFAMRFPREAVGVP

SEQ ID NO: 2473 - protein, 244 aa, Methylobacterium sp.
MTASGPHIAVVDDEADARAMVGDYLRLHGFDVALCEGGRALRAHLQIRTPDLIVLDLNMPEEDGLSIVRDLKARSPIPIIMLTATASAIDRVVGLELGADDYLPKPCELRELVARVRSVLRRAQVAPASPQAAAPEAAAPTRTVRFGTKWLELDALRLRDDAGVEQPLTRSEFDLLKAFADHPKRALSRERLLDLADARDPDAFDRAIDVRINRIRKKVEPDPANPRYIRTVRGLGYIFRPEGD

SEQ ID NO: 2474 - protein, 757 aa, Methylobacterium sp.
MRVGRKIALVGGVPILVAAAIAAAGWFLLAQGERARAGALLAARVYHDLTLARMVRDDSVSARADARAAIETRFFDLTARAGRGLEALQNQARTRSQAERAAAARQSLGRYVARMRDFSAVARENDGLIAEMGQRANRLTDLAEQARQRQQAANVDLAWTMTGKVNRLRATRDVVAGLNAVLAAAWQGALARQRGEEAAHSERTRLVHAGRDLAAALRATSRETEATEAEGLTASEPAAGDRLTEWGERWLKTATSEQRTLDDAVAQLLASAGEANATEQATQNIGIATLKLGQRTAEALARRDAEAVSAMLGEGERLSASASTLPISPLIQSDMIEAIDGWRARLATTIDGLKRQNAMIAEMDGLAAGLSEAARDLNDDAVEDADRFGTFLGRLLLAGAAIGLLLGALVALAVARSILVPLRQLQGDMIALAADPKAEGLSGTQRTDELGDIARATNFFVTEIGRRERALRRAKDQADTALHDLRQAQDDLIRVEKLASLGQLVAGVAHEINTPLGIALTTATLVRDETRTFQDLVAAGTLSRSRLTHFVDRVGEGAQLLCANLTRAADLVHGFKQVAVDRASDERRSFDLDIWLGELLASLQPMLRKGGHRIRCEVPPGIVLDTYPGVLAQVVTNLVANAVVHGFAGAERPGTITVRVSTPGALVRLEVSDDGGGIAPEHLGRIFDPFFTTARSRGSTGLGMHIVHNLVTAKLQGRIAVESAPEHGTLVRLDFPRVPGGTERPGTARRPTGADAR

SEQ ID NO: 2475 - protein, 285 aa, Methylobacterium sp.
VSGGVIEAALAVERAVAAPEPRRAGIGARFGASALDRLAPLFGLAGLLALWFAGGLVLESVPAYAAFAGFAPAPALASFVELLTSGEAWRAAAPSLARIGQGLAVAFGLGAPLGLLIGSVPLAERILQPPFQLLRMISPLAWMPVAVLAFPSWDGAIVFLIAAAAIWPILFATAAGVKRVDPVWLAMARNLGAGRLAALRAVIVPAVLQDILTGLRLALGVAWIVLVPAEYLGVTSGLGYAINDARDTLSYDRLAALVLLIGGIGYALDTGLGRLAARARWIPAT

SEQ ID NO: 2476 - protein, 408 aa, Methylobacterium sp.
MTAPDDLSALWTHEWARADWTRRNTLDALARGGLAALLGGGSLALSGRAVHAAEDDTVRIGYLPITDATALLVAHAKGYFEEAGLKVAEPIPVRSWSALVEGFAAGKFNLAHLLKPIPVWMRYNNKFPVKILAWAHTNGSGIVVGGKSGIEDFKGLAGKRVAVPYWYSMHNVVLQYALRESGVTPVIRGDAGPNECALQILAPPEMPAALAAGKIDGYIVAEPFNALGEIKAGARMLRFTGDIWKNHPCCVVVAHESQIAAKPEWAGKAVDAIVRAQAYCVKNREEVARLISKEGRGYLPMPADVVIKATTDYGPAYEASGAIRHRDWAAQRIDFQPWPYPSATKLIVEAMGNTVVEGDAGFLKGLDPDFVARDLVDDRFVRASLKRYPEWPGAADDAALTRQETLSL

SEQ ID NO: 2477 - protein, 132 aa, Methylobacterium sp.
MLSDAQWGELEPLIEACRPKAKTPPKELRRTISAILWRHQNGAKWRAIPEELGPWWQAAQIFIRWARAGVWERLLDRVQERGVALGMVFLDGSNVRAHQKAAGAAKRGDLRPSEMLVKHLAALVAAMAPRLA

SEQ ID NO: 2478 - protein, 132 aa, Methylobacterium sp.
MLNDAQWAALEPLVHACRPKAKTPPQDLQRTLSAILWRHQNGAKWRAIPDEFGPWWRAAQIFIRWARAGVWERLLALVQERGVQLGMVFLDGTNMRAHQKAAGAAKRGDLRPSETVVKRLAGLVAGMAPRPA

SEQ ID NO: 2479 - protein, 1240 aa, Methylobacterium sp.
DQLNSFASEVVRVAREVGIEGKLGGQAQVRGVGGTWKDLTDNVNMMAANLTGQVRNIADVTTAVANGDLSKKITVDVKGEILELKSTINTMVDQLNSFASEVTRVAREVGSEGKLGGQAQVRGVGGTWKDLTDNVNMMAANLTGQVRGIADVVTAVAQGDLKRKLSVDAKGEIAALADTVNEMIETLATFADQVTNVAREVGVEGKLGGQARVPGAAGLWRDLTDNVNQLAANLTTQVRAIAEVATAVTKGDLARSISVEASGEVASLKDNINEMIRNLRDTTLKNAEQDWLKTNLAKFTRMLQGERDLATVSNLILSEIASLVSAQRGVFYMVEDEGGEPVLDLMASYAFTERKNLSNRYRLRQGLVGQCAFEKKRILLTHVPGDYITIGSALGEAPPLNIIVLPVLFEQEVRAVIELASFSRFSETHQSFLDQLTESIGIVLNTIAANMRTEGLLKQSQLLTGELQSRQEELKKTNDRLELQAASLQQSEDLLKNQRERLQQTNEELEEKARLLEIQKREVEGKNREVSIAKTALEEKAEQLSLTSRYKSQFLANMSHELRTPLNSLLILSKLLSENRDGNLTDKQREFAKTINAAGTDLLSLINDILDLSKIESGTVSLEIGDVTLQDISENLNRTFRQLAEERHLAFVIEADPGLPRSLRTDSKRLQQVLRNLLSNAFKFTEKGSVSLKIGSAEGSPLRAGTQWIAMSVTDTGIGIAEDKQRIIFEAFQQADGTTSRKYGGTGLGLAISREIARLLGGEIVVESRVGTGSTFTLFLPFEPPAQALTGRVAEASDGYAPSAPMGRQPNTAMALSSSADDRHAIHPSDHIVLIVEDDAMFASVLLELARERGFKGLIAQDGAGALSLAHRFKPHAITLDIGLPDMDGWALLDLLKNDPRTRHIPIHVISVNDEKKRGLRAGAFGFLEKPVEREGLMRALERSKEFITRPVRNLLLVEDDENQRASITALLSEEDVKIFGVGTASAALEALTGGRFDCAIIDLGLPDIGGSELIEQIRASQDGEELPIIVYTGRELTAAEEQQLRHTASTIILKDTRSSERLLDETALFLHRAINRVPVEEQILVERKDATSLQGCRVILVDDDLRNIFSLTSALEQHGLEVLFAENGQDSIALLKSNPNIDAMLVDIMMPGMDGYETMRAIRAEASFRSLPLIAVTAKAMKGDREKCLEAGASDYVSKPIDMDQLLAVLRVQLARRGEVAHGPVPTLGDPTTLDRQPQ

SEQ ID NO: 2480 - protein, 348 aa, Methylobacterium sp.
LEPKLLLKSLRAFRKGDFSTRLPLDLTGIEGEIAQAFNDIVELNQGLARELDRVARAVGKDGRIGERGKLPAATGGWNDCVESVNTMIGDLVQPTTEVARVIGAVAKGDLGQTMQIEIEGRPLRGEFLRIGKVVNTMVDQLNSFASEVTRVAREVGSEGKLGGQAQVKGVGGTWKDLTDNVNLMAANLTGQVRNIAEVTTAVANGDLSKKITVDVKGEILDLKSTINTMVDQLNSFASEVTRVAKEVGSEGKLGGQAQVKGVGGVWKDLTDNVNMMAENLTGQVRNIAEVTTAVARGDLSKKITVDVKGEILALKLTINTMVDQLNSFASEVTRVAREVGTEGKLGGQ

SEQ ID NO: 2481 - protein, 557 aa, Methylobacterium sp.
VILVVGGAGAFGSRLVAGLAATTDLRVIVAGRDVAKAEAVARTVPDGRGRAVRLDATEVDAAQLRALGATIVVDAAGPFQGGAPVLARAAIEAGLPYLDLADGRDFVAAFPALDAAARANGVVALTGASSTPALSNAALDALTAGWRTVETVRVAIVPGNRAPRGLSVMRAILSYAGQPVRVLRAGTWQNRPGWGLLSRIAVPGLGRRFASLCETPDLDILPARFPALRTALFRAGLELPLLHLGLSLASLPVRWRLLPSLVPLARPFLAIAGWLDRFGSDRGGMSVEALGTDATGRPVRAVWSLVAEAGDGPYVPTLPALAAIRRLTDPSAAPIPPGARPCVGVLPLEAIEAEMARLAIHTRRDTDHPVPLFERVLGDGFARMPEALRAVHGAVGDGAFRGRAAVMRGRGPLVALVAALFRLPPALEDGPIRVTMEPDLDARSERWTRGFPDRRFASRMQRAGPDGSGRVREHFGPFAMDLAVRAHADGLDMAVTGWRFGPLPLPRLLRPTTQASERVDAQGRFRFDVALFLPFLGLLVHYRGWLVRCDEREEETP

SEQ ID NO: 2482 - protein, 417 aa, Methylobacterium sp.
MLDLNTLQVASISSRLAFVLVFFVTLLRHPREIYFGVWAGALCCSLIGSLLMLGDPPSVPLNAVKGSIVYILYGASLAVSWAGLRLFHERALLIPQTLGLALLSGLSYGILPQIGASVTWALSVVFVCIALSTALCMWEILRTPASMRLWTQYIVLLGFGGYFIAFLLTIGVIHFANERLASPESGIYSLLFDLWCGVFIQVGYLAMVSERAHLKLSRLADTDPLTGLANRRGLFAALSQRAGLSPSPPRCAILLADIDHFKAINDTYGHDGGDAALVGFAERLRGVMRKDDLVARWGGEEFLVVLDQADATAAVTVAERLRKSAAGQPFTVNGAAVTVTASIGVAVVAAGEERIDAALSRADAALYAAKRAGRNRVCLAPSPPPPDTRAVRAEPSSGLREAMEAIQVVGQPRSEPA

SEQ ID NO: 2483 - protein, 105 aa, Methylobacterium sp.
MGRSDLERLIHSELIDLVLRLQRPDKTSRTSSKPPSTDRKERREQSRPGGARTGHEDPSRAISKDPEAVVDHRPDRFACCGGALHGDLPAEIVSVSERIEFPGAM

SEQ ID NO: 2484 - protein, 595 aa, Methylobacterium sp.
MSLSSPRRADVVRRVLAFVVRGWRRRLGLVSALVTAITLATLADVMLPLYAGRLVDALAGAERQAALQAALPAFAIMTALSLATVLLRHVAWSLVVPLTLGTMSDIASQSFARVQRFSTEWHANTFSGSTVRKISRGMWALDGLNDVLLLSILPSVVVLVGTTVVLGLHWPAMGAVIGLGTLAYVGTAVFLATRVIAPAATLSNALDTRLGGALSDTIGNNAVVKAFGAEAREDERLARVLSKWRRRTRRTWMIVTWSGTLQLGLLLAFRSAIVATALWLWWQGQATPGEVAYVLTTYFVVHGYLRDIGGHINHLQRSVNEMEELVALESEPVGVADRPGAVPLAVTGGAIRFDAVRFHYGTHGTPLYDGLSVTIPAGQRVGLVGRSGSGKTTFVKLIQRLYDVSGGHVLIDGQDVAGATQASLRAQVAIVPQEPVLFHRSLAENIAYARPGASPEEIERAARLANAHDFIARLPKGYATLVGERGVKLSGGERQRVALARAFLADAPILILDEATSSLDSESEALVQEAMERLMRGRTALVIAHRLSTVRALDRILVFDRGRVVEDGAHAALIRRPNGAYRALFERQSDMAENA

SEQ ID NO: 2485 - protein, 84 aa, Methylobacterium sp.
MPIAATLPATVALALALIGGSAAWAADAGRPRPGAARCSDDVRCRRPPGPPDRDIRPLIDPLGRPCGFRWRETPSGPRRVRVCY

SEQ ID NO: 2486 - protein, 76 aa, Methylobacterium sp.
VARSARSIPGRALASVQRSAGAARPRAAPADRHTLTLTSADGRSRRLFFAYSSQNEPPEADRDMIFVGGSVFSSDD

SEQ ID NO: 2487 - protein, 609 aa, Methylobacterium sp.
MARLYPFVPLLPDEAVTGFCSRLAAIHKTTSVRTFLRYLGRRFTPIVFGQAAALDDLADLTGIPPAEIARSSLVRAEGHITHRGELLPTTMSRGTRTFVCPRCLTEDGEHARRIPIETSYGRTIWQLTPIRACPRHHVLLREIGVPVHASEAYDFSRAIRPHLSRMREYADAAAEVMPSAAEAYLLFRFEEQREASPLLDQMPWYAAARACEAVGAAALFGPTVKLGNLALSEKREVTDVGFEIAHGGEPAVSRFLDDLLGKHYTRNGSNDGPGAMYGILNHLLTRPGVDPGYAPLRDIVFRHALDAAPFGPGDVVVGLPVVRRRTHSLTTAAVEAGQHPNRLRKILIAEGIIPPDASLNGDVIFNAAIAAPILRRATNLLNLHAIAKHLQTTYSYAKMLATNGFIEPFQSDMVGEKVIRARYAKADVDAFVERLVEGTVIHPRPERPLMDIPRAAKRTYCPTPGIIRMILDRQLRWVGVDPDRAGFHAILVDADEILKRVRGPEHDGYTMQKLRVRMKVGQRVVEALITGDYLPQVMRPNPVNRHRDWIVLPETIDAFERTYVSLSELAGRWEMNASKLKTDLDRRGVEPAIRRDQVGATFYFRDRLL

SEQ ID NO: 2488 - protein, 32 aa, Methylobacterium sp.
LIVPVAMEEKLRFAIREGGRTVGAGVVAAIND

SEQ ID NO: 2489 - protein, 32 aa, Methylobacterium sp.; identical to SEQ ID NO: 2488

SEQ ID NO: 2490 - protein, 226 aa, Methylobacterium sp.
MAARSSRLAAVFGVLGVGLLGVSAASQAAEPAMKTVPESGLTAGSFLVRGRVVGSIPVGQFSRVEPIGGRVITPARALPDLDVTYFLSDHFAVAGQLGVVSTKTSIRGSLIGDLTIGSTWSFAMTGAVQFHFLPHGPFNPYIGAGAGYTHPIAYEPAKPLITEMKADPQLGPMLQAGFDYHLGGNWYANMEIKKIFLPPQVSRIGSGTTTVRLDMLIIGAGIGYRF

SEQ ID NO: 2491 - protein, 441 aa, Methylobacterium sp.
LGRGGTGAEDRAVSPIAWQRYAIGGYALIAAAFGVAGAWAATVRLDRAVISTGVIVAETSRKVVQHFEGGMVHAVLVKDGQMVRSGDVLLRIDPLQSQASADLFRNQLDAALVLEARLRAEQAQSDDLQLPAEIAARRNEPVLARMIGDQAGQLAERRTTLKGQLALIEAKVTQLRTEISGLAVEKSSVEQQVGFIRQELEGLRSLHERNLIPLSRLLVMERERTRLEGVIGRSVAERAKAENAISEAGLQVTQLKQKLQEAVTGQLLETRQRIGELREKLVVAQDVFRRHEIRASHDGVIQGLKVFAIGQVVRSGEPLMEIVPTADRLVVNVQFSPNDLEAVHAGMRAEIKFPTFQARRTPAVFGTLTVVSRDRLVDEGSKQAYFAGTVEIDEHQLPAEVRHRLLAGLPAEVVVSAGERTALEYLFAPFFDAMGRAFHER

SEQ ID NO: 2492 - protein, 98 aa, Methylobacterium sp.
LYVHQQRLGSEEVQELRREGGRFLKDLREKQGLSQRQLAALVGAEYYTFISQLETGRGRVPPDRYRLWADALGVDAKDFVKSLMRFYDPLTFEILFGD

SEQ ID NO: 2493 - protein, 289 aa, Methylobacterium sp.
MSNLNVDQIRSFLAVLESGSFTAAAQTLGLQQSTVSGHIARLEQALGRSLLMRDTHRVALTPDGQAMIGFARDVLEAHDRLRAFFSPGGLRGRIRLGVSEDYTLSALAQVLARFADGHPSVDLQLTVGLSRALYQGYDAGELDVIFCKRRRGDPRGELAWAEELVWVGRPGFAPDPALPLPLVLYPPPSITRTLALDALEAAGRSWRIACTSGSLMGLRAAVEAGLGIAPHSAQVTPPGLAPIPETAGLPPIGEVEFVVLGSGRQHPAATALQEAILASTAELQAVPEG

SEQ ID NO: 2494 - protein, 587 aa, Methylobacterium sp.
MSDRVAESVLKDGLRAIRPVLVTVFVFAFFTNLLLFAGPLYMLQVYDRVLSSRNEATLLGITGIAAFALAVYAVLEMLRSRLLVRGGMIFDRKVAGPVFEIVHRAALLKPRAGHETVLRDVDVLREFLTGGAILALCDLPWASLFLMACFILHPWFGWMALLGGGTLLGLTLLTDLTTRRPLDVASQAAREAGEQARATMRGGEVLRAMGMLGALRSRWRRRHDEAIRLQARASDRAGLITAATKFTRMFLQTMVLGVGAYLAIHGEISAGSMIAASIIMGRTLAPIEAVVGHWKSFTAARRSYARLADIVGRIGLEPQRVMLPRPRGLIETENLVVAAPGSPTAILHDVSVRLEPGSVVGIIGPSAAGKSTLVRAITGVWPITSGAVRIDGADLRHWDPQALGQHLGYLPQDVELFDGTVAQNIARFDTQDDAAIVAVAQRAGCHDLIQALPDGYNTRIGSGGHGLSGGQRQRIALARAMYGDPSLVVLDEPNASLDQAGEAALMRAVADLRERGTTVVIVTHKVSLLAGADQILMLEGGTLRASGPADQILTQVSGPRPVPALVATGGRAMPENERMPEIQRSAG

SEQ ID NO: 2495 - protein, 145 aa, Methylobacterium sp.
MTPDSTTPDAAALRLDHSSIEELNLALRHYRRLMIRLPLILVLGFAAAIGLSYLGTALSPPYGVYILGWDLLTWGLLGVLAVLFAEFWWEGRQIGRALNSVEMQSAPIASLLGGQALIGERAREHGMKPGPFNGPLRPITKRQPG

SEQ ID NO: 2496 - protein, 108 aa, Methylobacterium sp.
MEIQEFLDGSGRSPFASWFDDLDPQAAAKVTVALARMEAGNLSNVKSVGDGVQEYRIAWGPGYRLYFGRDGDLLIILLCGGTKRRQQDDIAEARAHWADYRSRKKETG

SEQ ID NO: 2497 - protein, 113 aa, Methylobacterium sp.
MEIREFLDGRGGSPFASWFDDLDAQAAAKVTVALTRMERGNLSNAKGVGGGVREYRIDWGPGYRVYFGQDGDTLIILLCGGTKRRQQDDIDEAQAHWAEYKRRKKEEGDGPDP

SEQ ID NO: 2498 - protein, 151 aa, Methylobacterium sp.
VTASTPRPMPPTLVFDTDCVLCAGMLRFVLAHERDHSLHFMGAWSREGLDLAARHGFTEADLNGTFLLVQGGRALTRSDAALAVVRHLRAPWRWCGVFAIVPKPMRDRLYSLVARTRYRVFGRREDCARVPPDQQHRFHGVRPTRRLGRTN

SEQ ID NO: 2499 - protein, 106 aa, Methylobacterium sp.
MVARPMSGSTGNAVAEYDLSHAPERLAEKQPPGAGPWSSTNAPASCGGAPHLGRTFREPARASGKPDGIWNMDGRAGAMSEACEARAVPDNVMRTATPTPISTTML

SEQ ID NO: 2500 - protein, 123 aa, Methylobacterium sp.
VIADGAGRAVAFRLAPGQAHELPHAVPLLDQLPGVPLWVVADRGYSSHGFREHIRDVGAKPAVPTKRNEAPTRCPDWIYTNRNRVERLWARLKEWRAVATRYEKTAASFTGVLCLAAACDWIK

SEQ ID NO: 2501 - protein, 331 aa, Methylobacterium sp.
MIYQQSFGEIPDLKLRREAWIESAAPLYRTDIDRDVPVGDDVFIRNFNLGTCILGKSIAPEMYMERSLEQISRQSLDHISFRLFLSGTSDLHVDGRSSVLRAGDLQMLDLSQWMRSTSHGSKPVIHLIVPRRLFEKRLGDVSAFHGSTIRPDASPLTRLMTDHMRSLAACIDAADEGQRTALTAATVSMVNAVLTKPGDGPYERDTVLGVAMLRFIEDDLRSFDLGIEKLCARFAISRTRLYALFEADGGVASYIRDRRLARAMRILAGLEAGDRRRISSVGYACGFETEKMFSRAFKRKYGVNPSEVDAGYRPQVRLEYGATLMSWINAL

SEQ ID NO: 2502 - protein, 121 aa, Methylobacterium sp.
VDELFAPLFASGRIVDAILVLVVLEALVLLGMRARWGRGPAPGALLSNLASGAALMLALRAALTGTAWPGIAVWLAAALATHLAEMVIRFRRDGAAASPDCDKLAENNQKWRTFGARPPMT

SEQ ID NO: 2503 - protein, 605 aa, Methylobacterium sp.
MRSLDTLPLLRPKSEAGRAPSGEDARAGVPPDFEAMLGAFENGAAERGTADTGTARTGEAAAEQVEAGTNMSPPLPAEALPATTLDVGGSALQALMALTGPAVPTIAVPPDASLEAMVQRAAARAGSGPGPAPAEPALQMSMVGLETHFAPVRPHGAAPAETAIESGLNAPSAPPMPPTSGSIGAAPAAPVSPEKAPDATVPSALPAGGPDGPLAPGPVAMQPPAARSDASDPAVPSDRPAPDAPANALTAPAATTPARPASPVPGADRPAESTPASHAPAPDEAVRQAAGAPPAQAAGAEAPRSPAARGRATPRSDQAEPVGAADNAALPDQPEGTSLAEPVAVAQPGTPGQTRGDPESRQDRPAAIAHPDTMPEHAAVAVPRPQSEGGARAERAGSDAVTIEAPRPDMPLAPSGPQETAGLPTPAPASPLRQIVDAVAAQLPAAPAAIATPSARPIPASTEAGPLKILTLQLHPADLGSVLVRMRLQDGRLEMSLRTSREETAERLRKEGDLLAGLLREAGYEPEAVTIQSGGPGPGESGPRGQGFASFAGSQGGQHDRQPGAATPDQSGRRPSPRADAAATPTEEQDHETDSRGRDRGSLYL

SEQ ID NO: 2504 - protein, 72 aa, Methylobacterium sp.
MPVFVLRGACRAPDGQIGPPLFEETITAASPSEAVRLANAHDLSTKDERANALWLVDAQGVLHWSLRRADRD

SEQ ID NO: 2505 - protein, 361 aa, Methylobacterium sp.
MRDDIANPLDHFRSVAAREQRQRIEVMQRVRGAYFRHPKHDEVAEHVDELIEHLLEHTDSRVQCGSEEASGIAIIGASGAGKSTMLRRIFLEHPAFPHYGVIGSRCPIVTVKPEGACTLDRFAIDTLRKLGMPVQDVPRQEQRMAHMVRDQLRLMGAKVLHIDEAHHITQPANSIQIKKILNTFKCLMIDDEWPIGLILSGIPELRQVLEGERQVARRLAFVPLAGLTFASDARKVGKIAQQLAGLAKLGFSAVQADVLAPRIIHAGGYQLGCAIERIHEAIRVRLKRNLPRLSTATPSPDPLILDDFATAYARKTGVEAQDNPFLAHDWEATDPFRVLNGPQRTDDKGDRPSSRSTKKGG

SEQ ID NO: 2506 - protein, 313 aa, Methylobacterium sp.
MNTFPQNGLGAMPSDTGAANDDSSAAMRRELARLREMLEQNSDWIWEVDAQGRYTYASRQCVALLGREPEEVLGRTPFDFMPPDEAERVGRIFGAIAAEQRPFTQLLNRNLRKDGSLVVLETSGVPLLGPDGALRGYRGIDRDVTQREAANERLRHLARHDDLTGLPNRMYLREHLAGLLAAGQRPGVLCLDLDGFKPVNDRLGHAAGDRVLTEIGRRLAELAASHGLFAARPGGDEFVLIVPDGVSVSPEAVRAIIAAPIAVDAETVRIGASLGLASAQGPEDTVDALLARADRVLYDAKEAVRRAGVSDGG

SEQ ID NO: 2507 - protein, 36 aa, Methylobacterium sp.
MLSVSRAVVSKHREISALLATYAMFLSGVLILAWAA

SEQ ID NO: 2508 - protein, 308 aa, Methylobacterium sp.
MIRALSIRALSLPGQAPSAAAPDRIGAGRSSEVFAAGPDRVVKLYRQPFEPEAVANEWAASRLAHGFGLPVPKALGIIRRAERTGILFARLDGSPMTVRYAYNPVGLMIALRRVARIQHAIHACPAPGLPSQHDGLRTQIEGARVPEPLRQAALAALDRLPRGDRLCHGDVHPGNVIATSAGLRLIDWQKAAAGDPAADVARSELMLRYGRLGPAWFSRLRPVRMARRLIAAWYVQAYRAASGLPREAIAAWRLPVAVSRLFGRPSDTDADLLAAIERLARKKPDFEKASLFAGPRQSPGRGQPEQSP

SEQ ID NO: 2509 - protein, 912 aa, Methylobacterium sp.
MTDAAEIARLDHVSHRYGRTVALDDVSLGLPAGRMVGVIGPDGVGKSTLLALVAGVRRIQTGQVLALGGDMAERRHRAAQGARIAYMPQGLGRNLYPTLSVFENIDFHGRLFGQGQRERRARITDLLTATGLEPFEARPAGKLSGGMKQKLSLCCALIHDPDLLILDEPTTGVDPLSRGQFWDLIGSIRARRPGMSVVVATAYMDEASRFEWLVAMDDGKVIASGSPAELLERTAKPDMEAAFIALLPPEKQAQHKAVVLRPRPPGLDAEPAIEAEHLTRRFGSFTAVDDVSFRIGRGEIFGFLGSNGCGKSTTMKMLTGLLPATEGTARLFGRPVGSNDMETRRNVGYMSQAFSLYSELTVLQNLELHAQLYQLPPHDRPVRIRELLDRYELEPVKDARPDSLPLGIKQRLQLAVAVLHRPAMLILDEPTSGVDPIARDAFWRTLIDLSRDEGVTIFLSTHFMNEAERCDRISLMHAGRVLAVGTPADLVSERGSASLEDCFIGYLAEAAGIDREEPAGPPADLPASAARPAPHRHLFDPRRLWAYARRETMELLRDPIRIAFAFIGPMLLLVAFGYGISFDVENLRFSAFDQDNSPESRQLTEAFTSSRYFSEQAPIRSATELDERFRSGTVQIALEIPPRFGLDLQSGRVPEVAVWLDGAMPFRAETSRGYVTSLASQYAQQLVIERTGAAATGKTVSVETRFRYNQAFRSVNAMVPSVMMLLLILIPAIMSAIAVVREKETGSIANFRSTPVTKFEFLVGKQLPYIGIAMISFLLLVLVALIVFDVPVKGSFIALALGTLYYVSATTGFGQFISTFMKTQVAAVFATALLSIIPAVNFSGLLVPISSLSGSARIIGLSLPPAWYQPVTAGAFTKGLPFIELAPNIAVLAGFAFLFLVLSQLLLRKQEA

SEQ ID NO: 2510 - protein, 112 aa, Methylobacterium sp.
VRILFVCGRARARSPTAEQVFLRWPGLETASAGVSDDADEPVEADHLAWAEIIVVMERAHRRKLMRRFGPALRHARIVCLDVRDDYAFMEPALVRMLEARAGRLLPPGSKPG

SEQ ID NO: 2511 - protein, 83 aa, Methylobacterium sp.
VNAKVFLLLVGVVVGGLVGYLTRPQAAEFKLGPLSVEIQDKDSAVGARGGELTTGQLQHVGLFALIGAVIGFGAGFVADRSRR

SEQ ID NO: 2512 - protein, 736 aa, Methylobacterium sp.
MVRGAAAWAVVLGAPASALEPVESRIEALLARMTLEEKAGQLNLISHEPILDLDAFRRGEVGAVINFNNAGLVAQADRLARSARLGIPLLVGLDIVHGYRTIFPLPLAMAASFDAGLVRRAAAAQARESAAIGLNWTFSPMADVARDLRWGRVVEGLGEDPWLTGRLTAAQVEGFRDGGLASTLKHFAGYSAVLGGRDYDATFVAPTELHDLHLPPFRDGIRAGADAVMTALTALNGLPTTADPALMTGLLRRQMAFSGLVVADWQAIASLTKHGIARDGAEAARKALAAGVDMDMTSGLFLRHLPDEVRAGRVPETAVDEAVRRVLRLKFGLGLFDRPVVDPDGAEAKLLRPETRRLAREAARASLVLLQNREDLLPIDPAKVRRIAVVGPFADSAWDQVGPHEGTGQEWDAVTILAGLRERAAASGVAIDFAPGCPRVCDSRAGFAAAVEAAAGADLVVAVMGEPRDRSGEGSSSATLTWPGLQHDLLAAVAEAGKPVALVVVGGRPTDLGDALGQAQAVLMAWLPGTEGGPAVAETLFGDANPSGRLPVSWPRKVGQLPLTYDTLPGGRPHVPGSRWTMGYADESPLPLFPFGYGLSYTRFAYGEPEIVAPHVGVGDRYDAMLEVRTSVTNYGTRPGRAVAQLYIGQPVASRSRPRRLLKGVALLDLASGETGVASFRVPARDLGYHEPDGTLVVEAGTYLAHVGGDAIATRSAGFAVETGWRGPPGSDEARR

SEQ ID NO: 2513 - protein, 898 aa, Methylobacterium sp.
MDQAKPKERVRIARAGAGRPGYVTVKGAREHNLRDVDVEVPRDALVVFTGVSGSGKSSLAFGTLYAEAQRRYFESVAPYARRMIDQVGVPDVDSIEGLPPAVALQQQRGTPSARSSVGSVTTLSSLVRMMYSRAGTYPPGQPMLYAEDFSPNTPQGACPSCGGLGRVYQATEASMVPDPSLTIRERAVAAWPQAWGGQNLRDILVSRGVDVDTPWKDLPRALRDWILFTDDQPQEPVYAGLSPEQTRLARRRRLEPSYMGTFTSARRHVLGTFTNSQSALMRRRAASYLVSEDCPVCQGKRLKPEALSVTFAGLDIGELSRMPLADLAEAMRPAAEDLLPDDADGTAPETLGRDTGRQDRARRAASGASAHAGAPDVRATPNLSIEKRLAAQRLAADLIDRIGTLTELGLGYLSLDRVTTTLSSGELQRLRLATQLRSQLFGVAYVLDEPTAGLHPADGDAMHDALAGLLASGNSLFVVEHDIGTMRRADWLVDVGPAAGEHGGTVLYSGPPEGLRDVEASRTRLHLFGMAEPPQRPRREPSGWLRLEGIVRNNLSGVSAAFPLGCLTAVTGISGSGKSSLVSQALLELVGDRLGRPVEIDDEPEDPLDDAPGPTEGRIVGGMDGIRRLVKVDQKPIGRTPRSNLATYTGLFDAVRKLFAATPEARKRRYDAGRFSFNVAKGRCPACEGEGFVSVELLFMPSVYAPCPTCHGTRYAPETLEVTWNGLTIADVLGLTVERACDAFADEPSVLRPLAVLRDLGLGYLRLGQPATELSGGEAQRIKLATELQRGQRGGTLYVLDEPTTGLHPTDVDRLMLQLNGLVDAGNAVVMVEHDMRVVAGADHVIDVGPGAGNLGGTVVAAGPPEAVAGARASRTAPYLRDELMAYAGQESSPRLAG

SEQ ID NO: 2514 - protein, 280 aa, Methylobacterium sp.
MPVRAWHIAILLAATVLPVSASAGPSGRDGERIRVVHVAPKTAAYHEIYDTMREQRVLERVGAIIGLVRLPNRLTYRLTECSGERNAWYAPENRSVTVCYELLDSIVQAAPRTKSPAGVTRLDAIHGPVFQILLHESSHALFDLLQVPILGREEDAADQVASLILLHLSPADARRVVNGSAYFFAATAKEEPIDKGAFADVHGLSWQRFYNLACLAYGSDRRRYRAMVAKGYLPKERAKGCGEEYGQVDFAFRTLIGTHLRVRPAGGQRLRRAFRSAFKS

SEQ ID NO: 2515 - protein, 92 aa, Methylobacterium sp.
MFPKLVGTAALLAAGSVLLHSWNAPRWAITALCVIGTLAAALSLAPILEQPIAPAAVMPAPEALKGPAPVFEGIWDPVHRRQLLGEADRTGL

SEQ ID NO: 2516 - protein, 94 aa, Methylobacterium sp.
LAGIRRLAAAKPEGYTRAFEVPYIVTTARNWAGRIGRFTLTVDKGRADALVSFCRQGVRKTGPTTFAWEARDYVPDSDLRVLLVSNDPAFLGDR

SEQ ID NO: 2517 - protein, 781 aa, Methylobacterium sp.
MAKISVTWANEYSMGLAGWQAGLILATAQAAADAWGKYIQVESTFDIAIGIGNVGGALANGGPQWTWNGRWWENTPILKAREGYDPNGGVQDANLTLGEHTFRDWFYDPTGVAAAPGNRFDAFTIFQHEIGHGLGFLEFPATVGANGLLLFNGENTRTVLGGPVVLDGARAHVWGSEDLMDPYLGWGQRSYISDLDLAMLQDKGMPISTERADKMWLGNRADTFFAYGGDDWIDGGWGDDKLFGGVGNDTLIGGDGNDALDGGAGDDTLIGGNGGDTLEGGEGIDRAVLTGRSQDYVALYGATGSLAIKHLASGSIDTLTSIETLNFDDTVLGMSGLLAHLQQRFGPVQAGKAPYEMALNATADEAYRPDIPEIDGAFSVTARVRFDDLAGGHFQRVFDTGNGPDSDNIWLGQVGNGRDMAFEILDGAIKHTITARDGITQGVEARWTAGVDERGWMSLYKDGVLVAEGQGVVPRDLTRAKDLVGQSNWAQDAALKGSIYDLTFKDDLPDIHGAFTASATVRFDDLDAGAWQRVYDIGNGAGAENVFLGQIGTSGDMQFMVLNGTNSANIVAKGAIVEGQEATWTTSVNETGWMRLFKDGVLLSEGQGIVPKDVVRTNEFVGKSNWTWDKPLVGEVSDLTITPFKGIPEIDGAFKMFAEVRFDDLAHGNYQRVFDTGNGRDSNNIWLGQVGNGDDMAFEILTGATKHRITAADTIVEGEMAKWQASVDEAGYMRLIKNDKLVAEGQGAVPLDVLRTSDLVGQSNWSWDTALAGQVKDLIFA

SEQ ID NO: 2518 - protein, 74 aa, Methylobacterium sp.
MRPSTVFAAASLCLAALPCRAQGVPSNPFASNYPSAPPRMVEREGRLQAPRARRPLPPGRVGRGLLPPADVPGR

SEQ ID NO: 2519 - protein, 399 aa, Methylobacterium sp.
MAAPVQAPAQVPAPAQVPAPAPLGFGTHVANVFRLIVKELRSIRADPVMLFLVVYAFSFAIVSVASGASTEVRNVSIGVVDEDHSDLSRQIVSAFNPPLFKDVVLIGPAEVDPAMDTGRLVFVIDLPPRLQRDVLSGHPTSIELDVDATAMTQAGNGSVYIQTIITQEIAAFAARSELNDTAPVRVVTRAKFNPNLQTSWFTSVMQVINNITLLTVILTGAALIREREQGTVEHLLVMPLVPVEIMLAKVIANGMVILVAAGFSLLIVVEWWLGVPIAGSIALFLFGAGLYALAVAALGILLGTIATSMGQFGLLVIPVLLLMQLLSGSSTPMESMPVWLQYLVQTVSPTPHFVALAQAVLYRGADLSIVWPQLLALAALGSVYFAFALARFRRVIFGD

SEQ ID NO: 2520 - protein, 300 aa, Methylobacterium sp.
MAGSSSAAARPTKRVEPRTLALIGLAGLAVAAAAALFATLADAGTVQAVRDGLSSRGFWTAAAVGLAAQTVDGALGMAYGITSTTFLLSTGVPPAAASASVHVAEIFTTAFSGLSHWRLGNVDGPLFRRLLIPGVIGAVAGATLLTSVDGETIKPFVSVYLLGMGLYVLSKAFRTLKANRAPPRAVVPLALGGGFVDAVGGGGWGPVVTATLVGGGQDPRTSIGSVNAAEFFVAVASGLSFTLLGGLTHWTTIAGLVVGGLFAAPIAALLVRVIPARVLMVVVGLLIASLSLVSLAELFG

SEQ ID NO: 2521 - protein, 468 aa, Methylobacterium sp.
MDVRTRRLLTDPIVPTLARMAAPNILVMAVQTSVGLIETYFVSMLGTDALAGMALVFPVVMLVQMLSAGGMGGAIQSAVSRTLGADRQAEAGILAWHAMVLGLGLGIATSLVALPFGPTLYAAMGGTGGSLRAATTYASIVFGGAVLIWLFNALSAVIRGTGNMVLPAIVTCVGAVVLIPLSPALIFGWGPFPEFGVAGGGVAFAAYYAAGSAVFAAYIWSGRSVLRPSRRLPALSWGPSREILRVGVLSGIASMTSNVTVIVATGFAGAAGPAAVAGYGTGARLEYLLVPLVFGLGSPIAAIVGTALGAGDHVRARQAALTGALIAGVLTEFIGLAAALHPAAWLGLFADDPAMLATGSLYLRIVGPFYGFFGFGLALYFAAQGAGRVGWPLAASLLRMGVALGGAWLALALGLGLTGTFIAMSAGFVTMGLVNAAAFATGKMFPSDALGPPSVTSGTLAPAAGVRR

SEQ ID NO: 2522 - protein, 64 aa, Methylobacterium sp.
MIFIGGFVAIPASGRWAHQVTEALAFLLATVVLVIAVMLLCKTWPDYYTSPQIPAAMTETPLDD

SEQ ID NO: 2523 - protein, 39 aa, Methylobacterium sp.
MKSFLRAGTAIAGIAFAGSALAADLPRRAAPPPVFQPVP

SEQ ID NO: 2524 - protein, 569 aa, Methylobacterium sp.
MDHSESPHHSASAGSRRALLLTSAAALGATTMPSRLFAEASAPRGALAQSRQGMVTSPHELASEAGREVLRGGGNAIEAAIAINATLCVTYPHFCGLGGDAFMIVSDRNGASFTLSGIGQAASKLPQDGQPIPLRGPGSAITAAAAVDTWEQAFTYSQRAWGGRQSWKGLFQRAITYAAEGFPLTPSQHFWANFRAKELGNWPDIVRVFTAEGRIPEAGETFRQPDLARTLTTLAENGGRDFYEGELAQRIARGLEQAGSPLTADDLARCRARNESALRVPYRGGELISLRPPTQGLTTLEIMGVLDRFDVASLPEGSADYYHLLVEAVKLAFIDRNRFIADPDFVDVPVERLLSASHLDAQARSIDPRKAAPWPHVFKTGDTVFIGAADRDGNCVSLLQTVYFDWGSGVVAGDTGILWHNRGASFSVDADSINVLRPGKRPFHTLNPGMYFKNGRPNLLYGTQGADGQPQTLSAVLTRLIDYGMDPLTALARPRFLLGKTFSDSRDSLKLELDAGQAVFEELKARGHEISPIPAQSPLAGHPGAIRIEDDGRFVGAHDPRSDGLALGL

SEQ ID NO: 2525 - protein, 150 aa, Methylobacterium sp.
MHLTLAERGVWVATPAVAQRFDISVHHLQKIAQTLVRAGVVEARQGRSGGVRLARDAREIRLGRLVADLEGVGTVVDCRRDPCPLLGRCRLKWAFDAAEQAFFLELDRLTLADVVAGPTAAALRALFRAEPGDGGATPAAPVPTDPTPSN

SEQ ID NO: 2526 - protein, 406 aa, Methylobacterium sp.
MTVTGRRDRVLAALTALSGALLLAVLLGRGALRDAGFNSHGALADAFLHGRLWVERCPEIDCAVFEGRTYIIFPPLPALLLTPFVALFGFPGFKGLVLLGLGLSALSLLAWSRIFRALEVERGQALWLLAALAFASPLYQVTLRSDGVWFFSQTVGFLMMTLSLWAVICRSSLPLAGLFVGLAFLCRQMAIFYPLFLLVLALPRGRPLLANPASVAKSAMLAGLFVAAAIAVYCAYNAARFGSPFETGYAFIHNPGQDSFIWRRITEGGLFSRDYLLFNTLYLFLQGIHFEFGGPRLTELVGFDKAGTALLVASPWLLLAFYARLDRVFAAGAATIAVIAGITLFYHSNGAEQIATQRYALDWLPILIVLMVRGERPPAFAALPILVTWGVVANLAVVTLLALYRL

SEQ ID NO: 2527 - protein, 465 aa, Methylobacterium sp.
MSATGLPPDLLARLDGLLGPGGLLTDDADCAPFAIDWRRLFPGRPAAVARPTSTAQVASVVGLCREAGIALVPQGGHTGLAGGATPDASGRQLVLSLARMNAVRAIDPVGLTLEVEAGCVVQAVQAAAEAAGRLFPVSYGAEGSAMVGGMIATNSGGINVLRYGMTRNLVLGLEVVLADGGVVDGLRALRKDNAGYDWKQLFIGSEGTLGIVTAAVLRLVPRPRHTETALLAVPDPEAALRVLAAAQDGLGDTIQAFELISRCSFDLLERYAGLPSPLPPSPWCILLEAGSSLSGLRDAVEGTLGEVLERGDAVDGVLAESEAQAAGLWGLRERITECEAHQGKSVKHDVSVPIPAIPAFLEAADRALAEGAPGTVPNVFGHMGDGNLHYNVLIGPEHDSAAINRLVHDVVDRFAGSISAEHGIGQYRVDELARRRRPEEMALALRLKRALDPDGLLNPGKVLRV

SEQ ID NO: 2528 - protein, 628 aa, Methylobacterium sp.
MTRRRAGPADQIIRAHAPAAMRPGPQGSQEVSKIMPPSSQAVAEAAAFRSFANGYLREIDPGIRIRHALTDGPPAPCIEWNLRSRRLAIRVEILSPSLCGAQAFGRLWTRHLHEPRWRPVAPMRALQELLGEAYSRTDEGRGDTARERELELLGRVLDSYRETARLLDLAERAAETETGFIAAERALVFGHWLHPTPKSRQGLTTWQARAYAPEEGGTFQLAVFGAQASLVRHDSAVARAAPDLALDLLGPDAAELRLRADEIALPMHPLQAEALMLEPHVAAWVEAGRLRRLGAFGPRFTATSSLRTVYAAESPWMAKFSLPVTLTNSLRVNRLAELKAGVAMARLLAKSGFGTRHPNFQILADPAYLTLHSPDREESGFETVLRENPFRDGAERGVATLAALTAEPLPGRLSRLEALLRQVCPEGSAARAQAARTWFARYLDCMLEPVVALYDAHGIALEAHQQNALLDVASGWPERGFYRDNQGFYLSESARPRLLRDAPETGAIASLYFPDGEIRRRLAYYLVVNQIFSVIARMGHDGVAREETLLDDLARRLEAMARRMTGAGRAFARSVLDGPTLCTKANLRVRLSDRDELASGDGTGNYIDMPNPLLLRAARGEAGHALAS

SEQ ID NO: 2529 - protein, 140 aa, Methylobacterium sp.
MLIGELALVAAAAFAGAALYVGFVEHPARLVLDPASQLQQWRPSYRRATRMQGGLALAATALGLLAWARTGDPRWGLGAALALANWPYTLLAIMPTNRALLAASATDPVVAPLMQRWIRLHAVRSGLGLAAVAAFLWALW

SEQ ID NO: 2530 - protein, 112 aa, Methylobacterium sp.
MTEMAQPCPATILGLIEREKAIENPSHERAAVTPCFVAVTLAGLLASGKPAKDARAYLHIGPSTRISPVVTAPADRPHARSEITIGPLTTFARETPEEVVRAPCVERGPPPQ

SEQ ID NO: 2531 - protein, 338 aa, Methylobacterium sp.
LAHLRVAQAIYAVLVELEADPDTLMIEAGLDPRLFECHGKLVPYSSLGRLIAIAVERTRCPHLGLLIGQRTTITSLGLLGLLLGNSDTIGDALRALEAYLGMLNRGAVVGLGIDNDVAVLTYCPYEPGAEGAVHHSDRALATATNILRALCGSDWAPLEVLLPRSAPSSTTPYSQFFRAPVRFDQETAALVFPASLLKRRIAGADPVLRRRVEDRIRRLESARPSTLKDGLRQHLRAEVIRKRCDVMKTALRLSLGRRTLSRRLRAEGTSFKQLANEAQFRVAKRLLADTKMSMTEISAVLDFSEPAAFTHAFRRWAGMTPSSWRQGNHSETKREEHQ

SEQ ID NO: 2532 - protein, 79 aa, Methylobacterium sp.
LYEGAPAAPSPAVDVEASRGLPTYIVGQDGQGHWVALESQGLGGGYFRSREAAFQYAVGETGRRAGAVRLSAEPLRIAL

SEQ ID NO: 2533 - protein, 652 aa, Methylobacterium sp.
MRNGWVVVGALGCALGAAPAHAGITGIEIASVEPFADGAEFGSAGSYERVVGTARGELDPADPANAGIVDIALAPRNARGMVEYKTDLFILRPKDPARGSGTLLFEVLNRGRKFLFNWVLDAPAQAAQAVNDPKTATDAGTGLVLRRGYTIVWSGWEADALRQQGGMAIDVPVATRSGKPIVEVVRDELVSATRGPPEAPFYLSFKTASPDKAEARLTVRRRESDPPRPVPPDAWHYATPRQIELLPKGTKPLPGSLYEFTYQATEPKVLGIGFAATRDVVAYLRSEGGAANPAGGAIRHALALGISQSGRYLRDFIQQGFNRDETGKRVFDGVLSHIAGVGGVFLNARFGQPSRTNTQHEDHLYPENTFPFSAITQHDPVTGRTGKLLRDDGFDPLLIEANTGTEYWQKGASLLTTDPVGRTDVPLPDTARAYLVSSGFHYGRAGLGSTKGPCTNPRSSLNPAPAVRALLVALEEWVKDGKAPPESRVPRLSDQTLVEAADIGFPFMVGVPVPTAPNAIARFSTYVDPHPESGPQYRPLVPRVDADGNEVAGIRLPAVAAPRATFTGWNLYADPFPAGALCDREGSQIPFARTRAERDTAGDPRLSLEERYQDAGAYVAAVTKSVDALVSDRLLLQEDGDRMIAAARQETP

SEQ ID NO: 2534 - protein, 483 aa, Methylobacterium sp.
MVAEGRDGKVADMSSAGTFRVCEAGGPPLQEALAEAVALPSVLATMLRSLIEAWPDEVYTRPLVTTRFLGQRTTYVCAPGHIRSLIVDQAGALEREPFMLRALAPALGSGILTADGPHWRGQRRTAAPMFRPDRVKAFIPAMAEAAHATRLHWLSQMSAHGSADARFDGERDILPEMMRTTFDVIVATMVSGDSQLKVEPFGRAIDAYLGQTPWKIALSMLGAPAWMPHPGARAGARAVRYLRSEVARTVERRRARGEPGADLLGLLLQAKDPETGERLSDESLIDNLLTFVAAGHETTALALTWTLRVLADHPAVEARILDEIAGLGADPAPEALDRLAFTRQVVLEVMRLYPPAPLIVRRTAEEVRLGDTVIPAGESVHVPVYALHRHQSLWDQPDVFDPDRFAPELTASRDRYAYLPFGAGPRVCIGMGLALTECLVILATLLPAFRFVPAKAEMPATQFRVTLRPKGGMKMKVVPRHAH

SEQ ID NO: 2535 - protein, 67 aa, Methylobacterium sp.
MPHFSKEDLEASAETLANLREILHGRQQGGRDGRPVPTTPTKEGRFGTSGGRGAPVRKRRHTAPAGA

SEQ ID NO: 2536 - protein, 35 aa, Methylobacterium sp.
MRDAVKVVLLDLGVPDGQIRTEAFGTDRRDPTRRT

SEQ ID NO: 2537 - protein, 32 aa, Methylobacterium sp.
MSVQDALSDGDREDGYILACQAEPEGDVELEA

SEQ ID NO: 2538 - protein, 435 aa, Methylobacterium sp.
VSNETLIAAIGTVLREEMQHPHLDGFGPDARLNEDLYLDSVQLLQLILSLELTHGVSVPEEAINRQDVSTVADLARLLAPGAEPVAPVAESETPSEGVHGAMPYDLKIHCFVSCVCDGLKARGIDYRPFYALIWDAEFAITDGSRLAYHSDAMDHESFRYWFERLYSVPLVSWYDHSRSKDENVATLLDLLDQREPDTRIMVMLDMFHLPERENKFNQNPFPHYLLVSLGDDPDLWQVRDPDFRWEGVIERERMLNAIRQPSVAGGYRFDPSRAHPPADTDLAAFFDACFRFDTNPLIDAARAIVLAHAEGRGGLKLTDVGEALRELPVITIRKWAYEHGFAFFWRALRWPDPEFQRICDEIEALVNGLTALHYAVLKLARTGETGEVASVLARLDALDAQEFAIKRQLASAYAAWRQTSPDLGQALPSRERLSA

SEQ ID NO: 2539 - protein, 100 aa, Methylobacterium sp.
VPELQETDMTESRAVVGTPHASRYLQQLCKHWAHRFETEFSPTDARIALPLGETRLSASAETLTIDLTAQDAASLPDLRDVVVRHIERFAFRETLRFDWT

SEQ ID NO: 2540 - protein, 159 aa, Methylobacterium sp.
MREDDAPDLFEIYNQPAFRFGTLALPYESFEAVKKWAEPRSPRDLHLAAQQGERVVGAAALRPFYGRRAHAAEFWIAVHEDFAGHGIGSRLLAAVIDTADNWINILRIEMTVFTDNTRAIALYEKFGFAIEGTHKAASFRNGIFADVHCMARLRPSIGP

SEQ ID NO: 2541 - protein, 50 aa, Methylobacterium sp.
MAQDGVPRLPDAVAAYAAQDVIYGAFIAASCRDSGDPGWRSWDPAERAWT

SEQ ID NO: 2542 - protein, 66 aa, Methylobacterium sp.
MFLSHGTRDAMWSVAMTQRLEARLLQAGRTPEVHLLAGQDHSPHGEDENEHHLRLITFLRRTLEAA

SEQ ID NO: 2543 - protein, 2794 aa, Methylobacterium sp.
MATSLAAGDIAIVGYDADNPDDFAFVVLRDIEAGTAISFTDNGWSSSGNALRTSEGTYTYTAPTAVAAGTVIHPTSDGSAGGPDSPVYTSALAPNFSFSTDGDQILAYQGSDATPTFLYAINFADGATGFAANGTNANTSALPPGLVLGQTAVALGADNGRYAGTLSGTRDGLLTAIGAAGSWSQSDTVRIGAPGYSAFTITAAPTIPALSIDDVQVAEGDTGTRQLTFTVSLNAPAPSGGVSFDIATADGSATAGSDYVARALTGQSIAAGQTATTFTVDILGDTVIEPTETFSVTVSNVRGATVADGQGTGTIINDDTGPRIGGTAIFEAAPSLQGVSGATATAPPVPTNALQLVRLGAYAATNDPATSTAPNAEVVAYDSGTGRLYIQNTAENRIEIASLDATGALSKAGEILLSGLEQYGAVNSVAVFNGLVAVAYANAAGDAPGRVALFDADGTLLRSLTVGVGPDQIVFTRDGSRILVANEGEQASATSNPVGGVSIIDVSGGAANAAVTATVGFEGLDGSEATLRARGLALKPGTGAAADIEPEYIAISPDDRFAYVTLQEVNGVAIIDLTNPGTAPIAIQPLGSVNHSLAGNEFDASDRDGPANPQGTGTPSIRIAATPANAPIYGLLQPDAVASFSTGGATYFVTANEGDQRVIGGGDDTGDVARLSSIANSRLTPELQALKADPAYARLNVLLRTGDTDGDGVIDQLHTLGGRGISIFRQNLDGTITKVRETGGEFEKIFAQIAPERFNNDQVTGNTPDDRSDNKGPEPEGITIGTVNGRIYAFVGLERQSGVIVYDVTDPANAAYVSYVPPQPGATTDLGPEVLTFIAADRNPTGTPLLVSANEVANGGAVVYAALPQGFTQEVAFSANSLAVSRAEGDTGETVFTFTVERSNGTLGAVTFTAEITGSGANAADGSDFAGALPLSVTGTIAAGAASAEVSVRVQADAVPEADETFALTLRSASSNQPGIAAAVRPAAGTATGTIVNDDTSLISAVQGAGAASPLVGRTVTVEAIVVGDFQNGDADAKRNLGGFYLQEEAADQDGNPLTSEGVFVFEGTGNRLVDVNEGDRVRVTGTVTEFNGETQIAVSNAAAIQVVRAGALTPAEVKAAAVAVELPAAGVIGTGTTAQPDLERYEGMLVRFAQTLSITEQFNLDRFNEIRLAAGGRTETFTNAFEPNAAAYAAYLAQTAARSITYDDGLNTQNQPVENLDGFGPVYATATAPRMGDTVTGLTGTLGFGPAGAYRVRAIDDGDNRFVTANPRPAEPDPVGGTLKVGSLNVLNYFTTLDTGSAARTAIGLEPRGANSPEELARQTEKLVTTLIGTGADVLGLTEIENQFRPGDPGNALEYLVGQLNLRAGAGTYASINPGAQLDQGQFLGGDAIAVGFIYKPSKVSVAMNTTIERLDDTDVAAFNPALLQQSTLGHLFNGANTSRAALAVTFNETATGEDFTAIINHFKSKGGTGTGADADQGDGQGAWQQQRELAATALAQWVSMRPTGTQDSDTLLLGDFNAYLKEDALDILKAAGFTNLAEDRLANPYSYVFDGAYGALDHALASASLNQQVSGVTEWHINADEADAIDYNLDFGRSPISFDGRSPARESDHDPVLVGLRLDQTAPVLVASMPADDAARVAVNADIVLRFSEAVRAGTGSITLTDGAGDLRTIAVSDTAQVTIAGDTVTINPSADLRPGTAYDVIVPAGAFTDAAGNASAAIPQNRLDFTTEQAKPMTYTLQILHASDWEGGLLATQRAANFAAIVDRLEDTTPNSITLSTGDAWIPSPFYIAGADPQMAATYNGVYNQFYGLSGAGAYGRLAASPGRADITIQNIVGVQAAVFGNHEFDGGPTEVANIIGANLGAAAGAADDTWLGALFPYMSVNLNFSREAALSGLVHRDGDGATFAQTGPTSTQTGTGADKIARSTILVENGERIAVIGATTQINPLISTLGNVTVDGFTGRDEIALLASQINAEVDRVLAANPGLNKVIVGTHLQQLANEQALAPLLRNVDVLIGGGSHTLLADADDRLLSGDRAGGGYPQFFTNASGQTLALVNTASEYSYVGRLNVTFDDQGHVIRDSINSATSGAVAVDDTTVTQLYGSTSAAFTPGSKGFLVQQVIEGLDVNNDGIQETAGIADIIRQQDGNILGRSSVYLEGRRGEVRTEETNLGNLTADANLWYAKQFDGAVAVSIKNGGGIRDSIGSFSTTGGSTAELPPAANPAAGKAAGDISQLDVTNSLRFNNALAMVTVTASELERVLEHAVSSAAPGATPGAFPQIGGISFSFDATRQAQTVDVNGTVTREGQRIISAAIVDADGFLIDTLVQDGQLVGDANRSIRAVTLDFLTTGTSTAPGLGGDNYPFPAYGENRVALSSAAPASLPNAATFAAQGSEQDALAEYLKAFHSVTPFAQADTAPAADARIQNLAARSDSVLARGVSRTGADGNDVLQGTPFADRLFGGAGDDIIVNSAGDDVLSGGRGNDTLVFNTSFASVTVTEAGSLTATSGPDGRDLVSGFERYLFSDATIVVNDGKPLVDDLFYLSRNKDVFQAGQDADAHYAQYGAREGRDPNAFFSTKGYLAANPEVRASGANPLDQYEQAGWKEGRDPGVRFDNEFYLAANPDVKAAGLNPLAHYLANGQAEGRAIHDAVGRSGDIRGGFDAEYYLLAHADVAQAAGTTDTFAFAARHFEQYGWKEGRNPNAVFDTKGYLAAYGDVKAAGLNPLTHYEQYGWKEGRDPSASFDSSTYLSTYTDVAAAKIDPMQHFLQDGLYEGRSTFADGTFGGGTLG

SEQ ID NO: 2544 - protein, 82 aa, Methylobacterium sp.
MDRFETDCADQDHVVRPDSSSRALVADTPSDAGPRIRGRRPMAGFLTQLIVSADPALRPARLERTKAATALYARNAAFAKRA

SEQ ID NO: 2545 - protein, 67 aa, Methylobacterium sp.
MADRNHHPYSIDVRPCWRRPGRFVCSIIEKGEPRRYGAQSYATFDEARRAAQTRLRQLVFEWQLVGS

SEQ ID NO: 2546 - protein, 409 aa, Methylobacterium sp.
MDVVTMLVMSLAAAAAAAGFLAVEWRILRNPALLLWSAGFATIVLGCSLSPVRAASFLVGVWFANGLLVVAHLLFLFGTARFTGRRIAPLWWGLLLAWAGLLLLPAGIDPTPAFAMTNSGLVALAALRAAHLLLSRAGTPFPERTAASDALGAVFLAHGTFYAAKALLVPVPGAFVSLVGFKGVLIQVSLFEGILVEMLLALLMAAAVRRRREEAMTALAERDPLTGAFNRRAFESRAAEALRDMAAGRQSGALLLLDVDRFKTVNDSFGHAVGDRILVALTGVLEACLPRHAILARLGGDEFVILVPGLDEAAASALGAAIRDRMARESGRGLPTGATVSLGAALFSGGPAGLDTLMALADTALYEAKAHGRDRLQARRLEPPAERVPDRSGPGAAKANMSTQGGCCA

SEQ ID NO: 2547 - protein, 92 aa, Methylobacterium sp.
MFAIAFDLVVVETQAHHPKGIAQAYSDIRAVLARQGFNWVQGSLYVSRDEDLAKLFAAITALKALPWFPASVRDLRAFRVEQWSDFTATVKG

SEQ ID NO: 2548 - protein, 346 aa, Methylobacterium sp.
MTSAPEPAADVYEGRDGWLFLIRGNNRVLEQYGRPGVSRRTLWRWRRIIETRMRRCARLGATYFHALAPEKLTVYPERAEGLAFDPARAPALRLARWLTGSPGVRAWVDLTGAFRAAKDGPPLYLRTDTHWTHQGCVLAYRTILARMGVPPRDDIEARRERIALPFTGDLGLKFMPHRSELAEGSAIASEARRIHANGLLLEMEALGRGGDAHLGAHAVFRNDDPGADPRRLVIFGDSYAQHTPHSPVATLTALFADTFREVHFLWSTGIDWHYLDAVRPDFVLGEMAERFVIDLPPHGIRIERLAELARERKLMGEITAADSRSPAPLPPDAPASVPEAADAAPR

SEQ ID NO: 2549 - protein, 441 aa, Methylobacterium sp.
MANRLSSLGASLRWLRGQRPGRRSDPLPSHFDSERYLDLNADVAMAVEAGLVASAEEHYRVFGRHEGRPIQVPSATAELGGGIAGQWTYRYPYRAWPELPAIAFAAPRPGPEDDAIARRLIAAWQSGAGRAPVQADSEGMWAARSQGFPDFHRALQGGDAGALAGLLNNLFQSHLAHGIAMGRTMATLARHAPTPFAASWCDRLLRLSEAVGLAPIRSPEQGDYAAALPGPLAHHVAPAHLEAELGFPLAFPEVGAPFGVRYGAGILPEHALTHAYAAWRVGQLGRFDRVVEIGGGFGGLAWFLRHPDRRYTILDLPFTNVLQGWFLLKAGLDVSLAGEQDTAIRVRPWWEIERNEHYDLAINQDSLPEMPPETAAMYIARIRAIAPLFYSINQEAAAPNTDAFRQAVVADLVARDGGYRRLGRHLFWMRDGYVEEIYARR

SEQ ID NO: 2550 - protein, 97 aa, Methylobacterium sp.
MDESRKHDSLRDFNANADRNGQDFGQDSPLDVARPADLQRALQEDPGGEAQVARTASDFDRRDSVAGGSIESVEATEAETPPENLRRISDPSYTPKR

SEQ ID NO: 2551 - protein, 149 aa, Methylobacterium sp.
MTETPNLKIPHGGYVVVGDGRRALVLRNEGHALHLALRVQHVFEAPPNPPTREQGTDRPPRVRQGEHRSAIEQTDWHTIAEERFADEVAAALDRIADAIPALIVVAPPRTLASLRQALSERLKRVVIAEIDKDLTKLSIEEIGRRLTDG

SEQ ID NO: 2552 - protein, 220 aa, Methylobacterium sp.
VTAQVRSLRPEAEKHFIDALRRRYEEQGFAFTSEPDPKQLPGFFGSYVPDALAQKSGRNIVIELKEQATSSTQRALSEIRRLFEDHADWQFRVFYTGTDPQQAETVAPASPDLIRESADEVKALAAQGNLRAAFIVGWALLEAALRARRDGLESLSRKPGTVVQTLAMEGFIEPPAERRLRELIPLRNRIVHGDLTVEPTTAEIEFVLATIENVLDADLS

SEQ ID NO: 2553 - protein, 74 aa, Methylobacterium sp.
MEGDIDNIVKPIMDALIHVACMTDNDVERIVVQKFEPEVGCAFTDPSAQLVAALDVPPPAVYVRIDDDLSWRFL

SEQ ID NO: 2554 - protein, 248 aa, Methylobacterium sp.
MPPNRDAVPRMLSAVIFDVDGVLVDSPHEQAWREALAGFADPAGFTTAFYQAHVAGKPRLEGARATLERLGDAEAAAHAAAFAERKQAVIERLIAEDRFVAFPDAIRLAFALRDAGLRIVLASSSKNADATLARVTLPDGRTLRSLFDADVSGRDVPRGKPDPALFQLAAKAVNVPPAECLVVEDAPAGIRAAQAGGMASLGIARLGDEALLRAAGADLVVTSLDQLDVAALGSGSLRTRSVEAANDP

SEQ ID NO: 2555 - protein, 154 aa, Methylobacterium sp.
VGLAGTAASAAGLDCGPPSAPHPEADAVLTQAIVSPQPETNAGTALASAIQRLRAQGVPRTVIVDRAVAAYCPLVARDESLTLDRQREAVRRFASALTSLVYDPPGPNEGETAFILSLPVKPALSLQIDAAAAKAGKTREAWILEAIQARLAGD

SEQ ID NO: 2556 - protein, 201 aa, Methylobacterium sp.
MQPAAQSVERGGEGTMIPVSRRLGRAILSAAAGLLLIVPAAARAPDFDFPAEVAGFSRGPRTDYEARAPGLGYSVVYTNGRWKADIYVYDAGVANIPDGASSPVVTGQLAQAAGDVRTAVAQGIYRGSEDRGAERLPGEAGARLTCRAFTIDHPALGATESLLCLTGLRGQFVKFRLSGPAAKQPPKAEAERFMTGWLDRQ

SEQ ID NO: 2557 - protein, 63 aa, Methylobacterium sp.
MRKPEKPGADAGKTHKGGALGNIDEQTGHPGKGTPGATLKPEDNPDPSKDFKPETPEDRKPKG

SEQ ID NO: 2558 - protein, 652 aa, Methylobacterium sp.
MTSLVGPLAGSALFPFTLAAVVMAGLVAVEALSLLLGQSLSGLVDGALGHEAGSGGDLTSAADADAAFSPAAVMSWVNLGRVPFLILLILALAVFALAGFVVQGLAAAVIAPLPALLAVPAAGAATLPALRVSTKAIARLIPRDESYVVSADDLIGATAEVTLGPLDQGLPGQVRAVDRHGNTHFLRTRAAPGAPAMEAGARVLIVDRANAVYVAVIEAKFVDALRSVAAGMTLPDLQEKRAAFVKGVQEAVSGDLRHNGLELESASLTRLDQTSIEHFNPDNSFDAEGLARLKEITEQRRKERNATERDAEVAVAEKDRETALKQLEIKRTTREAELAQERDIANKTAETRAETAQAEQRAQQSEETARIEREQVVRLREAEARKNSEGARIEADLAIAQRNAEAERERQLILQDNAIKIAERSEKESQARAAAKAAEALAVAAEERVATAKAKEIAEREREVTVIAAKQEAEREATGVTVTAEAERRAAEDRANAIITLAEAEATAAASRAEAIAKLGQAEAERERVMNEARNALSAEARAFETNLKRLGIIPDALRESMRAVEKIDSIRIFDAGGMMGSGNGAGGVSANFGDSLSGHLLRYQYNSPILGAILNEAGFAEGKGSLDTLVGGLRNGTAVEPAAKGHAAAAE

SEQ ID NO: 2559 - protein, 353 aa, Methylobacterium sp.
LNPTAQGPLADEDARTEDAKLAREVARHCAAFREPIPRMAFRQVADTLLPYLILCAAMLVAAANGYALLALPLAVPAGGLLVRLFIIQHDCGHGSFLPSRRGNDWLGRALSLLTVTPYDSWKRAHALHHATTGDLSRRGTGDVHTLTVREYLALPRWGRLRYRLYRNPLILIVLGSPINFLILQRLPTGVGLPWRTAWRDVLALDAVLLAAFAVLALAAGGIGPVLWVFLPVIAVAAWVGGWLFYVQHQYEETVWEEADAWDFHRVALGGSSYYALPRVLQWFTGNVGLHHVHHLNSRIPNYRLQECLDGHEVLGRVGRLTLRDSLRCLKLALWDEEARKMVGFARVRGLQAA

SEQ ID NO: 2560 - protein, 82 aa, Methylobacterium sp.
MPAHISSAPAAAVTDGTSSQASRRSRSRAAAGRLEAARHGFERSLITLRRAALDAIDSGDLASLTLRVCGDRRRHAGGEGAA

SEQ ID NO: 2561 - protein, 471 aa, Methylobacterium sp.
MHKLLIQLGLRFDDPHEEQSFVRSFTLDDLGRTQAAMVLGAFVFCSFSAMDWILSPDAWAMATALRLAVAVLVLVPATLLLSRPDARPFAEWIYLVYCVVPGCMLSLIYVFLRPSFDHGAAGLIVVILFVSTLLPLRVSSFGVFAALTWTCFALFETIATHDNPGLALVNNAEIGAAYALSLYGVGAREFRARRQFRTTGELQVEKERSEATLAELRAAQAQLVQAEKLAALGQLVAGVAHEINTPIGLALTTSTAFDHDLAELRRTVASGQIRRSDLTRSVDRLSEGAGLVFANLTRAADLVQNFKQVAVDQATEDRRRFEMRPWLTELMSTLDPILRRKGHEVRLTCPDGILLDSYPGALAQVVSNLALNAVIHAFPEGRTGTLLVDVSRLGDTQIRMTVRDDGRGIPPENRQRIFDPFFTTGRDKGSTGLGLHIVYNLVVSTLRGQIAIDSEEGVGTGVTIDLPVTVP

SEQ ID NO: 2562 - protein, 318 aa, Methylobacterium sp.
MNQLATLARFPAPALVAAAGDRAAYRFLEFFTAQIRNPNTRRAYVKAVGEFCTWLERHGLPSIAAVSSIHIAAYVEELGRSRSASTVKQRLAAIRMMFDWLATGGVLPFNPASAVRGPKHVVKRGKTPVLAPDEARAILDAIDVSTPIGLRDRALIGLMVYTFARIGAATAMRVEDVYVQNRRLWVRLHEKGGKAVDLPCHHNLETYLHAYLDGTGIAGDSDGPLFRTIRRGTAELTRTALPAANAYAMVQRRAKAADIATRIGNHTFRATGITAYLKNGGTLERAAAIANHASTRTTQLYDRRSDEVNLDEIERILI

SEQ ID NO: 2563 - protein, 84 aa, Methylobacterium sp.
MLRKPTLTLLSVLAFAGGILGTTSAAMADPPWARGGGRGFHHGGPPPWAPAHGWRRKHDFGGYGGRSYRSSRYNDGRRYDRYGY

SEQ ID NO: 2564 - protein, 258 aa, Methylobacterium sp.
MALGRRMIGWLRRLLGQDRPPPHPVPAWEPEPPPPVPAWEPEPQPPQRRSEAEIDVVEAALNGLIAAGLRLGPHYEGMDRRAVARAMAEHLEFAVGDGNETLPLTEHSSDALSIDILWSYRALADAIEDEFANAAIFEDHCYDGADEETYRALFARLIELAGAWTGRGVTVSRVPGLGPYGHGFRIAFETQPPIPPLTFPADKNFDWSLLERLDACRPAGETRRFRIAADGGAGLVLFLDDTEARAIAARLGWGPDDL

SEQ ID NO: 2565 - protein, 73 aa, Methylobacterium sp.
MPVRMTQETQDVIDGRRQVVVRVLFGRPDAGRDIVEVSATVRVPAIESETQTEAAARQMARRALEQALSAFPL

SEQ ID NO: 2566 - protein, 55 aa, Methylobacterium sp.
MTGLSLVICGAIGVGLLAMLFLLHELKNAPYDDGLEPEQVVPELEKQRLRYRSFD

SEQ ID NO: 2567 - protein, 367 aa, Methylobacterium sp.
MSRLGLYAALLGIALMANDPVAAAPDTAPVEAAPATEAALGERMNANTVTVVTGTPGGTYFRVGAELAFVLDDGDKLRILPMLGKGAGENAYDIRFLKGVDLGFVRTDTLDQLRQDKRLSNIERQIQYIAKLFDDELHIIAPNSVRTVSDLAGKRVSFDVKGSGTDYSGRAMFRELGVTVEGINVDQPTALEMLRNGEIQAVVSVAAKPVAFIAGFEPGERFHFVTAPYPDTMNEAYVPATLTRTDYPKFVGEQAVETVAVGTVLGVYNSPKGSARYEKLVRFVDAFFGQFDKFLAPQRHPKWREVNFAASVKGWRRFRPAQEWLDRHKEQEAATQPDLDRFFQSQPERPAGKEEIYQAYLKWRQAR

SEQ ID NO: 2568 - protein, 43 aa, Methylobacterium sp.
MTRAGGTVRLPRRSLFRSGVGPRLAAALILSSLLWAVILWAKS

SEQ ID NO: 2569 - protein, 278 aa, Methylobacterium sp.
MRIALCTISFRHHLVSIGELARFARGHGFDGIELWGVHARNLGPGDHAEWLAAYGLRVPMLSDYLPLDAPLETLTERTAELARLAGSWGAPRLRTFAGTKGSAAASADERAHVAQRLRMAAGQLADQGLRLVVETHPGTLADTTASLLDLLDAVDHPNLRVNFDTLHVWEGGDDPLAAHARLSPHIDYYHLKNVRSRADLSVFEPANVYAAAGRREGMTGLFEGALDYAAFLKTLPPQAEGSLEWFGEASFSVLPTDLFRLRSATAGRRGAGALHAAR

SEQ ID NO: 2570 - protein, 105 aa, Methylobacterium sp.
MHNPMLRPLFLRQAILAAAAALALTLLPASLAQAQSMPGATVGLPMGSPDPFGLSTVNRPSGYSAEPYAEPGMDPAERRIRPRPQRRLKSHRTSAPKRRAPMARR

SEQ ID NO: 2571 - protein, 352 aa, Methylobacterium sp.
MQGQMQQADPDLDRALAPAHRAWEALRQYALPPSPRNYELLHTFFAGANPPLSERLAACLAPGGTLTEEQASALYDACIAGTGTEASVLDGAGRLAEAAGTLAERVAGSRRALAGYGDALTHWSGRLNARPTADELMTALVALIGETEQAQTRNHLLEEQLSASAAHIAKLHKDLVETQRAAATDALTGLANRKTFDGFLRDSIARTRSDSGSTFSLLMLDIDHFKGLNDRHGHRFGDQVLRLVGRLLSAKTTDRDLAARYGGEEFAIVLGEAGIGAGVALAQEICGRLRGQRLVKRGTGDVVAQVTISAGVAQYRPGEAARDVIERADRALYEAKRTGRDRVCPTPRAAVA

SEQ ID NO: 2572 - protein, 379 aa, Methylobacterium sp.
VTRSGTLPSRLTYRLLPEPADLAEVFALLAAYRRMLVLLEEIRREHGLRANVVALIEHGYQRVRDETGLPARLVTLGIRDFAQRAAGFDPETVTSMPLDDKLFSVKGASEIALTTMNGRRTMPYRVEGYDGPWRELSSARLTIAGDALTIQVGVSVTAPQEETRMTENILTRVGRIIGGLSNAALEAVEDRNGLAVAEQALREIDAVIQEARLDLGKIKAEEHRLSARRGQLDGELRALPEKLSLALSNGREDLARAGIARQLDLESQIEAIDSSLADVAERHGAATKAMQAATAARRDAEHRIALLRKPPAKAADLLDGYGSEEATRTRQLEQSLQAIDRVTGTASAVADPSVEELDRLHRDDTIERRLAALKQGRPS

SEQ ID NO: 2573 - protein, 73 aa, Methylobacterium sp.
VAIVLSVVMITMYFGFMTMFAFAKTAMGTILMPGLSLCILLGAGVIVGSFVLCLVYVVWANRFYDPAVRRIMS

SEQ ID NO: 2574 - protein, 522 aa, Methylobacterium sp.
MQAANNPLAVTFFFIFMALTLGITYWAARRTRTTEQFFAAGGQITAWQNGWALAGDFLSAAALLGIAGIITSHGFDGLIYSIGFLVGWPIISFLIVEPLRNLGKFTFADVVAYRLRQRPVRMAAAIGTLTVILLYLIAQMVATGSLIKLLFGLPYTASVIVVGTAMLIYVIFGGMLATTWVQVIKAVLLSLGGLVLALLVLAHFEMNPLRLFSAAADKYGERVLQPGSKVAGSGWDAISLGVGLMFGTAALPHILMRAFTVPDVKEARMSILYATGIIGSFHLLVFVIGFGAMVLVGPEAVTKAGGGGNMAAPLLALTVGGNGFFGFICAVAFATMLAVVAGLTLSGVATVCHDLWVNVVRNGHAPEREQLTVARIATVAIAVLAVVLGIVFEGQNVAFMAGLAFAVAAAANFPALLLSITWKRFTTAGAVASILIGTFASLLLISLSPTIQVDVLGRSLAEVSQAWWFVPMKNPALISMPLSFLVAIGVSLVTKEDAADSTFQEMRRRIMFGASRTAYAGR

SEQ ID NO: 2575 - protein, 88 aa, Methylobacterium sp.
MIAASAVLSAGLVAGLAATDAAAGPKPALSAAPIQAPAAMASKVSAPKATALKGETSTTAPCAAAWPYQPAACAADGRKVRIIALTAR

SEQ ID NO: 2576 - protein, 295 aa, Methylobacterium sp.
MSDPVQGPVQDSLQDPVDAERPDIVVLALARNCAATLPAFLRFLSSLRDAGLDCRALVGENDSRDGTGAQLWAAQARGELSHVPTAFMSDIRGRLARMARGREHLKRVLDGQGPAPAYVCVADIDNVMARPPEAGAVLAALAKLERPGLFAVSAASQPHYYDLLAYEDEAVSYEYLLDDIARHRRGALGYYRFFSDTIYPAQSALTREREATCLSAFNGLTLYRGADYRLGSYLDDDYTRCEHLTLNRRIAAATGRRMLVDPGLVLRTPGDHAQRGFLSFYASRVRKMAVARLRG

SEQ ID NO: 2577 - protein, 423 aa, Methylobacterium sp.
VTRRGRAGGAGLGLALLFAAGLPARAAEVTLGSSRFELPVMFEGWTRREAGDGLVFERLFEPTAPRGRKGAALLIVAKPKPASGRFDETFSAFVRSLKQIPPGEKPLTAKAGETLDGHRIRVEQRCCRTTDGLRMAAWHIGIATRTSEHFLMLLTLQLEREQQNPIREGFEALVGSYRPAKDDRGLVLAPVRGDGGLDGLYTRTKTQLRPNAFGGMDFTADQDTLLFDKGGLYTTELPRDGDMAAHCRAEPATCGTYALKGGWFSANRIERVEVEDGFGRVTRSGEAFSRTKEALTIGGDTYVAVPPFADGYRFDGTWSHTFGSSGAMGSVGGTHSLALTPDGRFTREGGVGFSSTGGSMDGGTVVAGHSRRPVRSGRYTVSGYRLTLTDDAGTTEALSLFAPDRGSDKLLIIGGANYLRQGR

SEQ ID NO: 2578 - protein, 83 aa, Methylobacterium sp.
LKIALVGGICLLASTAANAMNHPAQTGTGGGPETTITAPHVAPTGRVIPRPQVFSSPTSGEAGQKPEPQFKDSFLMKDICVGC

SEQ ID NO: 2579 - protein, 290 aa, Methylobacterium sp.
VLRACDLGQHDGPHLGMTFFRRTLHNHPQIKRALKSVAKSVGLFRSSPANDFYRDLAEVKTRGDDAFSKLFYGYDGDHLINKWNHFLPIYSRLFAPFRDGRPDGRPLRFLEIGVYEGGSLDLWRRFFGPSAILYGVDVDPRCAVFDGRAAQVRIGSQADPAFLRSVVEEMGGVDVVLDDGSHVASHQRVTFETLFPLLAPDGLYVAEDLHTAYWRDYEGGYRRRGTFLEMTKGFIDDMHAWYHDRGAQEIGRSIGAIHVFDSIVAFEKGGGERPFHTTIGTPQRAIDRVR

SEQ ID NO: 2580 - protein, 49 aa, Methylobacterium sp.
MASKVLLALVVFVFLVDGHLPGMRELRNPDSEGGKGAGRAALLSKRSEA

SEQ ID NO: 2581 - protein, 73 aa, Methylobacterium sp.
MSVVLRSIEIETVRYVRAPAGPVSRAEAAGAGLPASAGVVTDIARYRTIGSLQALGLAATASVVTIALLWLAV

SEQ ID NO: 2582 - protein, 206 aa, Methylobacterium sp.
MVETQLVARGIRDAGVLDAMRAVPREAFVPDALAGEAYDDGPLPIGAGQTISQPYIVALMIEALALRPGDRVLEVGAGCGYAAAVLARMGAQVFAIERHAALGEAARARLAALGLTVSLRVGDGHAGWPEAAPFDAILVSAAGSTIPEALKAQLKPRGRLVIPVGPPGGQTLLRLTRRGRDRFESRDFGPVSFVPLLRGVGTADPV

SEQ ID NO: 2583 - protein, 226 aa, Methylobacterium sp.
MMLEILRRLFQSRRVKAQSQAPSDSPLEAIDRADTAERIEILARGGFETEASTLKTILDEYLNPDEIDPEDRRWVEAEVARAFARKRADEATWPLETDFDRLAIAFDALDASGIIALHDAGYTRSDGISDAAEIYHQRRERGRASRGFVFYHGQDVEAVVCDRGLYLAFGAFDDREATMAAIAAEIVAAVEAQGLRTHWEGDVGTRILVHPIHWLKRSPSDDPRAA

SEQ ID NO: 2584 - protein, 71 aa, Methylobacterium sp.
MISLALLAALTAGVANIALVTLVANRLGPKADTAAAGEFAAVGGAAPASAKRAAVKIGNENVLPVGAQRAA

SEQ ID NO: 2585 - protein, 66 aa, Methylobacterium sp.
MSIAKVRQPEEQWIELPEPNLDRYMLHSCSRAANDNRRPAGEIFRVVQIGACVVLIGATTLISALI

SEQ ID NO: 2586 - protein, 373 aa, Methylobacterium sp.
VGQFGLVEDANSAAFDRLPDLAIGLPLPVEGTHRERMSRYLSLCSRTENPIPGAVFVRAGAESSCRHPCRGARIVLRAYGDEPLVLLHLTPTNLEGRLHLLTERLNDVRRVMQERKRREIEMQALLTERSRLLVHLEEDAQARQRAEAERDAVLSRLYRAGQDERRRLARDLHDHAGQQLVTLTFGLRKIASRLSCPTAIHEVEQLLRHTQDIGQSLRRVTLELRPAALDEFGFVTALRSLVDEWSRVTEIVTEFQIVGEEVDFPLETAITLYRLAQEALTNVAKHAGPGVCVSVVLRFSALQVTLTIDDNGGGFAADEAIATSLVSQGKLGLLGMRERMALVDGTLNIESAPGRGTSIVARAYRSVEESGHA

SEQ ID NO: 2587 - protein, 222 aa, Methylobacterium sp.
MPRTLIHVVLADDHPVFRHGVTSLIADSGEIVVVASVETGAAAYRAIVQHEPDVAILDINMPEMNGVTVLRHLARTGTRTQAIMLSVYESRVYIDQAFEAGARGYVLKRSAFQNIASAVRAVHAGGIYLDPALPERTAPHRRLSSSVDEAACSTLSERERDILRFVAFGFTSKEVADRLGATPKAIETQKARACTKLGLASRAQIVQFAILQGWLHGEIPLR

SEQ ID NO: 2588 - protein, 704 aa, Methylobacterium sp.
MSPLLTRLLASVSALGVSTLPSHALDPTAIELEELQVTAQGGSANSVAAVAGPAANLKTQISSSVLALPGNSTVIDAAEIARLPVQSYGDLFRPVAGFDVSNYGQGGVGYGIALRGFSDAEHGRDVAVFIDGVPINEVSSIHTPNYVDLNPLIPETIRSISIVRGPFSVEAGDANLGGSIFIETKRAEPFSTVGASGGSFGTGRGLATFSQVGPGIQPFLAYEGYGTGGYRENGDLGRYNAFNKVTIPLDLGSSLSLRVQMYGTGFGQPGYLERDRVRAGLVSPRAATNITDGGGKTLQTFVANYVNGGPDDELSALVYASHDVFSRFSDFGAGQRGQVEERETVGGRIRKVWTTSLFDALPTQVLVGGDWRSDALDANTGPSVARTFTARTLDLDLSQHNLAAYAQVQVKPAPWLKLTGGARFDQFFYDVRNNLDPALSPKVSPNVVSPKGGAALTPFDWVELFANYGQGFRSPSASSELTNNPRLTPLTIESTEGGGRLVFDRFSLLGTVFFTDIANEVFQPAPGLPVQNLGKSRRDGFEIEAKVLAYREGLDRVALFANYSGVSARLLNGAPSVFIPNVPAYLATVGAEFDVAAPAALLPRGRLTGAAYLSYIGAKPLTEDGLLHSSPYPRVSGRIAYVHESGWTAYGQATWYPGDRTSESIFNFGSSVSASAAEIFTSPQPRLTLLAGITSSFATGAPLR

SEQ ID NO: 2589 - protein, 400 aa, Methylobacterium sp.
MRDSILVVNAGSSSIKFKLYRIEGADLAPSLSGGMSGIGSTPSLKVTDGSGALLEDRRFEAGEVPDASAAQHHLADWLVHHLGDTTIVAVGHRVVHGGADFAEPVLIDDAVLRRLETFIPLAPLHQLGNLDPIRVLRQRRPDLPQVACFDTSFHRGHPELSDRFALPRFLYDEGVRRYGFHGLSYEYVAGRLREIAPEVADGRVVIAHLGSGASLCALKDGRSQETTMSFTALDGVPMGTRCGALDPGVVLHLIEHRGMTPAEVGHMLYYESGLLGLSGLSNDVRTLLASDRPEAALAVDFFCRRVAQAAAALAVTLGGLDAFVFTAGIGENAPEIRRRIIADVSWAGLILSNDANGSGVARLDASGSRAQIWVIPTDEELMIAKHTMRLLDRIASGTRA

SEQ ID NO: 2590 - protein, 436 aa, Methylobacterium sp.
MTMTGMFTLRVWVAAATLSAACPPAISTAFAQAEPTGPPVVGIIAARKEPITQTEQFIGRIEAKQRVDIVARVTAFIEKRLFVEGTDVEEGALLYLLEQGPFQAVVAAQKAQIAQVEAQLENARLTTQRARTLLGGPAGQQSTYDAALANERALEAQLQGAHAQLDTAQINLGYTEIRAPIAGQIGRTSLTIGNVVGPGSGVLTTIISQDPMFVTFPVPVREAINLRARYGPTGGFGAVLIRAQLPDGRFYDHTGTLDFVNNTIATNTDTILLRGVLPNPPIFGQTRSLLTLRELTDGEFVTVFLEGVEPVEVVAIPRAAVLADQRGSYVYVIGQDNKAEERRIQLGQSSTTLAAVTGGLKVGEQVIAEGLQRVRAGETVSPKPADAILQRMMRNSAVNADRAGPAASVSPPAGHAPTGAASGAGPSASGSPNSRR

SEQ ID NO: 2591 - protein, 55 aa, Methylobacterium sp.
MAETKQTDKVEAPDRPRLTPQGHSSGTASGEDSTDPQGGAKQGQSDKAEGERREP

SEQ ID NO: 2592 - protein, 332 aa, Methylobacterium sp.
MRSEPAVSSQRLHRAEDRPCIEPVQLSGVAGVTAPRLDLERSATGRGGAPRVPARIKDLKAKDLKAKDFRAALAGGEFSLAYQPIVSAATGAITGCEALLRWQHPFLGPVSPADFVPLAEETGAIRPIGAWVLEAACRQAAVWPDFCRVSVNVSPVQLQDPGFAGRVVAALRASGLAAGRLELELTEGVLMGDVAVALEGVAALRALGVSIALDDFGTGFSSLGYLQRFAFDRLKIDRTFIRGLGEARESWFLVRTMHDIARHFGMAVTAEGIETEDEARMLREIGATELQGFLFSRPVAGAVATALLSEQAHRLRSGEAGPPAKSSDHPVP

SEQ ID NO: 2593 - protein, 141 aa, Methylobacterium sp.
MLDATDRQLIALLRTEARMPVAKLAAALGVTRATVRARLDRLVTSGIITGFTVTVREVEPGGVRAVTLIEVDGRHAESVIRRLSGLPEIRALHTTNGRWDIVAEIEVPTLGDFDALLRTIRQFEGIANSETSILLAARKGG

SEQ ID NO: 2594 - protein, 84 aa, Methylobacterium sp.
MIRFPILSALVLGGLSLAGTATAQAFPNDEASVRYRQLIQQLPPSERPRPHDPRWTTNGLSPSVGRFGLPLSGPAARGGMTAIR

SEQ ID NO: 2595 - protein, 216 aa, Methylobacterium sp.
MLRIIIADDQRNFRIVLRRTLELNLSGIVVVDVSNSSELINSLRSPLKTDLVIVGSRLLPAGDPTYLGALKRAAGTARLLLVVPHASADLFQDALSLGFHGLIVRRQRHEEMLEAVRTTLDGRLYAPTTILAVKPPDAGSGLRQPERSVRTFGLTLRQREVLALIGKGLSNREIAIALSIAEATVKIHVSAVIRMLGVRNRTEAALLAPTILKGKA

SEQ ID NO: 2596 - protein, 51 aa, Methylobacterium sp.
MVASVACLVAGVGLAAQAHRFGARAALAETLSGLLLILGLGLIGLGLPVFR

SEQ ID NO: 2597 - protein, 249 aa, Methylobacterium sp.
MALTTSFAERSTQPRDNQGNNNLVVFLWATPWKVLGGQLRFLQSFPFNAASPQGGPWQAGLYQPLTTAQIAWKINDNLGVSYFLGGFWPSDTLLALRSASIAQRFAISYVGDGWNVTANLHYGTMLAENSPTNVHYSDYLNLDLTATKRFGKWSFGAVAFGSTDLPTNRRGYRPGGQVAMGPLVAYAFDKFTVQSFVTRDIAQRNLGGEETRAWLRFLVPLWRPDKGEQVPNRVLVRRNSAAGPAIAGQ

SEQ ID NO: 2598 - protein, 343 aa, Methylobacterium sp.
MRRTRPGPRARGALLAILLATGFAVAAPPPSFAQSRLKQLIDRLRGQKMPDGIAKSNGRIEATQVDVAAKYAGRIAKLLVKEGDEVSAGQVVATISSPETEAQLRGAQSQVLRAKKSLAEAVALIAQRNSDLTFADADYSRGKELVGKGYMAKQIFDQRKAKAEAAKAALDAAKAQEDQAKFAVQSAEADVQRLEAMLVDLVLRAPRDGRVQYRLAREGEVVGAGTRILTLLDLSDVYMTIYLPASQAGPLALNDEARIILDPVPQYVVPATISFVAADAQFTPKSVETEEEREKLTFRIKLQIDPQVLKTYRKRVKTGVRGIGFVRIKGNVAWPPDLAVKLP

SEQ ID NO: 2599 - protein, 162 aa, Methylobacterium sp.
MDLDSPCPITSESGLPVQPSEWAMFGVEVRLDDALGLVKQAADTIHDLQRWKEMIEPQALNLIQSVQQERVRWQSERSALMNEISECRLTITATKMALRTALSEKEILSRRYHEAKAAAASSETRACAAEELLAFIYKTFNVELSEHPATGRIAQIPFDPAG

SEQ ID NO: 2600 - protein, 179 aa, Methylobacterium sp.
VEQSLVDSRGDFCGSQIRLDREIFMDLVVTTMGSLFEDTVGSSEAGSFISLVGLAVGEKIQEEYLQVSGASQLDRKGMVDALLDMKQRIGSDFYVMDESEQRIVLGNKRCPFGELAKKCPSLCMLTANVCGHLAAESQGYARVDLPETIAAGASECRVVINLDPNTTGSGRRYHRRAWA

SEQ ID NO: 2601 - protein, 329 aa, Methylobacterium sp.
MRALLCAGAALLGLAAGGARAAEKVTLQLKWVPQAQFAGYYVAQAKGFYKEAGLDVTIKPGGPDVAPPQVIAGGGADVVVDWMPSALASREKGVPLVNIAQPFKKSGLMLTCRADTGIKSPADLKGRTLGVWYAGNEYPFLAWMAKLGLKTDGSPGGVTVLKQGFNVDPLIQRQADCVSTMSYNEYWQVIDAGFKPEQLVVFRYEDQGVAALEDGLYALESKLKDKAFVARLAKFVAASEKGWAYAAAHPDEAAEIVLENDASGAQTETHQKRMMREIAKLLDTSGGRLDPADYERTVAILLAGGTDQPVITRKPEGAWTHAVTATLGQ

SEQ ID NO: 2602 - protein, 441 aa, Methylobacterium sp.
MPRPLRRHEPQSRTNVAFSVGPRIVAGFIFGAALVGGVGGWAATTDLSGAILASGSVAVDQRAKSVQHRDGGVVGEILVRDGQPVTASQVLLRIDDAQTRAELAIVKGQLVELAAKKARLLAERDGQREVSFPQALLHQGAEVQSILEGELRLFQGNLAGRDSQRQQLELQIGQIAEEIAGLTKQRDAKRDELAVLTTEHGKLSILVEKQLYESSRFLPITRDKHRLAGEQGSLEASIARAKTRTSEIRVQILAIADTARTEAQRELSQVDAKAAELSNRRVALDDRLTRTEIRAPVTGILHELKTFTVGGVVTPADILATVVPEDARLKIEIRIPPTSIDQIGVGRAARVRFTAFSQRTTPELKGTLTYVSPSTTKGPRDEAFYIGHVELKDGEIERLGGSARLIPGMPVEVQVATDERTAMSYLMKPLQDQFSRAFLER

SEQ ID NO: 2603 - protein, 264 aa, Methylobacterium sp.
MRGPLIQDPRVQAALPPLLVGIAVLSLWEAACRGFAVPEYLFPAPSVIAASLLQNGPDLLRALWSTMRVTLIAFALSTVLGTLVAFLFVQSRFIERGFFPYAVMLQVTPVVAVAPLIIILVRDTQVALVICATIIAIFPMISNTTVGLRSVDPGLVNLMRVYRASRLQTLLRLRIPSALGYFFAGLRISSGLALIGAVVAEFVAGTGGRSAGLAYEILQAGFQLDIPRMFAALSLITAAGILLFLAMSGLSRLALGSWGDPERP

SEQ ID NO: 2604 - protein, 422 aa, Methylobacterium sp.
MAQVVRRLWVRATLIGSAGVLAALLAAVAERYLPWTVPGAISTDALDSILTVIASSMLSVTTFSLNVMVSSYGSATSNVTPRATKLLIEDRVTQTVLSTFLGSFLFGIVGLVVLKTGAYGESGRTILFVVTIAVIVLIVVALLRWIDHLTRLGRVGETTDRVETAARTAIEARLRDPYLGGRPLRDPDRRIPAGAAAVTVDAIGYVQHIDMAALSKIGEAHDIEIFVAATPGRFVHPETPVAWIGRPEAGEDGDTLRRTVGEAFLVGNERAFDQDPRFGLAVMSEIGSRALSPATNDPGTAIDVIGRSTRLVSLWVRGTTAPEEDEPKHPRIHVPPLDTADMFEDAFMLMARDGAGLIEVQLRIQKALLALSRIGGEASRAAALHQSRMALERAELALTLEADKIRLRVAAGAVEAVDASPA

SEQ ID NO: 2605 - protein, 470 aa, Methylobacterium sp.
LVRLAAALGSLIPVAAFAQVAPGQTLQQKPYFALYEALGKPENWKIQGSFRPRAEGLGGQFRPAPAPATNDLFSMQTTLFAEYDSGPVRFGGEIFDSRAYFQRRNSNSIATTEVNAFELGQAYLGFDMADAAGLGTVSTLTVGRFTQNVGSRRLIARNQFRNTINAFTGIAYDWENAAKDRLRLFYTLPHYRLPDDRAGILSNSVEWDHEGLDTQLFGGIFTKAGVLGGILEAYGYGLLERDSGSQLEGIQTRDRRLFTPGFRLYRVPKPGQFDHELEMVGQLGVARNTAAITDVTDVPVSAYFVHAEAGYTFKTAWAPRISLHYDHASGDSANPNSYTRFDTLYGARRFDYGPTSLYGAVQRANLISPGIRFEVAPDPDWDAFIDYRSLWLENPTDSFAATGVRDRTGRSGSFAGHQIEGRVRYWLVPRSIVLDSGVAYLLKGDVLRNAPNAPNTGDTIYGYMTTTFFF

SEQ ID NO: 2606 - protein, 347 aa, Methylobacterium sp.
MAGYIPAMVALVSVVYLILPASAQVADGQPPADVAAPGSRSDADPGQGKTSDLFFAAHDVSGKLGTPLPLEIKLVRTGRVSIESILLLGLPQGVTISDSTNTFSPSDETRDVDIKAWDLPNIKITQTDERESRFSLAVAAIWTAGSGGQVDVATSLLNVSFRPDGPDRATAAGDEPRSPEKPAAATRGTLSPPQVIASAAAPDASATAEGVVVPSARGTPLTNTAGIDRPASPAVTEKSPAAEGEAARLKRPVETARPTLQADPLVERARGLIRLGDISGARLLLERAQARNAPNATFLLAQTWDVDMLRRWNVRGLRADPDLARSLYAKAAAQNQTDERLLAATGR

SEQ ID NO: 2607 - protein, 276 aa, Methylobacterium sp.
MATLTTISVEKLARLIGTPGCPAIVDVRTDKAFLANQRHVPGSLARAPDRVAEWAPRLRGRSVVVVCEDGRRNSHGVAAWLRSAGVDAEALQGGLADWAAAERPMVPADKIRNRDAQGRTVWVTRARPKVDRIACPWLIRRFVDPDAVFLFVPPSEVVGVAERFEAAPFDIDDPGTFWSHRGDLCTFDVMVEELGLATPPLLHLATLVRGADTGRPDLAPEAAGLLAASLGLSRIYADDLAQLDAGMLLYDAFYRWCRDATEETHNWPTNKPKERA

SEQ ID NO: 2608 - protein, 185 aa, Methylobacterium sp.
MDTMPVALAGRILLPCGAERDCLCRLSQADEVYVVIGDAGAAVGSRVICHVDGLGVIEASVTTVSRGSLRLSVEGSPAHRARLATRLAWHRARLDGREDQRGAMRVIPLDPSAEVTLSDGMAVEARIVDLSATGAALEMVLRPPVDAVLTVGRRRARVVRQTDAGIAVRFVLPLRPQDVSADIRL

SEQ ID NO: 2609 - protein, 181 aa, Methylobacterium sp.
VSSVSLPGRYLDGSGAERDCTLRGDTPEALEIAGDRAPVPGERIVCRIPGLGLLTGRAAMLSDGTFHLELEAGPVQRDRLAARLTWHAGQADGALDRREAVRITPIRTGVVVVWDGAEVHGSLRDVSANGASVDLTPCPGIGTPIAINRRRGHVVRHTETGIGVRFVLPLSPYDVTEGIVL

SEQ ID NO: 2610 - protein, 76 aa, Methylobacterium sp.
MKHPILTAAVLALGAAALAGPVEAKGCLKGAVVGGAAGSMAGHGKAGAAAGCAIGHHEANKKDKSGGQSPQQGSAK

SEQ ID NO: 2611 - protein, 462 aa, Methylobacterium sp.
MSRNFDQAWEALVAHFGAEQVNGITSSRRQFGAHLLPDLQATVVAEIGSVASVLLGVHQIYDQLPLTISSLLVRQGQYTISVTPLQYQDMDVGEAEPFAALNNGLWLFHVEQRPVAVLLSHYTKYGEGTFAQVEIATLPDPASLAFARGFLAAVQSAGANSTLYRGKVLSFESGSDYSGMKAAMQVHKLPFIPREAVILETATMARLDRHVFEFDRHRDALKRLGQSTRKGLLLYGPPGTGKTHVIRYIASNLPERTTVLITAEEVVYLDRYMLLARTLQPSIVVLEDVDLVGRSREGMNSPKTEVLLNRLLNEMDGLRDDADVLFILTTNRPEEIEEALASRPGRVDEAIEIANPDAACRTRLVSLYGESIDFEEGAIDAIVTRSEGASAAFIKEMVRRLAQATIAAGTGNRITVATVESVLGEAVGSRNRIGRRIVGLASGAPERAGKQAPPFDSCCDDL

SEQ ID NO: 2612 - protein, 209 aa, Methylobacterium sp.
VFIEEDWMAELVVIGFEDPQEADRALNELARLQTEYLIDLEDAVVAIRSPDGKLRLKQSVDLVGAGAASGGIWGAMWGSLVGLVFLNPLLGLATGAALGLGAGALSGKLADYGINDDFIRSVAEAVQPNTSALFILVRKAQPEKVLAEMSRFRGRVIRSSLSPEQESRLQAALSQPDVSMPGSDGASAEPSAGSTGAPPPGGSGTADGS

SEQ ID NO: 2613 - protein, 293 aa, Methylobacterium sp.
MTTPDHDTSPPDTWTFFEGAWHPGNVRIMGPRTHGAWLGSTVFDGARAFEGVTPDLDLHLARVNRSATALGLTPKVGIEEWARLVAEGLTRFAPDAELYIRPMYWAESGFAGGVRFDPASTNWCLSLYTAPMPLPSGVKATLSPFRRPSIEVAPVDAKAGCLYPNGARALTEALSRGFGNCLMLDGLGNVAEFANANAFFARDGVVYTPVPNGTFLAGITRGRVLALLRGAGVTVVEKTLSYEDFLSADEVFTAGNFAKVAPVTGLDDVRFEPGPVFRLARQLYWDFAHGRLS

SEQ ID NO: 2614 - protein, 293 aa, Methylobacterium sp.; identical to SEQ ID NO: 2613

SEQ ID NO: 2615 - protein, 33 aa, Methylobacterium sp.
MRMMQAFSYGMIGALALGLATTVIGSANVLLNL

SEQ ID NO: 2616 - protein, 416 aa, Methylobacterium sp.
MILRRRASQAAALQPREHANTLAVDYAAVLNALPVNVLVLHPTEATITFANQRSIETLRSLREHLPTSVNPDAMVGLTMDVFHKNPAHQRSIVADPARLPWRTKIRLGPKTLDLHVSPVRDTAGRYIAAVLSWADVTPFTESIASFDAAVRTALGEATAATGAMRGAAERVLSATDATSRAADSAATGATDTTVNVQSVAAAVEELTASNGEITRQVNRSSAATGQAVTEAGAAMESVKALSETSQRIGEVVGLISSIASQTNLLALNATIEAARAGEAGRGFAVVATEVKVLAGQTARATGEIAQHIGLIQAATAQTVAAIERISGVIRGLDDGATTIAAAVEEQSATAGEISRSAREAADRTGLVGGSIAQVATTAETSAGSARSVLSATTILDQQMEQVTRAVQEFLVEVRRI

SEQ ID NO: 2617 - protein, 109 aa, Methylobacterium sp.
MTRSWTAAALFTALMLAHLPAPVRADPALSPAERKSLPAEVVTYLDRHMGCNHWSGEDAYDAARGRQIAAAVKTLRCDAIEADAKRLRQRYGRDPAVRKALDAAAHAEG

SEQ ID NO: 2618 - protein, 588 aa, Methylobacterium sp.
MRSRDQKKLAQQRCAEQLTQSVRGPFVFLFGMSGIINILALTGSFYMLQVYDRALPSGSLPTLVGLSILAVGLYLAQGLFDVLRSQILVRLGAQFDRRVAPLAQRVGIDMPRFGFSTAEAMERGRDVDTVRGFLGSPGLVALFDLPWVPVFLVFVYMLHPYLGALTVAGAVVLALLTILAELLTRRWTGATQQAVVARNAIADSNARSADVLKAMGFADRAVDRYRRANDEHLDLQTRTTDISGTFGAIARVLRMILQSAVLGLGAYLVIGGELSAGAIIAASITSARAMAPIDQAIGNWKVILAARTAFRRLKETVIALAAAEPPMTLPPAHRSLRVGHITVAAPGSGRVLLSDVGFELKAGQALGVIGPSGGGKTTLGRALTGIWPLLRGSVRLDEADLPQWDEASLGGMIGYLPQEVCLLDATVEENISRLAEDSDPALVVAAAQAAGVHEMILRMPDGYKTELGPLGTALSGGQRQRIALARALYGNPFLVVLDEPNANLDAEGEAALAAAIQGVRARGGLAIVIAHRPSVLAAVDRIAVIQDGKLTAFGPKEAILGKAARDGAAKPDSAQDNRERSMPERVPA

SEQ ID NO: 2619 - protein, 285 aa, Methylobacterium sp.
VHATSINPLDAQIRRGDYADQVELPAIIGHDVSGVVDQVGSDVTNFRVGDEVYYTPQIFSGPGSYAEYHVADAEIVARKPANLTHSEAASVSLVGVTVWEGLVERARLQVTETVLIHGGAGGVGAIAVQVAKAIGARVLATARGSDAALVERLGASAVIDFEREDYVDAVDRLTEGRGVDVVLDTIGRDTLSRSPRILREDGRVVTLVDTATPQNLIDAWGRNATYHFVFSRQNGSKLDALTRLLERGLVVPQVGLEFPLDDVARAHARSEEGRLKGKIVLRVRS

SEQ ID NO: 2620 - protein, 83 aa, Methylobacterium sp.
MRKVLLVTAALGGLIIQEAPSFAQGFRVGPGGVEIDDGRGYREDRQERRYRRMCRELRDACENKDIYGEEGQGNCRRYRRTCG

SEQ ID NO: 2621 - protein, 373 aa, Methylobacterium sp.
MNGQAETRITERNRARAARMKAAIFVEPGRIVLDEKPVPEIGPLDALIRITTTTICGTDIHILKGEYPVARGLTIGHEPVGIIERLGSAVQGFQEGQRVVAGAITPSGHSAACLCGCLSQDGPDTKYGFKPMGGWRFGNTIDGSQAEYLLVPDAMTNLAPIPDDLSDEQVLMCPDIMSTGFSGAESGGVRIGDTVAVFAQGPIGLCATAGARLMGATRIIAVECVPERQRVARSMGADEIVDFSKEDPVDAILRITDGRGVDVAIEALGRQSTFEAALRVLRPGGTLASLGVYSEDLRIPLGPFVAGLGNHTIVTTLCPGGKERMRRLMSVVASGRIDARALVTHRFRLEAIEEAYDLFAHQRDGVLKVAITP

SEQ ID NO: 2622 - protein, 115 aa, Methylobacterium sp.
MKLPLVTAVILAACTPLAEEAGAQDLQPGMRTMLQQGGAEGLPLVPVHPDDLDDDKLQPGMRTMIQRGGSEGVQLGALLPRAYDPYDGPGYDPSYPPPAYETRPDRRREPLRARN

SEQ ID NO: 2623 - protein, 76 aa, Methylobacterium sp.
MSAVAASATGDGLTAIGSERAGRHPVQTEAIAIRARRSLRSQTDSRAVAAAAGPEAAVPEVEVPASRASGFARIRR

SEQ ID NO: 2624 - protein, 71 aa, Methylobacterium sp.
MAVSATRKTSRIRSLWPSWNPGLLSAAAPPLDRRSIDLHPIESEARLPSHNLTANELIAMARAARARRLDP

SEQ ID NO: 2625 - protein, 311 aa, Methylobacterium sp.
MTLHEPLGLIDAARELRGFQTEPAQMRAGAPGKVGRLRLGFSLRDGRSVLHDLYRVAPLLVQQALYWDEAMPELPVCPIISVGGGILQGDRYTIAIAVGEGACAHVSTQGANRIHCMDANFASQHQAVTVEAGGYLEYLPDFTIPYRGSRFLSRTDLVVAADATLLYGEMVLAGRKHHHVEERFGFDLLSMDVSLRRPGGHKLFAEKILIEKGDPTIAFAAVMRGFDAFANILCVTPPETAARIKERFEPHFPIEAPRALSGVSRLPNAAGLMLRAVGVESYDVRHEVRRFWRIVREEARDRSLPAEPYWR

SEQ ID NO: 2626 - protein, 346 aa, Methylobacterium sp.
MPRANSNLLVQSLRGTSQVFFMENALTGVLFFAAMAYASSVTGNWATTVGAAIGVLVATLTARLLECDDPSVSSGLYGFNGVLVGAALPTFIAASPQLWASIVIGAAASTVFTAAFSATLTGKWGIPGSTGPFVLTGWLMVAAAYSFGGLHVTGDAPKLAGDVAPNLTGIPAPMDLVAIFFRNIAQVYLLGSAVSGVIILAGILIASVPAGIAAAAGSLISMIVAIAMGADPKAVSQGLYGFSPVLTAMAVGVVFLTPSPRVAVYAGLATVMTVFVQGALDVMVAPAGIPSFTAPYVLTMYLFIAPKKLMAPHPHGPVADPMIDDQGKAPGKVSGKAPVHAAGTAR

SEQ ID NO: 2627 - protein, 412 aa, Methylobacterium sp.
MQGINAGDTAFILICTALVLMMTPALALFYGGLVRQRDVLSVMIQNFVCIGVVGVIWVFGGFSLAFGPDIGGTIGNFAYYFGMYEVGIEPNPVYAPNIPFIMVFAYQMMFAIITPALMTGAFVGRFQFGAYLFFITAWTILVYVPAAHWVWGGGFLAKLGVVDFAGGIVIHTSAGFSALATAKFLGKRRVAAGESESAPASLPLVALGAGLLWFGWFGFNAGGAYAADALAAYAFTNTMLAGSIAMLVWMFWEWRETKHPSFSGVLVGAVAGLATITPASGYVEPIAALAIGAIGATACYFAKYVQKWLKIDDTLEVWRAHGVGGLTGALLIGIMASSHINQVSASLQQFGVQLLAVLVVGAYASFVTFMILTGLDRFGTLRVPEKIQEEGLDTMLGERAFNLWNMDRTLPK

SEQ ID NO: 2628 - protein, 173 aa, Methylobacterium sp.
MTIGSPKFLAGAALAFFLLAGSAALAKKVTVVTGDRPISVEIPAAWKVTTIDRGVQARTADEEIYLWFESYKPTQFDTLLGEHNAYFKEQGVKVTGEGQSKEVDFPTYALKVTEYPATYEGKPTVLRYLSVVPKAESQRHLLVSYWASPEGDKKYDAETNQIMNSLAASYDGK

SEQ ID NO: 2629 - protein, 508 aa, Methylobacterium sp.
MKILLVNVPHPAIGSRIPDDHLPPLGLLAIGGPLIDDGHAVSLIDAEFGPVPLPDLVREIVAQAPEAVLFGHSGSTSGHPVIAEVSSRVAAAMPGVTIVYGGVFPTYHAREILEAEPHVAAIVRGEGEETARRLMAALAAGRSLGTVPGLAYRDGDAIRETAPAPLIRDLDAYRIGWELIDHARYSYWGGLRAVVVQFSRGCPHPCTYCGQRGFWTRWRHRDPVRFAAELARLHREHGVRVINFADENPTVSKKVWRTFLEALIAENVDLILVGSTRADDIVRDADILPLYKRAGWERFLLGLESTDTATLDLIRKGATTTTDREAIRLLRANGILSMATWVVGFEEERDRDYWRGLRQLLAYDPDQIQMLYVTPHRWTPYFRLAEERRVIQLDRRRWDYKHQVLATRHMPPWRVLLWFKLIEVILQARPKALARIYLNRDPRLRHAMRWYTRMGRRVWSHEILAWLRDPLTRTGPTVVAFWGRGQEREEAMAVRAAARSRPAGREAA

SEQ ID NO: 2630 - protein, 288 aa, Methylobacterium sp.
VLLLGGAILLWGANWPVMKLGLGHVSPLWFSAARFATGAACLFAWQALRGEVWWPQRRDLPRVASIGLFQMMLFTALGTVAMRHLPAGRSAILSYTTPLWVLPVAVLVFGERIERRHWAGLGLAGLGVLVLLNPHAVDWGDGQVVGANAMLVAASLAWAVCILHLRYGRASASASAIQLAPWQMLVAAATLAPLAYAVEGPFTGDGTAAFWACLGFVGPVATAFCFCAVNAASARLPASTTATLMMAVPVTGLALSTATLHEDPSLDLIVGALAIVLGIAASAQRSHP

SEQ ID NO: 2631 - protein, 491 aa, Methylobacterium sp.
MTTYTATRGAIPLSSFDRPAAPAGQSPSITPAQLLAMLRHRRRLIALSMILGTLGGVLVVARTEPNYVATAQVIIDPRALRVVEREVTPSIDNADAQIASVENEMRVLRSSTVLNALITRDRLDEDPEFTGEPPGLLRRAKAAILDRVGLSPPRSPDPRRAALQTLERKIAVRRAERSFVVEVHVATRDPDKSARIANELVTLYTEQANRTRSELARRSGASLDDRLAELRAAVRAAENRVATFRSEHDLVSADGALTRDRRLRDLNTQLAAARARSTEALVRMEQANALRGRLDGLSEAVQSQAMIQLRYQITEARRRRANLANVLGPRHPELNSISREIDALQDQLGQELQRIGDAARNDYRRAKQTEEELRRTVETMSTASLADDRALAELRAREAEAEAQRKLFAQYLVRSRELIEQTQVDVNNIRVIGAAIPPELPTNLSKAIVLVLGTLIGLALGILAAIALGVLRGEAAPLPRYPVGSGEAVIA

SEQ ID NO: 2632 - protein, 708 aa, Methylobacterium sp.
MTIEIKGTKPGRDAPEGAERYVSRSADRRSGVPYFAAVAVASVAAYLKSLLLPRATLAEEVDPEIVAARADALRLVHSEELAAPTPAKAAEAPKPLAEPPSPVLQSGMSLFDDGHELLARGLRFARPDAHPDLGDFKASPVIPQPINDNGGSLAAGSGGRGGGQPSGGGGRPRDASHPEPDAQEPGNEAQPAPRPLGEEKADRPDQGLAGQGSTGQGSTGQGGSNPQDPGPSDGGVRIPPGSTPGGDPRPVDPATPPRGRDDGPAGQRNRAPVVNGPVQLGDIAGCALLTIALSDLLRGASDPDGDALSVRDVRVSSGTVTADGSGWVFDADAPGPVTITYAVTDGEFSVARTAHLTVLERALIGGTDGDDLILGTPCADDIAAGAGDDNVDARGGDDLVDAGSGSDHVIAGDGADTVLGGPGDDLLFGEAGDDLLDGGEGRDILDGGDGDDLLLGGEGNDSLYGAAGADDLSGGTGADVLVGDAGDDRLQGGEGADILSDGAGRDLVSGEAGDDVIILALDSAEDTVDGGAGRDTLDLSAATVDLVVDLRNETVSAQELGLDRIASVEAIIAGSGDDRFVVGGRDIVLTGGGGDDVYAFAAPAEPRDGTRTVQITDFSVGDYIDLVRYALFKEETAAGRPLAEALRGESDAPTGIQCRFDRSEGRDRTVVSADLDHDEAYETTVVLDGEHLLRFTIGPLPEPPTFHT

SEQ ID NO: 2633 - protein, 172 aa, Methylobacterium sp.
VADPQATVHGVDENDLSGPSGGPDLTSPSAPAAQEAIAPAHPDRGQVDDVLSVTGRTDREAPGQAALPVKVNEPTQPPVQVEADLAGGPLPNSQSGSAASQGASGQAKPGRPSPPPAAIDADGNLVFHTDAPQDPAPSALPHGPDEATTHHTVGLIGVTDQTHPVHDMYHHT

SEQ ID NO: 2634 - protein, 301 aa, Methylobacterium sp.
MTRKAASFPRGRALPVAGVVLALLAGWYLAALLGNWNGAADALVRAGAAPDAAGIAAATMAQERPVVPAPHQVVSELSRSVLGVPLSSKRSLVYHAWVTLSATLTGFALGSLLGIALAIAIVHLRSVEASLMPWIVASQTVPILAVAPIIIVALGAAGLTGLLPKAVIAAYLCFFPVTVGMVKGLNAPDRIQRDLMRTYSASRGQILARLRWPAALPYLFASLKIAVAASLVGTIVAELPTGAQAGLGARLLAGSYYGQTIQIWAALFAAAALSALLVQGIGLAERASARALGARPAGSAR

SEQ ID NO: 2635 - protein, 321 aa, Methylobacterium sp.
MTRRATRIGLLTPAALIGGAALAIAAHRPGLAGAAGPGFWLAAFLIWLAATLAARDLAALEPGHAAGRRLVRLAVPLLFGVLVLVLWEVVVVGAGVPAVLMPPPSAVAERFATALPVLGADLVQTCLKSALPGYAIGCLSGLGVAILADRLPVLGRGLLPVANVASALPIVGIAPIMVMWFGFDWPSKAAVVAVMTFFPMLVQAGAGLAATGSIERDLMRTYAAGYARTLLSLRLPMALPFLFTALKVNATLALIGAIVAEFFGTPIVGMGFRISIEAARLSLDMVWAEIVLAALAGSAFYGLIALAERAATGWHPSVRAG

SEQ ID NO: 2636 - protein, 39 aa, Methylobacterium sp.
MGRIRSPDPTAAQDRAVAATLCVLVFLECLTLIASLIWL

SEQ ID NO: 2637 - protein, 97 aa, Methylobacterium sp.
MQAGETRYGGVAHRSGRRPEDTVMAENVSDHAADRALADLVDAFGHYSDAEMQAFLDATPFAAEMRCGVSLAKPAGPEWLAAAGFAAGEVAVQAARA

SEQ ID NO: 2638 - protein, 68 aa, Methylobacterium sp.
MALAFDRTRLLQAFELLGADLSARGLFVELAVYGGGAALHDLYVSVYDETPPDEASLRFRSVLQDGPR

SEQ ID NO: 2639 - protein, 303 aa, Methylobacterium sp.
VLDRVTGMQVFCRVAALGSFSAAGRALGLSQTGVTKHVAALEARLGTRLLHRTTRRLTLTETGRTYLEACERILAEIDDAEAAVGAEGVEAHGTLRLNVPLSFGVREIAPALAAFSAAHPALTIELGLNDRRVDLIEEGWDLAVRIGTLADSGLIARRLTSSRLVACGAPAYFERHGTPRRPEELKNHNCLGYTLSDSSGWHFGEQAYPVSGNLRAPNGAALTAAAMAGLGLIYQPTFLVAQALRAGTLVPLDFGTPSPVLPIHALMPPGRRPAKTCAFVEFLVQRFAGEPAWERDLPEALRR

SEQ ID NO: 2640 - protein, 86 aa, Methylobacterium sp.
MLAQVAQRRRDQGLKLNHPETVSLISVAALDGARAGKTVEEVMELAGKTITRDDVMDGVAEMIPYVQVEAVFTDGSRLITVHAPIK

SEQ ID NO: 2641 - protein, 136 aa, Methylobacterium sp.
MSPPQKKAPVGGIIFGSGDIEINAGYPTTAIKVRNTGDRPIQVGSHYHFFEVNASLEFDREQAFGKRLNIPATTALRFEPGDEKEVSLVPYQGKQRVLGFNGLVDGWVGDETYDDYRPRLSDALDRVNRYGFKNKP

SEQ ID NO: 2642 - protein, 127 aa, Methylobacterium sp.
MGAQAVFVFIGGGFGALTREFLMLLIPQHSGAFPLDIFTANVVASFCLGAAFELHRLNQVSDEYLLLIGTGFAGGMSTFSSFVYGITSEAASPGQAGLAVLYCLSSLIVGYAAIWLGIASGKRLRRA

SEQ ID NO: 2643 - protein, 220 aa, Methylobacterium sp.
MILVEHKLGHLGDPVWQERAGQARIDPLVLEQWEAPKSRLRKATESGIELAISLPRSEHLHDGDVLHYDAAQGLIVVARIALKEVLVIELEGLESLAPHEILRASFELGHGLGNQHWPAVIKGSTVYVPLSVDQKLMASVMRTHAFAHVKTRFAPGEEVAAQLDAKEVRLLFAGADATPHHHHDGHEAAQAHDPHDHHDHPDHAHDHGHPHTHHHHDPVA

SEQ ID NO: 2644 - protein, 226 aa, Methylobacterium sp.
MAHLARLLQFSDSTLPIGSFAFSNGLESALQTGIVTDASSLLHFVELVLHQNARVDGVALLHAHRAALAEDYSGIVTADRELLCRRVGEEQQLMLTRMGKKLAELALKIGPSPVLERWLADIRSDTTPGCLPIGQAITLAHLGADETDAFVVHQYGMASMILSAALRLMRIDHFETQRILFAAQGRVEDDYLAVRDLALDEMAAFAPVFDVLVAHHTTVHVRLFMN

SEQ ID NO: 2645 - protein, 215 aa, Methylobacterium sp.
MKKITRIGIGGPVGSGKTAVIETITPRLIALGIKPLIITNDVVTTEDAKQVRRTLHGVLIEEKIVGVETGACPHTAVREDPSMNIAAVEELEDKYPDSDVILIESGGDNLTLTFSPALADFYIYVIDVAAGDKIPRKNGAGVCQSDILVINKKDLAPYVGASLDVMARDSKLMRGKKPFLFTNCKTGEGVDDLLQLILDMALFDVRTRPPLAASA

SEQ ID NO: 2646 - protein, 126 aa, Methylobacterium sp.
MGSLAAELRLLGVAAALGGLLVMMLAGEPNIASVGWGFVGLIFFGATRLVLYRKPAPAIAKKAVAVEPAHPTDTTHGSEASLPVAAVPGDVHAALHRKVRLIRPTSPMLASSVLPRSRVARSPSTT

SEQ ID NO: 2647 - protein, 59 aa, Methylobacterium sp.
VPTLTSAVLSLWSAYWAAIFAQVAHLRALDDGVGVSAFARLSRSLLAVGFGFLLIAKLM

SEQ ID NO: 2648 - protein, 610 aa, Methylobacterium sp.
MDQTFAAAPSPDPLEGRPEPDSAAPPPRPSSTAGWLGALARTARIDASPERIFPLVLDAVAAERPHAPALIGRDETLSHRELAARRNRYARWALGRGLAKGDTVALLMRNCPDYLAVWLGLTRVGVCVALLNTHLRGAGLAHCLTVAAPRLVIAAADLAEVLEGALPHLAEPPEIVWQGTDANDTFAAASAGFREAPLGPDEAPSVTLRDPALLIYTSGTTGLPKAARVSHHRVMMWTHWFAGLIDPTPDDRMYDCLPLYHSVGGVVAPGSVLLGGGSVVIREKFSASRFWADVAESGATLFQYIGELCRYLTLAAPDPAEGRHRLRLCTGNGMRADVWEAFQARFAIPRILEFYAATEGTLSLYNVEGRVGAVGRVPSFMARRSPALIVRHDVTTGLPARDARGRCIPAEFGEAGELLGRLSERAEYTFEGYTSAAESARKVLRDVIEPNDAWMRTGDLMRRDAQGFFTFVDRIGDTFRWKGENVATTEVAEALHRVAGVREANVYGVSVPGAEGRAGMAALAVGPDFDLAQLHAEMKTRLPAYARPLFLRLSDELGHTETFKQKKVALAEDGFDPARTDDPLYIDRDGAYRRIDSAMHAEIAGGTLRL

SEQ ID NO: 2649 - protein, 610 aa, Methylobacterium sp.; identical to SEQ ID NO: 2648

SEQ ID NO: 2650 - protein, 430 aa, Methylobacterium sp.
MRSETIALHAGFDHDPATHAVAVPIYQSVAYAFDSADHGAALFNLEEEGFRYSRIANPTVAVLERRVAELEGGHSALAVASGQAALHYAIATLADHGGNIVAVPQLYGTTHTLLAHVLPRQGITCRFAASDRAADIAALIDGDTRAVYCESIGNPAGNICDIEALAAVAHAHGVPLAVDNTVPTPILMRPIDYGADIVIASLTKFMGGHGTTLGGIIVDSGRFDWTAQAERFPMFTRPDVSYHGLVYADHFGRGAFAARARSVYQRTTGAVLPAMSAFLLLQGIETVALRVERHVANARKVAEHLRAHPQIAWVNYAGFEDSPNHPMARKYLKGEGSSLLTFGVAGGFAGGKTFYDALKLVKRLVNIGDAKSLACHPASTTHRQMTPDEQRVAGVLPETIRLSVGIEHIDDILEDLDQALAAVAPAALAA

SEQ ID NO: 2651 - protein, 430 aa, Methylobacterium sp.; identical to SEQ ID NO: 2650

SEQ ID NO: 2652 - protein, 191 aa, Methylobacterium sp.
MAAAALAPELAIDGELLKQAMRRLVGGVVVITAGTGEDRVGLTATSAVSLSVDPPTMLVCVNRASATWPVIARRRHFCVSILGAGQQATAERFAGIGGLRGAARYRGADWTIMESGASGLTEAQAIIDCALEEVIERHSHAILLGAVRAVRLNRMERPSLAYGGGRFIGISPDEAAPGIGRVHSTADNKTD

SEQ ID NO: 2653 - protein, 191 aa, Methylobacterium sp.; identical to SEQ ID NO: 2652

SEQ ID NO: 2654 - protein, 89 aa, Methylobacterium sp.
MSQAVAASVADRTMGLAYAIAARHAIKPKFDQADALVDVGLSSLDLVNLMVAVEAEFDIMIPPASLTPKNFYSIETIARMVESVRGLNA

SEQ ID NO: 2655 - protein, 89 aa, Methylobacterium sp.; identical to SEQ ID NO: 2654

SEQ ID NO: 2656 - protein, 453 aa, Methylobacterium sp.
MILRERLLAAGGLEGLFLSDHRSKKDLAGIVSGERDAAVTAALAGRRVLLAVGGQMAAARAMIALDGLAARLALVPPKLAPEHIARIARDSEAEICVADAEGLPPDALPGLPRIDAADAFRAGSETSRETEWALATSGTTGAPKLVAHTLEGLAGGINTAAAPEPGTVWSTFYDIRRYGGLQVFLRAMLGPSSLVLSDAGEPVRDYLVRVGAAGVTHILGTPSHWRLALMSAALDRLSPRYVRLSGEIADQNILDALRDAFPEARIAHAYASTEGGVGFTVEDGQEGFPAALIGTRAGIEITVREDSLFVRSGRTGRRYLGAAPEALIAGDGFIDTGDLVERRGERYHFLGRRSGVINVGGAKVQPEEVETVINVFPGISMSRVRARPNPILGAVVEAEVVLRADAGTDQAALKKAIIAHCRPRLAGHKVPASVKFVDALPITSGGKLVRRGA

SEQ ID NO: 2657 - protein, 453 aa, Methylobacterium sp.; identical to SEQ ID NO: 2656

SEQ ID NO: 2658 - protein, 248 aa, Methylobacterium sp.
VSDDLKTGRLVVVTGASRGLGLAMAETLAADGFRVVALARRPSEALEAAQEAAGPGRIAFTAADLGEIDALQALAQRIRAEHGQVYGLVNNAALGTPGLLTTMPASKIAELVHLNTLAPMVLTKYLARGMMTAGAGRIVNVSSIIAFTGYNALSVYAATKASMIGFTKSLAREVGRLGVTVNAVAPGFIETAMTGEMDEGERGRVANRSALKRLAEPQDVADAVAYLMSDRARNVTGTVLTIDAGSTA

SEQ ID NO: 2659 - protein, 248 aa, Methylobacterium sp.; identical to SEQ ID NO: 2658

SEQ ID NO: 2660 - protein, 314 aa, Methylobacterium sp.
MIGVSETVEDVPPAGEGVRSARVKVRCRTIEEDDLASVVRLLQAGFPDRSEAYWRTGLDRHRTQPLPDDVPRYGYVLERDGAIVGVLLALYRMVTDEAGTHLRCNLSSWYVLPEFRALGTLLDGFAMRDRRVTYTNVSPAPQTWQMHKARGFKPVCSGQMLVMPLLAGLGRGRRVRVATPETLRLLPEPEARLVADHLAFGCIGLVCSDGEKAWAVLFQRRAIKMRPGETRWPRLPCLQLVYRSTALDLSAFLGAIGRHLMLHHAMPWFVLDAVGKLPGFAGHFFEGRAPKYARGPNPPATGDLTYTEVVLFGA

SEQ ID NO: 2661 - protein, 314 aa, Methylobacterium sp.; identical to SEQ ID NO: 2660

SEQ ID NO: 2662 - protein, 58 aa, Methylobacterium sp.
VIRPEPGPAPERGAYLVRHDPVAILERRDGWVRALYRRGAKPVAGWLPEADLALAAAP

SEQ ID NO: 2663 - protein, 80 aa, Methylobacterium sp.
MEYPMTRILTASVLALALTTAASAQSYNAPAGIPAVTAPGGLADDVSAVQRPTAHDTRFGTLPAGADLTTGSVRRTHHAR

SEQ ID NO: 2664 - protein, 119 aa, Methylobacterium sp.
MRTISAPGGSVDRKILDVAKVFLERLEGRYPVRGGVLFGSRARASHQADSDADLAVVLAGSSGDRRSASREMAGIAFDVLMETGVLVDPLPLWEDELERRVAFSNPALIDAIWRDGVRV

SEQ ID NO: 2665 - protein, 68 aa, Methylobacterium sp.
MRVKRALFGLSLPLLAWFVAAFCLGSGIATAPGARAQGTVTPPAGQSRVTAPGGRRGKAARSHRKRHR

SEQ ID NO: 2666 - protein, 482 aa, Methylobacterium sp.
MPRRASVDRAYLEQHGRHWRVSVNVPAAVKDIIGRPKLRHDLGTDSLRTANLLKGPYIARFKAQIQEALTTVGRQKQSTTREAMELAKWAREAKERNTSREDWDEYHQIISERTVEIRTRNAMPVELPAIDDDGPGLGWINKPEDVAEARRFGRIAYQAGTPFAEFHEEYLKGSQVAARTKADDERSLRLLLQWLQNENVDPEIERITPLRAHAFAKRLPTLADVAPATCNKYLSRLSSFWAYLATVTEVAASNPWVGVALRKTGPKSGEEERPFTDTEVAKLLLGPASPHMLDLMYIGALTGARLDAIVDLKVQDTANRVILFQARKTETHARYVPIHPLLEPVIAKRCQGKAPEDDLFPEWPPVRKVGSMRERSFKASNHFTDYRRLVGVDEVVAGKRRARVNFHSFRRWFISRAEQAGVATAMISAIVGHKHGSITLDVYSEGTTMQRARRAVAKVKLPPLDGSPIREIQTVRARVRSA

SEQ ID NO: 2667 - protein, 473 aa, Methylobacterium sp.
VPRKPDPEMAYLTVHDGLYRVSMGVPKALRQQLGSRLVKSTGTKSKGQAKLVRDRVVPEFKKRIEDAWKARGGKRGSLLAEALETRKLLETADDNLADFMIQGALERSDEILNEGATWVNEHTPDGIVPVRRPTPEAVKSVTEFRRVLAGDTPIAFHHQAFVDGLKIKARSKLDEPRALSILLDWLEANDIEPFIENINRRNAIRFMDWMDADTNLSWASKAKYFGRIKFYWAWLARREYAKENPFLDLNLDKPDTERADDERPYTDGEVQKLLMGSPMEGDRMRDVMMIAALTGARLDAVIDLKVGGLFDGYFTFKAQKKERDSRHVPVHPDLDEIIARRIEGKAPKDDLFPEWPGPPSTSVKPRSSYFSKRYTKYTSDIGVRDEEQGRRRSKINFHSWRRWFITKLERARVGEPLIAAIVGHKRPGMTLGLYSGGPEFLEAQEAIALVKLPPLDGSPVIEERSLMPRRRTS

SEQ ID NO: 2668 - protein, 42 aa, Methylobacterium sp.
LDDTAHQERTDWELVYAGMGVGVVGLIGAALFFRRRRDAVAA

SEQ ID NO: 2669 - protein, 148 aa, Methylobacterium sp.
MVRSPQRPRPRHTFEMIMTDARTAPYAALLLRLTLGGLFLAHAGLKLFVFTPAGTAAFFGSLGLPPAFGYGVIAAEAVGGLALILGLYARFVALAIVPILIGAIVTVHGANGFFAQNPGGGWEFAGFWAVMLLVQAGLGDGAYALRRA

SEQ ID NO: 2670 - protein, 121 aa, Methylobacterium sp.
MWVCLGGGAGSLLRWQLGGFIDRAIPARFKFGTFLVNVTGAFVIAFLSAALALGWQQRHGDVVSSLVLTGFLGGYTTFSSMQLDTAQMAMEHRQGLAALYLVASVGVGLCAAAAGVALARS

SEQ ID NO: 2671 - protein, 119 aa, Methylobacterium sp.
MRTGSSKTYLLSALAVVLSAGLVQAETTSGKSTDKNQEKLASKPLEKVTCEEFNGFEDTFKPKVVAWAAGYKQGQKKPDVVAIDIAGVEKVTPLVAEECRKAPTASLWSKIDGELKKIF

SEQ ID NO: 2672 - protein, 35 aa, Methylobacterium sp.
MICSGCWKVAVIHGGPTEAQERFIARTVRVLAEQH

SEQ ID NO: 2673 - protein, 42 aa, Methylobacterium sp.
MATEKKRGNRETKKPKKSTAKVIAAAPSTKNLVSAAVKSAGR

SEQ ID NO: 2674 - protein, 85 aa, Methylobacterium sp.
MSLRETVFAEIAAIAAEQEKAMPPITDDLVMLDTEFDSLCFALLVARMEDLTGADPFGEMDASDLPVTVGDLVALYNRAAARQAA

SEQ ID NO: 2675 - protein, 85 aa, Methylobacterium sp.; identical to SEQ ID NO: 2674

SEQ ID NO: 2676 - protein, 519 aa, Methylobacterium sp.
MQRLRSHPRVAQFCLTLGVISGCSGSAFGQAVTRAQVEARLPALEALAQQAIDAGNVPGLAIAIVYGDETLFLKGFGRRAIGKPDLVGPETVFQIASLSKPVTSTVVAALVSEGVVGWDSRVADLDPGFRLHEPYPASQVTVRDFLNHRSGLPGSAGDDLEGIGYGRDDILRRLRLVPPSSSFRAGYAYSNFGFTEGAVAAARPTGKLWDVVAQEKLFGPLGMTSTSTRHDDFLTRADRAALHVRRDGVWTAGTERDPDAQAPAGGVSSNVRDLARWVRLEIGNGLFEGTQRVAGAALAQTRGPLTARGTNPVTGGASFYGLGWNIEYGRHGLVWGHAGAFSIGAQTLVSIHPEAKLGIVLLTNAFPSGVPEGLADSFADLVFDGRIRKDWLKDWGEAYTSLFGPGAAANRAVYGQPPANASASLPLSAYTGRYANAYVGNAEVAEIDGRLTLTVGPGGARTYPLRHFDRDLFLCFPDAEAPDNPSAIRFAVGSGGKADAVTLDALNANGLGTLDRASE

SEQ ID NO: 2677 - protein, 73 aa, Methylobacterium sp.
MPDETRLPTLDVLADLPQAEFVARWRSLVGEPPAIMLESRSEMIRLLVDSTEPAPFRFDEQALNAPQSHPDRR

SEQ ID NO: 2678 - protein, 455 aa, Methylobacterium sp.
MKPADQPATSPQQARFVAVALITGALTGVFGGLFHLAIDTIIDWPTWLAGQTAGWRLVAASAAITMAATVFAVFITRRFAPEASGSGVPEIEGAIAGIRHVRWERVLPVKFIAGIAAIGSGLVLGREGPTIHMGGSAALAASEMFRVRDVDRRALLAAGAGAGLACAFNAPMAAVLFVIEETRKQFPYSFRNYMGVFAAAITGTAVTQMISGARPDLPLSAGAAALASLPAFAVLGIILGAVGVLFNRCILAMLDRAAAWQKRAPYVWPALVGLLVGALLIVAPRTATGGEQVISQIAVLTPSAGVLLMLAVARLCTSVVCYSVGTPGGIFAPILSLATCIGLAFGLLAQMAFPEVLSGLGVTPVSFGIVAMAALFSATVHAPAVGVVLVLELTTAYALVLPMLTACLTASLVAQWLGGRPIYGQMLERALAQAGRVPAKGSDIGLAADRDRATH

SEQ ID NO: 2679 - protein, 193 aa, Methylobacterium sp.
MLEAATALFLEQGFGRTTLDQVSRRSGTGKSALYGRFPDKEALFAAVVRRSIHVMFDELTASPTGVGVRERLRHVGRGLAENLLVPRCIALMRITAAEAPNFPDLARMAYRVSFEGSVRCVLAALDPVGGGEASQDMIRMAERFVELAIQPISFQAAFGTDIEPLRQRCAGDVDDAILLLEAKGWLTREPPGT

SEQ ID NO: 2680 - protein, 96 aa, Methylobacterium sp.
MSVRLSPRARADLSRIWDDSAERWGADQADRYIRLLAGGFDRLAEDPARGLRADEIRKGYFRLSVGSHVLFYRLGAEGGIEVIRILHGRMDFKRHL

SEQ ID NO: 2681 - protein, 127 aa, Methylobacterium sp.
VGAVQGGPGLDVVVLKLPRLAWFSCLATIAAMSLLNLYCAASIQTDRVPMQWGINGRPTWYADKTIGLWIPVAIIVVIAPQIFLKIKQVEAQAGAWYWIGMIAMFCFIAAVYAWHISAVITWAEAQP

SEQ ID NO: 2682 - protein, 390 aa, Methylobacterium sp.
MSLSRTGTIEGEFAGLTPLRFSPPVEARFETEGLPERIRLAQATLFAAIFLYDIFLLADWMILPDVLGPLAVMRLGVFTPLTLLMIWILPRRTRTWQVDGLLVGGCFLSVLMPSTIISFSASHYVATYQLGSMLIIFYMVLVQRVRFRMAVIGMALIVLTQISTVARRPEVDAPTFWYIVVFYLIAAAIILLGSFVLERTERYGFLQRLRVESMIERNAEMARTDQLTGLFNRHHLATIGADLIPKKDTQSLGALLIDIDHFKRFNDTQGHLAGDRCIRTVSDLVREMLVPANENKPPLGTAVRFGGEEFLVLLPGMDAARAAALGEAIRRRVEGVGIPHPGLGPNAVVTLSIGVADWKKGHTALDTLVNAADAALYQAKNLGRNRVAVA

SEQ ID NO: 2683 - protein, 350 aa, Methylobacterium sp.
MAEIRRALVAGANGIIGKALMQELAAADGWHARALSRRPHGSSGDIAADLTDPHTTRAALAQARDTTHLFYAALAPHPSLAEEDRVNGAMLRNLLDGLDAVGAPLERVVLYQGAKVYGVHLGPVPAPFYEDENPRHIGPNFYFTQEDVLRRRAERGGAAWSILRPDVVVGDAAGNAMNIAMVIGAYAALCRMEGAAFRFPGPTHVYEGVFAQVTDARALGRASLWAATADAARGEAFNYVHEPFRWRRVWEKLATALDLPLGPPVPMRLATHMADKKPAWEKLVAEQGLSDMPYERAVGSGFGDFVFHSDFDLVSDMGKIRRAGFGESVDSVEALMSAIRRLQEAKVLPR

SEQ ID NO: 2684 - protein, 150 aa, Methylobacterium sp.
MRYSLVRVAEPSDRQVYHAIRRSSLWEERGRVGYDDARPEELFPNHHALLLMRDEAGIGTTRLDDLGNGTGIVRLVAITAPLRRNGHGRVLDAMVADYARALGLGRLFVSAASDAEGFYSSTGWTRLMRDAPVLLGQAESFVPMTKRIQR

SEQ ID NO: 2685 - protein, 172 aa, Methylobacterium sp.
MATSVVVEDRAALDGLFRKHNGWLMRWLGRQRWTVSSAEDLASDVFIALLTMPNLGAVREPRALMTTVARRLICDARRRDDVRRSYEAELAALPESLDISAEERLIVVQALQAIDAMLSTLSDKARRAFLLSQVEGAPYADIAAELGVSVSMVRKYVAQGLRATYLATANQG

SEQ ID NO: 2686 - protein, 172 aa, Methylobacterium sp.
MPEVTFNSNRRTLEEIFRAHNGWLKNWLRKQSWTVQSAEDLASDVFCALLTVPNIGAIRQPRAMMTTIARRLIYDERRRHDLHAAYKAELTFLPEVLEVSAEDRLILIQALQAVETILANLPRKARIAFLMSQIEGMPYAVIAVELNVSVSMVRKYVAQGLRAAYAAVDHQN

SEQ ID NO: 2687 - protein, 323 aa, Methylobacterium sp.
MSGVDQLEDPRAEAAVGWMVEMGSGPMSEHQIRAFEAWLEADPLNEAAWIRLQGGMMPYGIASRHRLQPDLLARRRGRSPTRRTLLTGLCAVLGAGAAGGSLLNRFVPLGGVLADHVTLTAQNRSVPLADGSETVLSPRTAMNLRYEPGLRGIQLVSGEVLVRIASRATPFHVTVGPLTLRAQAGIFVLEDRNEVVTVTGVQGTGELAGLGAEGPQAVAPGDLLEFGDGRLHRLVADRDAATAWLDGLLVAKDRPLAAIVDKLRPYFPGVIRVDPSVSALRVTGVFSLKDPSAALDALAESLDLSISRLTHYWVSLGPRAAAA

SEQ ID NO: 2688 - protein, 302 aa, Methylobacterium sp.
MVEISSGEVSADQLEAFDAWLRADPANETAWIRLQEGLMPCGVTARRGAGQAVLKRHLGAHRENRRNVILGLACLAGLGVISAGIADRYIPLSEILADRVTYTGGQETVALSDGSELVLAPRTALNIVSEAGQRGIQLLTGEVLMRVAPDATPFKVQTGALTLVTSAGTFLVESRDERLAVTGIEGTGRLAYASATESLAAGDLIEFAGGNRRHLKADIAAATAWLDGLLVAKDSSLQAIATKLQRYFAGIIQVEPGVADLRVTGVFSLRDPEATLDALAESLGLSQARLSRYWIKLGPAKA

SEQ ID NO: 2689 - protein, 236 aa, Methylobacterium sp.
MADRDEIYRAADLLLAEGRTVSQASVRDRLKDGGSYRDIAPILRDWKVDRNYRSRPGREELPASVARLLDAFAVEAWKAARLDAHASLENDRAKVSEQQRVSEGLVIELAAAADAAERRAADSEHAASEARDRAGRLERESTDLRRQVDLLERRVRRLKAEAYWDLVMRTVQGLLTPENGLTAEEIVARLPSLLGEHAWGQHDPITAPILKEKMRVRVGAKNYFRMDGDNRFYRIV

SEQ ID NO: 2690 - protein, 41 aa, Methylobacterium sp.
MTGFLVAGAIGFGLGWLVFGQHSYSGDYVARRMSRSSERDY

SEQ ID NO: 2691 - protein, 52 aa, Methylobacterium sp.
LTAQNDRPKSESEPKPIGDPPPAPQPPAGDPPPHRPDAIPDEDLDQVEEQPS

SEQ ID NO: 2692 - protein, 62 aa, Methylobacterium sp.
MIKHTGIAILLSLSGFALGSVIARVTEQAGAAGTTAAAPALRHISQLPPPPAAGKPAARSGR

SEQ ID NO: 2693 - protein, 118 aa, Methylobacterium sp.
VSQDISAGPYQGVPEIEVAVIKEVGSFGQQLGIISEAVRELAEKVSAMPPAKSAHELVKSSEASRELTPLEKLDVLIERVDRVKAAYHESVERDAIRALERLHRVDPGASSKLAARFR

SEQ ID NO: 2694 - protein, 249 aa, Methylobacterium sp.
MTPGRAQPLSSCAALVGLSIGLLAPAAAEGWNAARFDPPAKVETATDAVGREITCTFYPDLVIRESDTGTPEPGDAALIPIRGGPPVACRAAPGPSARTLETGGQRFIGRADGFLVFEDASTNGTMPFAVIDAGTGRRLFTDTTTYDGIDSFAAEGATLRLSFRRGVQAPCSIPQGGAACWARIVREDKLPAPVAALPAPAPAKACAQAYRAGKAPKDTPSIVSFPVRLVWTGSLAVEADGPVRCLPTP

SEQ ID NO: 2695 - protein, 655 aa, Methylobacterium sp.
MAEAIPGKEGHDFVVETDASAAYWHNRPTNTLPPPDMMGAYMRNRPVPGPRVEGRKAWIIGGGIAGLAAAFYMIRDGGMNGQDITILDALDVEGGSLDGAGNPEDGYIIRGGREMNWNYDNLWDMFQDVQALELPEGYSVLDEYRLVNDHDPNYSKARLMHEQGQIRDFSNFGLTKSQQWELIRLLLKRKEDLDDITIEQYFSPEFLETNFWFFWRSMFAFENWQSLLEMKLYMHRFLDAIDGLADMSALVFPKYNQYDSFVRPLVNHLMARGVTVRFGVRAYDLAMSVDGNARTVTGIHVKTKGEEDVIPVESRDVVFALTGSMTEGTAYGDMDQAPILERGRHDPGQDSDWALWKNLAEKSPVFGNPAKFYGDIDKSMWESVTLTCKPSPLVERLKELAVNDPYSGKTVTGGIITFTDSNWVLSVTCNRQPHFPEQPQDVLVLWAYALLMDKDGNHVRKPMPACTGREILSELCYHLGIADQCEAVAANTKVRLALMPYITAMFMPRAAGDRPHVVPKGCTNLGLMGQFVETSNDIIFTIDSSIRTARVAVYTLLGLHKQVPDISPVQYDIRNLLKAARALNNNLPFPGERLLHRLLGKTYYAHILPPLPALEGPSREAAQLDLRHLLGRRRHALSAIGESFEHIRGYLKSQK

SEQ ID NO: 2696 - protein, 101 aa, Methylobacterium sp.
MPTKMIAKPIALAAALTLAVSGAAFAQSSTGKGGTGGTTDSASPVRNNTGNSMRPTNGSPAGATTGSTGTMAPGATTGNAPGGTMGGGAGSAGGGNSAAGR

SEQ ID NO: 2697 - protein, 695 aa, Methylobacterium sp.
MKDGLSFLPTGTGSSAEPRSARTEPDPVRAKILIVDDDQRNLLAASEVLADPAIDLVLANSPEEALRQALREDFALILLDVQMPRMDGYEVASLIRSRSRTSRVPILFLTAHNKEDIHIFRGYSAGAVDYVFKPIQPLVLKSKVDVFVDLYLKTAEIQRKAAAEKQLLLENLRVRGEKLAAEQALRRREEHQAAVLRGLPIALYTSPFSGDDRRLHFTNDSIERITGFSREAFAASNLWGEQLEPDDRERISADLSTVSESGAVTLEYRWRNADGRERHILDQIVINVDENGAPVELFGMWFDVTERKELELSLQHASKLEAVGRLTGGIAHDFNNMLSIVIGNLDLVKSSLSGNEKALRRIESAIEGAHRCAELTSRLLAFSRRSPLQPRALDFTSFIPGLIKLLERTLGERIAISADLEDGLPEVCVDHAQFEAALINLAVNARDAMPDGGTLGIRIKRHEADAQEDSEQVHSVEIAVTDSGTGMSPAVLARVFEPFFTTKEAGKGTGLGLSMVYGFVQQSGGTIAVDSNPDQGTRFVITLPVLAQRSFSSEEMDPGNAPGPQNAMNGAGRAVLVVEDDADVRFTVVSTFEALAFKVFSAQDVDEALRLLQIESNISLVFSDVNMPGAMNGIELGHIIRQRWPDMPILLSSGYLQEDQDTNGFSLLQKPYRATELVETLRGLLSNAHGTMPIE

SEQ ID NO: 2698 - protein, 98 aa, Methylobacterium sp.
LSSDVDVINRAASVSAGDRFVRWLGWIATITGVLMFASYLDQIQLNLSGQKGSVIQPLATVVNCGLWTTYGALRRDWPVSFANAPGIVLGALSLITAL

SEQ ID NO: 2699 - protein, 106 aa, Methylobacterium sp.
MTLAHTQPTCQAPAAGTPDRRDGGTERFVRWLGWIATVTGVLMFVSYLDQIQLNLAGQKGSVLQPLATVVNCGLWTTYGALRRDWPVSFANAPGVVLGAVALITAL

SEQ ID NO: 2700 - protein, 115 aa, Methylobacterium sp.
VPLPTRFAGIILAFAPLFAHRSWRHARILLIGAFLTPGRRTVAGALRIMGLAHERRFVNLHRTLNLSISLIQSQPVRSGRHLCDRCLTSDGPRNPLRSPPNGPLLVPRLGASRAA

SEQ ID NO: 2701 - protein, 77 aa, Methylobacterium sp.
MIEKPGFEIRITTTETGSILRAQTEREVATKAESLIRRVHARGELIGFSIMGPSATEIGRIKAYLEDVLIEVAQLSI

SEQ ID NO: 2702 - protein, 307 aa, Methylobacterium sp.
MPMNLLDVALFCAIVTTGSLSAAGRQAGLSPMAVSRRLAALEHELGVRLIHRTTRSVALTADGETFLPLAQTMLEAQEAATAAFSEQHEGLSGVLRVTAPHRIGRALVVPLVVRLMAENPRLKVDLTFSDGIVDIAAAGIDVAIRAATLQASELVAVQVADNPRILCAATAYLAAHGCPERLADLDAHACLTLHAMDAWTFRQAGHPIAKRIKGRLAASSVDTVHAACVAGAGLALLTYWDVAQDLANGTLKALTLNDAEPEQLAIWAVLPTRQHMPARVRRFIDGLRSALMVSLPNVPTSGSLFAS

SEQ ID NO: 2703 - protein, 557 aa, Methylobacterium sp.
VDVHHITRDLAVAPQIRPDDIPAVASAGFRSILCNRPDAEAPDQPNFREIERRAGEGGLVARDLPVTSGRITDADVAAFEAAADTLPKPVLAYCRTGTRSATLWSLAEARRGRAVAEILAATKAAGYDLKGAAPRMAAQAGAAKERTEQRFAIVIVGGGAAGLAAASSLKARKPDLEVAVIDPADIHYYQPGWTLVGAGVFDTAVTARTMASLIPDGVTWIKAGVVAFEPQRKAVMLEDGRTIGYDRLVVAPGLKLDWGGIEGLVETLGRNGVTSNYRFDLAPYTWELVRNLGGGRAVFTQPPMPIKCAGAPQKAMYLSADHWRRAGRLREIGIDLFTATPSLFGVKEYVPPLMEYVRRYDAKLHFRHDLTRIDGSAKRAWFTCTAEDGTPSTVETGFDMIHVVPPQQAPDFVRESPLADPSGWVEVDPASLRHKRFTDVYGLGDACSAPNAKTAAAARKQAPVVAHNLLRDMGFIEGPDAVYDGYGSCPLTVERGKILLAEFGYGGKLLPSFPSWLLDGTKPSRAAWLLKERLLPPLYWHGMLMGREWMAKPKRAV

SEQ ID NO: 2704 - protein, 166 aa, Methylobacterium sp.
MDDNTSPDLLTMAADIVAAYVSNNSVPASDLPTLLVQVHGAFVSLSATPAAEADSEIEKPTPAQIKKSVTPDALISFVDGKPYRTLKRHLSVHGLTIEGYRARYGLPNDYPSVAANYSASRSALAKQLGLGNPRKKAEPAPEPAPEPTMASKPKRAGRSRKVAEPA

SEQ ID NO: 2705 - protein, 548 aa, Methylobacterium sp.
MPANPLLPVAEPATATLTLPDGVSLAADVWRPAGPGRHPVLLMRQPYGRAIASTLTLAHPAWYAARGYIVVVQDVRGRGGSGGAFRLFEHEAEDGAATLAWAADLPGSDGRVATYGFSYQAVTQFLALAGALRAGTKRPDASVPAMGAWSIRDDWAYTGGAFGLAGNIGWASQMGAEAARLRGDAAAFAALGAAARGTPWSGPVAAYPEALAAHAADHHYFDWLGDDPALWDRIAPARRLAGSDLALPSLHVGGWQDFLLDGTLGAYDAFRAGPAPQRLLIGPWTHSPWGRRVGSLDLGPEAVTPVDAATVAFLDHVLRGREEPGPPVRLFDVGARNWAGFSEWPDPEPTALYLASDGLAATAANGRLVAAPGEAGEDRLVHDPWRPAPVVGGPWGTPPGYQDRAALDDRSDVAVYDGPVIAAPLQLAGRVAAEVFVETAAASHDLHATLSLVEPDGRAVTLTAGHLRVVEAAAPGPRRIAMRGVCCTLRPGQRLRLSLQAAAWPAFAVNPGTGSRPEANAAMQAQVIVLALRHGAERPSRLLLPVLG

SEQ ID NO: 2706 - protein, 182 aa, Methylobacterium sp.
LARRLEGVARPWCVVGGWALDLWHGHQTRDHEDLEFTVLRDDVGVFRQALSDMTLYTVADGRFEILPEGAEPPPHILQIWCFDARAARWRVDLMIEPGEPDVWVCRRCPAIRHPRAEMVASTPDGIPYLRPAAVLLFKAKHRRDKDAADFERALPHLTHAERRWLREGLDRLHPGHAWAQAL

SEQ ID NO: 2707 - protein, 82 aa, Methylobacterium sp.
MPRNAHTTIRSGDARLETAALLLAGFTALIAIGRSDPGPRACTGAPPVAVARPMSEAALLSTKEAEAEAARQAILRDMRLHD

SEQ ID NO: 2708 - protein, 143 aa, Methylobacterium sp.
MTIAEKIEQSLTGRPNSFVPAHTLQRLLGRSQPDRDDIVMNWAMHWGQGIALGPLRALMAEHGMRGSVASFLFLNARLFNDQALENVTGAGAPPWTWPLDEQRVDLLHKAIYAFVTGYVADRLAAGEDRNREHGRAFYDEGAP

SEQ ID NO: 2709 - protein, 59 aa, Methylobacterium sp.
MDLQTTIRDAILTELQRQAEATDAAPKVSLAEDGFVDIQGRIDIDALIMVITGSLAGGP

SEQ ID NO: 2710 - protein, 170 aa, Methylobacterium sp.
VSLSRSSRAAGIIGPGLLGTRLLLSAAGTIPVLLTTTAARGAAITAPGGCRLTVDVPKGFSAQPYGESIVLRPIGQERRRSVFEIRLTPGHGRDATALTERRPLGGTIARYRMTRETGGSGGEETALIAEVQRVGGVIRLEASVQRDDGAEPDFEPAWSALATARCTEIR

SEQ ID NO: 2711 - protein, 128 aa, Methylobacterium sp.
MFAADRLILATAVALLCPWAAQAESLCERTVLPFRAMVAALKAEPGAQVLRDNGSVIEIEDPKRFIIWTLVRPGGTAPGAHICRRVVQENGEIFIQLKAYCAGKKSDCDGVIQGVLKAQNQAVERFRQ

SEQ ID NO: 2712 - protein, 121 aa, Methylobacterium sp.
MQQHLPAWACVLVMLAGEASAQEARSPLIDAADSRMQIGAASLVPTLRRRWLYADHKLVVGRVKDVRVSADGTALIAVVARRRWLGGGEVGIPVPLLRQADNDLTVSATRETIGQLPLFKP

SEQ ID NO: 2713 - protein, 93 aa, Methylobacterium sp.
VVAAPRPEPKPAAPAKPVAPPPFVAPPKPDAVKSEPFKAEPPRPEPARPEPSKPEPAKAEPPEPAAQAQNPFSVEEIEAEFARLLGRPLDSKN

SEQ ID NO: 2714 - protein, 301 aa, Methylobacterium sp.
MLHHRLLGYLDEVARSGSIRRAATRLNVASSAVNRQILSLEEEMGTPLFERLPRGLRLTAAGEVLVRHVRDTLNGHERMLAQVASLKGLTRGEVTVATMASIAAGVLPGVIRTFRETHPRIVVKVLVLPVDQIAAALLAGEADLALAYRLPPDPRMRCIAEFEHRLGAVMAPDHPLNGRYQVRMADCLEYPLVVADRSMTLRDVLELLVPEGTSFTPVVETNSIELMKRLAQTAPHITFVNLSDVGEEIRRGVLAFTPISDASAIIQRASLMQRARSALDGPAHLLAARIQAEFERQSVPD

SEQ ID NO: 2715 - protein, 322 aa, Methylobacterium sp.
MVRLSALLATLAALVASPALALDKVSFGLNWVPEAEHCGFFQAKATGLYERAGLDVELRPGNPNVNMPLLVASGELDMGMGSSFTTLNLVAKGIKTRTVAAFFQKDPQTLVAHAGQGVARLEDLRGRPIMVGGFSRNEFWQFLKARYGFTDDQLRPFAYSAAPFLADKRAVQQGYITEDAALLGKALPEPPVSILLADYGYDNYATSIFATEAFIAAKPKLVRAFVEASRKGWEACMAGDYEPAMRAVLALVPTGGEDLFRFKMDQMKRRGLVEGGDAARLGLGAMTDARWRSFFDVMTQAGLYPASLDVRQAYTLDFLAQP

SEQ ID NO: 2716 - protein, 237 aa, Methylobacterium sp.
LAPLEPALPEAGVSGFTVLLPVVPPLADVSGLASVALAPAGFGGIALLPVAPGFDGALPPGMPEAAAGAPDGFPGSVGLLDIVPALVEAADGGTALLPVAPGFNGASARASCGRAEDPGALLPARALLPVGPAFAGSDLTGSNAAGPDLAGSTFGVEAAADGSPGLPIALSAGRDESFVTSLAASRACSGDLPCSEDLPCSENLPCSGDLAPSLAPSLGEVTGVRSIQPPHRRSVLP

SEQ ID NO: 2717 - protein, 71 aa, Methylobacterium sp.
MKKTTLALAILLGGFAAGTASAAPIAPAGIQADSSVTQARMSHHERRMMHRHMMRKRMMHRHHHRSMRHRM

SEQ ID NO: 2718 - protein, 88 aa, Methylobacterium sp.
MWRRGNSFMRAISAVPRKAAGWLLPHTVLAHSELTGQSHRVVDPAARFAGDGCFDLDLRADRATARSAAATWFRPGSATSTIRISTRP

SEQ ID NO: 2719 - protein, 181 aa, Methylobacterium sp.
MKGVVFTEFLDFVSGALGSDVADDIIDDADVPNGGAYTAVGTYPYTEMQALVTALSRRTGKPVPDLLTLFGRHLCRRFAVRYPEFFTVQTSLFDFLESVDAYIHREVHKLYPDAELPVFRLTRYGSDAIDLDYESCRPLEALAEGMIHGAADHFRQPVAIAKLRVEHPAGPFVRFSIKHAA

SEQ ID NO: 2720 - protein, 474 aa, Methylobacterium sp.
MYGAVLAGASTDAAAEATPKNAPAKGAPAKGAPGGNVTLIRGAYVMTMDATRGDLPEADILVRDGRIAALDRALPVPAGADIVDAAGAVVLPGFVDAHTHGSISQMRGLYGNTPETAFFPVTNRLSAHYTPEDTYLGMLLSAVENVASGITTTADFFDIVRDRDHAEAGLRALQDAPIRARLLYGMKSKTTADPIDLAHVEEWQRGWAQRSAGGRLSLGLAWRLPQDLDDAQAWTIKQREWEAARRLGLPMQVHVSGTVPGRAAAMFDALIGRRMLHPNLQVIHATDARDDQLAALEEAGSGLVVTPLTEHRVGYGLTRIDRFAGTRRLGFGIDGSALAGFTDMFALMRLVALTQAGATRDETAVSPRRLLELATVGGARALGLDAEIGALVPGRAADLQIVRLDAWHLAGFDGGDPSGLLVYSARPEDVAAVMVGGRFVKRDRRLLGFDAAALLGQARSSIRSIRRRALRADP

SEQ ID NO: 2721 - protein, 467 aa, Methylobacterium sp.
MDISRRDLGKALGGVVLVGAASDARAADGLPGGVTLIRGGYVMTMDAGLGDLPGADILVRDGRIAGIGRGLAVPEGAVVVEAGGMVVLPGFVDAHTHGAISQMRGLYGNTRETAFFTVTNRLLAHYTPEDTYIGMLLSAVESAASGITTTADFFDNVRDRAHAEAGLRALQDAPVRARLLYGMKSKTDADPIDLAHVAEWQQGWAERSVGGRLSLGLAWRLPQDLDDAAAWAIKAREWETARRLDLPMQVHVSGTVPGRATAMFDALIARRMLHAGLQVVHGTDARDDQLAALEEAGAGLVVTPLTEHRVGYGPTRIDRFDGIRRRGFGIDGSALAGATDMFALMRLAALTQAGAARDETAVRPRHLLEWATAGGARALGLDAQTGSLVPGRAADLQLVRLDSLNLAGFDGGDPSALLVYSARPEDVAAVMVEGRFVKRDGRLAGFDAATLLDRARQSLRGVRARAG

SEQ ID NO: 2722 - protein, 326 aa, Methylobacterium sp.
MPFLRTFPTRAADAAGPSPSTYGLLLLSVAAAMCVQSLTDVWLHTSVVQWLAPLSMLAGAVYFSTRPISRRRFGAGLALLAVLIIQLPTTSALAYGVQAFGLPLRDDWFIGIDRAFGFDWLTFQTSMVERRGLMEILSRAYETFFLQLGLTPVLLAALGEVRRSDRFVASFILCVSMTTIISAVLPAEGAAGLLGPDEAHLLFQGATPLVDLHALRDGTMRALPLNEVGPLISFPSLHCAVAYLVTAAIWPLQRLRWAVLLLNAVMTVSAVTHGAHYACDCVAGLLVAAVSFHLAGQLGPWSERMVARMRGVAVLPAATASTALTP

SEQ ID NO: 2723 - protein, 144 aa, Methylobacterium sp.
LEAPAPARPRPDADAEAHLRILVVEDNLEVGRFCTQILEELGHQPVWAENAEAALVELERTETPFEAVFSDVVMPGMGGIALARILRERYPDLPVVLTSGYSHVLAQDDAHGFELLRKPYSAQELGRVLKEMAGRRGRRETASR

SEQ ID NO: 2724 - protein, 550 aa, Methylobacterium sp.
LIACASPEDRVRAAAGRAVIARPPRHVGRESKKGHGSMERRDILKTGLLTSIGLAAGATIPKVAAAETGKAGVQPAGSSATDGGECFRVEKDSMGEVKIPCDKLWGAQTQRSIENFDIGIERMPRELVSSYAILKKAAANVNFADGRLGETQHKLIVQVCDEILAGQHAEMFPLHVWMTGSGTQFNMNVNEVIANRSSQIAGQPLGSKNPVHPNDHVNMAQSSNDTFPTAMYMAAAIAVRQRLAPSITELRDSIAAKAEAWKDIIKIGRTHMQDAVPITLGQEWSGYSGMLSDNLERFDDALKGVYRLALGGTAVGTGINAQPGFAEASAKEIARLTGLPFVTAPNKFVVQGAHDAIVHLSGTLRTLAGSLYKIANDIRLLSCGPRAGLAELIIPENEPGSSIMPGKTNPTQVEALTMVTLQVMGNDVSTGFGGASGSLEMNVYKPVMIYDVLQSIRLLSDGSRNFRKHLIEGTKPNHKRIKDYVDRSLMLVTALAPTIGYDKASKIAHLAHEEDLSLREAALKLGYVSEADYDRIVDPRKMIAPYVAKK

SEQ ID NO: 2725 - protein, 459 aa, Methylobacterium sp.
MSEPPFLPEARAYRLRNARVPGAFLTGGVPAGATLDGDGCALLDIVVADGVVARLLPAGGTPDASPDTLPAADLAGRQVWPRLVDAHTHLDKGHTVARTPNPAGDFPGARDATTADRTRHWDAEDLRCRMTFGLACAFAHGTGAIRTHLDSQESGEGALRDQAATTWAVFREMRAAWAGRIALQGVGLTPIDAYATDYGRRLADLIADSDGLIGGVTRPTGGLHGGALAEIDALLDRLFGLARARNLDVDLHVDETGDPAAASLDAVARATLRHGYEGRVTCGHCCSLALQPEAQASATIARVAQAGIRIVTLPTVNMYLQDRQRGRTPRWRGVAPVQELMAAGVPVMVAGDNCRDAFYAYGDHDMLDTFRASVRILHLDHPLAGAPALAGPVPGAMMGLPHAGTIREGAPADLMLLPARSLNEVVARPHADRIIVVAGRPVAARLPPYEALTGEAAPW

SEQ ID NO: 2726 - protein, 140 aa, Methylobacterium sp.
VPIRPEHRHFYPIDWPQLSAVIRFGRAGGFCERCGRPHGRVIVCVDDGSWYDADGGVWRSGRGRILRRMPDLASARLTRPILAACHREHDTSRNGPADLAAWCQRCHLEHDRPEHIRRRRLTFLRRRALGDLFLGLYPVL

SEQ ID NO: 2727 - protein, 469 aa, Methylobacterium sp.
MRPVDPLPGGPPRDGVDAVPPAPRLFVLGLQHVLVMYANAIAVPLIVGGALHLPKDQIALLINADLFACGIATLIQTVGIGPFGIRLPVIMGVTAVAIQPLLAIAAMPGVGLTGIYGAVIVGGLYGLLVTPFIGRVMRFFPPVVTGTILLMIGIALTRVAVGWAGGGAGSADFGAPGTVAVAAGVLAATLLIARFGPGFVGRVAVLLGIGLGYAVTLALGWTSFEGLGAEPWLRVVLPLQFGLPTFHLVPCLILCLVMTIVFIEATGMFLALGVMTGRKVATEDIRRGLRADALGTLIGGLLNSFPYLSYSQNVGLVGLTGVHSRWVCAAAGGIMLVLGLVPKVAYLAASIPQPVLGGAALVMFGMVAATGIRILAQVDYARAGSRDALIIAASLGIGLIPIVQPLFFRAVPDAFGPIVKDPILLTAIAAILLNALLGQSGAQPEAERSGSAIGASEPEIAASSRSSRS

SEQ ID NO: 2728 - protein, 328 aa, Methylobacterium sp.
MRSIRFDTGASALLAVTLGLAMAGPAQAADKVVFLTSWYAQAEHGGFYQAKATGLYEKAGLDVEIRMGGPQVNGLQLLLAGEADAIMGYDIQVLQAVEKGLPVVTVAASFQYDLQGMMTHDDVTSLAGIKDRAILVSSAGMTAWWPWLKKKYTLSDAQVRAYTFNLQPFFADKNVVQQAYPSSEPFQAQEKGVPVNFHLFAKDGYPPYGTTIVTTRKLAEGKPEAMRRFVAASMEGWKSYMENPAPANVLIKAANPKMSDGQIAFGITRLKALKVLGGEENVPIGTMTEARWKASYDYLVEAGLLKASTDWKRAFSLDFMPVLSAKAE

SEQ ID NO: 2729 - protein, 293 aa, Methylobacterium sp.
MASPLPAYPRPAEAAAPASERLTRPAANAAPAIEILSAEKVFADGTRGLAPVDLTVREGEFLSLIGPSGCGKSTLLSLVANLSEPSDGRLLWWRGGFNGVGAEGRRMSVVFQDATLMPWLRIAANVRLPLDLAGVKKTEAAPRVQAALDLVGLGEKGRSYPRQLSGGMRMRAAIARGLVTEPNLLLMDEPFGALDEFTRNKLDADLVDLWWRRSLTVLFVTHSIYEAVFLSTRIVVMAARPGRIFSELTIDEPHPRGDAFRRSPRFAEYCQRLSALLTEASLASDPASAEARA

SEQ ID NO: 2730 - protein, 357 aa, Methylobacterium sp.
MLTTRQKLWRHYWYATLRLSDLADGPKPFTLMGERIVLFLDGEGEPAAMMDRCCHRTARLSKGWCEDGLIVCGYHGWAYDRHGALARIPQFSPEQVVPRLAVKSYHCTAKYGYAWVCLEEPYAAIPEIPEDTMPGYRRIQQFHDVWKTSPLRLMENSFDNAHFAFVHQNTFGQISQPIPEKYEITETEYGFEAETIITIANPPMAHRISGTTEPTTKRHMRNKWFMPFCRRLDIEYPSGLRHIIFNSATPIDDGTIRLAQILYRNDREEDCSTEALIAWDAVIVEEDRDILESTDPDATVDMGRKVESHMPSDRPGMIMRRRLLAALHAHGEEEVSEATPAVSVPVAPTLMPHERVA

SEQ ID NO: 2731 - protein, 323 aa, Methylobacterium sp.
MRQADLPIVDIAPFIDGDAAARAGVGRAFGHAFETTGFAVVVGHGIPERLANDVYDAMKRYFAQPLAVKSRDAAPEKTKGRGYLPVGIESVARTLQGETPPDLCEALVFNAPHREGPSARPNIWPAEPPELRGLVEAWRDAILRLTGQLTELSALALDLPQDYFAPWFADPALTLRFVHYPDQAEPPMPGQLRYGAHHDYGGLTILRQDTAPGGLQLADRDGNWFEAGVVPDSFVINVGDLLARWTNERWRSTLHRVSNPDRALTGSSARLSMVAFTAPNEQSEVACLPSCCDAANPPRYEPVKAGAYILSKLQASMDLTARA

SEQ ID NO: 2732 - protein, 462 aa, Methylobacterium sp.
MPSRPSPDALAALKADLSGRVALVEEPARVRKRSRDFFWYSPVLDAELKGLSGDLVAEPASEAEVIAVAASCARHGVPLTVRGGGTGNYGQAVPLHGGVVLDVSGLDRIEWQRDGAVRTGPGLRMNRLDGLLAEGGEEIRMHPSTKRTASIGGFIAGGSGGIGSVNYGQLRERGNIRAARVVTLEPEPRVLELTGDAVNGVAHAYGTTGIVTALEMPVVPVHPWIDVIVAFDDFLTAAEVGLAVGRDPAITKKLITPIAWPLPQWFTPLRAQCPPGQAILIAMVSETTLPAFRATMAREGGTITLETPLDDSPGHTPLYEYSWNHTTLQVLKTDRSWTYLQSLHPADGLMESIAEMAALFPDEIVPHLELIEFAGRLTYAGIPLLKFTDAERLNHIIAAHEARGVWIANPHVYTLEDGTRHKRAETDQLGFKRLTDPMGLMNPGKMRSFTPAGVATGAVCFT

SEQ ID NO: 2733 - protein, 195 aa, Methylobacterium sp.
VKRILYLYCHPLPESFHGSIRTAALDGLARAGHAVDLLDLYAEGFDPVLTAEGRRHYHDVTVNQRGLEDYVARLRAAQVLVVQFPTWCFGPPAMLKGFIDRLMMPGVAFDLSDPRHVRPTLDSLERIVGVVTYGRPRWMALAMQDPPRRMVTRYLRWFAARRARAEYLALYHLNVASDDRRHAFIERVRTRMERL

SEQ ID NO: 2734 - protein, 515 aa, Methylobacterium sp.
MLMHRLLTLGAERHPDRPAFHWVDRDRGLTYAGAVDAMERMAGALHDAGVGKGDRVTIFAHNGLDYIVAMLGAWRIGAIAALVNVKFADELTDYFADHTPSAVVYTHDMEGQVAAACTAIGTVRARLCMDGAQDGALSLPEMLAAGLPAPPDPGDETAIAHLSYTSGTTGKPKGACLRHEPTVRASRCIGERLRLRPGDVSFGPSALSSSYQLVANLLPPLAVGAAINVMRFWTREGGYDALTARGATSLVANPPILDDVLQEARRRGGPPPSLRLGISGGGPVPPTLKAAWRDELGLPLVESYGQSELGGFVGLGYPELEPDDAKLGRVGPPLPDKEVFILGPDDRVLPPGEIGEIALTGGFMAGYWGKPDKTEAATRGGYLRTGDLGLLDAEGCVTLRSRRAELVEVAGRLWYPRDVEEALSAQPGVAQAALVGVADPALGQRPVAFAQAQPGVALDAAALKAAITGRVAYDLNPLVLVVVPEMPMTPTGKIAKADLAHSDLARNAAKNMAAA

SEQ ID NO: 2735 - protein, 272 aa, Methylobacterium sp.
MRPASRWWWDLTTEDFSRLDWGPLVAILPVAAVEQHGPHLPVRVDAAINAGILARAVALMPDDLPALVLPMLPIGKSNEHHAFPGTLSLSHETLARLWIETAESVHRAGCRRLLILNSHGGQPQVMEIVTRELRVRLGMLAVGCGWGGVTPMDDLFSQAERRHGIHGGEIETSAMLALHPDLVRMERADDFVPLSVAMERAGGLLTPEGRVGFGWMAQDLHPSGVSGNAAAADARRGAELVERAAAGVVRLVREIADFPLERLSSGTAFDAR

SEQ ID NO: 2736 - protein, 270 aa, Methylobacterium sp.
MDDLVLRIIIFAIVGLVSGFISGLFGIGGSTVRLPIFIYLLPWVGIGQSVLMHVASATSMALVIPSAITAIRKQYALGNLDVGFYKTWVIGLFIGVALGAILLPHGSTEILQTLFAVYILLVGFYIAFGRGRFSSRSEAPSGSKRIGIASFVGLVAALTGTSGGTLTTPILSTCGLALEKAIAIASATGLVTGSIATIGGILSGWHAPDRPSYSLGYVDLVIFVVMMPTVMISAPWGVSVGEKFSETTLQRTYAALLILVGLDLLRRLAF

SEQ ID NO: 2737 - protein, 39 aa, Methylobacterium sp.
MMQQIHRALTAILGLVVLGLQAKAAGRLPQGDRGRETPR

SEQ ID NO: 2738 - protein, 76 aa, Methylobacterium sp.
MRPAPFTIVISGKRYECRVAGNTEAEAADTAEHILHQLRQEERVWPGQVNIECEDFEAAKRLAAYFATITVEPDLK

SEQ ID NO: 2739 - protein, 52 aa, Methylobacterium sp.
LARLLPELTLSWRCHVRRIEPMQDGPLLQMLYAALMASSMMLTWQFSRLRKP

SEQ ID NO: 2740 - protein, 70 aa, Methylobacterium sp.
MLDAKPAALQEPRSLIGSWRRFGSAGPVYEIVGVTEPKAADHPQMRIRVLETGEELDYPLTDLLEDPAEG

SEQ ID NO: 2741 - protein, 447 aa, Methylobacterium sp.
VTTVTLRFRTLLATAALALCLPLGLVASAETEPAPVQKNDVDTPQVVEAPKTEPDPAIERGRYIAVAADCVACHSNPKSGKPFSGGYALETPFGTLLSSNITSDEETGIGRWTEAEFTRALREGLGKDGQHLYPAMPYTSYTKMSDQDVHDLWLYMKTVPPVRNAVVTNQLPFPFNIRALLMGWNLLFFEQKRFELRADRSAIWNRGAYLSDALAHCGACHTPKNVLGGDKTSKAYHGEVLQSWYAPDITTSKAGGIGDWSKDDIVQYLKIGSNRMAVASGPMAEAVTNSTQHLTDADLAAIADYLQTVPPGPATEAPRATVTGPVMAQGKRVFDSQCKACHASDGTGIRHMTPSFPGNSAIQSHEVAGIVRTVLAGARGAITRENPTGAAMPSFAWNLSDQQIAAALTYIRNSWGNAAPPVTAEAVAGTRKTLNLNAVGRAPHPAP

SEQ ID NO: 2742 - protein, 447 aa, Methylobacterium sp.
VTTVTLLLRTLLATAALSLCLPLGSVASAQSEPAPIQTKDVDAPKVVEAPKTEADPAIERGRYIAVAADCVACHTNPKSGKPFSGGYALETPFGTLLSSNITSDPETGIGRWTEAEFTRALREGLGKEGQHLYPAMPYTSYTKMSDRDVHDLWLYMKTVPPVRNAVVTNQLPFPFNIRALLMGWNLMFFEQKRFQPRADRSAAWNRGAYLSDALAHCGACHTPKNVLGGDKTSKAYHGEVLQSWYAPDITTSKTGGIGDWSKDDIVQYLKIGSNRMAVASGPMAEAVTNSTQHLSDADLAAVADYLQSLPPSPATEARRVAAPDPVMAQGKRVFDAQCKACHASDGTGIRHMTPSFPGNTAVQSHEVAGIVRTVLAGARGAITAENPTGAAMPSFAWNLSDQQIAAALTYIRNSWGNAAPPVTTEAVAATRKALNLNAVGRAPHPVP

SEQ ID NO: 2743 - protein, 443 aa, Methylobacterium sp.
MTATSLTDTSLPPNAVRAAPPSIGLSGARWRAAFVVFAVLMCANAFYVLFLGSNNEVGNTKTLMPSNRNNLLYVGLWLCLYVLSLGVVLRDMRRNGIDLCLVAVLPFAGYILLSTCWATDSWASLVPAGMLVLNIAIAAALACLVHPAVFLSLYAWTNVFLVASSLVMVVVMPDAVRTDITRPGLLMSGELFGAYGSKTLHGMSAASAMLILLFLPSASPRGLRGPALAILALGLILANSMSSVSGIAVAGLTLLTARMLPGCGRAIFAAVTGFAILLSLFLPFIGVGDIAVALGRSPDFTGRSNFWPYALEVFRDRPVFGYGYLSFFNTDPFSKAWNVWEREMFFFTPDFHNTFLDTLVGLGLVGGAFYLVLLLASSCIFAHPSLERRPAFLLSALLIAFILNSATGYLFLAHNRMSTIFQFYCLFVLCRRYRPRFPQPAVV

SEQ ID NO: 2744 - protein, 288 aa, Methylobacterium sp.
MERPSSSVARTLSRTGAQLMRSGTVGRGLSLAEWSNRDNQARYDRPDHHTLSIYLDGGERVVREDRHLSGGGPDKLCLLPAGHESHWHIGGSLRMFHLYIEPDVLAYRALTAFDVDPRRINVQDLTFSDDPAMAMIVRGGVMPLDWTEGGDGPALDAACHLLVHRLLRQYAKATGPAPVRGGLSPTTRRRIAALIEAHLDEPLTLDRLAAEARLSTFHFAKMFRISFGMPPHRYLGARRIERAKQLLRGEPAGLAEVALACGYASQSHFTRVFKTATQMTPGEWKKRS

SEQ ID NO: 2745 - protein, 227 aa, Methylobacterium sp.
VAALAGNASAAQAAELSGEMPWEPGQANVPPLPEPGPERWTFFTPAEAEAIGAMADRIVPADDLSVGGKEAGCARFIDRELAGPYGRAATQYRLGRFVKGTAEQGIQSPLAPADRYRLGLAALDRHCRAAHGKGYANLPPAEQDKILSAMEAGTLDLEPVDAKEMFEQILQNVREGFLADPLYGGNKDLVSWRMLGFPGAQYDFRDVIDLKGKKLDFVPVSMIDKSL

SEQ ID NO: 2746 - protein, 227 aa, Methylobacterium sp.
MAALAGNASTAQAAELSGEMPWEPGQANVPPLPDSGSERFVFFTPAEAEAVGAMADRIIPADDLSVGGREAGCVRFIDRELAGPYGRAATQYRLGRFVKGTAEQGIQSPLAPADRYRLGLAALDRHCRAAHGKGYASLPPDEQDKVLSAMEAGTLDLGEVDAKEMFEQILQNVREGFLADPLYGGNKDLVSWRMLGFPGAQYDFRDVIDLKGKKLDFVPVSMIDKSL

SEQ ID NO: 2747 - protein, 693 aa, Methylobacterium sp.
MRVRNLFVSCMATVGLVTAGSSSFIAWQEWQRWSQADEARQLVGVLGEIARFNERLALERGSYNQLLLSDSAEQAPIRASAEANRKATEAVAGRITGAVAALPADKRAVLDQALQPTIRQLEGARAAADSEIAKPLKERDEQAAKSFQKAIIAVVAQNAKTLGMIEIDITRENPEVARSVPVVSLAMELRDIGGSRSIWFSQYAGAKQRFSPALTVQIHEMNGRIEQAWQRLQRSVMQVETQGPLVDALTMVERNFIADPGQVVAGMFAAGRDGTEPPMTLTEWRPHTTKMLQSILSVRDAALQSALATADETIASALQRLAVAGATLLLVILFTFGIVVFFTRRVVQPLASLARTITQLVEGTRDVEVLGTDRRDEIGEIARAVDVLKAHGAEAERLRGEREGLRQSAEVERRQSLERTADQFGSSVGGIVGQVATAAGSFEAQATNLAGTAREADLRSAEAARLSRSASQNIEAVAAAAEELSASIDQIRQQARGSSAAASEAAQEAASTEAKVADLGAAAARISEVLGLIRGVAEQTNLLALNATIEAARAGAAGKGFAVVAAEVKALAGQSARATDEIAAHIGSVRVATEQTVQAIGNITQAIQRATGMADAIAYAIDEQSTATQEIAHNISAASHGMRLATGEIESVIGASSATGRAADRVLQDAIALNGQSTELRSSVQHFVGSIRA

SEQ ID NO: 2748 - protein, 328 aa, Methylobacterium sp.
MRVVAVSRVLDEVDVIEAFIRHAAAFVDHHIILDNGSRDGTVEIIRKLAEEGLALTVYQSPSICFSERDMNNWLYNEAVDRHDADWVACLDSDEFYDERQLPGGLRNYLQELENAGGNVVAVRVPWAHYNYTTRDDAGENLVPRRITHRTEIASDGKIIASWRLAKEKGLVLEGQHDVHLPEGSRGTVVVERRLWIAHFSERNAAQYVTKFVRGWAKILTAGQACQDRGFSAHYRGPFELLRDHPETLLRSDEFLERKNEDRSAIHDPMDYRGGPLRYTPPNDPEMQSVRALVGFLSDVCARYGELTDALPVARAYSERIERRINRLI

SEQ ID NO: 2749 - protein, 41 aa, Methylobacterium sp.
LLRAGAKIDKFEKTRAVTGPAQDRAHRIGNNTLAPLSQGGT

SEQ ID NO: 2750 - protein, 49 aa, Methylobacterium sp.
LETNVPTLRLNTRRIALATLTAVLTLSAAACATKPPPAPVEPAPLIKKG

SEQ ID NO: 2751 - protein, 49 aa, Methylobacterium sp.
LNGRFTWPGTVRFVKGECFCFIASVPYETFDAICPRIRSFDDAPELKAT

SEQ ID NO: 2752 - protein, 64 aa, Methylobacterium sp.
VDVLVERYLDTSNGNAVAALRQAISDALQDAVECRQKLEAAERAASRGFRRQMPMPRMTGTAFQ

SEQ ID NO: 2753 - protein, 70 aa, Methylobacterium sp.
MSAVAAARADEVEILVEQYLKNAQGSPVVALRQAISDALVDAMECRQRLEAAERAASRGFMRQLTLSASK

SEQ ID NO: 2754 - protein, 580 aa, Methylobacterium sp.
VIVGLGWCGSLMAEELTRAGLTVVAIERGPWVETAVDFPPSVDMDELRWDTRRAMLLPPAIETITFRNDPSQKALPARDWNFNEWGYNVGGSGTHWAGMAWRFLPFDFQPYSMTVQRYGAEQIADGLIVQDWGVTYDDLEPFYDRFEKIAGVSGKAGNLKGEKIPGGNIFEGARSDEYPLPPLKTTRLTDLFTEASASLGYHPFMVPAGQTSAAYTNPLGVRMGPCTYCGYCLYYGCGNWSKSTPNNCVVPALMQRENFSVLTESTVLRANLAPDGKTATGVTYVDKDNRTWEQPADIVVFSAFQMQNVRLMLLSKIGKPYDHASGEGVVGRAYSFQTVSGANIFFENEYLNQFIGAGALSAQVDDFNGDNFDHAGMGFIGGAGILVVSRGARPIGNADFVPPGTPRWGSDWKKAYTHSFQNGTFIFGQGTSFAHTDAFLGLDPEYKDIHGLPLLRLTYDYNENDRRSAKLIEDKSVEIGRKMGAKVVVGTNATNQHASPYQLASDHTNGGAVMGLDPKTSALNRFQQSWDVHNVFVLGASSFPNNAGYNPTGTVGALTLWTAKAIIETYLDKRGPLVAN

SEQ ID NO: 2755 - protein, 590 aa, Methylobacterium sp.
MTNVRPKADAVIVGLGWCGSLMAEELTRAGLNVVAIERGPWVETAVDFPPSVDMDELRWDTRRAMLLPPAIETITFRNDPTQKALPARDWNFNEWGYNVGGSGTHWAGMAWRFLPFDFQPYSMTVARYGAEQLLDGLIVQDWGVTYDDLEPFYDRFEKIAGVSGKAGNLKGEKIPGGNIFEGARSDEYPLPPLKTTRLTDLFTEASASLGYHPFMVPAGQTSGAYTNPLGVRMGPCTYCGYCLYYGCGNWSKSTPNNCVVPALMQRKNFSVLTESTVLRANLAPDGTTATGVTYVDKDNRTWEQPADIVVFSAFQMQNVRLMLLSKIGKPYDHATGEGVVGRAYSFQTVSGANIFFENEYLNQFIGAGALSAQVDDFNGDNFDHTGMGFIGGAGILVVSRGARPIGNADFLPPGTPRWGSAWKKAYTHSFQNGTFLFGQGTSFAHKDAYLDLDPEYKDIHGLPLLRLTYDYNENDRRSAKLIEDKSVEIGRKMGAKVVVGTNATNQHASPYQLASDHTNGGAVMGLDPKTSALNRFQQSWDVHNVFVLGASSFPNNAGYNPTGTVGALTLWTAKAIIETYLDKRGPLVAN

SEQ ID NO: 2756 - protein, 269 aa, Methylobacterium sp.
MNYEIQPHNAKPASIWNSGGAHYNEISRGIADSIEHCVLRLDPKPGERVLDLATGTGWTSRVVARRGAQVTGADISADLLSFAAEQARAEGLDIDYQLGDAERLPFADGAFDAIISTCGVMFASRPEAAAAELARVCRKGGRICLTTWLSNDNVFRMFMVMKSYMPPPPNPAPPSPFEWGRTERLEELLGRDFELAFENGVSFYREQSAEAAWERFAGGYGPTKALVASLDEDRRANLRRDFIAFHAQFSTPLGICVPRAYWVTRGIRH

SEQ ID NO: 2757 - protein, 117 aa, Methylobacterium sp.
MATIGTFTRTQNGFTGEIATLTIQAKRVTIVETTGDSENAPTHRIYLGKAEIGAGWAKRSQEQRDYISLKIDDPSLPAPLFANLCADEDGKTFQAIWSRSKARPMGRQQGRQPSRRD

SEQ ID NO: 2758 - protein, 56 aa, Methylobacterium sp.
MAHDLTLARSSAYHLAQSLMVCVTLFVTDGGYGVMPSDEFDGDPASVIHEFDPHGE

SEQ ID NO: 2759 - protein, 311 aa, Methylobacterium sp.
MDWENPIGTDLYILPRGMARNGEVGPASIRWTSKYGSLVATAFDNSTSDGANEAGLTANVLWLEESQYPAFDGKGPPGLAISVWAQYALDNFATVDEAVAALKKQPFTLVTSVIPGTQIIANVHMSLSDSGGDSAIIEYIDGKQVIHHGRQYQVMTNSPTYEQQLALASYWSQIGGTVMLPGTNRASDRFARASFYVKSIPQDGDSDHLLASVYGIIRNVSVPIGLSTPEKPEISSTRWRTVFDHKRRLYFFESALSPNTFWTDLNQIDFSKETGKVLKLDLGIDQANVFAGNATRSYRASEPFPFAGLPR

SEQ ID NO: 2760 - protein, 65 aa, Methylobacterium sp.
VLPSGLMVRSPPEHRLDYDPVSLKMRSCTGWSEAALAAECRFLTRQASLQGGRSGEFFWTFPPPR

SEQ ID NO: 2761 - protein, 34 aa, Methylobacterium sp.
MTKRVLFTSLVEFTAFGLLFGAVALWAVALAPIH

SEQ ID NO: 2762 - protein, 541 aa, Methylobacterium sp.
MVTTALSGFFFTNAHQQALIDLREGGRQMRIAQEALMDAESYVLNKALGTGDGQFGAFNRALEALHSRRTAQLALLTPFIGRSDGKATAGGIIESLEASWTEVLELARTGRLSEAQALLRERHSAAQVGRIRSAFDAFLTDWNAHFAVHETRIEIGKLFVLLSQLLIGGVMVFAFRSAARDAQARQAAITQVEASRKQVGHLFGMTDMLQSAADHHDANAVLRATAGELIAGFGGALYVFNNSRDRLVLSTSWACSDSASLPEAIMVGQCWAMKRGKPHINHRGAKALCCEHHASGMAALEIPMAARGENLGLLQIFAEGADAETRLAAMLPLSSALGDAMSLALSNIALREKLRNQALRDPLTGLYNRRYMEDSLERYVRLAEREGRKVSVVMIDLDHFKRLNDEHGHATGDAVLCEAAAAIVGALRETDVACRYGGEEMIVFLPDCDLEDAAAKAEQIRGRIESLSGTHGAKVSASLGVASVPSTSGTSAELIRAADTALYRAKHNGRNQVAVAPPRQGWRSRSEAAPDEPVLLPIAAE

SEQ ID NO: 2763 - protein, 293 aa, Methylobacterium sp.
MRVSGLEVISHSAVGTRAGPSIILVHGAWHAAWCWDEGFAARLAAHGHDVHAVSLRGHGHSEGRRGLWRVRIRDHVADLRRVIDAVGGPVLLVGHSRGAYVVQKHLETAAAAGAVLLAPMPHFGVAPCMGRLMRRVPGAVVRIHASFGALPIAATPATARALFFSARMPEKAVRRHQARLQGEAFLAYLDLLGLDLCRPRWGGSPMLVLAAGADALFTRREMEEVAAAHGAGLEFVPGMAHDMMLEPGWETVADRIAAWAQTIGARREEPRSGDIARWANEPVGGVEQAEALS

SEQ ID NO: 2764 - protein, 353 aa, Methylobacterium sp.
MELDAAESDSGPTPRAFAAPVPFADALPPGLDLLIERLEEHARAARGAFADNTMRAFAADSRIFSAWCGQAGRAMLPATPETVAAFIDAQAEIKARATVERYRSSIAALHRAAGLSNPCADEIVRLAVKRMNRAKGRRQEQAEPLNRGSIERMLDVKTPERRHRRVTEAKRDVPLIALRNAALVAVAYDTLLRRSELVSLYIGDLHRGADGSGTVLVRRSKADQEGEGAIKYLAPDTMAHVDAWLAAAQLVSGPLFRPLSKGGQVGAAALGGGEVARVFRDLATAAGLKLARLPSGHSTRVGATQDMFAAGFELLEVMQAGSWKTPAMPARYGERLRAHRGAARKLATLQNRA

SEQ ID NO: 2765 - protein, 102 aa, Methylobacterium sp.
MAAFLTVGDLFKAKTVTDEQVSAAVETYLMKPDTSAHTIADGYTVDLAAAVESHGWASQITARPKTNPILKRAAVQTAILLARVRRARTRVKRDRTIPAGEP

SEQ ID NO: 2766 - protein, 123 aa, Methylobacterium sp.
MRKAERALASARVLLHDGDPEGACNRAYYAMFDAARAALMTLPEDVGPLATIKTHRGLIAAFGQRLVATGRIDPAFGRSLNQVEKLRLSSDYFGDVLAADDGRWAVEQADAFVNEVKARFPGL

SEQ ID NO: 2767 - protein, 315 aa, Methylobacterium sp.
MVALEAIERTKSIRGLSETLGLSYRTAWCRLQMYEMALGQPLVRKTRGQGSELTEFGAALAEALTSAVAGLDANLGCETRAIEHRLRRLLTGRSEVLTLAASHDPLLIEVLRELPAEHGQIRLSVMGSSTAVKLLLDGGVDAAGFHCGALTPEQADVPFSGVHSRAGLVPRPLFEREQGLLLAPGNPLGIRTLADLTAEGVRYVNRQPGSGTRSWFDRMLAKAGLSPDAIQGYAVEEFTHQAVAAMIACGAADAGLGVRVAAERLGLDFLPVGWETYYLAASRSLASPLFDELVAAVRVRAAETTGYRLSREHKS

SEQ ID NO: 2768 - protein, 198 aa, Methylobacterium sp.
MTVPRELIPYATDDVSALAKSLRSQMTARTKPPSHVEMLNMLARAAGHRNFQHLRGLAAGLVPRASDAVGAPAQADGALVARAARCFDAQGRLTSWPARRSVQDLCLWAIWSALPRDRLFDERGISALLDTLHRFGDPAIIRRTMCHLGLMSRTVDGRDYRRIERAPTPEAAALIRLLRERARGAVGPQGQGAAETSS

SEQ ID NO: 2769 - protein, 314 aa, Methylobacterium sp.
MDRRMKERARLSVVAVLTVPVVLLAPLSASAQDEAQPSPAAAYSVSQPPGEVVQPASPAAPTAEAAPPATPAQIPAAKPDKAVHDLSPMGMFLNADPVVQAVMLLLAAASVVTWTILLVKVLSLLLAKRGMRASLKEIRASATLAEAGQRVRRGVGALLLVEAEEELTLSRGLPSEGVKERAAIALGRIEAMVGKRMASGTGILATVGSIGPFVGLFGTVWGIMGSFIGIANSNTTNLAVVAPGIAEALLATGIGLVAAIPAVVIYNALTRSITGYRAMTGDAVALIMRHLSRDLDRREFGTYGAKSGIRVAAE

SEQ ID NO: 2770 - protein, 145 aa, Methylobacterium sp.
MAVNLGSNDSGDLAENADINITPFIDVILVLLIIFMVAAPLSTVDVPVELPVSAAPQQPRPDKPIFVSVKADLGVALGEDAVDRPALGAALDAATKGNKDERIFLRADKGVPYGELMGVMNLLRGAGYLKVGLVGLEDTSGGGQP

SEQ ID NO: 2771 - protein, 45 aa, Methylobacterium sp.
VGTGARLTLPTETDWLRTERRTPIIALDRIVSPYAHRLMPQVGVD

SEQ ID NO: 2772 - protein, 96 aa, Methylobacterium sp.
MAFRPLHDRVLLRRIESDERTKGGIIIPDTAKEKPQEGEVVAVGPGARDDQGRVTALDVKTGDRVLFGKWSGTEIKVDGQDLLILKESDILGVIAA

SEQ ID NO: 2773 - protein, 53 aa, Methylobacterium sp.
MPETKPAPLPPATEDAGLPTPPSPGRLPPPNLPPSPFTDDGASDAGTDGADTE

SEQ ID NO: 2774 - protein, 336 aa, Methylobacterium sp.
MDVTIFSTKAYDRRFLDEANAAAGEPHRLRYLEARLTHESAPLTQGAQAVCAFVNDVLDRPVLEVLAASGTRMVALRSAGFNNVDLPAAAELGIAVGRVPAYSPDAVAEHTVALILALNRKTHRAYARVREGNFALEGLLGFDLKGRTVGIVGTGKIGRAVARILAGFGCRVLAYDPMPSAELAGFGAEAVGLDRLLAEADIVSLHCPLTPDTHHMIDRAALARMKRGVMLINTGRGALVDTAALIEGLKSGVIGDLGLDVYEEEGGLFFEDLSNQIIRDDVFSRLLTFPNVIVTGHQAFFTAEALAAIAATTIENLSCFEKQGVPRHPVSVERLA

SEQ ID NO: 2775 - protein, 514 aa, Methylobacterium sp.
MPEPDEGPTVTASPERDERIRRLERRVARERSARAEAESLLEAKSRELYALNQQLSRFAADLELRVDERTRELALARERAVALAERDQLTGLANRTRFARVLGAAVGRAGRGTGSERFALLLLDLDRFKEINDSLGHEAGDVFLQHVARRLSGTVGQGAVTARLGGDEFAAIVPLGPRSDLARLGEAVVAEIRRPVAYRGRMLEASASLGIAVFPDDAATGSDLQRFADIALYRSKATRAAWTRFDPRMGREIEERQALGADLGAAIRSGAIEPWFQPIVDGVTRHPVGAEALARWVHPQLGFLAPAAFLGLAEERGLMRDLFAGMMRRACPPARDWVRAGAIRTLSVNLSPSQFKLGSVADDVIALLAELDFPPEALTVEITEEVLLNDLDRARVQLERLAAHGVRIALDDFGVGYSNIGYLRRLPIQTLKLDRLLTVDVAQEHEARCILGAIVQIARALDLRLVAEGVEDPGQALWLSHLGCRHLQGYLFGRPMPAEAFAGYLGFDGARRIA

SEQ ID NO: 2776 - protein, 532 aa, Methylobacterium sp.
MRSWHSHAAWAMRGVALGSLLALTGAGTAWAKEIVLPEKNPAVTLTIPDDWKTEVRDTEVVSTSPDGDVSFEVGFETRADRDSLVKDKVSFLRKQKVNLSIKPVEQAMDFGGTPARVQRYRTTDKYGKTIVDLVTLDASRDRALLMTIWGSEDQRQANEAALDTIMKSVRVPAETGGSSNFWSGGKTAAKPETKPEPKVETKSEPAAAGLSPSVAAAQPAPLRPYATRRALYVARKAADFGDVEARPSNVFKPGEPLLTYIEPVGEATQPIGSDQIGFGVIVDFEVRTPEGKALATQKNMIDRDVTVKRAEGEPNFFLNLSLDLDGFPPGNYVLVYTLRDKLSGRTLDVPQPFTIAPAATDKAAGASPAAPSPAPAAPATPPASVQTTVVDGWTVQLAPPDGVSCAIHYENKPPRADGKRFATIVAFVSIPDRNLKLTTLELKFSGWNWTKDQEVKATLRTGEFYLYSGLNWIVLDPRSLLLRSNDPDDILKLVKTTSKLSVERDGEDAVTFDITAPDKALEALKPCRDQLK

SEQ ID NO: 2777 - protein, 482 aa, Methylobacterium sp.
MTLVTRRNLVTGAALAVPLIANSSLVSAQVSEALLGSASDAERIAMDAYIYGYSLITTEVTRVQMSNVPALSGLHGPMGQFINVKRYPPADYRGVSAPNADTLYSAAWLDLGAEPTVFSHPDMGDRYFLFPMYSLWMPVVECPGARTTGGRAASFLITGPGWSGQVPSGMREIKSPTRYLLILGRTYANGTDADFAAVNALQEQYKLVPLSSFGKPFTFHAPPVDPNPGFSMTDKPQSVILSMSAEDYFNRLARLMGTVAPPAPEDGPMLARMARIGIAPGQPFDAAKFNPAVREALRDLPQRALAVIGAGRSSLGNEVNGWTVTKGLGRYGTDYMKRGVVAAFGWPANLEEDAVYPNTTVDSKGRVLNGANKYTLTFAAGQTPPVNGFWSITMYEVGQGWWFVPNRLNKFTVSLRDDLKRNTDGSITLHFQNESPGPERESNWLPAPKGDFIPMLRMYWPKAGNPSLLDGSWAPPWVQRVS

SEQ ID NO: 2778 - protein, 136 aa, Methylobacterium sp.
MSEKSENPAVPALLETEPGTSPLSGKRPTLQQRFVTRVSPELAQAIVVASRREGLSASAWVRRLILERTPLQSDVDAHSGRPVRLPKEEVTAIAAAVRELASVNAAISLSDGRAARAGLDRARDLLIPVLMRHARR

SEQ ID NO: 2779 - protein, 178 aa, Methylobacterium sp.
MMPSISPASRKRTDVRPVPLPSDCAVTSWYAGADLADAFAVRLPGPGPHDLSRLAEDALSNPAAWVTLAMWLRDGAVRPFGVRTSGQIRTRLETGGRDRIGFFPVLSRSDREIVLGEDDRHLDFRLSLLLVTRDDGREDLTATSVVRCHNLFGRAYLAAIHPGHVRVVRSALARAGMR

SEQ ID NO: 2780 - protein, 58 aa, Methylobacterium sp.
VNDLPAWTISLGVSAVEAGETDVSASIERPDRSLYRAKAWGVTAPRPEAASGLPLCPP

SEQ ID NO: 2781 - protein, 440 aa, Methylobacterium sp.
MDDAPPKAIALQFGIAAALSFSAMALPFVPEVILAYAGYRYLSHFTYGWRTWRAPARIPLHLGKRGYRDATTRRRGDATWPLGLAATGQVWLRREDLVQGLSFFSDGPDWHREVAANLVFGACLNRMGAIIVQSAAADMMTDQLAEVARPFGRDGEIRAVDLRQAPRPPLLITTTTLAAAIDDLRLGPEASTVNRALLPIIEMLASRYRKSSLDLYQAFTDETAFKRLLSGEYEIDHENVSADMASLADGAAFRAVLKPLKDIPKDQRETGRKALVAHAGELAALTSMSLTNGLDLKKALMAGGLVCIRPSSPLTTALVIARCTEALASLTPGRAGHALVHIAYPDALSGISARRFREAAKKAGAIGSLAHPARPTNHIQKAFRKGGALRIHSWKAKGGIVPLRGKFVSTVKDCPFILDVGLPNAPETMNSGTDAYASVS

SEQ ID NO: 2782 - protein, 442 aa, Methylobacterium sp.
MNDATPKEVATHFGIAVAFAFSAIAAPFVPEAILAYACYRYLRHFTYGWRTWRAPARVPLHLGRRGYRDETTRRRGDATWPVGLAATGQVWLRREDLVQGLSFNGNDPLWQEQAICSLVLGSCINRMGAIVVQSAKQPMLSERFAEVAKSYGRDNEIYSIDLAAAPRSPLRIRSSTLSAAIADLGLGPDAGAVNRKLMPVIEMLGARHGKNPLSLYEAFTDEAALGRLVNGEYEIDREEVSAARLSSSDGAALRAAIKPLRELKEETRENGRKALAVHAREIASLTTVSLSEGFDLRSALSTAGLVCIRPSSALTTALVIARCVEVLAEGDAGHAANALVHVVYPEELSGGSARRLRAAAIAGGAVSSLSLPARSANHVYKATRNIGAISIQEKPIAAPLDGTPLGCKITSAIKECLFTLDIQLPKAPKLQSANVPTNTDQR

SEQ ID NO: 2783 - protein, 58 aa, Methylobacterium sp.
MAGAAALAAIATGLNERQQANLLAAYDEDQAREASHQRPGGPPARQWRWIEYGPVGHR

SEQ ID NO: 2784 - protein, 138 aa, Methylobacterium sp.
LAERGLLSTSYAHTGLIDTRSRWPIRSLTVRLTTDGRKVARLLRGEPPTRPRSKEPKPLSLSALRMVAYGQQHPKETFDFHAPWGICPLDYLVALGICRGLVKRGLLDGDPPTHLRITPAGLTLDVSSININRRATTA

SEQ ID NO: 2785 - protein, 839 aa, Methylobacterium sp.
VHLNRHAPTRGRVRGVTTARAASVAVAVESATSRSRTFQAGLLALLMGASPAPLLVLSASKSWAAGEIVFDIPAGDLGGVLAQIGRIGAQPISFPADLTRGRRAGPIVGRMGVQAALARALAGTGLVIVPGPAGALKVSASSAPAPAPAAVAGDIAAIDVVDANTGSPYGDRGFQAGAAGDTLRIADAPLKETPVSVSVVTNEVLRSQNVTNPLDAARNAAGVVVTPTANGQPRFLIRGFETRGFSVNGAQSVTLQQLPIDAVDRVEVLKGPTAILTGVNADGGGLVNLTLKKPTSETIRELTARYGTFNYKTIALDLGGVMPELEGTTYRFVSSLNHADQSEFGYRDPSEFLVMPSVRWQGEGLTLTTGLRYIQTRGVPQARFGYRALDPITGEPSIFKIPGNGPGNPNAHFDGKELTYDTEQSYHAGTLFGLFDVTFNNIFQHQSARYIGPSFAFGTSGFGYDQPVVQIGSDSRNENITERLSMSLRYEDDLFRSTTKFGFDYLSQGSTTRNSNSSFDPDFNFLTNTPRQQLISSGYEFYSISNNIYRGGYMVEKLDLFNNKLHILGMTQWDWFSQSGRGGQDGFGDDRYSNSKNQALAYTFGALLDLPYDLGVYINRSDGRIPQVPVAGISIPPVGRTLNEFGLRSSMFDNRFNTTLSFFELRESDLTLVIQNSPGFPNNIEVVNTQGLESRGIELEGQGEILPGWNVIANVTRLWTRSLDPEGRGLDPSAGRPAYQGSLWTTYTWSSGWAEGITIGGGLRGLTGFKVNASEEEPLFRLPGYAIFDASIGYVSGDFAANLKINNLFDTKAFSITEASNYLPLERGRNVILQASYRF

SEQ ID NO: 2786 - protein, 775 aa, Methylobacterium sp.
VCGSQPAFAQAQYDFSVPRGDLATVVTEIGRMAGTIIVIPQSLAAGRMAGPVQGRETVFDALAKALAGTGLRADSGQGRSIIIRAASSTSAIPPAGGNVIEAIDVTDNSGVNAFGDRGFQAGAAGETVRIGGAPIKEIPLSVSVVTRDVVRSQGITSTADAVRNVAGVSASAVSTGRPEFTIRGFKQAGYAINGQIGSTFAQVPIDGVERIEVLKGPTSILTGVSREGGVVNVTLKEPTAEPIRTLTMRYGTYNYKTLAADIGGPVEGVDGLNYRFVASGNHADENYGGYRDPRELHIAPSVRWTGADLSILLGMRYDRAHLVPAPITFAPFLLEGGLGRPLRLPREVPIGSPYFGGSTEEIAFNTRQSYDVGNVLGADVTVNNSTQYLISRAKLLTGLLDATEDEVQGLFNSPSNVSMRDLTNRLDVTTEYNAGFARNFLKLGYDYIDRTNRPRIGGEPLGNVNIRTGLPYFPLRFAYSPNLREDSSTIQGIYFINKFDTFDDRLHIMGSYRYDWQATNSVTRTPLETNRVSGRNEGESWVAGAAFDVTPWMTVYGNRSVGFVPSVLGTVAGALPAPEGRDLAEVGARYFLFDKRLSLTTSLFDLARTNVTITDPRDPTGQTRILVGGLRSRGTEFELQGEILPGLNVIASLTIQNIAVTDRATEEGGEFFGVPKKTASLWVTYALQSTPFAGLTFGVGARGNSRSTTGIGTDSVYVPGYVVADAMIAYQRDDFSVSLNVKNILNEYSLSPSYFSDYIGINQGRSALLQADYRF

SEQ ID NO: 2787 - protein, 26 aa, Methylobacterium sp.
MLKGGLLWLIGIPLPIILLLWFFNVF

SEQ ID NO: 2788 - protein, 231 aa, Methylobacterium sp.
LPVAAAMNASARPPETALYAPVKGFLETLGFAVKGEIGGCDLLGVREGEPPVLVVCELKQSFNLELVLQAVDRAGACDEVWLAARLSVRGKGREADARFRNLCRRLGFGLLGVGADDGVHVLLGPGAPMPRRDPKRRSRLLNEHRRRQGDPVAGGGSRAPVMTAYRQQALLCARALAPGPLRPRDLTSAVPTAAAILRRNVYGWFERTGHGVYALTPAGHEAIARWPSTPP

SEQ ID NO: 2789 - protein, 218 aa, Methylobacterium sp.
MTSNAPSSPTITYYFSFLSLWSYVGSRAFRDLAERNGARIVYKPVDLMAVFAAGGGKPVKERPLQRQAYRLVEMQRWRRIRGIPLVLHPKFYPADPSLAHRVLLAALDEGSAVADFVHAGLSAVWADERDIADPGTIVRLADAAGLDGKRLLARADEPAFRAAEAALTCEAIGRQVFGAPFYVYRDEPFWGQDRLDLLEAAISGSDAPIALPDLSASG

SEQ ID NO: 2790 - protein, 80 aa, Methylobacterium sp.
MNKAYGVQVTARGPDGGDPRTVPVLVVAGDEQDALLVVSEAVGADAESEVLRELTDAEIREHSLDLEQRGAAKSLAVLKL

SEQ ID NO: 2791 - protein, 283 aa, Methylobacterium sp.
LALAAAGIVLATPAGAGSAAQPGGSIGIPAGAQIPVGLYFVAVPNYGVRPTFPASSDLNVNTATFALSTPWSVLGARLQFIVFNRSAVSASARGAPSSTGLGQSLYATQLAWNLGNDVGVSYFLGGYVPNSTRFGPQEGSLSHRFAVSYTGNGYNLTANLLYGHFLTDRALNGTRAFPDYLNIDLTATKRFGKFEFGPVAYASTDLPVGNVAGYRRQSQLAVGGLVGYNFGPVNVQAYITRDVAERHYGGQETRGWARLIVPIWQDKGEVAPNRTLVTRQQGQ

SEQ ID NO: 2792 - protein, 89 aa, Methylobacterium sp.
MKRLLLVSALVLSPLALSATAQAQGTIRGAERGVEDGNRAAGPVGGVVGGAVGAATGTVGGVLGVDPDARREERIERREERTVRERPAR

SEQ ID NO: 2793 - protein, 51 aa, Methylobacterium sp.
MTITTILLILLILLLFGGGNFYGGGRFRGPGFGLGGLLIIILIVLLVTNRV

SEQ ID NO: 2794 - protein, 291 aa, Methylobacterium sp.
MKRCAILTLTVLAIGPASADPVELADFRDLLRPPPTLQLTYGEAPSQGIDVFLPASPGPHPVAVLIHGGCWSATTVGREQMRHLGPDLTRRGVAVWSIGYRRANEAGGGYPGTYQDVGAALDRLAEEAGAHHLDLSRVVFVGHSAGGHLALWAASRGLLPATSPLHAATGFVPRAVISLGGVGDLATFARFIPVLCGPGIVERIAPADKLSEVSPAALPPAGVPIFLVSGVLDRLTPPWVAYDYARAVRGRSGPAPQLINVSDAGHFDVVTSSTLAWQEVRGLIEASLELQ

SEQ ID NO: 2795 - protein, 416 aa, Methylobacterium sp.
MISGATRGQGIGDALARHLLNPENEAVVVIPARGLGSTDLTAQVRELVALSLGGRTDRPIYHVHLDPDAGIADEVGARARWWALFEIEFGMEGQPFCGVEHVKHGRHHEHRVYGLVRPDGSVIDLAWDYPRREKVSRIVEHAFGMAPVASKHARSLARRLRDEGRLDVADWLTRSGSLERTRPIAPLTPAERLQQERTDTPLDAVRRAALAAWRESADGPTFVAALRARGFDLRRGRKGPVIVDGSGGAHLTTRVIGAAARRFEGKRILAATVKERIGGLTLEALGHGWSGNRAPVRRAGSAAAGDRRNAGAGAERDGRLGIRGPDRGAGGPDGGGGRGDGGGAGHALERLRALPTGRALILRRRLSGLHPAVATFLSAAERARAAIARIEERNAYEKERAWRLWGLTDIWGLPLR

SEQ ID NO: 2796 - protein, 267 aa, Methylobacterium sp.
MLLTYSRLGGLRFVLCGIGLVVGLFLLLPILVLVALSFGDSQWMQFPPPGWTLRWYADLFDDPDWIFAFLTSLRIAAWVTLLSVALGLVTSFGLVRGRFPGRETVRALFLMPMILPVVVLAVALYALFLRLRLNGTELGFVLAHLLLALPLSIIAISGALERFDSSIEDAAVLCGASPMEAKLRVTSPAIMPGIATAALFSFLASWDEVVVAIFMASPDIQTLPVRIWGVLRQDLSPVVAAVSTLLVALTAVLMLLSAALKKKDVRA

SEQ ID NO: 2797 - protein, 472 aa, Methylobacterium sp.
MAPDTVALDLPELGKGRHTARLSLIGVIATFGGLLFGYDTGVLNGALSYIADYFGLSPLQEGFVTFSLLIGATLGALAGGRISDRIGRRVTITGLGALFFVGALGCVLAPTYDILIVFRVVLGLAVGGASVTVPVYLSEVAPAEQRGSMIGRNDIMIVSGQFLAFLFNAVIGNVLGGNEHVWRIMLAVALLPAVVLFLGMRRMPESPRWLMAQGRSPEALDVLRTIRSEARAQAEMEEVRVLARLDAVKRSTSWRDLVAEPWLVRLLFVGMGLAALAQLTGINSVMYYGTQVLEQAGFTRNTALIFNVLNGLISIVAMLVGVMVVNRVGRRSMLILGFGCATALHVFIGVIGIVVPLDNPARPYLLTVGMFGFLAIVQGTIQLVSWIMMSEIFPLRVRGLMIGASVAVLWLTNALISLAFLPVVQTLDFATFFLFGGCCLFGVVFTARWLPETRDRSLESIEAELSAGGARV

SEQ ID NO: 2798 - protein, 423 aa, Methylobacterium sp.
MFAMLYVIADTNWLLLAFSALMFDLPRYTFSLLSWSLVGIFGSSRPGDRRVEAAVSVIIPTFNGGSGLAPTIASLRQQTLSPLEIIIVDDGSTDDTRAVANRARQDGLVDMVICHGTRCGRSAAINAAARFASGDLIFTIDADTVLERDAIARLANAFNDPRVAGACGNIAIRNESASLWTGLQSVEYMMSISAGKSILDVVGAIACLSGACSMYRRDVFARQGGLDVGPGEDLEFSLRLRRLGYRVRFVPDAWAETDGPVAAVGLLRQRARWDRDALRIRSMMYGELSFFHPLERLPDTLQRLDFIVFDLIPTMSLPFYSMYIVILFGPAHAIFFIAAIYFLLLWISIFNMALAFVLFSRSPSFFSLGAAFIFPLYQGIYMKCARFVSYSSEILFATSRRDDYVPPRVRRALFADEVGKVVS

SEQ ID NO: 2799 - protein, 316 aa, Methylobacterium sp.
MLNTLLDFSRLEAGVVIPRPRAFELQPLLDKIENDLAHLADAKHLIYRTLQTNLAIISDAALLELVLRNFVLNSIRYTDRGGILIGCRRRGTDVSIEVYDTGIGIPEGKREDIFREFYQLGNPERDRQKGLGLGLAIARGITTSLGHTLSLSSKEGHGSVFRILVPGTDETVPDVDVLADIPNVGGLVGARILVVDDDAIVRDAMVALLTGWGCRCWVYEGADDVRRHRSSEPAPDALICDFRLREGQTGTEAIALLRRHWGRPIPAILITGDTAPARLREASDSGIPLVHKPVRPDILQKALLTLIAPEPTSKSL

SEQ ID NO: 2800 - protein, 141 aa, Methylobacterium sp.
MEPRLSLITLGVTDLARATAFYEALGWPRKVQAAQGVAFFQLGGLGLSLYPRADLAHDAGVPVQAQPSQGFTLAYNTRSRAEVEWVLAAAEAAGGRITQPAQDAVWGGYHGHFADPEGFLWEIAWNPGFALAADGSLSLPD

SEQ ID NO: 2801 - protein, 338 aa, Methylobacterium sp.
VSERIRFGVSPIAWINDDLPELGAGTPLERMFHEAAAIGYDGIELGGAFPREPAALSALLAPSGLALAAGWYASSLLTVDAEAEIEALQPHLRLLRAMGCDVFIAAECSTSIHGLRRVPLAHRPVLDWAGWRRFGRELTHLSEYLAREGFRLAYHHHLGTAVQSVTDLSAMLAHTPSHVGLVLDTGHAVLGGIDPVALIREHPERIAHVHCKDVRPPAFAAVEAAGGSFLDGVLAGMFTVPGDGSLAFGPVLRALADIKYRGWLIVEAEQDPQIADPRIYGRIGLETVRREAIGAGLTTWTGSLARAAVGAPSPRNAPSQSPAATLFPLAELALSGLA

SEQ ID NO: 2802 - protein, 214 aa, Methylobacterium sp.
MMSTINTHHRDDAQRDAGIYVAIVYHSGYGHTARQAEAVGEGVWQSGGATPVLLSVDEAQHRWDELHAAHAIIFGAPTYLGAASASFKAFQEATSKVMMAEGYRWKDKIAAGFTNSGARSGDKLSTLLQMVLFAAQHGMHWVCLDLPPANNSTTGSEDDLNRLGFWIGAAAQSNTDEGPDRAPPEADLATARRLGERVARVTRDFVRGRNLAGT

SEQ ID NO: 2803 - protein, 294 aa, Methylobacterium sp.
VIHPPPEAFVRAAERNRMHQESRESSSAVPILGWAVAGLLTLGVHVGLYLLLTRQAETPPTPLEMPAAVMIDMSPEPTVAQSATDNASNEPEAQNTEQAEPEPAEEAPPPPDPEPVVEAPPPPPQVKPEAVLPPTPPKEVKKPEPKKPEPKPLKKKAQKKPTKPVVQKKDRPSAASRNGGGPRSDQQNAARTAASAAGAAVSQASRASWQNEMRTRIVRAKRFPAGAAGASGIAVVSVTFSGNGSVSSAQLIRSSGNAALDAEAVAVMHRAAPFPPPPGGQAITQTIPLNFSRR

SEQ ID NO: 2804 - protein, 168 aa, Methylobacterium sp.
MADDNFTKWHIAGLHALRSASEQGDAAGKALAGKVRNADLKALLGEYSETAGKQETHFVGFLKELGTEPNGFKDRIMEGVGNGTSEMVKAAPDQDLLDLSAVAGTQSGLDYYAGAFKGQGALAKQLGYADQADTFMAMSKACEALRERFTKVGDTIRAKAAGEARKAA

SEQ ID NO: 2805 - protein, 100 aa, Methylobacterium sp.
MHIVDRRLNPGGKSLPNRQRFLRRVKDVAQRAVRESAREKDIKNLGKDGRITVPGDGVREPRFSRQPGTGHQDYILPGNKTYVEGDRIERPPGGGSGEGG

SEQ ID NO: 2806 - protein, 74 aa, Methylobacterium sp.
MDESMERAVDEMKRAYLEASGGDARDALRRALADAMQEIADVSSHVSRGFVRASKPADLARKLGPERRAREAAR

SEQ ID NO: 2807 - protein, 100 aa, Methylobacterium sp.
MDLKKATETLIVFADLDLLVERVLALVRAHNALRQDGFHLISDDDLVEIYRLLTELHEVAIDGVDPELVAPTILQLRLKLSVLEVTISAHLNAPSPQYLH

SEQ ID NO: 2808 - protein, 267 aa, Methylobacterium sp.
MPPGQSESRRLAALHRLQLLDTPPDPAFDRITQLAQTLFDVPIALISLLDEDRQWFKAKCGLHVSGTPREQAFCNYTILHDSVFVVPDARAHADFALNPLVTGEPFIRFYAGAPLIVAPGTRIGSLCLIDRKLRAFDEEDSRLLARLAQVITDEIWLRTLASGQNRVFPHFAQGRPRTETPSLITGLQVRAARAMLGWSIDELSLKTGLSPNTIKRMEADEQSRPSSPSTTVKIKEALEGEGIVFLGHDAADPGVQLVRKISNNKDQ

SEQ ID NO: 2809 - protein, 92 aa, Methylobacterium sp.
MASDYAFKLHNRAEGYSIAGFYTYQNGRWSRNWIGGSINPGQSASLDWNSNDGDCVVPFRVKWRDYGADDFKLDWCKGVSNVYMKDKGFTYD

SEQ ID NO: 2810 - protein, 27 aa, Methylobacterium sp.
MLSHEWLAPHLVCWPSRIPDARMRDEA

SEQ ID NO: 2811 - protein, 59 aa, Methylobacterium sp.
MIMRAIYVFLLALSLATGAFWATMLISPPKTRAAPTALADTWVVKTDQPPIADDYDPEF

SEQ ID NO: 2812 - protein, 35 aa, Methylobacterium sp.
LRNSLILAGLTGILLSGTALAADLPRRAAPPPVFQ

SEQ ID NO: 2813 - protein, 255 aa, Methylobacterium sp.
VLCAGALAGLFARFSFDGATLTKSLLFVPYYNAEGQIWPLAISGWTLNAEMLFYVLFAAGLWIGAPRTFCAAALAGLVIAGAIFAPENAPLRFWTSAIMLEFIAGLALAGPIRLAGLGRGLSLVAVGATCLVAAELAWHYTEALRPLVWGGPAFLIVCGALAIERAGRWPRRALAALERIGDASYSLYLTHGFVIALVHRKVGTTIAANAMAVPACLVLAFLTYYGFERPVGRMLNRLARPHPRSALELAATSTH

SEQ ID NO: 2814 - protein, 80 aa, Methylobacterium sp.
VPGGGAASTLMDPPRAAALLVLAPHMPMVMHVRVPVPAVVAVTLRVMCVEMMIVVAGVRMPIHGSDRTAGQDTAEHHAGC

SEQ ID NO: 2815 - protein, 388 aa, Methylobacterium sp.
VTVGLCCLVTLIEGFDLQAAGVVAPRLVSIFNLTPGQLGLFFSASTMGMLIGAAFGGRFSDRFGRKKTLIVSVALFGLMSILTGLAHSFEVLLLARLLTGVGLGSALPNLIALVTESTAPGRRASAVALLYAGLPAGGALASLFTLVGAESHHWSTIFITGGVAPLLVVPLIWAWLPHSSTASAQRGGGSVRSVPTALFGEGRAATTLILWLAFVLGLLVLYLLLNWLPSLVIARGMSRADASWVQFVFNLGSALGSTATGLLMDRWGKVTTAALVFSASVAALILIALVPSDLSALVFAGFFLGVALAGTQAVLYALAPSCYPTDVLGTGVGAAVSMGRFGSVLGPMLAGTLVGAGRSDVEVLVALIPILMVSGGAATILSLRIRSA

SEQ ID NO: 2816 - protein, 253 aa, Methylobacterium sp.
VIFSREAFEGRDFLITGASSGIGQHTAVRLAEAGARVALIGRSTERLAATAALLAGDGHSSHSADLSDAEVTADLVQGIAKQHGRFFGIFHSAGTALILPARATKNRHLDDVFAAGVRGAFGVARAAAKKDVVVDGGSLVFMSSVSSMRGRPGMSAYSAAKAAVDGMVRALASEMADRRIRVNSIVAGGIQTAMHRDFTESVGSEMVRNYEALHMLGFGRPDDIAHAAMFLLSDASRWITGSNMVVDGGYTAK

SEQ ID NO: 2817 - protein, 264 aa, Methylobacterium sp.
VAPSGRQILPGGRQIPPGRREAAFTAKTFLVLYQQLARHRQMVRGLLWSPPASATKERDGIVVSRADLAEAFFRQTLRPASSAARGAEGTARFSLEATEQRPAAPARPASRRDDTASARSDAIRADRMDAARTENAKIGAARTGAAKGDRAKSDKAESGPSGALQESRAQAASARSKPLAARTGRDGAEAASARNPAAAKTANSTAQRPERPAADGAEPAQEAAAEEAAAKEAGAAEVSEDQTGERDETDPASPEAAAPAAARW

SEQ ID NO: 2818 - protein, 408 aa, Methylobacterium sp.
MPEFRFIAATGTNERREGLLEAGGVSEAAAELSRRGLLVIRITPQARHRSLWALLNREVALTAPISARERVSLTLEWANLLEAGVPLDEMLMLSATGVRRKGVRTVVTAIREAVKGGASLHEALKAHSSCFSPIYVALVQAGEAAGALGPALSRLARDLEAGQDFSARIRGALLYPAFLVVTATGAIVVLLTVVVPSLEAMVTERGSEALPFATRAVIATSHGLRDYGMPAAFVAVMAILGAVALFRLPSARRRFDRFVLELPGLGSLARTADASRYLRTLSALVAGGVALPRALPLAVPALRNRALAAAFETAHAKVLVGAALGDALNESRTLPSDALVLARLGERTGRLAEALGHAAILLEKRLRLRLEAIATLIGPLLTLSFGLLAGLIVYAMLSTILGINELVR

SEQ ID NO: 2819 - protein, 1164 aa, Methylobacterium sp.
VASVLASNAKHAFVVDGGETGRLVRSRDWSATPLGPIEGWPPTLKTAVNIMLTSPGPVSILWGPERVQIYNDAYIPIAAERHPDALGQPVAQNWSDAYEAFLAPILDRVFDGQTVRIDEYAVPLRTLSGRVEQRFFTGSFQPLHDETGTVEGVFHPLSEVTGNKAAADDQRRAEQALRESEIRYRQIVEGAEDYAIVRLDDRGIITTWNTGAERLTGFTERDAIGQPGDILFTPEDRALGRTEAELNRARSDGRALNERWHMRKDGSRFWASGLMMRLDADGGSYLNMFRDRTAEHEAEAALAAEVAALGRLQEVSTRLVGDEAPQALYDAILTAAADLMGSECASIQMLDAAGDLKLLAHRGYDPRSAAYWQTVDARSESTCGLAMTTGERVIVPDVEDSGLAHRSGDLQSYRWTGMRAIQTTPLLSRSGKPIGMISTHWKQPYTPPERDLKLFDVLARQAADAIERTSAQANLRESEARQAFLLSLSDAMRSLKTPADIASLAAERLAERFNLSRVFYAEFFGSLMRVERDYTRGVGSLVGEHDLAAFGPDLLRAYHDSPIVKVDDVRTDLRFSEDARSGLLARQVGAYLDVVLFEHERWVSVLALQSAKPRNWTSSEEGLFREVGERVKAAIERARAEDRLRELNDTLERRVAEALAERNMLAKLVEMTDVMIMAIDLDYNILAINAANADEFERIYGVRPKAGDNILALLADQPEHQEQVRIGWAQGMRGEPVTFVEDYGDPTRVRPYYEVNFRPLRNESGELIGFYQFVTDVTDRLRREAQLAEAHDALRQSQKMEAMGQLTGGVAHDFNNLLTPIIGSLDMLQRKQLGNEREQRLIAGAMQSAERAKTLVQRLLAFARRQPLQPVPVDVAKLVTGMGELVASTTGPQIKIVVEAPDGLPPAKADPNQLEMALLNLAVNARDAMMEGGGTLRISTRVEDVRAGHRTKLRPGPYLCLSVADTGTGMDEATIARAVEPFFSTKGVGKGTGLGLSMVHGLASQLGGALVIQSRPGLGTNIELWLPQSTAGQEAVRPAAGTSELPATRGTALLVDDEEVVRISTADMLTDLGYAVVEATSAEEALHLVNTGEHFDLLVTDHLMPGMSGTDLARAIRTAKPGMPVLLVSGYAEREGVDPDLARLNKPFRKDELASSLAQLMTEH

SEQ ID NO: 2820 - protein, 85 aa, Methylobacterium sp.
MRRPFAAAPQELNDTEEHMRAIKLIPVLGLLALGLAACKDEKKDTTGTTTPPANTTTTAPATPPAAGQTTAPTTPPATNKPAGQP

SEQ ID NO: 2821 - protein, 58 aa, Methylobacterium sp.
MKTATLAFDDGATTIDLHAADEQAHRIRNDDIWANFDIDTIGCLVPNEASDIIADTRR

SEQ ID NO: 2822 - protein, 37 aa, Methylobacterium sp.
MKILLLASSALVAATVAASAADLPRRAAPPPVFQPVP

SEQ ID NO: 2823 - protein, 119 aa, Methylobacterium sp.
MLRSFEERERAEELLFVIGEERRFLNRRAGAQALADFAIRKLGCDARTSRAYADVLIDAMIHGASNEALLERVRADLAANLADFSLEELRAVMLGGSDPALRSRPVVTPRSPVRSSSRL

SEQ ID NO: 2824 - protein, 76 aa, Methylobacterium sp.
VLEARHDTFMTTPLPHDASAPSRRRLRPAPLPAPAPILVSRPQRSPMTILRLDSGPDGLPPMTAGEEIVLETCLGV

SEQ ID NO: 2825 - protein, 572 aa, Methylobacterium sp.
MTALGTLKGITAQLATTGNRLATGQRIAAASDGAAYWSIATAVRTDNASLRAVGDTLGLGAAAFDVAYAGLDSVLSDLRSLRATLQTALAPGIDRAKVQTEVAAIQNRMRATADTSVSAGRNWLSVDSASATYRPREDIVAGLSRGSSGAATFLTFPVEVEALKLYDASPTVIRTAPMPASLSGDIPLAITSAFGGRGRADFTTAIEASFRLSTGSGSDVIRLNAVNLASQVGDLSAVTPAELTDAINAEIARSPTLTGNVTASLTADGRLSFSTMATGASASLTLHHLVPSLGYTTADLAIASVDRRQLFSPAAFAPDLYRNVDLSGSNTKSITLGDGTASVTYTFGANSQPPPADLTSVTFDEMSAMFLHERRRVNADFWMNIGGGAGGHVFVATGRAEGPSAVVTVSGPDVATFGFTTGQSAVGSEYVQYGMPKSASGRDGTQMASTRGLLDTPGASGYAVATLDVSRLRGASGDATVQAMIRDVEAVIARATDTGAQLGAGKLFVEGQRMFLDALVKTNERTIGTLVDADIEAEASRLKALQTQRDLAAQALNIANAAPQAILTLFRS

SEQ ID NO: 2826 - protein, 582 aa, Methylobacterium sp.
VTSLSTNTVALTALGTLKGITAQLATTGNRLATGQRISAASDGAAYWSIATAIRTDNASLRAVVDTLGLGAAAFDAAYAGLDGVLSDLRSLRATLQTALTTGVDRAKIQTEVAAIQARMRATADTSASAGRNWLSVDSASATYRPRENIVAGFSRDPSGAATFSTFAVEVEALKLYDASPTLIRTAPTPASLSSVIPMAMTSAFGGNGRADFTTAMEVGLSLSTGNGSVVIRLNAANLASRVADISAVTPVELTEAINAEIARSPTLSGHATASLAADGRLSFATMATGASASLTIDHLVPSPGYTAADLAIVSVVGRQSFSPLAFAPDPYRNLDLSGSNTKSITLGDGTASVTYTFDASSRPPPADPTSVTFDEMSAMFLHERRRVNADFWMNIGSGAGGHIFVATGRATGPMAVVTVSGPDVAAFGFTLGQSAVGSEYVQYGMPRVASGRDGTQVASTRGLLDTPGASGHAVATLDVSGLSGASGDAVLQAVIRDVETVIARATDTGARLGAGRILVEGQRMFLDALVKTNERTIGTLVDADIEVGASRLKALQVQQELAVQALNIANAAPQAILILFRP

SEQ ID NO: 2827 - protein, 198 aa, Methylobacterium sp.
MLARLLSVFRRPAVAGAPVVRTPAPMAAAAASPKVRNRIAAAILAGTMATGVGGLAVTKIGGHEGYSEKAIIPIRGDVPTICFGETRGIRMGMTRTRAQCNAMFLEALSTFADGIESCVKRPMSDETYVAFLSLAYNIGVGSKSRPGFCQSTAVRLYNAGDKRGACEAITRFNRAGGRVVKGLVNRRADERALCLNGI

SEQ ID NO: 2828 - protein, 35 aa, Methylobacterium sp.
MSGLLTSGLATGPGGIVGAILGLVSGGGSILAVLA

SEQ ID NO: 2829 - protein, 46 aa, Methylobacterium sp.
MYDLQGKGRKSEQQLHAGSLDAIALAHHLVSTVIVRDHRIAGLQHR

SEQ ID NO: 2830 - protein, 105 aa, Methylobacterium sp.
LVQAYTRLILLPARADGSKMAVIARFGTRDICLIETLAADAPPESVALRVELYDRARGHAVESMACNDLEEAEAATTELMKDAREAVFGCLPPSSGQPCADAAGR

SEQ ID NO: 2831 - protein, 286 aa, Methylobacterium sp.
MVGAHEPEGSLTMASPTPASGLREGLSYAPPHRPSDRLAGETAVITGAGSGVGAETARILHAEGAHVVLNGLTAGRLEALAAELGPRTTVLPGDVTDLAYLERLAEEAQAVGGGRVGVLVNNAGATIRGSLAETTPDNFMSTVELNLNGAVQLTRLLAPAMCEARQGSIVNMASITSLKGLGGAVAYTASKAGMTGVTRALAVELAPFNVRVNAVCPGVIDTPMTWEHAEAQPDPAAHYAMLRARQPMNRLASARDCALAVLFLASPDSAFITGAALPVDGGRHAA

SEQ ID NO: 2832 - protein, 62 aa, Methylobacterium sp.
MRVSLGFKLAMAVGLLGLVGAGISAFALRQASQEQARAALTESFWNAGLQARGLAQSIEHAV

SEQ ID NO: 2833 - protein, 293 aa, Methylobacterium sp.
MQSDEKLKYSAPAAACAADLLLALARADGPMTLAALIERTTYSRSLLYRTLKTLGTRGFVVEEAAPGISGSLHYRLGSAAAEIGGAYQSNVPFEESVRSALRALAQRTGETASVATIEGEDVLYVMREEGRYSVLAVSRVGKRLPAHATAMGKALLARFDDGEIRALYGRGELRRFTGNTITDSGALLRNLAEVRLRGYAVEHSELVQGRCCIAFTLQAGPGPGDLLGISLSTTEARFEVEHDALILEVLSTRDALLADLSRRRVPGDRKVARDLTASLGAISRRSVPAAAGT

SEQ ID NO: 2834 - protein, 143 aa, Methylobacterium sp.
MIRVTRLHHTAIAAHDLDAMRRFYTEVIGLDAHPTKTNWLRAGNGFVVHLMPSPDAPASGRIEQHFALEVESLRETAAALLRQGVTPYMASLEYETHAVTDAGDPLDFGIGTLFVADPEGNTIEFVEPDTGIFAEVPLEAQDT

SEQ ID NO: 2835 - protein, 377 aa, Methylobacterium sp.
MTPEHLCERDVEAVVATTPESVFLLSGHLTWLGERMRGWMGGPAGDAAFQAGYAVLTRDGRVGLAARAVTRMAAEAAAPDSLVLYGRACPAADADAALSLLLAEMGLAGRTIGVEWDGAGRGLARSLEPVATRDASLWLRSLRAVKTEAALRTMREAATATEAAMEAVFAAWTADADPRALRTVFRVALAERDCDFDHLVFGAPGGGVCDAARPPEPVTALFFDAGARCGRYYSDTGTTLTRAGFTAADRERHAGALAALAAAERALRPGRPASSAWAAMQDEARRIPGLVAQGHGLGLGIREWPLLGPPSDAVLSDGLGTYPVDAVLAPGMVVNLEAGGHFADGTSVQVEKSFVVGADAAVPLAAQPRDAPIRLPA

SEQ ID NO: 2836 - protein, 624 aa, Methylobacterium sp.
MTRQKTIRLTTAQAILRYFAAQHTRCDGRERPLIGGVFGIFGHGNASGFGHALATGAGGLTYHQGKSEQAMVHAAIGYARAHNLASTLAVTASIGPAATNLVTGAGTATLNRVPVLLLPGDVFASRRQGPILQGLEMAGSYDMTVNDTLRPVSRFFDRITRPEQIIHSLPHATAALLDHGQAGAVTVAVCQDVEGEAFDFPLALFERRVHDLERLAPSETALAAAAERVRAARKPLIIAGGGVRYSEAEASLAALSDACGIPVVESFAGRGAGREARLNAGGVGFIGSPAANELATEADLVLAVGTRLSDTLTGSHTLFQNPDVNFVTLNLAERDLRKMGALALRADARAGLDGLAAALEGHTAPAEWRDRADRAILRHVARVGEIVGTENPRMTGYEAVAEIKDAARREDRVVFSSSTAIGQAHTIWDSRSDAPVDMEYGFSCMGYEIPAALGAAMAGTVKGRILALIGDGTFLMGNTTEIVTAIQEGLAFTIVVVVNRGWQCIRGHQLGSYGEEFGTQFRRREGDARNLTGETLAIDYVANARSLGADGLDVHSRAELRDALEQARRSDRPFLIAAHVEDAPLPIENGAWWEFGIPQADAPEGLRETRAAFEAAAAKHRWFV

SEQ ID NO: 2837 - protein, 471 aa, Methylobacterium sp.
MNAVARCWWEDELAACTFNDARLRQRLHRLVAQMDRSLGASLPFACQDWANTKAAYRFFANRRVSEAQILSGHFAATGERVRASDGPVLVLQDTTEFTFQRESRETVGITRRVNSGRDKAGQFRMHTLCGLLMHASLAVTADGLPLGLAAVKFRSRDKFKGTNALKRKINPTRVPIEQKESFRWLENLRQSTSLFGAPSRCVHVGDRESDIYELFCLAHGLGTHFIVRSCVDRLAGDGRHTITDAMSEVAVQGLHRVEVRDRAGRLGTAAVELRYRRITVPPPIGKQQCYPALSLTVLHAREPGTPKDRPAIDWRLITDLPVDDPDQAVEKLRWYARRWKIEVFHHILKTGCRAEDARLRTAERLVKLIAVFCILAWRVFWTTMVGRAAPGADPRLAVTAAEIALLDRLVPDRAAGGRTLSAYVVKVARLGGYLARSRDPPPGNLVMWRGFARLADIMLGATFARASPGCG

SEQ ID NO: 2838 - protein, 240 aa, Methylobacterium sp.
LSRPQASENDEIVRCTVQIVKGYVAGNRLPPEALAALITTVSRALRSAPDDEIEPVVPQDVLPQDAFVGSDRPRMQAAARALTRKEIADSIHETFLVCFEDNKPYRMLSRHLRLFGLTPDAYRAKWGLPDDYPMMPAFDMKHRAELARQRKLGKYDRSTAKPRKAYVLKAKAKATVQHDGTPAKPKASSSDRIRGERPRPERPLSLHDRSAAKPDTKNPEPFGSGEWHRRAAPAQVASAV

SEQ ID NO: 2839 - protein, 158 aa, Methylobacterium sp.
MGEIVMTTVTIGGPLRGRDAVAALVEAAEAYFAEAESLVRDAIADDTSVTFEGEQNFGLTPGLDAFCREYGLSYHRAWIARPGVFEAGVKHWKPGMASPVVEAADEGGDPVITLAALRNCNDAGETLPDILARLEKAEAAAVPPLTLVEDADAWQAAA

SEQ ID NO: 2840 - protein, 150 aa, Methylobacterium sp.
MFSPFVWWYAWACIERCAIGQVLHGSATTTEAIRRAIQARQESVRAASNATASARPHFRSGVVGRHRRTRAWGRIEARFTVLSPEEEAIVVAFRRHILLPSDDCLDALQPSVELAFVDQGYTGQKPATGARVEGESIPEIFPLHRRAQRS

SEQ ID NO: 2841 - protein, 397 aa, Methylobacterium sp.
VSVPLHSAPEIGGVRPSFDRSWLRDAVDSIAAEAARSADTHLLRVPLGGSAGIDLYVKDESTHPTGSLKHRLARSLFLYGLCNGRIGPRTTIVEASSGSTAVSEAYFAQMLDLPFVAVMPASTAPAKVAEIARYGGSCHFVEHPGAVYAEAIRIAEETGGLYMDQFTHAERATDWRGNNNIAQSIFEQMARERHPVPDWIVVGAGTGGTSATIGRYLRYRGHATRLCLADPDASVFHRHLADPSVTARSGTASVVEGIGRARLEPSFLPSLIDRWVAVPDAASLGAARALTEVIGRSCGASTGTNLWAAAELISEMAAQGRSGSVVTLLCDSGERYRGTHLDPDWIRARGLDVDGPRDAMMRFLTTGCAPCAEAGPAASAHPYRETGSSSATRSSEQ

SEQ ID NO: 2842 - protein, 88 aa, Methylobacterium sp.
MADPNPTVGELFKAKVVTHDDLNALVDAVLGGRMEERAELGEGDTVDVAAAVKANAFATAVLRDKTSTTGARRTATRTAILLARTQKA

SEQ ID NO: 2843 - protein, 26 aa, Methylobacterium sp.
MFPLLRITITKNPSGEWSVTITLGLM

SEQ ID NO: 2844 - protein, 96 aa, Methylobacterium sp.
MKNLLILASAAGLMAASLVPLTATSADARSRHKSRGIVTSDGSVTGGRGRGQTISRGATGASTISRNSAAGGNANQPERAVPQGSGGGGSGGAGAQ

SEQ ID NO: 2845 - protein, 65 aa, Methylobacterium sp.
MTEAEREHEWNRDRLLVEIAEAVERMLELTRHTHPSGSMLTLGATQQQDRLEAARERFVGSMEKQ

SEQ ID NO: 2846 - protein, 32 aa, Methylobacterium sp.
MFFFFSNRLGCLGSILISVLLTVILIGIFRGG

SEQ ID NO: 2847 - protein, 238 aa, Methylobacterium sp.
MPATPSRSQNTSRRAAAPVAAQRDLDAIYGILSKTYTTFDETDDPWMTNGLSSTPFKSLVSVCLSTMTITQRVVNAAVPLYEKVSTFEELRDLPDDELRRIIKPVAHYNRKTKNLKEMARQIIEDYGGKIPGNRDDLMKLQGVGRKCVDILMNFTFSEDSIAVDTHVLRVLNRLGVVDTTSAKQAADLINAQTPARYKRHAHEWLIQHGMKICVARTPKCADCPLTKHCDWYADHRTA

SEQ ID NO: 2848 - protein, 348 aa, Methylobacterium sp.
MNVRINRLDPHVPDPVESRRRAAGRVVRIAYAVGIFGVLGFFVVYFGAPFVFLSGPGIVSSPRHVLSLPFTVQVNRMNVRPGSTVKAGDEIGQVYSPEQETIVATYMRALSDIAGRSAELRVKARVAAESLEAARAYQRETETALERIAAMASTTTTFRVQILRERALANKDVISQQAEAEEATKQLVSLDAFSKQIHEQLDEVKQNFRSGRVFAPVGGIISTGLAQTGQSLVAGAPIADILNPNDFYVDWYIPNERLIDPRIGNDVFVLFGHRRIPGKITEILPVSAVFGSSQQLTLRDRPATQIARIRFTSDASTPALNSTVCVHMHYSKISTDISRSLIKICGLD

SEQ ID NO: 2849 - protein, 123 aa, Methylobacterium sp.
MGIPRPHLPLFHGSGDIRVATQVLVFVELSLRLLLGPTMTLPFPVISVVPATGLAILIFIVSATPLVTVAIIVAAAAFTWPIIIIIIVIVIVPATTNAAVALAIALTTILPLVVAVVTPPSLG

SEQ ID NO: 2850 - protein, 26 aa, Methylobacterium sp.
MTLFTILLACNLALGLVFSLIAASVE

SEQ ID NO: 2851 - protein, 294 aa, Methylobacterium sp.
MPSAPWPLIEISVAAVSDDNRSSLRSALLELVAETPGLDFSTDSTTGQFIFKAGTERCLGAALERLRAGPIAFETGRLQVAYRERLTRRREIDFLHKRVIKGNESQFARVKLRFEPSEPGVGNVFNATITEGILPIEYVDGIERGVASVLTAGVVAGCPVIDVTAELIDGAYHEIDSSPLAFEIAARAAFREALHGSAVLAEPIMAVEIAVPERSAAWVISDLQGRRGLIWDRSVRSDATLITATVPLAEMLGFGSRLQSVPGDEARFSMAFSHYAPVPSLDLDPPPMVAALGA

SEQ ID NO: 2852 - protein, 117 aa, Methylobacterium sp.
VISKLALLPMAALGLTLSACSGEPSEAEMLQAVSRFTSSVYQQQAAALAFMVGPSRGGVPQVPTITAFRKLGCEPATGGASGHVCQFEMTMNNGKGETRDRARFFKAADSSLAMSIN

SEQ ID NO: 2853 - protein, 318 aa, Methylobacterium sp.
MPQNAFISYAHADEKRLERLHKHLVMLRRDGSLQAWSDHAIVPGDNVRQTISTALEQSSLFIALVSPDYLASNYCYEKEFQRALALQAEGRLRIVAVILEPCDWLNSPFSEILVLPKDGKPVSDWTNENTAYLNAVEGIRRALTAAPSPLLEAAVEAAGGSASSPARRVRVKQQFDAIQKAEYAEQAFRTLQIYFQNACTELHEASDQIRARFESMGPTAFTCTVVNRALMRNGEAHITVRHARGGRMRVGDISYVYQPHADDGSSNGWMSVQADDYNLFLNAVIGHLGMDREEKVTPEQAAERLWNSFVTKAGIEYE

SEQ ID NO: 2854 - protein, 42 aa, Methylobacterium sp.
MLNRWESFETLDAVIGLPAIGARLALADIYEDVAFEPGRSVR

SEQ ID NO: 2855 - protein, 240 aa, Methylobacterium sp.
MVVSIHGHYFEERWFSTWMQFARRMNNIWFAPLSHALADTLITRFGAPRSRTVVVGVAVDTTFYTRTDPLDTRFVLSAGAAGRDYSTLIAASRGIDAKFRIASGSTWIGEAASSDALPSNVSMGSAGSLANLRNLYGQASCVVLPLTDTYHATGYAVMVEAMAMGKPVIATRTGAPSDFVISEQTGLLVEPGNVAAMKSAILFMLDNPDKARAMGEAARLLVETKYSMPRFTDTILAMAT

SEQ ID NO: 2856 - protein, 529 aa, Methylobacterium sp.
MTTAAAIPEPERRRGPAPQQPRLVLRSSRTDATRKTIYIRDGKIEISTRLPEGSESEAQTLLDLYRLQKGAKERGIVAPRMVPVAAVLAHLLEAARPGRNATDAEKATYSALTTRLGTLARYFGAKVLKDVTTAECKLYIEWRTSLPDARYREGAPDAPLAKVASAREDLFELRKAVRLYADEHTLTWHPNVHIPKAGPGRTRWLRRSEVARILWAIRGRVWDPATGTWMVETVTGPDGVTVTRHVLRPRHMVLNRRMLRRFVAVGLYTGTRNTASRELSWLASEDGGCLDLDGCFIHRRGFGRDPKEGKPRASSRLARKFAAMAIPWRDADLAVGITHVIHRPDGSPYATSPSCIWDAVIADAGLGEEVVPHVLRHTAATWLRVGRTDVRAAADLLGMSVQAAVRIYGQWTLEGQDTAADELGYGKGLKADVFVGGKARRPRRDPAREARPVPVVEPVPVPVPAFVPRRPPMPAAAQIEEAPPIFASELLKTDHMKRDRRRRDRRISRERSAKQLAYLRRDALTLISR

SEQ ID NO: 2857 - protein, 284 aa, Methylobacterium sp.
VTYLFQILNGVGLGLLYFLLAVGLSIIFGLLQFVNFAHGAFYLLGAYLAYEGVERGLSFWVAMPMAAVIVAALAGMTERLLLRRVYKLPHTFHILVTVGLALVVQELVIIVWGPLGGNVAAPDELSGVMILGDFIYPEYRLFVIGFTVILAAALWWLLDRTRLGAIVRAGSESPQNMALLGYDTLSINTAVFALGAGLAGLAGALAAPIRGVEPFMGVEALGIAFVVVVIGGMGSYAGALAAGILVGVAQSLMATLWPEGARLVIYLGMAGIIMAMPRGLLGRA

SEQ ID NO: 2858 - protein, 396 aa, Methylobacterium sp.
LVVGAGAVSGVALPGLLRSARAADGPLVIGAPLPISGAFAANGKFASLGAAFAARKAAAALGRKIVVTDIDTEGKPAPAARKLQEAMAQGTRLFAGGILSSEALVMGKEATKSEGVFITTAGADEITGSDCNRGTFRWSVPTFGAIAQTVRPLIEQMPQAKRWYTITPQYVFGEGLLSAAKVVFQEKGIEHVGNSYHSLAEKEFSGYLTNAIAAKPDVLLLLNFGSQSSDALRQAVSFGLKKRMTIVLAWASGLEQFEALGADLCEGVYFGAQYWHGIDSPLNKELVSKLRESAKMTPNYSFAGSYQITKLLLDAVAKAGSAEGPAVIKALEGLGYSGLTGHEEIRAADHQVIKDYYLLKGKAKSAMKDKDDFANVVNAGKSFLSPEAAGCKMQQG

SEQ ID NO: 2859 - protein, 93 aa, Methylobacterium sp.
MTDAQSYTMALDLAVQNPVRVLNEAARELVRRRLAAFDHEALALLAGDVPKALAILIELHDLTSAGAVVLHIDCKPNPDPTPSPRIDADPIAV

SEQ ID NO: 2860 - protein, 301 aa, Methylobacterium sp.
MTLLADASTTMSGLAIGRPRALARRFGNAAGSRAYDLFVPSGYEGAPLPLVVMLHGSSQSSRDFAIGTGMDRVAEEQSFLVAYPDQPRSANLGKSWNWFRNGDQKRDEGEPSILAGLTREIMAKFNVDPARVYVAGLSSGGAAAAVMALAYPDIYAAVGIHSGLASGSAGSMSVAFSTMRRGALLRPRQATHPLPTIVFHGDRDTTVSPVNGDQAIAQAQPDGELNITTVEGRSDGGMAYTRTILIEPDGKWSSEQWVLHGGGHAWAGGHPSGSHTDPTGPDASREMLRFFMTHAKGDGAY

SEQ ID NO: 2861 - protein, 162 aa, Methylobacterium sp.
VSAADLSDVEAVFDDLRGYSVRVDDEPRRRGAAEEFATAVPPGCGLQDKHAFVAKRDGLPVGLLDIIDGYPGQGVAFIGLLAVNESLHGAGIGRRLYAEAERYVRDRLGAYTIRLAVVEANPVLGFWQRMGFSPTGESKPYGGGVVASRAIFLEKALGSESD

SEQ ID NO: 2862 - protein, 60 aa, Methylobacterium sp.
MGKGRKVLSNDHARALIKQAVAIVFGDARAEAEAAAEIATIEAVHVQTAPKPRRFRRPPI

SEQ ID NO: 2863 - protein, 152 aa, Methylobacterium sp.
VPADARWPEGGSDDTRHSPRARDRRSHVSVSAFSFSTLFQIKQLLKKMFLLAEGKIGLLLRQQRNKFAHEAAAFFLGLLGHDQFSDDAFRRFSWYDGPCLCAPIHVASRMDGRQAILVPAGRRRLLPWLVPTKMPRAAEPAGQVFGGTATVH

SEQ ID NO: 2864 - protein, 330 aa, Methylobacterium sp.
LCKAVADPGKHRGAASAVLSAASAGLKGPPVTAFFYALTVLIWGTTWIAIKNQLGAVPVEVSIAYRFALAGSVLFLALVAMRRFQPIALRHQPFVALQAVCLFSCNFLCFYNATIYVPSGIVSVVFSAATIFNMANAFLIHRRKPEGRVLGGAMFGIAGIACLFWETVTSTQFGADTAFGLGLALLGTWFFSAGNLVSARNQRHGLQVASVNAWAMLYGAGIVSLVALAQGIPFAFETSPVYVGSLLYLAIPGSVIGFTTYLTVVHRLGPERAASMTVLFPVVALTISVFAESYRVTPLVGLGLLFVLLGNGLVLGRWHRPAARRPMAKA

SEQ ID NO: 2865 - protein, 68 aa, Methylobacterium sp.
LAAVPIYSMAKAAINSLTHTLAAFRPNIGLSRPCRPEDVAAVVVLASDRAGFVTGTNLRVEGGSVSTL

SEQ ID NO: 2866 - protein, 285 aa, Methylobacterium sp.
VRCRALSVTAAWGLALAAALAFPSATAAQDEPITLADDPFEVTDPHATPPGEAAYSIVGSYERAATGRVRSTWGAETELSYGVSPNLDLRIGQTGAYGNLDVRRRLGTVSTEVGGPGSEQERAALGGTTRLGALYQLTEESGSWPIVGLLGRVRSLYGPGGTAYETEATALFGKTLIAGERPLGVSLNIGTVYRFDPAPGERMTRYLVNASAGQVLTRDTALVITYAREQQEKGQPDYSLAQAGVRHRLRDQRAILGAAVGFGLNRNTPQFQVALAVQWELGASK

SEQ ID NO: 2867 - protein, 33 aa, Methylobacterium sp.
MTKQISAADRIVVTKGDRMTPARSLPAFAVATH

SEQ ID NO: 2868 - protein, 127 aa, Methylobacterium sp.
MKVTVSIDVPSIEEGLKFFGDVFGFVETARPHPGYATLASGDATIGLLAKPAGSSPAPGSNDLRRYERHWTPVHVDFRVDDFEGTLGRALANGARSEQVHRVPGFPPVAFCSDPFGHGFCIVGMNTL

SEQ ID NO: 2869 - protein, 117 aa, Methylobacterium sp.
MQRRPTDRTALPRFPAILGLLLLAALWLTAAWSALPQPAAAQWGDSYDAPAADPYAAPPPRRRARGAYADEYGYGRAPARRAAPPQEAPRQFYWPWEDQPRAQPTPPPQPAPGYARP

SEQ ID NO: 2870 - protein, 82 aa, Methylobacterium sp.
MAYAFDTLGYSKALRTAGIPVEQAEAHAEAAREFIMHELVTKEDLRTAMELQTLQMTVRLGGLIAAGFVAMFGALAALIKLT

SEQ ID NO: 2871 - protein, 82 aa, Methylobacterium sp.
MAYAFDTLGYSKTLRTAGIPAEQAEAHAEAAREFIMHELVTKEDLRTAMELQTLQMTVRLGGIVAAGFVAGFAALAALIKLT

SEQ ID NO: 2872 - protein, 360 aa, Methylobacterium sp.
MERDNLGLRVAAMTLAVVAARRLDLRIVSRRRLGRPLRTLIVGIFQAAGATTLLIRGRIAGHGLGPCASRTRDAGMAFIRAGPHDRRVLCHRRLSLRAPLLSSGTGVAATTATRLDRWAIRTFSLSRRGVFPSDNTGMVLAAAGLRGQRITSRRMLGLRAPVLSSGARVAVVTAGLLDRWAVPRLGLSRHGVLPSGNAGLVLAAAGLRGQRITSHRMLGLRAPVLSSGTGVAATTATRLDRWAIRSFGLSRRGVLPSDHAGLVLAAAGRRARRITSRRRLSLRTPLLSSGTGVVTAGLLDWWAIRSFGLSRCSVLPSDNAGLVLAAAGLHAWRITSRRRLSLRAPLLSNGAGVATATRLD

SEQ ID NO: 2873 - protein, 123 aa, Methylobacterium sp.
VIEALADAMCLHGIPEHIRCGNGPEMISKALRKWVAKAGSQIQYIAPGSPWENGYCESFNGKLRDECLRQEIFYSLKEAQAVIALWQNTYNRVRPHSSLGYRPLAPVSFPDLAFRLPMAAAMQ

SEQ ID NO: 2874 - protein, 408 aa, Methylobacterium sp.
MMRTNHLQNFETRLPRALLGLPRAEGDPRRVLSEIQGAFSAFQARHRTEMDGVQSAVDDLNGRLAAVATGGLAIGGGEPVDAPYSAAFGEWFRTGHGEADLRAAHASGTRARIMAAMSSGSDQNGGYLAPVEWDRQVNQALRPVSPMRQIANVQSTTVGAFSTIWSNGEWGSGWVGETAPRPNTTNPQLSQIVFRSGEIFANPSITQTLIDDAGFNVERWLADEVADVFALQEGAAFISGDGVNKPAGLLGYAPGGGFTHPGGAIPVVNSGLAANLTADGLHDLVYALPAPYRANATWIMNSTTLARVRKFKDTGGQYLWQPSLDKGQPSTILGYAVVADENMPDVAENSLPIAFGDFRRGYVINDRAGIRVLRDPYTSKPFVSFYTTKRVGGGVLDPRALRFQRVAA

SEQ ID NO: 2875 - protein, 413 aa, Methylobacterium sp.
MPTPYSEPRPWRLKTHEMLPGERIVTVVDRVGMPVWWANLFHAYEVRDAGRAYATQKRTMSAIVIAFNWAAEKGIDIEERIATFEFFSYAETKNLQARLRYDASGEATGHRRPVGNGYWDARCRAVRDYVRWRAGEAMQRLARPDASDASAHLYAMAGDGLDRFCETLLSGIGRDIEQDVMGLDEEQRAALLQAITPGSETNPFEERHQYRNFALILTLYEIGARNGEILGLKGRDLHALGPAPAVEIHRRHNDPDDTRSRPPASKTKARRLPISGPLAHVLSTWMTGHRNKPGLYPGAKRNPYVFVSELGRPIAANTVESIFIALRQVEGIPDWLTAHKLRHTFNDRLSEMMDGLPEDLLRPAVETRMRNFLNGWSPTSDQGEHYRKRFVQTKAHEFLLKLQNLSAQGAARS

SEQ ID NO: 2876 - protein, 95 aa, Methylobacterium sp.
MRLADLPALVTQREEAVTLLQAIAEGVDERELAPFVSALTTAEDEQAVAIMRGSGNEVSLRVHLGAMLTDAGLVTQDEVFAALDARRALGRGETA

SEQ ID NO: 2877 - protein, 147 aa, Methylobacterium sp.
VGYSSTIKTKVRIGTTKPAAALADYTSDTFTPIAGLTDIGEFGDEFEEIKFNTIEDGRTHKLKGSADAGNWDVEVARNPNDAGQIALRAAAKSSDGVYNFHVELADGTDFYFRGNVMAGKNSFGSNDVNKQKFTVGITSEILEVAAA

SEQ ID NO: 2878 - protein, 88 aa, Methylobacterium sp.
VRRPDRTFADWIAEGLTTMALHCSCGHYATVTLADLPPRLTRTCLGQNACCAKCGKRGAQVMRDMKAHNAFLEATGWSCEPKPWPARS

SEQ ID NO: 2879 - protein, 249 aa, Methylobacterium sp.
MRRIKLSDQIAEDLCRRIARDRLLPGDRLPNERALMQHYSCAKGTIREALKALEVQGLVAMQSGPNGGAEIRPISTDAAAQQLRRFFHFQELDFAHVYALRRSLEVALSISVIGRLKPHDFQRLEANIAECEAANTSGQRRIGRIIEVDFHDMLCDASDNHLLVFMCRFLNSLLRDLVEFRSESLVEHEAFGSHNVASHRALVTALRAEDADAVSVEMHKHMCCAEHFMQRLDAKFREDLLSSSSPDRA

SEQ ID NO: 2880 - protein, 1290 aa, Methylobacterium sp.
MRPIKTIQTGVARSLRGGWLLAPLALMLLSAPASAEIDFGTRTGSGAIRVSHSGMCLAVPGANPAETVQIEQQPCSGAPEQTWRAQPSGNGFNLVNQATGLCLDSQARRDNGSAVWQIRCQTATQQTWSAQPQSDGTRLVAAFSGKCLDVFAVSRDPGAKLIQWDCWGGANQAFSAVASPAGPAPVAGTTVTLTPTEINGWYAKEIFLFVRDGSGAITRQTTVASYNSGFTTAGLNTPSPPVSVPAGSSWGVGMRVWANADKSRRGTPILYYSDTPGQRALQSTGDCATGGRRQDAWGDAGNAGRNVLYTLACTAATGPDTSGTGTGGGTGGGTDTGGETGAGGGTAGGNGTGGTGGGTGTGGGTGPGGTTPPAAAATKVSITLTAANGWYAKELFLFARDARGAIVSQTNLVSYNFGVATAGLNTPSQPLTLPAEATSWSFGLRVWGNGDKSRSGTPVLYYGDTPGQRALQTAGDCRMGSRRDQWGDAGSPGQNIVYAVTCTTGTTGTEPTGPTAGTSLSVTLTPTLIDGWYAKDLFLFTRNADGSVGTEMPVLSYNWNTMPAGMNVPSQPLGVPAGARWAVGMRVWANPDKSRGGTPLVYYSDTVGERALQTSGDCAAGGRQDAWGDSGAPGRNVVYTLRCTSSGTGGGADTGGGTGGGNAGGEGAGTAGPTPGESAPSGTLVLINRRSGNCIDSAGGVTQQICRDLPSQNWTFVPAAGGYQIRSGTTGQCLAVENGSMGNGARLVQQGCSGAANALFRLRKLEKWTEVVANHSNRCISPTGANDNRNSGSAIVQWDCDGADPQRWTILGPEGRAPSAWTAPREIGIVPVSGAVLPNGKLLFWAAEQRSAFQTGATDGTWTTLYDPATDRAVDTYIRNTGHNMFCPGTNVLPDGRILITGGIAAGASTIYDPEANTWTRAANMNITRGYNANATLSNGDSFTLGGSWSGGQGGKDGEVWSQASNRWRVLRNVKGNATADPSVSILYGDNHYWLFAGANGSVFQAGPTSEMYWIDTNGDGNVRSVGRRGSDRFAVNGTANMYDVGKIYKAGGAPAYTGVPSLDTAYTIDISAGPNGPVTVTEAAPLLFPRTYMNSVVLPDGDVVTAGGQIVAAQFTDNLPVMTPEIWSPKTGKVRRMAPMAVPRNYHSIGMLLLDGRVLFGGGGLCGGCGGADHLNFEILTPPYLLDAQGRAGNRPGITAAPASAPVGGTLSVTTDRAVATFSLVRLSSVTHSTNTDQRRVPLAVAGSSGTTYRLTLPNDPGILLPGTWMLFAMDEAGVPSVAKVVRIR

SEQ ID NO: 2881 - protein, 89 aa, Methylobacterium sp.
MTKTTGLAGAALLVVPLLAPLAVSAQVAAPQGGTATRQDQPAPALPKGACRVTDRLGGRSCTGDVPESACAAIAKEAKGEYAWTQDECP

SEQ ID NO: 2882 - protein, 214 aa, Methylobacterium sp.
MTPPPRHRSVRRLRPSRARTASLLALLLLPLAAPGLRAEPSARPGPAAAGAGLLAGHFRLVDPAGRTVDSDMLAGKPYGVFFGFTHCPDICPTTLAQLSTALRGIADPDLRIYFVTLDPERDTPAALASYMQSFDPRIVALGSERAAIDEAVAIFGVVAERTALPEGRYTYAHTAAVLVVDENGLIADRVSADIEPTALAARLAPLARLPEAAR

SEQ ID NO: 2883 - protein, 147 aa, Methylobacterium sp.
MGTFETARPTDLDPLIAAMGPEIWGWQYARRLTGQSAWRARPDVDERRERMIAADQMTADIELWERAIATHDRLAERARRYGDRPPDPLAVPSLVRDILAERQTAALQRAERRRRRGEGEGGGPEPVPDEAVRHPVPPNQSNPNPAA

SEQ ID NO: 2884 - protein, 239 aa, Methylobacterium sp.
MRWETLNAYVDGELDAQDRRAVAETLARDPVLAARVATLTRLKQGVKREVKAAAVPPRRAPIARASLGWACAAALVVLVGTGWLALSSRAPTDPARAAFTAWSSAGSPSNDVRLAGGLNGFPLDLGAAGFRLVYVSEGNSSVGRLAGYEGRHGCRLAVWSGPSRAQAGLEIPQGSGGGLRVARWDSGRRRYVLLSETVPVERFALLAEAAVLLTEPNETDRLRLALDRATGLSERPCTG

SEQ ID NO: 2885 - protein, 162 aa, Methylobacterium sp.
MRSIGQHLVEAWPRLFRYALTLTREPDAARDLMQQSALKALSTGTTPSEPRAARAYLFRIVRHAWIDRLRRNRTRREDDLVDWPDEGFDDRLIEAIAVRQAFATLDAPCRKVVTCVDVEGLSYRETAERLGIPVGTVMSRLHRARRIMLHRIAGPSDGSEGP

SEQ ID NO: 2886 - protein, 45 aa, Methylobacterium sp.
MPRVRAAFDAAFIAVAVQKTAARRPLLRISLPRFGERSENPDHPD

SEQ ID NO: 2887 - protein, 575 aa, Methylobacterium sp.
LDFRFLTYDPIFERTDINFAETLGAFWKLARSGLGGLFRQPRGPVSNISDRLRWTAGYVVAWVEDEQFQQETRALVLDTLRDYKPDIVLAHSLGSLVTYNAFSHADAAESEAAKALAGTHYVTFGSQIGNPFVLGNLTYGRVQRLAVRHWHHLYNEHDDVFTAPLKVQGVDNFNQLLTPFDLPGFGDHDAAGYLTHAVTQTSFWTPMVDLAARQSRAVGRKAVAGVDRWNRSLPTAAPSTRRKALLIGIDDYPDPANRLSGCVNDVFAMSATLQDCGFEPEQIRVCLNERATADGIISRLEWLVDGAQPGDQLVFFYSGHGARVPEYGQQQEPDRLTETLVPYDFDWTPEHGVSDEQINSFYAQLPYETHLLMIFDCCHSGSMHRDGAGRARGITPPDDIRHRQLRWNREAEMWVERDFTPLNKAFSSQAAKRQAFFGSNLATVRLGRAALLRVNDQKSYDRAKKARGAPIGPFLPVIIEACGEEQYSYEYRHGATSYGAFTFCLTSILRKEKNITFQKLVQLATERLERLGYNQKPQILGPAIDLDAKVPFETGRVGQPPARNLPGSATPRTSG

SEQ ID NO: 2888 - protein, 238 aa, Methylobacterium sp.
SSPFFRFSDTQVTYTYLNDLRQPGVTGGRAGRSIEGRSAPGNMLSLTHVNGWEYGTNFVNLDLRRYGSQIPAGRPPYPGPATTFDYGQTTLFLTYRGTLSGNAMAGTPLFVLPGIIKDVSLAYGVDHQSDNTRLSLLRTRAMGGLSVSFDVPVGFFNLAVFAQKDWFRFADLLPPLRQTGTDIVPRVEATYLVPLTFTGLPLSLTGFASYNPPRGDDPKGGRLKAEVLMRSNLVLDLG

SEQ ID NO: 2889 - protein, 63 aa, Methylobacterium sp.
LAQASDPGGAGNKTDPLIAIFRLCTEAAQIIDPAETPRLHEAMQELLKEIGMEMGRRLNARLH

SEQ ID NO: 2890 - protein, 121 aa, Methylobacterium sp.
MCGLFSNLPSTQYDGETRSVRLGGHSTSIRLETMFWRVLEDLAASQDVSLPRFLTVLYDEVLDRHGEARNFTSLLRCACLTHLELQATGGTVSWQSRACANSQDAPRFGLRHGRPHEAKIA

SEQ ID NO: 2891 - protein, 129 aa, Methylobacterium sp.
VTVAADATITAAIAGHAPAIATGPTAESARPATVKAAAMDAATPEASASAATESARICRDAGQDQGCESRRRNQESFHDVVSSQEDNMEVRRISPRRRDRTRNLLGSQTLVDRFVLPSLQRCLIPEDSR

SEQ ID NO: 2892 - protein, 348 aa, Methylobacterium sp.
MKSWAAVAVARRALPLFLAVAIFGACAGWVFAGAFETGRPFINTIYGMFFSLTLFLYERGKLLPGLRARVRRAATPIFFAATLLIFGCTFVVGTTVAGTVLWAVGIASTPILDVAPTAQKLTYAFVTAALLVAVLRMRDLIGPRMFMSFLLGRYHKPRREERVFLFLDLIGSTRFAEERGDLEAMLYLGHVFEVLARPVELYRGSIDDYVGDMALVTWRMGPDLEDAAPIRCLFTFLDQVERDAGEWRRRFGEVPRFRAALHCGPVMTGEIGVDRHKITYFGDVINTTSRLESLAKALDEPVVVSAELLARLGPVPEGVTVTNLGRHSLRGRGEALEVVGLRRSIGED

SEQ ID NO: 2893 - protein, 122 aa, Methylobacterium sp.
MATRAVTALFDNQDTAARVIDRIEAEGVPHSDIGIVSLNGANRPAGALAGGATGEPVAQGHASSSEHEGSAAEGAGAGATVGTVLGGGAGLLASLGLLAIPGAGPVIAAGWLVAALSGAGVG

SEQ ID NO: 2894 - protein, 139 aa, Methylobacterium sp.
MIILDTNVVSGLMRASSDPILVSWLDSQPRNSVWITTITVLEIQFGLDLMPDGRRAAGLRTAFDRLVAEMLQRRIAPFDAAAAGETATLMAARQRRGQPQELRDSMIAGTAIARRATLATRNVRHFPDLVVPPVNPWDE

SEQ ID NO: 2895 - protein, 380 aa, Methylobacterium sp.
MSAEFMIPVDHPGTFIVEELEARGWQQVDLSYVLGMSPQQLSPLLTGKARITPELATDLGAAFDMPADFFANLQKMYDLSIAKPADPGVRLRSKWLSTFPVREMIKRGWIEETEPSLLDLQMLRFFNKPTVDDIPFIGSGSVIAHAARKLDYDGTTAIQYAWLHRVMKIASLMSPPPYSANALAANLAAIKAHMLDKEDLVKIPSILWDCGVRFVLVEALPSSKIDGVCVWLDGQPVIGMTTRLDRLDNFCFVLRHEIEHVLQGDGQAETFAPIDEFDGNYESSNDLPEEEIRANTAAGEFCVPRQQLNSFIARKSPFISENDVLVFSARLEVHPAIVIGQIQNKTKKYNWLRKYQKGIRHYLMDWQFKDGWGFYAPTGL

SEQ ID NO: 2896 - protein, 128 aa, Methylobacterium sp.
MTARVGHNGGPALGELADTRPGRCKHCRHWMAPSDEEQRAYEWFHLGLSRRRVRRPTGACDRVLVGNNPRPPFSATSAEFGCDNFEAAPPLPIPRGGGFVTIWQDGRIAWQGREEDIPARFLQQDLDL

SEQ ID NO: 2897 - protein, 374 aa, Methylobacterium sp.
VIRILVATAAVLTMALHPAVARPPERLSTEKAEIVVEPVACNLDHPWGLAFLPDGGMLVTERAGRLHIVSAGGQVSAPLRGTPPVHTGEGGLLDVAADPNFSENRFIYLTYGEPRENGAATAAGRGRLNSDQTAFEDFQVIFRQHPVGSSDAGHFGSRLLFAPDGKLFISTGDRFNPGLAQDLSTDVGKLIRVNPDGSMPPDNPFANHEGARPEIWSYGHRNIQGLAVQPETGALWAGEFGPTGGDEINIIEPGRNYGWPLVSWGQHMDGSAIPRPPARPDLADAAYHWSPSISFSGIVFYSGSSFPSWRGNLFLAGLTSQAVIRLTLVASRVTGEERIPMGERIRQVVQGPDGLLYLLTDEDQGCILRFRPGR

SEQ ID NO: 2898 - protein, 35 aa, Methylobacterium sp.
MQALAGDRLDETVPFGAALPAIEESPWTDVPSPGK

SEQ ID NO: 2899 - protein, 327 aa, Methylobacterium sp.
VWRADEETRPRASKVPRRGMDPKTARAAAAERGRERVGAIQAAGERRVLVERLQPSPEKPAPEPHRRVRFRNEEERSAPRDRAREDRPRQDRPGQDRPRDDRPRSEGPRENRARDERPGRDEFRHGAPAGDARPRRREAGEAAPAERRGPPRERPSDFEGRPPRERSEGRPQRDFHGDSRERGEGAPRRERPSEGRPPERRGPPRDRPRAAEGERPARPPRGAEASDRPAFRKGPGKGPGGGAGKSFGGKPGFKGGDRDGARGDFKGGAKGGPRGDFKPGGGGRPGGRPSGRPGGKPGGAPGGRPGGGGKPGPRGGGRPSRPPRGEG

SEQ ID NO: 2900 - protein, 294 aa, Methylobacterium sp.
MLRVALTACLLTAGTVLASANPARLEKGIVPSGPAKAVVERWFTAGSGPICSDANGADAPCDLGRALAFRTFYAAGGTDALVFAHYSPSVGNAVSLAVAQFRRAGQDWTLVRTVTGVYGEGPDSLSFEGGRATFTMDALMPGDARCCLTGKQRYTLDLATGTVTAGPKTAAKATPASGKRSFAPRPEGFEGATYFHNGSEVLVDERVGVIRYDVPKTSIRAAVSKGTVLFRGTFAASGAVTGTAYVFKAGCEPAPYAVSGHSKGSTITLKGNAPVAIRTPVPSPGRLRAARTLS

SEQ ID NO: 2901 - protein, 425 aa, Methylobacterium sp.
MTIHVGSIAASSSLASRVQVVRSPGGVEALLLEDHALPLVSMAFGFRGGAALDEDGKAGTARMVGGLLCEGAGPYDDQAFQVALADRAIQLSFGIERDRLTGSLLTLASDLDQACGLLGTALREPRFAVPELERRRGVYAAELRRSLNQPGAVADTIFWERGFRGHAYGRPPGGTLSDLPAIDREAVVALHAALVTRTSLRIAVVGAVRPEDLAAALDEAFAGLPEGSAHSLPETALGGVGESITQFVESPQSSVFFGRPAIPMHDPDFPAAMVINHCLGGSPSASRLFAELREKRGLCYSVWTGFDVSEGVASLVGSTSTPNEHVGQSVELIGSEIGRLAQDGLDDDEIDAARRYLIGSHAVRLDTSAAITRLLLAMQFDGRSLSWLDERGPRLAAVTSQDITRATARLFGDGGLLVVSAGGAR

SEQ ID NO: 2902 - protein, 441 aa, Methylobacterium sp.
MTRHTRPLRTDIPEAAGSSVAPPVVSGRLDNGMEVLVLPSYRSPIVTHTIWYRNGAIDDPPGKSGTAHFLEHLMFKGTERYPTGHFSKGVSAVGGEENAFTSWAYTCYFQKIPAGHLRTCMAYEADRMRGLRFDEGEIASERDVVLAERGMHDDSNPARLLQEALHAAAFPAHPCGRPIIGWRHEIETLGRADVEAYYRRFYRPDNAILIVAGDVEPVAALDMAAEIYGVIPRDEGPLDRSHPIDPPRRGRHRLTVAERSVRQPRLRRLHVVPSPRLAAPGEAEALELLAYLLAGDETSVLHRRLVVETSLATSVGAGYMGDLFRDRTLFAMSGTPNAGITPEQLDTAIDGIVAELTGTGFSEQDLARAKRQTVAGAVYEQDDQSTLAQRYGAFLCCGLSHEDIALWRSRVEAVTGDDLLRALRHLDPRNAVSGHLIEAAA

SEQ ID NO: 2903 - protein, 382 aa, Methylobacterium sp.
MLPCANYYRPEILADELDTLFDPLWQFGALAGELAADRDFVCVDYKNTATVLQNFRGEIRAFANVCSHRFNRIQPGERGNRPLMCAYHGWSFDSTGFPHGMPRRDGFALDDRERLCLTGYEIEMCGIFVFFRKRSGGPSLREYLGAFYPLLEQIGSYFGPEIDTGTISHAANWKLLVENVLECYHCSVVHQDTFVKTLGIGRAGIEQERFDGPHSSSHFPRTATAGEARRQKALAYLDTRAFTHDSFFHIHIFPNLFISSTQGLSFYVGHALPLSATETGLRFRLFEPKLDLTRAQRAAQDLINQSGKALGRAVIDEDRAILENVQRGVELSEKPGVIGRDEIRIAAFMRAYTHLMGGGSLSGIPPIDDHVAAGDPARSIAE

SEQ ID NO: 2904 - protein, 79 aa, Methylobacterium sp.
MTMSGFYEELAEILEVEPDQVTADLRLESTSWDSLAVVSTIALIDEQYDKAVNATALAACETVGDIERLIAARQTESEA

SEQ ID NO: 2905 - protein, 346 aa, Methylobacterium sp.
MISAIQSEGRTVGARIAAIATHLPERVLTNEHLAELYPDWSSEKILEKTGIRERRVAAEYETAGDLAFHAAEKLFAAGDCVREDIDFLILCTQAPDYLLPTTACLLQDRLGLGRHVGALDVNLGCSGFVYGLALATGLIAAGAARNVLLLTADTYSKFIHEGDKSVRTLFGDGSAATLITASNESVIGPFVFGTDGAGGKDLIVEAGGFRTPRGPDTALAEADSHGNVRSREHLYMNGANVMSFSLREVPRTFARLLETSGVTQSDVDHVVLHQANKLMLNALQRKMGLPAERVPHHHEDIGNTVSSTIPFVLANLRDKGQMAPGRRLVVIGFGVGLSWAGASIVC

SEQ ID NO: 2906 - protein, 33 aa, Methylobacterium sp.
MDEHAGQHEVLEHIREIAGVEGVTVVQGMVPTE

SEQ ID NO: 2907 - protein, 54 aa, Methylobacterium sp.
MSWELRRPGALEAATCFVRADDMPACVRISHDLNRDTASPSHASANFMDLQRVS

SEQ ID NO: 2908 - protein, 145 aa, Methylobacterium sp.
MSRYEFDQPGVSLAIGWDAPLSTFYLQIWNEALHTAEMDDEERASPQIWFGTEYAEHLSPSLLLTLARQHLPSLPEDIEESLMRDMVKEPARPLSADHAEIRLMLEALLGEGPSVMEAPQRTPDETARLEMEALLKGTTSETRRQ

SEQ ID NO: 2909 - protein, 42 aa, Methylobacterium sp.
MGTKRHKPEDVVAKLRQVDVLVSQGQSVAEAIRAIGVTEVTY

SEQ ID NO: 2910 - protein, 532 aa, Methylobacterium sp.
MNAPLKGPPKRHIPIVVPAPRETHPGDYYGKEVFLDRPIWQLNDFAHPELRLDWASLEFSHRGMVEATADFIVDLLSTSASNVANHFNAIARLKTLRAFRLWSHPVISLNRADLNQSFFYEARDVAKFTRGELSHLQRWYRFCAKREGSGVNRTSASIVDAISIGGGPKAVAVLTRDPKGGPLDDAETTALLQALAAAREAGAVPIQGLVAVWLCIVLGPNPRMLSMMREEDFRRVDGRHPELSVPRIKGKDAFGRTQFKTRKLDEPSATLVEELIAANAAARKAHPWDDDRYGKALFPRTKPDARLVGRPQHAYAMHRSSALISRLVMRTVVALGVRSPRTGETLKAGPRRFRYTFATRLLREGASAEVVKDLLDHKDLQTIRAYLNLRGELVEKLDAAMAMELAPMAQAFLGMLVGSEAEAVRGDTRASRIFGAGPSKEEGLGTCGSLSFCGLAAPVACYTCIRFQPWVEGPHTQVLDGLLRQREERRERGLDGRLVTMTDNTILAVADVVRLCEDAKRARDAADPEAAR

SEQ ID NO: 2911 - protein, 141 aa, Methylobacterium sp.
MNASHAAFFERPDARPIKDVLSRAEMLPQYELLSRLEIPAVQAAVWEIEPIIEKLDPGIRNYAIQSAGALIGDLLTARGFRIARDARGEKRRGRVRKARFVKSGTIWELPAEPDGGHRDKVAKIMEDVMVRYRSTLTELAK

SEQ ID NO: 2912 - protein, 153 aa, Methylobacterium sp.
MLSLKPRGIGLAVVLLLFQAGTASAVELPEAVRTWFGTDRSIVCVDPDGNDRRCAIDVDTHVEFRRSPDASTAIVFVTYLPDPTGNATETRAAIFRAAGTGWRHVRTLTEVRNPLAGKVAFGDRTATFAAAVPQRGDSHCCPTGRRIYRIALP

SEQ ID NO: 2913 - protein, 259 aa, Methylobacterium sp.
MTMKQIFLASAVLAGALAYLPASADARPIGVGGSGGLGGGNFRSALGAGGVSGFGRGGGFAGGGFRGGGAGIGGGGFRGGGAGLAGGGFRGGGAGLAGGGFRGGGVGLAGGGFRGDGFGGRPGFGAGRPGFGNGVAGVRPGYGGQRGWYGGNRWRNAGYYRRGYGYGGVGLGLGLGAGLGLAAGSLYGSYGYPGYGYGGYGYDDGYYAPAGYYGTETVTTGVAPGGDEDLVAECARRFKTYDPQTQTYIVRRGVRRSCP

SEQ ID NO: 2914 - protein, 115 aa, Methylobacterium sp.
LKANGIDQLNATMSRIAETGLLRVQSVTFKVENERAALLEARRAAMLDARQQAKVYAEAADVTLVEINAITDGEASPSEVGEADMPRSLRRIQIVPPAAISFNATVNVTWRIAPR

SEQ ID NO: 2915 - protein, 124 aa, Methylobacterium sp.
LRQRERSARNGRRAPIAAIQQAAGGTSGAIGENGQTIAQLSLIAAEVAAAAEQQGQASHEIACAIAGAAADARTVSRSIAGIRAAAASNEERSDEVCSGAERVGHGSAALQVAIGTFLKRVHAA

SEQ ID NO: 2916 - protein, 37 aa, Methylobacterium sp.
LADRSAVTLIVRAVSRSSAAEVPTVPTMRPTDAAKPS

SEQ ID NO: 2917 - protein, 140 aa, Methylobacterium sp.
LACASQPAERSTRVPPRIADRPGPEEWTDDELLTLPEAAALFWPAGPITTNTLRTAGRDGSLAITKVAGKFFTTPMAIRRMGLDEADAVKPGAAETVETSPEAMFQMKLAEAKRLGRERARPRRAAKRSVLPAVSGKAGQ

SEQ ID NO: 2918 - protein, 134 aa, Methylobacterium sp.
MPTAVTAVPPAPSELAREHFAAEFAFETDCWDVHDTLAQGADFVLLDVRSPTLFAAGHVPGATNLPHGKIVRSKLEHWPEGTVFVTYCAGPHCNGAARGALRLAELGRPVKIMAGGITGWLDEGFDLVRIGATG

SEQ ID NO: 2919 - protein, 440 aa, Methylobacterium sp.
VSTPANASGERYQLFQRAGSTRWQVRFSIKGQGQFKRSLDTDDRREAERKAEAIWYEATYRAKQGLTAKTHTFESVAEAYIAQILREVERGERRADQGKSEPAVIRRYFVGYFGDKPIDAVTEADLERYAEWRRTYWTEGPGKLVTHIEYERDGHRLRRPVRRSAPSLSRQRGETVVLRGLLRWAARQGYLKTPPEISIKARRSPDNRRPSFEPHEFARLEAVSLSRLVDPIMDGTGAEVRASDRRSWRIKRLDDHTRRDRTVLHAYVMIGAFSGLRPTEMYNLTWGDVLGYRAGRKKSVDDRDIRLQVRGKGKSGKAIPQKAAIPWFDTLWMLFERSLGREPVDSDPVFASEQGKRITSVANGFTELLKAAGLERDHRGIKRTPYSLRHFYISEQLANGAEVLDVARNCRTSLAMIDKHYGQVRLERVVDRLRPEWTRA

SEQ ID NO: 2920 - protein, 42 aa, Methylobacterium sp.
MMPTSVISEQDLSVIVRQIPLIGPSAGGLAPKASMCRRYRMM

SEQ ID NO: 2921 - protein, 48 aa, Methylobacterium sp.
VRTDGFVCLPENTLHALRTTNEPVVLQGYGSGPFGVNDPHPADDPSKA

SEQ ID NO: 2922 - protein, 213 aa, Methylobacterium sp.
VPVFTVPASTVPVPPPAPIITANVWAPSPAPELGPVMPLAMVTYAQAAFWDNSEKPQTYRCEITGKTRKRKGPYHKLSLDLWTAPIDRIVKAYSGKAFIRHIQLRHPPQFEVAVLDKNLKSGKITEDYYREIRSILMTCDLNRDFLGVIIDRDTWTYHPHQFVHVRWSDDDRPVVDLYVNGECMTIDTFHNDDLSEAQHEKGVRFIAQFHPNA

SEQ ID NO: 2923 - protein, 171 aa, Methylobacterium sp.
LRSLEFGNGAMNDGSWPILDNLTANAAILLDDHPSMSRCAVAVILATGCYVCLVAPAWSRVVCSDPSLRRVLHVGGLGAGGCLILTGLFYDSLLRGLDGAITSQPLIYVYYPASIMLSCAAIVFAGFQLYCALHVRQAPLMRAVIPGLLGAWLFALSVPVYQFAVILGLHQ

SEQ ID NO: 2924 - protein, 86 aa, Methylobacterium sp.
VTRLPAGSDARWRADYRQAQYERALIGIQTDLLGGPVVEVFRASPKQPAPPAWTPNYEVKFFHDLSPEQQGRRLATDPQTPFARTI

SEQ ID NO: 2925 - protein, 76 aa, Methylobacterium sp.
LQHVESPTVADEQVNVAVDAYLADSGITADSNADGYGLHLAAAVAGHGWASSVIASPKSSPSLTRGAILLVRAQKA

SEQ ID NO: 2926 - protein, 337 aa, Methylobacterium sp.
MTTGRPLTPEEQQRLARRERTLKNRRGRRNPAVMPDRLARTSAFVPRKVNLITDSNFTRVYEVPGYSVVEVKGRELGSQHRDAIYALFRLKREKVSMPNPDYRPGTFISPTRTYYETRTSWRELIRVMGRTEHVNNLLSLVHVFQEIQQVSVLIHEGRSLAELDKIKKTRAIGALPDSRGSAAPLITEVSWEGAQLDSSVTVRYGPSVLQMIEKAHLVSINADVQFRLKGDHAKTFWPFIDSQPGFAWIDEERLAQLAGRDLWSERETSATRAQFRKDCRQAFNDMVAAGGLKEWREEITGSGWRKSRRYHYTHAAPTQLEMDLARAAGQAAAQLTA

SEQ ID NO: 2927 - protein, 203 aa, Methylobacterium sp.
MQAEDSACRAEDETAAAQVRRVDRDTSRIRLLGAQFTRLRKRLPLRRRFVGGFAHGVISAVAAIAAYLPTHLLGLREGFWAAITAVAVAHTEFDTTRSTARDQLTGALIGGAAGLGAYLSLGPSLPTYASAVLLATLACWLVNVSSACRVASITATIILLVPHIGPVERMAGSRVLEVGWGVCVAVATVWIVTRLNRGIGIKL

SEQ ID NO: 2928 - protein, 430 aa, Methylobacterium sp.
MRAHNRADAEEVVNHLPTPANTNTKTSKTTPTETNPKARTRGIASWDDAGELPRVIAMNRALDRFGVPMAFSVNFDPRLIQAGNDNARGQLDYYRRRIALALKRALGEALTMWIAVETADDGRQHCHGGMALTERHDPAVALDALARAGGNWTTQGSAPADLRPQHDADGWAVYPFKRAPRTRRDLREAAGLDADARVTLNSCTDDLRTEAKRVYEEARRVIGSDDRKHARDRTARCDHQEARQRAASLQATETAPVLPEPPCEPAAIPEPASGADAATPAELAQPARVASAHASDAELAFTVPALPALDEPFRMPATARSRGPPSSPDVSQPPCPHRTPHHIERPTKRGAPMSDQNEPKVEATHKTVRTAELKAERPSASTAISSVTSSNMTVGEPKVDTKHTTETVDPVEEAKKRPEDPDKAARDGQA

SEQ ID NO: 2929 - protein, 362 aa, Methylobacterium sp.
MLASAQASCDEYIAKIRATGRIPQLLDYAHARRHAAEEQARQAAEAARVADRDPHGFGALLAELRALEPANDDPELDALLDGLDAAVPANEATPLVAADNDDAAPAPLAGNPKKRAAKPRVSFARDKRHLSVFNDFVPDVRSPRTRSLTGPLVGDTTHPSTSPIPPSTPSLTTLKRQQANDNDTRKAPAWDRTTEIIRGHTYARTVSTTGGGVSWTLNLGGKIAKAANDNPHGLKDKLHDRLVKALKASALGAREFVFAVERTRSGRWHLHGILDVADDERGALEAILRQVGGTWGSEHHRDKQVQTDVLWGPDGWLRYMRKDSAATRRLLGTKSILSVTRGCRQRAEELWEASRRRQRSAN

SEQ ID NO: 2930 - protein, 368 aa, Methylobacterium sp.
MSRLELLVGDPAPAFPTAVFLKGTPFSAFEPGHVYVVECWATWCGPCLSTIPHLTQMQKDHPDVRFVGVAVWEDDIKAVRAFVAEKGDEMGYAVAFDVGEPAASGGWMPHHWLLPAYQNGIPTAFIVDREGRIAWIGHPAVMKEVLPSVVDGTFDIRAATDRYAAWIRESMTREKSALQAAVQSHLKADDNAGAIQAYDAAIAECPRLESEVGLEKLRLLLRTPDSAALAYGSRLVTTFGSDFPFLKRATASEIVGALEDDTVLHQRQPLARFVIDLIRNLEAEKSEEDAYEACVRARCLAIAFLEEGQPAEALRQAEAAIVHGRTADLHERALDGLQSLVDRCAGSVATHSPKTPTVVCDGDVCRIV

SEQ ID NO: 2931 - protein, 29 aa, Methylobacterium sp.
MLTVVVVMVWSDYEPMPHDDGKASGSATA

SEQ ID NO: 2932 - protein, 287 aa, Methylobacterium sp.
MPKPVVPRYFLYGEPPQTADDGFLHLEDLDDRSRPAAWRIRPHAHADLHQVFCIRYGRGTVTAEGEETAFAAPCALVVPAGVVHGFVYEAGSTGRVLTVSDAVLRGLGRDERAFAALFEGVRCLALDGTAHLDAALDGLDRERASAAPAQRAALKAHLTLLLVELARLADARAADGPTRLAAHARIVARFRAAIEEHYRAGLSLEQYCNRIGTTVGRLRVACRAVAGATPGQLIADRVILEAKRSLRYSDLPVAEIAYDLGFHDPAYFSRYFSRVTGSSPSAFRRAD

SEQ ID NO: 2933 - protein, 295 aa, Methylobacterium sp.
MKVLVIGGTRFIGAHVVRQLHEAGSAVTVLHRGRSTNPILPEVEHVVDAGAAYPIVAFPETVRRDWDVVVHMVAMGAADGAAAAQAFTGRAGRLVLISSSDVYRAYGRLTKAEPGPPEPTPLREDAPLRSVLYPYRGMEEQIGAYARDYEKILAEEAVRGAVGLDWTIARLAKVYGPEDNADLGTLYGFAGVPDWRWTHGHVQNVAAAIATAATHPSARNAVFNIGEATTPTMGERLARLPARSGEAPVPPPFDYDQPFVIDTSKIRQDLGYTDLLDEPAAMNQIASQASASSVP

SEQ ID NO: 2934 - protein, 48 aa, Methylobacterium sp.
MPDGLPASLVAVLRAAHAQDAVWILSDTELEPTTFDLPVFDHSSPRQG

SEQ ID NO: 2935 - protein, 166 aa, Methylobacterium sp.
MTPGAVDAVIRGLKRAGVSIVCYLPDSLFKELYPALDADPDLRTIPVTNEGEGAAICGGVFLSGKRAVLVMENSGLRASVEPLARMGLGAGIPVVMLMSYRGDLGENNWWAIPHGITMEPVLQALRIPYRVVREEAAIETAIADAYASAYASYYHAAVALGGSIVR

SEQ ID NO: 2936 - protein, 213 aa, Methylobacterium sp.
MSVEPEASGRPMKRYACMQRLAARLRDELVILSLGGSVDEWYNAAPHMRAASLFQQQLGCVTPQAFGLAAGLPHRRIVSLDTDGGLLFNLGILATLGNERPKNLFVVVWDNQCYQSIGGPPTHTAKGRVDLAAIARGAGVEHAYTVHDLDGFERHCAEGLAAEVPYLVVAKVAGTVQPGIRRKHSDGREDKYIFVRHVEASEGVTIMGPSEHN

SEQ ID NO: 2937 - protein, 201 aa, Methylobacterium sp.
LSLIRTKHEVFVKQARVPTEQEFRRLVAVVVSQGKYGPRNRMALMLSYLAGLRVGEIASLCWSDLLDSDGKVREQLRLSAAVTKGGHARVVFLNARLRKEVGLYRATLAQPPALLQPVLVTQKRSAFSANTLCQLMRGWYDLAGLDGGSSHSGRRWFITRLAHAGISPKAIMMLAGHRHLSTTQRYIDVNDEMMRKAVELL

SEQ ID NO: 2938 - protein, 95 aa, Methylobacterium sp.
VPSFAGLAFVALVTMAAAGGKPPTFDIAATCRAAPTLGAGDENTDRNCLRDEEQARGQLSKLWSSFDAQRRETCIQEAGNGGSPSYVDLLTCLQM

SEQ ID NO: 2939 - protein, 177 aa, Methylobacterium sp.
MQDKEPARLSRRVFLGAAGSTLLAVAIMPDGLVTGRAWAQMPKATKPETLASLVQMSRDCYPHARVADRFYAAAVRILDEAARAAPVELDLLEDGMAALDREAAARHRVPYAKIEREADRDALLKAIEPTPFFQKVRSNLIVGLYNQKELWPIFGYEGASFDKGGYLHRGFDDINWL

SEQ ID NO: 2940 - protein, 133 aa, Methylobacterium sp.
DRALLAAFLRDEGTDFALNPFPSTTAGAARLTCAGLAFEYPILGILSAGLPCLMEALAQLPKTTPLTRCILKSAAHTCIVFLTTEEACVGAYLHGKAGVPLPVFAPAAPKPAPRKGRTRQTKAEQLDLFFDVA

SEQ ID NO: 2941 - protein, 1365 aa, Methylobacterium sp.
LQEKATVADTPLPLSLADDPVARAVLARFPGAQIVTDTAPPAGALPVVGGMHQINAPCFSALAPELVTRGWSVFPQTRDGKRGSGLVDNAALKWKPYQDVLPTLGEIDWWSRFCPSHNVACILGAASGGTWALDVDVSDGELSHAIVALADEHLGYTPFRRVGRVPRIVLVYRQAPASEVGADAVIRVSPPRFTARPGEDSPGQIEVLGHGKPVTFFGLHHGTGKYFIWVDGSPHVLTPEHAPLVTRQQYDAFLDAVNEIRPFARRAVHESPDAAWTFDPAAGLHRPTALGEPDWQVSEGKVVDGRNRFLIRLTSNTVRANEAAARDAGAGRAQLCALVEQEFLARAELSGTWTPLKVKTEIRSMVTSSCEWHIREERFTRIRRGAPLAVDGEGDVQHAPSRTDDLAPADDMPELAHIRSDFARFLARSGRKGYTLKAGAHPIRALKRALLTDELLRTQAAQAATASVRDHQDRWIDGLYERAAERRSRELRKDKTPLDAGLISILRGDAGVGKTSTFWRALARAVDKRGRLGFPVGFAMPTHANIEDSLESASKAQLAWEQSVSEAVEAGEKAGLKVVVFRGKLRTNCGFKEQIRSLNAASIQAERLCKSRVNVNEKIPGAEPEWEERLCPMVEACEYQRTLAEVATADVVLFASAYLSAKAPAALTKALLALVVDERPYNGLLGTNSRNPMPVSVLELPRPAPRLLDEEIQPLLEQANPRQAIEDRREGYLADRHAAVQIVLPHLRKRDAGAAVVALHRTRNGNQRTGLEIARSAYAVCSRGSNLAKDVAPGMTEEAAAALAGAPRGEGIWDERRFWSLVIERLEALAHDEENPGTPRQSKGASDARLQVVSGETGPAIRMSWRGTPGFPGIPLLMLDASAAPAIVKKIWADREVEVLDVQAPCHLRTVLVTGSTFSDFSMLPGRSRRARTILSASKRVQMHREVVTRLAGVHGYGKLLVGGNMGPMTVLRAGWQPPANTDFVHNGAMRGLDQFKNHAAALLLGRLELPPRAIDAFVAALTYDDDAPEQPVDRNGDGLDDEGKPLQPLIGEKLIAMRDGRDIAVDDATYEGAWARLIQGQFREEEVRQFVARLRPVHRLGRAPVAYVACTAIPEGLIVDDVVDIRDLLTPGPDNGQRPFELARATGGVLDARYGVQDREDLVGPNRTVESHLAGARLERPGFPESQGTSRIRWRLPGGEWTTSSVLTWPENPVAPLARAIAAEQGLTVEEAEEALEWEILWEGTPRAASGTKAPDKIDRANLGLKPDAELTHEDARRAHADQEATERADMIARVKAELSGLPIDAPDEAIEAALRRKRIAAIDWSKLAPYPGADRKLQGVSLAELVIARRYGLDDAEIEEDED

SEQ ID NO: 2942 - protein, 116 aa, Methylobacterium sp.
VSLDTFYPPVAPSPGTSRKPELRLLEADFGEGYSQAGADGMNHIRDVLTLKWDVLTQGQADAIDAFLRSKRGTMPFLYQHAHTPAPVKVTCKEWNRDDEAAGLCRFTATFRQSFAL

SEQ ID NO: 2943 - protein, 332 aa, Methylobacterium sp.
MSHESAAGILDVPALIDARPIGAAQVLTFLLCFLVVLLDGFDTAAIGYIAPSLMTEWGVGRAALAPVLSAALFGLAMGALAAGPLADRYGRKAVLVAAVVELGLACLASAFEADLPQLAALRFLTGLGLGAAIPNAVTLTSEYGPVRRRALLTNMMFSGFPLGAALGGFLAAWMIPTLGWRSVLLLGGAAPLALAALLALLLPESVRYLVARGAAPARIHAVLRLIAPGTGPAAGYDLGAAAAGPGRPAGLRLVLSPAYRIGLVMLWAAYLMGIDRFGGIAGSFLVAELAGTSLPVTFALVAVPALLAAAAVATKRNARRGAAPARAAALGH

SEQ ID NO: 2944 - protein, 1064 aa, Methylobacterium sp.
MWMPVGRDGSGMSGQALRVLRPRDAGEALAALSRHGGEARLAAGATALQLDWAAGAERPGLLVDLSGLPELRGIEAWGGGLRIGAATPLAEIEADADVARRAPLLSRAVRTVAAPAVRSLASLGGNVAGRTGCCLPALVALDAALDILTAAGRERVALADWLGQAARPASLILAVTVPEQPEGSPATLRKVGLRAAFSPSVIGVAGLLPLDGGVIGAARLAAGGGPVRPQRLPRSEALLAGRSLAAIDWAGLHAELLAEIDAPGDDLRSARYRRWAAANALVASLGGADRLSGARATPRHRPVGAGAPAGERVVSRAAGPAGWHQRPDIADKVHGRLAYHTDARVPGMLVGRILRAGRPHARILAIDTAEAEALPGVAAVLTHRDVPGLNAYGIVVQDQPALCGERVRYVGDAVAAVAAVDEATAEAALALIRVAYAPLPVLDTPEAALAPGAPPLHPEGNLRREVRVARGDTEAAFAACAHVVEGTYVTPRQMHGFLETEGGWAMVEADGSLTIRVGGQHGARDRLQIARILGWPEARVRVVTSPTGGAFGGKDELTVQPALALLAVKTGRPVRLHLGRAESVAAGVKRNPMRIRMRTGCDAQGRLLAVAVELIADGGAYASLSPAVIETALEHCCGPYLVPNVAGVARLVATNNGTCGAFRGFGANEMTFAIECQIGRLAEAVGCDPIALRRRNLRAPGSPGFFGQTVGPSERLAEMLDAAAASPLWSAGPEGAGAAIGVGLALNYQGNGLGSLPEDRAAVELRLAADGAIEALYGLDEIGQGLQAAICSAVAARLGVDRAEIRPVIGDTGHTPDSGSTTASRGTFVVWEGARSAAPAFAHALLDAAARRLGLSAADLALGPGGIREARSNSGRPLLGFAELAAGLPPEALPQSRAAFEFPKADYVAGNARYLFAFGATLARVAVDRVTGEVRVLDLHQHTAAGPVLDAAAYLGQIEGGGVQGLGFTLTEDARMEAGRYAAANLDGYLMPTIADAPERSRVLALEDLDSGDPYGPRGIGELGIGAVTPAIAAAVADAIGHWPCAAPFSPETLLCALGDGAAA

SEQ ID NO: 2945 - protein, 586 aa, Methylobacterium sp.
MLERAASVILTDSAGRRTAVASAGTATGATPILFIHGVGLDHTVWRPQIAAFAGQRPVHAYDMMGHGASDRPKGRPELADYAAQLFGVLDALGIERAHLVGHSMGAMVALEAALSHPARVSSVTALNAVYRRNAEQAQAVLRRVEALEAGEASPGIETALARWFGSPVPPHLADEAERMRALLERADEQGYALAYRVFATADAAYAERLPTLSVPALFMTGQHDPNSTPEMTRAMVAAVPGARGLVLSGERHMMPLVGAARVNAEIARFITGLEVEEPAAAKRFRNALGTFATGVTVVTTLQENGEPRGFTANSFSSVSLDPPLVSICIARTASSHPIFKAAPRFAVNILAQDQRDVSGVFASKRPDKFEQVAWVSGVTGAPVLENCAAWFDCRLHEVVAAGDHDILIGEVVDFDASPQMPLGYCRGAYVDFGLAQDALAASARSIEVRAILESEGDVLLVKERDGQFALPSGTCIEPASDPKSLHGRLTALGFAAELGFLFAVYENPDAAGAPTSIVYRGTFTGHAGPGTCLWPVADLANCPVRDPASRTMLERYARERRENAFGIYAGNVGGGTVQALHPGAAA

SEQ ID NO: 2946 - protein, 157 aa, Methylobacterium sp.
VAKATELVIAPADLQPRLGAIEDLVGYHLRRASTAVRNDFARVIEGSGMRQVLFGILSVVEANPGINQGAIGRVLGIHRANMVVLVNELIEKGWISRRADEADRRAFVLDLTPEGQAVFAEVRRQLHAHEATLLAELDAAECAQLIALLRRIGSKDA

SEQ ID NO: 2947 - protein, 69 aa, Methylobacterium sp.
VLVQRFQPNPQAGATLLPLQLVADSELDGFREWNALPLGQEADDAVRLRSADVQGHKRLLAGRVESRCA

SEQ ID NO: 2948 - protein, 58 aa, Methylobacterium sp.
VAIVTEIRSWHRAPRDRGVSDVRARLARTLTTALRRMAEARYAQQVDRLARSGHGGVL

SEQ ID NO: 2949 - protein, 42 aa, Methylobacterium sp.
MVVATTAPKNPPFNTRIREKIRERIALAGILDLSGRMKRADR

SEQ ID NO: 2950 - protein, 384 aa, Methylobacterium sp.
MHVAALEGAPIELKDAEGETDAAEAVAKALGEIETKLNARFDAIETKSADRLDRLEARLNRPGLSAPKADDAPAGEIERKAFTGYLRAGPNGLGAEEKKALSVGVQTAGGYLAPDQFTLDFVRDLTLFSPIRGIADVRNTSSHTVLYPKRTAITNARWQGEAQPTTGSEPAFDQGEIEVKNLATHTDINNQLIDDAVVDIEAEVRLALAEDFGVKEGKAFVSGDGVLEPEGFMTAAGVPVTLNGHAANLSTDQLIVMLYSLAPAYRSAATWVMNGNTLAVIRKLKDSQGNYLWQPGLVAGQPETILGRPVVEAVDMPDVGANAFPIALGAFKAAYRIYDRKAMEVKANPFLLMTQDQTRFHAFRRTGAAVVQPAALRKLKMATS

SEQ ID NO: 2951 - protein, 390 aa, Methylobacterium sp.
MTFHNPIHEGTPLETKAEGDQAETDTEGATGVADIVTDALDKIREELVTRLEKLETKAEATDRRLSRPGLITSPSEAPGAIERKAFSAFIRRGVEKLSADETKALTVSVDADGGYLAPVEISSELLKLTTEFSPIRQYARVVTTGSQATKYPRRVSGVTATWTDETAERTEDEPTYEQVTLTPYELALSIPFSRQLLEDNAYNLEGELALEFADAFGTAEGAAFVNGSGVGQPKGLLKAAGIADFKTGAATGFPAANPADVVINMFHALPTVHAQNGVWLMNRKTLGMMRTWKDGNGRYLLADPITADAPTTLYGRPVVQCVDMPDVAAGSTPLVFGDLSGYRIVDRIQPTFLRDPFTLAGRGLIRIVGHKRVGADVTHPDRFLKLKVAA

SEQ ID NO: 2952 - protein, 130 aa, Methylobacterium sp.
VKGRKPVGLVTASAPPTSLPRTPAWFGREAKAEWKRMLPVLMNERRTLDLADLAAFTSYCLAVEQVAVASRELGTAYTYQANGLTKKHPLVDIRDKAMAQVLRHAAELGMTSVSRSRAAIRDDGEDDLLA

SEQ ID NO: 2953 - protein, 133 aa, Methylobacterium sp.
MKGRKPGTITAGADALQRVPSPPSSLTGTARNEWRRVARILVARRHLTAADLGALESYCVAIGMRDDARQTLTAFGGTTYTAGTLIKQHPAVGILKSALDACARFGAELGLSPVSRSRVTTLESDADDLSHLD

SEQ ID NO: 2954 - protein, 68 aa, Methylobacterium sp.
LGLNRRRPPPRAQASAPLDGLPELKFWKSPLRAALFAPQSRHAASSSGPAWSLAFGLSRRAVPRYLVK

SEQ ID NO: 2955 - protein, 155 aa, Methylobacterium sp.
LAALVLLVLIITCAILYNFETYIEYPSIFGGGDRFFVLNGSWMLMLALYAFLLGVLMHAAGCAASGAQAIETEWSARLRLSWTETRIDHRGVTVEGPAAAVFQAWSTMTEVRSEAGLIAFVTNGVILLAVPEAVISTEERDRVVAYCAARIAEAR

SEQ ID NO: 2956 - protein, 235 aa, Methylobacterium sp.
MSDATFDHPRDAGQPPSLFPAYRSTVLRSPREPLVRIPHTLTETTGPAGTWEALMGPAIADLTRHDRGPGVAIGQRIVVTGRVLDEAARPVPDTVVEVWQANAAGRYIHRRDQWDAPLDPNFTGTGRVVTDAQGRYRFTTIRPGAYPWGNHRNAWRPAHIHLSLLGPAFATRLVTQLYFPDDPLIEIDPIANAVPMPYRNRLVARFDIDTTQPDYALGYIFDIVLRGRDATPWEH

SEQ ID NO: 2957 - protein, 237 aa, Methylobacterium sp.
MTDALEGLPRNAAPRADNQDPALFGQTPSQTVGPFFHYGLPWKGGADLVGASDIGARLDLFPEEHDVLHLAPPRGPVTGEIVSVVGTVRDGAGEPVTDAMIEIWGANAAGRYHGAADTRAEIPLDPGFIGFGRAAVDAAGGFRFLTLRPGRVPVAVESNRWQAPHLAIGVFGRGLLKRLATRMYFADGTDNDADPILALVPEARRRTLIAPRVAEAPPTYRFDIVLCGADETVFFAL

SEQ ID NO: 2958 - protein, 101 aa, Methylobacterium sp.
LAQGVSESTDLCWVHDHGWQPPGGESTCHHGFQTAGCLQDDELRLQGPEAFAQLLHALGRTVNGEVRSRGMNVNIEAVTGHVDPDNRSVHLIPSLRKRASR

SEQ ID NO: 2959 - protein, 507 aa, Methylobacterium sp.
MQATLAAARTRSKEKQTVASPARRGRPLTAQQMARQHYLSQIQFDQEVRETKEQASMGFFDEEALAGLARAMSGAAENPELEALVGRILTSFRLRGHTTITPASPEFRRTAMALAVAEHEAIAVSAARDDGDFTAATMHPLLAEEAPLDPVPASPRILGPLSSKPLHEIVPLVIAEKKARVASANEYEVAIRMFEEHLGEPRAVYTITRRDVISYKTALMETPTSYTLRFPGVPLPEAIKRNKARASPFPTLQAKTINAKWLSRLNSILKWCVSNDVLPDNPASGIKVDQIAGTAAPRVPFTPGDLSKIFAPPLFQRGATLGERQWATLIALHTGFRTGEIAQLKLDSVRHERGVLAFAVEEDTKTRGSVRLTPVHSTLVRLGIEARVAALRAAGETHLFPEWYRKANVVPASGAQRARNAPYSQVIPRWFNRTYLPSVGIVDDRKVFHSFRHTLKTALSRAGVPRSISDDITGHDDQTAGGRYVHETSVEAMRDALEKIHLDGFTL

SEQ ID NO: 2960 - protein, 557 aa, Methylobacterium sp.
MHLLDRDGRYSARVAVPKALHHIVGKRELLQALGPDRTLALRALPAAVAAMQATLEAARAQLKGRQSASAPARRGKPLTPQQMALQHYRTQIAFDQEVREEGRGHTHGFVDEFYAEDLKRAASGAASNEELQVVVGRILDLFRFQGHTKVTTDDPDFRKAAMALAVAELESLRVVAARDDGDVAAATSHPLLKEEAPLESVAGSPRIIGPDSTRPLKEVLSIFAGEKGSRPGTVYEYEVAVRMFEEFLGEQRPVYAITRQDVLGYKRALMETPANYTKRFPNSTLPEAIKLNKARAQPFPVLNTTTINDKWLARLHSILKWCVSNDVIPDNPSSGIKIEQVKAASASRTHFTPGDLTKIFAPPLFEDGKSYGERHWMALVALHTGFRASEIAQLKLDSIRQERGVLVFAVEEETKNRASVRLTPVHSTLIRLGLEKRVAALRAKKEARLFPDWYGKGQALMRSAGERKVNQPYSQIEPRWFNRTYLPSVGIHDDRKVFHCFRHTLKTALARAGVPRSISDEITGHDDRTAGAKYVHETSVEAMRDALEKIQLDGFSL

SEQ ID NO: 2961 - protein, 278 aa, Methylobacterium sp.
MDLEPAIRDEWYVVGAMAACREAPVRTRLLGTDIVVSGSDPVSARTACGRDLPVRTRYGCVWVSLGAPETEPPAIPEADEDDRRHVLCGVVGLRASGLRIVENFLDMAHFPFVHTDILGAEPHTEVLHYTTEIRRDVDEVWATNCRFFQPQAALSAKGGIETQYQYRVATPHVTMLYKTCPNAANRWDVICLFVQPLDPDRCRAHPVMFLIDDASRLTDLVAFQQVIFLQDRIILENQRPVLLPLEPRAEIPTRADSSSVAYRRWLKEKGVRYGTSIA

SEQ ID NO: 2962 - protein, 311 aa, Methylobacterium sp.
LELITGILSTALLAGGVLALAALGEVLAERVGVVNLGVEGLMSLGALTGIATVAAVPSPALGFAAALGVGFAFGCVFAAATVLLRANQVLCGLALTLLGSGLAATLGRSYAGAPAAAAFPRVSVPVLSEIPVLGPALFSQNVLIYAIYIVLPVGLHLLLFRTRHGLNLRAVGENPAAADAAGIPVAAIRFWYVALGSSLAGGAGAYLTLAFVPSWSEGVVAGRGWIAVALVIFAGFRPLTAVAAALLFGVITALGFVGQARGWPVAPAILSMLPYLGTVAFIILPVVAWRRLRGWFAAPAALGLPYHRDVR

SEQ ID NO: 2963 - protein, 350 aa, Methylobacterium sp.
MSWRFQRVPSVPAGAALAGRVGAIVAALACVWVVLTLAGLAPGRLGAEVIGSAFGSVEGLEDLGLLVTPLILTGIAVALTQRIGLWNIGGEGQFNAGALAATAIGLHVGGDDAWVLPLMALAGAAGGAAWILVPTLARAFAGVSELITTLLLNFVAALLVAWLCTGPWRDPSGRALATTARIPAELPPLGDTLHWGFPAAVAVAILAAGLLAFTRFGYEVRIAGANPGAALYAGIPVRARIVAVMLLSGAVAGLAGTIELAGTVHRLQGGISNNYGYLGIMVAVLARGSCLGVIAGAVLMAALLNAGIVLQTQGVNTNTVLAITGLILLFTAIGDEIVHYRPVRRTPILG

SEQ ID NO: 2964 - protein, 371 aa, Methylobacterium sp.
MSDAALPSRRHLLSLGAGLGAGLILPPGLSPARAQAPLSAVPEKDAVIAFGHVGPVTDEGWTWSHDQGMKAVQAAFPQAKTLFVESIPYSADAARTFRNFVSNGASLVFATSNYGDFFSDVAKRAKKVGFLECDGRTTGDNLGWYYFAHWYPTYVLGVAAGLMSKTGKLGYVASFPVPSCFSSTNAFLMGARTVKPEATVQVISINSWFDPQAATQAGVALANNGCDFLFGIMDEAGYLQVAQQRGLKAAMWNTDMRRFGPDAYVSSIVVDSRKYYVDQVGKRIAGTWTPGTTLLPMGGGVDRDAWGRTVPEAVAKQADAVREKILGGTSPFVGEIRDSKGKVRVAAGKTMSDLDLYNWDWSIEGVTGLGA

SEQ ID NO: 2965 - protein, 87 aa, Methylobacterium sp.
MTFTGRFRAASFRAFAEDRARLLALDSAWAEATPDRMIVAIAGQRDFIDAFEMACSLGPMDCLVHEIERRDTDWAGIATFEREHDDG

SEQ ID NO: 2966 - protein, 217 aa, Methylobacterium sp.
MDEPDGWYAVALGADIEPSTSAGTRLFGHELVVWRDAAGAVHVWEDRCPHRGMRLSFGFVRGDHIACLYHGWRYDAAGQCRYIPAHPDLEVSPMIRTRTYPCRERAGLIWVRWGRPADAPETAPDEAEAVPVSPLRSLYLDAPAARLAAALGGAGSDGLARIDLGGSPVLVAVQPLAAEASAAHIVVPAAPDAPTADLARLAAACVALRRTIEGAAP

SEQ ID NO: 2967 - protein, 217 aa, Methylobacterium sp.
VSLAVSPAVSLRLYDYELDENGYKVRLALGALGLGCETVAVDMVPGAEQTRAPLIDLNPLGTLPILVDGSTVLREAEAILAYLARRYDPAGTWLPQEPAAFGETLMWLAFATRELHAASLARRAALFDHPGDGPDLENRARAAFRVMEDHIVLRGFSGASWFAGTGPTIADLALFPAFALSRDFGIDHEAYPGLRRWSRRVRGLPGFRTMPGIPDYH

SEQ ID NO: 2968 - protein, 307 aa, Methylobacterium sp.
VDPHRLGLVSTRLHYFQLVARAGSIRQVARALNVAPSSISRVIVQLEEDIGTKLFERAKQRLRLTSAGELLLYRARLSLGELSRACTEVGELQGLHRGTVTVALVESVARGLFPAVMGAFWERHPGVAVDVQVVRSTEAAAAIADGECEIALGFDLRAPRGAQRLAAALVPVGALMRPEHPLAGRESLRMFDLAQEAVILSDTSLTLGAAIEEALADASAHVGRRVTTNSIGTMAALASAGAGISLQARLGVEAEIAEGRLVFVPLRDPKLRPRRLVLVARNRDRLSEAGAALAAMLARAVEAQSQA

SEQ ID NO: 2969 - protein, 461 aa, Methylobacterium sp.
MPRTRTRGPLIDPTQLREGFSNLAQAFAPPSAQEIYLGAKTASERASATRIADLYSMAGGSDVDQARLDRLAGIAGAYSPNQSLTAVGMNNATSVRTNAADNERALTQTRLQQRGELDRAMLAPVGAGGTRFVPGSIASAYGVSETQTGVVSLNPGDTATLPDGRTLQGAPKPLTDDQLRAQILGGLPANEQRAYALGGTPVENVQTPGGPRIAFRADAVGQAPASDVSGKVQNYSGPDGSRGTAVPGYGGKLVDTQTGAELPAGSTVFIGQAQGTPDQFGKTTEAENRDAYAARMVDSATQDILSAFDTGKLPTRGDTAKRALAENLPVLVQPELTNSMSPEGQAFYQNVRTALPMQLLTQSGQGVTEREYERKMAELVPVAGEAPSVTAAKRRQFATYAAAVKGLAGRALDKVNSVPAQAPAGTAAPAASSGYPDGTVIENDTGQRMIRRGGKWEPHNG

SEQ ID NO: 2970 - protein, 700 aa, Methylobacterium sp.
MPNLARLLRPRSVAIVGASDKPGALGSSVLANLTRAGYAGPIHLINPRRAEIAGRACLPSVEALPEGIDVAVLAIPRAAVLETVRALAERRVGAAIIFSAGFAEGGESGLAEQRAIAQIARDADMVVEGPNCLGLINFVDGVPLTFVELPVTPLAGRPGIGIVSQSGAMAAVLGVTLLARDLGLSYSISTGNEAASGVEDYVDHLVDDPDTRVIAMIVEQFRRPARFLAAAERARAAGKPVVLLHPGRGEAARRSAATHTGALAGDYAVMRLKVERAGVSVVGTLEELGDVAELLLRCPPFGAGGTAVLTESGAYKALTLDLAEDVGLALPPLGDADSPALRAALPDFVPVSNPVDLTAQALVDPDLYRRALAALLDDARVAAVVLGIIQTDTATCALKFPPIIAALRALKPGKPVVFGGLDEGAAVAGEHIAALRALGVPYFATCERVIRALAVAARRGGTPAEAVPVPPLPPRFADDVRGVAPEYRAKALLAPLGIPFPESRMATTLAEAHEAAGQLGYPVVLKAQSAELSHKSDAGGVIVGLADPGDLARGWAQLAANIAHHRPGLVLDGVLVERMGARGVELIVGGRSDPDWGPVVLVGFGGVQAEVLKDVCLLPPDLDEAAIADQIRTLRSAALLDGFRGAPALDVAAVARVAAAVGRALLSETRIREIDLNPVVVRPVGEGAVALDALMIFAPP

SEQ ID NO: 2971 - protein, 308 aa, Methylobacterium sp.
MLDWDDLRFFLTLARHGTLSAAAKVLHVSQSTVGRRLNSLETALAVRLLNRTPDGYVLTLAGEEVRRKAEHLEAEALALERDVTGRDTRLRGLVRVTCAETLAAHILAPSFAKLHASHPDVMIELIPNPRELSLAMREADIALRMRQPEQNDLVVRRIGNIAFGIYATPDYLRDQGALDFEAGCAGHHLITQLDDTQEMTQSAWLTDLASRATVVLQTSSHEAAALAAASGGGLACLACFRGDGEPRLTRVPAPTAPPSADILLLVHRDNRDTPRIRVVLTHITDTIHELAAILQPGDGVGSDARVAG

SEQ ID NO: 2972 - protein, 334 aa, Methylobacterium sp.
MQPEVIDPNIPLLGDEKLRREAWVETVAPIWVSIPDRDKPLPDKVHFRAWKVGGIHLYGLHASAQTVERTGPQIASHAVDHVYFQHHLNGRAMIDASSGETPIDGGDILVVDMAQPAFGRAFTGVDAISLCIPRRAFDARVGEVGDLHRSVLSRRDRPLVRLFSDHIRNVRHCLDGTDEEQRTLLSVATVALCNAALTPVSDSGYNRPAVAAIEIRQFIEANLDRTDLGVELLCARFGLSRTPIYALFEPEGGVMTYIRNRRLARAMRILSGVEGGDARRISSVAYACGYENLKSFSKAFHARYGVNPRDVDASFRVGSRWETGTALLSWIKEL

SEQ ID NO: 2973 - protein, 414 aa, Methylobacterium sp.
MRTQVAIVGAGPAGMVLAHLLHAAGIASVVVERRTRDYVEGRVRAGVLEQGTVDVLARLGLDGRLRSEGLVHTGANLAVDGESFRIDMAALTGAAVTVYGQQEVMRDLFDAGEARGLAVVYEAQDLRLHDLDGAAPSLTYRTPAGPQHLVCDYVAGCDGFHGISRRSIPADVLRTFERIYPFGWLGILTDVPPAAHELVYASHANGFALASMRSATRSRYYIQCGIDERPEDWPDTRFWDELCLRLGPGIAGGIVRGPAFEKSIAPLRSFVGEPMRWGRLFLAGDAAHIVPPTGAKGLNLAVSDVVMLAEALEAFYARGTGSGLDGYSARALARVWKAERFSWWFTRLMHRFPEETGFDRRMQLAELAYLGTSRAAQTVLAENYVGLPLDPPPVSTSVADFFSAPSANLRGMCA

SEQ ID NO: 2974 - protein, 99 aa, Methylobacterium sp.
VKVDSILSITDGLGGHHYVYPYFAEAPAVSEEAARLGLWVLGRALPNVPPEQFRLLDVFRGRAFSITETPLQGDEEQRFHRMYAGLIQERNGLRGPEAL

SEQ ID NO: 2975 - protein, 224 aa, Methylobacterium sp.
MIVVVGGTKGGSGKSTVATNLTIMLAAAGNEVLLVDADDQETSTDFTNLRDASRPGGAGYTCVALTGAAVRSGVQRLAPKHAHVIIDTGGRDTVSQRAALSICDVYLVPFAPRSFDVWTLDKVAELVEEARAVNPDFRALAFINRAEARGGENAEAAELIRSKPGLEFVPASLGARKAFAHAAAAGLSVVEMRPADPKAVEEIETLRRHLFDASGISSGNQEGI

SEQ ID NO: 2976 - protein, 73 aa, Methylobacterium sp.
VVLHGAARTWREQSSQPGRYSKAGVVTIDLVSLTASQRDLTGWLWTGLIERISQDRRSRTCGEDRRRARSRSF

SEQ ID NO: 2977 - protein, 171 aa, Methylobacterium sp.
LQALDFWVRYPDFLANELLNEFAHGGAPENLELAARIIDDREPDLRRVPMVRYLFGAFEPLDNPLSLLRSRDLVRQKKSGQPGQVRETSYLLTRLGGDALERLAGEADELAWYRDRAIVAARVAGGVGGRALKGRQYLQDEYAATPIGGVIPSISEKVRERLDAIRRMGRG

SEQ ID NO: 2978 - protein, 480 aa, Methylobacterium sp.
MLDTSTEPGAAPADTSYLERRNPLTGAVATRMPAHDVDAARAVADAAEAALPAWSELGPTARRTVLLRAAECLTARADAFVAAMTAEIGATEAWARFNLQLAVGMTREAAALTTQIGGEVIPSDKPGCLAMSVREPAGVVLGIAPWNAPIILGVRAVAVPLACGNTAILKASEQCPRTHALIVEAFREAGLPDGALGFVANRPEAAGAVVGALIDHPAVRRINFTGSTSVGRVIARRAAEHLKPVLLELGGKAPLLVLEDADLDEAVKAAAFGAFMNQGQICMSTERIIVLDAVADEFAERFRAKAAALSVGDPREGRAPLGAVVDLKTVDHVRGLVEDAVADGATLLTGGAADGVLMPAHVVDRVTPAMRLFREETFGPVVALVRARDEAEAIALANDTEYGLSASIFTRDTARGLRVARRIKSGICHVNGPTVHDEAQMPFGGVKASGYGRFGGRAGIDAFTELRWITVETQPGHFPI

SEQ ID NO: 2979 - protein, 191 aa, Methylobacterium sp.
MSFPSTGPVLTGVKYFGTNGDNSIGGTAGGDLIDGQGGNDLINGNGGADKLYGGAGNDRLSGGAGNDLLQGGKGVDALYGGAGNDTFAFSKADFDLSLGAKPQDFVWDFEGAGVAGGDFLRFSGFGADSTLTKVTTDSVVNALAKYNPGLDYYTLKDSNDGASYTIAIKTGGVVLSDSFDYHFYDTGALLA

SEQ ID NO: 2980 - protein, 98 aa, Methylobacterium sp.
MAFIVLSAIGGGVGIGALMLSYGFGTALACAIPGGSLCAAVAAFVLMARRGEDWAGEDCEDDEPVDDQTDQMVKALREIAQRGDLDRAKPAGKQSRAA

SEQ ID NO: 2981 - protein, 217 aa, Methylobacterium sp.
MESMNVTALSAKRRYVRLTEDQWAEAEAAWTSGSASLPELAHRFGATERALQAHFAKRGLEKGQAAKALAAQVVARVKKEQEAQADTATERALTIRETTYSYATKIERMIVERLDAAAADPDQVYAAATFVKMLANSAAALERLHTLKRNALGITDEDMNADEVPELVIKNLSDVEVASIRQRQSDEDEFDNDTIEGADEAAEAPEDEIVCESDDAH

SEQ ID NO: 2982 - protein, 203 aa, Methylobacterium sp.
MTFQTWLAFAAASCIVLAIPGPTALIIMRYAAGGERDRVARVIVGAVLGDAVALTICNLGLGALLATSTGIVTILKAAAAAYLIGLGLKGLFGRGPVTEQARPRGGRPFLGAFLVTALNPKGIAFFCVLLPQFVDGSAPILPQLAILQATFCVLSLIAALIWALASMSLHRAVVHGPGGRLLQRVSGVVLICTGIAQVSGRAA

SEQ ID NO: 2983 - protein, 449 aa, Methylobacterium sp.
VPRKAPSDSPPSAPSGVSALARGLALGLALVMSPAQAEPGVTASPQAGRIEGVQLWKLPPTPNGLVPSQSWHATGSAPNGDLYVAGMDHRTNAALYRLPAGRDDLRLVGDARSASEAAGNWHPSETAEKFHTRPTFMNGKVYVATMDSSSLDADYKAKRGFHWYAYDPDTDHFTDLSAREKGGTGLPHGSVVTLAADPARNALFGAIVPTGEVVRYDATGGVTASLGRPAGYDRPFLYVNRFMFTDAKGRLYGSAGAGPGYAAGIYAHLYRYEPGVGPVPRPDLPLVEPRALETGRCFPDRQLCFAADSRGHLYRFSEDAAGDTIAWTAIGQVTMERPGSFLWMFQVDPAGATAYAAATSYAPDAGPASLYEVDLATGRSTRLCSLADLDPRLSALNVHTGYDAWDAQGRFAFASFAGEGESEVLLTRVDPAQLKAALRARCRDAACTP

SEQ ID NO: 2984 - protein, 127 aa, Methylobacterium sp.
MKAEIKPDYTPSVDDEAERVRDIFVKSFRRSESDLDRLLPKNFTSTLSQRDEADKPTAGDEFDWSVTLANVEKIVEAAASSRTSTLAAERRAEIAEAKAKEALHWLRVLHEAVLRGLPDATSETAVG

SEQ ID NO: 2985 - protein, 404 aa, Methylobacterium sp.
MQREVPRGWGDRGDDVIPSVAGKQTDEFQMKRLKILAPQRYPWTFTGPRASRHDITRAFFIPANKISPKIEGITAFPTVLFKPFDLVHAFNRIPLGRTPYVIGCESHIPRGFGIETSALYKRMARSLASQRCRAIIPISRYASGLITRDHEHRPWWPALKAKMVVRHPSIATRPFQVGPPPSPIRIAFVGNHFARKGGCVAVRIAELAARRGIPVEVHIVSGLEMGAAVWTDPTRDAFFDPYRRLLDRPNVTLHPTLPNREVLDLLGMMHFSVLTTFSDTFGYSALESMACGTPVIASRQGALPEFIHDGVNGIMLDLPTNPWGEWIHGGHTGRHTVAYEAIVRDDIERLAEEALTAVERHLSDDDGYRRMRRAAYAEIETRFDIPSSSAFWDDLYQQAISNGR

SEQ ID NO: 2986 - protein, 41 aa, Methylobacterium sp.
MSVRDELVVLAFLGALTGAGALLWAREGVGLWLRAAIPLCF

SEQ ID NO: 2987 - protein, 110 aa, Methylobacterium sp.
MIKSELILRIAEQNPHLYARDVEVVVNTILDTITAALERGCGAFSVKHRQARQGCNPRSGAAVSVEAKTAPVFRSGKELRLRLQGETGGVAARAPHREPRQAASPASPEG

SEQ ID NO: 2988 - protein, 41 aa, Methylobacterium sp.
MSEVQRHYEDLLASHYLWMSGMTFLDKVAEQRKLLEVLGFL

SEQ ID NO: 2989 - protein, 162 aa, Methylobacterium sp.
MGALIAADTAEARGGFGGGGFRGGGFGGGGFRGGGGFGGGFRGGGFSGGGFRGGGAVAGGWRGGVGGYRGVAGGYRGGFYGGRGFYGGRGYGYRGYGYRGYGYGVGAGLAGLAVGTAVGAAASNYYGGYGYGYDNAGYGGYAPAAYGSSYPAYGYGGCTCGY

SEQ ID NO: 2990 - protein, 1236 aa, Methylobacterium sp.
MFAARPDDFPDPSPDLPVVNVVLVSHSPHLCGAERMLVNLAIGLAATPRYRPIVLLPNAKAGPLARILDHHGIEWHDTPELSWFLWANVDATRDFLIKAADGAAAYEAILRRVGADLVVVNTLTYLEGVIASVRADIPFVLWVHGILDAGMLGRFDHLAEISAGLPLKLARRIVCCSDWTRTFFEFRAEPTKIETIHNWTHVPVEPTPRAGQTRFAALSTLEKHKGIDVLIRAVALLKDRSIGLDLYGDGVDRQAYQDLVRRLGLADRIAFHGRVTDVERVYDGSVAIVFPSFVEPFGMVAIESMARGTPVIASRVGGLREIVDEGVSGLLFRAGDVNELAAAMIRILDDPPLAEALGRGGFDAVRQRFDGSRAVARFEAVFDRVLTEFGDYANDDRDALDILEVGLCRARPRHQTDWPVALSGGPRDGTAGAITPALTDMELAVLEWPEIGPDTEFRGRLEELAEGSFLKGWADLPGMGEACTLDAFVDGLFAGRFRADLHRPDLGQAGFPDPRRAFFYPVPAAFLDGQTHVFAVKLAATDRPLSGSPAVFATENVHDRRVVESNLEELALGETLKGWSVVDGLGEHALLEVFVDGCFAGRVPADIRRPDLEFVGLENGRGFEFRLPAFFLDGERHAFDVRQAVTGIPLRGSPMVARSSHDRGPSRETAATPALANWAERLFPQRRAAAPTIKHAWRAGRNDGKAPVIVAVADAAIPSTEILLAQPLAAMKRTYGIDYRIFLQDAGPDATELSGADILVLLRTTSDGAVATADAARRHGIPIVYITDDNLALLGQEVGVALAAALTRRANIAAMMRAARQVVVTTDALRAEFARSVSNISIIPAAADIEFFDAIEIDEREDTGEIRIGYAGTKTHGEDIKLVEDALVRLLDAYPTVWVESIGQVLPRLSDHARYRQFDEIDGIRPFARFLHTRNWTIAIAPLAATAFNEGKSDNKYRMHASARIPGIYSDLKPYETVVDGQTGLLVDEPTTGAWFSALERLVLDPDLRGTIVANALADVRSKHAMVQVTARFHDLLRSVAEVPTVMVSGGRAATLPGGLRSLDRGRTIFVRQAESNRLADRDLDWADILVIAMTDDDTYHPLLSRARSAGCRIVALYEVAANDGAPRGPGFSRNAIVAASDILILRQPSSGTTRAVSVFAQNLAEIYASSNGAGDWQARLAGMIDDRALGSVARDVVRTDFAVQGEDDLPVWRHVFRCMGLSVMMPPIAQRAERS

SEQ ID NO: 2991 - protein, 518 aa, Methylobacterium sp.
MLRDAADALEAAYDVIVAGAGTGGCVVAGRLAAAGFSVLLVEAGPPDSAEPAIADAGAWVGLLGGPCDWGYAYAPTPEVAGRAIAIPRGRVLGGSSSINAMLWNRGHPSDYDGWAAAGATGWDFATVLPYFKRAEDWEGGETPLRGAGGPLRIETSRDPHPVASALIAAAAERGMPVLADANGPDNAGTALANLNQRGARRWSVVDGYIRPLADHPNLRVLTGATVIDLLVSGAVCSGLRLGLESGIVAVRARHEVVLTLGAIGTPALLMRSGIGDPADLARLGIAARHALPGVGQNLQDHPLLMGINFSARAPLGPVRDNGGGAQLNWRSRPGLRAPDLHAFVVQGPHAGPEIAATADLSGPVFAVSPGLMGSTSVGSLRLQSAEPDGPITLRPNFLAEPADRAALAGAIDTILDLADTAAFRDLGAVPLTPARRLNRSEADAFVARACSTFFHSCGTCAMGTGPAAVVDPALNLHGVAGLRLADASVIPTIPTGNTQAAVVMIAERAADLIRNAAG

SEQ ID NO: 2992 - protein, 336 aa, Methylobacterium sp.
MIRMLMLAARALAWVTSPALTTEVATVADKAFILPWGDWLDAPAVSLCDPVLTILLPIITASIARAVRKVYPWAALFQSQRRVEMRLEQAVGFSRKALNGPAKGKTLSVTVAVPVIAKGTQYVIDTVPPVVIKAAGGADGIAARIFRRLDLDDRAGEATELFPAQEQVGAGTVAAHELRRTDKMTPAISRRRACPARTEERAGRSSVGSIASVRRGSWARWPPAMPASDAAASCRPGRVSRRSGGLGRRSKSARRATRIRWMNSRSRTAGRFVLQPRQRRRSFGVCCSRAMNRPAIKCCGKYLADGRVISILATIRDQSCDPNIILLTFVDSRLLY

SEQ ID NO: 2993 - protein, 90 aa, Methylobacterium sp.
MTVVFPEPMATQIRAAVEAGEYASTSEAVRDAVRLWSDRRKFRDMEIERLQRAWDAGKASGRHGVLDFDALRREARSRLIGPDDEDGRGG

SEQ ID NO: 2994 - protein, 312 aa, Methylobacterium sp.
MTRLVLGRLVQAALVALVVGGLCFALVWVLPGDASFRIAADRYGPDALTAQAAEAVRQELGLDRPWPELLLRWFGELAQGNLGNSLVSGEPVSEELASQLGPSLWLAASALVLSLLIGLPLGLVSGLRAGSGLDRLALIGAVALRALPPFVLGLVLMLVFSIRLEWLPPAGYGTWREMALPSLTLALGLAAVLSRVARDAVAEVGATTYYRFARLKGLPERAVLVRHGLRNAAIPIVTYLGLQAVYLIEGVVVVESLFAYPGIGHALVHAVIARDVPMVQGAALVMGLMFVLLNLGVDLLCRLLDPRLGAGR

SEQ ID NO: 2995 - protein, 2053 aa, Methylobacterium sp.
MSARVAGQGADPFAPDLGSGSMRHVAQTPETLGFGAFAQSHAIEVPKFRGLEPKLSLQYSSGGGLNAGRLMAGFIGVGWELQGLPDIVRTAPINGTPRFDASDVFQLDGKDLVPCTDGMTSPSCTQGGNYTGKVESYERIRYDTEANTWTVWAKDGTRTLFFAAAHWGGTVEADDDAPDLIRYQYRWLPIEREDIHGNKVSYNYTCRTLPVCYPERISYNNTEIQFVAVDHPAYQTRATGRSLARLDQQLRRIEIRTGGLGVRAYGLWQETSPSTGLQRLVDVRRFGTAWGLTEDARPSGENILIGHYAYSDSDIQFAPGAETIHTDTVEIFDLPGDFDGDGRQDVLSIRQSSQMDLCTIDIRLSTGSGFAQPQIVQPTPNGIFSCWASGVALMPSFGFRLGDFDGDGLTDISIYKQPNFGVYLTRYDRSTNTISFEDKSFPLSHPVSTNPTFSSYADIEGDGATEIIPVGHSTIYKYDGLSFNPVQFPPVAMQADSFEERLTSSGDANGDGRAEVVTYHVLNYANPAEYLATRYRWAGMLFESLFSYQFSRAADPMVGTAHPVYDLPGDLNGDGATDVVRYHFPDGMSGDPVIDRAGLPSIGDIGLHVSTGRSFQAVAQLAPQTSCAPIYRFTASEYPGGPNVCEVRVIDIDGDGRGDVVVSTPIGTDGQTAPVELFLNRGGGTWERRVLPAISIYTFADLNGDGKPDIIAQANSTGQRGTFPSGSVLYATGPIPDLMTAATSALGGVTRVEYTPSSAWGTTPGTRMPFVTQTVSKITVEDGRGQTAVTTLSYRGGRYDFPNRRFLGFAGLTATLPCSEGETACPGLDIAFSQDFASAGTPIQVERRDGAGTPLRRTTTALQANNAAPPYTALPVTQESIEFFPGAAKTTRLSRSFDVFGNVTAETSHGDVDRAGDERHRAIVYAAPNVGSYIVDKPARVHLHAGDSPAQPVVADTVTLYDGSTTEGAAPTHGNPTQIRRWRDTADDWVSAAREYDTFGNLVAETDEVGATTRYTYDPGFNVFVVATTNALGQATATGWNVPCEQPATQTDLNGGVTTWTYDGLCRRSRVTRPGGDFTGWLYVDIGQANQQYVRETRPAPNDAPGEIYAITDIDGLGRTWRTRGRGPGEQDIHVDRVFDGRGNLTTETLPYYYGAPSYGVTTAYDALDRPVRLTQPDGAATTLAYRASGLPNGSTAVDRVDPLGRTSAADRDAYGNQVSNGRITAGAWSTVYSSYDSLDRLVQASDPVGAVWRYAYDSLGHRIRAEDPDLGLWLYDYDAAGRLSRRTDAKGTIIDYAYDALGRETQRTVTQVDGAVAVTASVYDQAGPGTDPDGLVIRNVGHLAEQRNATVTLCRDHDEAGRLIRERWLTAADARCNAEATTGEAYRTLTRYDSGGRVTGRAYPDGDSVGYLTPSDPGAWRYDAAGRLFSLPGSIGEMSYDAAGRLLSAAYTNGVQASFTYSATRGWREQAVSTRDGATLLSTVYAHDAGGRITAVTSSEPGENWTYAYDDLDQLTIADNHGDDSRDRTFSYDVGYRLLSAAGLGAYAYPGEGGARPHAPAAIGASQRSYDANGNLVTATSGSGLPARTITWDGENRPTVLATENLAGGGGQPDVAVQAAYGPDRSRYSLTRPSPSLAPCADPPTVVVTLSLGPDLELVRRPVCADGVVSEQATWTKYLPGGAKRVGSGAGVQAQVLHQDHLDSVQLVTDAGGTVAERSGYLPFGQRTQVPAPLPGAVRASNLENKGFVGERDDGDSGLAYLNARYYDPVVGQFLSPDTLDPTMPGVGTHRYAYAFNDPINRSDPGGRQSSVELDEISVTAGPASGTGSNVGVGFGSSIGGGSGYGQGGYLANTFPQSSAANGLASSINQTRFSAISGISNLRSPCIPGIIGCSSAATAILGSTSAAGSADILKDFGRIGTGLGAGAARLLGIFGAILSLSGDTPQQIILYRAVNPAELGSIMATGQFSLGPSGFSQKQFWFNMDDAQWYGQWIAPSTIVSTQITPSTLSMGYQFRDAGHLAVSFEGAGITSLNRDAARYGIRILDSIGGRP

SEQ ID NO: 2996 - protein, 79 aa, Methylobacterium sp.
MRETATRLRLDELVTSDPAVMGGRRVFRGTRVPVEVLFENLADGLSLDEILDEYESLDRGDVVAVLELTARSLAAPRAA

SEQ ID NO: 2997 - protein, 99 aa, Methylobacterium sp.
VPDFYEHPAESIPGRIRECPVEYCQQDDEVMVWVYVVDRANDEGSINLRDDDIPVYLEWIVENCPGAILFDHATRESGLKSGIRFPDYAQLHHHLTRWR

SEQ ID NO: 2998 - protein, 383 aa, Methylobacterium sp.
MTVTTCFDEATYVDLVIGEAKQPAAALSDRLGQIVQEAARHFMAGVLSNAGYDAILEAVEARKLRQRAAQQRQGSIGAAAQRVAETIGLERPAKRAPDRAASPSLTVAPRVTRIISPEERILREARIARRRYLAKCARIPALIARHFTVGETAVLGQVAYQVAHNNGECTLSVDALAACAKVCRRVVQSALRRAFSAGFLIIHARRRQTNLIRLVASDWIVWNRRPKTEKTQERERYKEPSQGAEICTASPSVPTSETVEAERVAAEVRAGEAVEEARRLWADERSKQTALATVRASRSDWTTRQEADPWREQWPFVVSVGDRHIDARGDLTGEALRYLADHLSGRFSFRFQTTRSPAGVVVDRPVIGLRDHLDAVAVKVMFG

SEQ ID NO: 2999 - protein, 360 aa, Methylobacterium sp.
MTAPKPFPMNAWYAAAWDYEIKRALTPRRICDTPVVLYRRGDGGVAALEDACWHRLLPLSLGHLRGDEVVCGYHGLVFNPAGRCTFMPAQETINPSACVRAFPVVEKYRLIWVWMGDPALADPATVPDFHWNSDAPWVGEGGTYYGLKCDYRLVVDNLMDLTHETYVHAGSIGDEAITRNPFEVTHAGRKAVVERWMEGIEPPPFWARMLGRPGPVDRWQIIHFEAPGIVAGDVGVAPAGTGARTGDRSQGVNGFFLAAITPETETSCHYFWNFVRNFRTDDQSLTKTLNLAHVNDGNGVYDQDFAVLEAQQRAIDRNPRQPFYNLNIDAGALWARRLIDTMLAAEQGGPAGDPPRLAAE

SEQ ID NO: 3000 - protein, 467 aa, Methylobacterium sp.
MPQDEPDMSADRILAADLVLTMDPDNRVLTDGAVLIQGSRIGAVGPREAIIAANPGAAVVRLPDRLLMPGLVNAHMHSGFLRGTAEHLPVWDWLRLHINPMHRLLRPEEAEAASWLCYAEGLLSGSTTMLDMWRFMEGSARAAETLGNRLVCVPYVGAHPDYDYFDHLDDNERLIESRHGSANGRINVWVGLEHLFYADEAGQRRAIEMAQRHRTGFHTHCSEAEVEIAEFEQRYGCRAMVALDRLGFFETPHALIAHAVWLDAAEIELIAARGVAVAHNPVSNMKLASGIAPVDAMLRAGVAVGLGTDGEKENNNLDMFEEMKTASLLGKLKNLDAAALDSWEALRMGTILGAKALGLDREIGSLEPGKRADLIAIRTDTPRMTPLFGDGPWFNLQHNLVHAVRGSDVDLTMVDGVVVVEDGRLKTADLRALIDHVRGLAPGLFARRAAWLAENETGSVQWTEAGR

SEQ ID NO: 3001 - protein, 286 aa, Methylobacterium sp.
MKTDDRVALDEWYAVETAAAVTAAPVVTRLLGQDIVCDRLPDGAPRVRECLADGFGPALPVRERYGCLWTTLGHPNRDVIAITEADEPDRRHVPCGWVKMRTSGPRVVENFLDMAHFPFVHTDILGAEPNTEVPAYASEIRRDVDEVWATNCSFFQPRIAATETQGDFVRLTYRVPSPFVVMLYRVCPSAPDRLDAIALFIQPMEEELCRAQPVMYLVDSCSTHTALLNFEQVIFLQDRIIVENQRPLRLPLEPRHEIPTRADKSSVVYRRWLKEKGLRFGTVGHG

SEQ ID NO: 3002 - protein, 179 aa, Methylobacterium sp.
VRARRRSGGVSAPRFRLNGCDRVLPDDPARSLLDILREDHGLTAAKPGCRIGRCGACTVLMDGRPVNACLVMAYRLEGAEILTADHPEAGPEVAIVRAALIDENAFQCGYCAPGFVLALAALFGRVPEAGEAEIRAALTGNLCRCTGYASILRGALTARDRLRAARDAEGAEPSAQLPR

SEQ ID NO: 3003 - protein, 45 aa, Methylobacterium sp.
MGTTNFLTRTLAKVRTEMSLQVLVYNMKRMIQIFGVGPLMVAIQA

SEQ ID NO: 3004 - protein, 28 aa, Methylobacterium sp.
MTTADTSLLAAAFVLGLGAAVLLNALLT

SEQ ID NO: 3005 - protein, 64 aa, Methylobacterium sp.
MPALFVWAWSKSVLVRGSEASADQQQIQHDRRDAACHGQAEDNDAAELIDGIHVLTDAVLELIR

SEQ ID NO: 3006 - protein, 136 aa, Methylobacterium sp.
MSRITTLTLAGLTAASLTVTAVSPVQAAPLPAMSAAQVGSGPAVETVGWRRGYYGGYYGPRYGYGYGYRRRNVAGALFAGAALGLIGGAIAASAAPRYYGYPAYGGYYGYGVPVGYYGGYGYPVYGGYYGYGPYGW

SEQ ID NO: 3007 - protein, 203 aa, Methylobacterium sp.
LLRERRLIAGSGLFDESLYLFEAPDVMREEAEPIEHFCRFGWREGRRPNLYFDPLWYRDRYLEGADRDPLVHYLTIGESAGCRPVCYFDPHWYARTYRLPSRANALAHFLAHRRSQRFAPNPDFDLAFYLDRYGVEIGPNRDPFAHHLRFGAARDIDPSPHFDAGHYRKSTMTDLTPETRTPWAAADLRVPLVHYLDTQYRRS

SEQ ID NO: 3008 - protein, 169 aa, Methylobacterium sp.
MTRWNFRAQVIDLGVIELGTHFVTYNGVKVVTPDGKRSFLGRVTMHNEINALFRETEGEFVDLHFVGPKGNHVPLLYGLKTDRENAHSRFTHMYEAKAQVYGALILSLLLCFLLIGFVMIPVCLLCLAHLARWNPPSRKVFEALTDRGTSSPGTGSGRVIAQEQPSPVT

SEQ ID NO: 3009 - protein, 155 aa, Methylobacterium sp.
MNMSVLKTLKLSAAAPAASATDPLSRAREKLLAQLAEQKNMVSASLEGRLYEPPKVAAVRKNAAGERVRVEVARRARKGWFQDQASTVHFIMRVGGKPLELQPGKAAISIGSLDKLPGTIDALISAVRAGELDPQIREAAAARGLMMAERRKKAA

SEQ ID NO: 3010 - protein, 136 aa, Methylobacterium sp.
VSALALQKAMGARLAGFPAVTDLVPAEHIVDAHGRPARFPSVILGDGQEVAADLTFERRHVTVFVDLHVWDRSPSFTSTKAIAGAIRAALHGDDLVLDEGRLLDLKHAGTRYLRDPDGQTAHAVVTIEALVEETRP

SEQ ID NO: 3011 - protein, 138 aa, Methylobacterium sp.
MSPSFALQVLIHERLSTAPAVTALVPARDITDRHGRPARFPSITFGEGREYPLGGVKRDSARVSFDIHVWTDTPGTRDAKLIVDAARRALRDAPWEADGHAVLDLRFEGARYLPDPGATDITHGVLTLDAFMIELEDA

SEQ ID NO: 3012 - protein, 290 aa, Methylobacterium sp.
VKLTQIVAVTAALLAGPVTAWASDHAAHRIVGDEREIVRRYETSGRNGSSSSNSRGSDALLERVVAVRDDGVELEYDLPKNTSAPDRARQWQFPARLFKPSSGPAKLVNADEIDARIDAWIKAAGLTRASCGGWLFTWTMFKIECDPQSIIATVEAIDLRSLRAGEGEPYRDIESRVSGMLTRTQAGPRGETYTALLPIDPDAVRRTRAEGDVAVAQIMDKTLTLDDALRRRARDTISGTIAITLETDAAGTVWRRTRVTTLEAVGSDGTPESSTHTEIVTHRAASEQRP

SEQ ID NO: 3013 - protein, 26 aa, Methylobacterium sp.
MPCHPPDADIDPFESPRQDMFMRFKV

SEQ ID NO: 3014 - protein, 63 aa, Methylobacterium sp.
VILDPDPLWYDREDPDEPVGLLCLVLSIGLVSLARLFFLPEEMWPEIKRATVAAFRDVEETHS

SEQ ID NO: 3015 - protein, 312 aa, Methylobacterium sp.
MQPDHTRAIPVFRLYGEVAEAAAPNFVHAERIGPSARLHDWEIAAHRHDHLTQALMVTEGGGQVRIDAGNDRFRAPWLLWIPAGTVHAFSFRPETEGVVLSLSDDFLGSVITHDHEAARLDATAAAVFSGPPGAPDEIDMNVVSLFEGLRREVGGAQPGSFSAVAALVKLLLVGVVRTHALRAFTEPAAAARAGLYRRFRRLLEANLRQNWPVARFAADLGVSPDRLHAACTQVVGKPPQSVLHERQMLEAQRALIYTALPISKIAFDLGFNDPAYFSRFFAQRAGISPAAYRKRNRPADPSARGAPPLRVR

SEQ ID NO: 3016 - protein, 180 aa, Methylobacterium sp.
MPRLLVLACSATKRPDPERIPALARYDGPLWRTLRAADPEGRRARVAFLSAHYGFRDAATPIAAYDARLTQDLAERMVADGVTTRWPRPPSPRRPDTYGMHAGAEIASMTGYGAEPFEDVALVGGQLYLDVMQAFVAGFVTMGCVWPNARITVINGPIGLMRRDLRHWLLEAASVQGGRS

SEQ ID NO: 3017 - protein, 417 aa, Methylobacterium sp.
MSNRWPHLDYLGWRETCSALHLYLQIAGKYRLAHSPWLNHSWNATFYVTPRGLSSSPISDGPGIEILFDLHEHRVVGTNGDGREASFALGPSTVATFHADFVRLVSDLGGTPTFDGQPNEVPYPTPFREDDRDRPWDRDAVQRFHRALMAADRVFKAFRTSFLGKSSPVHLFWGALDLAVTRFSGRRAPLHRGGIPALPDDVAREAYDREVASAGFWPGGGGIDYPAFYAYAYPAPSGFRSASVRPDAAFWLEELGEFVLPYDAVQSAAEPDEALMAFLVSTYEAAADLGGWDRDLLECVQGQPRKARQPDAEPSGETSRSTHVTVEREERATKGRYRIVVEGVEAEMTYTRSSETLIIIDSTNVPAALRGRRIGEQMVRRAVEDARRDGVAIIPLCPFAKAQIERHPEWQDVLRRA

SEQ ID NO: 3018 - protein, 56 aa, Methylobacterium sp.
MRFGRLLVVPLGRDRVLTRAAIGLLLSRGKNGLGLCRRSPLVGIAWGPTVAGGRRV

SEQ ID NO: 3019 - protein, 67 aa, Methylobacterium sp.
MLGWSQDRLSNASGVSLPTIKRLEPGEGSLQTRLDTLNKLQAALEAAGVLFIAENGEGPGVRLRKSF

SEQ ID NO: 3020 - protein, 125 aa, Methylobacterium sp.
MVERGWRWRLRRRFAERPILTAVQLACFVLWVGVVGLGTYLSFALPYFPPPPGAKCYFTDALIIFIECRDGFPTLWLNIAWWWTWGSFVTISFLPFSLPVALPALVTLGFALGFARLLYRWRWTS

SEQ ID NO: 3021 - protein, 89 aa, Methylobacterium sp.
MAGGLFGASTANAAPLTPAPEAALASEATVETVQWQHHHFGHRHHPRHWGHRHHHHGHWGHHRRHWGHRHHHHGHWGHHRRHWGHRHHW

SEQ ID NO: 3022 - protein, 217 aa, Methylobacterium sp.
MNVIAFVTQKGGTGKSSLAVSLAVAAEERGIKTSIIDLDPQGTAKNWYERREAEGGPEVNALQSGQLEAAMGLLKKQGVQLVIIDTPGVDTPAATAAIQVASLCLIPARPSIADIEAARPTVRSIARLDKPFSYVLNQCPPGRSIRTGDAFRVLQLSGAVASTPLAMRADHMDALATGQGVTERDTNSKAAAEVRELLQWALTKMEGKPHGQETRVA

SEQ ID NO: 3023 - protein, 95 aa, Methylobacterium sp.
MAKKPASLEAALGGHTQPAPQDTAEVLQHPATQQAGRPAKPQDVKLTVYVPPAASKRLRLMCIEHDRDLNSYLREGLDMVLEKYGQPSLAEFAKK

SEQ ID NO: 3024 - protein, 67 aa, Methylobacterium sp.
MSRETIKDRYQRTLGYIITEGSGRQKALNAAQRTLGYYYPQQDVTKDAGQRTIAHGNVLASLIYDAG

SEQ ID NO: 3025 - protein, 167 aa, Methylobacterium sp.
VSLDFLERKAAISATDEGEITALAWSFASADRYGDIITKGAFSPLPTTLPMLFAHDPGQVVGVWEHFAETPEGLEVRGRMFLGQTRADEVRTMIQAGALGGISIGFDKRQWAPRPDHRTGRTIRSLTLAEVSLVSVPAHPRARIRTAKNGAAAVAIAAALNRFASKL

SEQ ID NO: 3026 - protein, 171 aa, Methylobacterium sp.
MLKHRLITKSLTVADTGEITGIAWGTGPDTAGDVIHPGTFGRVTGPVKMLWQHRQDEPIGTWDMIEEKADGLHVAGRLAIEHSPRAREAHAFLRDGIVDGLSIGFRLEKKAAPRAYGIGRDIRPEHGLRLAEISIVTFPSHPGARVMSTKSAADATAIAKALSRFRASIRA

SEQ ID NO: 3027 - protein, 196 aa, Methylobacterium sp.
MFLADEEVTIALDDERIHLRPSLRAATRIERQHGGFPAVLRALDECSVTVIADVIRECASVPTTLPDRLLAPGIAWRVAPLVPGLQVLVLNLMGYDPDAEEKADDGQDADPRSTFAEVHTKLYRLATGWLGWTPAETWAASPREIKQAYEGRVELLRTVFGGGEDKPSDQDRAATADERFASGIRAMGTTKVARPA

SEQ ID NO: 3028 - protein, 191 aa, Methylobacterium sp.
MQLAADNIIEFGRVRVSLRPTLWAAIRLDRAHGLQGLVRGITDGSLSVMSDILRESADPSEFDPNMLLVIGPDGLGTTLAQLQGPMLRHVFALYGIDSDHRPATSKAPAKVKLSDPFAELFSIATGVLGWSPETAYAASPAEIIEANRGRTRFVNDLLRTIFGGKAEDAPEAQLHAELDREGLAALKAMAA

SEQ ID NO: 3029 - protein, 108 aa, Methylobacterium sp.
VIDARKLDRTITIERLTRTLDEFRAEVETWAPVATLAAQRIENGTREFVRAYGQAEEGAALFRTRYVAGITTADRIVFEGAAHELVEVVELGRREGLTLRTKTQGIGP

SEQ ID NO: 3030 - protein, 100 aa, Methylobacterium sp.
MPFKHAVQLMTLQGMMGQLCGRPSTVYFGRSGVHLPNVAVFKYLLTPRGHLLIEALGHLLREVPFDEISHRLLAEFVAIRSGTGATEATIRQRRVVLAPC

SEQ ID NO: 3031 - protein, 116 aa, Methylobacterium sp.
MRTVVAAEVVWSRLARADLLDIYVSIGSHDPAAAERLYDRIEERARQLALQPRMGPRRPEIRPSTRILVETPFLILYETIPDTDDAPVREVEIVRVLDGRSDLNVVLHAGENSADR

SEQ ID NO: 3032 - protein, 44 aa, Methylobacterium sp.
VNWAELYLVEDSIPISKVAWLLSFEEARSFTHACKRWPAYRHAS

SEQ ID NO: 3033 - protein, 222 aa, Methylobacterium sp.
MAPKALWKGIGCRLRQVVPSRGRRMNKATRWTLRTLGGLGFLLTLNGAMLLGAWALLHRIPFADPFAEQSASHYRRAIPAEIGITTMVAEGSDASLSSLFLPITREACGGVAFRLSDSAAEQIAAQGLAHLGSARIGRGYENSPEEHYFTYQPWQETPVPSTWIGDGKWAGALGCLKQSARQFDTDVVTEAARQPGAFFTTGRESEILIIPRLRLLILTYFG

SEQ ID NO: 3034 - protein, 176 aa, Methylobacterium sp.
MRREDRSGWFADLIGSDMIGGMKDWIEHFRAAAKGLAVAHVWRGYGSALFVEFGALRPTTCMRKDGRPSAPSGEIGLMIEADWRIEDERTIVCGSGSDEELWEPTFASLVGKHVVNVATFGRLPEILVSLSDGFHVASFSTLEGDPEWTLFDRRSTAPITVHCRSGAIIEEQASSA

SEQ ID NO: 3035 - protein, 149 aa, Methylobacterium sp.
MTDLIQHFRTAACGLAVAHVWRGHGSALFVELGALTSATHRDGSPGQPQGEIGLMIEWSWRIEDGRSIACGSWGDEDLWPPTFARLLGCPVQDLSMFGRLPEVVLSLAGDLRVASFMTAEGDPAWTLFDRRGPRSVAVGCRSGVVGVEP

SEQ ID NO: 3036 - protein, 66 aa, Methylobacterium sp.
MKYNQISSNGLRALHSGIVSALAEDDAQPPHRKAYGVREYPDWRRHADCIEAELAARGQWIVPVRW

SEQ ID NO: 3037 - protein, 81 aa, Methylobacterium sp.
MTEAIEHLKNWCADQHKLLSKNLDLMERGLLHTSEGRVGGGVVDTTDASIARTKESLAELESVLRIIRDDSAEQAADGPSE

SEQ ID NO: 3038 - protein, 127 aa, Methylobacterium sp.
LVGGRWVTNQAIDLVQLAPDMYKIDWHEPTGTCVSLYFDTKRRLVHGTIFFPQWIAGEGAHPEKTICYQNDFMEDMHRFRDEGPAYPYVVIGEFAKITFMERRGRDNDEVINAAPGQLPAGYLERTN

SEQ ID NO: 3039 - protein, 88 aa, Methylobacterium sp.
MALSGKPARPVAKPADPVEAFISKGGSVPAQDSPADKAAKGAQHPLKFPADSDLFDRLEQARKASVVRLPRNTWILQAIAEKLARDAG

SEQ ID NO: 3040 - protein, 204 aa, Methylobacterium sp.
MTNTLDAAIRSAALAGTADPPSRSVPGRGGGGAASAKDAAPTPIEFYASISVKPEAMDGFLAVMRANARASREEAGTVSFDAYRRADCGNELLLMERWANEAAVEAHGQTPHLQAVVDRIESDLNGAPQELHLVRLSPMAPEKPITDPAATRNVAVTLHVKPEKREAFQQALLDVVEPFNAIWAEFLARPLGEGRRLLSDAAPS

SEQ ID NO: 3041 - protein, 502 aa, Methylobacterium sp.
VQDLSVTTSTLDLGRTCWRIARADRFALIVDAANYFDTLRHAMIQARESILLIGWDFDTRVALTIDEDGEWPTTLGPFIDALVDRRPGLDIHVLKWDLGILGTLGRGTTPLFVLDWVTDERIHLQLDRVHPVGACHHQKIVVIDDAIAFCGGIDITVGRWDTRQHLDEDARRKSPWGFAQPPWHDATTAVDGESARTLGELARLRWKQATGECLKTPSRQSGDRWPKDLQPTFTNVEVGIVRSQPTHGEEGEAREIEAYLLAAISRAQRLIYIESQYFASDIVSHALLERLREPHGPEIVVINPCTSEGWLEEQVMGSARRLILERIHQADHAGRFKIYYPVTAKETPIYVHAKILIVDDQILKVGSSNLNNRSMGLDTECDLVVEAAGDAAVAEMIEQSIREVRHDLLAEHLGTTRAEVAAVEKRQAGSQLSTIETLRLAPGRTLVPLTPEPITASERALAAHHALDPARPEPISHHLGALASSAVDAVRVAILGKDASRT

SEQ ID NO: 3042 - protein, 175 aa, Methylobacterium sp.
MTQDTRTPQPRGIEHVGLTVPDMEAAVRFFRDVFGAEELYALTRKEAAPIGGPEVSAVNGISPTSVIRDLRMLRLHNGPNLELFEMSEVHRPTPTGINDIGLHHFSIYCDDVAAIAAKARDCGAQLLEGPSPLSSYEAGDGNTIRFIRTPWGMLIELIQIPSPGREIARRWLPSS

SEQ ID NO: 3043 - protein, 146 aa, Methylobacterium sp.
VAEVGEINQSFETKVEVALTRIEERQVAAKDDLAGMREQMKSQFEQVRLEATHKHNNLRFEMDKYEKELERFVPRAEVEAMHRETQQHCDTNRAAVVARVDTLTEKVDRFGSLAAKLFWALVSLAGSAALGLLTWFVKMALSGTTI

SEQ ID NO: 3044 - protein, 175 aa, Methylobacterium sp.
MKDRCNQPTHTNYAYYGERQISYDPEWEEFAGFVSDMGLRPPGMTLDRRDNDKGYSRHNCRWATPIRQGRNRRNNVRITYAGRTQVLSEWAEETGIPYGTLYARIFELGWPAERAFSTPSQEQRTLYLTHNGQTLSSAEWGRVTGLPNATIRFRIKMLGWSIEKTLTTPVGGAGL

SEQ ID NO: 3045 - protein, 156 aa, Methylobacterium sp.
MHSQLMSVASLEAMFFEISWAERVVALELRARVRGKRFNWIERPAISPFAFSICQAAADDLSEIVGANTELCGRALDASQVLCESCFSPLAAALETGSTESLKSSFREIIEEEWMWGDLDESWRLRCRDIVIGLYICIAILLIHKPRTTAGTVIAA

SEQ ID NO: 3046 - protein, 52 aa, Methylobacterium sp.
MPVHIRTMLTDSGLTIPVRDGRLALGTWQGIYLIEHRDRAHRREIALHAVGA

SEQ ID NO: 3047 - protein, 438 aa, Methylobacterium sp.
MWRVRAMGLKSMSGKEFSRLDVLLDVEAGRLAIDDACDLMGLRRRQVFRLLAAFRKQGAAGLISKRRGRPSNNRLPDEVRQLAMSIVRERYSDFGPTLACEKLANLHDCPVSRETLRKWMMEDGLWLDRRRRLPSVHQPRLRRDRVGELIQIDGSKHYWFESRGPECTLLAFIDDATSRIMHAAFVHSESAFDYLRETRAYLLKHGRPTAFYSDKHAVFRVSKRDAAGGTGMTQFGRALDELNIDIMCANTPSAKGRIERAFGTLQDRLIKEMRLAEICSMEDGNKFLVGFIADHNARFGKPPFDERDAHRALQGDIILDDVFAWKEERTVTNSLTLQYDKVTFILEPTAVTRPLARKRVQVIDYPDGRFAIRHQGLDLPFRTFDRIRHVDQAAIVENKRLGAVLAFIAERQQERDQNRSQKAPRRQGQVDRHMFKSG

SEQ ID NO: 3048 - protein, 81 aa, Methylobacterium sp.
MSPVVCELRLLRESIEEDLDRKRIDENLGRGVYGYVGCLIRLVEDGDRDPARSLNEARSAAGYLRAVPRLPDPRPRTWSAR

SEQ ID NO: 3049 - protein, 635 aa, Methylobacterium sp.
MSVVEAISKLMVEGAPVTMAAVGGRDAVAGDFDCLVASPFLDVFVGWANTAPADGDAIVDRLVLEGLRRSVSPANFREASRNLLLSDPVCRRLGKHLPRVLEERASARDTDPEGLLAAYALEAWFCLALRKSVGHLKLLGVMTEIEVGENELFVQHVAKLVGAAYHAWGEDDLLGILDSLRRGEHAPEEATFEYAYAIMALALDAHDGESLISRLEAAKTLFEDVVRLDTERADALVYASVIELVTLFHRGARYEELAPVLSRLDAAAADRAFLLAAGPVPDWLSPRSDRDEQWLGLLRCLPDLAADLSRPSWYRAGIALDRLLRVYQAERTIEGRVGFAGLFQPRIESAFVMHRGLLAHLDDHLRELEDTGDQATSAAALRSRIAVLAEEGTAPGKPPGGDYSKMLPDALLDLLASSGVDGTIEIARHYARDRGELGNRVVDRIYLGICDRLRMESADYAGQVAVTFDRLLEQVIRFCKDRQDAGKRDLGTRGAYLYDPTAHELELQRDLREFLVGNLGSGDTRTEIDGVAKGRADIMVTHGDHHFLAEMKRQDGFVTLESARKFVGQASSYQNTNVKLGFLGILELVDRAGPPAALESCIWYDRVVPEGDTIPRHLVVFRVPGNLNRPSELSR

SEQ ID NO: 3050 - protein, 643 aa, Methylobacterium sp.
MSEGWYEGIAARAGVTVKEVDAVLRKRGIRAKAGVGKPRALRITTVSFSGEKRGRFSGRFQFSWTGLGNGVWAVASEGRNLVGKSTVLEVVLASLRGDVRRIQSDVRKWIEHARVEFTLDGQRHEVDYTFHHTVPRGALRRERLDGVTEEIDSFESATAFGLVMARFMMEALDLEAVPYQHGKDEAAQLVEHGWQALAMGMYFGGNHDVLLGQTTFGGLPARILQLYVGMPWAATVVQASATLKQLATEELRAKAVREEAKTRRTEAREGHERQLKAARRRLDEIPRENTYVDGIAARAEAVVRTTEELVELERRQAAIEDEASSLRGVADADEREVRDIRESVVATAFFNGLRPTCCPRCEARVTAGRIERERSELECSVCAEPITSERMEDVDDALQQAATRMAASTSAALRAENLLPAHQVEVALARQRLVDARTALGAAPTSDILREHRELELEVARLEGMIAALADEGDEEVTSPDRGVVQAAYDMSKEAMDAAAGGLFAALNEEIVSLARQFGFVALDETDLRPTGRLDLKKGGDPTTFVAVTKGERLRLRLATAIALLRVGSRMGVGRHPGLLIIDSPGAEETYDADLEALLRELRSLADGDLGMQVIVSSAKADEVVPALGAARCRVAREGEYLW

SEQ ID NO: 3051 - protein, 73 aa, Methylobacterium sp.
VSALALVPTLLGMRLGGWVRGRISEPVFQRCFFLGLVGLGLHLASRALLRRGRRVKVHFSSTVWPSAWTPCFR

SEQ ID NO: 3052 - protein, 81 aa, Methylobacterium sp.
MDRLNDVAAGIHIVRVYMDSGVGGIPTVQLWVAAVPRDQAEEAVQRAVPAGWRAELTRDTLTKETVARMNILAEEVRQLAT

SEQ ID NO: 3053 - protein, 67 aa, Methylobacterium sp.
VAADETARLASEIPDDSDVEALRAIARGQRVRALELQGQTVKIAARELINARALHGSIDDNGLSTGR

SEQ ID NO: 3054 - protein, 38 aa, Methylobacterium sp.
MNDRITIAAPGVSAAIVPLGAELSCRPEMPLAEPDLRV

SEQ ID NO: 3055 - protein, 117 aa, Methylobacterium sp.
MSRTAHVAFFGDHDHTFDLAKPELIRELESLTGVGIGALVGRVVETRTFFHADLEAVLRLGLIGGGVHPKPASHLVETYLPLMPLAEVQTIAMGALAALWFGVKAAPEHIMNDEVEP

SEQ ID NO: 3056 - protein, 123 aa, Methylobacterium sp.
MPADRDVWAYLYHYRDDEDFGLLRGRYDAEFREFWWAGGSLTTSVLAWVDTEEQPAFCIEAVRACIASLQPLVDNCDDEIAHMAEDWLHREVLRAVVAGHPDAQAIAAAALESRAVKFTRYYS

SEQ ID NO: 3057 - protein, 154 aa, Methylobacterium sp.
VTSPSPTTADRQGFTLLEMLVVLAILSLTSVLGGFALQPLRQRMDLSQAATRLDALLRAARAEALRTGRTTTVRFDAGTRQLTLPSQGRTYTLARSIAVSVTGAAIGTGSDRPAILFLGDGSSSGGVIELRSGTLRTARRIGWLTGRIDRSGGP

SEQ ID NO: 3058 - protein, 86 aa, Methylobacterium sp.
MHMRAFEVGDCHADLWGKLSIVSRRVEGPEDRTVGFHPDFGLAVVSHHGLENRVVWWTARPIPEPEPETDGLAEIEAMLAELGWSS

SEQ ID NO: 3059 - protein, 264 aa, Methylobacterium sp.
VTASVDESFKRQSIVMDFLTGAISGDEARFSAALAALKWAGAFREAFEKLVSVGAVHPRIRPVFRECWRRMKAESYARLDTGAQAPPPDWHLERDLCGHPHLLADGLKLLMPTFEPRQYPLALYRGQRLEDHHAGAHGLWWVSCPIFAEMFARMPSRTRHGTGVVVMTVDPHAAIIGEIDGEYLVDPRLLDGVQIVSTLMPHLDGEMDDPGRAFTMTGIPDGFDGLGLLEWLDLGMPVEGLPAIRAKRIPFITTVVLGLDPLLA

SEQ ID NO: 3060 - protein, 57 aa, Methylobacterium sp.
VQLSAGTSSVARSPPCCFGNVGGDVLFISPAWYLIDRPQAAAARRTEAAPAAAMATR

SEQ ID NO: 3061 - protein, 87 aa, Methylobacterium sp.
EASLFLPDVPVGALVLIGMTAYLTGVLQAPITSFVIVTEMTQNHAMMIPLMLAALVADAVSKLVCRGGLYHTLAEVLVRRAAGERSA

SEQ ID NO: 3062 - protein, 38 aa, Methylobacterium sp.
LRGLGQPSAAEVGRVDANSRAVRSLPTMISMHAFVQVE

SEQ ID NO: 3063 - protein, 352 aa, Methylobacterium sp.
VIPARSRLHAVASVVGRAFTWWGDGLKMTLPAPLVALVLGDTRILHLDIEDGDGRMRVRLFASSFRTRVVTEALVADDGDGPREMPRSLVAAARSRPVVLHVSGQAVLSRTVTLPTVALEDLRQAVRFGLSRWTPFSADDVVYDAVVVGTTAEQATVRVRMVPRTILEPFVDRARRAGLEVTQIALGSANVAYVPTAPKGMPAQRANRIDAALLTSALLITVAIPILLHLRGNDALRDLRASVQAEVAHRTRQVALETELVRLAGWRRTALLKRAKVKRVSSVVADLARALPPEILVQEFSWSGERGQARLSGESDRVNAALSLLRSTRLERLTELTKGVFRAELVARDDPP

SEQ ID NO: 3064 - protein, 195 aa, Methylobacterium sp.
VKTVATSTTLHKASSLLLLALVVVAIALVAWPIIGSLSAMHEDIAAERARLANLRAKRVDLKSIEGELEAERSEATGRNPLILDVTGSAAAWERMERLLREIAARSGATVISVRGLPLENEVDLKAARMELMLRTSHEGIRPLIENIEAARPLVFVETITMRGRAAAGVPDRETIDVSATARVLATISPVQAPRR

SEQ ID NO: 3065 - protein, 40 aa, Methylobacterium sp.
MAGVVSGGPQSRATATREKRPASSRLQAMRATTVMDWIRD

SEQ ID NO: 3066 - protein, 157 aa, Methylobacterium sp.
LLAGPAVAAEPIVLEGGAYEVEVKLELPHLDEITGKKVARLCLTPEANGNNHGIAVLSDNNPLARCPVSNVHQDGNELTFDTACEGKNSAHASVRYLLAPTSFRGRNAMQMGGKNMTMTEVQSGCQRGRFSSQSWISLVLWVAAPPAPLKAGRKPAR

SEQ ID NO: 3067 - protein, 309 aa, Methylobacterium sp.
VVKLNNIQNLRVFDAVARVGSLTRAARELGVSLTLVSKRLKELEAELGLRLVQRSTRKLALTEEGHVFLDRCRDVLDAVAAAEDVRLRQTESGIIRMSAGVAFAHRQIAPRLPPFLDRHPDVTVQLMASNEMDDLIQHRLDFAVRQLDLTDSALVMRRLAPDARILCASPGYLARHGVPGHPQDLQDHRCLTIGLPPPRRWPMWRGEEAVEIDVPSTVTGTSGEIAHAVALADGGITLKSVWDLIPDLRSGRLVRILPEWWGSRERWLHLVYPARRHQPRRVRALMDFLQVELAQVVEENADLGLFENS

SEQ ID NO: 3068 - protein, 141 aa, Methylobacterium sp.
MAETSTFNTQRSVDRETANRILASTVDAARERNCAVSVAVVDCGGHLVAFNRMDGAFHGSVDAAIGKARSCAGFRAPLQAFGKLAREKPWLGDLPGLIPLGGAVPLTHADAFVGAVSVSGDTEESEQSLAEFAAKTFASWS

SEQ ID NO: 3069 - protein, 411 aa, Methylobacterium sp.
MSHAHLPTAARAFIPKAERTRVNVSLILLTLALGAFAFGTAEFAAMSLLPEIAADFSLGEPAAARVVSAYAIGVVVGAPLIAFPLARVSRRRLLIGCMALFAFGNGLSMMAPSFSTLLVFRFASGIPHGAYLGIAALMAASLVERDKRASAVATVILGLTLAMIVGVFAVTALGQAYGWRWAFASPGLLAVVVTGLCIWQLPQDMPDRRAGALTELKGLWNRQIWLVLLTGAIGFAGFFAVYAYTASILVAVTGLEKRWVPIMIALYGFGMTGGNFVAGRLADRALLRTPVIFLSAGALALVGFALAAENAWTVGLAMLAVSFFSATSGVLQTRLMDVAGNAQTAAAVFNHSAFNVANAIGPWLGGIPIALGYGFSSVGFVGAVLSLGGLAIWLLACAESHRTRTPASARR

SEQ ID NO: 3070 - protein, 110 aa, Methylobacterium sp.
MKFFPVATSLLAVVMLAVTPALALTVIIQNKSEQTLTVDSGQTQADQKMAAGASAEIECNEGCELRVRGSGYGRAAEAGDKLVIDDEGMIPFTSEDIVTGSVKPPTKTKQ

SEQ ID NO: 3071 - protein, 356 aa, Methylobacterium sp.
MKNIWLLHIESVETRYTGQWRRHLREQLEHAAADRDIAAQVIDVDGDVPDQIPTKGAFLDFAATNIFKSTQVAELARRFQRGEVKPDDVFVFTDAWHPGVHQVRYMSALLDKPVRIVGLWHAGHYDPNDFLGRIQLKDGPWARAMERALFEAYDVSAFATQAHVDLFRKGVVVSKDDPRLAQVGWPMEYLAGEVQPFLGAPKENIVLFPHRLAPEKQVDIFNDLSGEFPDWEFVACQETVLSKEAYHGLLARSRVVFSASLQETLGIGCYEGVLAGAVPVVPDRLSYREMYPKEFRYRSAWTMPDTYEQNKPALVAHLRQVLARATEGSFDLEPCRRQLEPFFSGEALYDRVFADL

SEQ ID NO: 3072 - protein, 167 aa, Methylobacterium sp.
MVKKLFENKPVNDSLRDISFYPFKGPTAFNYENTAPKHGEDLPDEDPANFSDEALALLAWLQVGIGHESLRLSINWPSVDRERRGRKPNKTVIPKVTEDEFMEEIEPMLAELGLCLPTEPLGTTDLSELFEAEVNQEDLGRGDSHCGEREEVAGINDTAPSPQNNRA

SEQ ID NO: 3073 - protein, 366 aa, Methylobacterium sp.
MAKWVFASPSRYVQGAGMIAHLGEHLSALGRNAFILADDTAWGIVGRDAEAAMQDKLTFRREAFGGEASNAEIRRMAGLAREAGAEVIVGMGGGKAMDTAKATADDLGLPVAIVPTIASTDAPCSALSVIYSPDGVFETYRFYSKNPDLVLVDTAVCARAPVRLFASGIADGLATNVEAKATWRSRARTMAGGAQTIAGGAIAQVCEDTLFAHGLSAYRAVEKGLVTPAVEAVVEAATLLSGLGFENGGLAAAHAIHNGFTALEGDIHHLTHGEKVAYGILVQLVLDQQPIADFERFVRLFRAIRMPVSLRELHIEGVSRRDLVKVGELANSPNDTLQNLSPHFTDDAIADAILATDLLAAGVSAA

SEQ ID NO: 3074 - protein, 334 aa, Methylobacterium sp.
MGRLDSIDDLRVFDAIVRAGSLSGAALDLDVSLTLVSKRLKRLEGRFGVRLLQRTTRQLGLTEEGGEFLVRCRTALEAIRAAEDVAGDGASGVVRVTATAAFAQRQIAPRLPRFLARHPGISVQVLTSDDVLDLVERRIDVAMRQAPLVDSRLIARPLVPDARILCASPAYLARVGTPRDPLDLADHACLTVGDPRPTHWRLCRGGESVDVSIRSAVGGIDGEICHAAALADGGIAMKAAWDVVEDVRAGRLVRILPDWWGGRDRWVRLVYPARLHQARRVRAFIAFMEAEMTQALAACATLDLFEAPEPAKPSGRPRTARNRAEPTPAESGPG

SEQ ID NO: 3075 - protein, 137 aa, Methylobacterium sp.
MPSAEPETSQSPSLNGVRLAGCTILCPAAIARAFEHQATISTADLCRLLPIDTKTLRQHIRAGHLEYVRLGFGETAPRRFTLEGVMRFLEDRSERQCRSTSLRNPRTTSTTSSAVASGILARQAQRTEEKRKLKNGA

SEQ ID NO: 3076 - protein, 287 aa, Methylobacterium sp.
MVKVFLFPGQGAQRVGMGRAEFDRFPNLEREASDVLGYSVRRLCLEDPDRQLGDTRYTQSAMYVVNALTYRALREDGPAPDMALGHSLGEYNALEAAGAFGFAEGLRLVAARATAMAEISGGGMTAVVGLDETYLRFLIRRAGFETLDLANLNTPQQAVLAGPIEDLTEIETILEDAGARMVRRLPVSGPFHSRYMTPAAEAFAPTLRAASFGSLSFPVIANCTAQPYKGDSIAELLTRQINHAVRWTESLRPIIARDDSDFVEVGGTTLKSMIRQIRQTALATGTV

SEQ ID NO: 3077 - protein, 2404 aa, Methylobacterium sp.
MTTTSTYVDTNAIAIVGLACRFGPIGSAEELWDLMARGDTAIRRYGEAELIALGHSPETLRRPGFVPAGSVLDDIYAFDAELFDYSPQHAEWLDPQHRILLETAWHALEDAAIAPRSNPLRTGVFMSVGQTIMPPVSITDLDAAGMIRFSSSDKDFAASRISYKLGLTGPSLTVQTACSSSLVGTHLAVESLIEEECDAAIVGGVSLHLPQAGYVASRDMILSPTGGCRPFDDTADGTIFGNGVGVVVLRRLVDALADGDPIRAVIRGSAVNNDGSRKMDYHAPSPEGQEAVLREALALGDIDPLTVGYVETHGTATQLGDSVEASALARVYGNAGRTEPCLLGSIKNTVGHTNTAAGVAGLIKAVLMLERGAVPPQNNFHRPNPRLSLDGSGLQVGAGSAKWPVPKGPRRAAVSSFGIGGTNAHVVLEEAPPSATPHAIPTRRQIVPLSARTAESLHEAMHRLAEALSATPTLRLADVVATLSLGRAHERERLAVIAEDTTTLIARLRSGEGGIRGAARRAAAESAAPGDLEAVAAAWTQGVGPLPDPVPSARRIRLPGYAFARHRWPRPPRPSAEPKRLGAMLERNVSTLSAVRFNRTLFPEETLVADHLIAGDPVLPAAAQLDMALAAAAEGLGRAVTGLADITFHQPVRVAAPTRLLAELTQGPSGPAVRILSETEDGDTILHSEARILTELAPAPRLYSSDIDLDALSIDGIYRRFSDSGVAYGPAFRVIRKLSRGTGGAVATIASDRRGDHKVSPFVLDGMLQAVIGCLSDDDLGGETFIPFALERFDLYGNVPSQVQVRVTPAALAGRGRRVRKFDITATAENGTPVLQLTNLALRPLAPGAVASVSKRLHVYAPERRTPEAAVHEAIGPVALIDGTDAQAAKLGAALGVDNVLRNLEALPDAMDARPVVIWPLPATETAAEAQKIALEAVLLLRLLIQRLPRRGARVVVTYPSGSLAGPGIAAIGRSLAGENPRFDLIAAELPRPEYVTSIVLLALASRPKDKHLRADGHTDVLVPQPTPTAPVVSPFRRGGRYWINGMGRLAEALCAHLLSRYGASVVLTGRSALTDARGAACKRLAALGGQVEYYQLDCTDAAVVTAFADGIAPVHGVFHCAGVLRDGFILRKTPEDAAAVIAPKLLGAEALDLATAEWPLDSFVTFSSVSGALGSPGQSDYAFANAAMDAFAQSRAQRRPGRTLSVAWPYWAEGGMGSDTVETVLTSLGMEPLSTADGLETLEALLAAPDTPAALTVLCGNRTRMHAALPLLQDATETREPEKYNMHASTAKPDGTFAPAYDNDRDTLPPIKTNHVRAEVAQRVTAAVSEATRAPLDKVRPDRHFEELGIDSLLVIRIVELLEVDFGPLSKTLLFECQTIAELIEYFLDEHAERCAELAGPHALALERAGSTAEPPQAATMQPQSTLAKPHDAEDDAVDPRAIAIIGMAGRYPEGEELDAFWQMLLSGKDCIVEVPRDRWNAEAIYDPDPRRVDRTYTKWGSFLNGVETFDAPLFNISPREASITDPQARLFLESCWAVLEDAGYRPNQLIRSDDPAERRNVGVFAGAMYGEYQLHEAEERLRGTPILANAAYWSIANRVSYFFDFQGPSIAVDTACSSALTAVHLACEALRAGSCRVAIAGGVNVLIHPNKYFMLGQGRFAASDGRCRSFGAGGDGYVPGEGVGTVLLKPLSDALAHGDYIHGVIRGTAANHGGRTNGYTVPNPKAQATLIRKALEDASLSPAAIDYVEAHGTGTSLGDPIEIRGLTAAFGKPSDQTMQAPVPIGSVKSNLGHLESAAGVVALHKVLLQLRHRTLVPSIHATPPNPEIDFAATPFAVQQQVAPWTSRDGGPLRAGVSSFGAGGANAHIVIEEAPKRVARRGNVDGPVVVFISARTDTALSAYAESLCAHLTRERPALIDVAYTFATGRVDLPKRCAIPAATLDELIANLATVAGGGHLEVSAETMDWVNGGDIDRNAVCGAADWGRRIPLPHYPFERVRCWYDLQIANIERSRLGGEVPTLGPFRDFGKTAKASAKSNLAAELSDASAARPLPKPAPEPGRVRLRAPAPQAPRVAHHTPEREFMPRNRKITLRPLAAPLAAQPAPTQAEPTVIRVSAAQALRPTTPVQPKTEQVTAEMTEMLASVLYLSPDEIDPKQSFNDLGIDSILGVEFVTSVNGRYGINIKATALYDHSTPAAFAAHVIEMLDGTSSAAHVPALAATPTALVVSGADATAGSAPSGAVPPPAAAHRTTAGTDRYLEVRDTLRAQLADVLYSAIDDVGTEESFNDLGLDSILGVEFVTIVNRSYGLNLKADALYDNPTPAAFARHVASLLSPEAPPQLSSPSRPAPASAVATTPAVVLGAAPAVASPQSEVDAILIAVKDQRLSVDHALSLLETISSKD

SEQ ID NO: 3078 - protein, 99 aa, Methylobacterium sp.
MNPFTFLPLALRILSTLRPTSPADEPAPAPTPTKRRGKAVEPAPAVPKVVRKNFTPLLRAVAVLIAIGAGYYLGQMDGTAALTMLGTIDLNGILALFGG

SEQ ID NO: 3079 - protein, 99 aa, Methylobacterium sp.
MAIRAEGTLKQVIDHANRLERRTNIKGTVSLAPNATQTVVTVLQAGFDACAILSPMTANAAAELASGGCFVSTYGAGTFTITHRNLATTDRTFRYMVAV

SEQ ID NO: 3080 - protein, 93 aa, Methylobacterium sp.
MTDSIQRANTHRLYREDPTFREPWEAVRAAFVARWQTTSPAEAETRETIYRYLGLMTKLDAFVAEVIRDGEIDQAKLDNLLKLRNAGDSNHLD

SEQ ID NO: 3081 - protein, 85 aa, Methylobacterium sp.
MSELDPIAYLVVPANGTATLSRAASEAMVVLDREEDAADVLAWCSANNCRAETVFIGRLYRRGTRCWKIVAVDDDAAFNFRLRWV

SEQ ID NO: 3082 - protein, 146 aa, Methylobacterium sp.
MNTEDIIIEVVGEIVENFQNDLNDRLKALEERLTVIDNTNTAILEDVPNRSGLIEFEERIHDRISTLAETVTSITGLSEADICGKGKLETRLSQMEQRIEALDRRYGDNITVIRDCLVEVKGQISNPLRKTAAIDDLRQRIANTYK

SEQ ID NO: 3083 - protein, 231 aa, Methylobacterium sp.
MIKSIFRKLFSEPASKQNEIELRNAIIAELYAHLEHIGHPVEAVRVPLFAIPAADASSVHDAASVVVGLEHVFETEYGGFRVFAGLDAFGNNVVTGRTASATATSSTLSLVGNAAAAAEWLGRGEPWTGEVAATCRDAERDFGRPSPALSPTWAEASRAYNDGLDRAASIGVGTLAGVPAHARANLAGDWLNRPAPWTGERAGTRADIAAKLHEAGLAAERAAEARDKGAK

SEQ ID NO: 3084 - protein, 72 aa, Methylobacterium sp.
MKTPHRLFPFLDGADCPETIKASKSAAIHSGRSGRKEIAGLAVQAFEKLLAAENGILPKDYILRVTVKVTPR

SEQ ID NO: 3085 - protein, 100 aa, Methylobacterium sp.
MRCPLRSGPKPCSPTQLCRTAARPLKARTPSTARPCGGWAKRSQEQRDYISLKIDDPSLPAPLFANLSADEDGKTFQAIWSRSKASPTGRQQGRQPSRRD

SEQ ID NO: 3086 - protein, 43 aa, Methylobacterium sp.
MMAHDQTIESLLKAAEEMVRQGEHEEALLLLERICEMMGVTIH

SEQ ID NO: 3087 - protein, 380 aa, Methylobacterium sp.
VGRYTKREHAAGKFWLDKRSNSPAYCICWLDGRQVRRKSTGTDDLDAAIRALKAHYLSEDSPEVQDVTRVPLAEVVQAYYLQHGQHLAAAKWLRYAVAHWVRFFGETTSVWNATRPPQIERFIDDLRERGLKPSSINAVLTAGKAALNRSWRRGELTRQIHVPSVKVTRMQPKGRPLSVEECAAWLDASSPHFHTLLFVCLATGSRPEAVKELRWEQVDFEDGLLHLNPEEREQTSKRRPVVKMPLILIAYLRQLPRESDFVVSYRGRPVDRYYTALGESRKRAGLDERVNLYSARHTVARWMRKERVPIEEISGQLGHRVRGFAITEIYAAYSPDYQQNATSALERLLHAIATRAQSCHAVLKFSTTHLGSRISAAQPI

SEQ ID NO: 3088 - protein, 43 aa, Methylobacterium sp.
MQPQVNVSSRSEVTVPSLLIAFLGFAASTVGVVGIMTLLGTLA

SEQ ID NO: 3089 - protein, 96 aa, Methylobacterium sp.
LSGSKAPSAFLSIGEVAEKLDIAIHVLRFWEARIGEVRPLRGAKGQRRYRPEDVELLIGIRHLLHIEGYSIRGVQKILRERGIIHVRTCWQDQKAA

SEQ ID NO: 3090 - protein, 78 aa, Methylobacterium sp.
MTGKRRGLLTRRQAAALWAGTALAGFAAGPASAAEGQMRVAKPFGIVYLLRNVVEVSSLPSSRTLKSKATHFGSRSSF

SEQ ID NO: 3091 - protein, 55 aa, Methylobacterium sp.
LRYRENGVPLIPPILVRLGATVFNRVRPLIFAMPVFFAWTLLTVLSTPAVMLPKY

SEQ ID NO: 3092 - protein, 63 aa, Methylobacterium sp.
LSTLRGECDPSLAFVHARAVDISALSYRLKARMAQLLLPPRFEVPTNLKPSGRLIGGALFGIG

SEQ ID NO: 3093 - protein, 56 aa, Methylobacterium sp.
LADVTGLTTVHVSRAVKSLRTDGLVRLDDRQLVIQNWRRLYDAAEFDLTYLPEKLR

SEQ ID NO: 3094 - protein, 27 aa, Methylobacterium sp.
MANSEPSAVLKCGAIRTAILLARAQKA

SEQ ID NO: 3095 - protein, 62 aa, Methylobacterium sp.
MLFPKLAFDPLPAEAAEWRKAFGVLRPNSSPCWYFGATAWANIHEACTDFIERFGAKAVRPG

SEQ ID NO: 3096 - protein, 73 aa, Methylobacterium sp.
VRALNRTIRHGDDYVLSPIAWALIELDEIGYVVTAASAAPAPRWYVDTGSVMTSRQIISFAIEATAHASSRRR

SEQ ID NO: 3097 - protein, 414 aa, Methylobacterium sp.
PSGTITLDTTAPTLALTAAPPATVEASSAAGAAVSFTASAGDGVDPAPRVVFRAGDTVVSSGQTFALGTHSVTATAFDSAGNASAPVSFDFTVQDSTAPTLALTAAPPAAVEASSAAGAAVSFAASAGDGVDPAPRVVFRAGDAVVSSGQTFAIGTHSVTATAFDAAGNASTPVLFDFTVQDSTAPTLALTAAPPATIEASSAAGAAVSFAASAGDGVDPAPRVVFRSGDAVVTSGQTFAIGTHSVTVTAFDAAGNASTPVSFGFTVQDTTAPTLALTAAPPATVEASSAAGAAVSFTASAGDGVDPAPRVVFRAGDATMVSSGQTFALGTHTVTATAFDAAGNASTPVSFDFTVGDSTAPTLALTAAPPATVEASSAAGAAVSFTASAGDGVDPAPRVVFRSGDAVVTSGQTF

SEQ ID NO: 3098 - protein, 334 aa, Methylobacterium sp.
AVSFAASAGDGVDPAPRVVFRSGDTVVTSGQTFALGTHSVTATAFDAAGNASAPVSFGFTVRDTTAPTLALTAAPSTTIEASSAAGAAVSFAASAGDGVDPAPRVVFRAGDTVVTSGQTFALGAHTVTATAFDAAGNASTPVSFGFTVRDTTAPTLAVAAAPSTTIEASSAAGAAVSFTASTGDGVDPAPRVVFRAGDTVVSSGQTFALGAHSVTATAFDSAGNASAPISFGFTVGDSTAPTLALTAAPPTTVEASSAAGAAVSFAASAGDGVDPAPRVVFRSGDTVVSSGQTFAIGTHSVTATAFDAAGNASTPVAFDFTVTTPVAPATASFD

SEQ ID NO: 3099 - protein, 204 aa, Methylobacterium sp.
VNALRLALEELHRADVLKRLVASATTGDADAFLGAAAQLTWSGGWADALRALVPVGTVPDTIRSAFENVWNSSVSQEFGLRRTITYDLLGQDQRLVDGLRLLLPEIDQTPLTLFRVQSLADYRAGRIGVWWDGDRSSALSLWLTTSAAREHDGRAVLLTTEAPAEAIVIGQPDEFGVVVDPRRLGSVRAVGVLRFDQEPEQIAA

SEQ ID NO: 3100 - protein, 192 aa, Methylobacterium sp.
VTTLTIKPTQSSVGIPSERLAQLRALADHHGVSAVEIIERAIRRGVEAGEIEDTLPGFAEIAVVDDDVLFVTVRNVSLPLLDRNQANLIAAVIDAATGVAPFPGLEFKSGSAKGVDLGHGNKFYVGRHAKAVTFTIVDGQSGQTTLRTATTASIATDFARLLRTHATCLGLPVSGIMSFIASNNASSQEAQS

SEQ ID NO: 3101 - protein, 121 aa, Methylobacterium sp.
VSPKRMIWVTFKVRGFHCYPDAPEEVAYLRERHRHQFGFRVWIEVWGDNREIEFHMTQAWLESLYARGGALEADGKSCEMLANELYARMVQEERFQRRDIWIEVDEDGECGAFMRYEQAAR

SEQ ID NO: 3102 - protein, 148 aa, Methylobacterium sp.
VKFRSTKTYGHDIGLSCCFRQWRSSSHCRFLHGYALAVHLEFEADGLDARSWVMDFGSLKPVRHWLEQTFDHKTLVAADDPLLSEMRAMDELGLVQLVVLPHVSCEAFAEHIFAWVGDWLAEQSLSPRIRLAEVHVREHGANAAKVLA

SEQ ID NO: 3103 - protein, 752 aa, Methylobacterium sp.
MPPDDRRERPLLNPVLTLRKEPVPEAAKGGGPGAKDIVQERLQMQRRVLSERLEAIAASGTTATHAGRIQLAVEMFEDSFAPTWTPRPLFMDGRRTQLVAPARNGYLVEAEVAHLPNLARHIRNATAVDARVAISRVRDIRAYGADDLLRGREIGALWDRAAEVEGGKAFVLWLLPFRDEGARASVVQTLIRFEAEGAVVPTFSAVEFPLPRRDRADALVTIRSDETNLARTVRRYHGAGHARGVVTVPSQDALRAIVLSGSSARIDPVPRIEATSPAIGAEPTPPVPNANSQPIVAVVDGGLTAQSYAGLVAWQAHDLVPPGIADHVHGNRVTSLVVHAHAWNNLLGLPRLECRVGMARAVPREGSNYPADPARLVEYLRALARAHPETKVWNMSFNAVEPEAEADLVSFLGDEIRSVAREYGILPVISIGNRRRGGTDQLCAPADCEAALTVGGREHAGRGVPGGACSVSLRGPGTDGMLKPDLSWFSRLRMIGGSQQTGSSFATPLVSSLAAHTFANLRDPTPDLVRALLINATELEGHDAALGWGTPRHDHLPWTCAPGSVTLAWRATMRPGFNYYWRDIPIPPELIKDGKLAGKGQLTAILKPLVAEDGGPNYFATRLQVALQYGTRAGGTGNLLGSMREDRAPEQEARADLAKWHPVRRHIRDFGKRGGIAFSGNTMRLHARIYARDLFQFEDVDSHHDLGEQDVAFVLTLSDGSEGSDLYNSMTQRLGTFVESAVVEQVVEIEQN

SEQ ID NO: 3104 - protein, 669 aa, Methylobacterium sp.
MIRTVRRHRVSRVRSAVMATLGQTPRQNYERFVEAGRLSDAFGDIVFDDTIWKVPTRTNLPGGSAVGELAFTVHSTSIDPGGRALDKRFGDFLKTVVRLDHAKKPSQINKHRRTIAVARMLHEASSDVGHDPCLFSTSTFKRALDISRTRRTEAGAPYEVGVNLQKFGKIMTDAGITPHRIDFRNTAPRPQDVRSDDGEDRRMPAEGALAALAKASQLVTTPKDVLRMRIVELLPCAPWRINDILRLPVDCEVFEPATRNGRPVLDADGNQVVRYGIGYRGSKGFVADIKWIPTAMVDVARRAIKQIRELTADARTVAKWMEANPGRAWLAEPYRLSPDRVLNREELREALGLPAVKLVAPLARRFGIPRSPCSTERKWRYRVGDVEAALLRQHQPIQGDAPMERSEYLLLVQRNCFSSARETIASIVEVVDYGHVTDFLQSRPGVQSVFERFDLRDADGRHYVLKTHQVRHFVNTVAAEGGLGEIERAKWSGRTDIQTNAAYDHEPGYKLAEKARALLAQGKMQGPVADTYAGLPPVERSAFSLVHLATIHTTEIGLCVHDWATAPCPHHGACADCRDCAIIKGDPVHRERIEVLLEDEVTLIARATAEMDDGTYGASNYVEHHRRMAAGYRRMLATHDDASIEDGTLVQIDPEPARRGLLEEAELLS

SEQ ID NO: 3105 - protein, 36 aa, Methylobacterium sp.
MPATMFLVFLLLGPPIGFAAFAIEMNYAHIGFERAI

SEQ ID NO: 3106 - protein, 54 aa, Methylobacterium sp.
VVAEIDSVVDCAGGELQRRPPPLSFGVKRAALFAPGDETVAALRCAEVTFVVRG

SEQ ID NO: 3107 - protein, 29 aa, Methylobacterium sp.
VVGVSSPHVAIGTSDLAVSVSAAGNLVSQ

SEQ ID NO: 3108 - protein, 31 aa, Methylobacterium sp.
MSGAPDHLVRFMRHDADNRHPAIDGRHPTDH

SEQ ID NO: 3109 - protein, 259 aa, Methylobacterium sp.
MLGTISGTLVALLDEIRSSATDVGQLIEEARARGVAQAAIVRAAGSVTAEEDSIKGLSEGRVRPVHWRFEGMDVELDLEAEGDKIDLNTGHIDLITSVLTRGDPEAASRAELLERIHQARRGGEIFPSVRALLEPCARMGALAARLERELTVLTRAQGIQLRRTDLANLDLIPSITQAERDIIIQSFNSGRFPLDDRRLTHLRPYMSLNSSHYRFIARIKNNNNIPILERQIMVEFSVMKPNIRTVSGRWIINDPADFC

SEQ ID NO: 3110 - protein, 221 aa, Methylobacterium sp.
VKPDFASGGRDGFTLAEMLIVIAIVGLILSLSSGLSWTVQRLDARTHRETAARENLVSAARMFRALVAGAVPDLRTADGLSTGGTDTELNLVSVGLPILGFDRPEPMTLKWHPERLDGVLLLRWKDRRSEMLREETILQGARALSFSYFIENPDRVTAAWRSEWVDRDRLPLAVLMRVEVPGLGPAIEIIERAMGHASGGCAGLPHEEACRTGRRGSHHGR

SEQ ID NO: 3111 - protein, 134 aa, Methylobacterium sp.
MNDVPKLIHSMIRVRDEAASVAFYKTAFSLDIADRLDFESFTLIYMSNAQSGFELELTVNKGQDGAYDLGSGYGHLAVSVADLEAAHRRMGEAGLGPKDIKSLRHPSGGTARFFFIEDPDGYKIEVLERGWRFA

SEQ ID NO: 3112 - protein, 55 aa, Methylobacterium sp.
MVARYGGPAYWLARDRARAARGADAARDRFWGKVAVEIAPLDGRVIGLGTGERWR

SEQ ID NO: 3113 - protein, 154 aa, Methylobacterium sp.
MHRSHDRETLEARTIEAQRLYIKALVELERVQDGIDEGSLIVTHGDLIQAECLLAERRFALVDLLSALGYTPKGFTAKLPRRSGKGGHRLDATSDPDIAALRLCYLAWQGNSVSVDTGRSIRSMLNLGRVLILLGALSEEDMAAEEPSGEAIPN

SEQ ID NO: 3114 - protein, 27 aa, Methylobacterium sp.
MAPAVTAPDSLTFLVGEPATHVQAPHC

SEQ ID NO: 3115 - protein, 237 aa, Methylobacterium sp.
MTYGFATSASVMVPCPWAAEAAHMFDGLPVGVHLTLTSEHSGYRWRSLTGAASLHEASGFLPLSTALAVAQQDADDVRAECLAQIETALAWGIDVTHIDTHMDVLHASEPLFTIYLDLAQHFAVPIRLPFQAAFSARELAAARGILSVDQLIYTWPRPTRDVMFEMVPTMACGVTELFAHPVLDGEELRGYDRHHADIRAHDAATLTDPSVLALLDRHGVRRISYRELRSTQRGNRR

SEQ ID NO: 3116 - protein, 123 aa, Methylobacterium sp.
MTDRIPTDGTYRGVPLHAGQPAERIEIVVKPAIDHVIDLSEAIALADYAAEGANPPEARLFAAARVEAIWDLAAEGRAVRPLVNLVRVRASVAGLDSLTWRDPDRYGSDLEPPRDRPQRDADE

SEQ ID NO: 3117 - protein, 89 aa, Methylobacterium sp.
MTARRRDVLLSAGAFLAAATLPGRAGSAQATGAAGGPPEVVLSGGLVVSMDPLVGDLERGDVHVRDGAIVRVPEPRLPQNRRSSAPVVF

SEQ ID NO: 3118 - protein, 84 aa, Methylobacterium sp.
MPRWPADQLLRHGPELPLAEQVRRYQHNIRTIREVGCVVPRSAYVDTLDPVEIEMWFVDSAERKHRLKAAIQGLAALPPEPEPE

SEQ ID NO: 3119 - protein, 43 aa, Methylobacterium sp.
MEIYKAVGQEAVAASATYDDRMAEVRKRMLAAARGASKCRRAQ

SEQ ID NO: 3120 - protein, 242 aa, Methylobacterium sp.
MPRILLVAQDKGGSGKSTLTRALAECLPAARLIEIEANRRLIELEDRVSFFPVRAERGEINRTGGAAARAEFDGPLNAIAAAQGPVIVDVGANTAGSLLPLIGEAQARYARRGVEFALLVVLTSEPGALANAPVLLDLAKPFTAARFAVENQVEGPVDPKALKGFTKDVTLTQLEKLSLDERANELLQKGGLRFIGEDLVAAEDRLTERYGFAEAGRIVEDLTSFRARTMQAVSPAARWLEG

SEQ ID NO: 3121 - protein, 160 aa, Methylobacterium sp.
MPLDPKRLARDANRAQAQRPDTGIGRETTGVTRAVRAGLPVIRQLRAAGVTWAAIAEAMSAQGVTQGAGTPLSATRLTAIVTQVEAQIRRKAEREAGRRSRSDLTLSSGLLPPSHPAATSLPAPAAAPAPLPPSGSSVPATEEEIRRAGLNDLHQLLKKS

SEQ ID NO: 3122 - protein, 85 aa, Methylobacterium sp.
LAAIALRLAGDEAAPTGTFHCVNDGATTWCDFARAIVAGSARRGGRSVPIEGIPSSAYPTPARRPVNSRLSTQSLTDAYGLAPRS

SEQ ID NO: 3123 - protein, 100 aa, Methylobacterium sp.
LQERTALLQAADGGLEPYNPDFNPIEQVVAKLKGLLRTAAARTVPDLWHTIQQASDCVTADECRNGLAAAGYNNDLAIAAGTALGDVSKPRSVPHDGSGA

SEQ ID NO: 3124 - protein, 567 aa, Methylobacterium sp.
MYRPDLPARIGLVLLVFAATFLLGYPAAYLATHGLDARAWPALRGTPGDWFTPEGGGLGAWLDGLVRMGRTYVNMALGGSDALSGGGRSSVLFVWSIPVALGVLILMGGRLVPLRHHLRRFGDAAFASPRDLARMRKGIELGLDPDTGRAVRVQLEGNLLTIAPPRTGKSSGLILPNLALPEPGAWAGPAVVIDPKGDVVRAVRRRRESMGQTVYVLDPLGLAGGSDRWDPLLGLDAEDVLELQSMARALLPETAQPSEAGAFFRDRASILLVAALQCAIRSGQGVPEAAALVRNPDALLAALEGYDDAVAQDARGILASPPDKSRADILATAAQGFGWMLDTRMQQVVTGHSVRLDALCSGSADLYIVLPADDRGKELAPYVRWLLAALFSTVRRTPVAERLLVIIDEAYTLGRFGAILRGVGELPGYGVSLWTFWQSEAQIIDTYGEAGAAILRDTAEALLLFNLAGAQGAERERWSTALGSFTGVQETISRDPNTGRETKSVAPGPEALVPASELARLTQRHTLVFLASGAYTTDPLKLRKTLAHNDARFSGLLDSVAPVRATG

SEQ ID NO: 3125 - protein, 158 aa, Methylobacterium sp.
VDAIREKYGLSERHACRIVGQHRGTQRYVPIVPADEDALTRAIVALASEYGRYGYRRVTALLQADGWQVGKDRVQRIWRREGLKVPHPGGLERADVVGAVWSDDGQTPVVRVIRGRDIDGPGLSRTNHSILTAAVGLQAAIPVSSFEGPLMAQPRPTS

SEQ ID NO: 3126 - protein, 181 aa, Methylobacterium sp.
MGTREFTDGEERARRVALVQAVGERVYGGSWQTPLADALSAATGRSLGRARVAQWMLADGAKPVPGWVVDALPSIARDGAARLRRHADELDALFAEGGAGAPPAEDEPDAAGEPPLESGTEATAEAAPYDDGSDFDVDAFVEKFAHVRPASPEPEPAPEPTGWRSRFAEENIGRMRSLIHR

SEQ ID NO: 3127 - protein, 178 aa, Methylobacterium sp.
MEVLMSDASITPGQCRAARALVGRSRDDIAQMAGINPRTVAALEAAENVPSRATEKRLVAVFEKLGVTLLPEGASGGVGVRLSAGDGASLRLVRRDPLRQHGSIGVIAVFDGRPITARIEVAALAEGGDMDAAIEAFDTRRPAILAAVARKLADGTLDGDGHLRISAADLESAAGGQP

SEQ ID NO: 3128 - protein, 35 aa, Methylobacterium sp.
MVLSLPQVILFVAAVLLGMLLHRFAVGRGPVSRKA

SEQ ID NO: 3129 - protein, 34 aa, Methylobacterium sp.
MIHQLAEGADALPKDGSKPTAPPTNAFEGFGSFA

SEQ ID NO: 3130 - protein, 314 aa, Methylobacterium sp.
VLNALLADLPFDLTHVPAFIVTDETGAPVTDVVTTAPAPAASASRSSAPVVVAKVVTKAPARTRRKRVRSGLRQREDARTMRAAARGRAEEVVEHLPHHSSTSSTPTSPTKNANDNDEPETTKTSTGRGRMIAAWADAGELPRIIATNRALDRFGVPMAFSVNFDPKLIQAGNDNARGLLDYMRRRIALGLKRTFGETPPMWVAIETDDDGRPHLHGGIALTDQHAPAVVLGALAKAGGNWMRQGSAPADLRPQHDPDGWAAYPFKRKERTRRDLRQAAGLPPDARVGLYATSAELLAEGRRIHEEQRQLIGRR

SEQ ID NO: 3131 - protein, 70 aa, Methylobacterium sp.
MRHEKLVNECGECITRGTFFFASQKDRNSFLHCVLTSIFSDPVDDRFALYVEHQQPVIAVCVCIEGLKLF

SEQ ID NO: 3132 - protein, 27 aa, Methylobacterium sp.
VCRATLRRGPGMDNHPAIGHGAAVPKE

SEQ ID NO: 3133 - protein, 58 aa, Methylobacterium sp.
LKLAKQRGDIDCGGARYVIVGYGHFHQLVIDRPNGHVSVCFELDENPIPFVERILSLL

SEQ ID NO: 3134 - protein, 28 aa, Methylobacterium sp.
MRALAGILRTLAALIAPNRAVVRALSGG

SEQ ID NO: 3135 - protein, 133 aa, Methylobacterium sp.
MSGASGREIGERHVAALRAWLDGLEAAGEPLPTRNGRINLSAIAIACGFDRQTLYKNPAARALLEEAVGRLGTGEPAAEEAEAKPQTDRRDRRILQLEQQNAALRAEVRGLREQLARYRHVEDVMISGRGVRS

SEQ ID NO: 3136 - protein, 83 aa, Methylobacterium sp.
MIHAKIRVPEQSDLAGLAMFANQFFHSRVQGEAEASSKNMVWITFYFADKPEKLDGKVRTYREIFVREASAWYRLYQGGKQLL

SEQ ID NO: 3137 - protein, 314 aa, Methylobacterium sp.
MATVFFSYSHVDEGLRDRLEIALSALKRQGLIEAWHDRRLVAGDDFDRGVRGELERADVILLLVSPDFIASDYCYGVEMTRALERHERGEARVIPVILRACDWHPLPFGKLLAAPRDGKPVRSWPDLDEAFLDVAQKIRAALPKAEAARASAPTAAQPAPMAPQGSRSSNLRLRKSFTEVDHDRFLDDSFEFLARFFENSLQELKARNEGIDTAFRRIDGNRFTAAVYRDGTAVSRGSIVRGGMFGRGISWSANDEAASNSCNEYLLVENDEQGLFLRAGGMPHIGRGNPEGKLTQEGAGEYLWELLMQPLQWR

SEQ ID NO: 3138 - protein, 47 aa, Methylobacterium sp.
MSQAADGRGTLVDAIMLLLASFYLAGLAIFLEIIASAPTSDGSPLRD

SEQ ID NO: 3139 - protein, 130 aa, Methylobacterium sp.
MISVKFTGLDVFAALSRSERLKASAHHAVAEQAEQLADAIREAAPSDKGDLKESVRVEPTDDPLRVTVTAGGMLGTIETNADGVQFDEALMSEYGTSRSAAQPFFWPTVEKMRDTIKANIDGAMEGALEE

SEQ ID NO: 3140 - protein, 53 aa, Methylobacterium sp.
MRHSSPVGFGRTGCPRSDPAGGPSQVIPANTPRSVARLRASAKPLIANVFPAP

SEQ ID NO: 3141 - protein, 60 aa, Methylobacterium sp.
MSEPASAGRRSPDIMGRADASSMPGNHGEVVDGPETPLQPSRRNRVDTGDGRLVFAQTLP

SEQ ID NO: 3142 - protein, 392 aa, Methylobacterium sp.
MGTTRRAFVLGGAALAATAGASSAHQAWLWVAEPRPGKAPLAAIPVFDLRGSDPATHAISRKGEVLGLAQSCVGPLTPVARLGLDGADILAGRWLRASGSPYVGELERIAEGTGVSGVHLLNASYEWGCTSLAAPSPDGGSARLLRTLDWPFHGLGRRVEAWIQSGPAGEFVNLSWPGSVGLLTGMAPGRFAAAINQPPVKRRAIGDSPLLDAVAGSYAAWESSGRIPALHLLRRVFETTVDYASARRMLETTPIAAPAIFTLVGVNPDQTCVVERDVADFHTHEGVSSAANVWRYGTFPGTWRGGRASEEAHDSTQRSDMIESWAGKATTTGASTSNFEWVKAPILNAMTRLAVEADPGKGVLRAVGFEEAPGDADTAEWATLPLEWAAGT

SEQ ID NO: 3143 - protein, 104 aa, Methylobacterium sp.
MVGRVVSSRAERLTHDTDRLRAVFAAEAILNRIGLDLPLRTQDTSGQLGDGSRWRIVIRPYIEPGFRIQGRSNLLHVSVRVAPARGAERNAVVLNTLRLPGSDL

SEQ ID NO: 3144 - protein, 98 aa, Methylobacterium sp.
VKAASNDQPSLPAPKPPFWLVGIVWGETNRFAIVQSSRTGPIHRVRAGETIDRWRLEHMTARVATFRMNDVNVPLDLQRARSPASDPAPNTYGRVGRH

SEQ ID NO: 3145 - protein, 158 aa, Methylobacterium sp.
MTTTTCSGTVTALGQSALSLQGRRYAYIEIQRPDGRILRADDVVVLNEVGSLLHEGVEGRFHFDAARLKTATIRQLFGIRRNDGRWAYDAAQVRVTAAVHNIVQGALLAFVFVGIPFLLLGLLQLIYSIGTARLRHDEFFGSEDQGGGSTRQGEVIRI

SEQ ID NO: 3146 - protein, 60 aa, Methylobacterium sp.
MNRLTTRCAAERLALAAGAAAAQEAGAAAPGPHDGIRRTLFVAHGLRRPDHVAVDSSASR

SEQ ID NO: 3147 - protein, 49 aa, Methylobacterium sp.
MGISRVGPYDGLLAFALNDIELDMLRVKEHAGDAKGPVANAIAPTFTPR

SEQ ID NO: 3148 - protein, 110 aa, Methylobacterium sp.
MAETSPPETGKNRKPRVGKARGGRPNRNEALRRRIAEAGVDPALVDPRKLLAAIALDEKAPATARVQACKALIAAQAGLPPPIELDPDEVPEDDAVTRRALALMAAGRPQ

SEQ ID NO: 3149 - protein, 76 aa, Methylobacterium sp.
LTTTKIMSGMSVVDTASRRWASAAAVQKIMNAAVKSEGSAKVLGLNMDRMRALGLDDEIDLTGWLWTGLIERISQD

SEQ ID NO: 3150 - protein, 44 aa, Methylobacterium sp.
LGGGIAYAILDAFVFMRGQNIEHRVVPIFAAIFLTGILVAVALS

SEQ ID NO: 3151 - protein, 92 aa, Methylobacterium sp.
LLVPAVRTLISVPAGLAPMPMLPFLIYSTVGTLVWTTLLAVAGYWLQDRYEEVSAHVDPVSKCIVGLIVVTYLYRVVTWQPDIASADSDQAH

SEQ ID NO: 3152 - protein, 195 aa, Methylobacterium sp.
MAVSLTKGSSISLTKQAPSLARISMGLGWDPAKKGGGFLGKLFGGGGSDSIDLDASCLAFAGGRHVDTAYFGRLDILGGAIHHNGDNLTGDGDGDDEVIDIDTTRLPAEIDALVLTVNSFRGQTFDEVDNAFCRVVDQSNGRELARFTLAEKGRHTGVVMAVLRRAGSSWDMQAIGRSAHGRTAADLVGPARECL

SEQ ID NO: 3153 - protein, 408 aa, Methylobacterium sp.
MTTLTMGGNAPVPSGDLMVVVEWASTPGLDEIDAAAFLLGADGRVSGDADMIFYGQKGDGAVRFERVPGHVPDRDASVFHIKTALLPDRVQRVAFSGTIHGARETGMHFGKIAGLRISVQSAQGDAVAFIPPPASNGETALVLGELYRRDAGWKFKAVGQGFASGLASLASAYGVDVEDAAVASPPPAPKPQPVAPAPVSPPTPKPINLSKVSLTKERPTVSLEKRSDYGDVTVNLNWSRAKTGGLSGLLQRGGGGIDLDLGCLYELTDGSIGCVQALGNSFGRLDREPFVALDSDDRSGASVDGEWMRVNGRYFTNIQRLLVFAFIYDGVPNWARTDGVVTVRVPGEGPVEVRMEEGSNAKRMCAVALIENDAGRMRISREVAYFRGHDDMDTAYGWGLRWKAGSKN

SEQ ID NO: 3154 - protein, 192 aa, Methylobacterium sp.
MAVSLSKGGNVSLSKEEPNLSKILIGLGWDNRKTDGKDFDLDASLFMLSDAGRCSNDAGFIFYNNKESADGSVKHHGDNRTGEGDGDDEKISVVLGKVGSDVQRLAVTVTIHEASERGQNFGQVQNAFIRVVNEDTGREIARYDLGEDYSTETAMVFGEIYRHGGEWKFKAIGQGYAGGLKAMATQYGINVG

SEQ ID NO: 3155 - protein, 189 aa, Methylobacterium sp.
VNLSKGGTVSLSKEAPGLAAILTGLGWDNRVSDGKPFDLDASVFLLGADGKCAGDAAFIFYNNKKSADGSVEHMGDNTTGQGDGDDEVVKIDLAKVPEAITRLVFAVTIHEAKERSQNFGQVQNAYIRVVNQAGGAELAKYDLSEDASTETAMVFGEVYRHNGEWKFKAVGQGFAGGLGDLARSYGINA

SEQ ID NO: 3156 - protein, 422 aa, Methylobacterium sp.
MAKQLASDAEILAAVKNAGSIRAGAKALGMAHSSVRERICKLRQAVQGNDTDLAFASEKGLLGTEPVLPGYALKRSTAVNGKEGEVVRQYVTQAKAPGPRAEIPAGHVVKGVSQLRDSSGRVTQEWVKTREADGDPALLAKTLREVMLDARGPSGIVLPEVDRDEDLLTVYVVPDLHLGMMAHAKECGENYDLRIASEMIRREVSRLMAMAPPSKHAVLLFLGDFFHQNDQKNATPRSGHALDVDGRWRKVYRVGAQVAIGLSRAVAERHENVEVAFLPGNHDEDAALTMAVALEIHFEEHPRITVADGDGIHWFRRFGRCLLGATHGHTMKPDRMAMMLATDRARDWGETDHRHFFFGHIHHETAKEVGPVRVESFTSPAARDAYAAAGGYRSNRSLNAVTFHREDGEVCRHRVNIKGAVQ

SEQ ID NO: 3157 - protein, 127 aa, Methylobacterium sp.
LARFHFQVRTQSHVAFTEAADLPGLEKARTEAARRVRVLLTEHAQQIWADKDWQMDVTDDRGLILFTSMFQPTSRQPRRAVNARRGCRTQPSAFFGFALRFNAALKSASFSLAPDSRAASMKWLRYS

SEQ ID NO: 3158 - protein, 136 aa, Methylobacterium sp.
MSNVKEVAEDRMGRALNGFVAAIGALIAASPFFLSFSDNVPATTNALLCGIAVSILAIMNKRGRHVWAEWSALALGPWIIASPWLLQTDIVPSMTTGAMGGFEPEVAAHVAFGMALLISSAFVIVRSGSWILAPDA

SEQ ID NO: 3159 - protein, 102 aa, Methylobacterium sp.
MIEAAVSFGLNAVNGAAKGKTLSVNVAVPVIAKGTQYVIDTAPAAVIKAAGGADGITARIFRKLDLDDHASEAAVLISAQEQVAASTVDADELRRMDEMSRR

SEQ ID NO: 3160 - protein, 89 aa, Methylobacterium sp.
VSALSRIREFRIRRIENFRAVLLKAWSVRLIVLATLLEGAQAGCGFFTGSDLVSPGTLTVLNCGLMLAALAARLVAQEAVSGSTVKGDA

SEQ ID NO: 3161 - protein, 337 aa, Methylobacterium sp.
MQELEEFGLDEGEALGRLETLWSAYEKISAEAARYDGSLGWKTNAGLDYLVHTVNLRYEGNRQRTRSLGPRSEETERRMAEFREGRDRSRERLARVQERLEIHGRVLKVLRLGRLSSLTARFLRELHAEGFGAGHFRIGGAAALAAYGVRARIRMPTVGSEDEPDFDLLPTELFVRDQRLFDAVASRKIFGPVEPDGDRLVLGRGIVLRMLSEDVLDGWVRHMSHVGVGEDEINALRWAVEVPEAVPLLAVGRDGSPAPVAALDPRAFAVLAAVEARHVADDPTAARLAEQAAAVAGVAAGIVSEPFERGHLALFPEIADAVGEGGLHAHDAIVMRP

SEQ ID NO: 3162 - protein, 194 aa, Methylobacterium sp.
MEDATRFGQGDSDYAREVRRDRETARAWLTKPSADFNEVCALADREPDQVRKDALALIAMVDARVAAGLRARPRKTKPKSEVQRYEFQGERLTIPEWSKRTGICAPTLRGRLNTGWPLELALTKPAVVGAFGQPHTHRDAKRITFKGKSLSVREWAEATGINAKTLHARLEARWPVSRALTAPARSRPQETVPA

SEQ ID NO: 3163 - protein, 114 aa, Methylobacterium sp.
MMHALSRLDPAIARWARATRRRDMLTMVKRITAGITGHFKTRITEWFAAVLLLQLGWTLVSPPASFPPSTAWSVMAARMPEETWGAIMLAIAGTRLLALDIDGTFRSFRYWPAP

SEQ ID NO: 3164 - protein, 687 aa, Methylobacterium sp.
MDDLPAGFRLVSRPNAPAGADLPPGFRVVSDAPALPAPAAQPSVVADVAKALPTGAVKGAIGLAGLPGDVQEMSNSLIDRTMLGAAHMFMDATGLGYQAGTPEREEFDRFYLGIGSGGGLPTSKDVRRGVEKATGPLYEPKTVPGQYAQTVGEFLPGAVVGSGGVARRAAETIIPATLSETAGQATKGTAAEPFARLAGGVAGNLGVATAAARADAPARAIVAATRGTTEADLAAARALGETAQRVGVPLTGAEAIQGATGNATKLGDLQRAVEGSLDGGAILSQAYAQRPQQMRNAVEDALAALGPQSTAPSTLGPRAAQTAEAAIDDLRQSINRSTRSDYAAAGAHVLDPADFEPLARDPAFRETLRQLRADPVLGPTYRDLPDSSIAVIDAVTKGMRDRGVALGNRANPGFSSETAGFYTGGAAEARAIARDPARGGSQAYDDALTAQAQARRQNLEPLEQGPLGQLAQVGDTAAATQAVLPARPLVGGEAELADAVTRLRAREPDLTNELIRQRLADQFDASATRLVGGEAQGGGARFAKDIAGTEQQARSLDAVLDAVGGPAARQPIADVLDVFRATGTRKPQGSPTDFNQQIREAVGEMPLTAQALTALRTGGASLLTQAGDGARRAWFGRNNATLAEILTAPDSIGRIGTILQRGTTTPYADAALRQALQSRGAESAAQQ

SEQ ID NO: 3165 - protein, 45 aa, Methylobacterium sp.
MTALRGSLSGIMLPFVPPFPSGGGTLWTPVRKPLPKRATLRMAWS

SEQ ID NO: 3166 - protein, 49 aa, Methylobacterium sp.
MPGICLDQIAPVVLDGTVGRELTMMRWGIPGPKAYGEQPVTNVQCWMGA

SEQ ID NO: 3167 - protein, 37 aa, Methylobacterium sp.
SRLSTQSLTDAYGLAPRSWEPALDDILDRLVGPVRSH

SEQ ID NO: 3168 - protein, 37 aa, Methylobacterium sp.
FCLSTQSLTDAYGLAPRSWEPALDDILDRLVGPVRSH

SEQ ID NO: 3169 - protein, 123 aa, Methylobacterium sp.
LSILLFCGEDGLFVLELSSSLFAILDGECGRRIEALAMVLPRWLRDRLMPARFRQEVAGKATDLLSVHGGLAYRVAREQARMERAGGRLTECRFWSRVAVEIARREGRADQIGVKGGDRWPDP

SEQ ID NO: 3170 - protein, 51 aa, Methylobacterium sp.
MGATMSLHTASVTADLIVTALGLDLRTRAAQMPGQMSSVRLMPAFTLTAAG

SEQ ID NO: 3171 - protein, 715 aa, Methylobacterium sp.
MRSLAFALTGTGMAAFLVATRTGEWNLHLLTGFLVVAAACVLAVRDGSTFLKIPLATFGWEAVVLGLCTLARAEGAWPAWLADLAVPSTAVMTLTLLVIVLAALWSVSVVRRCLVIADRYFDRDDRLGWRLPGGAMLRVRERHLGRAAVSLTILLRQVGVILTIKTLYVSAQLADALQAGDRAMFWDALLVQMPLWAIPWMILHLASTSLVVAFSVRWRQVLSEDYARRWFSGAAHYRMTLVNSGIDNPDQRIHEDVPNFIGGTEGGTWGVYSIVVMITGILSSFLIYAIVLWNLSESVDLFGNGVRIPGLLLWIAMAWAVISTCLTIWIGKPIVPLSFRQQHVEADYRFGLARTREYSEQIALSHGGRAEAAIIENRLGAVVSNAYRLLGMTLVMSVLGSILNGLKDNLHILLLGPLVIAGKLTYGSLTIATSAFSAVNSVFSFVVDSFVSLAKFKAVVDRLSTFDAALDAVHGRSDGTRVETGPEGAIRLSDVAIDLPDGSPLYGRTNLVLRPGENVLLFGRSGTGKSTLFRVLAGVWPHWRGTIALPPQGSLLVLPQKVYLPSGDLMTAVSYPRVADAYRPDDVARALEDVGLGALVPKLHHDVNWAQKLSGGEQQRLAIARAILARPRWLLLDEATSALDAALERQVYEALRRRLPTTTLLSIGHRDSLLAFHPRRLRAESTGEGVVLKDITPAEEMASRTAGATMAEAPA

SEQ ID NO: 3172 - protein, 54 aa, Methylobacterium sp.
VSAASYGRDGDRKISAWLKAVGWRVNDKRVERIWRREGRKVPAKRTVVQRPTLY

SEQ ID NO: 3173 - protein, 234 aa, Methylobacterium sp.
MQSFTSGGRRIEVEWFAASGSFAEANGKGTSRPALLLLHGADGLSFAEGYRLAARTIAASGYHVAFVHYLDRTGGRRVAYTRLRQDFPLWAETVREAVAWLADQPGTDAQRLGIVGISLGAALAFTTAAAEPRVRAIVDYFGPLPDELARERPRLPPTLILHGSADAIVPVSHARALERLLQEQGAAHEVKIYEGQGHGLTGPAQLDAAARVARFLGQHLQPASVENNDRSASA

SEQ ID NO: 3174 - protein, 407 aa, Methylobacterium sp.
MVSRRNRANTFIITDSGGFQVQQGTIEWYPEGHPRDTVATVLDWQEANADFVMALDFPTGGISSGNMLKHMRALETEGVPLRQWSNGSGLSRAYHACLEHTIRNTDRMLNLRQQKGTSTGFLSVLQGRNEEESRHWYKATRHFIQQSDGIAFAGTGRSDFSLMLARLMDMKRDGLLKRLRHIHVLGTGTLMAGVLLTCLQRNLRLHTEAKEIQITYDTATPFQAANRYYEAFTHFYRDKQALQIPPGLQVGEAEPDEHTLSLNEWCWHRTRALFEADRPRDGLLRAESGVGDRAKVYDIFYTTKHGPHRKLKPTWPGALLLTLHNVEVTVRAQRAAIDAYLANRTDMFPLNVRSIAGLIDHAFNPERGAGLLAASRGYSENSAKRYAASFNVQRYLANYAGTLQGLL

SEQ ID NO: 3175 - protein, 178 aa, Methylobacterium sp.
MPLLTGSLVLTYVACGVLVNLFAHLLPVYHLHNPFLGNPSATFPIIPGTLLVGLIFVLRDYTQQLIGESVIGFTLLASAIVCVLIDGRLGLYSGAAFLVSEGIDQLIWKRLGKEDIKDRILWSSAAATWLDGLLILHGLNELTWPNFISHYIGKMVSVFVIWLVLRHNHKKKMALGRV

SEQ ID NO: 3176 - protein, 84 aa, Methylobacterium sp.
MSAVTIEEVKAHLRITDNGNDVLLTQKLAAAEAHVAAYIGAPLVVDGQVPAPIREAVLQATAWLFDGTPADLSLLLIPYREWAF

SEQ ID NO: 3177 - protein, 163 aa, Methylobacterium sp.
VPQFVKLPDPVHAQLKALAAARGKTMVEVIADTLRQAVEAGEIGAETSGLSIALFLDLDAAVETDQGPFAIIKTDQGDMPPMARGDAEAVAKHLALEDDCRAARYNRFGWWSTEQRGTSVKLTGTNRADEKAVTITMAPIVAKGLAAQLRKVAPELIAEANFE

SEQ ID NO: 3178 - protein, 27 aa, Methylobacterium sp.
MRGDDQEAHKAVGTDLQKIRFGNVTGY

SEQ ID NO: 3179 - protein, 631 aa, Methylobacterium sp.
MCPPATAHRHREEIIEAIKRTDWRTSDLLFPALRLWEHIGTCAIFVSAKEIEITPPFIPTGVYDFLGKGVRRIYLSATMEYETDFVRGFGRRAKTPIVPDNDAGNGERLILLGSRFVERTTKAEVATEILKSNKLLISVPSYPKAAAWKAHGTPPRREKFTDELQAFRAAKSGAFILVSRIDGIDLPQDTCRVMLIDGAPSGSSLMDQYLFHHLSLSNLFSTKMAGRITQLLGRINRGRSDYSAFIIYGSDINNWLKTERNVALLPPLIRKQVILSQTVQDGLEQATPAVVSTLISQVLSRDAGWLKFYRETVDGLEVSAEALNKVKERELQLASSAEAECKFMTRLWQGDREGARTALLDVLDDTAKADARLAGWYSLWIAMTYEMQGDATTSIAHYKKAKARLSHWLNVPHKSELDRRLEAEGQTSVLQKRLSAVNLDGPQALSNLTAKLKVHAGILGNRAASAQAKEEALRAYGELLGFSATRPDNEVGHGPDVVWRDDEARTLIAFELKTEKNEPAEYNKAEVGQAHNHVQWLADNMPESSAGGLLIVGPAGTCKAEASPSDTIYLVETKLLVERLLAFAAKVDDARGRTDIDRWALLSELGLREEWQLPGLFKVLATTTLRSLRKA

SEQ ID NO: 3180 - protein, 1270 aa, Methylobacterium sp.
MFTVHPDEIKDFTGDQLVALLRRLLYAEARKAGVPLRGVDVPLQITVADGGQDGSIIWEGGNASTDYLPSRDIIFQCKAKDKGDAQWKREVWTKPTQRSDSKVRELNDAVKGALDRGATYIGITAKALVKPKPADRVDAIREGIKAAGCNPDKLAKIEVYEGNTLAAWASSHPAVAVWVKQINAKIDLAGFSTLDHWGKRADIAKPVFFESPDRKFSLGPHEADAINFSQLADRLADALDQPRTSARLWGSSGIGKTRALYHALSTSTGLLGELTAANFIFCDFREVGDDLWKVANQIVKERSCAVLVVDGCPLAEARRLNGIARAEDSELRVITVGADGIDHDNHCVMVRPTQADHATILGILKAGLLEAKDDEVEYLANFCDGFPRIAVLATETYRQKDILKSADAVAQQILEAAGAERETIRALECLSLFNSLLPDESPDDFDNIAETLVHMKGELMYENLVIAAGQHLVERNSGAMAAQPRPIADFLALRRLNYLRPSTLIRFLKDAQPRHREAMLARWRFLARSRTLSDIVQSFLRDFDFNANIVHPDAATYLPAFVHVEPDRMGFALYQAIRPIPLDDVAAITVTDQLLDALRLLASRQNSFARSAEIVLRLAAVAPTGGSPPVVRLLRQLFQVALAGTQANDHHRRAALEHALEEDDPRIRRVGVEALSAMIQTQISRFDEFEQIGADPYSPEWAPNDVGTINTYFDWALRRLLDVWRKDPALRHVIEERIAGEMRNLLGSELLPTLKIFIEEVVAVSGHWFGATHGIGDWLYFDRPEKPTEFSAAVRDLFDATLPKDPVDQVRLHSRFWLSDLQDPDKRFAQDQENPDFEYSARRIQALAPEIARDPHQLARAIRTMASEELNTPQVFAHALAPELHDPLGTFEQAVAALDASGTRVGATFVGALLSALDRRLADQPDEVRALEAIAKKSEILASNPMHIVTSLRVTDDRLDAFANNVREGKITPAQSVSISYGRGLEEVSPAALCRFVGVLVDHSDGGWAALEILLMVTHDQKVSADEISDLVKHAILSPAIARGVEGNASKSDYIYGRMLRLLDTTGAIDNDFARRFAEQVVQACRTTGARRGVPSDALRDALPFVMKHAPNEVWPILASFYEIATSVEREFLNGITGATKRFAFDVVRTGPGTLFDTRLELMLDWVANDPEGRIEFLLTFFPILEQKDGAWAWHPALQTLARLYGRSRRFRNALRQRIYPRSWGGSLNSHLESFKAPLAAWTDDPDLGDWASTMLDTVARSLEDDFYGR

SEQ ID NO: 3181 - protein, 48 aa, Methylobacterium sp.
VERPISLGPGASRFTLALGCGESTGSSCVVGVGQSSGAGMAGIGVLFG

SEQ ID NO: 3182 - protein, 210 aa, Methylobacterium sp.
MQTQAPKEQVRPCAPFLKKESPRLIPYAGSPRNMRRKAGLPSAPKKQPPRQRRQLTAELRQWFAAEIAVWPDDPKLPLSWENVVAKGYATYYWTWSRSGLARIPEIAAAFAKRTAELSAGRNRMPRYPERADEKRTRARLLATIADLQAENEKLTRRLRVWQKSAHSRNITVEMLDEAWDEIDRGQTDLELRAKKGLPMPQHVPRQPTKK

SEQ ID NO: 3183 - protein, 67 aa, Methylobacterium sp.
VSNRDKETRSLIVRLRDDGWIVARKGPGDHVQYKHPAKPGRVTLDTGRREQALGTLRSIYRQAGWDW

SEQ ID NO: 3184 - protein, 349 aa, Methylobacterium sp.
MKRRTIIGIAAATFGSAALAALPAASLLPRAAAAAGSIVFTSWGGTTQEAQKTAWARPYTKASGVRVQMDGPTDYGKFKAMVESGNVGWDVVDVEYDFAAQAARDGLLEPIDFSLVKREALDPRFVTDHAVGSFYYAFVLGYGTKHVPAAPKSWADLFDTKAFPGKRTFYKWSAPGALEIALLADGVAPDKLYPLDLDRAFAKLDSIKSEIIWWSGGAQSQQLLASGEVVMGQFWNGRVAALEQDRQPVGIAWEQNLTTADMLVVPKGSRNRQAAMTFIAAATGAKEQADFAAATRYAPINLGSAKLMDPAVAETLPNRHAATQINLNMEYWAKNREEIGKRWYAWQTR

SEQ ID NO: 3185 - protein, 147 aa, Methylobacterium sp.
MRLEKNGNMTGLLSRSLKAAYDAVPRDEDNLGPTILGFGYDVPDRVVEVSGLRYEDAANPVKASATATLHYTNEDAPVPSFNRSIVVAFVEEDGWWRIDDVRPFDPKGRRTGREFGLKRAFERLAEERVRSAVERPGPATIPRSASR

SEQ ID NO: 3186 - protein, 109 aa, Methylobacterium sp.
MKSATFLAAGLCLTLAACSDEPPESAMREAVTNVMMASYKIHVAGMALIGSRPPPEPMLTAFKSHGCKPAIGVPGHVCQMSVAINGVDRGVSTGRFFKQADGTLAIADR

SEQ ID NO: 3187 - protein, 53 aa, Methylobacterium sp.
VLVVSYKGRALAPDQAAIAHDDAPALSDVTLSASLYLDTEVDDALILSEQTEI

SEQ ID NO: 3188 - protein, 299 aa, Methylobacterium sp.
MTRVLPALCLHSGNCLDLFRDVPDHSVDLIVCDPPYGTTFATWDKLLPFAELWPEIERVLKPAGVCLMFASQPFTTDVIASNRKFYRNLWYWKKDRPTGHFLSNRQPMRIIEEVLVFGRTPRSATYNAQTTKRDRPYKHYYRRSAGSIYKPSPWNRLPNGRDHRVYDTVQPHHLLEFARDPVQLIPTQKPVALLRYLIETYTNAGGVVLDPTMGSGSTGVACLETGREFIGFELLEKHFAIASDRLRSAQAALRPAPVLDELEEELRRVVKRKPAPTAEELDDELWRTIRRRSGRGAVA

SEQ ID NO: 3189 - protein, 32 aa, Methylobacterium sp.
VIVPIPRVTALSALWVGSAQTTSHWPAPAAML

SEQ ID NO: 3190 - protein, 105 aa, Methylobacterium sp.
MRAGRLKHVIDITRRVETIGEGGIASDTFTPIARLRAEIISRDARAFIAEAGEQTEAAVVFRVRFRPEIEPGDFVTMDEREFTISELKEIVARRVLELRCTGDRA

SEQ ID NO: 3191 - protein, 92 aa, Methylobacterium sp.
MKMTTLEAFKIHMNITDDADDAILAQKLDVASAWVGRIVGGPITANDPAPIHEATRMLAAHLYESREATLVGITAQELPFGVMDMLGPYRAW

SEQ ID NO: 3192 - protein, 102 aa, Methylobacterium sp.
MTDRVICETCGEDTWSEQHPCSNCDRCPPTSNWGTSFPFDQALLGMRLSKRVRRPGWDRTWSIEDGKLTVRWPDPAGGEDAVALACELHEDDILADYWEVAQ

SEQ ID NO: 3193 - protein, 59 aa, Methylobacterium sp.
MEQGLGLALLTRHNAFRAITEPRDGRREAYLIKIKAFLVGLPVGCQQICETIEDAISHA

SEQ ID NO: 3194 - protein, 92 aa, Methylobacterium sp.
VGANEPLARGPPPPCRRSLDFVSDTLDDGRRFRILVVVDDCTRECLALVVDTSLSGHRVTRELDRIIAGRGKPLMIVSDNGTELTSHAILRW

SEQ ID NO: 3195 - protein, 650 aa, Methylobacterium sp.
MRLKQIDPSSAEKRIAVLERMLLSRECDRRSGLMARQGEAWFTLSSAGHEAVAALADVLEPRDFVFPHYRDRALVMSRGMSVEDVARDLMAKARSHSGGRGMTSHFSHRPGNVFSIASPTGSHCLPAAGAAWASLRRGTGAVVLCSLGEASTRQGEFFEALSFTVQMSLPVVFLVSDNGYGISTSTKGKSPRDLGMLPGERLSTVDGADPDAVLAAGRTAVERTRGGDGPTVLWCELDRLDPHSSSDDHRAYRSAEELQAMRDPVALFSDRLIDEATITADQIDAMRTRIAEEVERIFWQVAAEHVADATHLHDHLFGPETALPHPVAPSGGTIVSAVNRALRDGLARHPEMLIFGEDVEDPKGGVFGFTKGLGTERVVNAPLAEATIVGTAVGLAAAGMRPVVELQFVDFAGPAWNQIANQLTTLRWRSMSDWRCPVVMYAPWGAYLPGGGIWHSQSNESLFAHLPGLRVAVPSTPEDTEVVFARAFAGEDPTLVLLPKHLMRQRQMAAAEPALAEGARTIVTGSDVTVVTWGNGTALAAQAAAELAEEGIGVDLIDLRWLVPWDRNAVAQSVRRTGRLVVVQEDTRTSSFGASLLSNITESDDEFYALLAPPRLVSRDDVHVPFHPELERAVLPGADDIANAIRSVLP

SEQ ID NO: 3196 - protein, 218 aa, Methylobacterium sp.
MVDAVFLSAGVPDPRRGPQYAATADTVAITAAVSALVHVTLGRRLLVWGGHPAITPMVWTIAQDVGVDYGRWVRLYQSRHFADEFPEDNQRFQNVTFTDDVPGDREQSLLVMRERMFSDHGFQAAVFIGGMGGITQEYEMFRRLQPNAVVVPVVSTGGATLDVAARAGLLDPDLADDLDYVALLHRHLAVSVREERFKDPDDQPASIPDRFWRPGKKA

SEQ ID NO: 3197 - protein, 386 aa, Methylobacterium sp.
MSLYELAILGCATPDERTTLTATLRGMIEDFGLAVGTDVRVLDSSNVAGRDKRAAFAAAYFAGDDHADVEAARALFRSSAPVIPTVGPAGDFARHIPDFLQSANGLRRRGDDGALVELASALLECVGLLRKQRRVFVSYRRTESRAAALQLHDLLTARGFDVFLDTHDIRPGDPFQDVLWQRLVDADVMVMLDTPTYFESRWTRQEIGRARAKDIHVLRVIWPEHVPSRLTDLAETVYLEPAELEGSDGPVTRAVADAIVVRVERLRSRAIAARYMAITGKLRADVEKFGGSVEGIGAHRAVAIRLLDDRKIWAYPVVGVPNAEILNDIAEKARRADQGETPVLVYDHVGIRDAWNAHLVWLGEHIRAVRSIKVAEAGWALAAWEG

SEQ ID NO: 3198 - protein, 199 aa, Methylobacterium sp.
MDVCFDIVNTLPGMTNYVFSDTRCNAAEQAYNLSGYMEGLYCGRCINVAVRFGWFLRPSQQTPPINIFSSQTDFFNAAVDITDITQGAYYGNLFYHRADATTNGVCYQITCVKKSQILGGECVNYADTTSLVGVAWSAASDNIVGDMILSKVDTGVTNLGGSTGNVYRRGRWINVKQGARDYGNGGDSSNVCIGYNAAC

SEQ ID NO: 3199 - protein, 48 aa, Methylobacterium sp.
LDRVLIQGKRQSLLARCVDYKIIAVPGQLLREHIASIALYGQGRELLE

SEQ ID NO: 3200 - protein, 126 aa, Methylobacterium sp.
LLQSPELIAAASVTAGLMWASPLPVAVATKIAPSTAKAHPAVIATQPLPSAFDPRSSVPATTPLPMMIRTIVPRSSPRNGDVMLSSPHSIVVSRRPSRVRSRFPPGVGEAQAGAFAGRLVPRRPCQ

SEQ ID NO: 3201 - protein, 83 aa, Methylobacterium sp.
MASGKTGAVQLAPCPAGWSACTGDVVPLGFIPLALPAPPSPVRAEPLRPSAIEIEMAGGHRLRAEAGVEVVLLQGLIATLLGR

SEQ ID NO: 3202 - protein, 71 aa, Methylobacterium sp.
ATVITIDIVRKPKDQVGFAVHPRRWVVERFFGWISRNRRLWKDPEATLASAQAFLYAAAVMILVRRLGRAS

SEQ ID NO: 3203 - protein, 71 aa, Methylobacterium sp.
LRSSSRSDLRHLNGPDRFSDLAALRDQNIDLAQLGDDLLSRMLLPAHQNVLHMAQSHTLGRPASQGEDQKT

SEQ ID NO: 3204 - protein, 73 aa, Methylobacterium sp.
MCGLPFAVSLALTLPLQPAPAPLCPRADTAVMAALVGDVRREPAATDPAFEAAIRAIRAPQPQKAAPRRKHRR

SEQ ID NO: 3205 - protein, 42 aa, Methylobacterium sp.
LLDTAAPIYEMEIYYNELLTLIWSNSPKLVHFSKIIKGYIYI

SEQ ID NO: 3206 - protein, 51 aa, Methylobacterium sp.
MARQAATKSAGGIWARVSEAGDLASFGIQWLLIGAQIKAPIRFEFDGLAAG

SEQ ID NO: 3207 - protein, 233 aa, Methylobacterium sp.
VVLDRPERRNTITDALLADLHGAVTEAETASDCQTLVISAMGADFCAGMDLEASHAAVGEVDLRYWAILRQLATTDLVTVAMVDGAATAGGVGLAAACDIVLAGAQARFRLTEVFFGLIPAMALPFVARRIGEQRAFTATLLAQTLDARAAADIGLADRVGPTAEEALRPLLVDLRRVRPGTVAALKAYRAQLFPWRADLGDVAGRAFLDRFSEPGVRQAMSDLKTALVGSSA

SEQ ID NO: 3208 - protein, 133 aa, Methylobacterium sp.
MKVVIDEGVPRHLASALIEQGIDASRFPRKWISLSNGVLIRACEAEGYDVLVTNDKNIADQQSLQGKRLAVVALPHNRRRAIIERIEDIADTLRRANPGEHIVIEIDGTRTIRRIVDGSVVEERLPAVATFRF

SEQ ID NO: 3209 - protein, 74 aa, Methylobacterium sp.
MNFTVEFFRIRPGDAAHAILDRVPQEVPTLEDAKVRAQSLFETLDMPQAPDGLRILDGSGAEVFSWKPVTAVDR

SEQ ID NO: 3210 - protein, 94 aa, Methylobacterium sp.
MLIPAGRHLEASFVGNADYELPDLELLAEPPLNDGEEVDADELEQNALNLQQTVQDFGVRGDILAVRPGPVVTLYELEPAPGTKSSRVIGLSDD

SEQ ID NO: 3211 - protein, 184 aa, Methylobacterium sp.
MTRALIEAAFEDRDRMAAGWEPNGYVWADAPILNRWAYGVHPLSGTMALVGFLNGHPRTCSPVVAMLTGPGGIGWCRTLTGWLRLALTSDELHREGRHLLPAHARELELAAHDAGYRAPRRSLRPDGPIGSDPRWHEAADHIDKTAKDPELAFAVFYARQRRVPLAEARRAMEVFWLSRTMTFD

SEQ ID NO: 3212 - protein, 118 aa, Methylobacterium sp.
MLTTGSGRAEEVRFFDFPRGPLATVLTRIALQGRRSIVFPADLARGRMVGPIRSYETVEAALARALAGTDLQIAKGAGGSLTVRRIAARSAAAGTDDLTSAAAPDPSGAAKHPTGARP

SEQ ID NO: 3213 - protein, 34 aa, Methylobacterium sp.
MTRPIQAPADEASRYVGSDIQSGALAADLHRVVA

SEQ ID NO: 3214 - protein, 65 aa, Methylobacterium sp.
MRAVVFHRLVISAVLGTMACATSTAAQGSSGTKTVIILCHYVRFAGRMGLNIAPSFVARVDELAV

SEQ ID NO: 3215 - protein, 563 aa, Methylobacterium sp.
MSFSNSRRILITSALPYVNGVKHLGNLAGSLLPADVHARFHRQIGSEVLFVCATDEHGTPTEIAAARAGLNPRAFCDAQHARQAEVYRNFGLSFDHFGRSSSPANHALTQHFYRRLDAAGLIDERLVPQVWSPADGRYLPDRYVLGTCPHCGDDGARGDQCDACGNLLDPVDLIAPRSALSGDARLELRESRHLFLRQAALRDRLSDWLDTRSGWPPFVASLARSWLTADLKDRCITRDLAWGVPVPRPDFEGKVFYVWFDAPIAYIAATQDWASAGPDRNWRAWWWGEAARETAYVQFLGKDNVPFHTVGFPATLIGSGEPWRTVDVIKGFHWLTHEGGKFSTSRGRGVFLDAALEALPADLWRWWLIANAPERADVDFQAARFAAEVNKDLADVFGNLVQRVTRFARTAFEGRVPEGGEPGKAERVLAAEVKDRVAAIRAHHEAREFRRAAAETRGLWARANSYVQETAPWSTLRADRARAALATRVALALVEVGATVAWSIVPNLAANVLRATGAPASSGTPAWPHDLEGLILGGRRSGSHLSHTFEPVVKLGAGHFDFT

SEQ ID NO: 3216 - protein, 63 aa, Methylobacterium sp.
VTSVGIFDDKPHRGEMAKGGFHSKEASLLAIPGLQAEGKLPTSDQVRAEEGVGCAQSWPESVG

SEQ ID NO: 3217 - protein, 81 aa, Methylobacterium sp.
MPRPEPAPGPLPSEADQGRRVFGALQPTSPLCRYLGTTACANIYKACIDFIERFGAEAVGLGWIMPLNYGVHPEYRSLRVD

SEQ ID NO: 3218 - protein, 112 aa, Methylobacterium sp.
MSETEPVESAHRTVAGVELVTIPLNHYAELLDCQRRLVEVSASAPVPPRRPLTVDTRSRLFDDPEVAAFLIEIAGTMRLTDARSACVDRFGAERAPSRSTINRFWQQHRNRR

SEQ ID NO: 3219 - protein, 127 aa, Methylobacterium sp.
MTVERLTTATGDMPTLTFEPGHALPIFALREGVPVVVISAAEYRDLRALRAQQARGDISAALRAVRAAPPGLSTVEEDAEVADFLRNRFRRRMSLQALRAACVERFGVERAPSVGRIQTFRSRWRSY

SEQ ID NO: 3220 - protein, 60 aa, Methylobacterium sp.
MGVMGAVETGGVEAAALIGSMAAFLRFRREAGPQEIARVATGVLRAAGCPPGTAASLTDP

SEQ ID NO: 3221 - protein, 337 aa, Methylobacterium sp.
VSSLTEAQKRKIHLPYVRAATNCISQSLLMNPDAVRLARQGQWGDAFRAAPKGQCATEISTLISTHDQLYGAGTGQTFFSGPYISDLPRALGSRLKGEFERLAAAEAREIAARQQEVARQEAAKRARIEEADRVVTLYRDKMYECTTNQIVKLAASSEGAEVLATAAMTICDDEIANAVRAGTAKLRLQFPDAETAPLRADFEAVIKKNVVTTAVQAKAALNTSRQQVASEPTPAPVTPVVAAPPQVATASDPANSGPALVASPVRECLRTMAKAREGKFVNREDLVKAMLDLCRPEIEGAARSAFLKDDKASLEQTRDKMLQEALREAREVVGSTN

SEQ ID NO: 3222 - protein, 64 aa, Methylobacterium sp.
MSFPHLEQHRNGKYYIHWTVGRRSMRESTRTDEQRTALIAFAHWILSRYSDGDGTGDAVRRRAR

SEQ ID NO: 3223 - protein, 105 aa, Methylobacterium sp.
VEKLFTEAEVAERLNCSVARIRKLRAAGRLAFLPGRPVLITERDYNAFVESERQHLKTLTGKRRKRAKKFLPPEDPPPKGGMTPEQRGHWIAIKMQILREEKAKR

SEQ ID NO: 3224 - protein, 196 aa, Methylobacterium sp.
VAVSSIRKLVAYQETTFIEGGRTAPQPLKLFGVAAVLKNPWAGRGFVEDLRPEIRSTAPELGALLTAEILRAVGSGEAVEGYGKAAVVGTDGEIEHASALIHTLRFGNHYRQAVGAKSYLSFTNTRGGPDCPIVIPLMHKHDEGMRSHYLTVQFSILDAPAPNEIVVALGASVGGRPHHRIGDRYQDLREIEAGDA

SEQ ID NO: 3225 - protein, 304 aa, Methylobacterium sp.
VADAVMGARERSRAMTAARLQALPLQDAPPPWSRRLRGFGAVLPALVFLVLLFVVPVLALLLRSITEPALGLGNYATFFAGTTYLKVLGNTFLVASLVTGATLVIGFPTAWFLAIAPRRLAGLLTGIVVLSMWTNLLARTYAWMVLLQGTGLINRALLELGLIAAPLTLTNNLVGVTLGMTYIMLPFMVLPLASAMRAIDPSVLQAASLCGASRWQCLTRILLPMLSGAIASGALMIFVMSLGYFVTPALLGGTANMMLPELIAQLVQSLLDWGLASTAATILLVLTLLLYALQVRFFGTRSTA

SEQ ID NO: 3226 - protein, 174 aa, Methylobacterium sp.
MVVAPVQAGRFTAQVREQLTPLVKAAFREIIRDSVQSRLSNALADTAALDIAEAQPAVEDAEIVTTDEEREGFMIVRAIVREVIKADRVIMRDQRSYCGILIDNNNRKPLARLHFNRTIKYIGLFDGDKEERVRIDSLDHIYELTDRLRATARFYAEGGARKAEAVSSETVPAA

SEQ ID NO: 3227 - protein, 105 aa, Methylobacterium sp.
VFPLLAALGLALGACSDEPSEAAMVQAMNDFMFRMSRQEAALMKASGRQPKPMPVIEDFRKVGCASAHPEAGYRCEFEATVDGSRGGKANARFFKAADGTLTMVE

SEQ ID NO: 3228 - protein, 33 aa, Methylobacterium sp.
VRFGIERLEASSRALALAHRHFEGGAKGAQALG

SEQ ID NO: 3229 - protein, 330 aa, Methylobacterium sp.
MSTRILLGDCRDTLRSLPADSVHCVVTSPPYFGLRDYGVDGQIGLEPTPAEFVAAMVEVFREVRRVLRPDGTLWLNLGDSYCNDDKWGGRGGGYNGRGGLDRERIALVPRHRRARSGLKPKDRMMIPARTAIALQDDGWWLRDEIVWHKPCPMPSSVKDRTTPAHEMLYLLTKSARYRYDHAAIREEAAWGYKTSPNQVPMEGRSVASTGIWRGAGTGEVDVARGRDETGSSYDRSSGRQKRSVWTVAPTPFKEAHFATFPPALVEPCILAGCPEGGTVLDPFGGAGTTALVAERLQRNAILCELNPEDARIATRRLQADGGLFAQVAAE

SEQ ID NO: 3230 - protein, 80 aa, Methylobacterium sp.
VTIEPTEFDLISLARRGLQALLDEAIAERQFARKFATVDVSTRRYTPESKEATSRALDAFGVAHDRLTRFNLLYPERAEA

SEQ ID NO: 3231 - protein, 46 aa, Methylobacterium sp.
MQRIGETYFAPNKDLSDFADIHHASGLDPLCAFSTVCRRELAIARR

SEQ ID NO: 3232 - protein, 258 aa, Methylobacterium sp.
MLREVTPSASDDAARLDATKTAYASEPGWLLPPLTEILPPSPAVCAINLHRHTWQALQASSAFLDATGQTERKRLMWPAEDAEGEAEDDLMMVACQGLEDAAAMLAHLRWYLGVRPEHPTRPRLCPATAALMAARVADLAFMLGEAGRQAGGGDLTATLAEHRRAWAAYLETPDPEETGWDVHHALTGAVDGAVLSVLAMPCANLADGAALAAHAQWYSAELEAAGEDLADGFSYEVQHLRARAGDWTMFLGAGSRTA

SEQ ID NO: 3233 - protein, 148 aa, Methylobacterium sp.
VSTHVREAAASDAITVLGLVRAHAGFEHGEASLSLDDLKAILSADYPPTHLLVAEGDTALVGYAAVTFDFSLWRGRTYGHLDCLFVAASVRGRGIGKQLFDAAVRLAQAEGVDRLEWQTPVWNSDAIRFYIRTGALGMRKQRFTISLW

SEQ ID NO: 3234 - protein, 160 aa, Methylobacterium sp.
LVAKKCFLSFHYKPDNWRVQQVRNIGSIEEQPLLDANKWEEIKKKGDQAIKDWIESNLKGKECLVVLVGEKTADRPWVKYEIKEAWKKGLGVTAVYIHGLKNSDGVQGTKGRDPFVGLSVSGETIVGTTHDTPYSSSTYVYDHIKENIETWVSDAIKARK

SEQ ID NO: 3235 - protein, 158 aa, Methylobacterium sp.
LSGPDALKQLIRDGVHNTSVVCVLAGAETYARRWVRYEIARSVIDSKGLLTVHINSIPNHQPPRQPHPLGPNPTAFMGVAQRDDGTYRLCERNYVDGAWKWVWYSDYVSGVPIPMYIGASVRKGVIPLSAWTSEYDWKQGGYNSIGSWIDRAAREAGR

SEQ ID NO: 3236 - protein, 102 aa, Methylobacterium sp.
VDRDQLKDTSVTVVLFGAQPPEREWVGHEIRRSDKPGKGLLAIDFHKVKDQQLGADVQGRNLLSYRLVKRGGRTIGSPAMGTIICPRRSRRPTKPPGAEASR

SEQ ID NO: 3237 - protein, 86 aa, Methylobacterium sp.
MRRWLRDLFQPSRFRREVAAKATDLLAVHGALAYRVAREQARIERAAHRSTENHFWSRVAVEIARREGRADQIGVKGSDRWGKFGE

SEQ ID NO: 3238 - protein, 40 aa, Methylobacterium sp.
MTLLDRDILLLELRWYNCHEFRHLAPQLAGALTGLLRVGF

SEQ ID NO: 3239 - protein, 80 aa, Methylobacterium sp.
LPLLANAGFCLTIARSHISGELCKEFMFSLQKEYEMTYDLTFREMNGDALLSMYQNFFDVAQGYSLLEDLADYQFVESSE

SEQ ID NO: 3240 - protein, 73 aa, Methylobacterium sp.
LDRWQAGRAGKDARAYLYIGPSTRISPVAADPGSRPHARSEITIGPLTSLAQETREEVVRAPCVERGNRSAEQ

SEQ ID NO: 3241 - protein, 48 aa, Methylobacterium sp.
AYYSPADDRNLRWNDPAIGIAWPVAEADAILSGKDKAAPLLADLGRVF

SEQ ID NO: 3242 - protein, 38 aa, Methylobacterium sp.
MPEGARFIGKPFTAEMVHDHLKEILPDGLKPAPLRDMA

SEQ ID NO: 3243 - protein, 41 aa, Methylobacterium sp.
VVDGGTFVWRCGAGMTRRTIDPPLSVYFMPAIQRAFHIDRY

SEQ ID NO: 3244 - protein, 77 aa, Methylobacterium sp.
GEAIPLSGRIVAVADVFDALTTQRPYKPAWSPEHARVFLQENAGTHFDPAIVAAFLSRWADVQAFLDLGRDTASAAA

SEQ ID NO: 3245 - protein, 50 aa, Methylobacterium sp.
VTLDPDSPDWPRRAKVVDAIAFYRAQEFERCWPINIADRLSVRSDHLHRG

SEQ ID NO: 3246 - protein, 39 aa, Methylobacterium sp.
QGFIGREQLQARGELFAKTSYGQNLLRLAREGHRADQSF

SEQ ID NO: 3247 - protein, 187 aa, Methylobacterium sp.
VLTDHLRLHLDGEAHLTHTPCAGREVATREPDRQGNYTVIVMPTEQFRALAEALGNLEPDWFAAKPDANTMKIAMGEFGDIWSDSIFGGNDQSRETYLLARGLYQALKYAQSIPKHLRNFSEEYAMADLLRTRFASLVQRLQAADEAMLAHLEEPRVAHRIPELRIALAVHTPPDMDGIRTEEALIV

SEQ ID NO: 3248 - protein, 112 aa, Methylobacterium sp.
VIVMPTEQFRALAEALANLEPDWFAAKPDANTMKIALGEFGDIWPDSILDANDTASETYLLAKSLYRALRYSQSLPKHLRNVVEECAMADLLRDKFTSFGEQVHDEDEVMLA

SEQ ID NO: 3249 - protein, 103 aa, Methylobacterium sp.
MSPLQLEGHFRALTVRFTQRCIEAQQALQDLADIQTEIEDLQGANSSDGLSAGLLGHIERISELKLHDFIGALLEAEQEEAEFLEDGSSPPPPVGFSDDEDDK

SEQ ID NO: 3250 - protein, 111 aa, Methylobacterium sp.
VTTNPNNPSLAEREALYRALTARWVAANVSAQQTLIDLCDIQGDLESLDGLRGRDGLPLPLKDHLERITDFDTDAPQAALLAVEQEEPEAYFLEDGDAPTPPPAFVDEDDK

SEQ ID NO: 3251 - protein, 694 aa, Methylobacterium sp.
MAQAYGGDTTPSVEHLFRTPWTINLPNAAKRRRGRTARLAKAQLVEPRRWHTLEDLEARFPPVAEPEDAAPVGSLDVSTALGVLDAPEYLDPELAERISSARAANPVFDKALRGDGPAADRSARDYSLAAASIDAGFDDPLDVAHIVAAYSSEKTEERGPRYLARTVERARQRVRPARPEDHFERIADAVPAAAGANEASIVEPADIFGDDDPGHLGTPPAGCLPEIMQRFVATEAQRKGVPESFVVGATLAVVGSAIGNALRIRPKRHDNWEAPGALAVVVVGSPGRKKSPTINAALAPLRAIDREQYARCSQQRRTWEAANKPVRGKAPSAATPAPPMRQAIVDDATLEKQIKIHADNPRGIVRAPDEFVAFLGSMGAYKRSGDGDRGTVLRMLDGGEINVDRVGGSVRAPSALMGLIASTQPDKIKELARNLGSDGFLQRMIFIVDDGLDRVGLDVPPDAAALADYEAAIRGLYSLDECTGGAVRLSAEAYEILQQTWRRVRALGSLPGASAAWEGHVSKWEGLLFRIALIFHSLDTWSFWGSADWIARLEVSAATARKVSRFVDFLMRHALRFYGEFYEPASHTREARELAGWLLTRPEISTFTPRDIEKARRSLTGQRPLTLAVMGSLESAGWVTVEKRGAEGPSSWTVNPEIHRRFAERAEREKARREQERTRMLAAMSAQKAIRDAQ

SEQ ID NO: 3252 - protein, 44 aa, Methylobacterium sp.
LSLADARSKIETWRRHYNESRPHTALGWRTPQEFALAAALQPAE

SEQ ID NO: 3253 - protein, 244 aa, Methylobacterium sp.
VAGEGGETLTLPLAELGDLLGLGIARPESATIPIVRLRGTRGRCLLAVDRLEEVRTLLVLPAPPIGSDPALVTGTVILGTDTPALVLDPDGLIDRLGRAGPRAARSPSKGLGDGSGTIPETRRSTILVVDDSITTRTLEKSILEAAGYRVIVCVDGQEALDRLRARIEPVDLVVADVEMPRLTGFGLVEALRAEEDFARLPIVLMTSRGDEEDVARGLELGADAYLTKQKFDQRELLDTIGQLL

SEQ ID NO: 3254 - protein, 345 aa, Methylobacterium sp.
MKFSVFVHMERFDDAQDHAELFDELTDLVQTAERGGFETAWIGEHHGMEFTIAPNPFINLAYLGARTERIRLGTGTVIAPFWHPIRLAGEAAMTDLATKGRLDLGIARGAYSFEYERLMPGLDAWGAGQRMREMIPALRGLWAGDYTHEGEFWQFPKTTTTPKPLQQPGIPVWVAARDPSSHAFAVENGCNVQVTPLASGDGEVEALIGRFDKACADAPNVPRPQIMLLQHTFVSESPEETARLNEDLSRFFCAFGALFQNKLPIEQGFIRGLDAELQASMPQFAPEKIAQNLVIGEAETVIARLKAYEAMGYDQYAVWIDSGIGHARKKRSLELFIRDVMPAFA

SEQ ID NO: 3255 - protein, 540 aa, Methylobacterium sp.
MNVVLHDSLAAYEREYNLVRGALTSKGTSLNAWLSEQGINRQLAYRALKGQSLGRKAVAVRAQIGLRGGITGTFSDLAAGKSPLAGILNSVNRTASSNFDRMVSGPLTAALFGQEGKAGGGLFGDAFGGVLGKAARLPTADITAGVVNLSGPISGIPGLTAANGNVPSAASVAAGLGGKGSADAAKGILSGLSGSRAEVADYVKQAAIERGIDPNTALRVINQESGFNVAAKNLTAREQSYGVMQLNTMGGLGVDAMKAGIDVRDPSTWRRQVDFGLDTVMRDGWRQWYGARDIGISRWEGIGQGGSATSATNSALPNLDASLRSIEGTATRATEGVTGLTANLSGLPAPLAQTSQGLTQVGQSLGSGGGGGGLLGAIASLFTGGASAAPASVAAATGGLIHGPGTGTSDSIHARVSNGEFIVNARATAANLSTLRAINENRLPAFAEGGYVGAVPPAARWDAPARAATANGNEAAGSSRGINVQIINNAGAKIEAREVADGNGGRRLEVQVDEMVAQSVGRAGSASRTALGVPSRVASR

SEQ ID NO: 3256 - protein, 294 aa, Methylobacterium sp.
MSRSVVIPLSRYFAGGLCLRGGSLTSLDLCLWLAAVSGTLALVDEPDESGLTMRDHWITARGDAAPVWIAGPVLLQATGQRGYALLERSFERLAEARVSIGLHGPADAHRLWHGWEATPVSKEDPIDRGVVSGMMLSQAMIEGDPHPVAVKLSAMAAFRSRFSALIYLRALGWMAGAGTPKAWSRTKPGPRVTVTVPIGDLHRALGTDSLAMVGDWNAKCFGPGGRGGPVHEDLATAGIRLKTEWLTGAAGYGTRQVPTGLRITVSTIAGAERRPLPRRPRQSSSSSISASSRP

SEQ ID NO: 3257 - protein, 183 aa, Methylobacterium sp.
MARSGGGLAECLPASRFPAAAVSLEFVGGHVSGADRADFEMLAFCDRQCQQIPELVGRPEQAPALISASRLGNALRQFGCADLRNGDPGPVGEVPPEAYFLQASADLGDARQCSPNPNRPIVSVARAAVPVLDQPADLRQDLTAAGPTAALAAGFWASINRRVETLEALRRLPRGIRYFLNIF

SEQ ID NO: 3258 - protein, 284 aa, Methylobacterium sp.
MKKRPPPARPDSPARRAWELSPEFRAIALETLRRVNARMHLIPRCGAKARSTGQPCKRIPAPGRKRCLFHGGATPRGDGPAGWHTPGFPDGLPPRKARSASFKQKRRRELQERRDALTPGQQAQLEEWRRTHEAGSTSKRARRRTDREAARWLRDLMERPQRPPEPAAAACEPMTANQTEHDDMSKPHIDSEGRAELTKRLHAEGASIGLDTLMLIARDGNFAAGARVLAARELVKLSGISGADQDDEKSPDQMSRAELEAAARSIRAKLAELDQGDRPLSVFD

SEQ ID NO: 3259 - protein, 134 aa, Methylobacterium sp.
MKKLAPALLSLLLSSAALAQPAPIFAIPISGQLTNGAPAAGQATGYNTGVGEFWVAFPGSIRCSGTWSVRDPNPTIIIPVTCGPRVHGEAIVTRQAGFMTGLAIVALSNGKRGQFVFGDLTYETAFGQGRVRTR

SEQ ID NO: 3260 - protein, 59 aa, Methylobacterium sp.
VTAHATRLGEKLRCEELATDHLTDFSHISEQDRAFFEDAFVSRVKRRMCIRIVRFCCST

SEQ ID NO: 3261 - protein, 422 aa, Methylobacterium sp.
MEANRFLPVLIKMFPKTDSTKRSYYSGALAYAWEQKTPTSQLNTFIKSNGGVQKTYRAYTQVQKQRQASSQSVSLGAPLPMLDSLHHTLQLMLGLTYSAKIAVANVKGKNVKQTKSRHFIIRNATSSDGRICGIVETAIAEYTAPAARMTFDDALPELHGIAYVLTDTQVETFGRLYVHHKPWTITADSNEIVFRAANGSEIKGAALSAQHQGLRVLDRLRDPSERMTATAAQMAGFEVWYKKVTGNTKAQYRRLLDRALTSENVQERLHATRFTTHANPFAAPFIPRALDFNVHADHVTVGFNRSRLRFDTIWLRNEVHDMFSTTKAVDVLLERRLLLGHALKLFGRLKVNADMAEMAMFYLASTDEAQGAFVCELPLDAGEFIVAYPTVLNAEMQQRCILDDLDIAKLANTGLMIPAQPQ

SEQ ID NO: 3262 - protein, 113 aa, Methylobacterium sp.
MSTDIRLIDEDMALESIGRLAQGKLSLEVIGVLAGEIARWVEDHPDLPIVAVSVRSGGRLQKLWLLFSAVEAQREDVRRSNDGLMLFKVTWDVSERGVRWHVPSDARTVLYTH

SEQ ID NO: 3263 - protein, 46 aa, Methylobacterium sp.
KLPQTLSQSNAHWTGDGVSDSKIGEPFFSFDIFMRLSLESSILVLA

SEQ ID NO: 3264 - protein, 98 aa, Methylobacterium sp.
LICAAGIQSRPVASIHIASTRSRRGSSIRLETVPSGAIRRMRCVSVSLTKRVPSAAIAVPPVDGVTALRSTAPDRVSGAVPGASRSRVGTRESGPEQG

SEQ ID NO: 3265 - protein, 51 aa, Methylobacterium sp.
MIIRLLSAALVAGFLASVVATGLQLTLTSPLILQAETYEGEGAHAALPPSP

SEQ ID NO: 3266 - protein, 36 aa, Methylobacterium sp.
MGQRPAIARMTGLSGAGQSTIAALFRLSAHAPGRPT

SEQ ID NO: 3267 - protein, 179 aa, Methylobacterium sp.
MKSFALAATALATLILAPATAEAREFGGHGGYVGGGRHQGGYGHHGYGARFGQAGRFGGYRGGFAGHRGGFGHRGYGHHGFGYRGYAARGVYGRGYGYGRGAGIGLAGAGIGLAGAGLGLGLGLAGGALSGGYGWGGYGGYAAPAYGYAAPAYGYGYAPVTYGNAPIYNTGYGAGCVCE

SEQ ID NO: 3268 - protein, 34 aa, Methylobacterium sp.
MKDIERNRRDPPSINDDIALATWLPEKDCVTGVL

SEQ ID NO: 3269 - protein, 170 aa, Methylobacterium sp.
MADPILAEEGRQCEVDEYDAYLYGAARLYAEQIVNYLSAELGGEKLAYRNGAQSFLASMIVRYWDGFLRPAQDREGRPHVGLVGGGDRMLDVSAHFLVCAVAALTEGRCDSHTGRCLRDFLTKALELWHQRYPGAVPRPIYGRLAFDGIESAAPDWSQRGQTVGLRASWV

SEQ ID NO: 3270 - protein, 271 aa, Methylobacterium sp.
VSCFDDDMERIRSRIRQYIDERAREEAVPLLHRLIASYPGTLAQRVALARGVSMAMQGRAEAGGALVELGGLDFIRGLAEAGAPSPALRSAIETALLIWYRQLPAFIAANGGRASFASWCRQAGFSIPETLPETLTIYRGTMGCSPAAAATGLHWTDTFEKACFYACRFADEHLTGVIVLKAEVQRSELVAFLEAVGEHEVIPADVPARFEIVADHELILSAGHRALLRYRDQIAQGYPFIATRGIAEQAAMATRGRMTEAGIAPGTAIVA

SEQ ID NO: 3271 - protein, 330 aa, Methylobacterium sp.
MTEPNDPPCFRYAIPSFLGFLERSTAAIDPRQFSFDQISAIDELMLLSKPGRSFQFSEGQRQIIRHFAHRAFEAGRLLELAGCGIDVLERGLQGVVGLGDALTLPEEERDGPSQRQRERTFMRAVKRLRHALYAAQIAIDEEHAGADVDLPPLGDLRQLAGPTATVLPFRLETREAVKRREARQAEEEAALWKRAVAYFWAAHNLDDPATPYAAGMRLLSEGLAAGFRLSAPDRITIAIAMLSAQWAVHRVFVPTYLSESTFSVVRARTHHILDALEADDAERSIWQPEWVAGLCADVCRQANAIADAAHDRTYQRAELSVHRYITQQAG

SEQ ID NO: 3272 - protein, 82 aa, Methylobacterium sp.
MKAVDPAAAYADRFYGRQAQFSSVALMSEGFNAASEDATVFAYIDATNEDLKTPCFTFEAADITAQQAMRLLGCWQQIIREK

SEQ ID NO: 3273 - protein, 362 aa, Methylobacterium sp.
MAAGRPTQSIIMVGLRGVGKTVLLNRFEEMATESGCRVSLVEAHEGKGLPELLAPHLRSILYSLSHVQNAKDLARRGLRGLKGFLNGLRVNISDIDFGLSIDAEEGLADSGNIEADFPELIVAVAQAAKAASKPVALLIDELQYLSEKEFSALIMGVHKVNQKNLPLIVIGAGLPQIRALAGNSKSYAERLFRFPDIGALKTLDAVEAIQQPAMSEGARFDDRAIAHILAITERYPYFLQQWGYVAWNISQTNVITEETARRADALAIAELDKSFFQMRFERCTPSEKRYMRALAEFGAGKQRSGEIADLLGVKVQSVAPTRSALIKKGMIYSPAHGDTEFTVPLFDQYMRRAIPIFGAGRV

SEQ ID NO: 3274 - protein, 921 aa, Methylobacterium sp.
LAGGTPELEAERHVWADAFVAEAVRRGLGAVAVTDHHDIAFLPYIIAAAGRIGAYAKLTVFPGIEITCSDNVQCLAIFEPGTEPADWRRLLSRLDAVTETALDAPKTDQIRHCGLTVEALFSIVAADESLSTRMMLVPHFSKEGAHKSLNAEGFAPRFAELPCDGVYIECPHGDLDAGTLDKVQGRTEEWGRRRRAILATGDNRNASWERLGVHDCWARLGEPTVEALRQAFLADGARITHVPPQLPANRVVKIEIRSSITGPDTLVILVNEGFTALIGGRGSGKSAALEFLRFGLGKSELDIGQEEAPGRKARARERTLIEETLLGGWVAVELDRGGLRERWLRTGDAPATIAVGTVAGDEIITVADAQRRFPARAFHQKELSTTMVDPVAAAEHITGIAAAEVIEERRRLDAEITAVKRDVTSSLQDVAAHWQAELELQRARGHSADIRRRLDAVRNRMEQGGVREADFDIIREAPRYARAQNYLDDVEKRIVDDDERIRLSLESILIVDRNRHAEALAFPPIAALDARVGTVRADVVARLHGILQELRNLTATHAGERDAFNALREAFEVDYAAAKERQAAHGALIKEAEALAKQAAEAESQVSKCVDRFNLTRAAPAGLLDARERLQALVEGRRSLLARASDGVAIKSGGTLLARVSRDRKPVECVQSLCTWMEGSMIRQSDRACSDWVADTCREGGGGWSNLCDAVLGVYRAKIMAGSPQEPGPDAIATLNDLVFGGVGITDNQAGRLYTRLTDQTVEVMLSAVPRDSIALTYVSGRQKIAFSRASPGQQASALLELLLRQEAGTLIIDQPEDDLDNRVIMRIVEGIRMSKSARQIIFATHNANLVVNGDADKVVTMVSTIAEDRQPEGIVHVRVEVDGAIETPDVRRAVTRIMEGGLEAFDLRARKYGVEGAQRA

SEQ ID NO: 3275 - protein, 30 aa, Methylobacterium sp.
LQRDALTKAGCERIFEKKSGKGQEQAPTKE

SEQ ID NO: 3276 - protein, 54 aa, Methylobacterium sp.
MKLRLTLVAENASLEHVAERTISLGESEDSETPYAYSNVQTDRAESVSRFMPSV

SEQ ID NO: 3277 - protein, 102 aa, Methylobacterium sp.
VRPATRPEVAGHLHAAYDVSERWACQATGFGRSSHRYRSHWDPQVALRMRLKEGAAARVRCGCRRLHILLQREGWKVTHKRTDRIYREEGLSIRPKRRSTHW

SEQ ID NO: 3278 - protein, 54 aa, Methylobacterium sp.
VIAPGQFVVESDIKKVQHLTGGRALRVREGARVQAGDVLIRLDETQTRASSTSS

SEQ ID NO: 3279 - protein, 65 aa, Methylobacterium sp.
MGRPPLKLELTSVRLSEGAKERITALVGTYGMAQFIREAVDTALAAEEKRRGVQQPAPLKPESDA

SEQ ID NO: 3280 - protein, 155 aa, Methylobacterium sp.
MSNFFIAVPAKAPTAIFGVGTTEAAAIADAVSWGDPSDKDAAEVWQALPATETLYNLVLNEGTPKSWGSITVGAQELRCTVDEEEAVEIAADILKAVGESVDGGSDLSGWNGEEAIDAYAEGSSWADDVESRPALRKAVAAAIDAELATWRAQAA

SEQ ID NO: 3281 - protein, 180 aa, Methylobacterium sp.
MLFCTPAPGLSHAGILACCTLTALRDDELHDLLGGHVPVETTPEPTYLELTAEEQARGWLQRAEQRVLEIKRRGGTSAEIVSARQQVDLAHLRVTFARAVEAVGPLDADRTLEFDWNDYSRYEVRDEDDGVLFHVPRTLRPQDIHWALAIHDRAFFQGLAKGREQVRRPILTALGLIDGE

SEQ ID NO: 3282 - protein, 69 aa, Methylobacterium sp.
MARRKNYNPKLITHDGLTMTALEWAEHIGISRSRLYNRLKAWPIADALSRDKQTGRNKLEGPRIPVSAH

SEQ ID NO: 3283 - protein, 69 aa, Methylobacterium sp.
MRACHTDDTRKHDSVTAHVRGSNERRAEASRLTEKEVKAILRSRRRIKDLARAFGVSTETMALVRSGNL

SEQ ID NO: 3284 - protein, 111 aa, Methylobacterium sp.
MTRHCDDYIDDPAQPECLRRFLDYSRLPAALKYPTRDEAFNQGMEEHLGHPMWRDPVPVLFARHEGRPVRVTMASRFGDIGITEDLDADRGYDRRVAVEELADFSASLPAI

SEQ ID NO: 3285 - protein, 133 aa, Methylobacterium sp.
MSEPMDEAALKAALRENIARYLASPEGREAVLRHLGEAVSEADRRRIIYGDAASLEIEFVEVDANEAVRSGIEFDETGKPIAYWLEPSPDASRFARGMAAYARCQDACQERAAGEPECRDSCRRAEAAMRRKG

SEQ ID NO: 3286 - protein, 96 aa, Methylobacterium sp.
MALTDSQLDALRSLKAAGGEGAIDRHGGVLAAGERLPFLADTWLRLVTLGLVAGAGPLRIRLTAAGEEAALPKGRRFDPRLLITDNAPKPAHPGAE

SEQ ID NO: 3287 - protein, 95 aa, Methylobacterium sp.
MAKYTRFYLTKWKDEGDSVVCRLMEREGSDDGTDAIVAEFSMHPAPLGERLAVDALATANAYAEAGSIKLTPGMVVELPAGTEIKRVDVSEAKTA

SEQ ID NO: 3288 - protein, 149 aa, Methylobacterium sp.
MRLRPLTPAEIRAIEEHRRQVWEILSREKAGGRFVHTDLRMAPFLDRWELRESPTVPGAICLSGIAYGHPGREDGPIVTPPIRHRADTWMETDDGVLYLLGRMAEPERPPILDGRRGRGRSLLYGLPPVKPDFGPGIPGADDDLPPLEP

SEQ ID NO: 3289 - protein, 57 aa, Methylobacterium sp.
MTAADRSTLLAIAALLKTPSTIKGPTRRYGEDELKAAVFGAGARLASSTFTNPIGRA

SEQ ID NO: 3290 - protein, 125 aa, Methylobacterium sp.
VIRAAAILLLGALAATPAAAACRTVPELVEVIRAPLPPQAFVGELSALVVPTVLAWLESEGLPHRADRIVQVAGDRGLALVLISGELACAGAPIALQIFGTKAVELARLVRRFRELKGYGPELPA

SEQ ID NO: 3291 - protein, 119 aa, Methylobacterium sp.
VTSGEILTVILSVTLPLLAIGTVIWRQASTQSELRASIRSVDEKAGSASEGVKRVESSVATMRDELHREYVRQDSQREMEARISKRMDDVEHTVRNTATTIIAALSGTEPLPRRRRPTP

SEQ ID NO: 3292 - protein, 179 aa, Methylobacterium sp.
MSALDILAALGPIAFLAVFLLTPWGSALAGFLLGTRVGRWISLAGLLVYAGLVAYAAAYRSGRRAGTAGALKDVAQANAAAVARHQRIEAKVSTAKTDTLRDELKRWAPMLLVGLMLGGCASVPTGGPGRGGAWCDIERPIRLSPERVDAMTDAEVKAAVAHNRHGAAECEWKPGEKQS

SEQ ID NO: 3293 - protein, 92 aa, Methylobacterium sp.
MRPGLALSLLAALVTAASLCNRSLRGHRRQAPPLPPSPVRRLLTAEEAVRLSGGRAVAESLIAADWRLSPEEAARIAMAWPAYTPLVSTRLQ

SEQ ID NO: 3294 - protein, 113 aa, Methylobacterium sp.
MEPAAAFAVNSPPLPLARRAPRGRHRRAATSIELRLCLVKAIARDIRDRALTAEDIRRMLGEAEASAIRREVGNLRAHRADRFGPERLQVYCEILDLDVFAVIAGHAARRLAA

SEQ ID NO: 3295 - protein, 118 aa, Methylobacterium sp.
VPQPAETSPATRKARRKAGARIRAQRWRDSRAAERAALQAAGAEAEALRTRLAVDGALVDALVDRHRQLRDETGERAPALPLGDVIRLARRALSPVLPEAEAAIRDRLGAALQAAPAA

SEQ ID NO: 3296 - protein, 33 aa, Methylobacterium sp.
MLRASRDETLPAALGDPSPVCFRFEETGTFTDC

SEQ ID NO: 3297 - protein, 106 aa, Methylobacterium sp.
MRTTHSRIPDAFGKGSTVVEHVFLDDVIEAWDAAMTRAGIDPTLPASVAALRDLLDKAGVLTLSTWGMVYKAEHARADLASALAAFGVDAPAESAIEAPPEDRVLH

SEQ ID NO: 3298 - protein, 41 aa, Methylobacterium sp.
VLRKPFALGDLRTAVERLLAGRPGRILPFRRTDDDGDGRAG

SEQ ID NO: 3299 - protein, 57 aa, Methylobacterium sp.
VIAIFERLLVPFERGTLSDDFGQSFDERLTFSVKDVAQCINCVGERLEVTHIWGDWM

SEQ ID NO: 3300 - protein, 206 aa, Methylobacterium sp.
MAFLQEADIRARARRRAGAAGISVPEALGRIARNRRPRYDIFLSQTIRDAEIVLGVYDMLTNAGYDVFCDWIEAPETDRSQVTPANAEFVRTTMGVSDTLLFLDTVNAAQSLWMCWELGWFDGRKGLVAVLPVLPEGERYYRSREFLGLYPYVELDEEGQLEVVRPVVTSPSGITLFEAPNSRTFESWRNDPRDFMRPRVVGGAGR

SEQ ID NO: 3301 - protein, 184 aa, Methylobacterium sp.
MCGDAAGRDYPCGRKAAFALSDKIGSGNVACDVVGKDRYGRSVAICRLGAEDLNGWLVAQGWGMAYRQYSKAYVSLEDEAKAAKRGIWAGPFTPPWDWRKGKREGDAPGAAAITPAPASPTTKAPAASAAGCQIKGNINRKGDQIYHVPGSRDYDKTVIDVGSGERMFCSEDEAKAAGWRAPRG

SEQ ID NO: 3302 - protein, 165 aa, Methylobacterium sp.
MPNFNEQVLRHWDDWEETTGDESGDPDAFVAWAMENRHLLPRPQDVRKLLRRQVTTALRQASRVDENGVTYRAKQCVTLFDGDLALKRWFDTDHGGTSNLRQKAVRQRRDAIANDVFRAMCDVEHMKTQFPKDPPLQFVLDFTDDYEEKKAAAQQSRDADDEDVA

SEQ ID NO: 3303 - protein, 87 aa, Methylobacterium sp.
MKWSIDVQAPYHLPDLEGYPITLPAVEADTKQDAASKAGEAVRAYRPALDQNARVTITGEDGSTSHDTPQTVDEFLEDEQNHPREGL

SEQ ID NO: 3304 - protein, 98 aa, Methylobacterium sp.
VSAIGGITNRIQQISGVATSIAAAVEEQGAATQEIVRNVSQAAVGTTEVTSNIAGVAQASEETGAAATQVLGAAAELSRQSEHLGAEVARFLSTVRTA

SEQ ID NO: 3305 - protein, 93 aa, Methylobacterium sp.
MPVFQIHQGGTGAILWTGAAANEIQAMDAMAHDAGYYDHSGLPENMRRGLKVEALSFDTDREQGSAGRAQGGRYGQFVMGTAISDRNLGRAAG

SEQ ID NO: 3306 - protein, 64 aa, Methylobacterium sp.
VRLSILTFIVFTLNGAIDSGRYDTLAIGEVREAIQAGTIFSFLKTKIGHDIDLSIFAADAGAEA

SEQ ID NO: 3307 - protein, 69 aa, Methylobacterium sp.
VDIDTGEAFYWGVDLWAGSLADCIEFRGQASLLLAHNGTGYDYRAIEKLYPGWCRPAKSRDTQVIAKVA

SEQ ID NO: 3308 - protein, 95 aa, Methylobacterium sp.
MSAPQSLTIPLAAELAARLATAAERSGLTAAELAARAIADHLDGVTAYGRLGEEMALVKDRLAELAGLVGEALVEPPPGAVAEICRYRAAKAPAA

SEQ ID NO: 3309 - protein, 193 aa, Methylobacterium sp.
MSSPSSRGSSSSVDARLRAAQKAERAATRRVQQASRARLTEILRLPLRERLTHLDDLALVGPDRVSLRRSLQAGLARPRRRWHPSRRLQALSRRLGVSALRQLLHPALLGLAGIAGVWLHMAWSNTPRVALSTQVLASNVVGPDGLVQSYAFPARSWVPMERLDAQTAQVRVWYTRQGYGHGAVWRSGLDLAR

SEQ ID NO: 3310 - protein, 157 aa, Methylobacterium sp.
MTVRAASLRHVMCRRFGFGKSRGIGTACIPLILTSQAVLAAGADFTRMRAFDAQYAYLDVPAGAPAQDWIAIEARRRGDGWRIEAVGSNPKLAASVRTCRKVFRGRTVGPGRIRATDPSGEFGTFELRREGAYARLVLLSIGDCARQGLYLIPTVQD

SEQ ID NO: 3311 - protein, 113 aa, Methylobacterium sp.
VRLSASAPLVTASVACGFPSPAKDHLERPLDLNELYRIGSPSVFLVRVAGESMTGWGLFPGDVAVVDKAKPPRNGCIVVACRNGDFTMKTYQRRGERVTLKAKIPPFRTSRFG

SEQ ID NO: 3312 - protein, 66 aa, Methylobacterium sp.
MSTVPVSQRSLTDLQRDLDHVKKMQDVVEADQANMPTGDFSFTRDLLAQGRQQLEEEMERKASGQP

SEQ ID NO: 3313 - protein, 27 aa, Methylobacterium sp.
MQMMLGLSMKLRMIETTLRHDGEWKER

SEQ ID NO: 3314 - protein, 57 aa, Methylobacterium sp.
MWFIFPRLASLGMSAMAQHYAISGLDEARAYLRHSVLGERLRTCTAAVNAVTGRTAH

SEQ ID NO: 3315 - protein, 37 aa, Methylobacterium sp.
MTLFGRADLADPTFKAALARYYDSAEDLRTLGLLGDV

SEQ ID NO: 3316 - protein, 93 aa, Methylobacterium sp.
MAYGGQLRFGFEGAVAFCDVAPAVEARFAVYLDAIADGEIVFAAGSKNGSFYMFPNAKLNWASGAPFRVVSPSTRDAQLRGLEFSIPYTYNVS

SEQ ID NO: 3317 - protein, 110 aa, Methylobacterium sp.
MGLATDLSLDAGSRLGMVGSFAHMGVQRAMADIRHEQRREANAVGEVVARLREARLGQVAATRRAVAAEARAARAEAEVAGAQGELDLLRDALRAEKRLTAALKETRGVA

SEQ ID NO: 3318 - protein, 270 aa, Methylobacterium sp.
MSFLARILASIAAAMRGAWSFLSDTFDEIVEPVTKRLPWVRNRARAAGRAIDRGVSAAADAAAVTAEVALKAPGVVGREIGSVIASALPSPAVTGRALAEGAVVSDAEIERLVGAAGDEDGFFERQRPPVHFGNFIQHAIEAYRDNGERGLARHVKTVSEPVAEWIRSLSRAELSAALTVSPDVLKRHAEATRQEELSPLIPAILPVKPARLVSDDEFAAIAAQMKRNRLHDRDGLDEMMKRGPGARPEPRFDAGQPPVYGRGYRPRPLH

SEQ ID NO: 3319 - protein, 177 aa, Methylobacterium sp.
VRVVLPAGSTVRLVDVWSGTRTSLHARLVTVRPFASQQHFLNPERTRWKAGFDLPIGEVVTTCRVREPTAGQLFLVTEDGLEPLTYAQAWDRVDPTGAEEGLAEMEHDARAAKAGLPRELTRFVGAHTLRNGVHPIGNSHYFSERCTARQAFWRRATRAEIEALGSGCVRAPVVPCM

SEQ ID NO: 3320 - protein, 108 aa, Methylobacterium sp.
VCREEFKVPAAVLRQHVAAGEGYAAISRRYDVGENAVRYRCRRLGLRELVNGKAPGEAALRMALSHSDIPLKQIARAFGIEAGTLTRACRAYGIPTDELGREQLRDAR

SEQ ID NO: 3321 - protein, 73 aa, Methylobacterium sp.
MARRPLHDEDVGRCLAAAVDLAGGQSAWAARHGMTQSYVAKLLLGRREVSPRVLSALGLRALPRAYEPTEPRP

SEQ ID NO: 3322 - protein, 163 aa, Methylobacterium sp.
VLSGFERAAVLAVFPTMPDPPASEPPPEEPSMPAPGQTNPKRLVPSDDGIRADHAANPSPRAPATKWGTSESAVFTHLRRLGLTRPRASVRLPAPVAPRSSPEDRSIGVHPLPGEPRLLGRLGVEDLAIAIELARRTGITPLDALTWVRADAGLAASDAERTA

SEQ ID NO: 3323 - protein, 93 aa, Methylobacterium sp.
MLRLLLATAVANAKADPAWRQCIRLIAGLVVLRVNSAIFIAAVVLQAIGAPALWPHDAPLMWAAVWAPAYVALSFLADAFGVDGMGDPDLDPR

SEQ ID NO: 3324 - protein, 157 aa, Methylobacterium sp.
MTDFEPPVVDPARRRIMEFHEEAQRCGQDYEPTAEELRLLMIEALPEAGGIHYWAQRLGCTPEDLQAVLDGEIEPAGDMLDILSMEPIPSRGVYADPLMDREARAIQRQRWSTAPTAATYVMGTPRRIERSAAIPDSVRNMFAIGVAAPRMKPNEEK

SEQ ID NO: 3325 - protein, 156 aa, Methylobacterium sp.
MAGATLPDFMSTVELNLNGAVQLTRLLAPAMCEARQGSIVNMASITSLKGLGGAVAYTASKAGMTGVTRALAVELAPFNVRVNAVCPGVIDTPMTWEHAEAQPDPAAHYAMLRARQPMNRLASARDCALAVLFLASPDSAFITGAALPVDGGRHAA

SEQ ID NO: 3326 - protein, 170 aa, Methylobacterium sp.
MSADPFERSLPLAAGRLVPLDFAYSHEIVRWRNDPTNAVWFTTSHTFTVEGHEAWLDKARASGTDFNWVIEDGAERPIGTIGLYNLDRPAGRVEIGRILIGDRGARRGGYARAAIAALLDLCRDVGIGEVYLYVLSNNRSAIQLYESLDFVVTEDGPTTVRMACLLGPSP

SEQ ID NO: 3327 - protein, 380 aa, Methylobacterium sp.
MTSDVIQLFTPTYRIDECLAEIRTCLEVGWTGLGFKTVEFENAWKAYTGLPHAHFLNSATAGLHLAVKILKERHGWEDGDEIISTPITFVSTNHAILYENLAVAFADVDATGCLDPVSVAARITSRTRAVMFVGLGGNVGQYEAIEALCRKHGLVLILDAAHMAGTRHRGVVPGRGADATIYSFQAVKNLPTADSGMLCFADADLDKIARQQSWLGIDKDTFSRTQSSGSYKWYYDVPSLGFKDHGNSIMAAIGLVQLRYIDTDNAYRRQLAKWYDDVLSSIDAIDRVPVDSACESSRHLYQIRVRRRDEVLLALNNAGIFPGVHYRDNTQFTMYADNPHPCPKAREFSDEVISLPLHLRMSHADVVRIGEQLNAIVSHA

SEQ ID NO: 3328 - protein, 35 aa, Methylobacterium sp.
HLAQKPYLRADHFSGGGSGSPFDYRLPIEDVQRVA

SEQ ID NO: 3329 - protein, 99 aa, Methylobacterium sp.
VEAEPVFLAPDRNGRRQVRVVGVEGIFLAAVAIERRRARVRLGSGLRCRLRGCVGVRGVVTVLSPHRAMGYTAPIGRWPLVEVPLGGFHIHAAGAVENK

SEQ ID NO: 3330 - protein, 47 aa, Methylobacterium sp.
MTEAIEHLKNWCTDQHKLLSKNLDLKERGLLHTSEGHVGGGVVDTTP

SEQ ID NO: 3331 - protein, 82 aa, Methylobacterium sp.
MRTSTDTALPHVILATVALAAAYVSAGLGWPFIAVALFLPIGLGQAKRAVTLDLIAAGRWVYGRVRITAGRAAAALRRWWAR

SEQ ID NO: 3332 - protein, 61 aa, Methylobacterium sp.
MHQLIEVCDRLMRRVHHATAADSRVLGLPTRCYRAGMDHLALTVMALAAAFSGFVVLIGWR

SEQ ID NO: 3333 - protein, 61 aa, Methylobacterium sp.
MIRREPVQAPSPPPAPLDVVLAELARAGIRPTRSAILAVALDAGCGPEFAATIARRAEVAR

SEQ ID NO: 3334 - protein, 65 aa, Methylobacterium sp.
MSDGRRHIPCRISINTLRDCFGEENSDPLDLFESCQGEIEDAASRKFLGNNISNGLIELEEGDFD

SEQ ID NO: 3335 - protein, 53 aa, Methylobacterium sp.
MHIEAFRHVGLDLIEEGAEPDGAVTPGATANEATRLHVWHGEQVVGACPAVAG

SEQ ID NO: 3336 - protein, 78 aa, Methylobacterium sp.
VTEVDERCSTVLADFATEAEREATNSGMDIHEFQTALKGETITTLIPPGSHETLTAYGLRATSEILVQYLMDDLSVTP

SEQ ID NO: 3337 - protein, 130 aa, Methylobacterium sp.
VCNLYSLTKSQDEIRRAFRIDIDRTGNLPPLPGNFPNTSAPIVHVADGRCVLSMYRWGMPSPAFALEGKRVDPGVTNVRNTGSPHWRRWLRPEHRCLVSLSSFSEFNSRGQGGRLLGDPGPAAHLPLALV

SEQ ID NO: 3338 - protein, 93 aa, Methylobacterium sp.
MATGNNTSMPDLGKGAILIWLKEGLEPGKGQFGAKPDGVNPKPVSWSRFDLALSFAMHDPRTDERLPWIKTGGRVIRPTELRAMFGAAEGLLG

SEQ ID NO: 3339 - protein, 387 aa, Methylobacterium sp.
MVAHIGSEPRVAFSSETADEIPADGAREIAGRGMGITLDNHGGRVGTLRELPAVLWALGFEPDAIIGRDGLDPRLLDNGDNALPASSVGGLLEACVESTGCRYVGLLVGARARTSCFGIVGLLMQHLPTVSDALRCLISHGHLYHPGAVSILDATDGTAMLRYRFSPADAPGGGQIVDGALASGFRMMQALCGPDWTPVEVLLSHPGGGDEEAYRRVFDVPVRFGQEATALVFDAEWLSHPVPGADPGFRAILELQVDALEHLHDEALSSQLRRSLRTLLLRKGCSAGRTAQLFAMHRRTMSRRLKAEGHSFQHLVDEVRYDIARHLLGNASMPLAEVAAALGYSEASAFTRAFRRWSGLNPKAWRLGAVVRRGLPEPAVAPALPVV

SEQ ID NO: 3340 - protein, 34 aa, Methylobacterium sp.
MRKSSVFSDIVALVILGIALGGVGLYLLEKASLS

SEQ ID NO: 3341 - protein, 28 aa, Methylobacterium sp.
MDDAPHPRFGAINVTASNFITLLTSQTI

SEQ ID NO: 3342 - protein, 80 aa, Methylobacterium sp.
KGEAIPLSGRIVAVADVFDALTTQRPYKPAWSPEHARAFLQENAGSHFDPAVVTAFLSRWAQVEANLRLRTALHSVPVAA

SEQ ID NO: 3343 - protein, 34 aa, Methylobacterium sp.
MTVESDRSRLAALIDGKDRALLAAFLRDEGTDFA

SEQ ID NO: 3344 - protein, 109 aa, Methylobacterium sp.
NGDLSKKITVDVRGEILELKNTINTMVDQLNSFASEVTRVAREVGSEGKLGGQAQVRGVAGTWADLTDNVNLMAANLTGQVRNIADVTTAVANGDLSKKITVDVRGEIL

SEQ ID NO: 3345 - protein, 32 aa, Methylobacterium sp.
MSRNFGMKMLTMTNLSTECLIQLTKLGYDATP

SEQ ID NO: 3346 - protein, 57 aa, Methylobacterium sp.
GPVYGTGYEEARALLHAGNDPRWDFAPLKFLATVLSSISGIPGGLFAPSLAVGAGLG

SEQ ID NO: 3347 - protein, 50 aa, Methylobacterium sp.
PSGTITLDTTAPTLALTAAPPATVEASSAAGAAVSFAASAGDGVDPAPRV

SEQ ID NO: 3348 - protein, 297 aa, Methylobacterium sp.
MDDVIIVGGSFAGLAAALQLGRARRKVTVLDTGLPRNRFAGHSHGLLGHDHKPPLDILAEARRQLVRYPTIRPVNARADGVSGAIDDFSVLTGDGGSLAARRLILSYGVVDQMPDVPGFAESWGTSVVPCPYCDGFEVAGQHWGLVWSGPRSHSQAKLFGDWTEKLTVFADGHDLSPAIRADLARRNVPVVDGRIAGIVGRGGHNATVKLYTVPDTDVDILFAQPSIKPSASLHEILGLATVDTPFGIALKVDERRETSMPGIYAAGDLANPGMPSVTTASWQGAMAGVFAQQSMVV

SEQ ID NO: 3349 - protein, 302 aa, Methylobacterium sp.
MRFDAIVVGGSFAGLSAALYIARARRRVCVIDAGAPRNRFAAASHGFFAQDGENPLAMIAAARAQLAAYPNTTLVTGEAVSARAQGDGFAVSLAEGRRLEAAKLVLAFGISDILPDLPGLAERWGASVLHCPYCHGFEFAGRVLGVLYAGPKSVHQAELVAEWGPTTLFLSGNPAPDAESTARLAARKVRIEPGPVRALAGDGGALSAVVMADGRTVALDALFVGPRYRLNSPIAEGLGCAVDEGMLGPTIRTDAMKETTVPGVYAAGDAARFPHSVAWASADGVTAGVSLHQALVFPRLAA

SEQ ID NO: 3350 - protein, 185 aa, Methylobacterium sp.
MTATATKDIIQTFEKVFEPIDRERLHALSEKGRADPSVVKTVRARTIAEGRRFRHLNYIRNLDAHIVDEPPALLGDDTAPNPTEALLAALGTCVAVGLQANAIARGWTVKGIEVESEGDINITSVWGTGDLSEKPVGLTAVRLKVHLDIEGATATELDELVAHAGQWSPVLNTVKNPVAVTLARA

SEQ ID NO: 3351 - protein, 3587 aa, Methylobacterium sp.
MAVKLNLQDLTFILKQIKIAEAHASGIKLTELRLDAAGTPLVERGLYDATGNWLGDAAAPKAIPDPHVPYGLRTVDGTFNNIVPGRETWGSSGQPMPQNFDPTYLNDADGDTMALGPGAPVITNNNYGLSGSVADADPRIISNLVVDASLDNPAAIAAALRIAGSENVIADQRAITAAREALKAAKAADPAGDHTTLQANLDALLEQTGVTVTNGSIDVLNVSPDEGLSKPFNAWMTFFGQFFDHGLDLISKGGNGTVYVPFAADDPLVLGKDGVAGTADDLAPHLRFMTLTRATPVEGSQRNVTTPFVDQNQTYTSNASHQVFLREYALVDGRPIATGRLLGGADGGLATWADVKEQARTKLGIELTDADVSAVPQLLVDAYGEFVRGANGLPQVMVGIGPGGQAVYASGSLAEPLKLAAIQLPVGTVLLGPSNTQNVIDAGETVAAARTLNAFLDDIAHNAVPVVVNGVLRPDADALTGNAVPVGQTGRNLEYDNELLDRHFVTGDGRGNENIGLTAVHHIFHSEHNRQVDAQKLTILQSGDLAFINDWLATDIAALPANFAQMTPLAQLAYANTLSWDGERLFQAARFATEMQYQHLVFEEFARKIQPLVDPFVFNSVTEIDPSIFAEFANTVYRFGHSMLTENMPRIGADGQALDAGLGLIEAFLNPVAFDNDGRMSHDESAAAIMRGMTIERGSEIDEFVVGALRNNLLGLPLDLAAINIARGRDTGSPTLNEARAQLYAATGSTFLTPYTSWVEIAANLKNPLSVVNFIAAYGTHATIAAATTLDAKRDAAMALVFGGEGAPADRLDYLNSRGSWAGRETGFNAVDLWIGGLAEKQMPFGGMLGSTFNAIFEAQMENLQDADRFYYLTRVQGQNFLNELEQNSFSKIMLANSSLSLPGPDGIRGTADDIVPRHIGVDAFADYDFELEVNAANQLDQNGSAPGRDPTGNDPVLEAMGLGKVVRDDPGTTADEGASGFHASINALVRRYGADGTPAGALVDGSEDGIGAAGSPVTWADLKANAAKLGIALTQTDMLDAPMLRIGTDGRLAFAPGSSVPQAVTVANGSFEGLALVAGQEGVILDGNGNYTTTSPAGWTIAGGVGGLYAPSDTVIDPAGRDGANVVWLRGGATLSQEGGASLQAGVTYTYSFKVGDRTDFTWPGAEARLVAAGGTNPVTLGTLTLTEPADGQWGTFTLATGVVPAALAGLQLRLEIRNTGSGDAQILVDDVELVRTAPAYRSDLTPGQTPGYDPAADPFLRDAAGNVLRTGQSIASPAADIDATVIDPAALNQPFSTGHYLRFTGGEHVLVGGTDGNDTIITDFGDDGIWGDAGDDRIEAGAGVDLVNGGAGDDIITDSGDTGDFLKGEDGNDVIANSNGIDILMGGRGKDAIFVGVDATEVFAGEGDDFVIGGDDADLLMGNEGDDWIEGGGGFDTTAGDNSELFFNSTIKGHDVMFAGGDEHDFDGESGDDIMVQGESVMRNEGMFGFDWAIYKGNQIAANADMRIPIFTTEEADILRNRFDKTEGLSGWRLNDTLIGDDRTAAADADAEEPAGAPVNATNEGVFFNDGLDAAGIARISGLNQIVSLAPGQQFFEAGNILLGGAGSDTLQGNGGNDILDGDRWLNVRISIRNPADASQEMATVDSLKHIFDNSAANQARGWAGKSLFELMIDRAISPTQLTIVREVITTGATAADVDTAVFNDIRANYTVTRAANGTLTVAHTTLSDPAVDDGTDTLRNIEKLRFADGTVDVALVLNQPFDRLTITPLDADGDDSSTLVATLVNQVNANTRPVTLQWQVLGDNGQWRNVTGADGQLTNQGTRFTPTGATGLEIRVVANWTSTIAGSTSAQQTASVQTAFVGTAAAEDILGSASPNVILGRDGDDDIEGDVGNDAIYAGSGDDRVDGGEGDDILLGNDGADTLIGRTGNNTLDGGNDDDQLSGGHGNDRLIGGAGTDTAIFSGPIAAYSFERNAQAEVVVSDNLGAEGDGIDTLASIEQIQMGEDITPYALGANGTAAIDIVVGTTGNNTLSGGAGNDLVFAGAGNDNVLWRTGDGRDFVDGGTGTDSFRIMNGTDPVQQLTLAQARAQFANLSFRDDTQTVVVRNGIVIAELKNVEGVVVNSVATGAPVVTDPTPTNGLVSPTEGQPLSALVAAIQDADGLGTFALRWQQSGDNGQTWTDIAGTAAGTLNYTPGQAQVGDVLRLRVSFTDGAGNPEELFSSPTGVVGDTFNGTAFTRTFNGTAGDDIANGADTALFGIPPNDTMNGGGGNDILNGRGGNDTFNQVSTDGRDRVDGGTGTDTYQLNGVAGSELFRIYSRSAWLQVAGNTDAQLAASTEIVITRNGTGAGAIVAELDNLEEIRVNALQVTSPGGQNGGANGGDTIQVIGSFTGTSLNFNTITIDGSSGDDTVDMAALASAHRIVFRSNGGHDTIVGTLRPQDVIELPAGSNRADYVTTAGANGMTTLTNGSHTITFSAAGGMPRIAVEAGSDEGDGEGVTGAFAYTQGDIDGLEALVRGQRPANAGDDDVPTGYRELSGHGNNLDHATWGSADQAFIRLTQARYGEPDANGNRAINPIFNGLDARTISNILGTQEAGLPKAGNDANIFFMAMGQYIDHGLDFLPKGGNGSIVIGAPGGGAPGSNNPADLTRGTVMATDANGIPQHKNQTSPYIDQNQAYGSNAMVGQFLRESDGAQGVGMRLLAGAPDPSNPAFNLLPTLRELVNHHWQADTIFEGPNGPISFRTYYTNFALSEGVTGTLFNTETGAFDPQVLTKLVGDFMGSGHPLLLDTNPFISVLDHFVAGDGRANENFALTSIHTIWARNHNYHVEKLLESGFEGTPEQVFQAAKMVNEAEYQRVVFDEYLETLIGGLRSDGTHGFEAYDPSVDVAISHEFAAAVFRFGHSLIGQTLNVKGADGQTIPVSLFDAFLNPSNDPSVFTAPLPPGYVPQPGYAQYGVGGIIGGTIEQAAEDVDFNIVDAVRNDLVRIRADLFAFNVARGWDVGLGTLNQVRADLAASTNPYIRDAVGFAGGDLSPYTSWEDFQARNGLSDAVIAQFRQAYPDLVLAAADIAAFRAVNGDIAVAMQADGTGVVKGIDRLDLWVGGLAEKHINGGVVGQTFWVVLHEQFDRLQDGDRFYYLERFDNFDFYENFIDGQGFSDIVARNTGLTVLPEHIFEVSDEDGPGTEPGDDDDDDGATDPVGGGEDDEDDDGTTDPVGGGDEDDDDDDDDGVTDPVGGGDDSGDDDDDDDGQGDGDGTTDPVGGGDDGEDDGEDGPGTNPPVNHVPGVIAGGANGDVLNGTAGADTILGLDGDDNILADGGADVVRAGAGNDFVDAGGGRDVVFAGAGDDDVLAGGGADMVYGDGGNDRILAGAGNDLVTGGAGRDTVIGGEGDDLFVVEIGDGDDTYWGDEMGGGVGSDTLDMSAITANIAVNLGTGLAGRGSATSTQSGRDVLWGVENVVTGSGNDDITASDAVNVMDGGEGSDTYRFGSAAAADGDTIEGFRPGDKIDLSAVDANAGAAGNQAFTLATGAAFTGVGQLLVTQETRDDGDYVVVQGNTGGDASPEFKLSIKGNTAPTAADFAL

SEQ ID NO: 3352 - protein, 88 aa, Methylobacterium sp.
MKALTFALASTLLLTPAAFAAEGSGTSRSGTADRTGPNDAGSGASPGAAGSGPTSGDKSRSGTANSTGPNDAGSGASPGAQGKGHEAR

SEQ ID NO: 3353 - protein, 93 aa, Methylobacterium sp.
MSESMSDVSSNGRITWTQDGISEVPLQRFTGRVGAIEVATVEFDGSNRLWTWWSPLSEDIWGHAKDADGAKQAADVWLREWLENFRTFFEAGR

SEQ ID NO: 3354 - protein, 358 aa, Methylobacterium sp.
MAASARIVESAPPDVAGIVRERLRPRLAAIDAGEYPADILRALGATGAYGHHADGTAAGLLAAIDAMTEAGQACLSTAFCMWCQDALVWYLARGDEAGPRRHLAALASGAALGGTGLSNPMKAFSGIEPLALQGERAGSGYRVRGRLPWVSNLGPGHRLAGILALPDGRRVMGLFEAGTDAVSIAANARFVALEGTGTYTVMVRDAHLSEADVITHDAAAFVPRIRNGFVLLQTGMGLGLARGAAALMRADARGRTNAAFLPLGPEAIEARADALRARVAAAAEAHAATDRATFLETLRLRLDVSWLALEAAQSAMLQAGARGYLEGAEAFRRLREAQFVAIVTPSVKHITTELARGA

SEQ ID NO: 3355 - protein, 254 aa, Methylobacterium sp.
MFSDSMSRSVPRLALAAVAYRYGPTPVIDRVDLEIDAGERIGILGRSGVGKSTLLQIMAGLVAPSAGGVRLDGAPARGPVPGCTVMFQRPALLPWASVLDNVLLPARLSGRRDRAACEAPARRLLDDLGLAERADAKPHQLSGGQQQRVALARALASEPSILLLDEPFSALDPEMRASLRADVLRLARARDLTLIVVTHDLADVAALAARAVVLDGRPARIAADFALGDDAEADLRRRLGALPRPVSGVTGRAA

SEQ ID NO: 3356 - protein, 354 aa, Methylobacterium sp.
VSLFERYLTLWVALCIVAGIALGHVMPGFFHAVGSAEIARVNLPVAVLIWLMVIPMLLKIDFAALRGVGRHWRGIGVTLFINWAIKPFSMAALAWLFVGTLFRSSLPADQIDSYIAGLIILAAAPCTAMVFVWSNLTRGEPHFTLSQVALNDAIMVVAFAPIVGLLLGLSAITVPWGTLVLSVGLYIVIPVLIAQVLRRSLLASGPAALGRLLGRLGPVSLAALLATLVLLFGFQGEQILAQPAVIALLAVPILIQVYLNSGLAYLLNRVAGEPHCVAGPSALIGASNFFELAVAAAISLFGFHSGAALATVVGVLVEVPVMLSVVWIVNRSRGWYERGGARKDLSLDPASRQV

SEQ ID NO: 3357 - protein, 608 aa, Methylobacterium sp.
MRVASKSAKGLHAMNDATDDDWLELIPDEVAETPARAGAWTIAVIDDDPAVHEGTRYALAGYSLDGRGLDILSAHSAQEARALLAERRDVAIVLLDVVMETDDAGLRLVNYIRRELREETVRIILRTGQPGQAPERRVIVDYDINDYKAKTELTADKLFTSLTAALRAYQQLRRLDETRRGLEIIIDAAPMLLDHKSMQRLAEGVLTQVASLLNVDCAGILVLREDERDHKREGGFSVLAGSGLYGGYVGCDPGWPLDPGIQPLVEQAFAARRHSFGDGLSTLYVQTASGSEIVALIDTDRPLSDTDRALITLLAGRLSVAFDNVILYERLQRANVTLEQRVVERTAELIRANRRLDMQRSDLRRANSLKTEILGTIAHDLKNPLSVILGRSEMLTDLIGLDSGEPSGLEQARIAMRTQVDHIRTSATRLIDMIDSLMADAMNDALDITLRREPVDLASLAREVCEANRPLADSKGQSLTLDLAAPLHLCGDAERLREAFDNLVSNAIKYSYPGGAITVSVREEGGDYVCAVADQGPGLSPEDAGRLFGRYQRLSAKPTGGEGSTGLGLSIVKRIAELHGGCAEAFSDGPGRGAVFSMRFPKETVGLV

SEQ ID NO: 3358 - protein, 251 aa, Methylobacterium sp.
MTPTGPHIAVVDDEADARAMVGEYLRLHGFDVALCEGGRALRAHLQIRTPDLIVLDLNMPEEDGLSIVRDLKARSPIPIIMLTATASPIDRVVGLELGADDYLPKPCELRELVARVRSVLRRAQGTPPAPAPTTTPASAPAAAPETPSRTIRFGTKWLELDALRLRDDAGMEQPLTRSEFDLLKAFADHPKRALSRERLLDLADARDPDAFDRAIDVRINRIRKKVEPDPANPRYIRTVRGLGYIFRPEGD

SEQ ID NO: 3359 - protein, 763 aa, Methylobacterium sp.
MRVGRKIALVGGVPILVAAAIAAAGWFLLAQGERARAGALLAARVYHDLIQARSVRDDFVAARADERDAIATRFFDLTGRAGSGLETLQGQARTRRQAERAAAARQSLDRYVARMREFSAVAHENDGLIAEMGRRASRLTDLAEQARQRQQASNVDLAWTLTGKVNRLRATRDAVTGLNAVLAAAWQLALGRERGASPETERAARTRLVHAGRDVAAALRATSREIEAAEAERRTALDAALDSAAGDRLTEWGERLLKIVTSEQRTLDDEVAQLLAYAGEANATGQATQNIGITTLKLGQRTAEALVRRDAEAVSAMLGEGERLSASAAALPISPLIQSEMIEAIDGWRARLATTVDGLKRQNAMIAEMDGLAAGLSEAARALNDDALEDADRFGTFLGQLLLAGAAVGLLLGALVALAVARSILVPLRQLQGDMIALAADPKAEGLSGTQRTDELGDIARATNFFVTEIGRRERALRQAKDQADHALHDLHQAQDDLIRAEKLASLGQLVAGVAHEINTPLGIALTTATLVRDETRTFQGLVTAGTLSRSRLTHFVDRVGEGTQLLCANLTRAADLVHGFKQVAVDRASDERRRFDLDVWLGELLASLQPMLRKGGHRIERDVPSGIVVDTYPGVLAQIVTNLVANAVVHGFAAARRPGTITVRVSNTGSLVRLEVSDDGSGIAPEHLGRIFDPFFTTARSRGSTGLGMHIVHNLVTAKLQGRITVESELGRGTRARLEFPRAPGDAERPGAARRPAGVQAP

SEQ ID NO: 3360 - protein, 285 aa, Methylobacterium sp.
VSGGAIEAALAVEREVAAPAPRRTGIRLGSSGQALDRLAPLVGLAGLLALWFAGGLVLESVPAYAAFAGFAPGPALASFWDLIASGEAWRAAAPSLARIGQGLAVAFLLGAPLGLLVGSAPLAERILQPPFQLLRMISPLAWMPVAVLAFPSWDGAIVFLIAAAAIWPILFATAAGVKRVDPVWLAMARNLGAGRLAALRAVIVPAVLQDILTGLRLALGVAWIVLVPAEYLGVTSGLGYAINDARDTLSYDRLAALVLLIGLLGYALDSLLGRLAARARWIPAT

SEQ ID NO: 3361 - protein, 408 aa, Methylobacterium sp.
MSAPDDLSALWTHEWTRADWTRRNTLDALARGGLAALLGGGGLALSGRAVHAAEDDTVRIGYLPITDATALLVAHAKGFFEEAGLKVAEPTPVRSWSALVEGFAAGKFNLAHLLKPIPVWMRYNNKFPVKVLAWAHTNGSGIVVGGKSGIEDFKGLAGKRVAVPYWYSMHNVVLQYALRESGVVPVIRGDAGPNECALQILAPPEMPAALAAGKIDGYIVAEPFNALGELRAGARMMRFTGDIWKNHPCCVVVAHESQIAARPEWAGKAVDAIVRAQAYCVKNREEVARLISKEGRGYLPMPADVVIKATTDYGPAYEASGAIRHPDWAAQRIDFQPWPYPSATKLIVEAMGNTVVEGDAGFLKGLDPDFVARDLVDDRFVRASLRRYPEWPGAADDAALTRQETLSL

SEQ ID NO: 3362 - protein, 113 aa, Methylobacterium sp.
MLNDAQWGALEPLVHACRPKAKTPSQDLQRTLSAILWRHQNGAKWRAIPDEFGPWWRAAQIFIRWARAGVWERLLALVQERGVQLGMVFLDGTNMRAHQKAAGAAKRGGSATE

SEQ ID NO: 3363 - protein, 125 aa, Methylobacterium sp.
MLLDAQWGELEPLIEACRPMAKTPSQELRRTISAILWRHQNGAKWRAIPEDLGPWCQAAQIFIRWARAGVWERLLDRMQERGVALGMVFLDGSNVRGHQKAAGAAKRMARSVRKCLWMPWTEQSA

SEQ ID NO: 3364 - protein, 1930 aa, Methylobacterium sp.
LEPKLLLKSLRAFRKGDFSTRLPLDLTGIEGEIAQAFNDIVELNQGLARELDRVARAVGKDGRIGERGKLPTATGGWNECVESVNTMIGDLVQPTTEVARVIGAVAKGDLGQTMQIEIEGRPLRGEFLRIGKVVNTMVDQLNSFASEVTRVAREVGSEGKLGGQAQVKGVGGTWKDLTDNVNLMAANLTGQVRNIAEVTTAVANGDLSKKITVDVKGEILDLKSTINTMVDQLNSFASEVTRVAKEVGSEGKLGGQAQVKGVGGVWKDLTDNVNMMAENLTGQVRNIAEVTTAVARGDLSKKITVDVKGEILALKLTINTMVDQLNSFASEVTRVAREVGTEGKLGGQAQVEGVGGTWKDLTDNVNMMAANLTGQVRNIAEVTTAVANGDLSKKITVDVRGEILELKNTINTMVDQLNSFASEVTRVAREVGSEGKLGGQAQVRGVAGTWADLTDNVNLMAANLTGQVRNIADVTTAVANGDLSKKITVDVRGEILELKNTINTMVDQLNSFASEVTRVAKEVGSEGKLGGQARVEGVAGTWADLTDNVNLMAANLTGQVRNIADVTTAVANGDLSKKITVDVKGEILELKSTINTMVDQLNSFASEVTRVAREVGTEGKLGGQAQVKGVGGVWKGLTDNVNMMAANLTGQVRNIAEVTTAVANGDLSKKITVAVEGEILELKSTINTMVDQLNSFASEVVRVAREVGIEGKLGGQAQVRGVGGTWKDLTDNVNMMAANLTGQVRNIADVTTAVANGDLSKKITVDVKGEILELKSTINTMVDQLNSFASEVTRVAREVGSEGKLGGQAQVRGVGGTWKDLTDNVNMMAANLTGQVRGIADVVTAVAQGDLKRKLSVDAKGEIAALADTVNEMIETLATFADQVTNVAREVGVEGKLGGQARVPGAAGLWRDLTDNVNQLAANLTTQVRAIAEVATAVTKGDLARSISVEASGEVASLKDNINEMIRNLRDTTLKNAEQDWLKTNLAKFTRMLQGERDLATVSNLILSEIASLVSAQRGVFYMVEDEGGEPVLDLMASYAFTERKNLSNRYRLRQGLVGQCAFEKKRILLTHVPGDYITIGSALGEAPPLNIIVLPVLFEQEVRAVIELASFNRFSETHQSFLDQLTESIGIVLNTIAANMRTEGLLKQSQLLTGELQSRQEELKKTNDRLELQAASLQQSEDLLKNQRERLQQTNEELEEKARLLEIQKREVEGKNREVSIAKTALEEKAEQLSLTSRYKSQFLANMSHELRTPLNSLLILSKLLSENRDGNLTDKQREFAKTINAAGTDLLSLINDILDLSKIESGTVSLEIGDVTLQDISENLNRTFRQLAEERHLAFVIEVDPGLPRSLRTDSKRLQQVLRNLLSNAFKFTEKGSVSLKIGSAEGSPLRAGTQWIAMSVTDTGIGIAEDKQRIIFEAFQQADGTTSRKYGGTGLGLAISREIARLLGGEIVVESRVGTGSTFTLFLPFEPPAQALTGRAVEASDGYAPSAPMGRQPNTAMALSSSADDRHAIHPNDHIVLIVEDDAMFASVLLELARERGFKGLIAQDGAGALSLAHRFKPHAITLDIGLPDMDGWALLDLLKNDPRTRHIPIHVISVNDEKKRGLRAGAFGFLEKPVEREGLMRALERSKEFITRPVRNLLLVEDDENQRASITALLSEEDVKIFGVGTASAALEALTGGRFDCAIIDLGLPDIGGSELIEQIRASQDGEELPIIVYTGRELTAAEEQQLRQTASTIILKDTRSSERLLDETALFLHRAINRLPVEEQILVERKDAVSLQGCRVILVDDDLRNIFSLTSALEQHGLEVLFAENGQDGIALLKSNPNVDAMLIDIMMPGMDGYETMRAIRAEAGFHSLPLIAVTAKAMKGDREKCLEAGASDYVSKPIDMDQLLAVLRVQLARRSEVAHGPAPMISDATTLNRQPQ

SEQ ID NO: 3365 - protein, 553 aa, Methylobacterium sp.
VGGAGAFGARLVAGLATTTDLAVIVAGRDRARAEAVARTVPEGRGRAARLDATRVEAADLRALGAAIVVDAAGPFQGGAPTLARAAIEAGLPYLDLADGRDFVAAFPALNPLARANGVVALTGASSTPALSNAALDALTDGWRSIETVRVAIVPGNRAPRGLSVMRAILSYAGRPVRILQAGRWQNRPGWGLLRRITVPGLGRRFASLCETPDLDILPARFPRLRTALFRAGLELPVLHLGLSLASLPVRWRLLPSLVPFARPFLVIAGWLDRFGSDRGGMSVEVLGRDATGRPTRAVWSLVAEGGDGPSVPTLPALAAIRRLTDPFAAPIPAGAYPCVGVLPLAAIEAEMGRLAIRTRRDVDHPVLLIERALGAGFVQMPEAVRALHGSVGDGAFRGRAEVRRGSGLVVALVALLFRLPPAMADGPIRVTMEPDFEAGAERWTRWFPGRRFSSRMQSVGLDGSGRVREHFGPFAMDLAVSSQADGLDMAVTGWRLGPLPLPRALRPTTRASERVDAEGRFRFDVALFLPLVGLLVHYRGWLVRCDGREEETP

SEQ ID NO: 3366 - protein, 419 aa, Methylobacterium sp.
MLDLTTLQVASISSRLAFVMVFLVTLLRHPREIYFGVWASALCSSLVASFLMLGDPPSVPLNAAKGSVVYILYGASLALSWVGLRLFYERTPRIPLTFVLILASGLPYGVLQQAGASMPWSLTTVFGCIALSTALCILEILRTPASMRLWTQYVVLLGFSGYLCTFLLSIGAVHFASERLASPESGIYPLVFDLWCGVFIQVGYLAMVGERANLKISRLAETDPLTGLANRRGLFAAINRRASPASPPPRCAILLADIDHFKSLNDTYGHDGGDAVLIGFAERLRNVVRKNDIIARWGGEEFLIVLDQATDDVDPAVAAAERLRRAVAGQPFTVNGAAVTVTASIGVSIVAAGEVGIEPALARADAALYAAKRDGRNRVCLERPLSQPDIKAARTEPLSGLRGAMDAIQIAGQPRSEPA

SEQ ID NO: 3367 - protein, 595 aa, Methylobacterium sp.
MSLSSPRRADAVRRVLAFVVRGWRERLGLVGALVAAITLATLADVMLPLYAGRLVDALAGAERHAALQAALPAFAVMTVLSLGTVLLRHIAWSLVVPLTLGTMSDIASRSFARVQRFSTEWHANTFSGSTVRKISRGMWALDGLNDVLLLSILPSVVVLAGTTVVLGLHWPAMGAVIGIGALAYVGTAVILATRVIAPAATLSNALDTRLGGALSDTIGNNAVVKAFGAEAREDDRLARVLSQWRRRTRRTWMIVTWSGTAQLGLLLAFRTAIVATALWLWWQGQASPGEVAYVLTTYFVVHGYLRDIGGHINHLQRSVNEMEELVALESEPVGVADRPGAVPLAVEGGAIRFEAVRFHYGTHGTPLYDGLSVTIPAGQRVGLVGRSGSGKTTFVKLIQRLYDVSGGHVRIDGQDVAGATQASLRAQVAIVPQEPVLFHRSLAENIAYGRPGASAEAIERAARLANAHDFIARLPKGYATPVGERGVKLSGGERQRVALARAFLADAPILILDEATSSLDSESEALVQEAMERLMHGRTAIVIAHRLSTVRALDRILVFERGRIVEDGPHAALMRRPDGAYRALFERQSVLAESA

SEQ ID NO: 3368 - protein, 466 aa, Methylobacterium sp.
VRTRSAEIDARSLREAAPRPEKPDTGEPDRRLPFTSSPDLRRATVERHLRTLRATSPIAAAEAGRELAKYDYDTIFRSFLDGTGLDPADAGDVLTAFVVLQWMVANDATVEPSPAALQAIRRRFVMPMAAKPPLSQPVSRAAFAEQVKLRSVLHHAGWKAARQLGVMPRFLATLSNEFIPATKLQALALTEDGLVPKTRPAGARLLREPSDPPPPTASTDVAPPANPRTVTPPSAGAMADAAAPPRHTANWDAVEGVYFRSTTGVGVGGMVTIDFEPLIFLQDGTFFEIGDTALEDIDLAAERTAKPRRFGRWTRKDQGFLLTDWRGNANSYKLGDGSFFRAFPAVADERVTRSYRRLSGGGNSAMGGDVTVAVESRYDFKADGRYGRGGSVGAINSGASTGVGSSISRRRAPEGGRYRLDRHTLILTGADGRSRRLFFAYSAQKDPPEIDRDMIFVGDSVFSSDD

SEQ ID NO: 3369 - protein, 222 aa, Methylobacterium sp.
MAARRVFSLAAALCLLGASAPCQAAEPAADTAPAGGLTAGSLLVRGRVIGSIPVGQYSRIEPIGGRVITPARALPDLDVTYFLSDHFAVAAQAGVVSTRTSIRGSFIGDLPIGSTWSFSMTGAVQFHFLPGNAFNPYLGAGAGYTHPIAYEPAKPFVTKMKADPQLGPMLQAGFDYHLVGNWYANMEIKKIFLPAQVSRIGAGSTTVRLDMLIIGAGVGYRF

SEQ ID NO: 3370 - protein, 457 aa, Methylobacterium sp.
MSTHSAPIPITSPDASSPSLGGSGEDGAVSPIAWQRYAIAGYALIAATFGVAGAWAATVRLDRAVISTGVIVAESSRKVVQHFEGGMVQAVLVRDGQTVRAGDVLLRIDPVQSQASADLFRNQLDAALVLEARLRAEQAQSDDLHLPADISARRDEPALARMIGDQAGQLVERRTTLKGQLALIEAKVTQLRTEISGLAVEKSSVEQQVGFIRQELEGLRSLHERNLIPLSRLLVMERERTRLEGVIGRSVAERAKAENAISEAGLQITQLKQKLQETVTGQLLETRQRIGELREKLVVAQDVFRRHEIRASHDGVIQALKVVATGQVVRSGEPLMEIVPTADRLVVNVQFSPNDLEAVHAGMRAEIKFPTFQARRTPAVFGTLTVVSRDRLVDEGTKQAYFAGTVEIDEHQLPADVRHRLLAGLPAEVVVSAGERTALEYLFAPFFDAMGRAFHER

SEQ ID NO: 3371 - protein, 98 aa, Methylobacterium sp.
LYVHQQRLGSEEVQELRREGGRFLKELREKRGLSQRQLAAQVGAEYYTFISQLETGRGRVPPDRYKIWAEALGVDAKDFVKSLMRFYDPLTFEILFGD

SEQ ID NO: 3372 - protein, 290 aa, Methylobacterium sp.
MISNLNVDQIRSFLAVVESGGFTAAAQMLGVRQSTVSGHIARLEQALDRSLLMRDTHRVAPTPDGQAMIGFAREVVEAHDRLRAFFSPGGLRGRIRLGVSEDYTLSALAQVLARFAERHPSVDLQLTVGLSRALYQGYDAGELDVIFCKRRRGDPRGELAWADELIWAGRPGLIPDPALALPLVLYPPPSITRTLALDALEAAGRSWRIACTSGSLMGLRAAVEAGLGIAPHSARVMPAGLAPIPEMAGLPPIGEVEFVVLGSGRQHAVATALQETLLASTAELQAAPEG

SEQ ID NO: 3373 - protein, 587 aa, Methylobacterium sp.
MSDPLAGSVLKDGLRSIRPVLVTVFVFAFFTNLLLFAGPLYMLQVYDRVLLSRNEATLFGITAIAAFALAVYAALEMLRSRLLVRGGMIFDRKVAGPVFEIVHRAALLKPRAGHEAALRDVDVLREFLTGGAILAFCDLPWASLFLIACFILHPWFGWMALLGGGTLLGLTLLTDLTTRRPLDVASQAAREAGEQARATVRGGEVLRAMGMLGALRSRWRWRHDEAILLQARASDRAGLIAAATKFTRMFLQTMVLGVGAYLAIHGEISAGSMIAASIIMGRTLAPIEAVVGHWKSFTAARSSHARLTEIVARIGLEPQRVMLPRPRGLIETENLVVGAPGTSRTILHDVSVRLEPGSVVGIIGPSAAGKSTLVRAITGVWPIESGAVRIDGADLRHWDPQALGRHLGYLPQDVELFDGTVAQNIARFDVQDDAAVVSVAQRAGCHDLIQALPEGYNTRIGSGGHGLSGGQRQRIALSRAMYGDPSLVVLDEPNASLDQAGEAALMRAVADLKERGTTVVIVTHKVSLLASADLILMLDGGTLRASGPADQILAQVSGPRPVPALVATGGRAMPENERVPEVQRSAG

SEQ ID NO: 3374 - protein, 142 aa, Methylobacterium sp.
MTPDSTLPNSPALGLDHSSVADLNLALRHYRRLMIRLPLILVLGFAAAIGLSYLGTALSPPYGVYILGWDLTTWGLLGVLAVLFAELWWEGRQIGRALNSVEMQSAPIASLLGGQALISARAREHGMKPGPFNGPLRPIRER

SEQ ID NO: 3375 - protein, 145 aa, Methylobacterium sp.
VTTGLPPTLVFDTDCVLCAGSVRFVLAHERDDRLHFMGAWSVEGLALAARYGFTAEDLNGTFLLVYDGRALTRSDAALAVARHLRAPWRWFRLFRMVPKPLRDRLYSLVARYRYRLFGRREDCARVPPGQRHRFHGVRPADPPHP

SEQ ID NO: 3376 - protein, 123 aa, Methylobacterium sp.
VIANGAGRAVAFRLAPGQAHELPHAVPLLDQLPGAPLWVVADRGYSSHGFHQHIRDVGAKPAGPTKRNEAPTRCPDWIYTNRNRVERLWARLKEWRAVATRYEKTAASFTGVLCLAAACDWIK

SEQ ID NO: 3377 - protein, 123 aa, Methylobacterium sp.
VVADGRGRAVAFRIAPGQAHELPHAIPLLDQLPGVPKWVVGDRGYSSHGFREHIWTTGARPAIPTKRNEEQLACPDWAYNNRNIVERLWARLKEWRAVATRYEKTAVSFAGVLCLAATLDWLR

SEQ ID NO: 3378 - protein, 120 aa, Methylobacterium sp.
MAQLLASLFVSGRIVDGILVLVALEALVLLGVRARWGRGPAPMALLSNLASGAALMLALRAALTGAAWPAIAAWLFVALAAHLAELVIRFREGPRAAQDCDKAAWNNRRWRTFGARPPMT

SEQ ID NO: 3379 - protein, 614 aa, Methylobacterium sp.
MRSLDTLSPMRPKAEAGRAPTGEDPRAGGTPDFEAMLGAFESGTAPSGEAPAEATEDRTDGPPALPADPPVATAPGSALQALMALTGPVAGPVPPATPEAGLEAMVQRAAARAGSGPSPLPTAPALSISQVGLETHFAPVRPGLVAPATGSGPVANGTTASPVLPETGGVEADVSPSIVRDDAPRLSSPSIAPAPAATVSGPPVAGPDRSSLAALRGAVHDLAAGIDDAVPAQGSPAPSRQAAVEQPSASTVTPAATRPAPAITAPPGVPATAAAPATQQPTSLDGGQDRAAGAAAVSAASAHRSAGTARGPAAAPDALGNPAGRERTASRGDRPEPAGAAASAPPAEGLSRGDLPEPAAVAQAGATQPVHRDPEPVRQQPDGLARPETPAERAAASVTRAKTEAEAGTDAAGGGPSTEAPHPETPAEPVLQAGAPAPVPASPLRQIVDAVTAQLPAAASAAQTRPSTAPTETGPLKILTLQLHPADLGTVLVRMRLQDGRLEMSLRTSREETAERLRKEGDLLSGLLREAGYEADTVTIQAGGAGPGESGSRGQGFATFAGSQGGQPDRQPGAATPDQSGRRPSPRADESAMPTEEQNHETDSRGRDHGSLYL

SEQ ID NO: 3380 - protein, 72 aa, Methylobacterium sp.
MPVFVLRGAHRAADGQIGPPLFEEAITADNPVDAVRLANTQDLSTKDERANALWLVDAQGVLHWSLRRADRD

SEQ ID NO: 3381 - protein, 314 aa, Methylobacterium sp.
MSSTPGATDSDSAEAMRRELARLREMLEQNSDWIWEVDAQGRYTYASRQCVALLGREPEEVVGHTPFDFMPPDEAERVGRIFAAIAAERRPFAQLLNRNLRKDGRLVVLETSGVPLLGPDGALLGYRGIDRDVTEREVANERLRHIARHDDLTGLPNRMYLREHLAEGLAAGQRPSVISLDLDGFKPVNDRLGHAAGDRVLTEIGRRLAEMSAAHGLFAARPGGDEFVLIVPDGVPAPSESLRKTLREILGEAIAAPIVLDAETVRVSASFGFARANGPNDTVEALLARADRALYEAKEAAKEAARRAGISGGG

SEQ ID NO: 3382 - protein, 40 aa, Methylobacterium sp.
LIAVMLSVSRAVVSKHREISALLATYAMFLSGVLILAWAA

SEQ ID NO: 3383 - protein, 290 aa, Methylobacterium sp.
MVCAPSLSFTCPPGFVPDRIGAGRSSEVFAEGPDRVVKLYRQPFEPQAVVNELAASRLAHGFGLPVPRAFGLVGRAGRTGILFARLDGPPMMVRYACNPFGLLLALRRVARIQHAIHACPAPGLPSQHGRLRHQIAGARVPEPLRAAALAALDRLPAGDRLCHGDVHPGNVIATSAGLHLIDWQKAAAGNPAADVARSELMLRYGQFGPAWFSRLPPVRTARRLIAAWRLPVAVARLFGQPAGTDAELLAAIEALARQSSDFEKASLFPGPGQNPGRGPVPHNPSAKVPR

SEQ ID NO: 3384 - protein, 922 aa, Methylobacterium sp.
MSDAAVIARLEHVSHRYGGTRALDDVSLDLPAGRMVGVIGPDGVGKSTLLALVAGVRRIQTGRVTVLDGDMAERRHRTREAARIAYMPQGLGRNLYPTLSVFENIDFHGRLFGQGASERRRRITDLLTATGLDPFEDRPAGKLSGGMKQKLSLCCALIHDPDLLILDEPTTGVDPLSRGQFWELIGSIRAGRPGMSVIVATAYMDEASRFERLIAMDDGHVIASGSPADLLARTGKPDMEAAFIALLPPEKQAQHRPVVLKPRPPRLDAVPAIEAEHLTRRFGSFTAVDDVSFRIARGEIFGFLGSNGCGKSTTMKMLTGLLPVSEGSAKLFGHPVGDNDMETRRNVGYMSQAFSLYSELTVLQNLELHAQLYHLPPHDRPVRINELLERFELEPVKNARPDSLPLGIKQRLQLAVAVLHRPAMLILDEPTSGVDPIARDAFWRTLIDLSRDEGVTIFLSTHFMNEAERCDRISLMHAGRVLAVGTPAELVRKRGSTSLEQCFIDYLAEAAGLDPKAAEKAGLETAEEAAEPDTPPAPAPPRAASHRHRFDPRRLWAYARRETMELLRDPIRIAFAFIGPVLLMIAFGYGISFDVENLRFSAFDQDNTPESRQLVDAFTSSRYFSEQPPISSATELDRRFRNGSVQIAVEIPPRFGRDLQSGRAPEVAVWLDGAMPFRAETSRGYVTGLANQYAHQLAVERLGIDASKTVSVQTRFRYNQAFRSVNAMVPSVMMLLLILIPAIMSAIAVVREKETGSIANFRSTPVTKFEFLLGKQLPYIGIAMISFGLLVLVALFVFDVRVKGSFVALCLGTLFYVSATTGFGQFISTFMKTQVAAVFATALLSIIPAVNFSGLLVPISSLSGSARLIGLSLPPAWYQPVTAGTFTKGLPFAELDRNILVLAGFALLFLILSQLLLRKQEA

SEQ ID NO: 3385 - protein, 111 aa, Methylobacterium sp.
VRILFVCGRARARSPTAEQIFSRWPGVETASAGVSDDADEPIETDHLAWAEIVVVMERAHRRKLMRRFGPALRHVRIVCLDVRDDYAFMEPALVSLLEARAGRFLTIRKPD

SEQ ID NO: 3386 - protein, 742 aa, Methylobacterium sp.
MRRLARGIVRGIAGAVLLIVPARAAEPVEHRIEALLSRMTLEEKAGQLTLISHEPILDLDSFRRGEVGAVINFNNAGLVAQADRLARSSRLGIPLLVGLDIVHGYRTIFPLPLAMAASFDAGLVRRAAAAQGRESAAVGLNWTFSPMADVTRDLRWGRVVEGLGEDPWLTGRLTAAQVEGFRDGGLASTLKHFAGYSAVLGGRDYDATFVAPTELHDLHLPPFRDGIRAGADAVMTALTALNGVPTTADPALMTGMLRRQMGFSGLVVADWQAVASLTKHGVARDEAEAARKALLAGVDMDMTSGLFLRHLPEEVRAGRIPESAVDEAVRRVLRLKFGLGLFDRPVIDTAGAEEKLLRPETRNLAREAARASLVLLQNREDLLPVNPAKVRRIAVVGPFADSAWDQVGPHEGAGQEWDAVTILAGLRERAAASGIAIDFAPGCGRVCDGRAEFSEAVAAAARADLVVAVMGEPRDRSGEGSSSATLSWPGLQHELLAAVAGTGKPVALVVVGGRPTELGNALEQAQAVLMAWLPGTEGGPAVAETLFGDANPSGRLPVSWPRRVGQLPLTYDVLPGGRPHIPGSRWTMGYVDESPLPLFPFGYGLSYTRFAYGEPEVVTPHLGVGDRYDAVLEVRADVTNYGTRAGRAVAQLYLSQPVAGRSRPKRLLKGVALLDLASGETGTASFRVPTRDLGYHEPDGTLVVEAGAYRAHVGGDAVATRSAGFTVETGWRGPPGSDEARR

SEQ ID NO: 3387 - protein, 92 aa, Methylobacterium sp.
MFPKLVGSLALLVAGSVLLHSWEMPRWVIATLCAIGTAATVLLIAPALERTVAPVAATPDREPPKGPAPVFEGIWDPLDHRQVLSGSPGTDL

SEQ ID NO: 3388 - protein, 331 aa, Methylobacterium sp.
MKRGSIAGRVPGALILALAVLASPVRANDSAATLDAGGLVLVRDDAIELASEDLRIAIDRIDVDYVFRNRSKAPRTLRLAFPLPPIDGAELSFSALSLPVRGSANFVGFTVKADGKAVEPALEERAFHGTQEITERLKRHGLPLNPLRREELEAALKRVSPADLKALHKADLLSDATTDAGAQWRSEAKFHWEQTFPADAELRIAHSYAPIAGNWFLSPEEATARDFRARYCLDDAGLAGIRRLAAAKPEGYTRAFEVPYIVTTARNWAGRIGRFTLTVDKARADALVSFCRQGVRKTDPTTFVWEARDYVPDSDLRVLIVSNDPALLGDR

SEQ ID NO: 3389 - protein, 753 aa, Methylobacterium sp.
MAGDRANLILATAQGAADGWAKYLQGEGTIDITIGIGNVGGGNYLANGGPNWAWSGTRWEYAAILEAREGYDGNGGTPEGTVTLGEHRLGDLFYDPAGTAAVPGNKIDAFALFQHEIGHAIGFVDFAATTSANGAPVFNGDNTRTVLGGAVQLDATRAHVSGIEDLMDPYSPWGGRPAISDLDLAMLQDKGMPIATERADKLSLGTRSDTFYAYGGDDWIDGGAGNDRLFGGAGNDTLIGGTGSDALDGGDGTDNAVFAGRSRDYLALYNTNGGGSVSIKHLASGSIDTLTSIDALNFDDTVLGMSGLLAHLQARYGTGAAGQGETYEMALNAAADEAYRAEIPEIDGAFSVTARVRFDDLADGYYQRVFDTGNGPDSDNIWLGQVGNGRDMAFEILDGAITHRITALDAITEGVEARWSAAVDERGWMSLSKDGVRVAEGQGVVPRDVTRVKDLVGASNWGADTALKGGVYDLTFKDDLPDIHGAFTASATVRFEDLDAGAWQRVYDFGNGAGADNVFLGQIGRSSDMQFTIVNGSKSAHVVAKGAIVEGQEATWTTSVNETGWMRLFKDGVLLAEGQGIVPKDIARVNEFVGKSNWAADKPLVGEVSDLTITPYKAIPEIDGAFKMFAEVRFDDLDDGHFQRVFDTGNGPDSDNIWLGQVGNGDDMAFEILTGSTKHRITALDTIVEGEMAKWQASVDEAGYMRLIKNDKVVAEGQGAVPLDVLRTSDLVGQSNWSWDTALAGQVKDLIFA

SEQ ID NO: 3390 - protein, 401 aa, Methylobacterium sp.
MPGPARNIGPSERAGPDQSAAPAPLGFGTHTANVFRLIVKELRSIRADPVMLFLVVYAFTFAVHSVASGASTEVRNLTVGVVDEDQSDLSRQIVSALNPPLVKSVVALTPAEIDPAMDTGRLVFTIELPPRLQKDVLAGRPAEVQLGVDATAMTQAGNGSVYLQTIIAQEVARFAARSDLSDTAPVQVVTRAKFNPNLQTSWFTSVMQVINNITLLTVILTGAALIREREQGTVEHLLVMPLVPVEIMLAKVIANGLVILVGAGLSLVFVVEGWLGVPIAGSIPLFLFGGGLYALAVAALGILLGTIASSMGQFGLLVIPILLLMQLLSGSSTPMESMPYWLQILVQIVSPTPHFVALAQAVLYRGAGLSVVWPQLLALAALGSVYFVFALARFRRVIFGV

SEQ ID NO: 3391 - protein, 304 aa, Methylobacterium sp.
MAGSSSAAARPTKFGEPRTLALLALAALATLVVIAAVWTLLAGGAGGGTVQAVSEGLASRGFWTAVAVGLAAQTVDGALGMAYGITSTTFLLSTGVPPAAASASVHVAEIFTTAFSGLSHWRLGNVNGALFRRLLIPGAIGAVAGAYLLTSVDGETIKPFVSVYLLVMGLYVLSKAFRTLKTRREPPRAVVPLALGGGFVDAVGGGGWGPVVTTTLVGGGQDPRTSIGTVNAAEFFIALASGLSFSLLGGLTHWTTIAGLVVGGLFAAPIAALLVRVIPARALMVVVGLLIAGLSLVNLAGLFG

SEQ ID NO: 3392 - protein, 232 aa, Methylobacterium sp.
EVPGARPPAAEAEAPAARDEATERAEAGAVNPSANAIIRSLAPFADGNPGRPAAPVAVSPGDGGPSLRVDPARSVDLTVFFAYDSARLTPEARIQLEPLGQALQARELAGHGFLIAGHTDAAGGLGYNRRLSLARARSVRAHLVETYGIDPRRLRIHGWGPGRPKDPSQPFARINRRVEVSLIAPAPSGALRFILPASERSCAAEPLGDPRRQVPLDLDDFGAAPTPLPCTD

SEQ ID NO: 3393 - protein, 64 aa, Methylobacterium sp.
MIFIGGFVAIPAFGRWAHQVTEALAFLLATVLLVTVIMVLCDRWPDYFANPRAPVTVIVDSPRD

SEQ ID NO: 3394 - protein, 60 aa, Methylobacterium sp.
MKSFLRAGTAIAGIAFAGSALAADLPRRAAPPPVFQPVPVFTWTGFYAGFNAGYGFGTQD

SEQ ID NO: 3395 - protein, 569 aa, Methylobacterium sp.
MDRSEGPPHPAPDVSRRALLLTSASALGATMMPSRLFAEAGAPRGALARSRQGMVTSPHELASEAGREVLRVGGNAIEAAIAINATLCVTYPHFCGLGGDAFMIVSDRNGASFTLSGIGQAAAKVPQDGRPIPTRGPGSAITAAAAVDTWEQAFTYSQRALGGRQSWRGLFQRAIACATDGFPLTPSQRFWANFRAKEIGNWPDIVRVFTAEGRIPEAGETFRQPDLARTLTALAENGGRDFYEGELAHRIARGLEKAGSPLTVDDLARCRARNESALRVPYRGGELVSLRPPTQGLTTLEIMGVLDRFDLASTPEGSADYYHLLVEAVKLAFIDRNRFIADPDFTDVPVERLLSPSHLDGLARSIDRRKAAPWPHVYKTGDTVFIGAADRDGNCVSLLQTVYFDWGSGVVAGDTGILWHNRGAAFSTEAGHINALRPGKRPFHTLNPGMYFQNGRPRLLYGTQGADGQPQTLAAVLTRLIDYGMDPLTALARPRFLLGKTFSDSRDSLKLELDAGQAVFDELKARGHEISPIPAQSPLAGHPGAIRIEDDDSLVGAHDPRSDGLALGL

SEQ ID NO: 3396 - protein, 152 aa, Methylobacterium sp.
MHLTLTEPGTWIATPTVAQRFGISVHHLQKIAQALVRSGVVEARQGRSGGVRLARDPREIRLGRLVADLEGVGTVVDCRRDPCPLIGRCRLKWAFDAAEQAFFLELDRLTLADVAAGPTASALRALFRAEPEARVVTTAPDPTDPAEPGSGN

SEQ ID NO: 3397 - protein, 397 aa, Methylobacterium sp.
VLAVLTALSGALLLAFLLGRGALRDAGVNSHGALADALLHGRLWVEHCPEIDCALFEGRTYIIFPPLPAVLLTPFVALFGFPGFKGFVLLGLSLSVLSLLAWSRIFRALAVERWPALWLLAALAFASPLYQVTLRSDGVWFFSQTLAFLMMSLSLWAVICRASLPLAGLFVGLAFLCRQMAIFYPLFLLVLALPRDRPLLANPTSVARAALLAGLPVVAAIAVYCAYNAARFGSPFETGYAYIHNPGQDSFIWHRITGTGLFSRDYLLFNMLYLFLQGTHFEFSGPRLMDLVGFDKAGTSILVASPWLLLAFYARLDRVFWAGAATIAVIAGITLFYHSNGAEQIATQRYVLDWLPILMVLMVRGERPPAFAALPLLVTWGVVANLAVVTLLSVYRL

SEQ ID NO: 3398 - protein, 465 aa, Methylobacterium sp.
MSATGLPSDFLARLDARLGPGGLLTDEADCAPFAIDWRRLFPGRAAAVARPASTEQVAAIVGLCREAGVALVPQGGHTGLAGGATPDASGRQIVLSLARMNAIRAVDPVGLTLEVEAGCVVQAAQAAAEAAGRLFPVSYAAEGSAMIGGMIATNSGGINVLRYGMTRNLVLGLEVVLADGSVVDGLRALRKDNAGYDWKQLFIGSEGTLGIVTAAVLRLVPRPRHTETALLAVPDPEAALRVLAAAQDGLGDTIQAFELISRCSFELLERHADMASPLSPSPWCILLEAGSSLSGLRDAVEGTLGEVLERGDALDGVLAESKAQAAGLWSLRERITECEAHQGKSVKHDVSVPIPAIPAFLEAADRALAEGAPGTVPNVFGHMGDGNLHYNVLIGAEHDGAAINRLVHDVVDRFAGSISAEHGIGQYRVDELAHRRRPEEMALAHRLKRALDADGLLNPGKVLRT

SEQ ID NO: 3399 - protein, 585 aa, Methylobacterium sp.
VAEAAAFRSFANGYLREIDPGIRVCHALPDGPPARCVEWNLRSRRLAIRAEILSPSLCGAHAFGRLWTRHLHEPRWRAVAPMRALQELLGEAYSRADEGRGETARERELELLGRVLDSYRETARLLDFAEREADATGFIAAERALVFGHWLHPTPKSRQGLTTWQARTYAPEEGGSFRLAVFAVQASLVRHDSAETRAAPDLALDLIGSDAARLDLRAGEIALPMHPLQAEALMLEPHVAALVEAGRLRPLGAFGPRFTATSSLRTVYAAESPWMAKFSLPVTLTNSLRVNRLAELKAGVAMARLLAKSGFGARHPNFRILADPAYLTLHCPGREESGFETVLRENPFRNGAERGVATLAALTAEPLPGRPSRLEALLRQVCPEGAAARAQAARTWFSRYLDCMLEPVVALYDGHGIALEAHQQNALLDVASGWPERGFYRDNQGFYLSEAARPRLLRDAPETGSIASLYFADGEIRRRLAYYLVVNQIFSVIARMGHDGLAREETLLDDLARRLEAMAHRLTGAGHAFARSVLDGPTLCTKANLRVRLSDRDELASGDGRGNYIDMLNPLHAAARGEAGHALAS

SEQ ID NO: 3400 - protein, 79 aa, Methylobacterium sp.
LPHVAPATEPPRAETEASRGLPSYIVGQDGQGRWVALESHGLGGGYFRSREAAFQYAVGKTGRRAGAVRLSAEPLRIAL

SEQ ID NO: 3401 - protein, 647 aa, Methylobacterium sp.
VVGALGCALGAAPAQAGITGIEIASVEPFADGAEFGAAGSYERVVGTARGELDPADPANAGIVDIALAPRNARGMVEYKTDLFILRPKDPARGSGTLLFEVLNRGRKFLFNWVLDAPAQGVQAVNDPKTATDAGTGLVLRRGYTLVWSGWEADALRQQGGMAIDVPVATRGGKPIVELVRDELVSATRGPPEAPFALTFKTASSDKTSARLTVRRREADPPRPVPPEAWHYATPRQIELLPKGTKPLPGSLYEFTYQATEPKVLGIGFAATRDVVAYLRSEAGAAANPAGGAIRHTLALGISQSGRYLRDFIQQGFNRDEAGKRVFDGVLSHIAGVGGVFLNARFGQPSRTNTQHEDHLYPENTFPFSAARLHDPITGRTGSILRDDGFDPLLIEANTGTEYWQKGASLLTTDPVGRSDVPLPDTARAYLISSGFHYGRAGLTSTKGPCTNPRSTLNPAPAVRAMLVALEEWVKDGKDPPDSRVPRLSDGTLVEAAEIGFPFMVGVPVPTAPNAIARFSTYLDPRPESGPQYRPLVPRVDADGNDVAGIRLPAVAAPRATFTGWNLYADPFPADALCDREGSQIPFPATQADRTAKGDPRQSIEERYPDAAAYIAAVTKSVDALVTDRLLLREDGDRLIAAARQEAP

SEQ ID NO: 3402 - protein, 67 aa, Methylobacterium sp.
MPHFSKEGLEASPEALAKLREILHGRQQGGRDGRTVPSTPTKEGRFGTSGGRGAPVRRRRRTDLAGV

SEQ ID NO: 3403 - protein, 807 aa, Methylobacterium sp.
MERTGTVPVRRPFGAEELKALALECGADDVGFVGIDRAELEPQHDEILRHYPWTRSLLSIVVKMAQAPVRGTPRSVANLEFHRAGHDTNAVCAKIVARLQDRGIRAVNPSMGFPMEMDQNPGNAIWIVAHKPVAVAAGMGRMGIHRNVIHPKFGNFILLGTVLLEQEVDVADEPIDFNTCLDCKLCVAACPVGAIKVDAPFDFQACFTHNYREFLGGFTDWVEQIADSKDALDYRRRVNEPETASMWQSLTYGANYKSAYCIAVCPAGEDVIGSYLKDKAAHRRDVLKPLQDRPEPVYVVAGTDAEAVARRKWKHKTVKPVGNGMTPRTISGLLTFMPIVFQPAQARGLDTMYHFTFTGSENRDVTVTVRDGKIAVRDGLVDKPDIRVTADAKTWLGFLAKERSLVWAFARRKIRVSGDPRLLLAFGKCFPSPEIRRRDVEILPVNSLLRPAITAYEKNDEMTGKVRWSGELELKEVERVTGSVKTFRFVDPAGGEIPFRHVAGQYLTLECVRQGIPTRRSYTIASSPTWRDRVEITVKREEHGTVSRWLHDELQPGDRIKVEAPSETFVFSGTEWPTVVLIGGGVGITPMMSSVRYLTETEWPGTIYLLLSFRSREDFIFESEIESLKLRNPRLRVAVAMTEPRQAGWDGHTGRIDARFVTAAVPDIALHRAHVCGPTPMMDAAKGILLDLGVPAGQVRIEAFGTDRRDPTKKVGKSGQVVGKVKFLDSGKSASAREGATLLDVAGEAKVRIDSACRSGTCGTCMVRLRAGNVRMSVQDALSDGDREDGYILACQAEPEGDVELEA

SEQ ID NO: 3404 - protein, 436 aa, Methylobacterium sp.
VSNETLIAAIGTVLREEMRHPHLDGFGPEARLNEDLYLDSVQLLQLILALELTHGVSVPEEAINRQDVSTVADLARLLAPGAEPATPAAEPEAPSEGVHGAMPYDLKIHCFVSCVCDGLKRRGIDHRPFYALIWDAEFAITDGSKLAYHSDAMDHESFRYWFERLYGVPLVPWYDHSRSKDENVATLLDLMERREPNECIMVMLDMFHLPERENKFNQNPFPHYLLVSLSDDPDLWQVRDPDFRWEGVIECERMLNAIRQPSVAGGYRFDPSLAHPPRDTDLAAFFDACFRLDANPLIDAARAIVLAHAEGRGGLKLTDLGEALRELPVITIRKWAYEHGFAFFWRALRWPDPEFQRICDEIEALVNGLTALHYAVLKLARTGDVAELAPVLARLDALDAQEFAIKGQLAAAYAAWRQRSPDLGNAAPPSRERLSA

SEQ ID NO: 3405 - protein, 92 aa, Methylobacterium sp.
MTESHAVVSTPHAGRYLQQLCKHWAHRFETEFSATNARIALPLGETRLSADAETLTIDLTAQDAASLPGLRDVVVRHIERFAFRETLRFDWT

SEQ ID NO: 3406 - protein, 166 aa, Methylobacterium sp.
MDLTIRALREDDAQDLFEIYNQPAFRFGTLALPYESFEAVKKWAEPRSPRDLHLAAEREGRLVGAAALRPFYGRRAHAAEFWIAVHEDFAGNGIGSRLLAAVIDTADNWINVSRIEITVFTDNARAIALYEKFGFVIEGTHRAASFRNGRLDDVHCMARLRPTSEL

SEQ ID NO: 3407 - protein, 2794 aa, Methylobacterium sp.
MATSLAAGDIALVGYDADNPDDFAFVILRDIEAGTSITFTDNGWNSSTNAFLSNEGSYTYTAPTALAAGTVIHPTADSAAGGANTPVYTATDAPRFSFSTSGDQILAYQGSAANPTFLFAINFADDSGSFAADGTDANTSALPPGLILRQTAVALGADNGRYNGTVSGTRDQLLAAIGTAGSWSQDNAARIGAGSYGAFTVTAAAVAPALSIDDVQVSEGDSGMKQLVFTVSLNAPAPAGGVSFDIATADGSAAAGSDYVARALTGQAIAAGQTSTTFAVDILGDTAIEPTETFTVAVSNVRGATVADGQGTGTILTDDVGTRINGITVFDAAPSLQGLSGATAAPVATNALQLVRLGAYAATNDPATQAAPNAEVVAYDSTTSRLYIQNTGENRIEIVTLDATGALTKPGEIGLSGLEQYGAVNSVAVFNGLVAVAYANATGDAPGRVALFNADGTLLRSLTVGVGPDQIVFTRDGSRLLVANEGEQASAGSNPVGGISIIDVSGGAANAAVTATVGFEGLDGSEAALRARGLAITPGKSAAADIEPEYIAISPDNRFAYVTLQEVNGVAIIDLTNPGTTPIAIQPLGAVNHSLAGNEFDASDRDGPANAQGVGSASISIAATPANTPIYGLLQPDAVASFATGGATYFVTANEGDQRVIGGADDTGDVTRLSNIPNSRLTPELQLLKADPAYARLNVLQRTGDTDGDGVIDQLHTLGGRGISIFRQNADGTLTKVRETGGEFEKIFAQIAPERFNNEQGLANTPDDRSDNKGPEPEGITIGTVNGRIYAFVGLERQSGVIVYDVTDPANAAYVSYVPPLPGATTDLGPEVLTFIAADRNPTGTPLLVSANEVANGGAVLYAALPQGYTQEVGFATNALTVSKAEGNAGESVFTFTVERNNGTLGAVSFTAELTGSGANAADTADFAGAPGLPLTVVGTIPAGAATAQVSVTVRADVLPEADETFALTLRSVASDQAGITAAVRGSAATATGTIVNDDASLISAVQGAGTASPLVGRTVTIEAIVVGDFQNGDADAKRNLGGFYLQEEATDQDGNPLTSEGVFVFEGTGNRLVDVAEGDRVRVTGTVAEFNGETQITVRNAAAIQVVTPGALTPEQVKASAVAVELPAAGTIGTGTTAQPDLERYEGMLVRFPQTLSITEQFNLDRFNEIRLAAGGRTETFTNEFEPNTAAYAAYLAQTAARTITYDDGQNAQNIPVENLDGFGPAYGTASAPRMGDTVTGLTGTLGFGPTGAYRVRAIDDGDNRFAVANPRPAEPDPVGGTLKVGSLNVLNYFTTLDTGSSARTAIGQQPRGANSAGELARQTEKLVTTLIGTGADVLGLTELENQFRPGDPGNALEYLVGQLNLRAGAGTYAYVSPGAQLDQGQFLGGDAIAVGFIYKPSKVSVAMNTTIERLDDTDVAAFNPALLQQSTLGHIFNGANTSRASLAVTFNEIATGETFTAVVNHFKSKGGTGTGADADQGDGQGAWQQQRELAATALAQWLTLRPTGSGDSDTLLLGDFNAYIKEDALDILKANGFTNLAEDRLANPYSYVFDGAYGALDHALASASLNRQVTGVTEWHVNADEADAIDYNLDFGRSPNHFDGRSPARESDHDPVLVGLRLDQTAPTLVAATPADDATRVAPGADIVLRFSEAVRAGAGSITLTDGAGDTRTIAVSDTAQVRIDGSTVTINPSADLRPGTAYDLIVPAGAFTDATGNAFAGIARDNLDFTTEQATPMTYTLQILHASDWEGGLLATERAANFAAIVDRLEDTTPNSITLSTGDGWIPSPFYIAGADPQMAATYNGVYNQFYGLSGAAAYGRLAASPGRADITIQNIIGVQAAVFGNHEFDAGPNEVANIIGANLGSAAGAADDTWVGALFPYLSTNLNFSREAALSGLVHHDGDLATFAQTGPTSTQTGTGADKIAKSTILVENGERIAFIGATTQLEPLLTTLGNVTVDGFTGRDEIALLASQINAEVDRVLAANPGLNKVIVGTHLQQLANEQALAPLLRDVDVLIGGGSHTLLADGNDRLLPGDKSGGAYPQFFTNASGQTLALVNTASEYSYVGRLNVTFDDQGNVIRNSITPENSGAVAVDDASVAQLWGSKAAAFTPGSKGYLVREVIEGLDANNDGIQETAGVADVIRQQDGNILGRTSVYLEGRRGEVRTEETNLGNLSADANLWYAKQFDGTVTVSIKNGGGIRDSIGSFSTAGGGTAELPPAANPAAGKAAGDISQLDVTNSLRFNNALAMVTVTAAELERVLEHAVSSVAPGATPGAFPQIGGISFSFDATKQAQTFDANGNVTREGQRILSAAIVDADGFLVDTLVQNGQLVGDANRGIRAVTLDFLTTGSSAAPGLGGDNYPFPAYGESRVALSSATPTSLPNTETFAAQGTEQDAIAEYLKAFHSVTPFGQADTGPAADTRIQNLAVRGDSVLARGVSQPGTSGNDVLQGTAFADRLSGGLGDDVITNSAGNDILSGGRGTDTLVFNSSFANITVTEAGRFTAITGPGGLDLVEGFERFLFSDATIVVNDGKPLVDDLYYLARNKDVFQAGQDADTHFAQYGAREGRDPNAFFSTKGYLAANPDVRASGVNPLEQYEQACWKEGRDPGARFDNEFYLSANPDVKAAGLNPLAHYLQYGQSEGRAIHEAVGRASDIRGGFDAEFYLLANADVAQAAGTGNTFAFASQHFEQFGWKEGRNPNAVFDTKGYLAAYSDVKAEGINPLTHYDQYGWKEGRDPSASFDTATYLSTYKDVAAAQLDPMQHFLQYGLYEGRSDFADGGFRFGTLV

SEQ ID NO: 3408 - protein, 84 aa, Methylobacterium sp.
MDRSKTDCADQGHTASGEAAGPEASSRALVAPSSAGAGPRLRGGRPMANFLTQLIVSADPALRPARLERTKAAAALYARAAASR

SEQ ID NO: 3409 - protein, 67 aa, Methylobacterium sp.
MAERTHHPYSIDVRPCWRRPGRFVCSILEKGAPRRYGPQNYATFDEARRAAQARLRQLVFEWQLVGS

SEQ ID NO: 3410 - protein, 425 aa, Methylobacterium sp.
LHEVLIAMDVVTMLFMSLVAAAAAAGFLAFEWRTLRNRVLLFWSAGFAVIVLGSSLSLLRAYSFLVGVWFANGLLVVAHLLFLFGVARFTGRRVAPLWWGLLLPWAGLLILPEGIDPTPVFAITGSTLVALVALKAAHGLLSRSGAPFEERTAASDGLGFVFAVHGAFYAAKALLVPLPGAFVSIVGFKGVLIQVSLVEGIVVEVLLALLMAAAVRRRREEAMTALAERDALTGLYNRRAFESRAQAALDAMAARHRPGALLLLDIDRFKTVNDSFGHAAGDRLLVALAAVLTEVLEAGSTREAIPARLGGDEFVILVPGLDEAAVQALGAAIGARMARARRRDLPAGATVSIGAALFTAGLAKPDLSLETLTASADAALYEAKRQGRDRLHVRRLVQPAAERGCGHRRADTAPSPLASGEGCCA

SEQ ID NO: 3411 - protein, 103 aa, Methylobacterium sp.
VRCYRLILGSSSEPAISRTPCSPRSPSHPKGVAQAYSDIRTALAHQGFDWIQGSLYVSRNEDLARLFAAITALKALPWFPASVRDLRAFRVEQWSDFTATVKG

SEQ ID NO: 3412 - protein, 709 aa, Methylobacterium sp.
MPRQATVIAARGAIRRSVRRSVHLAALLLAAGLGIAATVRIAPAQAAPEAAPFADNADSVAVVIGNRSYKQTVPVDFAHNDAEAIRAYLIERLGYRDTNVFILKDATLNEFNQVFGTERNPQSGRLWRSVREGRSNVFVYYSGHGVPDLATKQPFLLPEDGNPNQGESGYSLETLYRNLDLVKRKIGSERQLVVMVDACFTGETGRKGESLLAVSAPGFAPARPKAESGITRLIATSGATPANWDEPNRLGLLTSRFLMGVSGLADAMDGQGNGDGLIQWPELKGYLRREVEEAARRASGREQVPEIDDASIVVKASLPVAAVAGGVAAIRDDAAWRRAETLGTREAFEAYVGTCGEACAYRAQAMDRLLAGRKRDAAAIDQENWAKFGAQRQYQAYLDSCGETCAYRSLAEGYLGGTNPSSDPRVKRCDELAAGTDDPDRPKGVPGVKLGRIEASAAIEACRGASAAYPQLRRLAYQLGRAYDRADRSKEAFSAYDRAAKAGSVSAMNNLATLYENGQGVKRAQAEAYRLYRQAGEAGNVVALANAARMLEYGNGIPKNEAEAVALYKRAVAGGDVPSISKLVPHYATGTYGFPKDLRQGFDLFRQAADKGDPVAMATMATLIDNGFGRYFPGTRSADMVLRALKRGELGAASVSATDTAAQKLKPETIRTVQRAVKDADYYSGALDGRFNPVFVRALDQYARANEAE

SEQ ID NO: 3413 - protein, 87 aa, Methylobacterium sp.
MMLAATILVWTPALLFALGFALAHLTGCRVDEGSAHPCLVAGIDIGGLLYTLMMMGWLVILMLPFMLLTLVIWLGIGLRALFGVWFS

SEQ ID NO: 3414 - protein, 346 aa, Methylobacterium sp.
MTPAPDPAADVYEGRDGWLFLIRGNNRVLQQYGRPGVSRGTLWRWRRIIETRVRRCAGLGATYLHALAPEKLTVYPEWAEGLVFDPARAPALRLARWLTASPGARAWVDLTGAFRATRDGPPLYLRTDTHWTFDGCALAYRTILSRMGVPPREDIEARRERTALLFSGDLGRKYAPHHTELAEGSAFASAARRIHANDLLREMEALGRGGDAHLGTHAVFRNDDPAADPRRLVIFGDSYAQHTAHSPIATLTALFADTFREVHFLWSTGIDWAYLETVRPDFVLGEMAERFVIDVPPANIRIERLAELARERKLMGEITAMGSPSPVPPPPGAPASAPEAAGAAPR

SEQ ID NO: 3415 - protein, 397 aa, Methylobacterium sp.
MAIEAGHIASAEEHYRLFGRREGRPYRVPSASGELGGGIAGLWTYRYPYRAWPDLPEIAFAPPRPGPEDEAIARRLIAAWRSGAERSPVQADSAGMWAARTQGFSALHHALRSGDAAALADQLNNLFQSHLSHGIAMGRTMATLARHASAPFAASWCDRMLRLSEALGLVPVRSPEQGDFAASLNGSPAVYPEPARLEAELGFPLTFPEVGAPFGVHFGAGILPEHAFSHAYAAWRIGQIGVIDRIVEIGGGFGGLAWFLRRPDRRYTILDLPFTNVLQGWFLLKAGLDVSLAGEPDAAIRVLPWWEIERDERYDLVINQDSLPEMPPETAAMYISRIRTIAPLFYSINQEAAAPNTDEFRQVIVPELVARNGGYRRLSRNLFWMRDGYVEEVYARR

SEQ ID NO: 3416 - protein, 102 aa, Methylobacterium sp.
MDESRGKPDSNRDSLRNFSAYADRNGQDFGQDSPLDVARPAELQQALQDDPGGEAQAARIASGFDRRDAIAGGSIESVEAIEAATPPENLRRISDPSSTPKR

SEQ ID NO: 3417 - protein, 149 aa, Methylobacterium sp.
MTEAFNLKIPHGGYVLVGDGRRALVLRNEGHALHLSLKVQHLFEAPPNPPTREQGTDRPPRVRQGEHRSAIAQTDWHEIAEQRFAGEVAAALDRVASAISALVVVAPPRTLAALRQALSDRLKRAVIAEIDKDLTKLTIEEIGQRLTGA

SEQ ID NO: 3418 - protein, 240 aa, Methylobacterium sp.
LAEPLHAVIFDVDGVLVDSPHEQAWREALADFADPSGFTTAFYQAHVAGKRRLEGARATLERLGGAEAAAQAAAYAEKKQAVIDRLIAEDRFEAFPDAIRFAEALRETPLRTVLASASKNADALLARVILSEGRTLLSLFDADVSGREVPRGKPDPALFLLAAGAVDTPPRQCLVVEDATAGIRAAKAGGMAGLGIARLGDEALLRAASADLVLTSLDELDVRALPSGVLRTRPVPLSHT

SEQ ID NO: 3419 - protein, 171 aa, Methylobacterium sp.
MRRRAALVSLGLTAGLAVALAGAPARSAGLDCGPPSAPQPEADTVLTQAILSPRLDEKASTALASAVRRLTSAGVPRAVIVDRAVAAYCPLVARDGSLTLDRQREAVRRFASTLTSLVYDPPEPNQGETAFILSLPVRPALSLQIDAAAAKAGKTRDAWILEAIQARLAGD

SEQ ID NO: 3420 - protein, 186 aa, Methylobacterium sp.
MIPDLRPIARAALCATAALLAVLPAAARGPGFDFPAEVAGFARGPRTDYEARAPGLGYSVVYTNGRWKADIYVYDAGVANIPDGASSPAVAGQLAQAAGDVSTAVAQGIYRGSEDRGPVRVPGEAGARLTCRAFSIDHPALGPTESLLCLTGLRGQFVKFRLSGPAAKQAPKAEAERFITGWLDRQ

SEQ ID NO: 3421 - protein, 71 aa, Methylobacterium sp.
LLGERETDMRKPEKPGTEAGKTHEGGALGNIDEQTGHPGKGTPGATVKSEDNPDPSRDPKPERPEDRKPKR

SEQ ID NO: 3422 - protein, 572 aa, Methylobacterium sp.
MDMVSSGIVNLLVIAGIIVVALLGIGFVFSRLYRRTTRDTAFVRTGLGGRKVVVDGGAVLLPVFHSIAMVNLNTLRLEVKRSGNESLITKDRLRADITVEFYVRVEPKEESIALAAQTLGDRTNDAMLLRELIEAKFVDALRAVAAGMTLPDLQEKRAAFVKGVQEAVSGDLRHNGLELESASLTRLDQTSIEHFNPDNSFDAEGLARLKEITEQRRKERNATERDAEVAVAEKDRETALKQLEIKRTTREAELAQERDIANKTAETRAETAQAEQRAQQSEETARIEREQAVRLREAEARKNSEGARIEADLAIAQRNAEAERERQLILQDNAIKIAERSQKESEARAAAKTAEALAVAAEERVATAKAKEIAEREREIAVIAAKREAEREATGVTVTAEAERRAAEDRANAITTLAEAEATAAASKAEAIAKLGQAEAERERVMNEARNALSPEARAFETGLKRLGIIPDALRESMRAVEKIDSIRIFDAGGMMGGGNGAGGVSASLGDSLSGHLLRYQYNSPILGAILNEAGFSEGKGSLDALVGGLRNGAAKPLADGHAKAAETLSGA

SEQ ID NO: 3423 - protein, 349 aa, Methylobacterium sp.
VTGGRADEASRTDDARLAREVARHCAAFREPIPRLALRQVADTLLPYLILCAVMLGAAANGYALLALPLAVPAGGLLVRLFIIQHDCGHGSFLPSRRGNDGLGRALSLLTVTPYDSWKRAHALHHATTGDLSRRGTGDVHTLTVREYLALPRWGRLRYRLYRNPLILIVLGSPINFLILQRLPSGVGLPWRTAWRDVLALDAVLLVVLAGLALAAGGIGPVLWTFLPVIVVAAWVGGWLFYVQHQYEETVWEEADAWDFHRVALGGSSYYALPRVLQWFTGNVGLHHVHHLNSRIPNYRLQECLDGHEVLGRVGRLTLRDSLRCLKLALWDEEARKMVGFARVRGLQAA

SEQ ID NO: 3424 - protein, 46 aa, Methylobacterium sp.
LAAARHGFECSLIALRRAALDAVDSGDLAILALRVCGERRLRAGAE

SEQ ID NO: 3425 - protein, 471 aa, Methylobacterium sp.
MHKLLIQLGLRFDNPDEERSFVRSFTLHDLGRTQAAMVLGAFVYCSFSAMDWILSPDAWAVATAFRLAVAVLVLLPATLLLTRPGARPFAEQIYLVYCVVPGCVLSVIYVFLRPSFDHGAAGLIVVILFVSTLLPLRVPSFAVFAVLTWACFALFETIAAHENPGLALVNNAELGAAYALSFYGVAAREFRARRQFRTTQELQVETERSEARLSELRAAQAHLVQAEKLAALSQLVAGVAHEINTPIGLALTTSTAFDHDLARLRRTIASGQIRRSDLTQSVERLAEGAALVFANLTRAADLVHNFKQVAVDQATEDRRRFEVRSWLFELMSTLDPVLRRKGHAVRLACPDGIVLDSYPGALAQIVSNLALNASVHAFEGDRPGTLFIDVTRLGESQIRMVVRDDGRGIPRENLQRIFDPFFTTGRDKGSTGLGLHIVYNLVASTLRGQITIESEEGVGTQVAIELPVAVP

SEQ ID NO: 3426 - protein, 86 aa, Methylobacterium sp.
MNKVMILALVGAGLFGAAPSAFAQDSAAQPSNQEFIGVDLDNGGVYYNGRNSGRYCLYRTVEVFNRYTGYVEARRVRRCGRGLYLP

SEQ ID NO: 3427 - protein, 173 aa, Methylobacterium sp.
VSDEARLLAELHAARALMRVPVPVSQPGQIDRPRHAALWAHANREPGSPVDLTVVRAIRSDPETARRYRTLLGAQSLAHAPLAAAASDGALSRRRIGPFELEILKGTPPLLILRGLDAAMPRWIEAWLGDEAVRLDLGAPVDGAILLALDPAVAEADRLGQMLRDPACAVFLL

SEQ ID NO: 3428 - protein, 393 aa, Methylobacterium sp.
MTGPSILVVIPTTGGPLRLRSLNPRPGLPAPAAFADGDYRPLPWSGDYARLCAPGGPVVRLGGEAGAPHELRLSGSFDAGRSWEVPVCLAHGLSARGARFVGEPAQADLILWATGAVDRDLSLVPGDYALLDKIERSRALLTEAPDVSLAILLPEGPERTEAEAAFRTLGRSGTLRILPAGDVPAAVEALTRPNGANLPEPQRRGRRLVLTAGAAAAACLAGFIGFVALGARQAPVIGAASDPATGAASADPARRAETDPPSPPVAEEPTAKEASAIRIEELRAPPGSSCRRVAFGADAPERRPVASENGGRLAPTRLLPDLCGLAIAAAPGLRLEIGPELRAAALPPVQLADGAQGFFLREGGRQNLVYAVQALPETGTTRPGERLVHALTR

SEQ ID NO: 3429 - protein, 330 aa, Methylobacterium sp.
MVPIRRRCRPATAAACLLLAPFAADSVLAQTVGFDPADYGRAQLPLRQTTGDAAAYVDQNKGAFEPISELDPKDGLAALARPIGRVDIVLRNARTGQQVGASCTGALLPGDYVLTNHHCLPQSGDLTPVKASILMDYLTLDGKGARRFEIDPKPVEFDARLDYALARVAGNPSAAYGAVRLSGEAVPGNRSMLVIHHPLGRPKVMSRFRCFAMKDQAEGPDLRHRCDTLGGSSGSLMFDASVAGIALHKEGGLDPKDPSSFNKATRLSAILGRSRILSEIAAAQGRPVAASSAGDAPPKAGAAPTAKSAASPPAEGPLDPASMNAILRGR

SEQ ID NO: 3430 - protein, 327 aa, Methylobacterium sp.
MFPMLRARTRTWVPTFAALTLIGGALLGLAAPAQAQTRPNIVVMGEDADEDSVPRGNRIFQRVIAELSETMNLRGYNVYDETAVAMGITQANRVRRRDAELIEVARAVQNPPLDVVAVFQVYASASKSAYSDIVRPEVRIPGRLLNVRTGQSLGAFEVAGLQLPPLPQGCDRECLLERVGAEAKSIAADVAGALTSKLDGVIAPRRAADAGAPPATLPNALPGAEPPPAAAAGGESCGGLPTAYVVRLTGFSPQEVQAAEEYMAAFRCYEHHRPVRSGGATAEYWYETRSDSARLGRNLRLMLEHMSAPGQVQFSGNTFVVSRVATR

SEQ ID NO: 3431 - protein, 85 aa, Methylobacterium sp.
MLRKPTLTLLSVLAFAAGIVGTTTAAMADPPWARGGRGLHHGGPPPWAPAHGWRRKHEYGGHYGRSYRGSRYGERRYGGYGGYRY

SEQ ID NO: 3432 - protein, 264 aa, Methylobacterium sp.
MIDWLRRLLGWDRPPAPAPPTVVWRPPQGRGEAAIDAPIPPVALWEPTPQPPQHRSAAEIDAVEAALESLIAAGLRLGPHYEGMDRRAVARAMAEHPEFALGDDNETLSLTERSPEALSIDILWSYRALTDGVEDEFANAVIFVDHCYDGADADTYRALFARLIAVAGVWTDRGVTVSRVAGLGPYGHGFRVAFETEPPIPPLTFPADKNFDWSLLEQLDAHRPAGETRRFRIAADGGAGLVLFLDDAEARAIALRLGWGPDDL

SEQ ID NO: 3433 - protein, 73 aa, Methylobacterium sp.
MPVRMTQETQEVIDGRRQVVVRVHFGRPDAGREVVEVAATVRVPAIESEAQTEAAARQMARRALEQALSAFPL

SEQ ID NO: 3434 - protein, 55 aa, Methylobacterium sp.
MTNVSLMIWGATGIGLMAMLFLLYELKNAPYEDELEPEPALRQIEKQRLQFLTFD

SEQ ID NO: 3435 - protein, 43 aa, Methylobacterium sp.
LTRAGGTVRLPRRSLFRSGAGLRLAAALILSILLWAVILWAQS

SEQ ID NO: 3436 - protein, 278 aa, Methylobacterium sp.
MRIALCTISFRHHLVSIGELARFARGHGFDGIELWGVHARNLGPGAHAEWLAAYGLRVPMLSDYLPLDAAPKTLTERTAELARLAGSWGAPRLRTFAGTKSSADASAEERAHVAARLRMAAGQLADQGLRLVVETHPGTLADTTDSLLDLLASVDHPNLRVNFDTLHVWEGGDDPLAAHARLSPHIDYYHLKNVRSRADLPVFEPANVYAAAGRRDGMTALFEGALDYGTFLKTLPPQAEASLEWFGDASFSVLPTDLFRVRSATAGRHAAGPRHAAR

SEQ ID NO: 3437 - protein, 114 aa, Methylobacterium sp.
MRRPILLVAFLALPAVPALAQGFPGATVGIPLGKPDPFGTATRPPAQPMAEPFADPSADRGVAQRDRRLRSQPRRLLKGDHRAEPKRRPPPGPALTGPRSGLIDRPGAHRHQAA

SEQ ID NO: 3438 - protein, 355 aa, Methylobacterium sp.
VVMPGQVQKRADDSRDPAWASARSAWEALARHGLTPSPRNYELLHAFFSGANPPLAERLAPCLAPGGALTEEQANTLYDACIAGTSTEARMLDGVGQLAEVAGALAERVAGSSKAMAGYGDVLAHWSGRLTARPTADELMTALVALIGETEVAQSRNRLLEEQLSTSAGHIAKLHRDLVETRREAATDALTGLANRKAFDRFLRDSIARTRSDAGSTFSLLLLDIDHFKGLNDRHGHRFGDQVLRLVGRLLSEKTTDRDLAARYGGEEFAIVLGEAGIGAAVALAQDICGRLRAQRLVKRGSGDVVAQVTISAGVAQVRPGEAARDVIERADRALYEAKRTGRDRVCPTPQAAVA

SEQ ID NO: 3439 - protein, 379 aa, Methylobacterium sp.
VTRSGILPSRLTYRLLPEPADLDAVRSLLAAYRRMLVILEVIRREHGLRANVVALIEHGYQRARDETGLPARLVTLGIRDFAQRPAGFDPEGVTSMPLDDKLFSVKGAAEIALTTLCGRRTMPYRVEGYDGPWRDLSSARLTVAGDTLTIQVGVSVTAPKEETRMPENILTRVGRIIGGLSNAAIDAVEDRNPLAVAEQALREIDAVIHEARLDLGKIKAEEHRLTARRSQLDGELSALPEKLSLALAGGREDLARAGISRQLDLESQIEAIDSSLAEVAERHGAATKAMQAAQAARRDAEHRIALLRQPPTKAADPLDGYGREEVTRTRQLEQSLRAIDRVTGTASAVADPSVEELDRLHRDDAIERRLAALKQGRPS

SEQ ID NO: 3440 - protein, 78 aa, Methylobacterium sp.
MALHIRDAETDRLVRLLAEQKGIPLTEAIKVAVRNELEREAQRPALWERLKPLHERVAARPSTGLEADKAFFDGLNDE

SEQ ID NO: 3441 - protein, 65 aa, Methylobacterium sp.
MIVMYFGFMTMFAFAKPLMGTILASGLSLCILLGTSVIVGSFVLCLVYVVWANRFYDPAVRRIMS

SEQ ID NO: 3442 - protein, 521 aa, Methylobacterium sp.
MQAANNPLAVTFFVFMALTLGVTYWAARRTRTTEQFFAAGGQITAWQNGWALAGDFLSAAALLGIAGIITSNGFDGLIYSIGFLVGWPIISFLIVEPLRNLGKFTFADVVAYRLRQRPVRMAAAIGTLTVILLYLIAQMVATGSLIKLLFGMPYTVSVIVVGTAMLTYVIFGGMLATTWVQVIKAVLLSFGGLVLALLVLAHFDMNPLRLFAAAADKYGERVLQPGSKVAGSGWDAISLGVGLMFGTAALPHILMRAFTVPDVKEARMSILYATGIIGSFHLLVFVIGFGAMVLVGPEAVIKAGGGGNMAASLLALTVGGNGFFGFICAVAFATMLAVVAGLTLSGVATVCHDLWVNVVRNGHAPEREQLTVARIATIAIAVLAVVLGIVFEGQNVAFMAGLAFAVAAAANFPALLLSITWKRFTTPAAVASILVGTVSSLLLIGLSPTVQVDVLGRSLAEVSQAWWFVPMKNPALISMPLSFLVAIAVSLVTQEDGAEGSFREMRRRIMFGAARAAYTGR

SEQ ID NO: 3443 - protein, 444 aa, Methylobacterium sp.
MRLLLLAALLVLPSAARADPTTATLSPFLDAVAACAARSDLTLAVIGVEPGQTALAREQAEEVRLAVESRLQATGRVRLAPAADVVRIKGLREGTTGLSGAEAEAQIRAAFSGDASVFLVEPRRAGETAALRLQAITRNAACKATSEPLILPIRVGAGVADIDAVMESAVKALAGAAPNAGTVEVCPFVAEGGHSTCAGALTDRLVIALDAEARAPNRILKGARLDVRRTPPGTACAGALTARGRFLTDQNRQSFMELEFQRDGAVLAPTGRRRIGIEGLGCDPTPRPFLDHLAATARTDAGRLTVAATATPFSAGQRLEMRIEAHARQNLYCWVVAPDETAFVALPVRDNAASAAALKPGEAKRYPRGYGLDEIVAGEPFENLFACFGIEGGLPPELAARWLAAAPGADGEAKLLQPPDVLDLLDKIRATPGVTEATARIVVR

SEQ ID NO: 3444 - protein, 463 aa, Methylobacterium sp.
MTGGYDERCAADLAAVCDGRDLSREDRAWLARVVTGAVRPNRDKPLWDLAYALAALARATSAVSGRDLVTLALDPGLATASAVTARFSGSIAADTRGPVLGEAWGTSWAGLARLLALAEFVLTAEDLAQFSAVTGWLDELAAEPDAEGAIFLAKRLARHLTAYRNAHLPLAPLERRFRAILGFLAGRKTFSDDDILGFWRSEMEAGERPGFRTVAEHFVTFEAGAHLVGGLEGLSAPVSLDAHAGWEERLDAALVDLAASEPAETLAALLADWPEGPKILTGAEREDLTDLLRLEPFHRTRPLTTLRAASFGRVQSGIANRLRRGGGGAEVAERATCTDAESYAALQERAGTLAAHLGRMLRIAATLRIAERDGLGPETRAALEAAEADLRRVRRAGFEDRAVLAAGFAAAETALLRLSEEAGRLERALAGLARQRPLDAAFAADQSVFAAAFAAAYTGEAAA

SEQ ID NO: 3445 - protein, 79 aa, Methylobacterium sp.
MIAVSAVLSAGLVAGLAATDAAARPKPAATAAAIEAPALKAPESRPSTTVSPCTAAWPYQSAACAADGRKVRVIALTGR

SEQ ID NO: 3446 - protein, 287 aa, Methylobacterium sp.
MNNSMSPAVSEARPDIAVLALARNCAATLPAFLRFLASLRAAGLACRAFVGENDSRDGTGALLAAAEARGELRHVPTGFMAETRGRLARMALGREHLKQVLDAQGPPPAFVCVADIDNVMARPPEAGAVLAALEKLERPGLFAVSAASRPHYYDLLAYEDETVSYEHLLDDIARHRRGALGYYRFFSGTIYPAQSALTRERETTCLSAFNGLTLYRGADYRLGSYRDEAYARCEHLTFNRRVAAATGRRMLVDPGLVLRTPGDHAQRGFVSFYASRVRKLAVARLRG

SEQ ID NO: 3447 - protein, 426 aa, Methylobacterium sp.
VTGAPARRRAARACAALALLLATAPPARPAEIALGGARFDLPAAFEDWTRREANDGLLFQRVYEPTGPRGRKGMAILLVAKPKPASGPFDAAFTGFVRGIKQVPSEGKPLTAEAGETLDGHPIRIEQRCCRSSDGLRMGAWFVGIAAGGSEHYLMLLTLQLEREAEKPVREAFQALVRSYRPLRDDRGFVLAPKSGDGGMEGLYARTETRLMPNAFGGMDFIADQATLLFDKSGLYTTELPRDGDIARHCRTAVASCGTYALKGGWLSAKSIDRVEVENAFGLTKRSNETFARTGDGIKIGDTTYATMPPFAEGHRFSGTWSHTFGSSGPTGAVGGARTLSLTPDGRFTREGSTGFSSTGGAIDGGTTVAGHSRRPVQSGRYAVSGFRITLTDEAGGTESLSLFAPDRDSDKLLVIDGANYLKQGR

SEQ ID NO: 3448 - protein, 99 aa, Methylobacterium sp.
LSKITLAKIALAKIALAKIALAGSIGLISNTAANAKSHPAQTGTGGGPETTITAPHVAPTGRVMPRPRPLDSQTRGEAEQTLSPQFKDSFLMKDICVGC

SEQ ID NO: 3449 - protein, 49 aa, Methylobacterium sp.
MASKVLLALVVLVFVLDGHLPGMRELRNPDAEGGKGTGRASLLSKRSEA

SEQ ID NO: 3450 - protein, 75 aa, Methylobacterium sp.
VLQSIDIETVRIVRVPAGSGPRDEAVSSTGARLANPSAARVVTNIARYHTIPSLQALALAALASAVTPALIWLVL

SEQ ID NO: 3451 - protein, 206 aa, Methylobacterium sp.
MVEAQLIARGIRDAAVLDAMGNVPREAFVPPDGAAQAYSDGPLPIGAGQTISQPYIAALMIEALALRPGERVLEVGAGCGYTAAVLARIGAQVYAIERQAALAEATRARLAALGFAGVHLRVGDGGAGWLEAAPFDAILVSAAGPAIPEALKSQLKQAGRLVIPVGPPGGQTLLRLTRRGPDRFESTDFGPVSFVPLLRGVAAESR

SEQ ID NO: 3452 - protein, 225 aa, Methylobacterium sp.
MLRILRRLLAGRRAKAQVRTSSDTPVEKIDRADTAEQIEILAHGGFETEASTRETILDTYLNPDAVAPDDRRWVEAEVARAFARKRADEATWPLETDFDRLAIAFDRLDAAGIIALHRAGYTRSDGISDAAEVYHRRKERGRASRGFVFYHGQDVEAVVFDQGLYLAFGSFDDRDETMAAIAAEIVAAVEAQGLRTKWEGDVGTRILVHPIQWLKRSPSDDPREA

SEQ ID NO: 3453 - protein, 70 aa, Methylobacterium sp.
MISLALLAAVAAGAVNIALVTLVANRLGPKAGTASAGEFAAIGGAAPTAQRGAVKVGNENLSPLAVRRAA

SEQ ID NO: 3454 - protein, 66 aa, Methylobacterium sp.
MSIARIRETDEQWVELPEPDLERYLLHTRGQAANDNRRLSAETFRTVQLGACVALIGAATLIGALI

SEQ ID NO: 3455 - protein, 218 aa, Methylobacterium sp.
MSALVGPALFPFTLAAVVMTGLVVVEVLSLLVGHSLSGLVDNALGHEAGGGGDLATAADADGAFSPAALMSWINLGRVPFLILLILALAVFALAGFLVQGLAAALVAPLPTLLAVPVASAATLPALRVSTRVIAGLIPRDETYVVTADDLVGATAEVTLGPLDEGLPGQVRAVDRHGNTHFLRARAAPGAPAMATGARVLLVDRTEAVFVAVPATPDL

SEQ ID NO: 3456 - protein, 373 aa, Methylobacterium sp.
VRRFGLVEDANPAAFDRVPDLAIGLPLPVEPTQRERMGRYLDLCSRTENPIPGALFVRDGAEGFGRHPCRGARIVLRAYDEEPLVLLHLTPTGLEGRLSLLTDRLNDARRVMQERRRREIEMQALLAERSRLLAHLEEDAQARQRAEAERDAVLSKLYRAGQDERRRLARDLHDHAGQQLVTLTFGLRKIASRLSCPTAIREVEQLLRHTQDIGQSLRRVTLELRPAALEEFGLVTALRSLVEEWNRVTEIVTEFQIVGQEEDLPLETAVTLYRLAQEALTNVAKHAGPGVAVSVVLRFSALQVTLTIDDNGGGFEADEALTSHLVSQGKLGLLGMRERLSLVDGTLKIESAPGQGTSIVARVYRSPEARGDA

SEQ ID NO: 3457 - protein, 222 aa, Methylobacterium sp.
MPSPLIQVVLADDHPVFRHGVKSLIADSGEIVVVASVETGAAAYRAIVQHEPDVAVLDINMPEMNGVTVVRNLLKSGSRTRAIMLSVYESRVYVDQSFEAGARGYVLKRSAFQNIASAVRAVHEGGIYLDPALPERTVPHRLLHASVDESASSTLSEREKDILRFVAFGFTSKEVADRLGATPKAIETQKARACLKLGLTSRAQIVQFAILQGWLHGEIPVR

SEQ ID NO: 3458 - protein, 81 aa, Methylobacterium sp.
MLVRFGLGVVLTMVASSAALAAPMSDEDKAVLQQQCAGDFTTFCAGLPPEDGPETQACFQKNMSQLSPGCRTAIQAYKKKG

SEQ ID NO: 3459 - protein, 703 aa, Methylobacterium sp.
MSPLLTRLLASVGALGCTTLPGHALDPAAVELEELQVTAQSAPTSPVTMISGPTPNLKTALSPSVSALPGNTTVIDAAEIARLPVQSYGDLFRPVAGFDVSNYGQGGVGYGIALRGFSDAEHGRDVAVFIDGVPINEVSSIHTPNYVDLNPLIPETIASISIVRGPFSVEAGDANLGGAIFIDTKRAEPFSTLGVSGGSFGTARGLATFSQLGPGIQPFLAYEGFGTGGYRENGDLGRYNAFNKVTIPLDLGSSLSLRVQMYGTGFGQPGYLERDRVRAGLVPPRAAANPTDGGGKTLQTFVANYVNGGPDDALSALLYASHDVFSRFSDFGAGQRGQVEERETVGGRLRKVWTTSLFDALPAQILVGGDWRTDALDVNTGPSVARGFTARSLDLDILQHNLAAYAQVQVKPTPWLKLTGGARFDQFFYDVRNRLDPALSPRVSPNVVSPKGGAALTPFGWLELFANYGQGFRSPSASSELTGNPRLTPLTIESTEGGGRLVFDRVSLLGTVFFTDIANEVFQPAPGLPVQNLGKSRRDGFEIEAKILAYRKGLDRVAVFANYSGVSARLLNGAPSIFVPNVPAFLATIGAEFDVGAPASLGPSRLTGAAYLSYTGAKPLTENGGLRSSPYPRVSGRLAYLHASGWTTYGQATWYPGDRTSESIFNFGSSVSATAADIFTSPQPRLTLLAGITYGFPTGVPAR

SEQ ID NO: 3460 - protein, 140 aa, Methylobacterium sp.
MDTTRRAAGGSSLPKIKVTAEDRERLAGLASAAMDRMPDLAGYLSDELDRAQVVRAGRSALGFVRMGSEVEFRDDTTGKVQVVSLVYPGGADIGQGRISVLTPVGAALLGLSKGQSIAWATRTGAAKRLTVLDVREPVFA

SEQ ID NO: 3461 - protein, 400 aa, Methylobacterium sp.
MNDSILVVNAGSSSIKFKLYRIDGADLALLLGGGMSGIGGTPLLTVKDGRGAVLEERRFTPGDVPDASAAQHHLEDWFAHHRGAESIVAVGHRVVHGGPDFAEPVLVDDAVLRRLESFIPLAPLHQLGNLDPIRVLRQRRPDLPQVACFDTAFHRGHPELSDRFALPRFLHDEGVRRYGFHGLSYEYVAGRLRDLAPETAQGRVVVAHLGSGASLCALKGGRSQETTMSFTALDGVPMGTRCGALDPGVVLHLIEHKGMSPAEVGHMLYHASGLLGLSGLSNDVLTLLASDRPEAAMAVAFFCRRVAQAAASLAVTLGGLDAFVFTAGIGENAPEIRQRIVAELGWAGLILSNDANRSGVARLDAAGSRAQIWIIPTDEERMIARHTLRLLGRAAPGATA

SEQ ID NO: 3462 - protein, 419 aa, Methylobacterium sp.
VEVTVSGRFTLRVGWAAATLCTACLPAVSTAFAQGQGQPAGPPVVGVVTARKEPITQTEQFIGRIEAKQRVDIVARVTAFIEKRLFVEGADVQEGTLLYLLEKGPFQAAVDAQRAQIAQVEAQLGNARLTTQRARTLLGGPAGQQSTYDAALANERALEAQLQAAQAQLETAQINLGYTEIRAPITGQIGRTALTIGNVVGPGSGVLTTIVSQDPMFVTFPVPVHEAITLRARYTPLGGFGAVVIRAQLPDGRLYGHTGKLDFVNNTIATNTDTILLRGVLPNPPIFDRTHDSITVRELLDGEFVTVFLEGAEPVEVVAIPRAAVLADQQGSYVYVIGPENRAEQRRIQLGQSSTTLAAVTSGLKVGEQVIAEGLQRVRAGEAVSPEPADTTLQRFMRNSAARDGRAAPASPDGSSRRR

SEQ ID NO: 3463 - protein, 328 aa, Methylobacterium sp.
MRSEPDLPPDGSYSGEGRPPPDPIAHSAVSGLAARSLDTMSSTGDGVAGARSIQPRIEDLQSADFRTALSEEEFSLVYQPILSAATGAITACEALLRWDHPSLGSISPALFVPVAERTQDIIPVGAWVLETACREAAAWPDICRVSVNVSPVQLQEPGFEARVAAALDASGLAPGRLELELTEGVLMRDAAVALGSIVGLRALGVSIALDDFGTGFSSLGYLQSFAFDRIKIDRSFIRAMSERRESRFLIRTMHDIAHHFGMAVTAEGIETEDEARILREIGSAELQGFLFSRPLASAAATSLLREEAHRQRRSEAARQRRSTRHAAP

SEQ ID NO: 3464 - protein, 141 aa, Methylobacterium sp.
MLDAIDRRLIALLRTDARMPLAKLAAALGITRATARARLDRLLTTGVITGFTVTVRNPEPGGVRAVTLIEVDGRHAESVIRRLSGLPEIHALHTTNGRWDIVAEIEVPTLGDFDTLLRTIRQFEGIANSETSILLAARKGM

SEQ ID NO: 3465 - protein, 84 aa, Methylobacterium sp.
MTRFPIFSALVLGGLSLAGTATAQAFPNDEASVRYRQFIQQLPPSERPRPHDPRWTTNAISPSTGRFGLPLSGPAARGGMTAVR

SEQ ID NO: 3466 - protein, 216 aa, Methylobacterium sp.
MWRIIIADDQKSFRIGLRKALEVGSAGIIIVDVSGASELINHLRSPLKTDLVIVGSRLLPAGDPTYLGALKRAAGAARLLLVVPHASADLFQDALSLGFHGLIIRRQRHEEMIEAIRTTLDGRLYAPNAILAVKPPEVASAMRQPERGARTIGLTLRQREVLALIGKGLSNREIAFALSIAEATVKIHVSAVIRMLGVRNRTEAALLAPTILKGKI

SEQ ID NO: 3467 - protein, 51 aa, Methylobacterium sp.
MVASAVCLVTGVGLAAQAHRFGPRSALAESLAGVLLILGLALIGSGLPVFR

SEQ ID NO: 3468 - protein, 334 aa, Methylobacterium sp.
VRAALLAIGLAAGLAVAAPPPVQAQSRLKQLIDRLRGQRMPEGIAKSNGRIEATQVDVAAKYAGRIAKLLVKEGDEVTAGQVVATISSPETEAQLRGAQAQVLRAKKSLAEAVALIAQRTSDLTFADADYNRGKELVGKGYLTKQIFDQRKAKADAAKAGLEAAKAEEEQAKFAVKSAEADVERLQAVLVDLVLRAPRDGRVQYRLAREGEVVGAGTRILTLLDLADVYMTIYLPAAQAGPLALNDDARIILDPIPQYVIPATISFVAAEAQFTPKSVETEEEREKLTFRVKLQIDPKVLKKYHRRVKTGVRGMGFVRTKADAQWPPDLAVKLP

SEQ ID NO: 3469 - protein, 193 aa, Methylobacterium sp.
MSVDSSCPTTGEPRLPVQASERTLFDIEVGLSDALGLVKQAADTIHDLQRWRDTIEPQTLSLIRSVQQERVRWQRERTALAGEIRECRLTIDATKLALQTALTENEGLQRRYHDAKACAASAEKRAAAAEDLLAFIYQTFHVELGGAAGNDRIRLPSRPAGERIAPESLPASAAPHGTSSSAASPEPGIDLGL

SEQ ID NO: 3470 - protein, 155 aa, Methylobacterium sp.
MDLVVTTMGSLFEETVGSNEAGGFVSLVGLAVGEKIQAAYLASSGASQLDRKGMVDALLDMKRRIGSDFYVVEESEQRIVLGNKRCPFGELAKKCPSLCMLTANVCGHLAAESQGYARVDLPETIAAGASECRIVINLEPNSSGGGRRYHRRAWA

SEQ ID NO: 3471 - protein, 437 aa, Methylobacterium sp.
LRRHDPQSRADLAFSVGPRIVAGFIFGVALVGGVGGWAATTDLSGAILASGTVAVDQRAKSVQHRDGGVVGEILVRDGQPVTANQVLLRIDDAQTRAELAIVKGQLVELAAKKARLLAERDGQREVSFPQALLRPDVEVQSILEGELRLFRGNLASRDSQRQQLELQIGQIAEEIAGLTKQRDAKRDELTVLTHEHGKLSTLVEKQLYESSRFLPITRDKHRLAGEQGSLEASIARAKTRTSEIRVQIIAIGDTARTEAQRELSQVDAKAAELSNRRVALEDRLTRTEIRAPVTGVLHELKTFTVGGVVTPADILATVVPEDARLRIEIRIPPTSIDQTGVGRAARVRFTAFSQRTTPELKGVLTYVSPSTTKGPRDEAFYVGHIELQDGELERLGGSSRLVPGMPVEVQVATDERTAMSYLIKPLQDQFSRAFRER

SEQ ID NO: 3472 - protein, 76 aa, Methylobacterium sp.
MKHPILTAAVLALGVAALAGPAEAKGCLKGAVVGGAAGSMAGHGKAGAAAGCVIGHHEANKKDKAGGQNAQPVPAK

SEQ ID NO: 3473 - protein, 209 aa, Methylobacterium sp.
MAELVVIGFEDPQQADSALNELARLQTEYLIDLEDAVVAVRSPDGKLRLKQSVDLIGAGAASGGIWGAMWGSLVGLLFLNPLLGLATGAALGAGAGALSGKLADYGINDDFIRSVAEAVQPNTSALFILVRKAQPEKVLAEMKQFRGRVIRSSLSPEQESRLQAALSGPEVSMPGSAEPAASSAADGTAAPDIGSSPQPPGGATGPTGA

SEQ ID NO: 3474 - protein, 108 aa, Methylobacterium sp.
MTRSWTAAVLFAGLTLTNLPASVRAEPAISPEARKSLPAAVVAYLDRRRECSHWSGEDAYDAARGRQIAAAVKRLRCDDIEADETRLRQRYGRDPAVRRALDGAAHAD

SEQ ID NO: 3475 - protein, 588 aa, Methylobacterium sp.
MRSRDQKKLAQQRCAEQLTRSIRGPFVFLFGMSGIINILALTGSFYMLQVYDRALPSGSLPTLVGLSILAIGLYLAQGLFDVLRSQILVRLGAQFDRRLAPLAQRVGIDMPRFGFSTAEAMERGRDVDTVRGFLGSPGLVALFDLPWVPVFLIFVYMLHPYLGALTVAGAVVLALLTIVAELLTRRWTGATQQAVVARNAIADSNARSAEVLKAMGFADRAVDRYRRANDEHLDLQTRTTDISGTFGAIARVLRMILQSAVLGLGAYLVIGGELSAGAIIAASITSARAMAPIDQAIGNWKVILAARTAFRRLKETVIALAAAEPPMPLPPARRSLRVGHITVAAPGTGRVLLSDVGFELKASQALGVIGPSGGGKTTLGRALTGIWPLLRGSVRLDEADLPQWDEASLGAMIGYLPQEVCLMDATVEENIARLAEDADPALVVAAAQAAGVHEMILRMPDGYKTELGPLGTALSGGQRQRIALARALYGNPFLVVLDEPNANLDAEGEAALAAAIQGVRLRGGIAIVIAHRPSVLAAVDLVAVIQDGKLTAFGPKEAILGKAARDSAARLDAAQDNRERSMPERVPA

SEQ ID NO: 3476 - protein, 315 aa, Methylobacterium sp.
MVLTRFGGPDSFELRELPDPRPGPRQVRVAVHATSVNPLDGQIRRGDYADQIELPATIGHDVSGVVDQIGSDVTEFRVGDEVYYTPRIFGGPGSYAEYHVADADILARKPVNLTHSEAASVSLVGVTVWEGLVERARLQVTETVLIHGGAGGVGAIAVQVAKAIGARVLATARGSDAALVERLGASAVIDFEREDYVDAVDRLTEGKGVDVVLDTIGRDTLSRAPRILREDGRVVTLVDTATPQNLIDAWGRNATYHFVFSRQSAGKLDALTRLLERGLVVPQVGLEFSLDDVARAHARYEEGRLKGKIVLRVKS

SEQ ID NO: 3477 - protein, 85 aa, Methylobacterium sp.
MSIRKVLVAAAALGTLMILEVPSHAQGFRIGPGGVEIDDGRGYREERDERRYRRMCRDLRDRCENKDIYGEEGQGNCRRYRRMCG

SEQ ID NO: 3478 - protein, 373 aa, Methylobacterium sp.
MNGHAETRITERNRVRAARMKAAIFVEPGRIVLDEKPVPDIGPLDALIRITTTTICGTDIHILKGEYPVARGLTIGHEPVGIIERLGSAVQGFQEGQRVVAGAITPSGHSAACLCGCLSQDGPDTKYGFKPMGGWRFGNTIDGSQAEYLLAPDAMTNLAPVPDDLSDEQVLMCPDIMSTGFSGAESGGVRIGDTVAVFAQGPIGLCATAGARLMGATRIIAVECVPERQQVARRMGADEIVDFSKEDPVDAILRITDGRGVDVAIEALGRQSTFEAALRVLRPGGTLASLGVYSEDLRIPLGPFVAGLGNHTIVTTLCPGGKERMRRLMSVVASGRIDASVLVTHRFGLEAIEEAYDLFAHQRDGVLKVAITP

SEQ ID NO: 3479 - protein, 311 aa, Methylobacterium sp.
MALHEALGRLDGARELRGFQTEPAQMRAGAPGKVGRLRLGFALRDGRSDLHDLYRVAPLLVQQALHWDEAMPELPVCPIISVGGGILQGDRYTIEIAVGEGACAHVSTQGANRIHCMDANYAAQHQSVTVSAGGYLEYLPDVTIPYRGSRFLSRTEIVVAESATLLYGEMVLAGRKHHHAEERFGFDLLSMDVALHRPDGRKLFAEKILIERGDPTIGFAAVMRGFDAFANILCVTPPETAARIKARFETNFSGEAPRAVSGVSRLPNAAGLMLRAVGVESYDVRHEVRRFWRIVREEARGRTLPAEPYWR

SEQ ID NO: 3480 - protein, 336 aa, Methylobacterium sp.
MPRANPNLLVQSLRGASQVFFMENAATGLLFFVAMAYASALTGNWATTIGAALGVLVATLTARLLDCDAPSVSSGLYGFNGILVGAALPTFIASSPQLWAAIVIGAAASTVVTAAFSATLTDKWGIPGSTGPFVLTGWLMVAAAYSFGRLHVTGDAPRLAADLVRGAAGIPGPADLVAIFFRNIAQVYLLGSAVSGAIILAGILIASVPAGIAAGAGSLVSLVVALAMGADPSAVSQGLYGFSPVLTAMAVGVIFLTPSPRVAVYAGLATVTTVFVQGALDALVAPAGIPSFTAPYVLTMYLFIAPKRLMAPHPHAPVADHMVGEGTPARPASPAR

SEQ ID NO: 3481 - protein, 412 aa, Methylobacterium sp.
MHGINAGDTAFILICTALVLMMTPALALFYGGLVKQRDVLSVMIQNFVCIGVVGVIWVFGGFSLAFGPDIGGTIGNFASYFGMYRVGIEPNPVYAPNIPFIMVFAYQMMFAIITPALMTGAFVGRFRFGAYLFFVAAWTILVYLPAAHWIWGGGFLAKLGVADFAGGIVIHTSAGFSALATAKYLGKRKLAEGQSESAPASLPLVALGAGLLWFGWFGFNAGGAYAADALAAYAFTNTMLAGSIAMLTWMFWEWRETRHPSFSGVLVGAVAGLATITPASGYVEPIAALAIGAIGATACYFAKYVQRWLRIDDTLEVWRAHGVGGLTGALLVGVLASPHINQVSASLAQFGVQLLAVTVVGAYAALVTFGILKGLDRFGTLRVPDAIQEEGLDTMLGERAFNLWNMDRTLPK

SEQ ID NO: 3482 - protein, 158 aa, Methylobacterium sp.
VALLGSQAALAKRVTVVPGDRPIAIDLPNAWKVSEIKRGIQAKTADDEVYLWFESYRPAQFQTLLDEHNAYFKGQGVKVVGTETAKQVDFPTYVLKVTEYPATYEGKPTVLRYLSVVPKAEGDRYLLVSYWASPAGDKQYDSEVQKILNNLAAAYDGK

SEQ ID NO: 3483 - protein, 163 aa, Methylobacterium sp.
MTLKDRPGATCAVRRLEPGDVPAMRALNALFGRAFAEPDTYGAAPPDDAYLADLLAKAHVAVLVAEEGGAVIGGLVAYELDKFERARRELYIYDLAVEAAHRRRGIATALIEHLQAHAARRGAWVIFVQGDPGDGPALALYERLGTREDVLHFDLPVGTPPLP

SEQ ID NO: 3484 - protein, 321 aa, Methylobacterium sp.
VLRAAVEASGEAIMITSAKLDEPGPRIEYVNPAFTRMTGYEAHEVLGRTPRLLQGPGTERAVLDRMRSALAAGEAFQAEAVNYRKDGTSYVVEWLITPVRETDGRITRWVSAQRDVTERHAYEERQALMVRELHHRVKNTLATVQAVLNATVRSSLSIPEFTRALSGRIASLARTHALITEDLAQAASFDGLLWAELEPYDERRRLTLEGPKVVLPSELAVPVGMALHELTTNALRHGSLADPNGRLHVTWWVEDDTAGRALRWDWAEHDGPPAEHPTREGFGHRLLNKVLAAQTGADVDVAFESDGLRVSIRMPLPGSAA

SEQ ID NO: 3485 - protein, 491 aa, Methylobacterium sp.
MTTYPAVRGAIPLSSLDWPAASAGQSPSITPTQLLAMLRRRRRLIVLSMILGVLGGAVFIAGTEPKYVATAQVIIDPRALRVVEREVTPSVDNADGQVASVENEMRVLRSSTVLGALIARDRLDEDPEFAGDPPGLLRRTKATLLDLVGLSPARVPDPRRAALQALERKIAVRRAERSFVVEVHVATRDPDKSARIANDLVTLYTEQASRTRAELTRRSGASLDDRLAELRAAVRAAESRVETFRSEHDLVSADGALTRDRRLRDLNTQLAAARARSAEALVRMEQASALRGRLDGLSEAVQSQAMIQLRYQIAEARRRRANLANVLGPRHPELNSVGREIDALQDQLGQELQRIGDAARNDYRRAKQTEEELRRTVETMSTTSLADDRALAELRTREAEAEAQRKLFSQYLVRSRELIEQTQVNVNNIRVIGAAIPPEKPTNLSKVIVLALGTLVGLALGILAAVALGVLRGEAATAARSPTGLGEAARA

SEQ ID NO: 3486 - protein, 721 aa, Methylobacterium sp.
MTIEIKGTKPGRDPADGAERYVSGSADRRSGAPYYAAIAVAAVAAYLKSLFLPRATLAEEVEPEAVAARADALRLVHSEEIAAPVSGRAAEAPRPLAEPPSPVLPSGMSLFDDGHELFSRGLRFAKPDPRPDLSDFKASPIIPQPINDNGGSLAAGSGGRGGGQTSGSGRPQDAGRPEPQEPGDGTKSPPGPHGEDKGDKPDQGTDGQGGSNPQGPTSPEGGVRVPPGSTPGGDPPSPDPTTPPRGRDDGATAQRNRAPVVNGPVQLGDVAGCALLTIALSDLLRGANDPDGDVLTVRDIRVSSGTVTADGSGWVFDADAPGPVTITYAVTDGEFSVARTAHLTVLERALIGGTDGDDLILGSPCADDIAAGEGDDNVDARGGDDLVEAGSGSDHVIAGGGADTVLAGAGEDVVFAGTGADIVWGGAGHDRLFGEAGDDLLFGEAGNDLLDGGEGRDILDGGDGDDLVLGGAGDDRLYGAAGDDDMSGGAGADVLVGDAGNDRLQGGDGADVISDGTGRDVVLGGEGDDLIVLVLDGQEDALEGGSGRDTLDLSDATVDLVVDLISETVSAGELGLDRIASVEAIIAGSGDDRFVVGDRDLVLTGGSGRDVFAFAGPIEPRDDTQVVQITDFSVGDYIDLIRYALFTDTTVGRPLADALQGGSDAPTGILCRFDRFEGRDRTLVSADLDHDDTFETTVVLDGEHALRFTPAPFTEPPTTHP

SEQ ID NO: 3487 - protein, 1255 aa, Methylobacterium sp.
MTMSTVIPFFRPASARQGNWSQQELAEFYRVEAALLRAGFSIASDHGLSDEGEPWFVFCRPDGDAIIHFAKIDGSYLIASEALDRPVRGTDFRTLIDQIARLHPHLLPIPATGTATTLVVHPAALLAALVAAAALSLSSEDAHAAPLVPGEGVSAAPASEGGRHPLSQPQPKASGGSGDRDTDRKQLEAIILSAMIFAAEAMAVDHRAVSAELDLDFAGGAGNAWSPTAQGDATLTPGTALGSGRGSVSVQPAVLTAQGSGANPDARPQSASDTIAAPSRVDPAPVARTEFAIETPKSPASQNQPQAPGFGSDVALTGTSAEVSAAKSSGHQASTSARSEGAAPTSDEPGPASRDQRAGSASASIAEPASHARPGHAASSDLVSTGSGPARPAWVNDLTQTVTSRMPSPEASRDADDRSHGRPAEAAFGSGRKVDPTGPGNGRVDGAGRDREPSAKAADETHQTKDQAAPGHSQAGSGQGRGVPAETATGNTPPAEQARPGQGPVDRADQDRGGMAAVGRSPNAEQAAPGPSQASARGQDPAASSAASQEMRVEQTGPINGQVNPAGPDRASSPEGASGNDPQTVPAGGGNGHTGGLARGEAVPAQAKAANGPPVEPSSRGSGNAGAIAQERGPQVETTTGSKPQIDQTGGGNDHASVVARQEAAPAQTEAGNLSPVGQTGQGSSHAGGVARDRPPQAEAAAGTNPRPAQAGPSESRADVSGPGSARAEAATGELPEAQQVGRANGQENANDQGSLRQSGAAPGNDPRIEPTDGNDGQGHGSHAKPESVAQREPGSGGPAIGRDRSPSDASERGATAQAEAAHLKTEQEADRGNGHSSAPAERSDQRMPEAQGPGATDTVSNHGRPDTPGEAPSDAASTIKAHPPLDSDSAARGSNKPSATELPGGGREPIDRAAPEHAAAAEQTPVAADVPAQKLTSPPSEHGRGNSIGPSADHASNAAASEQTNGDVAGTKEHGSGPNNTAVASSSNVHVGGAGPQASHAQDEPVSHGHDPAAEAPVPASVARDPILQDRGSDRAVAEHSVGHGASLGSDALDASAKAKHTQAETDGSHDSAGPVVVRAIPAASPQATVHGVDENGLSVPSAGPNLTSPSAPVSQDEIAAAQADRAQFDDSPSVSGRAVREAPGHAAPPVSADSPTVPSVPVEADRADGPSPTSQSSSTASHGTSGQAKPGRPSPPPAAIDADGNLVFHTDAQKDPVPSALPQGPDEATPHHAIGLIGVSDQAHSMHNLYHQT

SEQ ID NO: 3488 - protein, 39 aa, Methylobacterium sp.
MRHTLSPPPATPRDRAVPITLCVMILLECLILLVSLIWL

SEQ ID NO: 3489 - protein, 100 aa, Methylobacterium sp.
MHFTQRETDKLLIYMLAQVAQRRKDQGLKLNHPETVSLISVAALEGARAGKTVEEVMELAAKAITRDSVMEGVAEMIPYVQVEAVFTDGSRLVTVHSPIK

SEQ ID NO: 3490 - protein, 136 aa, Methylobacterium sp.
MSPAQKKAPVGGIVFGSGEIEINAGYPTTTLKVRNTGDRPIQVGSHYHFFEVNASLEFDRAQAFGKRLNIPATTALRFEPGDEKEVSLVPYQGKQRVLGFNGLVDGWVGDESYDDYRPRLADALDRVNRYGFKNKP

SEQ ID NO: 3491 - protein, 127 aa, Methylobacterium sp.
MGAQAVFVFIGGGFGAITREFLMLLIPQQSGAFPLDIFTANVVASYCLGAAFGLHRLGRVSDEFMLLVGTGFCGGMSTFSSFVFGVLSEATAPGQAGLAVLYGLSSLAVGYVAVRLGILSGKRLRRA

SEQ ID NO: 3492 - protein, 228 aa, Methylobacterium sp.
MILVEHKLGHLDDPLWQERARHARIDPLVLEQWEAPKSRLRKASESGIELAVSLPRAEHLHDGDVLHYDAARGLIVVARIALKDVLVIELEGLERLAPHEILRACFELGHGLGNQHWPAVIKGSTVYVPLSVDQKVMASVMRTHAFAHVKTRFAPGEEVAAKLDAKEVRLLFAGADATPHHHHGDHGGAHAHDQHEAHLHPHDHPHGHDHGHANGHAHTHHHRPGPVA

SEQ ID NO: 3493 - protein, 226 aa, Methylobacterium sp.
MAHLARLLQWSDSTLPVGAFAFSNGLESALQTGIVRDADSLLSFVELVLHQTARVDGVALLHAHRAALTGDYPGLVTADQELLCRRVGEEQQLMLTRMGKKFAELALRIAPSPMLARWLAEIRSEATPGCLPVGQAIALAGLGADESEAFVVHQYGIASMILSAALRLMRIDHFETQRILFTAQGRVEDDYRAVHDLALDEMAAFAPVFDVLVAHHTTVHVRLFMN

SEQ ID NO: 3494 - protein, 230 aa, Methylobacterium sp.
MKKITRIGIGGPVGSGKTAVIETITPRLIARGIKPLIITNDVVTTEDAKQVRRTLNGVLIEEKIVGVETGACPHTAVREDPSMNIAAVEELEEKYPDSDVILIESGGDNLTLTFSPALADFYIYVIDVAAGDKIPRKNGAGVCQSDILVINKRDLAPYVGASLDVMARDSKIMRGAKPFLFTNCKTGEGVDDLLQLILDLALFDLAPVDQAPVDQAPAGGAADRPLAASA

SEQ ID NO: 3495 - protein, 139 aa, Methylobacterium sp.
MHGPATAAPYNAIMGLPDSELRLLGVAAAVGGLLVMMLAGQPSAASLGWGCLGLLLFGVSRLMPRPRRKARPAIVPSTVATPLEGDAPAGSASEDAPAALPGDLHAVLQRKVRVQRPINPIIASSLLPPSRASRSPSTN

SEQ ID NO: 3496 - protein, 83 aa, Methylobacterium sp.
MQRDPAGASAEGLSMRTIIEIDNGSAMGIRNGGQEVADLLACALMTGSDAAWDKLRPDGILCLVERHPTEPAKVVGQREIAVR

SEQ ID NO: 3497 - protein, 56 aa, Methylobacterium sp.
LNSAVLSLWSAYWAAIFAQVAYLRVLDDGVGVGAFAWISQGFLAVGFVFFLLAKLP

SEQ ID NO: 3498 - protein, 131 aa, Methylobacterium sp.
MAMGVQAEATIESATRVKRRRGGTYYKLDLSWTDASGLKRRVEEVSISHALADKLIVDNRLAADTLPIKYMPGEAGSPKESENVVVLDDTAYQEKTDREIVYVGTGAGALGLIGAALFFLPRRRRHEAVAA

SEQ ID NO: 3499 - protein, 131 aa, Methylobacterium sp.
VHALMKPIDIMWVCLGGGAGSLLRWWLGGVIDRAIPARFKFGTLLINVTGAFAIAYLSAAFALGWQQRHGDMMASLVLTGFLGGYTTFSSMQLDTAQMAMEHRHALAALYLVASVGLGLCAAAAGVALARA

SEQ ID NO: 3500 - protein, 102 aa, Methylobacterium sp.
LSAGLVQAETSTGKSADKNQEKLASKPLEKVTCEEFNGFEDTFKPKVVAWAAGYKQGQKKPDVVAIDIAGVEKVTPLIAEECRKAPSASLWSKIDGELKKVF

SEQ ID NO: 3501 - protein, 172 aa, Methylobacterium sp.
MPVIAAVVGAVMTGLMYYFIYGNGMEQLDRFLGDRRNAKLRARSAAAFRAAPLRAIRDPADAAGVLMMLVALARGTPTPEQETAIEAEMRKVTSPDDDHGTRMAYIRHAAAQASDADTAVDHLAPLLREKLDDAERDELEQMLEAVAVIHGGPIEAQEKLIARTVRVLAEQH

SEQ ID NO: 3502 - protein, 519 aa, Methylobacterium sp.
MQRLRSPRRLAPIVLALGIMSGWPGSACGQVITRAQVEANLPALEALAQRAIAAGDVPGLAIAVVHGDETLFLKGFGRREAGKPDPVGPDTVFQIASLSKPVTSTIVAALVGDGVVDWDSRIADLDPAFRLHEPYPASQVTVRDFLNHRSGLPGLAGDDLEQIGYGRDDILRRLRLVRPSSSFRAGYSYSNFGFTEGAVATAGPTGQSWDVVARERLFGPLGMTSTGTTYEAFLTRVDRAALHVQRDGVWTSGIRRDPDAQAPAGGVSANARDLARWMRLVIGNGLFEGRPLVAAAALAQTHGPLTARGTNPVTGGASFYGLGWNIEYGRHGLVWGHAGAFSVGAQTLVSIHPDAKLGIVLLTNAFPSGVPEGLADSFADLVFDGRIGKDWLRDWGETYGTMFGPSAAANRAAYAQPPANASASLPLSAYTGRYANAYVGDAVVAEVGGGLSLTVGPGGARTYPLRHFDRDLFLCFPDAEAPDNPSAIRFTVGSGGRAHAVTLDALNANGLGTLDRSGE

SEQ ID NO: 3503 - protein, 455 aa, Methylobacterium sp.
MKPADQPAPPWQQARFVAVALIVGALTGVFGGLFHLAIDRIIDWPAWLAGHTEGWRLIAASAAITMAATVFAVFITRRFAPEASGSGVPEIEGAIAGIRHVHWERVLPVKFVAGIAAIGSGLVLGREGPTIHMGGSAALAASEMFRMRDVDRRALLAAGAGAGLACAFNAPMAAVLFVIEETRKQFPYSFRNYMGVFAAAITGTAVTQMISGARPDLPLSAGPADLASLPAFAVLGILLGAVGVLFNRCILAMLDIAAVWQKHAPYVWPALVGLLVGTLLILAPRTATGGEQVISHIAVLTPSAGVLLILAVARLFTSVVCYSVGTPGGIFAPILSLATCIGLAFGLFAQMVFPEVLSGIGVTPVSFAIVAMAALFSATVHAPAVGVVLVLELTTAYALVLPMLTACLAASLVAQWLGGRPIYGQMLERALARAGRGPGNDSEIGLAAAPDRAAN

SEQ ID NO: 3504 - protein, 34 aa, Methylobacterium sp.
KGLMAAPVLVDLRNVYAPTEVERHGFAYSGIGIA

SEQ ID NO: 3505 - protein, 390 aa, Methylobacterium sp.
MSLPHSGPIDGEFASLNQLRFSPPIEALFEKAGLPQRIELGRTTLAVAILLYDVFLLADWVILPDVLWPLTVMRLGIATPLALLTIWTLPRSRCVWQVDGLLVATSVLSVLMPSTIISLGTSNYVAIYQFGAILIIIYLVLVQRVRFRLAVLGLVLIVLIQVATIASRPEVDAATFWYIVSFYILASVILLLGSFVLERTERYGFLQRLRADSMIEHNEAMARTDQLTGLFNRHHLATIGADLIPKSDAEPLGALLIDIDHFKRFNDTQGHLAGDRCIRAISDLAREMLAPANENTPPLGTAVRFGGEEILVLLPGMSAAQAAALGDAIRRRVEGVRIPHPGLGPAGVVTLSIGVADWKNGDTELDALVNAADAALYRAKDLGRNRVMVA

SEQ ID NO: 3506 - protein, 333 aa, Methylobacterium sp.
MPKTSGSLQVAGTDAAVAREGRFVPSPPAPSQFQRFLPEIAHRTSGEILIHPDFHRMRRRYIASTMACYEIATFPGGWQSAAYRVAIISAIICLHAAWDPADRATWPTLARLKEAGASFGLSSPRQIDDLIARLVETGHVVLERPAADGRLRLLVPTDKLLAWDRVLLSAYYGVLQELYPDPGYGPAVTRDPAFHRAHRRVAVGMFDVIGRFIAQNGDIVPFLQMYQGFQVLVRVILLREEDAQAAIRESDFSDIIARFGVSRSHVRNILTAAEAGGLLTSAGRGLKDLAPTARGLAAVDRFIADTLASHDMTYRMALASLAAEPARSAGTAS

SEQ ID NO: 3507 - protein, 150 aa, Methylobacterium sp.
MNHALVRVSDGVDWQVYHAIRRSSLWQERGLTGYDDARPEERLPNHHSLLLKLDGEDIGTTRLDDLGDQTGIVRLVAVTARQRGRGHGRVLSAMVEDYARKLGLHTLFVSAVLDAEGFYSATGWARVASGAPPLLGHADSFAQMRKRIVP

SEQ ID NO: 3508 - protein, 46 aa, Methylobacterium sp.
VDSGTMTGFLVAGAIGFGLGWLVFGQHSYSGDYVARGMSRSSARDY

SEQ ID NO: 3509 - protein, 52 aa, Methylobacterium sp.
VTAQNDRPQSETEPKPVGDPPPAFQPPAGDPPAPRPDAIPEEDLEEVEEQPS

SEQ ID NO: 3510 - protein, 208 aa, Methylobacterium sp.
VKVETATDAEGRQITCTRYPDLVVRESDTDTPEPGDAALIPIRGGPPVDCRAAPGINARRLETGAQRFIGRADGFLVFEDASTNGTMPFAVIDAGTGRRLFTDTTTYDGIDRFAAEGPTLRLGFRRGVQGACSIPKGGAACWARIVREEKIPAPVATLPVPAKACAEAYRAGKAPRDTPSIVSFPVRLVWSGSLTVEADGPVRCLPTP

SEQ ID NO: 3511 - protein, 655 aa, Methylobacterium sp.
MAGAHPGEEGRDFTVEADASAAYWHHRPDNTLPPPDMMGAYMRNRPVPDQRVEELRAWIIGSGIAGLAAAFYMIRDGGMKGEDITILDALSVEGGSLDGAGNPQEGYIIRGGREMNWNYDNLWDMFQDIQALELPEGYSVLDEYRLVNDRDPNYSKARLMHQQGQIRDFSRFGLTKSQQWELIRLLLKRKEDLDDITIEQYFSPGFLETNFWFLWRSMFAFENWQSLLEMKLYMHRFLDAIDGLTDMSALVFPKYNQYDSFVRPLVNHLQARGVKVRFGARATDLAMRVEGETRTVTGIHIRADGKDEVIPVAAGDVVFALTGSMTEGTAYGDMDHAPVLERGRHDPGEDSDWTLWRNLAETSPIFGKPVKFYGDTEKSMWESVTLTCEPSPLVERLKELAVNDPYSGKTVTGGIITFTDSNWVLSVTCNRQPHFPEQPKDVLVLWAYALLMDKDGNHVRKPMPACTGREILNELCFHLGIADQSEAVAAKTKVRLALMPYITAMFMPRAAGDRPHVVPKGCTNLGLMGQFVETANDIIFTMDSSIRTARIAVYTLLDLKKQVPDISPVQYDIRNLLKAARALNNNEPFPGERLLHRLLGRTYYAHILPPLPDLEGPHRGSAQLEMKHLLSMRRQALNAISTSFEQIRGHLRPPR

SEQ ID NO: 3512 - protein, 97 aa, Methylobacterium sp.
MPIKTIALAAALTFAMAGGAFAQSSTGKGGTGGTTDSASPMRNNTGDSMRPTTGTGAGSTGTMAPGATTGSTTGKAPGGTMGGGAGSAGGGNSAAGR

SEQ ID NO: 3513 - protein, 695 aa, Methylobacterium sp.
MKDGLSLLPTGTGSSAEQPSARTEPNPVRAKILIVDDDRRNLLAASEVLADPAIDLVLANSPEEALRQALRMDFALILLDVQMPRMDGYEVASLIRSRSRTSRVPILFLTAHNKEDIHIFRGYSAGAVDYVFKPIQPLVLKSKVDVFVDLYLKTAEIQRKAAAEKQLLLENLRVRGEKLAAEQALRRREEHQAAVLRGLPIALYTSPLSGDDRRLHFTNDSIERITGFSREAFAASNLWGEQLEPDDRYRISADLSTISEAGAVTLEYRWRNADGRERHILDQIVINCHENGTPVELFGMWFDVTERKELELSLQHASKLEAVGRLTGGIAHDFNNMLSIVIGNLDLVKSSLLGNEKALRRVDSAIEGAHRCAELTSRLLAFSRRSPLQPKALDFTSFIPGLIKLLERTLGERIAISADLEDGLPEVCVDHAQFEAALINLAVNARDAMPDGGGLGIRIKRHEAVAQEGSEPLHSVEIAVTDSGTGMSPAVLARVFEPFFTTKEAGKGTGLGLSMVYGFVQQSGGTIAVDSNLDQGTRFVITLPVLAGRSFPSEEIDPGDAPGPLNSVNGAGGAVLVVEDDADVRFTVVSTFEALGFKVFSAQDVDEALSLLQTESNIVLVFSDVNMPGAMNGIELGHIIRQQWPDMPILLSSGYLREDQDTNGFSLLQKPYRSTELVQALRGLLSNAQGTMPLE

SEQ ID NO: 3514 - protein, 166 aa, Methylobacterium sp.
MEDNTSPDLLMMTADIVAAYVSKNAVRASELPNLLVQVHGAFVSLSTTPPVEPGSEIEKPTATQVKKSITPDALISFVDGKPYRTLKRHLSVHGLTIEGYRARYGLPSDYPSVAANYSATRSALAKQLGLGSQRKKAEPAPEPVPEPTPASKPKRAGRTRKVAEPA

SEQ ID NO: 3515 - protein, 82 aa, Methylobacterium sp.
MAWDIRTTTRSGDARLETVALLLAAVTALVAIARSDAVSRSVDPPAATLRPATAAAPVPTAPTEAEAEAARQASLRDMLLHD

SEQ ID NO: 3516 - protein, 143 aa, Methylobacterium sp.
MTIAEKIEQRLTGRPNSFVPAHTLQRLLGRSQPDRDDIMMNWAMHWGQGIALGPLRAIMAEHGMRGSVASFLFLNARLFNDQALENVTGAGAPPWTWPLDEQRVDLLHKAVYAFVTGYVADRLATGEVRSREHDRAFYNGGDS

SEQ ID NO: 3517 - protein, 59 aa, Methylobacterium sp.; identical to SEQ ID NO: 2709

SEQ ID NO: 3518 - protein, 165 aa, Methylobacterium sp.
VIALGPFRVPGLLGTILLAAGAIPGLPTAWATDQGTTKEKGSCRLTLDVPDGFAAQPRGKGVVLRPIGQASRRAVFEISLTPKSGGDPASLSEIRTLGGTYVRYRVTRLTEGSGGEESTLVAEKPGAGGVIRLEAWTQRDDGAEPDFEPAWRALSAARCARADPR

SEQ ID NO: 3519 - protein, 98 aa, Methylobacterium sp.
MWRQGDIFIRAIPAVPQEAVARPLPHTVLAHGELTGHSHRVVDPAALFAGDGCFYLDVRVDQARVVHDEHGTITLDRGVYRVWRQREYTPQRIVTVQD

SEQ ID NO: 3520 - protein, 185 aa, Methylobacterium sp.
MCAMKGVVFTELFRHVEAQHGADMVDDIIDAAQLPHCGAYTSVGSYPFQEAVALLVALNKATGKPLPEILDGFGMHCFNRWVSYAPHYFTRQRGLFDILEGIDNFHETEVRKLYPDAELPSFLSESRSDRQLVLGYYSCKPLSALAVGVIKGAAAHVGQPVHMACEPAVGERGAYTRITLTLLDA

SEQ ID NO: 3521 - protein, 857 aa, Methylobacterium sp.
MSSKTAAPSAAKPVPRRACRARCKRAGTSPWPLPAPADPSGGDRSEPRRQRPARRFFAAFLIGSAFAASDAVRAEQAPSPAPSSSASSSTPSSEKASGDPVGPGEACDRAIALPKEIEAVTPDRSILDGVTEGRNAALEAAATVCAAAEPAEAGASYRLGLAFKALKRKDAALAAFTRAKERNYPGGYDAIAEGRFDGLYGPALPKDPSAGLAVLSEGVARTGHPELKRYLARNLASAESPLRDSARALTLLEEAARAGHAPAKADWARRIAEAADGQPAPDEARIRSLLEEAVASGSRYAAFVYGQLHDRGIGLKRDLAAARRFYLLAAERDSIAAMLELAGMMRDGEGRPVDIAGQRRWLLRASGLGNATATFALANSHIDNAPTNVTLGLVLLERMAEGGSIEAAHGLGVRYQDAGGVVRDYALAMKWFRRAAEAGDGRAMNQIGTIYDYGQGVPVDHAEARRWYDRAAAQGVAAAYTAIGMQYDHARGVPRDLAEALAWYRKGAERGSAASMNNIGYAYMAGRGVTRADGQAVRWLEQAVAKNDRTAKLNLANLHFKGRGVKKDPIRGLTLLQEAAEQGLPQALNDLALMEMERPQPNGARAVRMLRQAAVDGAAVAYHNLGMALIQGWDGVPDDAEANYWFRQSIDNRSDIDAAAYSESQFQLGRNLVAGRGIARDVEGGLALIRASAAARNPRAMSFLRTAGQARAAKSKGGSSASVRKAGAAKEGACRAKGAALRHPPERLWPPSPTRGAAPRRACAGGSDRRPQPAADADGAAARDGAPVARPAAPVPAPRRPALAAAGPRPARRPPDRRGRGASRRGSAQPSSASGSTARLPRAAPSRRQPGRGGDSG

SEQ ID NO: 3522 - protein, 76 aa, Methylobacterium sp.
MVWIDEGAKLKQVSEWAGHESPEFTQRVYGHLFDAGRTDRRAATAGELSVLGVPETATQAQHGNDNTQIIIAASEI

SEQ ID NO: 3523 - protein, 307 aa, Methylobacterium sp.
MRAENLSIRRLVVGGLVCATLGLSGCVAIGEREPLNEAPTVTETSPTGLNLELLPPPAKAVDLAVYSFPDLTGQNKPSDNFAEFSRAVTQGGAAFLVDALRRTGGGRWFRVVERGSLANILQERQLIRATRQEFDQDQATPLPPIRFAGLLVEGGILAYDANFVTGGIGARYLGIGGDIRYRRDVVTVGMRIVSVQSGEVLTSVTTTKTIYSIGLATNTFRYVAVNKLFEFDAGVTRNEPTQFAVRESIELAVYSTLMEGARKGLWKFRDPAIGQRLLQEYIERDKPLPPVSPTTEVVQEAVVVAKN

SEQ ID NO: 3524 - protein, 368 aa, Methylobacterium sp.
MASLMLPALEQALGALVMGLVLADIFLTVLYARIGTGLIADRVAHLTWAIFRRAADQFGQRRDAVLSFCGPVILIVYVLLWAMGLTLGAGLIIHPALGTAVRASTGETPADFMTALYAGGSSMAIVGASDFKPVTNAYRVLYLVNSLVGISATSLVLTYVMQVYSALRQRNALGLKLHLLAGETSDAAELLARLGPQGQFSSGYSHLADAAASMAEMKEAHHFYPVLFYFRFRQPFYSVSAQAFIALDTVSLIRSGIADRQAAWLKETAAVDAIWRVAILLVVTLETTFLPGDLPAPADVNNAESESWRARFAEALRRLSAAGVETMPDGAGVETYLTLKAQWQPHIARLAPAMAYDIDEFEPGDQKR

SEQ ID NO: 3525 - protein, 448 aa, Methylobacterium sp.
MTATSRPATGLPVANPAVAGLRAASILSGFSGQRWRLAFVVFAVMMCVNAFYVVFLGSNNEVGNTKTLMPSNRNNLLYVGLWLTLYALSVCVILRDVLRNGIDLCLIAVLPLAGYILLSTCWATDSWASLVPAGMLVLNIAIAAALASIVHPAVFLSLFAWTNVFLVASSLVMVVVMPDAVRTDITRPGLLMSGELFGAYGSKTLHGMSAASAMLILLFLPGASPRGLRVPALGILALGLILANSASSVSAIAVAGVTLLAARLLPGCGRVIFATVTGFAILLSLILPFIGVGDIAVALGRSPDFTGRSKFWPYALEVFRDRPLFGHGYLSFFNTDPFSKAWTVWEREMYFFTPDFHNTFLDTLVGLGLVGGAFYLVLLFSSSCIFAHPSLERSTAFLLSALLITFILNSATNYIFLAHNRMSTIFQFYCLFVLCRRYKPRRPQPALA

SEQ ID NO: 3526 - protein, 147 aa, Methylobacterium sp.
MKTRFLAAGVLLALSAGPVLAGNLIYQPVNPAFGGSPLNGGWLQSEATAQNIPQAREQRLNQLFGTQGGRNGLNLTQGQLFAQQLQSQLFSSLANQITRAIFGENAQQNGTFEFQGTTINFAREGANVRIQIFDGQTTSTVVVPAGP

SEQ ID NO: 3527 - protein, 355 aa, Methylobacterium sp.
MFDTPADAQAQLAQQLTRPQVAMVVEALVPTLVFRPQPKGKANLGGTRIGGTPDLPPGLAWPRRAKPADIEAIAKRGNAEAGEEMRRHFRKELPYAFFAQVDLGEAKEKMKGQGALADALPGHGRLLFFYDLSAGPWDNGTESARVIWDESPREGLAAHVPPPDLAAAAEDHRAEIAKVNREFKLPLPKPDSGTPYGGPARPMSLHAILRPPAIESLEMETRPALKAALALRSDGEESFRDAYEDLFSRAFDTYHGAANAGRRNQLLGSPLPEQSDPRFEAEVVSRFGVQHLSQDQWKAHRPEIEAGARSWRLLLQIDVGDFLQENGEGTVYFLIRASDLSERRFERVVAVYQQT

SEQ ID NO: 3528 - protein, 810 aa, Methylobacterium sp.
MTTMRLTGYADKFGVHPGDTIQFYVNCDGPSEYKVEIVQMINGDTNPRGPGYIDKPVEAAVNGTYAGKKQIIHGGSYGYVPDAKPFHVESFTLQCWIWPTAPKTHPRYWKHGPQGLVTKWSNECGYGLFISEEGCLELRINEHRITTGVPIRDHAWHFCAATFDAATGLVTLIHEPQVVYALDPEIAPVEARLKVAIAHAPVPLALGAYVERLAPEDPLAASSKPTGVIFAGKYNGKLDSPRLCNRALSRAEIEMMKAGAQPGLTERRNAGPTGKLSECIVAAWNFSVGIDTLTCKDEGPYRFDATLVNCPNRGMTGYNWSGQNFDWKHAPQEYGAISFHDDDVDDARWSCDFAWTVPETGVKSRFYAAKLTTPEGDEEFIPFWVVPRIGQETAKIAVMVPTISYMAYANEHVACNAGGAELFVYRVPIMQQQNMFLSEHREYGGSIYDTHTDGTGISISSRLRPILSIRPKYDHFLAQAPWQYPADLHLIYWLETMGYEYDVFTDEDITYDGLARIENYNVIITGSHPEHNSGTQLDALHNYTQRGGRLMYMGADAWYWVHSFHPAYEDKGRGVVTEMRRCESGIRTWRADPGEYYHQGTGELGGMWRFRGRYLHSVAGVGMSSEGFDVSSYFSRTPDSLDQRVAWAFEGIDYDEKLGNFGLVGGGAAGLELDIVDTMLGSPPHTLTVATSAGRHTEAYLLVMEDFGFNQQGLDGTTHPRVRGDIAYHETPNGGACFAFSSIAYCGSLPWNNCDNNISRLTKNVLDRFAMDGPLPAPPDSAIKHRGRADYDPTPMEHRSRKERGEPLPA

SEQ ID NO: 3529 - protein, 108 aa, Methylobacterium sp.
MTAYSVQQIKFEFISYVKEFGADFSAWSVGVAEDAPAALFHEHGVDEARDIWLWKPAVSPAAAAMVRDWICGRQGATALVGEGRQVFLFRRGSVAASGVEGTAGTRFA

SEQ ID NO: 3530 - protein, 328 aa, Methylobacterium sp.
MRVVAVSRVLDEVDIIEAFIRHAAAFVDHHIILDNGSRDGTVEIIRRLAEEGFSLTLYQTPSICFSERDMNNWLYNEAVDRHDADWVACLDSDEFYDERHLPGGLRAYLQDLEIAGENVVAVRIPWAHYNYRTRDDATESLVPRRITHRTEVVAEGKVIASWRLAKEKGLVLEGQHDVSLPEGSRSTVVTEQRLRIAHFSVRNAAQYVTKVVRGWAKILTAGQACVNRGFSDHYRGPFELLRDHPEKLLRSEWILEKENEDRCIIHDPIEYRGGPLRYTPPNDPEMQSVRALLGFLSEVCTRYGELTDALPVARAYSERIERRIDRLI

SEQ ID NO: 3531 - protein, 261 aa, Methylobacterium sp.
MVNPDRAEQTGRTARQAPELLCYPEYEGAPEIIAGRSARDWMDATAQRFAYRCTPLAIANATGWEITLPFSFSATWNGGPLVSDVWTFLEGWDSRYRQVVSSVFGNGVLTFHPGWLFRTSPGWALIARGPPNTPRDGIAPLEGLVETDWLPFTFTMNWRFTRPGTVRFGKGECFCFITPVPHETYDTIRPRIRSLDDDPDLKAAYDDWRSRRSAFQARVAVGEPDAIRAGWQRDYIAGRDPTGSAGPAFHRTKRVLPKPVR

SEQ ID NO: 3532 - protein, 64 aa, Methylobacterium sp.
VRTNEVETLVEQYLERLQGIAVAVLRQAVADVLMDAVECRQRIQAAERAASRGFMRQLPAAAFE

SEQ ID NO: 3533 - protein, 221 aa, Methylobacterium sp.
VLDLATGTGWTSRVVARRGAQVTGADISADLLSFAAEQARAEGLDINYHLGDAENLPFADGAFDAIISTCGVMFASRPEAAAAELARVCRKGGRICITTWLSDDNVFRMFMVMKSYMPPPPDPAPPSPFEWGRTERLEELLGRDFELAFENGVSFYRELSAEAAWERFAGGYGPTKALAASLDEDRRADLRRDFIAFHAQFSTPFGICVPRQYWLTHGIRR

SEQ ID NO: 3534 - protein, 529 aa, Methylobacterium sp.
VAALAAALLAGASAGQARTLVYCSEGNPESLDPGLVTTTTAMSATWQLFNSLVEFAPGTTDLRPALAESWQVSDEGRTYDFTLRAGVRFHAQPGFTPSRALNADDVLFSFLRQWKPDHPYHGVGGDFAYFRDLGLAGLIKGIERLDERRIRFRLKEPDATFLPNLAQAFGAILSAEYAEHLARRGTPEVLARAPVGTGPFRFVDYRPDVALRYRRFPDYWRQPAEAGAGAVDALVFSITPNTAVRLTKLKAGECHVMAFPGTADLEAVRADPDLTLVSGEELNVAYLALNTARPPMSDPRVRRAVSLAIDRRAIVEAVYGPAGTVAHNPLPPTSWAFHSELPEPVFDREAAGRLLAEAGFADGFETDLWFLPVSRPYNPNGRRVADMIRADLARIGIRARLTTRDWTAYRAALYGGEPTMMLYGWTSDNGDPDNFMNVLLGCRAAAPGGANLARWCDPAYDAAVQAARRTDDRGIRTRLYRDAQARFREAAPWVPLAHTVVHMAVRRTVNGFRADPLGRTLFEGVTLAE

SEQ ID NO: 3535 - protein, 353 aa, Methylobacterium sp.
MRPILPMPVLLAWAVLLCGGTYVVTARSDAATAIDGPSQQDITALKERFRRPDGVPHPKANPATPEKVTLGKALFFDPRLSRSGSVSCATCHNPSLGWSDGLTRAVGFGMVLLPRRTPPVRNLAWGAAFQWDGRADSLEAQARMPITAPDEMNMSMDLVVERLKAVPGYAPLFREAFGGEEPISARNVTAALATFQRTLVSGKAPFDRWIEGEEAALGADARRGFALFTGKANCAACHSGWRFTDDSFHDIGLKAGDDLGRGKFAPPSVTAMRYAFKTPSLRDLRMQGPYMHDGQLGSLDAVIEHYVEGGERRPSLSFEMKPVALSAQERRDLTAFLESLAADPAALTLPHLP

SEQ ID NO: 3536 - protein, 327 aa, Methylobacterium sp.
MQLFVGCLALAPAGAQSLDAVKADYKRPTHIPFPEDAPYSPQLATMGKMLFFDPRLSGQQNLSCASCHNPSFGFEVPVPGAIGATNKPLARKAPSVLNAAWIPTLFWDGRAPNLETQAMGPITADAEMDGKFPEIIARLKRIPEYKTSFDALFPGKGVTQDTILTAIATYERTIVSGWAPFDRWVEGDEAAMSSEAKRGFALFTGKAACSGCHTGWNFTDNKFHDLGIETKDIGRAAFDPDDRYAKHAFKTPGLRNLSYRAPFGHAGQFADLDAIMAHYESGGLPRPSKSPLMKPVDLTPSERADVIAFLRSLTADQTETALPNLPN

SEQ ID NO: 3537 - protein, 119 aa, Methylobacterium sp.
MNRPTGSIFQEAEPPAGADTVVKFRGDSVRFLNPQGQWVRITYECDYDTAGRSVRGVKVRVGRIDGKGVNTSAAALPAGSGSAGRGQAAPAPPQAQVKRPRPSEPSEVEIRQVAPSAGR

SEQ ID NO: 3538 - protein, 290 aa, Methylobacterium sp.
MRGLLARMAPALAAVALVASPSQADVRARAAVLDLTAPAQTVASTEPQSAGMIAIVEKITPEAPVSAFATLIAQAATSTGVPSDFFLRLLKRESGLNPMAVSPKGALGIAQFMPATAAERGLADPFDPVQAIPKAAELLRDLRQRYGNWALAAAAYNAGPGRVDAWLVGRLELPKETVDYVANITGVNTQSWTSAYRPAGPGWPLQLASLAPPIPLFSVASDATQIRISDRRETGTNAKRGTKPADGTGAPLTTAQLRAAAGGVLRSAGASNPCAALLNSAAQCLNFSRY

SEQ ID NO: 3539 - protein, 348 aa, Methylobacterium sp.
VSLVAFWAAFQGILEPAGACSRFVYLGQDGKIFTARSMDWAKPIGTDLYILPRGMARNGEVGPDSIRWTSKYGSLVATALGNSTSDGANEEGLTANVLWLEESQYPPFDGKGPPGLAISAWAQYALDNFATVDEAVTALEKQPFTLVTSVIPGSQIKANVHLSLSDASGDSAIIEYIDGKQVIHHGRQYQVMTNSPTYEQQLALASYWSQIGGTVMLPGTGRASDRFARAAFYVKSIPPDGDLDQLLASVYGIIRNISVPLGLSTPDKPEISSTRWRTVFDHKRRLYFFESALSPNTFWTDLNQIDFSRESGKVLKLDLGVDQANVFAGNATGAYRPSEPFPFAGLPR

SEQ ID NO: 3540 - protein, 140 aa, Methylobacterium sp.
MSLRGHGRSWGAERIRDWGLADYVADLVEVSGRIDGPVVLVGHSLGGAIVQKFIQGGGQAAGMALMASVPPWGLAPSAIRMAARSPGMFAVLLEMSSGRHPPDDKALLRRMLFSPETVDDELDQFLSRVGPESPRLGSEL

SEQ ID NO: 3541 - protein, 227 aa, Methylobacterium sp.
MSMSLAQPLAPAPVLADGVAAFEAHAYDWALAVFRPLAEAGNPEAQAWLGALHAGGTGVPASLTKAFEWYRRAAEQGHGPAATNVGAMLAMGQGVAQDRAEGARWLERAAAGGDVMAAYNLATLLAKGDGLSADPARAAALYRSAAEAGHYPSQARLGHLYAQGIGVERDRVEAFAWLSLAAGHGVGTALNALEEVIREMSAEEKREGAARAQARRSEPGRIAPIPA

SEQ ID NO: 3542 - protein, 240 aa, Methylobacterium sp.
MSSTLQDRTVVVFGGTSGIGLAAARQAKAAGAQVIVVGFNAEGAEHVAAENGFAGWRAADVTRPETVAAALADIPHVDHLVLLAGTFVAGKVLEAEVDYLKRAFDERIWAAVHTLRALGGRLAGDGSVTFISGALADRPTAQGTAVLAAASAAMEALARGLALELAPVRVNTLSPGTTDTPLLARTLGAHRDAYVAALTEKLPQRRLGTAEEAGAAVLFLMSNGFMNGETLHVDGGARLV

SEQ ID NO: 3543 - protein, 537 aa, Methylobacterium sp.
MAAIQGPYAVLFLACQFLAVAITIFGFIAYAWMPLFGRDAVIGSIALILVACSIGHAIPLRRIKVLHGVVLILGVCAGLAAVAGLTGGSSGPGVPLSSFDQRFYGLVLPSLVGFLLGPWMDVQQWQRAVEIHREGASVRTAYAIGAVLFVGLLTINALLASVAGLGEPVVSFDGLPGAYAAVAQATERTHLAGVTAAFLIWTVVAAATTIDGFYSATRWLMTAITTRSNSPLLAFVPASMVSSPIWILMAAFTAAVVAIQLNLSLMYLMVPFATLLVGGGACLVCETLGASRRYDPVLSYMIGLAASLVFLTGYIEPNAAYLALAPVIGLVGALPMIAELLGFSDRPAASATPAPVPADEPAARTVVVAVPRDEAIASHGFDGEWFTLNLTPTYDDTNSVGNVYFANYVRWVGKARELFFNTCMPDFDLKSTDFYVLTKSFQHDFRREAAEFEPITVRVRIASHNRKFVTLAHEIHSGINGLLGRGEQSLMFVDTVQYRPLDIPRTIIEGFLPYWPKTSPHATSTVPSPLGAGSISV

SEQ ID NO: 3544 - protein, 102 aa, Methylobacterium sp.
MAASLTVGDLFKAKAVTDEQVNAAVERYLAAPETSAHPIAEGYTVDLAAAVAGHGWASRVAANPRTHPLLKRAAVQTAILLARARKARTASRKARTDPPAPR

SEQ ID NO: 3545 - protein, 436 aa, Methylobacterium sp.
MDFTRRKLLKQSSLAAAAIAAPHLWLPTAREAWGATLKKGEPIKVGLLFSLTGQLAVPEEDSTLVMQYAIDEINKNGGIAGHPIQPVIVDAKSDFNVYSEKAKELIIREKVIALFGCYTSASRKAILPVVMSQNSLLYYPTCYEGAECTQNTICTGPLANQHSKDLIPYMVKNFGKKVFFVGSNYVWPKESNKNAKIWLQEAGGELVGEEYIPLGSSEFGPVLGKIRDAKPNFIFSTVVGASDIAFHKQFKQEGFKVDSMPIASLTTGEIETKAMGAEFGAGHFLSAPYFQSLENPTNQKFVENFLKSKYGKNGSTHYNMEETYLSAYVFKAGLEAAIKKTGNVEEITSRMIRDVSGGVRVEDDISPEGLIWIDGDNFNSWLKPKIGQCQADGSFKIVSEAKEHVAPDPYSIYPNAGKCTAAGLVAPDGKSRKNVI

SEQ ID NO: 3546 - protein, 362 aa, Methylobacterium sp.
MNEFADGVSVAVAVRLGGTLQIGTNTVEVLDLLVVFDAIRRTGSIKGLAETLGLSYRAAWARLQAYEAALGQPLVRKTRGQGSELTEFGAALAESFTSAIPGLDASLGRETRAIEHRVRRLLTGRSGTLRLAASHDPLLIEVLREIPAEQGAIEPSVMGSSAAVKLLLDGGVDAAGFHCGVLDPEQADAPFSELATSAGLVTHRLFEREQGLLLAPGNPLGIRTLADLTAEGVRYVNRQRGSGTRNWFDRMLAETGLSPDAIHGYADEEFTHQAVAAVIACGAADAGLGVRAAAERLGLDFLSVGWETYYLAASRALAGSAFDALIATVRSRAAGTSGYRPAGPEAADALAVSASRDGLSGR

SEQ ID NO: 3547 - protein, 294 aa, Methylobacterium sp.
VTSLDIAPFANALVLGLSIASIWLIAAIGLTIIYGTVGVINMAHGEFIMLGAYTSYALQSSFGLPFLLCLPASFIVVALVGLVIERGLIRYLYNRPLDTLLATWGVSLVLMQGVRLIFGSDPKYIAVPEIFQSNVEVGFASLSVFRLVVLAITALIVAATAWLFYRTRFGMQVRAVMQNKEMAASFGINADRVYMTTFAIGAGLAGIAGSLFGVLAIVLPTMGTAYVVQAFLVVVVGGGTLMGSVAAAGLTGELQSVFAFMTNDTFARFLLYVLIVVFLRFRPRGLFAVAKGRR

SEQ ID NO: 3548 - protein, 373 aa, Methylobacterium sp.
MTTRNLYHSKPAQWAVYGLFFLGIAGIPAFVSDGFLLNQFAVYGIYGMLALSISLCWGFGGILNLGQGIAFGLAAYGMAMTMQMQSQDPDSNPIPPFMLNNSLEHLPWFWQPFWSTGGGILLALAVPTLFYVVFGTLMFRARVSGPFFAIMSLAMLSAFATLILDMQPYTNGANGLSPPAPLSLFGTDIDPYGPTAYWIVCGLLIAVTVGAKLLTQSKFGLVVQALRGDPERVRFLGYNVALYETCIYAISGFIAALAGCLWVMLIQYVSPAQLDPTFSIGMVIWAGIGGRLSLLGAILGAFLIQGGQSYLGDQFLATWLLVLGAFFIVVVRFLPKGLAGLLEKVLGALARQPGKHTRPDLPHAITGAPAAGE

SEQ ID NO: 3549 - protein, 246 aa, Methylobacterium sp.
MGVLEIRDLHKSFGGTKVINGFSLDVTELTLCCLVGPNGAGKTTTMDLITGRQKPTSGSIVLRGDDITSLSEHEIAQRGIGRKFQVPAVFRELSVRQNFEVAYSREVNPFRNMLRRRPAGFSDKLDEVATLTGLKDRLEVEAGFLSHGETQWLEIGMVLMQNPAILLLDEPVAGMTESEIEKTIVFLNELKRTNTLIVVEHDMGFVRQIADVVTVMHMGAFLAQGKLSDIENDPRVREVYLGEPEV

SEQ ID NO: 3550 - protein, 232 aa, Methylobacterium sp.
MLLDLDRVTSYYGKTPILKEIGLGLPEGQCLCVLGRNGVGKTTLLRTIMGLTDRTSGEIRIDGASVGKAPTHVRAKYGLGYIPQGRQILPHFTVKENILLGTFARTDGRQDVPELCLTLFPYLAQNLHRKAGLLSGGQQQQLAIARALATNPRILLLDEPTEGIQPNIVAEIGQTLGRLNKEFGITLILTEQHIKVARKLGDAFLMMENGRIVARGPIHEMTDELIERHMTI

SEQ ID NO: 3551 - protein, 146 aa, Methylobacterium sp.
MEPIPKKGTPERQRLIEAHKACMDSMKGVAGNSVLLCETPGDTTVVTGGVHTDPVLKRVLLRMRGQSPKGKLIVICTKVDAEWRIARLSGVRGVPPEFVGDKIYTDEQEIQHEIFLMRLDELSDSYGFPEDYHEGWKRKDDNWPIT

SEQ ID NO: 3552 - protein, 366 aa, Methylobacterium sp.
MALAVASAGFVPDRPDLGHRAEGFDLANPAFFADSLDPGAPRLLPPAAYRALAFAELEDDAVWTRSWLAIGLGAEIPSPGDLLPFTAGHHGLHVQREPDGGLVGRFNKAQHGGCRAVPLQCRTGTKTRCSFTACGYSRDGAVLPAGPDGPTPAMHQYLGLRPERLLPVAARAWGPLVRINLDPAAAPPEPQPEGLTARAGETRRAEFSANWKLAMQALAEGDFLAEASDSLRLSGRLATGDLVTIAVHFPNLVLIAARAETCAVMLQPTALGQTLLRIGLLGSGDAEPAAAAPGRMSWDAWLAEIAARMAPAVATQAALTGPEADDPRSTNAAGLWLQRNIAARVLARPAATETQPLYATAQGRGC

SEQ ID NO: 3553 - protein, 336 aa, Methylobacterium sp.
MDVTIFSTKAYDRRFLDEANAAAGGPHRLRYLEARLARESAPLGQGAAAVCVFVNDVLDRPVLEVLAASGTRMVALRSAGFNNVDLAAAAQLGIVVGRVPAYSPDSIAEHTVALILALNRNIQRAYARVREGNFALEGLLGFDLKGRTAGIVGTGNIGVAVARILAGFGCRVLAYDPRPSAELAAFGAQAVGLDRLLAEADIVSLHCPLTPDTHHMIDRAALARMKRGVMLINTGRGALVDTAALIEGLKSGAIGHLGLDVYEEEGGLFFEDLSNQIIRDDVFARLLTFPNVLVTGHQAFFTAEALAAIAATTIEKLSAYERQGVPRYPVSVERLA

SEQ ID NO: 3554 - protein, 492 aa, Methylobacterium sp.
MHVDDDKDWKASDCTVTEPATIRRAISAASIGNVAEWYDFGVYAFFEPTIQKVFFSNLSHQMGEIATFGLFAVAFLIRPLGGMFFGPLADRIGRNKVLAATMILMAVGTFAIGCIPSQESIGIAAPLLLLVARLVQGFSTGGEYGSAMTFIAEYAPDRRRGYLGSWLEFGTFTGYLLGAIVVTVAGVALTEEQLLDWGWRLPFFLALPLGLVGVYMRSQLAETPAFAALEQEAEDREKRLRAGQTAKDIVALWPYVLVCMGLALAWNVPNYMLTSYMPTYVTQTLPMMQQSGGISPRESQVLQIVVMVLALLSIPFIGRLSDRFGRKPFVLIGSLGLVVLALPMIMLIRSQSEIAVFLGLLIMGLLLICFSATMPSTLPALFPTNVRASGLSISFNVSVSLFAGTTSVVVGSLVAYTGNLDWPAYYLMIAGAIGAVSILVIREPNGTSMWGSPPAAASEQEAHDLVQGYGSGAAGGGSGLSVPVPIAPRQIV

SEQ ID NO: 3555 - protein, 458 aa, Methylobacterium sp.
MQDRKPERRVLAVTPVLAGLGMAALPTTGMAMLMPWLMQQGAYPVATAGVIQTAHTYGLILAALPMAALAARLGPRRAFLTAILTLAVLVPAASLPLDLVPLLALRLAQGAGSALLLCAGWSLLRRLFGEARLGLGLGCAELAALPALLLVQMGAGFALSFLGSLGILVPTLLLALPSLILGVIALPEDDAPRPRFDGLGAVLSVLCLGLLLAAVPLAVIRPVVALLVLNLGLMLSALWIWQQWRRPAPLLPLDLLARPRTGWLLAAAFAGNVALTAADTGLLARLSGFAGLSQDGIGFVFLGLAALTAGAGFLAGRSGAPPLARIGMGLTAAGLAVLAVASPGGGTAAAWPIPAAGLVAFGLGRGLFSVANALALLRAAPPARNAAATGLFVLAGGLGTLLGPLYLTQLPSLFLPAGAMSTELWLGLAAGAAGIAALLSRSGAKTAPRGGHLAREPV

SEQ ID NO: 3556 - protein, 81 aa, Methylobacterium sp.
MKTMQAAPKSLERDNTEKKGARRRYEQEGAYGRDISRMIHNQAPGGEMTLKDRAPSSAAEGDIGVMSGAKPTTTGNPRVAC

SEQ ID NO: 3557 - protein, 164 aa, Methylobacterium sp.
MLRLVSAVLTLVLSLSAVSAETPPSVAPGVPSGSGTQPVAVYGPDGRIVAFPDPSGIVVTTMPFRRLHSTPIRLKGLTTAPKVFPISRPADATTYRVVVPCNVNIRLLGAKTADEVLTDDNGVLYLAGTDVTMGTSKPDFIIAKTTAEPVGDCTPEMHYGMGGG

SEQ ID NO: 3558 - protein, 80 aa, Methylobacterium sp.
MNRAYGVQVTAQGPDGGEPRTVPVLVVAGDEQDALLVVSEAVGDDAEAELLRELTDAEIREHGLDLEQRGAAKSLAVLKL

SEQ ID NO: 3559 - protein, 291 aa, Methylobacterium sp.
MKRCAILTLAVLTTGPASAEPVELAVFRDLVRPPPTLQVAYGEAPSQGIDVFLPASSGPHPVAVLIHGGCWSVATAGREQMRHLGPDLTRRGIAVWSIGYRRANEVGGGYPGTYQDVGAALDRLAEEAGAHHLDLSRVVFVGHSAGGHLALWAASRGSLPATSPLHAAPRFVPRAVISLGGVGDLATFVRFVPVLCGPGIVEQLAPADKLSEVSPASLPLAGMPIFLVSGVRDRLTPPWVAYDYARAMRGRSGRAPQLIYAPDAGHFDLITPPAPAWQEVRGLIEASLDLK

SEQ ID NO: 3560 - protein, 178 aa, Methylobacterium sp.
MLQSGTKILLAALVAGLAPAAALAQNVIALDGSGSQAIVTAAGDVTSTAATRNVITPDGMGYRVDVFGASPGSRVVVAQNLITPNGAAPVPNVNDCTFIRDPIALRDCINLYEGQRLAPGPRNGALRPGLITDENLLDAAGPIPGSIKGRSGSGRDRTSVPEPSRSNAAYIDQVTRPR

SEQ ID NO: 3561 - protein, 113 aa, Methylobacterium sp.
MRRILTAFVILFSASPVPSMAQTITNVNECTFITDPIALRRCIDGFQLRGPAAQYPQSAPIPAVESPAQAERDQLNSKTPPAADYKDSPEWLGSADKAPNRSPPKRGVIDLNK

SEQ ID NO: 3562 - protein, 70 aa, Methylobacterium sp.
MNRVAPSLDTAPNPGQGNAFYGVQDGMYNRIDATQTGIGNLIRITQSGMSNNAVITQSGSYNQITLRQGR

SEQ ID NO: 3563 - protein, 244 aa, Methylobacterium sp.
LLDTPPAPAFDRITQLAQSLFEVPIALISLLDEDRQWFKAKCGLNVPGTPREQAFCNYTILHDSVFVVSDARAHADFALNPLVTGEPFIRFYAGAPLVVAPEIRIGSLCIIDRQPRTFSDEDRWLLARLAQVIIDEIWLRSLASGQGRMPPDSRQLERSSAVSSVITGVQVRAARAMLSWSIDELSLKTGLSANTIKRVEADDQSRPSSRSTITKVKEVLEGEGVLFIGNDAAAPGVQLVRNID

SEQ ID NO: 3564 - protein, 422 aa, Methylobacterium sp.
MLRSVQAEQERLRRENQEAKAELVEARRRLRDLQAVSRPSPSRKASIAEPVPVSGPLPPLPPLRAVSGVVGAIEGGAGGFRAGNGAYAAGSLAFPIGRSFGFQADLAAIANGGDLGLGAAGRAFLRDPTKGLIGLYGSVDYATSIRSYGLQDVGTTMGRIAGEGALFLDRFTVDGIAGWQMGDRAQHFFDQIDLSWYATDDLRFSVGHRYENRIHAVAAGAEYLLPLLSPVGISVFAEGRIGERDYRAGLGGLRVYFGQEDKSLLRRQREDTLKVRLVDPFAARPNGFRVVPAVGPQGPAGPQGATGAQGAAGAQGPAGAPGLAGAQGPAGPQGVAGAQGPTGAPGLAGPQGPAGAQGATGATGAQGPTGSQGVAGVPGAAGAQGPAGPQGPVGATGAQGATGATGAQGPAGPQGPEGQIRL

SEQ ID NO: 3565 - protein, 256 aa, Methylobacterium sp.
VTDLNPLRLDGRHILVTGASSGIGRRTAVMLHALGARLSVVDQDEAGLVSLGAELGAGEAVARHVADLSDIAGIEPLVGRCVDAGGRLHGVVHCAGVQAIVPVRTLQIDGWRRIFAINTEAALMLGKCLSSRKVYAGQHGSIVFISSVMGMVGSVGAVAYSMSKAALGGMARSMSLELAPRGIRVNCISPGFVRTPLLEQTERLWDEETKRAVEALHPLGFGEAEDVAHAVAFLVAETGRWITGSTLVVDGGYLAR

SEQ ID NO: 3566 - protein, 353 aa, Methylobacterium sp.
MKHFTVATISTLALLVGAPALAAGNNEAATEQRGYSNTLDLTQSGKYNTVTVEQSGSRNAFDGDQTNGSRNLIDLTQEGRYNYAASGQAGSSNATTTINQDTARTAPRDAGHFAVTQQDDTRNSEIEVKQVGQSQIALATQADNTRNNSKIVIDQSLTTNEAYASQWNVSGSTMYVGQAGEFNTANVAQDNSTGTHANVIQWGSANYAEVGQTNNKYSSTNVSQSGAFNAAAVLQSGSKNSDIIADQYGFDNLLVATQTNSNGARISTQQYGWSNVADISQNNSNGAGIYLLQAGTLNYANLTQDNSGASTITGAQLGTGNSLTAAQYNNVGSTILSAQYGTSNTAKIVQHGK

SEQ ID NO: 3567 - protein, 158 aa, Methylobacterium sp.
VAVEYATIGSVSLPIRILGLNGGTGGQVATNLQVGNANRTDISQTGRGNAAAIQIFGDGNSAAIAQQGSNNVGQGLLVGSSVRFDLQQTGIGNQADLSVNAPGGANLQLRQDGNGNSLTGSVPGAANIVVNQVGNGLSADVTQVGVPKNISVQQVRAR

SEQ ID NO: 3568 - protein, 550 aa, Methylobacterium sp.
MSIRHKILLPLLGFMLLGGLLSAMTGLTGLSAFGELSGLAGRAVEASEASRTARDRFRRAEALVARVTAMTDLLDIGRIGSEFTANADALEEGLGRLKASALSERMLTLSNSAEAESRQWRAGAEILLGLRKAREIPTLAVMARYSAAIGRDLDEAVALAGQEAQAQIGATGAAMSWKIGLMLALSAATVGAGAGVAFWLAGTLSKPLVGLARDTTRLAGGDLDVALPATDRRDEIGAMVAAVRVFKDNLIRSRTLEAETAQAGAAAERRAMVRSLADGFEASVVRIVGTVGTSAAQLRETAQTMSVTAQRTAERTTRMSAAAGAAASNVNAVAAATEQLGNSVVEIGRQMQTSADLARGAVSDADRTAGVVRELSAATAQIGEMVALISNIASQTNLLALNATIEAARAGEAGRGFAVVASEVKALATQTTRVTDEITSQITRIQGVTGQAVSAIGGITTRIGEIDTVAVSITGAVGEQGAATNEIVHRVGRTAQDTRAVTGHVAEVAEAAERTGLAADHVLQAASDMSAQADQLRQEVARFLVNVRAA

SEQ ID NO: 3569 - protein, 397 aa, Methylobacterium sp.
MPQLTDPGRRIALGLAAAAVGAGLAASLAKLFPWQRASREGDQPVADAPYDPRENESNLSVTGLPDDALRERGITRMVLGPLPLPNGAVIATDPLVQPEREAFTRRVAPGDYPVTLYQAQGRVALAELRFADGTPARWELALVPRQDIASLKAGEIFGYPVDAGLGCFMDTAARAAMARREAQEQKRSRYSNYYDDVLAGELKDSNLNWVMHRPLPDDPARVAVFSSGWGDGVYASYWGLDAAGQPLRLVTDFGIIENGDGRDPREIAVAAALAGLTPEQRRDSERGYAALKSDDRAAFAALLDAGRIAPETPIEAVEGTFTFEAIRLDKPEALERLVRHGAPTLMPPYLQFGDERKTYPAYARSLKTPRSPQLLAVIEAWERTGSTDTPSRGQTQP

SEQ ID NO: 3570 - protein, 146 aa, Methylobacterium sp.
MAAARAESAAAEAAKSEALKTEALKTEAARTRTAKAEATESGRGGASPESRAPSASARGKPLPSVPARDGTDAASARVPGAADSAAHRPEGPTEGEAAKAAAQEAAAEGVAAEEAGAVVLSEGETRDETDAAAPDAVDPSALLSPP

SEQ ID NO: 3571 - protein, 352 aa, Methylobacterium sp.
MRKPKPTAEATSHETELAGLVTTRDNLQARQAAIAAELEQAVTRRRELLIQGSNAAAIAEAERACREAEGTAAGIADALAEVERRIGATEDKIEDARIANVREAAAALLEHDGKAIDAAAERVRQAVADLAKAQVGLAAAITVTSTPHFGKYDFGGRRSGEAPEVVAAYLTGHMIATTLPGLDVSEAMRKIPAGGWTDRRLIEPTEHDLPARALLTDPMREAAAQVRAGEASPDLPRFHRPEPDFTPDVSLVQVYVLTPFRYGTGEGRMPGIVSGVIEHIPAPVAERAIAAGLASEVEPRNLTDLKARRPAATSGVNVFAFHDLGFDLAEWKAEEVARRRAAWLAEQEREAA

SEQ ID NO: 3572 - protein, 82 aa, Methylobacterium sp.
MKEHTPETDGAATILAMHAMVTWLVRREVERGEGAGDELTRHMVEAMLGVVQVDPALAEAAHEASNVVARVIDTRPMLAVLN

SEQ ID NO: 3573 - protein, 217 aa, Methylobacterium sp.
MFFELPDESWMARARPLGPFLCDAAFRIADSLYVGPDHGIGPDDWERLRVPLDPKDLPCRVANLVAAIDLPGHEAALAAHYERLIAEAQQHNKPAALAHPFPYFSVTPLLLEADRPVVTFPWTDDVPQTSAVLTALAGTGANGVVWDEIDQGWFMRIVARDGMLFIAEGDPDEGPDVVLRVEARAAAAQAGAALARLRTLHAHLIRVFGRDLWSYAG

SEQ ID NO: 3574 - protein, 754 aa, Methylobacterium sp.
MRKAVLPVLSAGRAAFGWIGRRIGPGRLLASGLLLLLLALRITDPPPVEALRVRTFDALQVLSPRVPPADRPVAIVDIDEASLREFGQWPWTRTRLAAMCRKLQEGGALIAAFDIVFSEPDRLSPPLLAETLPDLSEAARADLRAQPDSDAVFAEAIGRLPVVLGQTAASTPIAWTGREPPPQTGTAVVGTDFDPETALIGFPGLIRNLPVLERAAAGRGVFTISPERDGVVRRVPLVLRAGGTVVPTLALDILRVATGADTLLIRTDEAGVVSIRLPELTVPTDPHGQIWVRFSPHDPGLYVSARDLLNGTVPPERLRDKIVLVGTSSVGLLDNRTTPLDRSMPGVEIHAQLLENLLTGATLTVPNEATLIEVGATAAVSLAIILFAPILGALGLLLFGSLVAGQLVFVSWYRFSAHGILFDATYPLLTTFLVYLTLVFTNYFREQAGRKRIRTAFGRYLSPDLVEQLAHSPEPLRLGGEERRLTIMFSDVRGFTAIAEFYKDDPAGLTALMNRFLTPLTNAILDRQGTIDKYMGDAIMAFWNAPLPVADHEAQAAAAALDMLARMDALNAARRREAKAGGHPVLPLDVGIGINTGPCVVGNMGSDLRFDYSVLGDPVNVASRLEGQSKLYGVKIVLGAATADAIRARFPVLELDRVRVKGKSEPETVFTLVGDEDFRMSEPFQQLAARHGAMIAAYHARQWDETGAAAHACRALAEGLRIDGLYALYAERAETFRREPPPADWDGVTVATTK

SEQ ID NO: 3575 - protein, 109 aa, Methylobacterium sp.
MHGDLPPPPITCTLSEQRQGSQVRIDAEIRSATSQSGIYRLVVSKRGSSGNAQLSQQSDLALAPGSTLRIPGPRLSIEPEGHYRARLVIHAGDAEYVCEHEGPNASDPP

SEQ ID NO: 3576 - protein, 48 aa, Methylobacterium sp.
VINEEGTPTDTPGLTAKDFVQSGGNTETLTLKPTAPNKFVADLKAPMP

SEQ ID NO: 3577 - protein, 135 aa, Methylobacterium sp.
VPDPNPTVGELFKAKAVTDEQVSALVESVLAGKLDERAELAEAYVVNVAAAVKASAFATSVPPRQDEQARRTVECGADCDPAGAGAESFSGDHVARFGGRLMSAKMRLRGGPAIKDHTRWERTGCIADGASLTDL

SEQ ID NO: 3578 - protein, 96 aa, Methylobacterium sp.
MKTFLTFASAVGFAAACLVPLTAGPADARSRHKSRSIVTNDGSVTGGRGRSQTISRGATGASSINRNSAAGGNANQPERAVPQGSGGGGSGGAGAQ

SEQ ID NO: 3579 - protein, 64 aa, Methylobacterium sp.
MTEAEREQQLRDQLLVEMAAAVEMMLELTRHAHRSESMICLGATQQQSRLEAARERFVGSLGKR

SEQ ID NO: 3580 - protein, 170 aa, Methylobacterium sp.
MPRLLPLVFAATIASLGIAQADELTIEGVGISRDVDCEGKDVGVYGAENEIALTGKCGLITVHGSNHKVSFEEGTGLAVSGMDNKVKGGRAQNVTVAVTQNTVTATLGGGGAPGKLSTSGANNRVSLVLAGPTRLEVQGADHVVEWTRSDRAPNPEVTASGAKNVIKKKL

SEQ ID NO: 3581 - protein, 267 aa, Methylobacterium sp.
MIRAAECVGSHDILLVTLDSLRYDVAATALAEGCTPNLARLLPGGTWERRHAPGSFTYAAHQAIFAGFLPTPAEPGAHPRLFALRFEGSRTTGPDTAVFDAPDIVSGLFARGYHTLCIGGVGFFNKRTPLGRVLPDLFAESHWHGGFGVQARDSTAAQVGFAVERIAALELERRLFLFLNVSATHHPTRVYLPGAARESAATQAAALAYADGALPPLFAALRARGPALCILCADHGTAFGEDGYRGHRLAHPTVWDVPYAEFIQEAA

SEQ ID NO: 3582 - protein, 309 aa, Methylobacterium sp.
MSVPLSRPSRRAVVLSSLAGGASGLLAEGGPAKGSQAPERRIEGPGEPPAGRKVTVERRGGICLIGLNRPHVHNRVDPEAFGALARAYAAYDADDDLRAAVLFGHGENFTRGIDVDAFAEVLRSGKAREPDADGSDPLGRRALLSKPLVVVVHGDTWNMGHELFLVADIRIASAETRFAQDENAHGRFPGGGSTVRFPREAGWGNAMRYMLTGDRWGAEEARRMGLVQEIAPNPHTALELGLGMAARIARCGPLGIRATLASARNAVDQWERRAFSNLGEQYRALYGTEDFLEGRKAEAEGRTPVCRGR

SEQ ID NO: 3583 - protein, 558 aa, Methylobacterium sp.
MPSEATTEPFDAEVIVVGAGPVGLTTGCALRHHGIDCLILEERTEVRAYSRANNLWARPQELLAAIGLRDVIAERAYPIRLVNFFMNGTPTTPIRIDDVGSPHPQVLYSGQDVIETTLIETYEGRGGRTQRGRKVVAVAQDGDGVTVTVMRGDDGPEERLRCRYLVAADGATSTVRTQLGLDFEPERFEGRMNRQVDARLSWRRSLEPDQLWFFYYERGFCGVMPVWGGYHRLFFLADDAGVPDRDPTLAEIQAVAREVTGDETLTLTDPQWLTHSRFQYGVSPGYARGRVYLAGDAGHLSLPIGGQGMNAGLHDAVEIAWRLAAVLRGETAPVVLDSYDAERGGEHARLSEQQAKGFRRTVYRGAVTDAALGMAAKVMPSIGSLLQGTDDLQQLSVSYPKSPLNEDHLSGVAHLLQRGPKPGERAPDAEVTQDGRTTSLFPFLYNPDGRTTGWALLCFDGRSPEAGASLRAAIEAVAPWEWVRPRLVLSGPAIAAADVPVLSDLDGKAHGAYGLDGQPALVLVRPDGHIAFRDAAESPDRVAAYCRRVFAAEDQPSG

SEQ ID NO: 3584 - protein, 491 aa, Methylobacterium sp.
MTNSISARLREAIAQHAQAGRTAIAGPEAVTYAELGRLIDGYAAGISDWGIERGVKLGLIAPKSIAAIAAYFGAMQAGACVCFIEPGLAPEVVAEQAEAVGMRHLVVDESLTDRFANRSPRYPSVQGLNTLNGGGAFMDDGLSSDDSAMLLFTSGSTGRPKGVVLRHGSLICNADGVLRHTGTNPRDRLLHVMPLYHTNGVNNQLIVPFLAGASLILHDRFKPETVIESLRNDGPTYMTGVPTIYARMLPHLESGERFPTLRFLRCGSAPITPTLHQQIEAAFGVPLLVSYGLSEATCTSTMNPPEHRKIGTIGTVLSGQTVRLFDPVTNVEAAQGSEGEIRISGPALMAGYLGSTEQPIVDGWLRTGDLGRFDADGFLSITGRIKDVIIRGGENISPALIERHLTTHPAIRDCCVVGAPDADLGEVPIAFVVLKEGERLDEPALKAFVKGSLARIYVPAEIRGINVLPTNSVGKTDRKALRTVLAIEPHR

SEQ ID NO: 3585 - protein, 933 aa, Methylobacterium sp.
MANNIAIRIQAEGGAELRRDFEEAGRAGQDAFRQVGTAADQASAATDRLTQKTQTAADAARRASTAAGGASGQPSPSAATLREVERVRSRLDEEFRNSRQLERDLAVIERGTASGSLSADYAARLRGLAETRYGGPGNDNDPTRRGLDANQRRDLAYQTGDVVASLGSGAGLGTVAFQQGPQILQGLATGEGGLSGGLKALGQSALSLVTPLTVTATAVTALGGAFLYAGTQADKDREVLERATQGIGRMTGATTSQLDALAKANAEAGKVSTSTAREIVAGYASTGQIALPLIADLTRVTSDYARLLQIDVAAATSELARMFSDPAAGADELAKRIGGLDDRTRQFIQTQMEQGDRSGAQATAADYLRSTIEANTSATTGWAAAWDRAKAAADGYWEAAKRIAGIKLGIVPEGAQEAVDRLNSEIEKTNRIRQFSGLQPLGLGDKQVRERDAAAIIADTQRREAEAKAAEERASSASRIAGDIARSIDPQTAAYSRLRKQQSDLRDALADPLARNKLADFDQTETAYRATTRAIESLTDANGKLISSEEMVRRQDQLRLDAVKAKTAAEKADVAERQKALDLVGKTITGSDARGQIERAGILARAEADSKKDGSDKDKRDDFDRALRSAEDRTRRLEEQGATYGMGAEAIERYRVQTELLTAAQRAGREVTPELTRQIEEYANKAGDAAKRNEEVRENLRDTDSLRGVGSDGVRSLVRDLGDARSGADVLGNALSRVKQRVLDLASDSVAEMLFGKRGSAGSGLFGGGGGVGSLISGLFGGGGGDSPTGGVRLFDVGGFTGHGERYDVAGLVHRGEVVFSQDDVARHGGVAAVEILRRSGGLRGYADGGYVGRDAFTMPSAAAMRPANVNGAPPINFITPPGVALERDGPPQRRADGGYDQAIRVVEGGLGQRMARGQGPFRGVSGAGYRNG

SEQ ID NO: 3586 - protein, 387 aa, Methylobacterium sp.
LRPLSGIRVIEFCSVAAGPFCAMLLADMGADVIKVEHPDGGDTMRAWPPISEGYSENFASLNRNKRSVTLDLKDSAGNAQARDLIRSADIVLENNRPGVMQRLGLDYATVSADRPALVYCSISAYGQEGPRSTEAGFDLTLQAMSGVMSVTGEPGAPPVKCGVPISDFGTGLYAAYAIAAALLEARATGRGVHIDASMFGASLAMGALQTSEFFGSGRDPRRLGSAHPRNAPYQAFRAKDGYFAMAAGNNALYRSACDAIERPDLYEDPRFASTLLRAQNQGELLEILETLFADFTCEELLARFRAAGVPCSPINSYSEALADPQVAHMGWVQPVRLPSGVETRTFISPLRFSGEGFPIYRDPPALGEHNEEVFGAEQPAAALARTA

SEQ ID NO: 3587 - protein, 247 aa, Methylobacterium sp.
MSELLVERDGTTLILTLNRPDKMNALSATLVEALLEQVAEAGHTGIRLLVLKGNGRNFSAGFDFGGYEDQSEGDLVLRFVLVEQLLQAVRHAPFETMALAQGRNFGAGVDLICSCGRRIGDLDATFRMPGLAFGLVLGTRRYAERVGEARARAVLGDGLVFDVDEALQDGFLTGRVPITEWPEAVANAVEAACRLSPEAAAALYGATTADTRAQDLADLVTSAARPGLKERIGAYRAQTSSHREKRP

SEQ ID NO: 3588 - protein, 275 aa, Methylobacterium sp.
VSLGTPKIVPLEDLAARVADGSSLALGGSFLHRGPFALVRELIRQGRRDLEVIKQSPGYDIDILCRAGALGRARAGIVAMEGNFGLAPWYRRAVETGQIRLEEHACASLTAGLRAAAFGVPFMPCGGIHGSDLPALNGWKTVEDPYGSGETVYVIPRITPDFAVIHVNEVSEEGDVRVYGTSHWDRIMSRSAKRVLVVAERVASSASFREQPELTLVPHFLVEAVSIVPDGAWPGSCWPHYAVDYPAVEAYMDDAPGVLQAHLDAAPEAREAADV

SEQ ID NO: 3589 - protein, 243 aa, Methylobacterium sp.
MSEWSPFSYVVTNLARFVRANEITFSGVNSALPMLACLLAKRAYPFAFTYINVAGGVDPSPSMVPISSSDPVLAEGSRSIFANEDFYDLCTRGQMDLCFLGAAQVDGLGRTNVSCIGDWHAPKVRLPGGGGGAVMLPTARRAVTWRTEHSRRTLVETLDFVTASGGMHGVVTPIAVFTKRDGRLVLASWHPEASLDEVRDRTGFRFEADGAEPTPPPTPAEAEALAALDHDARFERDAAIRLR

SEQ ID NO: 3590 - protein, 162 aa, Methylobacterium sp.
MRALILAITTGILVAGAAYAHGLSSEPPAQQTAGILTCVTKPEATLVFGRTPVADCTFVAERGGFRQSYLAVFSRAATLAELETTQRVAWRVMTKDGFARPGMLADDFTAPQEQATDRPTLFGRTASLQFLSHSGQSSAKFALAQPRVQLAAARQGRTRGGK

SEQ ID NO: 3591 - protein, 363 aa, Methylobacterium sp.
VVWFLILLGAVSGWATAGGRRTLSAFWRDLSGFDPLPLAAYLGLITLALLAFYALHPWFARRRVRALMGPPGGDGRDPGPVPVGYRLDGAGLTQTAPDLTSFVPWPRIGALGEDRHHLFLPTEIGEVPIVLPKASLSPETIAGIRRWVQACAGRPAPALPPTEPAAGPEAVRATMRLTADERVPLILRSLGNPWARRARLTGAAAWLVGLTLLYPALLAMLWAVDPYRVPLADALPLFAEMVASDVWKPAAFAAAVIVGFFAVHPRASRWFAGDLARQLEAEAPPGEAEIVFDESGITTAKDGARAHLGWPLFRGRERIGDLMILPMRWDEVLPVPLRIFEPEARARVEALAERHISAETRAR

SEQ ID NO: 3592 - protein, 224 aa, Methylobacterium sp.
MTDASAHRLRAALLASCLLAGLSAFTPARAEEMPDSTEEPAPDVSTDPADTPADPITLRLDQGFRLDLPPGWVLEEAGGDPGDASGRRVVRIVCETPACARTREACTLRLRPKAVEGEDDDARLAGLHATPLSRYVRLRAVLKSTSAGASIRRPLGPERFGARDWIAVETEAAPRFKSGLFAETVVDGRYLGAICKTCETGAVRHEAARSILASVRRVERSAAR

SEQ ID NO: 3593 - protein, 238 aa, Methylobacterium sp.
MPRGQFGKGYNTAQATPQHNSVIAKDEPIPAERRNKTPNLYAAAVRWYVCTTAPSRELSAAASIKRAMLRGAREDETPFIPYVPCEYLWRRSVRSNLRVPRREQQRPAMRSYLFLGVLGGLCDATLAELRERDIDGRNMHGLSGILGSANRGPLAMNPAGLRWLRKWGEDELAGRTNLTPLAGMQAGEEVRAGSGLFSGFVGKFVGTSDGGAVGIISLEVMGAPFDYRLPIEDVHRAA

SEQ ID NO: 3594 - protein, 191 aa, Methylobacterium sp.
MRWGLAYAVGLSQLLFLSSAPVRGEVFTDPSTGFSVTVPAGFAIGSRRKDSNHEILVDILSQTGQPPVAGRSEALCAAGIRRNPPGAVSSQAELNALPALRERVAEARTILAGQGLQTETVESIKSSEFAGFEVVSVPTSGSDHRNVRIYMAIMDRVIGWIDIVCATTKQALPDALPIFRAIRDGTRPPTR

SEQ ID NO: 3595 - protein, 98 aa, Methylobacterium sp.
VADVVRRPLARQDLLDLWDYIADRDETAADGVLDRIEAVLAMLADNPEAGRLRAELSDDLRSFPVGSSVLFYCPRQSGIELIRVLSGYRDIGREDFDT

SEQ ID NO: 3596 - protein, 241 aa, Methylobacterium sp.
MAGISDKIILITGASSGIGEATVRELAQVGAQLFIGARRTDRLKVLALELGDHVAWSALDVTNGADFEAFAAAAEARFGRIDALVNNAGVMPLSPLAALKREEWRRMVDVNIHGVLNGIAAVLPRFVAQRSGHILNVASIAAHMVVPTGAVYCATKYAVWAITEGLRQEHDDIRATVISPGVVATELGSDITDPQVADALKVWRQKSLTPDAIARAIRYALEQPEGVDINEVIVRPTAAGM

SEQ ID NO: 3597 - protein, 88 aa, Methylobacterium sp.
MAAPDRTVADWIAEGLKTMALHCSCGHYATVTLADLPPTLTRTRLGQKARCAECGKRGAQVMRDMKAHYAGLEATGWSCEPKPWPARS

SEQ ID NO: 3598 - protein, 168 aa, Methylobacterium sp.
MCAPFSQADQPEPAISSLDLADAVEHLHLAAQVYGEMVRKVAIDDATSAQLGPRGSQSANMARLRLEEAMIGLRATCRNALASTSGTYASESDLAEAQSQRIQQNDRNITRTAMRRVDTVEAAERSLLDRAHAVGAELSRLDAAHPYGKSAAPAHGSHEAGFVSPAAA

SEQ ID NO: 3599 - protein, 133 aa, Methylobacterium sp.
MAAASKFPALGHMPERIRAAKRVHVESSDFLSDWWVGYGKDHSCQIEGTANHWNWLALIILGLADPAEAPYDEDKPLPVDPAEVRASLSAMTAARKALLAVRDACRDPDTDTALPIATGELVEAALAAMGERS

SEQ ID NO: 3600 - protein, 407 aa, Methylobacterium sp.
MAFVHTDPPPPTWRLTAWLTTSPAQVPPDVLTILRGRLVVGGAPLIVAALVGAALASLAILRVPTPAMLAWFCADLALTLVRLTTMLVMRHTLRNSGQRSGEWLPLTDLYVLSSLLWCAQIGCGVGLCMASADPVLVPFACLVTTGLVGGLAARNPGAPRMTLVQMISVVVPFTAGAVSDGQPWFLLLWALAPLYLVAVAAVNRRLHADYVALLCAERALRHQALHCGLTGLPNRTFFNQVLTAVPSGRKNEEHAVALLYLDLDGFKLVNDTYGHAAGDVVLQQVAIRLRHVVMVTDVIARLGGDEFAVLLTGRRVASAERVARSIIAAVGLPYDLGQGTIASIGVSVGIAECDSGLTDRHALLVRADRALYTAKQRGKGTFHHACPVRGDDGRTAWAIAECEASKR

SEQ ID NO: 3601 - protein, 463 aa, Methylobacterium sp.
MTAINGRDLIAWGFQPGEWFKRAVSIANAMRLEGSDDAGIRAHLTTLDPAAHAVPMRTNSLDFGVFLDAETEAERANAAAVIAHMDALMRVPTIVKGAVMPDACPSGLAEGTIPVGGAVACEDAIHPGFHSADICCSVAITVFRRADDPKRVLDAMQAVTHFGPGGRKGVVQPPDAVMAGVAGNRFLAEFAGMAVGHFASQGDGNHFAYVGHLASTGQVALVTHHGSRGLGAQLFKKGMAVARRHTSIVAPRVPAHNAWIKAESDDGRAYWEALQIVRDWTKASHFALHDLVARKVGNAVADRFWNEHNFVFRRDDGLYYHGKGATPSWKGFSADDDGRTLIPLNMAEPILITRHRDHAASLGFAPHGAGRNMSRTAFLREHAPALPEGIDVRFFCGRSDLSELPGAYKDAGSVRAQIAKYDLAEIVDTVEPYGCIMAGDWEAEAPWRKKAVAKWAAKMAQGQ

SEQ ID NO: 3602 - protein, 182 aa, Methylobacterium sp.
MHAVHELPPITVTTLDFDRLVAFGLDAYLRGDRRADFLLSELKRATLCPPRALPGEVVSVHRWVHYRLDDDPTVRGQLLVHPLDLTDLPDGLSVASPLGTALLGLRVGDRMPFRIDGTGTRHVATVEGVGWRLIDEPIPGHDALTKAALSLSVAAATKAASCPDGLGAPGIDLRALLCPALG

SEQ ID NO: 3603 - protein, 75 aa, Methylobacterium sp.
MNELTYPVVITPLTADDGGGFAATVPDLPGCMSDGDTPEEALRNVREAIDAWIEMARELGHGIPEPTHTPLRAVC

SEQ ID NO: 3604 - protein, 124 aa, Methylobacterium sp.
MSATRSFWRSLLTVFQIVALVAFSVAGAGHSHAGTAHAGHAASVHLESAGPQALGGLADHAEPVGDKAACGACSPCCCHASFLRLDAAAVTVAPQLGRTLSGNPTVAFESVAREMPSEPPRTFA

SEQ ID NO: 3605 - protein, 58 aa, Methylobacterium sp.
MGHGSALGAMMRTAIRRWIVSALALTVAAAAVWHLRDAWAQDACLDAGGAWRDGACRH

SEQ ID NO: 3606 - protein, 450 aa, Methylobacterium sp.
MREELKALYGDERLPRYTSYPASPHFTEAVDAATYAGWLRALPADATASLYLHVPFCRSMCWYCGCHTHITRHAAPIAGYLATLRREVDLVTGHLHHRPLVRHVHFGGGTPTLIAPDAFRALVAFLRDRFPFAADAEIAVEIDPRTLAPAMTRALGAAGVTRASLGVQSFDPVVQEAIGRRQDFSVTEAAVTGLRAAGIRGINLDLIYGLPHQSVESCIETVRQCLALRPDRLAVFGYAHVPGFKKHQRRIDEAMLPNGAARRAQADAIAETLTRAGYRRIGLDHYARPDDPLTIACVEGELHRNFQGYTTDASDALIGFGASAIGRLPQGHVQNDTVLRSYAERIDRGDFASLKGYALTWDDRLRATLIERIMCDFAVDVGQVCRSHGQDPDVLLASLPRLRILADHGVVRLDGHTLSIPEDAKPFVRNVAALFDAHLGTSAALHSRAA

SEQ ID NO: 3607 - protein, 73 aa, Methylobacterium sp.
VNTADYELEDNRSGNFTVRIGRAVAGYVSEDAEHPELWIVEDQDGQFMGRHRSQDAGAEFLAAWFIAEEQDWS

SEQ ID NO: 3608 - protein, 139 aa, Methylobacterium sp.
LRKLRPGASTDLVGLGLLAGAAGLLFIAVSDIGSALADFSAGAEPITVSSHAPAALPAAIGLGVFAALLLRRRGTPRGDTRLMAAALLCIPLMLLLPIPYLLVWRRVLTDHGYEQCETGVAGRRALYRWSHRTSASLCL

SEQ ID NO: 3609 - protein, 301 aa, Methylobacterium sp.
MTDASDRRLTMQDPRTQYPQPPFKRQPQDALGLAQEMQPKPDHGETSYRGHGRLAGRKALVTGADSGIGRAAAIAFAREGADVALSFVEAEMPDAQEVAKLIEAEGRKAVLLPGDITDKAFCETLVRKAVTDLGGLDILVNNAGKQTNQGDIGDITDEQFDRTLKTNLYAMFWITKAALPHMPAGASIINTASVVAYNPPQILVDYATTKAGIVAFSKALAKQQVAKGIRVNAVAPGPFWTALQPSGGQPQENVETFGSEVPLGRPGQPVELAPVFVFLASQEASYVTGEVYGATGGNGTA

SEQ ID NO: 3610 - protein, 82 aa, Methylobacterium sp.
MHAVVGRRTVLRDDLPTTVDARRAEAQIIAEAYRTAHRGNDHAALVAAIADALDDLAAAEQRMEVVQRQVSHGYVRGTAGTA

SEQ ID NO: 3611 - protein, 146 aa, Methylobacterium sp.
MARFICGADRHQVMLLPNRLDDYVSEDNLVRVVDLFVDELDLTALGFASMMPAATGRPGYHPATLLKLYLGGEQTLPLCPRADVPFPTHVGRRSTCSARLEADVDTLGWKIIRFVRECGIACHTRVAWLVMASNVDLRRSEHKDET

SEQ ID NO: 3612 - protein, 204 aa, Methylobacterium sp.
MPRLLVVETSPRGEHSISRALTRRFVARWQAANLEGEVVERDLIRTELPFVNAPWLQAYFTPPERHSAEMREVLRLSDELVAELLSADHLVIATPVYNYNVPAALKAWVDHVVRKGLTLGDDGRGLVVGRKATVLLASGGVYTEGSPIRDRDIATGYLRLILGVLGITDVSFVAAGGAKAVDLGEVGRDTFLDALQSEIEARAA

SEQ ID NO: 3613 - protein, 1928 aa, Methylobacterium sp.
TGAQVTGTEFGNVGLITGGGGGTGGAVGAQDPAAGLDAVVLAGSGGTGGTGLLLESATRLTNTTLGRIAGGTGGLGGAGAAGGAGGIGVLAPAGGTLINLGTITGGAGASGASGAAGSGGLGGTAIVGAGLTIVNSGLIAGGAGATGPAAVETGRAISFTGGLNSLTLTATSQIDGAVAAFSAGDRLILGGASDGRFSAAAIGAQFQNFGVFQKVDAGTWTLTGTTPAATPWQVLGGTLAVSADANLGAPSGGILLNGGTLQATAALSIGRTFTLGAAGGAIRAEPGVAMTASGPLVGTGGLTKTGLGTLTLTGANSYTGATRIEAGTLALAGSGTLAASSGVALASGTTFDIAGLGNGAAIRSLGDTAAGQAGTVVLGTNRLTLTDASGTFSGAITGIGDVVLSGGSQTLAGVSTFSGTTTVTGGTLSLAPGGSLASPVTTQTGGNFANAGAVGGGLTNAGSATNDGTIAGPVSNSGNFVNRATVIAQGRITGPVINLAGGTFANTGTVTGSLGNAGAATNDGTINGQVSNGGSFVNRGTAGSLTSTAGSATNTGTLNGEVIVTGGSLALGPGSLVNGALTNAATVTAQGRITDLVTNGVGASFTLSGPLADLSALTNAGSVTLAGNALGAGTVMGEGGVIQNAAATAATLTLGSGNATRIVLQDGAGGGALSLAKVGPGILTLSGPNTYSGGTALNGGTLLVSSDASLGAATGGLSFGGGTLASGASFTTGRALALGASGGTLAPDGGTSLTLTGVVGGPGGLTVGGAGRVVLTGANSYGGDTRVNAGATLQVGDGGTAGTIPGNVVANGTLTLNRSDRLDFAGVISGSGVLNQSGAGITTLTGSNGPAALFTGTANVNAGTLAINGTFGDTAGNRASVIVQSGGTLNGSGTIAGSVTINGGTVSAGNSPGTLTVAGNYTLNPGSASLFEFGSPGIVGGASNDLINVGGNLGLGGTLSLVSAAGATAPPVSGAYRLFNYGGTVSGAFAGVTTPGAGTSALVYTDIPNQVNVLVTNGNQSVQLWDGADTTGAAAGAQGGAGTWSAGGTNWTRLPGGQINDLWRSGVGLFGGSAGTVTVAGTQAVQGLQFTSEGYRLAGPGALLLTGDPFSTPSQSFVTVDAGVSATIATGLNGGAGIGLRKLGSGTLTLAGAGSYTGATTVEAGTLALAAGGSLAGPVTTGAGGRFANAGTVGGGLTNAGSTTNDGTINGPAANNGTFLNRGTAGALTSDAGTVTNTGTLNGAVTINGGSLALGPGSLVNGALTNAAAVTAQGRIAGPVTNAAGASFTLSGPLADLTSLTNAGTVSLAGNALGIGTLTGQGGVIQNGAATAATLTLGAGSTAGTVLQDGAGGGALSLAKVGAGTLTLTGASPFSGGTTVVGGTLALGGPGSAGSGAIALETGTRLAFLGSGYTVENAIRLANPGLATIDSGPGTIALSGPISGPGSLEKAGLGTLVVSGTGSYAGATAVTAGILQVDGALTGSSILTVGPGAGLTGTGRVGALTVQPGGFVTPGNAANPTGTLTAEGPVVLGAGSTLATTLSLTAASRLVTPATATIASGGILQITPSTLAYTTPVRLPILVASAGLTGQFTTVTFTAPVRGLQPVVGYDAGSAYLQFGETEPGRPTEPGPDLTSAIASAQGLARDRFGAFVTQRILGSVLTGFNQQISCGDCFSGFGMAGSYSVGAQGRRALTDELIAIGGFAYTGYDSGRVRVSGGPIFAGLLRYDPAGLGSARPFVDVGGLFAPSQNTSYSRGYTFGTMAGQGTGRVSTLGGSVFGRVGYVARLSPQDEVAAAVEYSRGWQYAGAYNEGLLAPNPYALASRGGTDIINIAKIGGQYTRLFGAAIEAQANLGVAHGFGLKSGLNGTVADVPFTTPIKDLTWVEYGARISYRLQQDLALDGFILGTLGPQPVGDTIHGGASVRYAF

SEQ ID NO: 3614 - protein, 238 aa, Methylobacterium sp.
MDCPVMRLVRRICFAGLAGGLALSLPASAQQIGATTVVKNDVSRLKGAQKNSLAAGDTVFRDEAVQTGADSLAKIVFLDQTNLSIGPNARIALNQYVYSEERPAGKVALNLLKGTYRFVTGDLDKKAYEIKTPVATIGVRGTVFDVWTTGARSVITLTEGEVRVCTRKASPQACLTLDQPGAVAIVTAGGVTSGPPGSATRFGFNGYCGANPGLCTPTRFAEGGGEPQPAAFAALCGR

SEQ ID NO: 3615 - protein, 254 aa, Methylobacterium sp.
MTASPQDRPGPVVFLGGGPGLEVAYAADPLRRAGFARDWAFFEQPGCGGGSEPATADSVLAAAARFVTERAEEGPVTLVAHSWGAWLALALLDRLPPDTIARAVLLHPTPPTRAGLDASVAALFARLSPEAMGRAAPLMARTDPEAGRAVMAILLPAYCGRQTDLPALDLALVPPVYHGVSASLGDFDQRGIVAARADRLTFVFGEADVFSHDLYMAHGGDLTGLDVATLPGGHFGFLEDVTGFEAILRRRGVI

SEQ ID NO: 3616 - protein, 76 aa, Methylobacterium sp.
MTFVRDRFGQLREGRVYPCSDGEVARKVAEDRVEQGWAPGAAAFLRRGGGEFDEGETITLAAFGDVPREVRDQMPF

SEQ ID NO: 3617 - protein, 75 aa, Methylobacterium sp.
MMTTSTKHTDRIGRPGRRGGIGTGAAGALLAAGLATSLATAPAALAQQPSPVGEFNDQTQPRTDPRIAEKPADPV

SEQ ID NO: 3618 - protein, 44 aa, Methylobacterium sp.
MSGEAFSRSQRSPSGETAMLDCVRGLTLGSPAQAKEQMEQRQFH

SEQ ID NO: 3619 - protein, 440 aa, Methylobacterium sp.
VSTPANAPGERYQLFRRAGSTRWQVRFSIKGQGQFKRSLDTDDEREAERRAEAIWFEATYRAKQGLTAKTHTFDSVAEAYIAQILREVERGERRADQGKSEPAVIRRYFIGYFGDKPVDAVTEADLERYAEWRRTYWTEGPGKLVMHIEYERDGHRLRRPVRRSAPSLSRQRGETVVLRGLLRWASRQGYMKTPPEISIKARRSPDNRRPSFEPHEFARLEAVSLSRLVDPIMDGTGAEVRASDRRSWRIKRLDDHTRRDRTVLHAYVMIGAFSGLRPTEMYNLTWGDVLGYRAGRKKSVDERDIRLQVRGKGKSGKAIPQKAAIPWFDTLWMLFERSLGREPADSDPVFASDQGKRITSVANGFTELLRAAGLERDHRGIKRTPYSLRHFYISEQLANGAEVLDVARNCRTSLSMIDKHYGQVRLERVVDRLRPEWTRA

SEQ ID NO: 3620 - protein, 154 aa, Methylobacterium sp.
LFNLDPWQAAIGLPLADYAEAILPADREEFFTNIDRVSEHGGLFVGEYRVCSAASGVRWVLARGYYERDDSTGDVVGRGIVVNTTESKLKRPVGDRAFFILHRNEPPLERLAACALQARRTIDEVGEHEKPALRPAVDALLWAVGRVLAKRGCF

SEQ ID NO: 3621 - protein, 87 aa, Methylobacterium sp.
VQVASITIRNVPDEVHRALRIRAAQHGRSTEAEIRAILEQAAKPAGRMKLGSLLSSIAREAGGLADAEADAFDRLRDRAPAEPMRFD

SEQ ID NO: 3622 - protein, 539 aa, Methylobacterium sp.
LSLAARVALLGSLFVLVATLAVGGNLLLEARAVMHARAAASLDSSMRLLRAGMEHAAGEKPDLNAAVDRVESVTGGTATVFTGEVRSATTVRKADGSRAVGTRLAPGPVHDTVLGRGAIYRGEADILGTPYLTLYEPILGADGHVTGILYVGLKRADVLAGLDHMTRQAALVGGGMIAAAMVLLWLAIRRTLRPLDGLGRTMTRLAEGDVAAEVPGLNRRDEIGAMAAAVQVFKESLIRTRELEREGEKARAASEDERKRALGAIAEGFEQAVGGIVGMVAASATELQVTAETMAATARQTATRSGHVAGAAEDAASNVGTVAAAAEQLGASVQEIGRQVSNSSDLAACAVTEADRTAILVHELDAVVNRIGDVVGLIATIAGQTNLLALNATIEAARAGEAGRGFAVVAAEVKELANQTARATEEISGQIGRVQGATGQAVAAIGGITARIREISEVANGIAAAVEEQGAATQEIVRNVAQAASGTGAVTSNIAGVARASEETGAAAAQVLSSASELSRQSEHLSAEVTRFLGTVRAA

SEQ ID NO: 3623 - protein, 66 aa, Methylobacterium sp.
MADLSAAVAQMLIKGEGVRQEDSPNVWVDAILDRWPEISADEIERGFRIAIEIQRADDIAEGRTHG

SEQ ID NO: 3624 - protein, 209 aa, Methylobacterium sp.
MFETATATLDWLGLIVFTITGALVASRKEMDFVGFAVLGTATGIGGGTLRDLLLGAPVFWTQRPSALLACLGISCAVFFCAHIPQSRYRTLVRLDALGLALFAVAGAEKAIQAGAGSAVAVVMGVVTATFGGVIRDLLGGDSPVILSREIYASAAGAGALTYVSLAALGAPRELALGSGFLVALLLRALSLRLGWTLPRYRPRARRPYS

SEQ ID NO: 3625 - protein, 243 aa, Methylobacterium sp.
MPATRRSLLLAAALFAPGRAHAFFWDSAPEPKAPEPVEPAANRDAWFIGEIPDEPFNVPMVDLTLVPAQYRRQIVDYDGPERAGTLVVDTHQRFLFLIREDRTALRYGIGVGRAGFTWSGVAVVKRKAKWPGWRPTPAMLKRRPDIPRYVEPGIHNPLGCRALYLYQGDRDTLYRIHGTNEPWTVGGTDSSGCIRLLNEDIHDLYGRVPLGTTVVVKTAQAEVMVQREWDGPSRSDNQVLLFR

SEQ ID NO: 3626 - protein, 43 aa, Methylobacterium sp.
MAVALADGDFIVTEDINLVWLTDEQGTMVWSLRLDDEDVVPRA

SEQ ID NO: 3627 - protein, 252 aa, Methylobacterium sp.
MTAFKDHFSTNNASYAAHRPAYPPALVDFLADAAPDRDLALDVGCGTGQLSALLARRFAQVVAIDASAGQIAAAAPVERVRYHVAPAERSGLPDSSASLITVAQAAHWLDLAPFYDEVRRAARPRAVLALITYGVLHLADAAADRVVRHFYEDVIGPFWPPERKHVEDGYRALPFPFAALETPALDIEVRWRLADLIGYVETWSAVRAAETSVGRGPIERFRADLAAAWGEPDTIRDVRWPLSLRVGRVRDT

SEQ ID NO: 3628 - protein, 36 aa, Methylobacterium sp.
MSKYNEEQVLSVHHWTDTLFSFRTTRDPSFRFRNGE

SEQ ID NO: 3629 - protein, 200 aa, Methylobacterium sp.
LSPISAIHEVSVKQARVPTDAEFKRLVAVASQGRYGVRNRLALMLSYLAGLRVGEIASLRWGDLLDGEGKVREQLRLSAAVTKGGHARVVFMNARLRKEVEQYRASLANPPALLQPVLVTQKRSAFSANTLCQHMRGWYDQAGLDGGSSHSGRRWFITRLAHSGISPKAIMMLAGHRHLSTTQRYIDVNDEMMRAAVEVL

SEQ ID NO: 3630 - protein, 227 aa, Methylobacterium sp.
VKRALIVGASRGLGLGLVARFLARGWDVTATVRRPSQALADLSMDAPLRIEAGVDIDDDGAVADLRTRLAEVPDFDLVFVVAGIATQAGTPAFLLSREVVGAVFQTNAVSPIRFAEAFHRRVAPGGLIVLMTSKLGSVSLNRGGGWSSYRASKAALNTLARSFAGQHKEADWGVVLMHPGWVRTDLGGRRATLDVETSARGMVGVLEAHLGQRGCVYLDHAGEKVPW

SEQ ID NO: 3631 - protein, 133 aa, Methylobacterium sp.
MSETTNAGGPATEPDYDRLLRANLERVFDERDAGKRAAALAELFVDEPVMYEPTGIVQGQATIAAVAGNLLKQFGPTFRFTPIGTAVGHHGLGALRWQAGPDGGPVAVIGTDVAEVVDGRIARLWVLRDQPAA

SEQ ID NO: 3632 - protein, 195 aa, Methylobacterium sp.
MPNPGRLLLALLAFLPLCLGCARAQGIGFAAERAFPVAGACYGRRYDADHLARHPGQVVSAIHLSGSSRGLIGLRPEAGRIDPELGLTLRIAFTDGGRAEGEIGCAEAGGRIRRCGRGASCAGSFAVDLLPDGRLRIVNDDADSRIAEPVVGEPGFSPDAVCRGKGRFVPPDAQNRVFLLTRLPLSACDPKRTGD

SEQ ID NO: 3633 - protein, 189 aa, Methylobacterium sp.
MQRAPDDLISLSEAARQIGVNKSTLSRQVASGAIRSHSGKVRLSEVLADRAANIDLSNPARGPRVARNDATQRSAASQDDDGAEDFVVVDGVVMPFAQAQAMKETYLARLRKLEFEQKSGALVDGERARAEVFDIARVERDAWVNWPSRVAPLIAAEIGVDAVALGVALERHVREHLAERAEPRLRLAG

SEQ ID NO: 3634 - protein, 189 aa, Methylobacterium sp.
MTELVSGRRLAAILGVSPTAVRNAIRDGRITAQPDGRLDPDAVRREWTASTDPSRSRVRTSSRVREQSARPATGPSVPDEPAQPSAFQLHRADKEGWTAQLRRLEYERKAGRLVDADEVHTAVFSLARTARDRWLNWPNRVAAIMAHEIGIDPVTGKADANSVAIVLERMVREHLTEMGEETLNLRRSR

SEQ ID NO: 3635 - protein, 98 aa, Methylobacterium sp.
MYVRMNRAFSFKDENGTKITAPRGWVGNLPDKAAKEAVSGGYAVDGNQRSATVVETPAPADGLDAMTKPELEALAKDRGLDVSAAKNKADLIETLRKA

SEQ ID NO: 3636 - protein, 447 aa, Methylobacterium sp.
MSIVLNKAAALLAGPVYGGYQYAYPHKTAYRPLPHPVPLREAWAAEPKDGLFLYVHVPFCAMRCGFCNLFTLTRGEGRVAPYLDALRLQAETVADSLGRFRVARMALGGGTPTFLEPADLDRLLADLRDTFGATPLAVPASVETAPGTTTPERLAVLRAHGVERISIGVESFRDDEARAMGRPQSRGSVEAALGAIREAGLPVLNIDLIYGATGQTPESFLESVEAALAWKPEELFLYPLYVRPLTGLGRRGGAAEDDRDWDARRLAIYRAARDRLREAGYSQVSMRMFRRAPEAVWGPAYDCARDGMVGLGAGARSYTAALHYATAYAVGQPGVAAIIADYTARDAERHGRADYGAWLDAEDRRRRFVLMHLLQAAGLKRHAYAARFGTALLDDLPELADLVEAGLATLDADRLTLTEAGLERSDSIGPWLQAAGVRERMRAYALR

SEQ ID NO: 3637 - protein, 79 aa, Methylobacterium sp.
LPRYYFDIHEDAVVIDINGRDLPDRAAARAEALARGAAFAADPQKLGGSGVVVVTVRDGPDRAVMRLRLVSQIEDVAGG

SEQ ID NO: 3638 - protein, 131 aa, Methylobacterium sp.
MRAPSSHHQGARRLAARNVPMRESAIQAAVVQHWRLFGQPHTLVAAIPNEAAKGQAGLTKGLPDLLVIGGRVRIAFLELKVPTGRLSLEQKLFRNLCAFVGIEFVAAYGRDEPIAVLERWGILRPNLNGPV

SEQ ID NO: 3639 - protein, 144 aa, Methylobacterium sp.
MTTEITGRPPRIIALGGPVSRAVAAMRHEPEPARRGFLRGLLTLPLLGGAVSLIGAPSAVAEPVTPRLLATYSDWLLLERRRLHMALFPDPAERSTARSFLIGPDTAANAFHLPMDGQAGSPDPATRAALVLSTVGCDWREGGL

SEQ ID NO: 3640 - protein, 146 aa, Methylobacterium sp.
MIRCDAPAFEDVGTTRRKPLTAKQKLDLYESQKGICPLCGKPMLPGDKLTDEHLRALGLGGSNAFGNRAMVHTKPCAEAKTHGPAGDLATIAKAKAQKRASLGFKTQKSRPLQGAPFPKAEPQRRASKPLDKPRLPPRQLYVERQS

SEQ ID NO: 3641 - protein, 311 aa, Methylobacterium sp.
VGPLDQLDMPRNEAVHALPDGLVCHHIQAPASRLETLGHGIVCRELVLDGSAIARIDDGNAITYRLSARACHRLKTLPANLRAGIVDLRDCLALETLPPGLSPAFLDLEGCSALKALPDDLSLRGGRLNIRDCALIGALPSRGSVAALDIAGCGRIDRVPEGFRVTSWIDVAGSGLTALPPHLSGIGLRWRGVPVDARIAIRPHELGIAEILGERNAERRRVMLERFGFETFMEAAEAEELDRDRDPGGERRLLRVELAGDEPLVCVSVGCPSTGRRYFLRVPPSMRTCHQAVAWTAGFDDPADYAPLVET

SEQ ID NO: 3642 - protein, 308 aa, Methylobacterium sp.
MPYENLTTFFGKPVEDFQSGMEAWDFERAVPRFRVEYDSEDSVPEMLGHYAALPGADATDALVIGYWQGDDSSESSQVVVEALVSYAERFPNLRALFLGDIVSEENEISWINQSDLSALWPAFPHLEHMQVRGATDLALGRFEAPSLTALIVESGGLPRRVVQEALAAGAPELRHFELWLGTDEYGGDSAPEDFADLFAGRMFPKLNTLALRNCAYADDLAAAVATAPVLERVSTLDLSLGNLTDAGAEALLASPAVAKLSRLDLHHHFLTEATTTRLAALGPAVDLSEQQEPDEYAGEFYRNIAVSE

SEQ ID NO: 3643 - protein, 381 aa, Methylobacterium sp.
MIRAAGSIDPCVILGVAGDERTEGFGAARVRAGHSPATVLDYARFIEAPERLGALFPEGRGLLRIDSPGGEPRIRRALLRLVGENDAKDHGEATRLRPDHAVQRGLAAALRLARRVVPPGVALTHEAETVALFYDKRACHAAMTAQGLPVPRALPPAASFDALAEAMRAAGLTRVFVKPRFGSGAAGIAALTVARDGIVADSAAEHVPGAGAGVLHHSHRMRRYRGPAAVALIDAILAQDAHVEQWVPKAALDGGPCDLRVLVVGGEPAHIVVRKACCPITNLDLGGRRAEAEALRSLAPPVAWEAMLSDCRRFARLFPQTFHVAFDVALTVGLRRHVFFEANAFGDLIRRVRHEGLDPYAWQVARLPGWLAARWPVECAA

SEQ ID NO: 3644 - protein, 324 aa, Methylobacterium sp.
MAGAPLDILYRGPLASCNYACPYCPFAKRRDSRETLRRDAEQLARFVDWAGGQTRRSLGILFTPWGEALIRPAYRNAMTALSRMPHIRRVAAQTNLSWPTGWLDGCDPERVAFWCTFHPGETPLDRFLGRCAELDARGISYSVGIVGKREHFDALAALRQRLRPEIYLWVNAYRDEGATYYGPDELALLRAVDPLFDLNRTGIRSRGRACATGESVVSVDGDGEVRRCHVVPARIGNLYDPDFDAALKPHPCPLAQCRCHIGYAHMPHLGFRELFGAGLLERALPHPAATLNGVRATGPAGRARRSSSATLSATPSAAMRSTPS

SEQ ID NO: 3645 - protein, 141 aa, Methylobacterium sp.
MIRRALLVALAVGPALAACSFPPTTMTPEAVEAFLEAPLPPGRRDMRTYTEAGIDRLVLLCLDAPEAEADAFAARLVPGGLEAGADPGLGLLSTTFEGWIAVPPEGSLGGERPYDGRRSVKVVIAPAGPGWRRVWVASFTL

SEQ ID NO: 3646 - protein, 141 aa, Methylobacterium sp.
LIVLDTNVLSELWRVTPDPGVLAWVDAQAIETLYLTAVTVAELRFGFAMMPAGKRRDIFRDRLEREVLPAFSGRVLPFDLDASRHYAEFMARARAAGKAIGMADGTIAAAAAVRGFVIATRDTSPFEAAGIGVINPWRNAR

SEQ ID NO: 3647 - protein, 95 aa, Methylobacterium sp.
VTATRPAGTRAAVAAWLAEGLDRATVVAPEALLPRVVTMHAQVSYRDGFMDQIGRVTLVYAGETSCTICCGAMNSVPNRAKRMPASPVVRSSAPP

SEQ ID NO: 3648 - protein, 34 aa, Methylobacterium sp.
MTKRVFLTSVVEFTAFGLLFGAVALWAVALAPIH

SEQ ID NO: 3649 - protein, 96 aa, Methylobacterium sp.
MAQHKRDALLTTVFVGSAVLALLLPGAPAWPASGGAGGRSSGDTLGNGRPGTDAPAGSADPEGRLDNSGAGGGGSGGGAGRAGGSGGSGYTFPEGE

SEQ ID NO: 3650 - protein, 161 aa, Methylobacterium sp.
MTIRYVEGDIFAGPERVLVHGCNAFGKTGAGLALQVKRLYPEAFRAYRAAFESLDDRQAGLPLGSATWVRAADGRLIVNAVTQRDHGRAKGRVYVDYEAVRTALRAIDARARSDGFEAVAFPLIGAGLAGGSWTILSQIIEAEARAFEPVVYLFDGLRPES

SEQ ID NO: 3651 - protein, 295 aa, Methylobacterium sp.
MRTFVRVVESGSFSQAARDLNVSQPTVSKQLAALESRLGTQLLARNSRTLAVTPAGQDYYEDTLRILQDLDFAEERVTAGQSAPSGLVRVTLSPAFGRMLVIPRLAAFREAFPDVSVEMEVSGRHVDLIEEGMDVAIRIGRLSDSALVARRIGDMRMITLASAGYLARHGTPKTLDELSHHQRIGYVYQGNIVGWGFDVDGRQVTVDGGGAFRTNDAEHVRGAVLAGLGIAHHASWLFTDVLASGEVVRVLEEYAPPTFPINAVTAAGRRMPSRVRHYIEFLAAICAEEPELKVG

SEQ ID NO: 3652 - protein, 44 aa, Methylobacterium sp.
VPSLYSAIVYSAVLLFMTLLGTNLWALRMAAAMTAADEEGQASH

SEQ ID NO: 3653 - protein, 71 aa, Methylobacterium sp.
MDDDDIIRTDIEFAVADACWRHEVTRQLGTSLVEDALTPPEMKGEPETALRLAYEERLRALQAWRRARGLA

SEQ ID NO: 3654 - protein, 120 aa, Methylobacterium sp.
MTDPWACAALAKVEQTAQLASEIRAIVERTRRIIANSREILAAHGAQDPPSHPPLPCPPKTTVPPDALCGVFDALLEAARQAENADDPELLALVERALLRTGDRIEQAAAALARRQPPIQ

SEQ ID NO: 3655 - protein, 324 aa, Methylobacterium sp.
MAGTPYGIADAERDLRASLGRAPAGAVVGGWSATTMQAGHAQISGGYTDAGGRHLDPEPRHAFDAVGAAVERLAAAGGAAFNRVEVRWTRARFPLSLLGQPGRIRVETAFDPTIVPRGPEDPAYEAAAAARRRFWEGRGRLLSGFAAQDPVANIHGQTKWFGPHRRVLLLHPASGTADGVVLATDGLSTTWAGIPDPENGVACEIALRLPEGEGEATERVGRWTNILMSLGDRVADGYRVARDVEKHGAILFSRLPAACAPFEFVILAAAADDAVIRDLPFGSVPLLEAVPVTAAEVAGGDPDEAWEASTARAALARRDRSAPL

SEQ ID NO: 3656 - protein, 206 aa, Methylobacterium sp.
PGLAAPPAASLPGAQAEARPAATGLLLGGGRVLTAASALDACAAPRIGGVAARIERRDAAGSLALLSAEGLAGAPPPLRTEPVGEGEALLVLVAQAKGRPSVAPASAAVEGVYAPLQPGAGGAPVLDRAGRLVGLVARFPATPRLIAGVMPPTRYGIVPGKAVAAFLAESGVPAGAGTGSAKGAATTLGGAAAPVLGAVVAITCTR

SEQ ID NO: 3657 - protein, 68 aa, Methylobacterium sp.
MRAAASYFRQKADLCRELAEALASQHDPVVSKLCEMADEFDDNARILERRVAREEAEEAVSSGAGNVH

SEQ ID NO: 3658 - protein, 296 aa, Methylobacterium sp.
MAPTDPTALAEHLGRLVDEITAGADAARTGGDILRLRDRLNREWDGAKPGAHLSGETYAALRRRSEAAHTRLTERFVALKDATPQPEPRLVIEPDGPTLDSFFEPEAPDAVWAAGVETAIRTAEARLGVRLPETLRALYRRRNGGATDFFLATDVPDAPLAFGGDAGVREADEVWRTVLPGFGLTALERLESLGAIADGIDFGSDEESWRAALPEIDRMIPISHHGSDLWLCLTYADPDPEPSVVLFDATAPNGGPGRTTFRRPDFADFFAGLRRYGVTVEDGVAMRGTRLLGTEA

SEQ ID NO: 3659 - protein, 324 aa, Methylobacterium sp.
VRAAIAALLLSAVPAQAWEPTKPIEIIVPFPPGGSSDQMARTIQGAIQKNNLVKQPIIIVNKPAAAGGEAMLDIQKSAGDPHKLITTSSGIYMTPLSTKLPVSWKDFTPIAMMAQDAFVLWVNSEKPYKTAGEFFEAAKAAKPPLKTGGNGSKREDHLISVTMEQATGTKITYVPYQGGGPASVQLAGGHIDANMNNPAEEVANWRSGAVKPLCAFSDKPIEYTQKVTAEMAWSDIPTCQSQGVNVTYQMLRGMFMPGKVTPEQQAFYVDLFKKVTETPDWKAYLERNALVPDFRSGQSFVDFLTEDERKHKELMTKAGFIATN

SEQ ID NO: 3660 - protein, 165 aa, Methylobacterium sp.
MTEASPPLPERGLSRRAVEIVVALLLLGLAGLALWDSYGRGAGWDNGPENGFFPARVAAILGVAAIAALVSALRREDSIFVTYGQLRLVAQVFVPLFLYLLGIAFLGIYLSSALFMALFMVTLGSFRWWQTALATVLVPLVIFWVFEQQFRVPLPKGPIEAFLGY

SEQ ID NO: 3661 - protein, 508 aa, Methylobacterium sp.
MDDLNQLLLGFQVALTWHNILFMVVGVLLGIVVGVLPGLGGPNGVAILLPLTFGMDPTSAIILLSSIYWGALFGGAITSILFNIPGEAWSVATTFDGYPLAQKGRAGEALTAAFTASFIGALSGVVLITFVAPLVAKFALRFGPAEFFGVFFLTFCSFIGMGRENKAKIIVSLALGFLLAAVGLDTISGDLRLTFGTPELMKGFDFLVVVIGLFGVSEILLTIEEGLHFKGKRAAMDLGVVLRTWASLPRYWATLIRSSVVGMWMGVTPGGAIAASFMGYGLAKRFSRQPEEFGRGDIEGVLAPETAAHAAGTSALLPMLALGIPGSATAAVLLGGLMIWGLQPGPLLFVEKKEFVWGLIASMYLGNLAGLLIVLATVPVFAAIMRIPFALVAPIILVVCAIGAFTVESSRFDIWLMLIFGVVGYVFKKLDYPLAPLVLALVLGDRAEDAFRQALLGSGGDLSVFFSNGLVSSLMVLGLLLLFWGPLGDLRKRLARKAGLTRPAPVSH

SEQ ID NO: 3662 - protein, 41 aa, Methylobacterium sp.
MSGRDEFVVLALLGALTLVGALLWAREGVTLWLAAAFPLCL

SEQ ID NO: 3663 - protein, 97 aa, Methylobacterium sp.
VLAPPDLKESQVQQGSQESVERLGRQALQVQQATLDLWDQWVRLGLAAQMAWLDLWVRPVLQASEAFKAQQDRQARVDRLVRRGIPAPVARQGLRVL

SEQ ID NO: 3664 - protein, 309 aa, Methylobacterium sp.
MRILVATDFSPRSQRAVRRAGILAGQSGGGVILMHVVEGAGAREVARDVCEAQRMTVELVTVVPELFRVECRALVVAGALPDAVLDAATAREADLIVVGVPLRGTARDPGRMVRNLIRSPPCPVLVVNRPAAGPYARVMLPVDLTDASARALRSAASLGLADDAHVTVVHAFEVLGKPKLSGFGVPHEQIDGYVEGWRSSFAEEVEAFLGAEGLAGRDWVRRVEEGRADEVIANLAARTCSELLVMGTHARTGIRRALLGSVTEAVLSVGGADVLVVPPPRSGADSRLDRPGRPSAVRAERPALRVVSA

SEQ ID NO: 3665 - protein, 197 aa, Methylobacterium sp.
MNPLTHYDLYGWPEGRDPSAGFDNELYLARNGDVSAAGMNPLAHFLQYGQAEGRQAYAAVGKAADLAKDPGFDAEYYLLANPDVARAALNAGGDTFEFAHQHYESYGWQDGRNPNAVFDTKGYLNTYKDVAAAGMDPLEHYHKYGFSEGRDPSAQFDTKAYEAAYADVEAAGVDPMLHYLQYGAVEGRTAFNDGHFG

SEQ ID NO: 3666 - protein, 68 aa, Methylobacterium sp.
VSDSTVASRVDAALDELEQAYRRPSERIVALEAVLQEVCRDYRTGGTPLGRFVQVSVERRQERLARRA

SEQ ID NO: 3667 - protein, 26 aa, Methylobacterium sp.
REMFAAVDGVLRQHPEVGAYNQTIQK

SEQ ID NO: 3668 - protein, 51 aa, Methylobacterium sp.
LFSADAVLNLLARGRESVPPAPVPTPAGLTLGVEPAADCARYDGLRALEAI

SEQ ID NO: 3669 - protein, 307 aa, Methylobacterium sp.
VREFERLNDDGGLAVNLYPVSRATPQVRVEGGQSPTMSLWLTQSATGFLTVPTLEADLFTIRFVTGGQMIRRNVRGEQVVTQGYATFSALEDMRSGEASSGFLAISSTIARASLLSSYHALEGKVDRPLPALEPLTSIDGLGMRALLLSLEQMQIRLRDVRTVDDLFFPLLEEIVSYQLLSVWPRAPVAELPSPGSLSASHVHRAVEYIGAHLATPFRLADVAAGVGVSVRMLQMSFKRELGVTPVEFIIERRLQQVHRDLCSEAQRDVSIAELSRRWGFAHMSDFAQRYRRRFGCTPRETRRDMLR

SEQ ID NO: 3670 - protein, 453 aa, Methylobacterium sp.
MAVGKHRRRLALAAFVSLAVLSSHAFAQAETKGLPGPTEEQLAKLQAIYEDLHANPELSMQEKRTAGIAAKWLQEQGFEVTEGVGGTGVVGLLRNGDGPTVLLRADMDGLPMKENTGLPYASTKRGTDPASSRETAIAHSCGHDLHVTWLMGATQILAANKDKWRGTIMAVFQPGEEIGEGAKAMVDDGMVKRFPKPAVTLGQHVLPFPAGQVRLAPGPVLSRSDSLKVTLYGRGGHGSGPESTVDPVVMAAATVMRLQTIVSREVSMSDSAVISVGSMQAGSSANIIPDEAQLQLNVRTYDDAVRDKVLASIKRVVEGEAAISGAPKPPLLTMLGQFPLTVNDEDATAKVAEALKQRLGADRVQPASSANASEDFTVFARAWDVPSVFWFVGGTDPKKYAEAERAGTLNALPSNHSPEYAPVLTPTLRTGVETMLAAAGPWLAPASAGLPPR

SEQ ID NO: 3671 - protein, 133 aa, Methylobacterium sp.
VPVYGTGSGGDGGDFSFNGQLIDHAPRPPGIASRKDVYVVYLVGDSISPAYEDGSPIYVDPHRRPAPRDYVVVELRGKREDEPGPAFVKRLVARGAGKLKLEQHNPSGPLDPIDESEVVRVHRVIPWLELIGI

SEQ ID NO: 3672 - protein, 92 aa, Methylobacterium sp.
VIALAQDLLAAGVAVALYALGIRLFLGRCQRLAPSAQPFPPSSNDNRHAMRTQQPAPEPLDINAISVAVGMAVLLLGSGVSLVACLRINGWL

SEQ ID NO: 3673 - protein, 108 aa, Methylobacterium sp.
VRKLALGLFALSILLGGGRLSTGVVYLSDEPTALLVLKRGPALWIERPESQDRPLSEQIVLDREEPDLAYGWLYSPLMRLAPILAPGLAGVAVLLLAISRRRRTGAQG

SEQ ID NO: 3674 - protein, 223 aa, Methylobacterium sp.
MAKRLRRWRAAARFSSAELRLLRERRLIASSELFDETLYLYEAPDVMSEEAEPIEHFCRFGWREGRRPNLYFDPLWYRDRYLKGADQNPLVHYLTVGEASGCRPVCYFDPHWYARTYGLPRRVCALAHFLTHRRSQRFAPNPNFDLAFYLDRYGVEIGPNRDPFAHHLRFGAVRDIDPSPYFDSERYRHSKMTDPPPGMRTPWAEADLRVPLVHHLDTQCRSS

SEQ ID NO: 3675 - protein, 216 aa, Methylobacterium sp.
MPKLLVAAAILAASTSLAIPRTLLEIAGVEPPPLVPERAALVIIDAQQEYRSGVLPLTAFEPAVAHIVKLREWARARSVPVIHVQHVAKTGSAAFAAGSPGADFVPELAPAPGETVIVKRLPNSFAGTDFDAVLRREGRTSLILTGFMTHMCVEATARAALDHAYTSFVVADATATRDLKMPGGGTLDADEVKRNALAAMADRFGWIITSDRLIGR

SEQ ID NO: 3676 - protein, 417 aa, Methylobacterium sp.
MSNRWPHLDYLGWRETCSALHLYLQIAGKYRLAHSPWLNHSWNATFYVTPRGLSSSPIPDGPGIELLFDLHEHKVVGTNGDGREASFALGPSTVAKFHADFVRLVSDLGGTPTFDGQPNEVPFPMPFREDHRDRPWDRDAVQRFHRASMAVDRVFKAFRTSFLGKSSPVHLFWGALDLAVTRFSGRRAPLHRGGIPALPDDVAREAYDREVASVGFWPGGGGLDYPAFYAYAYPAPSGFRSASVRPDAAFWHEELGEFVLPYDAVRSAVDPDEALMAFLVSTYEAAADRGEWDRDLLECVPGRSRRVRAPDAEQSDKAPRATDVTVEREEGATKGRYRIVVEGVEAEMTYTRSSEKLIIIDSTNVPAALRGRRIGEQMVRRAVDDARRDGVAIIPLCPFAKAQIERHPEWQDVLRRA

SEQ ID NO: 3677 - protein, 407 aa, Methylobacterium sp.
MTTDLSALHRRHFLVCGTTAAFGLAGPASAQTPADGGGQPAAKALPAYVAWKDADAFVVHSNQTLETKRAWIGSGIVTPTERLFIRNNVNPPSDAIVADRDAWRVEIAGVTQPRTLTLAELKRMGLASVATVLQCSGNGRKYMQDALQPGQKISGTPWTVGAAGCVIWTGVPLRAVVDALGGPVQGAQFVTGTGGEDLPAGLKPKDVMVERSVPLSTLDTVLLAWELNGEPIPLAHGGPLRMIVPGYSGVNNIKYVKAVALTERETEAKIQATSYRMHGVGEKGAPSQPSIWEQPVRSWITAPLGAGPGGSTVVTGVAFGGMNAVTRVEVSADGGTTWVEAPLVGPDLGRYAWRLFALRMDLPAGRHLLASRATDALGTVQPEDTPPNGGGYSYNGWRGPVVPFEAA

SEQ ID NO: 3678 - protein, 169 aa, Methylobacterium sp.
MDDLLREFLVESAEHLDTVDAELVRFEQDPNNQQILRNIFRLVHTIKGTCGFLGLPRLEALAHAAETLMGRFRDGYPVSGASVTLILATLDRLKAILADLEATGSEPAGADADLIGALEAMASDEAPAAAAPPPPPALPELPPIVERELKPGEVSLEDLERAFMEARSR

SEQ ID NO: 3679 - protein, 214 aa, Methylobacterium sp.
VAGRAGARGRLIQVAGRFAMPSDDAPAVDAPAPPVPRALPSTETKDRHMPGYSQTELDRARLPIRSADDRDGAVCVLGHLLTEQREAHTDERAGIITRITSAVQDFDTRTALGGVSAAPFAGSSGIQRDAQAAPPPAPPPSPPRPSPPPAPASSACPPTLLADNMRARLDPTASMRRELARQGLAPASQPSAGASTAVASMERELRRAGLTPNR

SEQ ID NO: 3680 - protein, 70 aa, Methylobacterium sp.
VAQVRWHTVASELLADVRRSSIRLQLLQQLRQAWIQNLVQYRLVEGLQLQPEPQACAGIQDWSVVRHGGR

SEQ ID NO: 3681 - protein, 100 aa, Methylobacterium sp.
MHFIHVEDGLRLRFPGRDAAFNEGVEIGILAVNLATGRGEFTLQFSSGTLEQARTLATQMGYRVHVVRSDEAWAEVTFLTGHRRPKLTLIHNQPEAQSAG

SEQ ID NO: 3682 - protein, 355 aa, Methylobacterium sp.
VSTLAAHGAAFTEAVSGFGPGAPVILCHDDADGLSAGALLWRALARAGREPGPVRVIGRGESAWSPAILDELAALAPAGFVVTDLGVQAGTILPGVPTVLVDHHVPRSWPEASEATVISGHADAPIPTSSLLAHACAAALGAADDLAWLAGVGLVGDLGERAASADFPEIMGPLRKAHTAKALREAVSLVNAPRRSASGDAGPALRMLLRADGPRDIVAGTDPDAAVLHAARAEVKAALDAARAVPPLFAGPVALIRCDSPCQIHPLVAQSWTHRLRRQVVIGANAGFRAGYVHFAARSLGVPDLIGFLEERAPPLGSDDQFAQGHRRATGGQVRIETWNRFAAQLGFGPEAQIS

SEQ ID NO: 3683 - protein, 289 aa, Methylobacterium sp.
MRKLMSDRRTTPISIIGFDSAWTDSPKAPGAISVIRIDDKGRRTFVPPSLVSFDAALTVIQTEASFSALRIVALDQPTIVPNLTSLRPVDRVAASLISWLGGGVQPANRSKIGMFDDAAPVWRFKERLGATEDPEASRSASAGLFLMEVFPALALPSFGPAFCGRLLGPRYNPARRKTFTLAGWQAVIDVMRLRALTESVDGLCEWADALAAVSAPKKADQDQLDAALCALIGLHWQMAPREASIMIGDRTFGYMIVPASTDVRARLKSAADKAGVPIDVEMLDCSKPF

SEQ ID NO: 3684 - protein, 66 aa, Methylobacterium sp.
MPRILPNRRIPRHHLMPYRPSRRRTHGSDAKPVRASDLVLALLGVVLLGGLALGAAFTLATGATAP

SEQ ID NO: 3685 - protein, 79 aa, Methylobacterium sp.
VLLREAEVQVSNVTRTAAAQEFVEILIHRAKRSGACPAQMLREHGRRLALLAKLATDMQLQAVLAELDRQATRLELSAG

SEQ ID NO: 3686 - protein, 165 aa, Methylobacterium sp.
MEPVEASGWGRIDCRPYRASNLEAVIGIFHSALRETASAEYDPAQIEAWSRIDHAVWAERRLRGCCRVAWIGTEAAGFADLEPDGRLDMLYVHPTHGRRGVARALLRDVETLALDLGLVALRTEASLTARPFFEAAGFHVVEAETVARNGQAFRRYRMRKDGLGA

SEQ ID NO: 3687 - protein, 120 aa, Methylobacterium sp.
MSGGADGPLRETAMSVRRPLAAVLLAFLATPAVADPAQLELGKRVFTELAEPRCGACHTLADAGTKGELGPVLDTLKPSASRVATAVSNGIGVMPAFEDLSEEQVKAVAVYVQTVTGGKE

SEQ ID NO: 3688 - protein, 47 aa, Methylobacterium sp.
MADFNERAKRAVAKMPTIEKPPEKRRNAPRPNKPPVAAKPDGEGENE

SEQ ID NO: 3689 - protein, 301 aa, Methylobacterium sp.
VAGETVQFSATQRDAGAGAPGATALFPYDRMTVERFRTAFPRARWRDDLGAWFVPGTTAERRLNAWSGREWTGVLAHADERGRDAFAFEPLASPYLEAADDLVVRTPYSRAVVAELRLVPWARWDPASKAWRVPFRSLEELRSRWPAIEEAARRAEPEERRKREASRRASPEHADRRAEAAERRRNRYPVPEDALPPLGRVLMTHVGCAVFESVNGEGVEASVATRFYSGVAAGSGTLVWATRRRPTHDELVRARPAREEAGPAETALGWWQPTIDVLREERRRAASQERRRATRLTGATG

SEQ ID NO: 3690 - protein, 198 aa, Methylobacterium sp.
MNRVIRWLLRTLGGVAALLILNGAILLGTWIVLRNMTFTDPFAEQIAAHYRRSIPAEIDITSMVAQGSDATLIDLIIPVRREGCGGAAFQLSDAAAAQITKQGLAFLGSARIGRGYKNGPKEYYATYQPWQETPVPSTWLGDGMWAAGFGCLKDDARHFDADAVYRAVREPGAYFTTGPEKELLIIPRLRLVVLTYFG

SEQ ID NO: 3691 - protein, 412 aa, Methylobacterium sp.
MTKHAHETRGVALLENPVTNKGTAFTRAEREALGLEGLLPPSVEDLDRQAERVASHLAAKPSDLERYVYLTGLLDRNETLFYRVVMADPMRFLPILYDPTVGEACLKFGHIFRRARGMYVSLEHKGRIAEVLRNWPVKDVRFLCVSTGGRILGLGDIGANGMGIPIGKLQLYTACAGVPPEILLPLLLDIGTTNAALRADPLYLGLRREPPPTEELDAFVDEFVAAVQEVFPDCCLHFEDWKGTDAIRYLARYRDRVLCYNDDIQGTASVTLAGLATALQIKGEALRDQRILFLGAGSAGIGIANLIVSALVEEGLSQDAARARISLFDIDGLIEPKRNDLLPEQKVFAHKAEPSDDFLATVKTFKPTVLIGVSTKGGAFTREIVETMAKLNQQPIIFALSNLWMSVAAIAP

SEQ ID NO: 3692 - protein, 133 aa, Methylobacterium sp.
MKTRTKRIFLGIGFTLPVAFTLTGGLLLAAHSAMRPNPASRPLLAEGLPHELRSADRVFAKRVLTAFPVGLPEADLVRTLDAQGFQCREIEGRRQSSFVQQATPCQHTWSIDWIADNEGRIAEIKANDDPVCL

SEQ ID NO: 3693 - protein, 70 aa, Methylobacterium sp.
LGRAAAAIGRDEHSVKLLPLDALHAAVSAAALDACPISSQPRSPSMTVVVLIACNLLLAGLFSLVAVALD

SEQ ID NO: 3694 - protein, 52 aa, Methylobacterium sp.
MRIIVARVMAVAVMLLVMAAWRGLEQLGVASLFEECLVAAAAATAATVLARW

SEQ ID NO: 3695 - protein, 277 aa, Methylobacterium sp.
MPDGTDIMHIDFTGRKAIVTGSTAGIGRATAEGLARAGAAVVVNGRGSGRVDEAVRQIRDAVPGSDVSGVAADLSTMEGVEALVAQAPDADILVNNVGTAFLRPYTGIDDIAAIPDADWLGLFHLNVMSGVRATRHYLPRMVRKGWGRVVFVSSESAVNTPKEMLDYGMTKTAQLAVSRGLAEAVAGTGVTVNAVLPGPTRSEILGNFMARQARDQGITQEEAEQAFLSSLRPTSLLGRFATTEEVANMIVYACSEQASATSGATLRVDGGVVRYVA

SEQ ID NO: 3696 - protein, 62 aa, Methylobacterium sp.
LGSAAQPFALFRRFSQDERGATAIEYGMICVFLGLAIVTGMQTFGSVLMEALPKTVQFPKWE

SEQ ID NO: 3697 - protein, 90 aa, Methylobacterium sp.
VRWHGAFVQEGRTQAKPMGGDQRSHTIEAQADLIRQTYEAQPELFLHELRDRLAERGLRVGVSSLSRFFKRHGITRKKTPATPPSRSGRT

SEQ ID NO: 3698 - protein, 371 aa, Methylobacterium sp.
MPTINGTNQADTLLGTDDDDVIDGRGSNDSLIGGAGSDTLYGGSGDDLLDGGDGTDVLWGGSGRDTLIGGSGDLLYGESGDDDFVLLPPQPGIPLDRTEAFGGSGDDSFTGSGSYNFRLTLHGDAGRDSFTFDFLQASRLEGGDGRDTFDINTMSSGTLSGDDGNDSIRIGSALGTIHGGNGNDTIAIGSAKSTAYVYGDAGNDTISVNVGRAVVEGGEGNDHLTGGYDRYVSSQFYGGAGNDILTSRGHNILDGGEGRDTLESGAYQNVMTGGAGADRFVYGDLVQWDMMSADTITDFSVASKDKLDLSGLLAKVGASADPFGDGWLSLALVDGSTEIRFDSDGGADNFQTLVVLQGVDLIDQQSAALIV

SEQ ID NO: 3699 - protein, 204 aa, Methylobacterium sp.
MTVLAGLLAALFGTSASAQVAQGIKAYARGDYPAAMRAFEAGAAKGDPQALYNLGVAYAEGRAVPADPARALDYYRQAAQGGSVLAAFNLGQAYRKGQGVSAVPAQAAHWYERAAKGGHYKAGNELGILYIEGKGVPRDPIEGMAWIYPATHASIMDESAMANAIQAAGMLDRAQIQEAQARGKTYFERYIAPNRAVVRTLSGG

SEQ ID NO: 3700 - protein, 353 aa, Methylobacterium sp.
MVGLVTAVMCPPALSCDLDALRHYPMTKALENRAVPLRMPDLFFTSDRHPDFDRFSLDAAGAAEMRAALTRGLATFKPAERPVLMLAALDHWTSGATGLKGFFVLSDSVFLEDALQALDAEGLLAHAALLREGAALFGPDYGGSQARRYARWSDGHGEIRDAALDAALDRLSERFRALPRLLDEAVARIARAPDLTALYEPLRSDADDDDRLAYLTGGLWTCLNHYDAPAAVAARLAALPTAHARIIAVRIFEAEMLNGSVHQAFFNSSGVLAPDVVEALKAMNLPKHAAAVERGIAMFPKPYPRDTEARRAFMGRQDKAFDTALGDLTGDVDDGAMHAAMIATARAADILPK

SEQ ID NO: 3701 - protein, 336 aa, Methylobacterium sp.
MARDPYIVRPETLPSAFPPGHEPPRLLLDFADWLEGRPWGSLGCFRLQGTLSDEAPIVDGSALRREFSLFLYLPDGSLVGFWHPDGVPTPSSPVVGLGSEGDAAVLAGSLEGFLAKLARDAFSDSTWSDLAAAEEDEEDDEEEDEGNPTRAADDETRDALAEWLAGRVGPERLDALAGEVCDSTAFAARMDAWMHEREAYWAGHSILTEIGRALAAHRPPGKTPWDRTQLRAAIVGTLCEVQVYRAGPQPVPEIAQVEPLLRALRDEQHRTDPDLGLWFEAHLTLDAKGCILPRFDYQTRPILGGAPAPVEQARSDLSRAPRPARWVPDWLADSRA

SEQ ID NO: 3702 - protein, 124 aa, Methylobacterium sp.
MSDTKWRKLLCALDEAGFGRAQIIVQFIDCPEPGVMTLPTRADLWPPRPYVDSMSVGPFELRAIAWLELPAFARWPGRDGRPVPGIPQDVARARAVLESLGRFPLEETERGLRVIGYSGRRSGA

SEQ ID NO: 3703 - protein, 508 aa, Methylobacterium sp.
MRVRAQIGMVLNLDKCIGYHTCSITCKNVWTNREGVEYAWFNNVESKPGIGYPKDWENQHRWKGGWTRKSNGRIEPKIGAKWRVLSKIFANPDLPEIDDFYEPYTFEYGWLQQAPELQAQPSAKPRSLITGEVMNKIEWSGNWEDDLGGEFSRRSQDANFDGIEKEIYGQFEKTFLMYLPRLCEHCLNPTCVASCPSGAIYKREEDGIVLIDQEKCRGWRMCVSGCPYKKIYYNWSSGKSEKCIFCFPRIESGQPTVCSETCVGRIRYLGVMLYDADRIEEAASVENPKSLYESQLSIFLDPNDPAVRRQALLDGVPEEWLDAAILSPVYKMAMEWKVAFPLHPEYRTLPMVWYVPPLSPIQSAAEAGKISAKNGMPDVESLRIPMRYLANMLTAGEEAPIVSALRRMLAMRAFMRAKTVDGRLDERIAEEVGLTAHQVEEMYRYMALAAYEDRYVIPTSHREVNENAYHLRGSTGFSFDEPTNGATKTNLFGGAKRTPRKPYMDVPL

SEQ ID NO: 3704 - protein, 96 aa, Methylobacterium sp.
MLSGLAYFLASTLILQPVQAEVADRLRQAKVAPEVVAQAQACVSSALPTLVQRVGDDYWWAATTAAGVWLGLTPLERVVADVAPSCRGTIDTIRAS

SEQ ID NO: 3705 - protein, 136 aa, Methylobacterium sp.
MQTAANLANPLVDALVRHAERRTGSRMLAYEAVGRTIGTTASWVRKFVGNQPVRLDADTFLRIRATYQANCDRWDAQADEDRAAFFALGGGDDAMDQGTNARLDVAEGSRAARGRQASALVAPVVDQGAQRLTHSR

SEQ ID NO: 3706 - protein, 294 aa, Methylobacterium sp.
MVKLRQEAIGFNYFDVLQRKGLISGSVPGRVMGIEGAGTVTALGPGVGGFAVGDRVGYLRSQGAYADERLIEADLLFHLPEDVGFDIAAALTVKGFMAWLCARRLYEVQHGQTVLVTTAAGGVGSLVTRLAAHHGARVIGMVGSEPKRRPVRDSGAVDVAVGLDDAGGMVARLTGETGVDAVFDGLGADTAERLLAANAVRPGGTIVSFGAAAGWPTADREAIARRGYSFMAPQAPDYIASASELRGAMTEVFALHRNGAFGAIPLTRHPLRDAAELHRQVDRRVVSGISLLVP

SEQ ID NO: 3707 - protein, 184 aa, Methylobacterium sp.
MAVVVEDAAAVLGFWFGEVPPDKRFAKDPVLDRVIEERFGALREAVLASDADGWRDSPDRLLAAIILLDQFSRNIFRGSGRAFAADPLARSLTLQAFDRGWEDRYAHEQLRFLYLPLAHAEDIEMQALSVARYEALGDPEALKAAREHADVIRLYGRFPSRNAALARQSTPAEISYLRETTHRW

SEQ ID NO: 3708 - protein, 102 aa, Methylobacterium sp.
MVIVKNDLIYIARTRNALTLTEASYPPVQYIPRGDVDMSRLIRSQHTTYCPYKGEANYYSIPALGDAGVNAVWTYEAPFEAVGDIDGYLAFYPDRVSVELAE

SEQ ID NO: 3709 - protein, 287 aa, Methylobacterium sp.
MVEGLADLARTNRAATADLNAAAAEIRASAQEQAASVEEQFAAVQETAATIDEISQSGAQISKRATEVIATAQAAAQTARSGLRAAGDTAKAMESIREQGEAVAGNIVALSERTQAIGEIIVTVNDISERTHLLALNAAIEAAAAGEQGLSFTVVASEMKLLADQAKNATVQVRGILGEIQRGINASVMLTEEAVKRAAAGKTRTDSTVRTIEEMAARVEESVQTFQQIVASTNQQLLGIEQVTGALHNIRQASQQTAAGTREVETASANLTELAGELLTRSERYRI

SEQ ID NO: 3710 - protein, 114 aa, Methylobacterium sp.
PLPAHAGHGLPSGPSDGGGQGRLAAAFALALALHAAGLLGIAYLRLTPPSPPGEQEITIDLAPQMMEAETQAPAETQQSEAIPEEAKPEGEPETAQPVETPQEVQPPPPPEMTQ

SEQ ID NO: 3711 - protein, 43 aa, Methylobacterium sp.
MHPQVDVSSRTEAATPSVLMAFLGFATSTVGFVGIMTVLGTLA

SEQ ID NO: 3712 - protein, 170 aa, Methylobacterium sp.
MATTDIGTIYAGALRNTRALEKQGLEQMERQLSGLERYPDYAAILRRHVETTKLQIDRLDTALELIGESRSTLKETVTSVAGSIGAAVHATAQDETLKNLYAGYAYQYDQVAAYRSLAVIAERAGKTDQVAFFRAAVDEETKAAEEIAALIEPVTKTYLDLTLSGAKADS

SEQ ID NO: 3713 - protein, 112 aa, Methylobacterium sp.
VICPKCSGSTKVVYGRPSAKEPAVFERQRVCVSADCGERFISYETTANIVTRRVEKARRGGARKIQDIPLARQLALRKAAEAEGRKLNKPASEILKSWGVSAKPSRPANPLP

SEQ ID NO: 3714 - protein, 83 aa, Methylobacterium sp.
MVAAGFSAEQIATVVKAELVADQARLAKVDEARRAKAAEKKRRQRAAKGDVSPDVPGTQGDNRGHMGTHGDSPSLHGLPLPQT

SEQ ID NO: 3715 - protein, 257 aa, Methylobacterium sp.
MAQDLTTRSAAALPAIDTADPASMLLLPDWLASQLAAVSDLGAGRTEVDPVTRQITARVATIPASRMPTGPQRAAIALRIADLQAATEAGPVGETIAALGDLIQEYAPTRLDDRTVSIKAEAYLDAVEDLPAWTIRAAIRRWRRGEVSADPATLDFAPKPARLRSIAERMVLVARGQAARLQRVLDAKPEERITDAQMAANSEKLTGLIAKTADGPVIEPQGAISAERRAALADLEERRKRREAAEREAAAAQEQAS

SEQ ID NO: 3716 - protein, 62 aa, Methylobacterium sp.
VIPGWIGDTIIIGGVTSQTLSGATVLAKRSRGTLALSSGPFETATPNLTMATIPVTVRVICN

SEQ ID NO: 3717 - protein, 537 aa, Methylobacterium sp.
MDTTTEDTLAEADQHYAALGLTRGRVASITDVTAAFRRLSMEGGHPDTGGLAERFIALKAAYDWFKQKLKEQPSFFTIEALRYAGGFGASGGYDAYDGRDGYDDRDAHDGKRPQDGLGDCPFDGKVKTRAMDFIHEYISNRELVVDARGVISPSNGYKTVETHTVEEVLRERDITFPRLLDEIKFYRDRTHSKGDEGLSNFELKQGLMTVIGNLKNERQAVIFEGLMLELSDAERIDADLAWSRLADVAFDGNPVVAIAILKKLIHQVKRKALKAEVENHLVPVIFSPHQGLGKSKFVRQFLTPLEELFGGNTNASALVDQSNIGLFEHPVIFLDDMQSFDEKHIAALKDVISADEISRRVYFTQNMQIFRQKSTLIATTNVDITRVVPDPTGHRRFGQMLFRFYPPGPERKKVWDVINQTDWLLLWRSVGHGDADPIKDVLPFLNTQNTAKTPEGRLRTWVRKLDLNRPEIAATRRGVTEVHYIAADLFAVYETDTGGSSGLTVNDFRRILDECCRQGVGPFVGSGKHAKGKSYRT

SEQ ID NO: 3718 - protein, 107 aa, Methylobacterium sp.
MGWVRTGATVERVAAEAAIPARTVAHARSLVAHAIGRWPAPDAVQPGYWPTLCLIWPALEVEIHDDRFELYRFGPNATQIREWRCGPDAPAADTLDALLHAAFGETA

SEQ ID NO: 3719 - protein, 315 aa, Methylobacterium sp.
MIALPFHKAPAPPAGFKFRVLMNQYDEELQFTFVDDDVPNRGLSRPSQPDFDQFVVTLDYQQKIAQIAAEDRPSSGGLAGPVGLPIHHEPGLWLYEKNRRSTDDQIKGDAVSEVELDVARLASIPHGNSVLALGKSEVHHGMPPIPPISGLPSGRFEDVTTPDYDFRSATDPDPYFEPYRHYIDNPFMGNVTAPGFPGFSPADMNAILRFANQNVEIVRTTTLTVDSTRKSAGISNVPFSVREAEPVSMKSTFWIQELAEKDEQGNPKLRLQYSQVVMLHFFRPREDEFPERAVWPHISIATLDKLPAGYELVES

SEQ ID NO: 3720 - protein, 308 aa, Methylobacterium sp.
MSATLIIDRRPDPAMPTGCGSGCGCASASKPPVPPPSDGPVSVNGVAIAAEAIAREIQHHPAGDGAAAWRAAAQALVVRELLLQAGRAAGFASRPERDEAGRWELAEEALIRAALDLAPEPQRAGAAECRRYYEANLHRFRMPDLFEASHILFEPASDDAAGWQQAEREARALAAELGDDPGDFAEAARGFSACPTARQDGSLGQLRRGELVPEIQAALEALTEGTTGRVPVRSRFGWHVLRHQRRIPGKTLSFEMVADKIAEMLDARAWTMSAAGFVLHLAEDATIEGIALDAESLSRLPASGGAPP

SEQ ID NO: 3721 - protein, 257 aa, Methylobacterium sp.
MWEAVNYLLFGWYPYLAVTVLVFGSILRFDRAQYSWRSESSQFLRRKQMLLGSNLFHLGILVILVGHFVGLLTPIALFERFGISHTAKQLMAITVGGIAGIAALIGCSLLLHRRLFDARIRRSSSIGDILVLVLIWLQLIVGIGSFYWTFQALDGHEMVRFMGWAQGLLTFQPGAADLLLETALVYRLHIVIGLTIFLITPFTRLVHVFSAPVWYLFRPGYQVVRSRRGPAQAVADPFAGAISGAASIGRAQAESAQ

SEQ ID NO: 3722 - protein, 232 aa, Methylobacterium sp.
MRYTLRALSVLIAYPSEDLQAHSGAVREALHGEAELPPEALARLEPLFEAFASQDVFDLQAHYCELFDSSRALSLHLFEHVHGDGRQRGQAMIDLGQAYLARGFMMREAELPDYLPMFLEFLSILPNDEAEEWLAQPAHVLEALEQRLTERETYYAGVLHNLLHLAKRRPSTGQVRDLPDYRDPATPAEIDRAWEDAPIDFSAPLGDASQPSALMTRLRAAQRDARDQAKGG

SEQ ID NO: 3723 - protein, 1259 aa, Methylobacterium sp.
MSHFLDRLTFFRQRRETFSDGWGVATDEPRAWENTYRKRWASDKIVRSTHGVNCTGSCSWKIYVKGGIVTWETQQTDYPRTRPDLPNHEPRGCPRGASYSWYLYSGTRIKYPLVRARMLKAWREARATLGPVDAWRKIVTDGETRAAWVTRRGRGGFVRATWDEVADIIAAANIHTIKEYGPDRIVGFSPIPAMSMVSYAAGTRYLSLIGATSLSFYDWYCDLPPSSPQTWGEQTDVPESADWYNAGFLLVWGSNIPQTRSPDAHFYTEARYKGTKSVVISPDYSEACKFADLWLHPKQGTDAALALALGHVVLKEFYIDRQVPYFQDYARRYSDMPFLVKLVERDGKLLPDRFLRAADFADGLGEAANPDWKTVALDQDGGIVCPRGSAGFRWGDPGKWNLEETNGAGEPTRLRLSLAGIEDRLAPVSFPYFGGIAPGGFVATDHPEVLSRLVPLRRVALKDGEALAATVFDLLCANYGVDRGLGGDDVAATYDDDVPFSPAWAERICGVPRQAILQTAREFAETAEKTDGRAMAIVGAGINHWYHMDMSYRGIIALLILCGCVGKSGGGWAHYVGQEKLRPQTGWLPLAFALDWVRPPRQMNGTSFFYAHSDQWRYETLDVSDILSPTAPPGDWSGSMLDYNLRAVRMGWLPSAPQLGINPLALARSLEARGEEPATALPRLLKSGEVQFAMADPDAPQNWPRNMFFWRSNVLGASGKGHEYFLKHLVGSSHGVVGTEDGIRPTEVVWREEAPKGKLDLMVNIDFRMSTTSLYSDIVLPTATWYEKHDLNTSDMHPFIHPLTAAVDPVWEARSDWDIFRTIAQTFSRLCEGELGVEKDIVLNPIQHDSAAELAQPYAPLDWGRGETEPVPGRTMASIAVVERDYPATYERFTALGPKLDTLGNGGKGLEWNTQAEISQLGALNGRVEAGPAAGRPKILTDIDACETILMLAPETNGQVAVKAWEALGRATGRDHAHLAAGKEEEKIRFRDVVSQPRKIISSPIWSGLESEKVCYSAGYTNVHELIPWRTLTGRQQLFLDHPWMLAFGEGFVTWRPPIDTRTVAQVAGKLPNGHPEIQLNILTPHQKWGIHSSYTENLLLLSLNRGGPTIWISEVDARKAGIEDNDWIEAFNVNGAVTARAIVSQRIMEGSAIMYHAQEKLVNTVGSEITNQRGGVHNSITRINMKPTHMIGGYVQFAYGFNYYGTVGANRDEFVIIRKMSHVNWFDKAVDDTFNTDATADWGGHGVNPNTKSKETAA

SEQ ID NO: 3724 - protein, 100 aa, Methylobacterium sp.
MSETSHSRSAKAQKAEGVQAVGSAKAGAGHPDVTEGGPAASPTEGKGHPKPAASTADTDGSPEAGTSSATAGKAEKLAAAENAALTKEQHGRGRRKAEEA

SEQ ID NO: 3725 - protein, 174 aa, Methylobacterium sp.
AVLTGLPPATRFGRSGIYARFDQMVWRPDPNGIGGLTLFGVAMAGTGGRLIEDYFLEIGALQTGTFAGRPYDTVGFVINTQAFSPLALGNIAAAQASLGLFRTIPKQQIMMELNYGIQVTPAIRLTPNLQYIVNPDQTRFPYYPKNIPDTLVVGAKLSVDLFTLAGLAMGPGSP

SEQ ID NO: 3726 - protein, 140 aa, Methylobacterium sp.
VGEGAISGLFTVLVEGDDHNEPVADAVRGILDGHIVMERRIAEQGRYPAINVLRSVSRTMPRACDPAHLPTVRRARKVLATYADMEELIRLGAYRAGSSPEVDEAVALMPDLTAFLGQGKEEATSIGEGYARLAAIVGGG

SEQ ID NO: 3727 - protein, 290 aa, Methylobacterium sp.
MSNGTTLLKKWELLQAITADPALSLVAKVIATRLLDHHNNQTGQCSPAYETLARGAGLERRSAIRAVKELEEAGWLRVSRVNGGATDAAKGFVTNSFVFDFSRADRASTPVTDQTLPPSVQPDTPPSASSDTPPGDWLDTPLGDSSDTPGVTKQSPPGVSDQSPKHLKLETGKGNRESPPTPSRFDEWWETYPRRDGKIAARRAYDRTIKQGLGSHDELVMGARRYADARAGQDPKFTKMPTTWLNGGHWADEPPPQHQPAHNPASRPDAGRPSATAYLMARQARRLGHG

SEQ ID NO: 3728 - protein, 217 aa, Methylobacterium sp.
MADPKRRGQEIAAAAPRAAERADLKGLLVPEQLLSQHDHAIRRTCFPSLRAIDERYSLESRAQQEQVHRDALEHMLARSATQHELLMVGEALTDAMAAAPDEGVIEACLAALIDTRVKLPHNLPIYLEALIYDLKDEGFPPAVVAAACQRIRRENVFLPEISEVLAVCRETLTRYRERERTISKALEDRRAAEAYIVRLNAPKTPAEAVSAEDEAHG

SEQ ID NO: 3729 - protein, 86 aa, Methylobacterium sp.
MSPEQRAAFLAARDALRRADEVLSAVLDADAVPVPDLFDAVPVAIAAQAWAISKDSARQRARRGAGFRIRGRWYVPRAALSCHVSP

SEQ ID NO: 3730 - protein, 72 aa, Methylobacterium sp.
MTLHITLPERVSAAVTEDMADAIRRTAAARGISVADYLRGALQGRLLMDGTPIRPLPDLQRLATPAGRIRTL

SEQ ID NO: 3731 - protein, 56 aa, Methylobacterium sp.
VRLLLCFLSLAQIRLSAFDRERSKMLARQADEALMRACSRMALAEELARRARLNGH

SEQ ID NO: 3732 - protein, 165 aa, Methylobacterium sp.
MSDLRVIVPAKRRKLQDARSGSRPFAYLDLYRASPFDRIEVIKAGVSAKSVKRFITALHLDQQVMFDALNLKTATVNKKAAKDEPLSAEDSERVVGLAKLVGQLEAMIEEAGEAENFDAPAWLSRWLREPLPALGGGKPLDLLDTMEGQALVSRALAQIQSGAYA

SEQ ID NO: 3733 - protein, 108 aa, Methylobacterium sp.
VLLVEDDYLIAKAMGTEFGALGAEVIGPAGSVESALELIATHELDAAVLDINLYEVMSYPVAEALLARGVPFVFATGYDKAALPERYAHVPHCEKPVEPYQLAQALFA

SEQ ID NO: 3734 - protein, 253 aa, Methylobacterium sp.
MSEPPASATHVLITGASSGIGREMALSLSGTYPLILNGRDEERLEQTRLACQAPDRHLCWARNLADVTTLAEALPIFLRQHEARVGGFVHCAALLKVLPLRSVTIAQAQDVMNTNVLAALEITRLLLRKDVNGKMLRSIVFVSSIASQFGARGFATYCASKAALDGLMKALAVELAPEVRVNSVLPGSVRTPMTETMFADSDTAERLMRDYPLGVGLPSDITAAVAFLMSDQARWITGHQMVVDGGRSVNISA

SEQ ID NO: 3735 - protein, 73 aa, Methylobacterium sp.
MTLSDYLRAHSLTHAEFAARIGATQAAVTRYANGRRKPSLEKIIVIERETDGQVRAIDFLPEMAGASVSGAAA

SEQ ID NO: 3736 - protein, 420 aa, Methylobacterium sp.
MSTQAQGAVGAETKTAGQVAYEAWWDCPAVARFSNEDPDRRARWERVASAVLEHAALAAPRMDSAERTAGEDLRAILLRAKWIGQRTTAEDYSARVVFDTQEEAYDAYRALVAVRDATPAPSSPGVPDSVREKIRLAIASVNVHAEASEYEFQADEGDHTPTDAERAILEDFGEQILSHLEAALLSTHPAVQSTGQGAEDLGKCIGCGKALTAEEAEFLVNTCDGCEWEEHECRKNAEELAPDSTRTGPVGTAWVLVPTEPTSEMIEAARETTKWGAGNWGDLPPGHDTYRAMIAARPAAPEAQEAWRSQAADDVLAERRRQVEAEGWTPAHDDGHSLGELGLAAALYALPYDARVGGEPLIEQDHHIGLDMALEIACGWRLKPDTDPRRRLVKSGALILAEIERRDRLPAPPSSGQGGR

SEQ ID NO: 3737 - protein, 508 aa, Methylobacterium sp.
MWDTLTQLGAGFLACLHPVTLLMLVAGIVVGLLVGVLPGLTLVMGVVLFLPFTYKMEVTNAIVLLSAMYVSGTYGGAFTSILFRIPGEPIHVPLLWDGYAMARKGEPARALGWTLVAAFGGGMLSAVAMVLLTKPVASFALQFSSPEYFAILLFGLMSVIALGKGSLANALISLCLGLLIASVGTDATYGAYRFTFDQPILADGIEFLVVMVGAYGVGEVLSRLEYGFSSKPLDKVANARTQLPSLGEMVRLKGMFLRSTLLGHVIGIIPGAGATIASFVCYGVESQFGRRRREMGSGIPEGIVAPQSAATASVGGGLIPLLALGIPGSGATAVILGAFMLHGIQPGPQIMVSSSAMVYTIFASIFIGIAVMCVLGYFAIRPLVAILDFPEAIVSAFVMLFCFVGALAIRSNTVDLWLMLGFGVLGYLFERLKFPIAPLVLGVILGPLAEESFMNAMISYSNDWTVFFTRPISGTIMALALLTMALPLVGMLRERRAEASGALKPAAR

SEQ ID NO: 3738 - protein, 598 aa, Methylobacterium sp.
MTMDGVFQNCMRQVRRQVMPVMWFSLAVNLLMLISSIYMMQVFDRVLASGSLHTLLWLTIAALLGIAAYAVIEQARRRVLARTGLWVEQRLSQPVIRRGVDARLAGVRSEASASDVGDLKTFISGEALLAFLDAPWMPIFIVVIWLMHPALGAVAVAGAVILFGLAVLNDLLTRSASARSAGDARQLQFSAQQMVEHGETLKPLGMVDPMLRRWRDRQGAVHAGAQGTQDVTETISNLTRALRLGLQIVILGVGALLVLRGQLTSGGMIGASIILGRALSPVERALTAWRSWVSARAAHTNLRALFDALPDHAGPMDLPAPVGRLDMEAVRYAPPGAVEPVLRGIDARIEQGTTCGILGPSGSGKSTLCRLIVGAWMPSAGHVRLDGADITAWNPMQLGRSIGYLPQQVDLFPGTVAENIARMGIVDAEQVARAAMLADVHEMILRLPEGYDTDVGRLGNRLSGGQRQRIGLARALYGDPVLVVLDEPNSNLDGDGEQALNRALIELKRLGRTVVIVAHQPGALRTADTLLVLRDGAVGAFGPRDEVLKHLMVPKPRDEATASAHRSAPAGPAAASSAASFAAAPFAAAPFAAAAPAE

SEQ ID NO: 3739 - protein, 93 aa, Methylobacterium sp.
MFEMRREKLIDERRQCVTLRAFFTASQEQGDALPSSVMAHISASAAHNGFALRVERQEPALAVRIYMQVMNLFRIAERSDWNAKHICEFTQAI

SEQ ID NO: 3740 - protein, 77 aa, Methylobacterium sp.
MRQDALPNAPLPAPRSSPVEDIARAYLVTAQGDAEAALHAAIADALADLCEAERRTVRQDRLISRGYVRAALHMAVR

SEQ ID NO: 3741 - protein, 112 aa, Methylobacterium sp.
MDAIDGGECDEDWDQDLADDLIGSTLLVGLTYVDPEGALLGRRQVFGIVETVDARTGIVIWTGDEGEPFTVAPLLDAIEVGEPGLYQLADQDRVVENPDFTALFTVTESRRN

SEQ ID NO: 3742 - protein, 192 aa, Methylobacterium sp.
VKWLEREVWELLSQNEGKVQLANRSTPTGSKLPEAETASMGTFLGNMIYVLEALGFAFFEEPGAPSTETLALLSTSPAAPAVQSFFTGAQPRSETHKAHLDMVGDGYVLRAGSMVSANATDSLPSSVAKLRAQLLAENALMPQDGCLRLTKDIAFTSPSPASALVKGRSSTGHGDWFRTTDRKKLGDVLRER

SEQ ID NO: 3743 - protein, 37 aa, Methylobacterium sp.
MLSVSRAVVSKHREISALPATYAMFLSGVLVLAWAAA

SEQ ID NO: 3744 - protein, 157 aa, Methylobacterium sp.
MAAKTDSAGVRFPPPLIYLGALLLGSAAERFVTLRSFGIDWWLLVAVGVLLSAAGAAVMLVAVRQFRRLGTEIPPSRPTTHIARTGPYRWTRNPMYLGMTSIYAGLAIGFDEPVAFLLLPLVLIAIQTQVIAREERYLEAKFGDDYLRYKAEVRRWL

SEQ ID NO: 3745 - protein, 478 aa, Methylobacterium sp.
PRAPGASPPPAPPAPGTPPQAGPTPHQTASPPCGVDASVGTVCAANTNVPCGVDLGAGTACGANAAAPCGENLTAGRACGTNASGPCAAKNTGGSLCGGKASACAADAGLGTACAADIGACAMNAGAGTACAAKETACGANAGIGNACATNFGACGAKLTTGKACGVDGSVCDARYSGPAACGVDGNLACAQKGSAGATGLGADICGSDNAIELCGSDLGVCGGNLGAEACGTDGNLCGTDATIEACGADGNACAADATVEACGTDGNLCGADAGAEACGADGNVCGADSTVEACGADADACGANAGAEACGADAGACGADGTVEACGADGNACGGNAAAEACGVDGNACGADAGAEACGADGNACGADANVEACGADGNACGADARAEACGADADACAANASADACGADADACAANASADACGADADACAAKAGADACGVDTGLCAANLGGVCGVDAPLGDPISFCAVNVIPLLPSC

SEQ ID NO: 3746 - protein, 283 aa, Methylobacterium sp.
MIINQVLTVVRTEGAAGLFARAGSRILKPRAKSFRALRERLVGKRALEIGGPSAPFQARGIFPAYPILATVDNCNFASRTIWEGEIDAGASFRFDPARAAGRQYIAEATALPEIAGGSYDVVLSSHTIEHTANPLKALQEWRRVLQDDGLLVLIVPHKDGTFDHRRPVTSLGHLMEDFDRNTDEDDTTHVPEILRLHDLRRDPGGTTAEAFAQRSAANLEIRALHHHVFDTALVEAMVRQAGFRPLAVEARRPYHILLVAEKTGEAGTSTEPMRFASPFRSDR

SEQ ID NO: 3747 - protein, 156 aa, Methylobacterium sp.
MSIFGSIMSKIFGSSASAQAAAPHASETPSVSAAAQGADGPTGSASSAAAPSMSGAPSPVAAGPAGAGQANVDVGQVLADLASKKGQTLDYKRSIVDLMKLLDLDSSLQARKQLADELHYTGDKEDSATMNVWLHKQVVQKLAENGGKVPDDFKPA

SEQ ID NO: 3748 - protein, 67 aa, Methylobacterium sp.
VNDQQRLDGAPLNPTLRKVSDGTHDTSRTAAPLESISIRTPHGGHWAWICLAVFVVCVLVSLVLIFG

SEQ ID NO: 3749 - protein, 87 aa, Methylobacterium sp.
VSRKRPIEGKRQRRRRAGRLALALLPALLSAPALAQEAPDPSPSDSAPSAAPGTRIASEPPTAGRPRRSVFDAPTALRGANAFSAPA

SEQ ID NO: 3750 - protein, 49 aa, Methylobacterium sp.
LRRPRTGLHTALQHAGHDPVGRAETSMRIAMIGSGYVGLVSGACLADFG

SEQ ID NO: 3751 - protein, 77 aa, Methylobacterium sp.
MKDYRFDEQVALLQKKPGDDEPTIRLFLTLREAAHRVATAEEASFERLSSVIIRNGEPLRDIAEIDRIHRLFSGEQQ

SEQ ID NO: 3752 - protein, 488 aa, Methylobacterium sp.
MLDGMIAEPGRYLLCSPRTSLIDEQAVYLRGSAAALDRAVEIIPIHSAQKGQRGDVLRRLREVVRESAATSRDDHRIVVVTHEALLTLDPSTIAGWHVRIDETPNIIASGSMRIGATWSSLERHYILESIDGTAWARVVDRDDVARLDRRQIVEDDATTLNTFRAAAWSPNRTTFVDLREWSDAARSRSPVRWWSMWSFTTLEACASVMMTAASFSDSIAYRSIRKFDAERVEVVEYNVSAGARRTQPNVLIHYFTRCPGSTTWWEGDEGSHCLVQISRHLERIGFGGFWAANEAVVPYFRHRFNGTGCQPKQAGTNSLIDQTACAMVYSNKAQNSDAASIEVLGLDSEAIRSAREEEDVFQFVLRGAIRDPSYGGTYRVYLHNRHQAEALSRRLCASGITNNIEIVPVVEAEVLDVQRPASKHDRGTGSKIGPEALGDRVARKKARDRARGEQRRIAAREEKIAAGTYRRRGRPRKEEHQRDGAQTT

SEQ ID NO: 3753 - protein, 426 aa, Methylobacterium sp.
MFGKHLQRALERTGGDARVALLYLDLDGFKAVNDTLGHACGDELLKAVGKRLADIPDETVLAARLSGDEFAIIQTGGDQPRVAVALADALIQAMQAPFGIGERDIQIGTSIGIAVSNDPVETPETLLHQADIALYRAKARQRGTWELFSPEMDIERLARLALERDLRTAIADEQFEVFYQPLHEAAGGVLVGFEALLRWNHPERGMVPPMTFIPVAEEIGLIHEIGAWVLSQACSDAIGWDAELKVAVNLSPAQFTRWSLLDDVRNALSKSGLASTRLELEITESVLMQDSESTLALLHQLRALGIHIAMDDFGTGFSSLSYLSRFPFDKIKIDRSFVQSMTEHKGSAEIIRAIIGLGRALHIKVLAEGVETTEQREMLRSEGCDELQGYLFSKPKPLVELGSLVANMRRHTALLASPQQVLQGAA

SEQ ID NO: 3754 - protein, 93 aa, Methylobacterium sp.
MADVRITGVSFAESEADQGAGIVARFACVIGPLRVTGCLLKRDGLGRLHAVLPRCRRASGSIRFSDRAEHPQLTEAAKAAFDALGGRLPDHEP

SEQ ID NO: 3755 - protein, 42 aa, Methylobacterium sp.
MKPSQGFDWRDLDRPPSFLFLIRIAGSLMWRCVKRLPIGRPA

SEQ ID NO: 3756 - protein, 269 aa, Methylobacterium sp.
MERLRDWDAWRRIGAVPRDTAAYTTNLYAAREQIEDWCAAGRLHALSTERAVLLLRADRGFHHVHHVASDLPALADALGALPAGTYTSDLVGQGEPLDDVCAAYAANGFVVHTVLQRMTRAGTPDAARADDATVAAPDEAAEVVALLERLLDPFAEPVPEVAALRREALEERLLIIRRDGAIVGMLLYEIKGRAAHLRLWHVDDNARGLGVGRRLMRNFLARCAQAQVQRLVLWVIGDNERSIAIYRHYGFAPDGLLDRIMIRHEEPHR

SEQ ID NO: 3757 - protein, 76 aa, Methylobacterium sp.
MSTVLDILAQIRPEFDFSQSNDFFEDGMLDSFDLITLVSELDKSYGISIDGLHIVPENFQNVAAIEALLSRSGVAP

SEQ ID NO: 3758 - protein, 72 aa, Methylobacterium sp.
MDEFLTEMSEILEDDVTMSDALGKFESWDSLASLSVMAMADSKFGVKITPRDLNPAMTLEQLYALIRSKTAA

SEQ ID NO: 3759 - protein, 151 aa, Methylobacterium sp.
MEPPPMSNKPPPSFSRWHAEMRGQRPAPPEVREERLRTMAGLRGGSGVALSAWRGRSTTRYVVGVHEVGSDIALEAAPAVVIAVRRDEAGLASPIDVASIETAADAVAWVRLAQASGASELHIHRLADAASERAAVVADLAPVLPPSDRAA

SEQ ID NO: 3760 - protein, 42 aa, Methylobacterium sp.
MPRFSVFFCASAALLTAYLGWSYAHADEVDVARMPTVEWQAR

SEQ ID NO: 3761 - protein, 186 aa, Methylobacterium sp.
MAGESAGRANGLGARIAPAIPYLLLLAVTIWLWGVSGRIDYQERPGTLGPDFWPRVAIGLMGLLCLVRIATVLTTGGAAARGIGAAITGGEEEEETGPRRPILLGLGIALTLAYGLVLNTIGFPLATALFLIAFMYLGGSRRHLVVWVSSLVGVALVTVLLTKVVYVSLPRGAPPFDRVIDLISGF

SEQ ID NO: 3762 - protein, 318 aa, Methylobacterium sp.
MGWTRRNVLGCGAAAVAATAAGRAFAQTYPSRPIELVVPWGPGGGADQLARKIAQLAEPMLGQGLPVVNVPGGTGATGMAKLLANPADGQTAAIYIADSHALLAGTGARWKIEDIVPAAVLIQAPSFLFVGQDSRFKTWAEFAQEAQTKPGTLKVATLGFGSVDDFTLKFLGAKGVKVNPVPFAKPGERYVSILGGHADALYEQAGDVGTFLAGRQMRPLLVFGRQRFPAFPDIPCSTEVGFDIALPQFRSLVVRAGTPQDRVDTLSATLAKVAGSDDYKAFLKEQYADENSFLSAAQAGDFVRRQLDDMKAALRQAS

SEQ ID NO: 3763 - protein, 164 aa, Methylobacterium sp.
MPRTTAIRSVAASALLFLGHPVRAETPSVEAAPLLTPRPVFVPGLYETESRNSQFQDQGAKGEACLASADYESFRRETMAQYQSNPRFLDACRLSETRDLPDGFVFAMACKESKVVLTYHFSKDSVTSTIQTLITRHPEFSSEILTLMRRRGDCPGREKPGRNT

SEQ ID NO: 3764 - protein, 337 aa, Methylobacterium sp.
LTAARGRTEIVDMSLPPTKCTLYPVFAAASPRAVIYRRGPSNQTCLIAWDRSDDSFAVGQWFKGTVKPAWGGLSPNGEWLVSFLGKYRGPFATWTVLSRPPFLTAVALWPKGDTWAGGGFFLSDDTLVLTHGESPYDSAPGLSPPPGLTVLPFTRANAPALTARARSGPAAKSWRPDPATEGGWVLDAPSETASSHACIRSISAYTADPLRSLPESVHHSLCADGPPVPLPVAGWAAFDRNGDLLFSRGGALFRLDADRVGGLGSTDELLARARCLADFSDLRFRPLAAPYAAPTAETDDGFAPALDRVSREDRQRRRQMRKAHERVAGAGWSGALR

SEQ ID NO: 3765 - protein, 138 aa, Methylobacterium sp.
MECDCTRISLSIRHPSRPAADLCRALPFAPSRTWDVGAPCTNPKGVPQPGYFAETYATFPLSESAGPPAEAVSAAAERVAPYGDRLRAWQAEGGACAFFVGWFMEGGQSGDLFEPELLGRLGALGIGLSLDIYSGADL

SEQ ID NO: 3766 - protein, 98 aa, Methylobacterium sp.
MFSLMYAYQSIMLAGDDWFLAMRMYHFDAQDEKGVLATESQFLADHVAARGHAARFAVRLVRQAASLNSCEGIVVVEAYTAEDGAVLTVRLVLNVEMA

SEQ ID NO: 3767 - protein, 88 aa, Methylobacterium sp.
LRSNRVQRAASAFGHIGGRTAHKGAIGQGVSGFRVDVGSPDGLRAVFQRIDADPERFRASPPQPSHPPRAAADPGQDLIALYDRLLAP

SEQ ID NO: 3768 - protein, 175 aa, Methylobacterium sp.
LGYHVAFVHYLDRTSDRRVAYTRLRQDFPLWAETVRDAVAWLSDQPGTDAQRLGIVGISLGAALAFTTAMTEPRVRAIVDYFGPLPDELARERPRLPPTLILHGSADAIVPISHARALERLLREQGTAHEIKIYEGQGHGLTGPAQLDAAARVARFLGQHLQPAVAESSTSFARA

SEQ ID NO: 3769 - protein, 68 aa, Methylobacterium sp.
MGLTGGMASIDPLRDGLRIMQAQRDLRFPHPVSGELQPAVGGFCQHTVITAQGISTRIVERWPAAHAA

SEQ ID NO: 3770 - protein, 68 aa, Methylobacterium sp.
MSAPVAASHGLTLDEQVLELWFEGRFDTFTIADALRVEGQEITEAQVVNIIADEKERRHVACQQGGAK

SEQ ID NO: 3771 - protein, 1132 aa, Methylobacterium sp.
MASSASVAPRTAPPTAPAPPPETPETGFSPPAPAEPAAGGASAPASANENASSDAPASAEPPAAADPLPPEREKAIADWADHKSDHSGGFLGFGGTDSSEKVRDALAGRSELGPLDADEQRVLADRMIARWEAGHGDGASGPARLVDALEDAPDSRALVGERLAARASAIARETPFDPAKPDENWETRARAQGYANNAVRAAGEADDPAAADRLRSMTEALGPEAAGGFARTLAGRDGIMAGGMITAAGGSPLGRTLAALNGGTPSETRSSLVQNAFAETPASAYFDPQLQGAMGTALAREWNPDDAAAAARDAQRLTDILATDQGQRLLGAGGEDGPSLDTRVNALATVRADGAITGDPLRETDDPWANPAILSPSAQASARQYLDARGDAPVALTGTDLDNTVGTAMGMPPALPPGTETGEAEAAAARGAFNFYGSGEAAEPVKLVADQIRAVAGEAPANVAVLPVTYSDGKTGPVQLPLFRVTDPSGTERYVDNTGRRYDDFEDWRTNNKLPPGTQVYPKGGHLTAGADGKVSLGQGNTPETVDTFGEHVAGVVDKAALVGGIVAGGVLIVGTGGLATPAVVAGASAVAVGAGAWGAYRSGSELVDRDQHGQSLNPVTDAEARGLWLDLGASVASVGAFGSATRLSQLGQVGRAVAPLEASLHGYTQAGAFALDTAAVAHQGVETARNWDRMSGDQRIESILQMGFWGVGAGVGMRASGTRNSGDMFNPVTVRDGILANNPPPVAADPALRGDAVQIDFDHGSGVVTGIRHGPEASPADIALHQRTAQNIQRSLTLEGQVSRLFAAGDAPPPGSVGWAARHDIAKVRERLDARVAELADPGLTPVRRAEIEHANTVDRAHLDDLSGEVSSFVRDPSAATIEARNTRRMAIDDALNNPTRLRTAEDVRTARASLRNETIAVETENFSATWHLDGEGQLKVADAYITDLSHGKKRSSTESGLTSAVSREGGNGRTDEARIINAKGKEVYDLTRVDDGGHGIGHRFFGDMGLANLFPQNARFNQQDFRMLEDDVAGWLEAGAEVRYRVAVGDNPSFNASARTENGWGPDHRPDKVFVEYQVFKPGDPPTPILKKRYKFDNDTGAQYRPLQQEYAAGNPAELQRLMRERILGQ

SEQ ID NO: 3772 - protein, 67 aa, Methylobacterium sp.
MDPARSRRVGATKSHGAARGLSGLSARCRPVAVDGPVAEAERRRLDAVFAGALSEQCAWNAASAWAS

SEQ ID NO: 3773 - protein, 50 aa, Methylobacterium sp.
MSDDIHGPAPTPEPDTTDAGDRKVVPLVRPRPSPLPVPAGEDDDPGPRAA

SEQ ID NO: 3774 - protein, 61 aa, Methylobacterium sp.
MRPKLFGEAKTRKLDILLTDEHIEMLKEVAEHHALAPSAYARSLIVTHLNKLKAAKDAGND

SEQ ID NO: 3775 - protein, 107 aa, Methylobacterium sp.
MNILDVSERCACRALGQHRSTQRKVPRGREDEAALTADLVGLARQYGRYGYRKIGALLKAAGWFVNDKRVERIWRREGLKVPSRQPKRGRIWDGDGSCLRLRAERRD

SEQ ID NO: 3776 - protein, 265 aa, Methylobacterium sp.
VSGVEDLALDPIHLDPETREWMESYRSSFGVDPLFDDKDMLLRAYIKYIGNLEGVRHYFVSGNYDADWMLSVLGKYVQKPSPKVLEFASGFGRVGRFITSKRPDLDFTASDIHPAAIAFMRERLAMKAEISSFEPEQLAIPKSSFDFIFVLSLFSHLPHASFSRWLRALLNLLQPNGVLLFTTSGENSMEHQPHIAVNYDKKKGYGYFGNDSDQPDLATTVYGTMAVDFEYVVRQIRSASDDVIVSYERGAWHPQDVWVIRRRGA

SEQ ID NO: 3777 - protein, 484 aa, Methylobacterium sp.
LDEYKKRYDNAVNSTFKNIDQLDALADTAERRKTNDEMRKTAADLFSVNDRVLQFALRNDNEAAGKLLLTEAAVFRAKLRDAVQTRVDRLGEELAEARDIADQAASRSITNLAIASVLGILAALGLATAITVLGITRPLARLVAVLRRMADGDVDATIREAARGDEIGAVGRAVDGIKTMVAQKAAEQAEMRRIADEAAAAERRRTMIQLADGFERAVGGIVGRVSSSAIELQATAQQMSMTANQTANQSSTVAAAAEEAASNVGTVAAAAEELGASVQEIGRQVQGSSGLAQNAVAEADQTGQLVRELSRTSARIGDMVSMISNIASQTNLLALNATIEAARAGEAGRGFAVVATEVKELASQTARATEEIGGQISEIQSVTERAVSAIGSITGRIGEINTVAATIAAAVEQQGAATQEIVRNVSQASIGTTEVTRNVTGLAQASDEAGAAASEVLAAATELSRESEHLTSEVDRILATIRAA

SEQ ID NO: 3778 - protein, 90 aa, Methylobacterium sp.
MMGLIGSRGCYLSPVRHPEDAVMTENALDDALADLVEAFGHVSEAELQAFLDGTPRSDAGLAATERGSGALPLPLPARAVPDLMASSQRL

SEQ ID NO: 3779 - protein, 86 aa, Methylobacterium sp.
MVKAAALAIAVTGLGLASAPRAAQAAPLPIQTEAAATAGDAIETVQYRPHRHYRRHYHHRRHMHRHHRFHHPRHHHHRRHHHHRRW

SEQ ID NO: 3780 - protein, 65 aa, Methylobacterium sp.
MIKRTGLAILLGLGGFALGSVVARVMGEGGPRPGGTAEAPPALRHITQLPPPAVKAARDVPLSGR

SEQ ID NO: 3781 - protein, 284 aa, Methylobacterium sp.
MRLSLTAEARREGVAAKGWVRAHKWWILRRLTQVTALGVFMAGPLAGIWLVRGNFASSEILGLLPLSDPFIAVQSLAAGAVPARVALLGALLITLFYIVVGGRAYCGWICPVNIVTDTAYWLREKLGITRDRKLDRRTRLWVLGGALFASLLSGTVAWEFVNPVSLLQRGLIFGLGAGWTIIAAVFLLDLLITRRGWCGHLCPVGAFYGIMGKASVVRVAASRREACTNCGACFQICTEPHVITPALKGRGTMSILNQDCLNCGGCIDACPVDVFEISVRRSIS

SEQ ID NO: 3782 - protein, 70 aa, Methylobacterium sp.
MWWPSSNFYPDLAPIIAGVLLEHPPRQMPPMHRLAWVLRTWPHCSREEAVRALRICIEIELADHLYEALR

SEQ ID NO: 3783 - protein, 77 aa, Methylobacterium sp.
MTREMMPLQDAIGRLADMQEAERDRLKAWADEVAPQIAAELGIPLERLRPVLDAHLAHHREVIREMMHQDVAELKYL

SEQ ID NO: 3784 - protein, 78 aa, Methylobacterium sp.
MAMARDGEDRAEGFAGQSVAGTPGHPSLSSPDHAEAGDGSPSHRSLTGGASPRPARSETTGKDEVGGTEPADPPSGSR

SEQ ID NO: 3785 - protein, 58 aa, Methylobacterium sp.
LACEINLIDRKQRMAATDPRHRIGQDVNTVDQLSSVVILGLAVAGGAAAIVLSLLLIG

SEQ ID NO: 3786 - protein, 58 aa, Methylobacterium sp.
MKSLLLASSALVAATVAASAADLPRRAAPPPVFQPVPVFTWTGFYAGFNAGYGFGTQD

SEQ ID NO: 3787 - protein, 192 aa, Methylobacterium sp.
VLTSVMARFLARHPAIEPDIDYSDRLVDIVDEGFDAVIRSGEQTDSRLMHRRLLSFPWRLVAAPRYLERAGVPGTVADLARYVCLRQKLPTGRLAPWPIRDAGATEPPASLTTNIIDPLIEMTLAGAGIAALPDFLVREHLASGALVTVLEKETERTGTLSVLWAANRFRTPKVRAFVDFLHEWSRGENHGG

SEQ ID NO: 3788 - protein, 82 aa, Methylobacterium sp.
MSAERFTIQQQIDEVQCCLVSIRSAVEAWQRAPERFRSVETGACRSKIAPLEAAVRTLEWVRDNAEHLRQARGAADPSQAAE

SEQ ID NO: 3789 - protein, 45 aa, Methylobacterium sp.
MGEHAQAFVGSAGPNEPSPFSNLCLATGHQQVAPVPAILAILDLW

SEQ ID NO: 3790 - protein, 72 aa, Methylobacterium sp.
LRPSSTDTAAGTGTDVLAATVVVAMVVGSADTDLARGSTVGVGMEAGTSAVQAAATVVIFVEVAADGSSMPT

SEQ ID NO: 3791 - protein, 273 aa, Methylobacterium sp.
MPLVSTRSEGVADCLVFAQEYSRRTRLAGLVGAALTGAAGAAFIARIDAQASTLPALILGFSFVGGLLSTWSPCGYSSLCLLRPVGRHARSALVTYTPTFLLHGAGYALGAVILGGLLGLAGGLLGFAGISVLTLAALGVAGLVYGAHQLGFLRVPYPQRRAQVPHDARQRFPMWFIGGLYGISLGLNYLTYVQTPILYLVTAAAVASGNVTSAIVLFLAFNAGRFLPMAVNYLPVSDIAVQNWLARRQESAAFLDGGLLIAFGAALLTFAVL

SEQ ID NO: 3792 - protein, 409 aa, Methylobacterium sp.
MMTHAHARLRHAFRYGSSVIGAAALAALLAAGPVAAAEPGTAAKQAAADLGAGKADDPVVLKAPAPNARRVYVYDPKHFAAISQSFIIDGDTARVLGTADSGFMGNPIVASDGSFFGHANTVFSRIARGKRTDYVELLDPRTADPIADIELPNAPRFLVGTYPWMTALTPNNKTLLFYQFSPQPAVGVVDLAGKKFDRMIEVPDCYHIFPSSNDTFFMHCRDGSLLKVSIGADGKSQTKRTEIFHKENEYVINHPAYSPKNGRLVWPTYTGKIFQVDLSSQEAKFLPAIEAFTEAEKKEGWAPGGWQQVAYHRDSDRIFLLGDQRAASKHKAPSRFVFVIDAKTGKRINKLELKHEIDSVGVSQDAKPQLYALSTGAKTLFIFDPETGKETSSVNQLGAGPQVITTSDM

SEQ ID NO: 3793 - protein, 197 aa, Methylobacterium sp.
VTIMSAIALSDIALPLLGEPVVTVFLRSFLILLFVAAALPKLRHGDEFFGVVRNFRLMPEAMARPFAAVLPLAELALAAGLAVPATAAIAAAGLGGLLILFGLAIAINVVRGRTAIDCGCFRNGMRQPLSWLLVGRNAGLALAAFGLAWILPAAPAAGPFDLAVGFAAAGLALLIGYGASLLNGLQAGARPSSLSKG

SEQ ID NO: 3794 - protein, 205 aa, Methylobacterium sp.
MTMQFLIASNVLLWLALIGCAVLLLGLLRQVGLLHERSSPMGAMITDHGPDIGDAAPVFDLPDHAGATVRIGGPSAEGRPTLLMFTAPTCPVCDKLFPLIKSIARAEKFAVVMISDGQPDEHQRFLAKHELGDIRYVVSAEVGMAFQVGKIPYGVLLDAEGVIRAKGLTNTREHLESLLEADKSGFASIQQLMTSRKHSHGAKAA

SEQ ID NO: 3795 - protein, 186 aa, Methylobacterium sp.
MLGKSQFDDLFEKMSRKVAGHTSRRGFIGRVGTAVAGVALVPLLPVDRRGRVSRANAAESAGDPRGKWTPQDHDVQACDYWRHCSIDGNICDCSGGSLTNCPPGTKLASSSWVASCYNPTDKQSYLISYRDCCGANMSTRCSCLNTEGELPVYRPEFGNDIIWCFGAEDDAMTYHCTISPIVGKAG

SEQ ID NO: 3796 - protein, 119 aa, Methylobacterium sp.
MRILVLAATLAALSAGAALAAGALEVVPEAPAGSTEVKIAKMKFATPEVRIKAGSAVTWTNTEALPHNVHFKPGGSVDKELEGPMLRSNQTFSVQFNTPGTYDYICTPHPFMKGKVVVE

SEQ ID NO: 3797 - protein, 295 aa, Methylobacterium sp.
MWIPYDLTGSLKGETSAASLQRSQADRSVRDVLVGFFVRNPITQSWEIDIRAESAKQVMTVALDGMPAEIACYGDASGKLSEIIYRIKSAEPYAAFDACRHDLEDRLARWTLELGRGMAIAGWRVADPANEARWRCTPFRPSALDLDLDAVAFAPDDLKPLLRVYQRARNASDPAWRLLNAYAVLTCWRAGRAPFPAKPPRPVPTVTLEMLVHSGTLGCAVTFKDQPLTVLVDALEVWRDAVLQDLESPGDGAQGLRGEARWRLAHMASLADLAARETLLREIARRRGADLALAS

SEQ ID NO: 3798 - protein, 118 aa, Methylobacterium sp.
MALDPAFRRLAAVFSLSLAVLTAPASAEEFEVTIHHAELQEVTIKPRVGDTIRFVNQADIAHNLYLTYEDGQVETLDTQPPRTTKQVVLRRAGHVVVRCWIHPIIRMELDVADKAASQ

SEQ ID NO: 3799 - protein, 220 aa, Methylobacterium sp.
MAKPKPPSRRDLLTSGAKAAGVACLAGLSLTAYVESARRAEATALRPPGALPEDDFQGACVRCGLCVRACPFDTLRLAELGEEAPLGTPFFVARETPCFMCADVPCAKACPTGALDRDIPSIRQADMGVAVLVGHESCLNYKGITCSICHRVCPIRDEAITLEPQAIRGRRMVIPTVHSDKCTGCGTCEKHCVLGHAAIRVLPRELGLGGRGRNPAGRAV

SEQ ID NO: 3800 - protein, 123 aa, Methylobacterium sp.
VWLRSIRSLAALILCGCLAAEPCRAEGANAAGFGLTSCADAAPLFDQPAYRQAFFTWTLGFATGINNVLVVRDRQLRDLSGLNADLVVGSLRAFCAQYPTAFLIQGAERFHAGLPLRAWTVPR

SEQ ID NO: 3801 - protein, 194 aa, Methylobacterium sp.
VPSTEPTRIFTTQVEFGEARATNLIEAAADGTQKGLGVAVAVGAMLIAFVGLIALVNAAIGWTGGVFGFTGLSIEGILGVALAPLAWLLGVPWEQATLVGGAIGQKIAFNEFLAYAGLSPTLKAGTLDPRTGAILCFALCGFANLTSVAIQLASFTSLAPERRPEIARFGLRAILAGTLSNLTSAAIAGLFITG

SEQ ID NO: 3802 - protein, 215 aa, Methylobacterium sp.
VTETSKARRGRPPNEALRQTILDAAGELFLELGIQATTLDKVAQRARISKLSIYRHFETKEALFSAAIASHCHQFASLALSERIGGSAEDQLMAAGSFLLRTLLGRNVRSVEAMIMSDKANQNSLSKLFFEAGPAHVISEIEALLRQLHAKSVLNVPDPRQSARLFAAIIKGSDLLMIVRFDEARATDDNEIASYCRSAVAMFIAAHGSNDHAGR

SEQ ID NO: 3803 - protein, 116 aa, Methylobacterium sp.
MNWNDVLAVGLALPEMEAATSYGTPALKVRGKLVTRLRTEDDSLVLLEVPPDERDMLIAADPETFHVTPHYEGHAIVLARLAALEPERLRPFFLRRWRAVAPKRLVARFETAQEEA

SEQ ID NO: 3804 - protein, 482 aa, Methylobacterium sp.
MPIRHSPPSLRRLRTGWPAGALLWAGAAVAAPEVPPAAAGPDPIRIPIGDAVHVVRLDALQRFGATPIAEIYGGPPETETMQAFLLTLICDAEQGKTSENGSGAPRPGEAALMLAAERLDALKDRPAAERETPLRAVNGLILAGLRRGEGRLLESLASRFSDLGEEARDGTPFAIAGELLLARTAFCDAADGHCRAGAETASADEFVQAGRWHNDVDQLRRAGEKAERAERGEGPEPRQLDERGLFKARNAAGAAYSYAAAFAELAERRPFIERSVAAYERALPSAEAQAPSFASARLWHNLGAAYVDRAALTRNLNDFERGVALYKRAIPLFDPRDDRRALARARSNMGRARSWIATRTRDLAIHDRAVADQRAAIKGYEAASETFDAAFARYRLAQDLFDRAKTADGLARDLAASWAGDAALRRDVLIRIAAESREQALARIAHAVPVLERAGATQYLEWARELEAEIRAAEPKIESKTR

SEQ ID NO: 3805 - protein, 614 aa, Methylobacterium sp.
MFANEGRRGVDVITRLRRFARWLELRAVGLMPEYFDPAEGARAAFIIAVPLVLIAATGERGFGWIIFAAFWTCLADTGGPERTRRALLAGFVLLGTLTTFVASWLAGLSPEAALAAGPVLVVMTALLPIRWNASSLVATLLGVVAVVAVGYPRPAVEAAVLAGAFLCGSAWAFVIGILVWRTDRWLPTRQAVTAVDARLHDMASDLVHRRADKPHIGQTQHRRAVRGALERAHLRLARIQEDDAVGAVRLRKALLAADEVFHALLALEHLHPRLDRETKAMLEAIPPLLRASGGTLSSRGSEAAEAAEVARQAEALRQRVAGRRGAAAAAMRAMAAALAVPNDRSPEAALAREQASADASRRILQAAIRSGTGVGIVTLVAHWFALGYPYWAAMAVVVVLSPVRRISWSRAIERIVGSVVGGILAQMLLTLVSSSPLLIGIIVAATAATIAVRSVNYTLFVVFLTLLFVLTMGVLNPGHGIASARMLDNILGSFAAITATVLVWPERPASTAALAGAALTANRAYLDAVLSGDPALIATTRRSAGIASTEAEIAFYAPDRILGAAPTEADIADLMAARRLAGEAAALWYDRRAASDSPETDDPAPSTSSARTGA

SEQ ID NO: 3806 - protein, 93 aa, Methylobacterium sp.
MKNPPTITCVIGFALAAVACLPATAQPRQGSGVIVTDDGSVTGGRDRGVSVSRGATGADTITNNAAAGGNANQPERAVPQGSAGGGSGNGPGQ

SEQ ID NO: 3807 - protein, 31 aa, Methylobacterium sp.
MMKAFSYGMIGALAVGIATAVFGATSLLFNP

SEQ ID NO: 3808 - protein, 130 aa, Methylobacterium sp.
MGDIHPPTNLVHEVGRLIVQDEQIGAHDWQSLSLVVVLDGAPSMSGYVYDAAGKATPELPDDNGIFDAFERLRDAMQQDNPTKRPWRAALFQIRRPEMKATFQFEYDDPNRWDVTPRNFETKPEELRPKA

SEQ ID NO: 3809 - protein, 164 aa, Methylobacterium sp.
VRPADLARLATLRARREAEAGRAAQAAAERRLAAEAAEARADQAVLDREATRVSGERALYAELKAGGAIPLAALEERRAALAGLGEAVEAARAEAATEAEAANAARAAHEDTLAALARRARETRKWQRAQDKILGLRRTLAERAEEHEAEDEILMRLGCVGAAL

SEQ ID NO: 3810 - protein, 171 aa, Methylobacterium sp.
MTLTRCPDCGRQVSDRAVACPNCGRPIAPGGASRTALAGRKGAGFEYRSERTLFGWPLVHVVYGASDNATLRPARGILAFGNIAIGLVAFGGIAVGGIALGGITLGPVALGGVAIGLMLGAGGIATGYWALGGVALGATAIGGVALGAMIGPAAQRETGPPLPSTVPPGGP

SEQ ID NO: 3811 - protein, 208 aa, Methylobacterium sp.
MPTLYTMPGTCSLSPNIAIAWLDAPVEVHNIAYGDQKKAAYLAINPKGQVPALRFDDGDVLTEASAILAWLGAAHGKAGYGRDTRLGRKEAEALSYMTSEVHAAYGGHFNTQKLAESEAAREEVKRKTYETLIGHYKRMDGILSENGGEWYLGQRSFADTFLYVLTRWIEKTPLSIEDYPALKAHRARMEADEGVKRALARQDMEPIG

SEQ ID NO: 3812 - protein, 211 aa, Methylobacterium sp.
MTSETTRNPKTDHLLTPENSALIIIDYQPIQVSSIRSMPREELLFNIVGVTKAALNYDLPIIHSTVNVGTGRNKPPIQELQDIIGHLPTYDRTTVNSWEDVGFKQAVKALGRRKLIMTALWTEVCLAFPALDAIQEGFEVYVPVDAVGGTSVAAHETALRRMEQAGAKLISRVQLYCELQRDWAREATISGFMDVFENFDGFNPEKAAEAA

SEQ ID NO: 3813 - protein, 62 aa, Methylobacterium sp.
MSSVAPSSGSSTSQAARRGADVDGIWASPCDGPGRGLPAVLSGTSLNAPILRKAANGHPAQG

SEQ ID NO: 3814 - protein, 49 aa, Methylobacterium sp.
MARVLHPPGTSIVEMPAHRPRLVYGVLFIVASIVLWGTASWMTGSILWV

SEQ ID NO: 3815 - protein, 45 aa, Methylobacterium sp.
MPRIFGEPTPRGFETQGLQAASSERRPFFVAMLDAGQGRDDDHLG

SEQ ID NO: 3816 - protein, 48 aa, Methylobacterium sp.
VPSTVLSPLERRPVELHPIESETRPPRSFTANELIAMARAARARRLDP

SEQ ID NO: 3817 - protein, 96 aa, Methylobacterium sp.
MMRQTFFLATALMIATPTVALALDPGMIAQGQVLSGMARGYAERGYAERRGVRSRRTEPSEARTRQTCANGRAMARRGNADPRLRYLLALCRRGGW

SEQ ID NO: 3818 - protein, 28 aa, Methylobacterium sp.
MASVGEGIQPRDLAGKFGALDCFGFASR

SEQ ID NO: 3819 - protein, 26 aa, Methylobacterium sp.
MAPAHQHLQPLPGAVEEDQRRGIARA

SEQ ID NO: 3820 - protein, 47 aa, Methylobacterium sp.
VNAATETGRTTGRETKMPQPDHRAGLEFLERDAIAPWRPSPGASISD

SEQ ID NO: 3821 - protein, 34 aa, Methylobacterium sp.
MSVILGRIAGSIRGGVATTSPVDIDGEERRGEAV

SEQ ID NO: 3822 - protein, 85 aa, Methylobacterium sp.
MGSTLQEQRGNGSRGFAPRSLVIDDETDRLAQGLAALRRVDKIEALRVSLVNALRLSEKTTVRKFALYRPKADGVAERDTTPLGP

SEQ ID NO: 3823 - protein, 58 aa, Methylobacterium sp.
VTALDGGGREGLAGHGAIKPIGETRAVEHDGEKLRVQIAVFEQQDVQGCLGAARRAVL

SEQ ID NO: 3824 - protein, 97 aa, Methylobacterium sp.
MFVEGVRWIVRTGSPRRDRLDALGEWNNVFRRFSSRSRKGNVPWTEALLKGLPTDVILADAADDSGRLCKLAAGKGAQAVIPNTMSRAKKYDHHEAH

SEQ ID NO: 3825 - protein, 85 aa, Methylobacterium sp.
VSGPDRSKRTEFRQSITRAVASRINDVNFSVSVGTAIRRAVMAHTLAPVMLGPVPANRSDRHMLMRDDIHTIDSNTCEIGVVIQG

SEQ ID NO: 3826 - protein, 165 aa, Methylobacterium sp.
VVSSLPRAAGAQRTSAPVELPRGSATVLVVEDEAAVREIACAILADLGYRVLEAADGEEALRVFGANMAAIDLLLTDVVLPGKVRGRELSERVLALRPNVRVVFMSGYTENSIVHHGRLDDGVHLVGKPFKREQLDRRVAEVLGTAAASTPEAPNVVALRPKRDA

SEQ ID NO: 3827 - protein, 27 aa, Methylobacterium sp.
MLDIAFLVGAVAFFGLAAAYATLCERL

SEQ ID NO: 3828 - protein, 41 aa, Methylobacterium sp.
MVMARGAVIGGNLALMVDCRFDLDLKPAGLQSHKDIGYHEP

SEQ ID NO: 3829 - protein, 213 aa, Methylobacterium sp.
MGHFRMIYEGTAYTPDIKSYSLSLNAADGRWRGQEPGDMVGLTLSLQGRPFTYDVPEDEDEHLAIAPNVDTQWLEVPTRLFAGRDMSSLGGLDLAYEGPRAINPLTGETWREPPGLLGTYGDEAFGPCRITATHRGGDRFALHLTGETEIGTGFDVAVEAPLTVALTSYTGQAGEDRLRRWFDAFLRWDDFFWERTVHPGEPPQHSLIGTLRR

SEQ ID NO: 3830 - protein, 478 aa, Methylobacterium sp.
MNDSAWRLLGLEPTRDTSAIRRAYARRLKLTRPDEDAEGFQALLAARERALAEARRPLPEAWQEVEDDPCDAEQGPADETPGDPAGAAQKPRPANEPDGGTEVTAERAAEAGSKAPPGDVLPPAVLLVRDLDGPAAPMPEVPALLVRDLDPPPAPPDPVPGAPTPLVIDIAPLEAGPAEWEEARALEADLPLFLRDGADSLTAWLARARRLPAGPRALAEAALLRALFGLWRGPDGRITAKRVEATRPAILRAAPVFGWPREDAVLATRFDARDAALATQILRDTFPPEPGDPAVVAVPVFPRGRLPLQAGDARAFLESAPHALKAYEAMRRQAPPPRRLSVYALLAPHVWAVAHRRWGVTLAALAGLWLSFLLSDTAVEASGTRAVALGVLALLLWAGTAAATAFGADRIQIAAAARVARRAGRKGVYAPVERAARLRAAGARLSGWGWLALVWGGSIVFIGPYFGLAAMISAALRR

SEQ ID NO: 3831 - protein, 565 aa, Methylobacterium sp.
MAIVGIDLGTTNSAVAVWTPEGPRLIPNALGEPLTPSVVGLDADGTVLVGRAARDRLATEPERTVASFKRWMGSGHVTRLGRGQSFRPEELSALVLKSLKADAQAHLGTEVTEAVISVPAYFNDIQRKATLDAARLAGLPVERLVNEPTAAALAYGVESKQEGSVLVFDLGGGTFDVSLLELYEGVMEVRATAGDVALGGDDFSEILAAAIAEDQRVALDTLSPGDRARLLRVAEAVKRGLTAAPVTAYEIRLGEEVRRGELDRARLETAAAPLLHRLRAPLERALSDSGKRLADLDGVILVGGATRMPVIRSLVARLFGRLPLVHVDPDTAVAQGAAVQAGLKARHAALEEVVMTDVCPFTLGIAITENARTAGATQVMLPIIERNAAVPVSRAHRITTVHDGQDHIAVEVFQGESLRPDDNIPLGQVPVTLPKAPAGTETAEVRFTYDINGALEVEVAVISTGLRRRQVFRNGANLDEAEIEARFAALAAIKLAPREQAENRALLARADALYADLRGDLRQHVAGRVARFEREIAEASGSEPEALRAAFAADLDALEDHRFRF

SEQ ID NO: 3832 - protein, 58 aa, Methylobacterium sp.
MPSLKPVICAGLLALTLAACSTAPAAPALDPVPPPAPRPDAKTQLEYGNPPPIGRGGY

SEQ ID NO: 3833 - protein, 37 aa, Methylobacterium sp.
MRVGGILFNSGETVLAPETVRMRLSHHPNRFNRRVYQ

SEQ ID NO: 3834 - protein, 71 aa, Methylobacterium sp.
MSLIRHPLDCFGFYDPPSSRGEAEAIQGATFPDNAEPWIATASPRNDGMTAEAINWKPFDQAEFVPPRIPR

SEQ ID NO: 3835 - protein, 89 aa, Methylobacterium sp.
MEAGPLKIVRTLETIETDSPMHPIRRVVVIERNDGFYCYAQQYYFRSEYEGEFISEGWHTISFDGIYETPEMAEIEGRASFAGCYGVEN

SEQ ID NO: 3836 - protein, 297 aa, Methylobacterium sp.
VPTPLLLTCADPLEPKKPDPAFRVEVGAARAAGFAVALLDHDELDRRVDPAAALRRARLDGGGPAVYRGWMLRSDAYARLFEALAERGVALLTTPAAYAACHHVPGSYPALARWMPRTAWLPLARIDDAAALRTTLDPFGSSPVILKDWVKSQASGYWDEACFIPDASDTARAAQVIGRFRALQGESLEGGLVFKAYVPLKPVGGPAHEHRAFIVRGSVVGCWPRGDGPSPSPPADLLASIAAAVPSPFASADLAQDHDGCWWLLEVGDGGVSGLPVVEAAAPLFEALAGAAAQEQA

SEQ ID NO: 3837 - protein, 50 aa, Methylobacterium sp.
VEADESFVPTAQNTMMLRRNGAGWRGPGDRARHEIAGCCTEAGCGASARS

SEQ ID NO: 3838 - protein, 201 aa, Methylobacterium sp.
VSARDTILARIRENRPAGAHPRPDVPRFPVLHDGRPLEPGDHVSVFETNLKAMGGKPAPSMEGDLAALVRRLFPQAGVVASRVPELAGDLDIAACRPQDLANVDVAVVRAAFAIAETGSILLSEDELGVNALAYLAQHLLVLLDPADIVPSTQDAYHRPEFKERRYAAFHTGPSATADIEGVLIHGAQGVRSLTVAMRPRA

SEQ ID NO: 3839 - protein, 263 aa, Methylobacterium sp.
MFPRMVRAMMTKEESAMRVGLFIPCYMDAFEPEVGIATLELLRRFDLDVTYPFDQTCCGQPMTNTGCHAEAAATEALFVRNFSGFDYVVAPSGSCTHQVREHMTAIPQTPDVVAVRERTYELVEFLHDVLKVDAFPWAEFPHRVSYHNNCNALRGIGHARPSELHAPFYSKPLDLLAKVKGVEVVDLARPDECCGFGGTFCVFEPAVSAKMGHDKVRDHVRAGAEYVVSADSSCMMHQRGSAERLGLPLKFIHIAQVLNGAAA

SEQ ID NO: 3840 - protein, 199 aa, Methylobacterium sp.
MTTGLRPGPEGDGGASPSGPAADRLGMRPFGPRGLLFVLRCSLSSTVAFLAASALGLGHPVWASISALIVSQESLAETHRSLGGRILGTVLGIATAVAVHATFRLFGLEATAVQLAVITAACAVIARERPTIRVCLWTGPLVLLTATPAAPIGLTALHRGGEVILGGLVGAGLHSVIEWCAQRVLDRPHPQDGGPGRAG

SEQ ID NO: 3841 - protein, 368 aa, Methylobacterium sp.
MARRRTTKPRRLWRLLAASAVLAASTASAAVIWIDLDARPWTRDGRVRAQVSRMAPQVSGQIVDLRIVDNQFVHKGDVLYLIDPFDYRVALDKARAELGNRAADLEVKRAQAARRAALTTVSTSIEEKQRTAGVAQQAEAAYDLAQAQLAQAKVNLERTQVRSAVNGYVNNLLLRVGDFATTGIANVSVLDSDSYWIDGYFEETKISHVRVGADAEIRLMGDDRPLRGRVDSITRGISTLNATPSTQGLPSVNPVYTWVRLAQRVPVRIRIEHLPEGLSLVAGTTATIDIRDDVWKPGTGLSRLIDRILGRSGRETGAPDETTRVRGTATRESIPVPTAPGAIPPERAAPGVAPGMAQPPEQSRPGQS

SEQ ID NO: 3842 - protein, 68 aa, Methylobacterium sp.
VAPGRICRLIADAARLLANEKRLLILCLLVARGEMDGTSLAGEVELSPSAPSQHLAKLREDGLVVFQS

SEQ ID NO: 3843 - protein, 514 aa, Methylobacterium sp.
MQTNVLEFFLAGALERCPEKTAIIDGDVRISFAELDRRSKNLAAAILARVGGLNEPVAVYLPKSADVVIANIAIMYVGGIYMNLDTKIPPLRLKNILDHIGPKLVITSRAHAADIPSATAGMTPDQILCVDDIAARDLWEEADGASFPFRQLIDTDPVCIINTSGSTGTPKGVVLNHRGVIDFMGWVFEEFGFDESTKIGSLSPFYFDIYILELIACLAKGATLVIIPDKLPIFPAKLMEFVAAEDVDFVFWVPSIMVNIANLGLLDKVSLPALRTVFFAGEVFPTRHLNMWRRALTDAVFVNLYGPIEIHVDCTYHVVKGDIADDQPLPIGRPCRNTDILILNEADQLCAADEQGELCVRGSSLCGGYWNDPEKTARVFVQNPLNTRYPELIYRTGDLAVRRADGLIYLAGRKDYQIKHMGYRIELPEIEHKVLGIPGIANACVVYDDPKKAITLFYQSSSGEVSKTKIRQALSEIFPKYMLPTAYHAMEQLPMNPNGKIDRNGLVLMLAENG

SEQ ID NO: 3844 - protein, 106 aa, Methylobacterium sp.
MQSKYRKFASIVAEKIAFFALVGAASGIGMMIRPGPGLDEYLLHWDSSKIVIGAVTGATTGIVVGVLEARRWLKQYWETVQTLAAEGKDASVLFTPRSRARSPFGP

SEQ ID NO: 3845 - protein, 49 aa, Methylobacterium sp.
MPETKPAPLPPADEDAGLPTPPSPGRLPPPTLPPADDSSDDRTDGAGTE

SEQ ID NO: 3846 - protein, 54 aa, Methylobacterium sp.
MGRAIFGAVALPLSRLVALGTLPPFKSGLPDLGNPIADLGQARDLLRGGLMILQ

SEQ ID NO: 3847 - protein, 26 aa, Methylobacterium sp.
MGFEAAARPLSMRSGADIEKAPSTDL

SEQ ID NO: 3848 - protein, 136 aa, Methylobacterium sp.
MIAARPGAGWTVENALPARNSNVSGESLIVADGIVLGYPLRQIRDFLHVALLTRLGLLNEAVSPLGNAMRRLVTADNPANRDDPAADLIAKLEEFVMEYGFMPSGEELYLLAEQFGLDALPPLPPNLEVLRHQIAP

SEQ ID NO: 3849 - protein, 206 aa, Methylobacterium sp.
MTRMTKIAVSLMLLSMTAVSAQAQMQSAGRLDRPGISRTANELFSQVGVERFGDRAGMGRALEEHGFNPAPPEAAAQAAARLPIGEPGQVWRWNDATQPMLVVIRDAGVRCQLMAPFVDVEESPERFRQTMTGLRRAGVKVETERDEPAELGGQPGRQVFFRVHLPDGNGESRLFALSVAPPRAGGVSLIMTASSLPPQKKSGPMR

SEQ ID NO: 3850 - protein, 35 aa, Methylobacterium sp.
MQDGSLLLQLLHAALMASSMMLTWQVHRLRKPKAE

SEQ ID NO: 3851 - protein, 112 aa, Methylobacterium sp.
MTARQPADRTTYAPFILGQSLLLVDPGLTAKAAIFQRKAGWIGNGHDWQSIAKTLLKEQHPALSERIEFDSEAEMFVARGEHVDLITLAEAMCRVYHGDGRLIDLQSRAELD

SEQ ID NO: 3852 - protein, 411 aa, Methylobacterium sp.
VADVGRVAVAHDDAARLAVIGAATDVVLAAIAADRVVVAHAIIVVTEAARHVGGRAGNVEPVAAPVIVPTVVTPIIATIVVTAIKSVATPVAITPLTVAAIIEAALIRASVELGRRRGIGGRAGGLNRTTGNTRLLVRRCAPAGSLAGSIGLGRRRRRRLIRTGGLLRVRRHWAPGNARPLVRCRLGRGWIRDGRRRRTGRALRRGRRRRLRGSALARRDVGAVGVAIAAGGAGRTVGAITVRPIRRIATGRCLALGRFAAGGRLTIGSPLAGSGRGRALLGSIRPLSGRQRALGTLLSFLRRRPLGTGRTFSGLRSLAAGGRLTRLRPLRPLGSIRPLPCRRSAALHATPLGRTSAARRTRTAGAAPTAAWSLTVILALCKLDPPTVAERPRQGQIGQDERRQHRAGQEQ

SEQ ID NO: 3853 - protein, 40 aa, Methylobacterium sp.
MADASLKLVLGVSLGPALLKERGRGLNLCGACMFRQRTIL

SEQ ID NO: 3854 - protein, 28 aa, Methylobacterium sp.
MTAADTPLLAAAFLLGLGAAVLLNALLV

SEQ ID NO: 3855 - protein, 315 aa, Methylobacterium sp.
MKTGGPAPDAQDDPADLLGRSVHDERVVARLNRVGASEPDTLIVGAFAAYGRPGETGFGLSAEGLASYRETNGEPRSRVIGTEAELIVSRIDFSDADCAAPGSRAYEGPLPFGLRFGDPAEGVTKKLGAKPRRKGRSSDLPGRSPVVFVWNYEVGGLAVIVKLTAQHRLAAIYLAPLDRPTRQAREREASLRAMSGRIDPTSVPRIEALRSVVPTARWREAAAEVDMAERDIAEADRLLHCYLDAAKAAAARRSAPALHRATQRLVLGLNRINRRNGLIETLERDELGVFIEAVLTEAGFERARGEDITLTWREW

SEQ ID NO: 3856 - protein, 88 aa, Methylobacterium sp.
MAWRLNIQFTIGLTSKRELPQWQTFAHTTRLAGLMADQHLAGAAHRVAAAGQRIRLDRHCVMRLIERPMRGTVPRSTAHATTSREAEP

SEQ ID NO: 3857 - protein, 132 aa, Methylobacterium sp.
APAAEPPPSPYPVGTLWTDWLNGLTAAAQANPSAKPSAPRPELRSTGRKAEAAPLPDATKASMDVLQQMLQTGAEVQEQNVKAMKEAFDAFWSQPKPEPEPAGPRAAPSSPPASPSRAGEGSPPKRKPVAKS

SEQ ID NO: 3858 - protein, 51 aa, Methylobacterium sp.
MTITTILLILLILLLFGGGNFYGGGRFRGPGFGLGGILIIILIVLLVTGRV

SEQ ID NO: 3859 - protein, 166 aa, Methylobacterium sp.
VAVALFLAGWLTVPEVRAQTQRQIGRYTVTERMVGAWLLKSSSGPLGAYCTIERRANGQTFGYQVTRAGERYVGLSSSAWQRAPGSFETVRLTVGGATLWSGRAAAPVPVPDSLVLPIKPEQRDPAEILSRADSARAEISGQVTPFDLSGAAEALRAQRTCLAEAQ

SEQ ID NO: 3860 - protein, 34 aa, Methylobacterium sp.
VQLDADDLARLDAATRLPPEYPGWMLERQGAYRG

SEQ ID NO: 3861 - protein, 976 aa, Methylobacterium sp.
VNVAPTTGTDAIVNGGQDSAIIFRDGAPSTINIGTVGNTTTTSGPLGIATGNVPNRIIDPGENTIQVRSNYTINIWANGRVLQLGSSSRAEAINPLGTNNTITNYGVVESTNGGGSAIWFQDDITGGLNTIDNHGTLSVGVNTGRSVIGSSSQEAGAGDVLFINQTGATVLGDISFASGNDTLQFFPNSTVTGNINGGGGTNALELNGIAGSFDTLPGALTNFTTLTKLGEGQWNITGTLIGFTAVTVEDGVLGLTGDNTGYTGTVLVEPSGILEARAQSLPTSSPNLNNVTNNGIVRFAQPDNGTYVGQITGSGAIEKTGAGITTLDPEAAIGNTYTGGTTILEGGLGIARDAALGDAVGPLTMNGGFLQLNADLDLAPTRAVTLGPLGGAIDTQAFTSNLSQGMTGPGAFTKLGTGTLRLAGENAYLGTTTVAAGTLQALATDTFSPNSSHVVNAGGVLDLNGFNQTIPGLTNAGLVSTNGPTASTILTVAGPYIGQGGTLQLNTFVAGDNSPSDRLVINGGTATGSTALRIVNTGGTGALTVSNGILVVEAVNSGTTSTGAFALSAPVVAGPYNYILARGGNATEVADNWYLRNTAQPTPTPTPTPTPTPTPTPTPTPTPTPTPTPTPTPTPTPTPTPTPTPTPTPTPTPTPTPDPTPLYRAEVATYKALLGTEFMVGRAMIGTFHQRRGDQYLQLGPGAGTGFWGRFFGQSSDRRWKGAVAPEFDGNILGFQAGLDLFSYEAFSGFGSLGVFAAYGKGDGDVRGFADAIQRGRVGRLNLENIGYGATWTHVGPTGWYLDSLVMGQHLSGTATSLRSYGIKADGTGFALSVEGGYPLPLYPGVVIEPQAQFIWQRLDLDARTDAFSRLDFGSPGLATGRLGVRVQGALLSQEIEWRPYLLANLWHNFREVSTVRFENIPIATRLGGTSIEVGGGLVARFNANVGFFVQASYAEGTAGSYEKTVQGVVGLRVTW

SEQ ID NO: 3862 - protein, 113 aa, Methylobacterium sp.
LGLALFAVAGTEGAFWAGASPVVAIVMGVVTATFGGVIRDLLGGESPVILSREIYASAAGAGAAVFAGLTLLDAPREFALCTGFAVALLVRAASLHLGLTLPRYRPRAGLPYH

SEQ ID NO: 3863 - protein, 50 aa, Methylobacterium sp.
MAAGELDRLNLECQQAIDRLGPNGPFRLKTLLQMVLLELRREREGREQRD

SEQ ID NO: 3864 - protein, 63 aa, Methylobacterium sp.
MDDPTPIAVTVETCPDSQEPYRWHLTDGDGVSVRVSPESYASPEDAGSAGDAALRAFGTAQFV

SEQ ID NO: 3865 - protein, 74 aa, Methylobacterium sp.
LGYFATYFNGPFSADFTYKADLLSLSERFNDSLAFTAQPTASPTTAPFFGGGRASLTTHSLIGNVNYRIPVGPT

SEQ ID NO: 3866 - protein, 42 aa, Methylobacterium sp.
LVANAGLDLQVSASATLGLAYTGQVGARAQDHAVKGGFTYRW

SEQ ID NO: 3867 - protein, 30 aa, Methylobacterium sp.
MVQNTEDRSHRRESAASGFEILDRREVEAG

SEQ ID NO: 3868 - protein, 398 aa, Methylobacterium sp.
LRTRGGALGADRMKKLTFSHKVWLARHARRAHVRRIVEKDRRHERRTGHRTKRAVGYHDGTRRKIWVSAKPDPVPALLCFDRNFEETAAFIEHATTKLCQVYAENRNRIRSRRTPVGWHDFASLEEITPGAALVLAAEYDRVRMLYGAAQMYAINVDDWQAQPRDLLRSLGFFDLLGIEAPPVRPDEMRTIVRFRSDTNVNMAVASRTLIEVIELAASAAIIGVGQDPLKEFRTFLQAIGEALNNTSDHAYPDNLSTEFPNVGRWWITGAVDLDARRLTFAVYDQGVTIPRAIPYGRRFERVRRIVQTLTRRGYDPDDRSLDGHAIAAAVRSGVSGTGLDHRGRGLGLMRDYIRNERSGRLRIVSRNGEFVACTGRKDEYRTRSVPLHGTFVEWIVDL

SEQ ID NO: 3869 - protein, 106 aa, Methylobacterium sp.
VPLPDHPGVQVLRIGTADGDDSAVSVDLARITCYEAFADVISQSQCGRLSAAIVLAGCVLADLRAFRRVDTVQANARSTNVERIAIDNGGSANERFSLGWRGEKQD

SEQ ID NO: 3870 - protein, 62 aa, Methylobacterium sp.
MLCVTIFVILVVWFLLPRVARLMIHTPTAISIFVCLSMVQLMAVFISMRCTLCGHFLQVALT

SEQ ID NO: 3871 - protein, 144 aa, Methylobacterium sp.
MAERLEVTVPRSASKLVELGASRATSVALDYSQASLTTLEEMAEEAARWAATLTPGQIGALVQQAGCYLLEVAQREFGGEYRWHEERDQPVLVVGEPDFHVALMTWDKVRSRLAGDRADDLRFFYDGFAERVRQAGPGTRALYV

SEQ ID NO: 3872 - protein, 33 aa, Methylobacterium sp.
GACLGESTGGQSSYRAVHAMDELRKFSDRNWVV

SEQ ID NO: 3873 - protein, 198 aa, Methylobacterium sp.
MIALVESGQKSQPVTASSLAGRTIRGALLGLFGLLCLVGLGIGAILIYWASSLGSQSIRPDLAFHVACDDPDSTNIDKQAEAFLRQRGFVVLDKVEAARKLGQPTLLLRDILAVDAQSREVTLIQIPFDNRLMSMGLRTPPPTRHDVELEEALLSFAESVPGCHAHQVTRNDNGPELRSFHDALIKMDARLLRKFGGQ

SEQ ID NO: 3874 - protein, 229 aa, Methylobacterium sp.
VNEGRQARTADIQAAQRGTAAETGRAWPHEGVGLAAPASPGFASAAETGGLASLAMQPVGGGPRRGEAPVPNAAPAQAVSAAPLQAGVTAAPQAGTAAPLVSAAPVARTTENPPAPAAAGAGLDASGASGVGAGLSLGPGSGIALAGGGGVGGVPLPLFNPFLARRSQRDVRRQAGLPERTSGLWAILRVLGWRRRRRGQDGVEPGPAEDEAAAALRARRAALGRRAGA

SEQ ID NO: 3875 - protein, 40 aa, Methylobacterium sp.
MSRNPARRLLIHFERRAENYEAFSFPRLSLITLHQIERFC

SEQ ID NO: 3876 - protein, 45 aa, Methylobacterium sp.
MTDTTDTVGVAGERIRSIIERVERIEEEIKDLMETKKEIFAEATG

SEQ ID NO: 3877 - protein, 56 aa, Methylobacterium sp.
VKVLKEILKLRKQDKDERDEQESLLEVYLCAMDAPAPVAQAAKRLHVGGSTFAATC

SEQ ID NO: 3878 - protein, 33 aa, Methylobacterium sp.
MASRRVDPKDRGATVILRAAAIRLGPFARLSSR

SEQ ID NO: 3879 - protein, 216 aa, Methylobacterium sp.
MEEHRLPVLKTLKFALKDVAGIIMKMPVLCMTVMLVFLIIKIYKPSRDIFRTEGFTIWNISEVYFYFALIVAVRAIFALPAYRFLIDGEDRMQRNFRESIEAALAYCAAYVIFKILPLFALGILVSPMLITNSLAFLFFYVVVMIIVVPFCVFWYIRWSLILPAIAVDWQVVSLSWTNWLTKGAAWRIYLSNLLLFAIFSVCFKVPALMAWGFGFE

SEQ ID NO: 3880 - protein, 52 aa, Methylobacterium sp.
MSPEITLPIAIRLNARGRPVSAETDRTVPGMPRRGRPPLLSGLGLNIPGVNR

SEQ ID NO: 3881 - protein, 32 aa, Methylobacterium sp.
MPAGFIRDPADLTEKMPVPDDCRMLPTTEISP

SEQ ID NO: 3882 - protein, 92 aa, Methylobacterium sp.
VEGVSAQALDFVLKVQFLTLEFGDAEIVTGEGLHRVVKLALQGFVLGGELAQMRLQGHEVSLLSLFRTGVDWHRMAGVSKPFGGKMDESVTR

SEQ ID NO: 3883 - protein, 123 aa, Methylobacterium sp.
MLMTMPVAMLVIMAVIVPAAAVVVAMTVVMVGPMLVPLLLSMIVMRVGFVVVVMVAMVVMVMVVVTALAVVVGCLFRLEGPVHRAGRAARAADQFGGPGRDVENIRTDLGGNVLAPELPGKAQ

SEQ ID NO: 3884 - protein, 35 aa, Methylobacterium sp.
LAIVQRACGNVSMRKAKLPAFNSAPFVLSIFAPCW

SEQ ID NO: 3885 - protein, 59 aa, Methylobacterium sp.
MLYEIVVADGLNIEPLDHGEYVTRIGSAKIVVRIRDNRVTALESDQKFFAADEAARTRL

SEQ ID NO: 3886 - protein, 84 aa, Methylobacterium sp.
MFFERDVSLCALVSTHFGCGRIGESGGPNSRNDGPLTRHPRLFFPRFLLPLDPAKFYGCTDDAISAGFVYVSFEIDVVACRMIG

SEQ ID NO: 3887 - protein, 77 aa, Methylobacterium sp.
MLERFHQAGHGPAAQSWVNHGPNQEIAPHHLEQAIGSDVLAALTLRTGLSRDELLSRLSRNLPHAVDQYTPEGRIPA

SEQ ID NO: 3888 - protein, 83 aa, Methylobacterium sp.
VQLAVSLPLILDLIPLASVRPVATGNGSAPVVARAPAERRPFPLRAGVLILGGAVTTVGYVVEAFTSGNRSPEMRSGRRGLDP

SEQ ID NO: 3889 - protein, 142 aa, Methylobacterium sp.
MRTLIAVVLAFAALPLVPVPADAVGTMAEWNDVASRLVRCNIQYPRDPRARDIPAGGVVVVVKFDVGADGYVGPISAVRSSGIAVFDEAALVAVKLSSPLPPPPVPDNRTVSVQVPIRFMPPPVPFLASPIPRSPCRLRFRR

SEQ ID NO: 3890 - protein, 184 aa, Methylobacterium sp.
MAGALMMIPATADARPGFGGFHGGGFGGGFRGGGFGGGFRGGGFGGGFRGGGFGGPRFGGGFGGFRGGGFGGPRFGGGFAGRGGFYRGAGFGGWRGGYGGWRGGGWGYRRGIGWGGVGVGLGLGLAAGTLYGAYGYPYGYGGWGGPYGYTTVGYDPYYSAGCYTVPRLTWTPYGYRRVLVERCY

SEQ ID NO: 3891 - protein, 163 aa, Methylobacterium sp.
MKCFAPAATALSALVLAPATAEARDFGGHGGYVGGGRSHGGYGHHGYGARFGHAGRVGGYRGGFAGYRHGFAHRGFGDRGGYGYRGYAARGFYGRGYGYGRGVGVGLAGAGLGLGLGLAGGALTGSYGGYAAPAYGYSYGYAPVTTGYAPLYNTGYGLNCVCD

SEQ ID NO: 3892 - protein, 71 aa, Methylobacterium sp.
MRRGQKTSAEQVVLKLRQIEVQTTQGRSLALACKEAEISEQLRDECLRQEIFYSLKWTEKQGHRAASVTSR

SEQ ID NO: 3893 - protein, 33 aa, Methylobacterium sp.
MVRMLGISGRRSRGDDGEDAGPHVAAQAIVDMC

SEQ ID NO: 3894 - protein, 433 aa, Methylobacterium sp.
VLGLALFAVAAPALPDAQEGVPVEVLTEQQFSEMTRGERNAEKPEKNPNRADRVSEKMEEREPENAKTDAPAAPTRTAETKLAAVDAMPLRADTADPVKEEAEAAAAKAEAAKAEAEKAAAAKAAEAKAKAEAKAKADSAAKAEAAKAAEARAAAAKAEAEKREELQKLVEREQAEAEAAAKAAEKAAEAKAKARAEAKAKADAKAKAEAKAEAEAQAKAEAEAKAEAAAKAAAEAEHRKQVAEAKAKAEAEAKAKAEAAAKAKAKAMAEAKAKADAEAKARQQAELANRTSPGDSRETHTRTASQSTGSTGREVQRTASLGTSTGTAQKLSPSLRDALVGMLQQQIERCYSAPPGATQGVVLPMLDIRLNPDGSLTAEPRVMRAGNNSVDQSIAQAALRAVRRCAPYKIPTQYAPYYNDWKAINAEFEFSPV

SEQ ID NO: 3895 - protein, 74 aa, Methylobacterium sp.
VRGHAEGIENPIECLLYGFRAFLVRLQPRLESADLRLEFFWHGRRLVAEKAGFGSRLGQHAAQLVAEVIANGFR

SEQ ID NO: 3896 - protein, 214 aa, Methylobacterium sp.
MTSTDALIHGLSADLVPVRRRSVRREIAALVGLAAAELALILMAGAMRPDMGSVILSPFMAWKIGGLALLAGVSGAVAIRSFAPPAASRRDLMFAFALAVLMMAAGVFVTSAAESGEPLLERLSPARGLRCAIAIIVLSLPLMSLLALLMRRAAPVHPKRSALATGLAAATCGALVFTVCCPANDPLYIVVWYSAGIAAVAATARWLLPRRFRL

SEQ ID NO: 3897 - protein, 38 aa, Methylobacterium sp.
MFRSAGRYRHLEHGSRFLDLIPAAAILLSLSIRLEHQI

SEQ ID NO: 3898 - protein, 39 aa, Methylobacterium sp.
MPTGEFDNRSRLANPQAVMPFDATLNRDLLRAGNLIAGK

SEQ ID NO: 3899 - protein, 117 aa, Methylobacterium sp.
VPAQVVGGLLGGRSDFDLDVAGVDLDGSGIFGECKWTAQPIGMGILGKLRRRVEEVRYGGDGPGRHLLLFGRSGMDTEVAAEAASDPRLHVVSLGDLLRPRTHELTDDEDATAAPRI

SEQ ID NO: 3900 - protein, 37 aa, Methylobacterium sp.
MRTWCAAIAVTALYALALQAVLGGTSLALFPDPAHVL

SEQ ID NO: 3901 - protein, 108 aa, Methylobacterium sp.
MHVIRDDDHLISGPLAVPTFLVLVTHVVRPAVPKEDVLQKLFAMTGAEARVARSIAAGEKLEEIAVKTGVTVGTVRFHLKGVFAKTGLDRQADLVGLLSGLSVSRGQK

SEQ ID NO: 3902 - protein, 627 aa, Methylobacterium sp.
MLALLSSFSAPALSGEPHAQPSAPSGLQADVEALLKPVQAYAQATLDGLAGLAGTTLADVHSAFAADPLLGTKLAAVAGLVLLGAGCWAFARHASGSSSRKTRIGGFAVFLLALVTGMAVAAGLFGAGANPSSPVLRDAAQLPSAAGLREAWIDPPLALLRETGLDPAIGLVLLLGACALALLLRAKAGKGDGAQDDAEALSQYVQAPRRLGWATILLVFGCGTTLAAAIPLAGAAVAPGFVSPDGHRKTVQHFEGGIVRRIHVREGDLVRAGDRLVTIEDTLARANMAELSERLVHFLAIEARLLAEQAGASAIAPQDAPMIHQAALANALRGQETLFISRRETRAGRERILGQRILQLHEESEGLRQVIASQNEQEALIKKEIATVETLLRQGLERLPRLLSLQRVQAELGGARASNFARIAKNKQAVGEAEMELLTMRQQDREKVNEELNTVRAELASLRSKLPARTDVLDRTLVTAPIDGVVMNVRVTTESGVVRPGEALLEIVPQKASLIVDARVRPIDVDVVRPGMGAKVVFSAFAQRNLPQIDGRLRSISADRMTDERTGESYFIAKVEVDAAKIRELNSSLELVAGMPAEVFILTGERTALDYLVRPFLESINKSFRET

SEQ ID NO: 3903 - protein, 5815 aa, Methylobacterium sp.
MARNKFGKGTSGSKSGSKTEAVLALASGAMVLALDEGKNAIGQTSAAVPPAAPPKAPPTQGSPVSLEVEDLPSAPLASSTTPPSRSTHSARELASEDTGPVMTASVEAPALKVGSSTLVESSGRVPAPAPAMAEDSFEAAPGGFIPGPISSGRGGSGSTARTANSNTLLSEQDALAAPQADAVPPVIQTLRLQAEATTGVTRGSVSGGTTTTTPVVVTATSASATDKPNAEAADGGAYVDFGGLNGNFNAGSGESLQWTFAVPAGGIYDLAFGYAFSSTGASNRPMRLEVNGKIWDRLFDFQNTGNNATYSEAVTRVYLDAGTQTVRLTATGFSGPNLDYLEIRSADPHRIVIQAEDLLSSATTDMTSLAVNRPITLPFLNGKTQPETFRVGAEGDAYLDWGSAANTLDIPVTATVAGTYSITITYANGGTTGRPLALSYQDGTAIGTFALAPTTAPAAYPAFYEDLAGAVRPADGNDTGNVPDQTGWEGWTKSTLTVNVTLNAGTTVLRLSGANGPNIDKFEFVLVEAFKPEPVAPSDITLANLSVAENLTGAVIGRVTVTDADSAAHTIQVFEGATLSARFEVVNGDLKLRAGQSLDFETGASLPIRLVATDAGGLSATRSFTIAITNDTTDDPLPPQPNVTPTARNGSTRTNEDTAVTFDVAPLIADADADAGDVLTVTATVPAAQGTVSVNGTLITFTPAANFSGQADITYVITDSGSPVRSATASLTVAVTPVDDAATALSVTAVPVAENVAGAVVATIAITDVDTLYGPDDVKLSGADAAKFRVIDSGGALHLALREGVSLDFESARPEVSVTVGNLSQSVTLSVTDDPADNVPGTQPNTAPTALNGTAQTSEDTAVTIDVKDLIADVDTGGTLSVTATVPAAQGTVSVDGTRVTFTPAANFSGQANIAYIVTDNGSPPLSASASVTVEIAPVDDAATALSVTAVPVAENLPGAIVATIAITDIDSSYGPGDVVLSGADAGRFEVVGTAGALQLALRQGQTLNFEDARPEVSVRVGDLTQSVTLTVTNVNEAPTLTGTLAPASVPASGGSVSLAGLVAADPDGTTPALGLRLAGGGDLPSGISLTGGAVTVAAGVAPGAYAVEVYATDGQLTSTAVPFTLTIQAPPMPEPFNQILIQAEAGRLTIVDTDTNTNDTFVRNPWNKETSGAAGLVDGLRPGFTGSGYLDFGDTPGDTASYSFTVAEAGSYDIHVRYASAGNRPLAFRLDGAALPNLANLPFLSTDPDGTGAADGFNNWSVQKVTVTLTAGTHTIAFAIPGGATSGPNLDAIAVTRQGATATFNAPNALPVVTEAGFTVAEGTVTVGTVTASDLDGDRVDFALTANAATDNALFAIDARTGALSFKTAPDFEGARGAGPYTVEVEAFDGTGRAVKTLAVAVTNVNEAPVITTTALSAAENQTAVGLVAATDVDGNALTYALTANAATDNGLFSIDAQSGALRFTTAPDYEALPAGKTFSVEVAVSDGSLTTSKTITISVTDVAEGGPVPVVFGAITPYSSQDRPQDGGTVTATPDSLTLDGNFWKRVSIGSYTVTEATKLEFDLRVGTGGELPEIVAIGFDVDEDPFDADASIYQLGGSQTQGGFIDLRGSGTPNGDGTVRFVIDLGAHAGKTLTSLVVVNDDDSRPNLGSSTYTNVRFVEAADANAAPVVVGGGIADRTIPETGSLEIDLPFLDPDGDALSYTLEVKNAAGAVVPNGGLTITDGVLSGSLAALGDGVFTVTVRASDGTAFAEDGFSLTVTHVNKAPVAEDVALEPYFGRVGTAFAGFDINGLSSFFSDPESEALTFTIEDLPPGLSVNAEGYVSGTPIASGTFTVRVRASDPAGLSDTLTLTFVVEASAAGNVVSVEAEALTGLATADGFFASGATGASGNRLILLNQGDAGSVSTNLAANGLADGYYQVTAYVFDETDGASTFSLSVDGTQLRIGGTSSVVLNDAGPGSFVNPLAPRGTAANAGNLKAITFDTIVRVEAGSVMTLNGQAIGGESLRFDRFTFERVEAPNAAPTGIALTGAVAENAAGALVGLLSATDAEGDAVSFTVSDPRFVVVRNTETGQTELRLAAGAALNHETDHGTTISVVATDARGAATTAQVTLSVTDVNEAPTLSGTIAAQVFQSDAGGEINLAVLTAADPDAGDAATLSVRLAGGGALPTGIVLDGSVLRVAPNVAPGAYAIEVLASDGELASAPVAFTVTVQEPGTPQPFEPIVIQGEAATVSLTQSPDANSTLLRTTTANPEAPGATKVLDQFGLRAGYTGTGYLDFGNDAGDRASFLVTVAQAGTYELAIRYASGDARALDLAVGTGPATLVEFANTGAPASGTTPAVDGFNVWATKTVTVTLAAGANTLSLAIPAGRVNGPNIDSLTISKPQAPADVSADADDIPLFLSGPVGELTGAAKESINFKIAGVDADIVKTEISFDNGVTRTLVRPDADGDFVADGSGLAAGSYTARVYVTDGAGNVAFSSMSIVIGGTVTVAPFTIQAEDATRVTVQDTGVPTNADFTRVVDAAHPDATGNYRVGAVGGAYLDFGANAGDAITVNVDAPAAGTYLVTFRYANGGAANRPLDLRLNGGTALSVDFVPGPVIGAGTTASGWESWVEKTVELTLKAGANTIALAIPAGALAGPNIDEIRFVHQGSGPSQPQPFQLTIEAETFTPIDTTGTGNAITQARTLANKEPALPLLRDTNGDGLWDGFTGTGYLDMGAQIGDAASFNLTTPQAGTYTFAFRYSNGGNPQGDRAMTVAVNGVTKTLSFPGTDVNGWDNWKIATVELDLAAGANTVTIANTVANGPNIDSVTISRDGAPVDPRGRELFQEVVKINFEPAPGQTTQGLPAGYVTPTGYLADTGAAYGDRGNGFSYGWVTEASVADGTANGTIAAAQPANAHWYKNTVTGASSLQKTYAHFEFPGAGAAGARAWEMALANGTYQVKLSIGDTAGAFDSTYAINVEGKRFMPSWVPVNPIDGSQNGGGFRSTLVTGIVQVTDGRLTVDSIGGTNTEIQYLEIDRLPDLTPTDARTADLDYSTFAAPRAAYLNDQVSIALGENGQLPTGINPLSSFVVGVNVQAPNHRGPNIAHVEGVKLVETLTGQEVAINVQISGGADSLTIRPLQALKANTSYTLKVEDVLDLGSITDAAAAIRQMQDLTTTFVTGVAPTEVAREVAFTTSTLLDGFADGAGGFTTVEFGPDGKLYVATIMGEIYRWGVNSDGSINKASKETLSLDYLQSGEDRRGIIGFTFDPTDPNTIWISDNYPIPRENKAFSTPEFSGRVSKVTLGQNGSFTGATAETYITGLPRSGGDHVTNSLEFRANPDAGQPGEPAYLLYLSQGSNSAAGAPDGAWGNRPERLLNAAVLEIDPTRNAPTGGFDVRTEPVTAPTTQNPLTSFNSDGTYPGFYNPFAADAVLKIFATGVRNAYDLVWHSNGHLYMPTNGTASGGKTFDDPTQPGSQVIVNSPTQDDYFFTVEQGKYYGHPNILRDEYILNGGNPTSGVDKNEVTDRKDGNPNTDGYDPGVRPDLNYDLDGAYSLGRNQSPNGAIEYKGGAFGTNLKGAVLFAQFSTGDNVRAIRVDASGKIIGDDVLRRPDGSVINNYIDPLDIIENPVTGQLYLMTLNRGTGASQLILLTPAPGGVTQDLTADEGGNLALVAVDVSNPAASIFQLNGLDSDITAVRVSFNGGSSQTVTLNAQNRFTADLGTLTGPVIATVEVTDDALNRASTTTTFTPGQNPGSTDLVSLVTIQAEDTTPGDGTAVTVATGATAQIQIRSAANPEPNATGTGYVNGLRPGAVGLDGNTSNTDGVPGGYADFGASNADFVTFSFSVPSTQAGAGVIKVRYANGATADRPLEAVLNGVSLGNVSFVPPAGVTGDLAWTVWQTVDVPANLVAGLNTITFKSVAATGPNIDQIEVLVPEAQVPSDPYTFYEAETAQIVGAKVVTENRNQVGTGFVDFDGTGDQSITWTVNAASAGSFEIGFRYALAASKADRPLSLTVNGVNLGPVNFEGFGPDAENTWQFETAVVNLRQGANTVTVTAPNAVGPNIDQLRVATGTAAPPFEPDYVSVTTESRIELEQTADSSTRILNSQAVEFYFKVASSGLYALDLAANAGATNGGTLRLFLNGTATEEIAFPGTGAAGERTVYVNLEAGTSYALRVLSSAPGANALDYLDVRRAPGNPNADIAVQSLDPAYLDNRLHFSYLEDPDSVAPDAADRDFKDSGTVRITNTGTETLSLTDYDLTGPFVLANPTQLDGLSIAAGQSADVTVLFNRAAYTPPTSNIDATSTVFTGALKLITNDADTPVTTIDLAGFWQARDEGGQEPNVNEIWKIFGFGNVIEGLTLRGGGENSVLSTNDVFAKTDDTEVLSPYWRIADGVTQAKVTQIAAFHGTGGATLHIHNPGNKGANVRFWDHEGTDNQRLLPNANNDTDFATRTFDRVSIPDNWAGNDIFGISVAGLSTDPRLNPRGNVEVPGAQQGHTVKMFQALDAQEKVIPNVYLGVMDYTGINYDYNDNLFVIEGVTPVGFGQHMVVSGLDDAAAGDRLVFTNIDSPANASQAFRNEATFTIRNDGSAALTIDSVTTGSAAFQIVGTPPATIAAGASANVTVRFVGTHDGTSAGADLAESTLTIRSNDFVQGEKVIALAGLAQEFSENNSEPTVAQIVKALGYSTDMAQGELANGGRVETVGNEVLMPYLERLDATKAVEVIQVAAFLNQGNVARLGFHGLASSQVTNLFANDDQQGQTVLPDQLVTGAGAGASVARGTINQSTPFGLYISVDGRPTYSSWTDPVANRIDPQFGQLVGDDQGHLIRFFEARDAKGAVIAGTYIGIQDYPGAGNYDYNDHMFVIKNVKPHVLTSTNDANGDRINDALQRDTDGDGLVNFFDTTNTAQTPFGGTAPQIGAAPVVIDATRFDLGGQGVAYNDTTANDEGGTAGRNEGVDIVGNNVAVGYIAAGEWIEYTVNVARAGVHTLTFAAASPDPGRTITASFEQNGSTYVTAASANVVDTNNYTSFAATAPVQVNLVAGVQTVRLTFGGGAFDLDTFTIDRANVAPTVAQTLSGASATQGQFFSYTIPAGTFVDVDGDPLAYTVTGLPAGLSFNAATRVISGTPLSAGSLTLQVTASDGAASVSTPLAVAVAALPGGLQQPFGGTAPTFTNGVLIMDASNFDTGGQGIAYSDNAGRDGGTTFRAGEAVEFVNVQNDIGYIRPGEWVEYTVNAPTGGTYDLSFLAKTPLANASIAVSLNGTTLLGTAALQDGGTSFDAAPFQASAPIGVNLAAGVQTLRLTFNGTPQAGSPYVLDLRSFTLDLRETPLTQTPFGGTAAGFTNGLLTVDASNYDNGGQGVAYNDAAGLQGGTNGGRAGSAVEQTGAGDIGWIDPGDWTEYTIAVPTAGTYDLDLLLSNGGETGRSATVDFYKPGAATPYATSGTISNPSTGSYNTFVAREVDDIALDAGTQIVRVTFAGGSQDFRSFTLTAPSNPQSPFGGTAPAFVNGLLTVDASSFDTGGQGIAYGDNAGRDGGTTFRAGEAVEFVSSQNDIGYIRPGEWVEYTVNAPTGGTYDLSFLAKTPLANASIAVSLNGGAALGTAALQDGGTSFDAAPFQSSAPIGVTLAEGVQTLRLTFNGTPQAGSPYLLDLRSFTLDLREPGPNALSALTANSETGPGEPASDSTVFSLMQSGAVEKFVWYPDSAVSDDVYATLTSAMSELYGPEAVSQAAGGGTADPHLPLAGDPGLGATMFTDAPSGITVPKALFSTPTPTHFNFGVRFAMPAAPDPVSHHPLPLEQETSDQPFAPLSPVLGEFETLMHIA

SEQ ID NO: 3904 - protein, 31 aa, Methylobacterium sp.
MADRRDLGQRAGADLTDVAETDFTFWSHARS

SEQ ID NO: 3905 - protein, 92 aa, Methylobacterium sp.
LAFVGRTGTLLDRQIQILGDRSNATVPDINLGAGLAFKLAETLKDSDLPFILSTGDEGAVIPAGVDAAARLQTPLEFRQTVAAVLKLPPTAV

SEQ ID NO: 3906 - protein, 52 aa, Methylobacterium sp.
MAETAPLIAMVAAALVWAAIAAVMLTFAIRQARKYLRRRPALNREEADRHGA

SEQ ID NO: 3907 - protein, 160 aa, Methylobacterium sp.
MPSLRPLQSGDLISIEAEARWAGYVAQNTQPVFLGRAPDIYKALFHRQQEAIERCYEALRPGATVGEISDMVAAMSDERFRCSLIMHGRGLGDDAPINIHEPRDATMRDWRIEANATFIVKPMIQTHDGAQRLYWGDTVVVGENGAERLGKRAAELIEIS

SEQ ID NO: 3908 - protein, 72 aa, Methylobacterium sp.
MSVPIRADAQNLSAEVDRRRLARERALLAQARESVAHGNVVPDCEVEAWLDRMIESDEPLPIPTARPTSDRS

SEQ ID NO: 3909 - protein, 106 aa, Methylobacterium sp.
VPLPRRLILSREAALDIEAARRWLRQPGAGRRAVERLRQIRAVILELRTAPLRWPFGEHDGVREAGAGGYRILYQVEPESDISEGDVVVLRVFGPRQDRSDLLRGS

SEQ ID NO: 3910 - protein, 89 aa, Methylobacterium sp.
LRVLVYGVIRVVGAMRDPVTRRLQAIGSVEALALRDGRFFGRRDKRSAMRSGKPFRSRRDREPEGPDSTLRPRISIGSPSPKGGTSTKA

SEQ ID NO: 3911 - protein, 109 aa, Methylobacterium sp.
VPVTQVVPEGFAAAARSAAPAEVRPAARQAPRDAAVSREGPARAAVETATRPAPESRASAAIVKRAATAAASATAGVAVMRPESEVPATGPASGAAAGLPRKPAAPPKA

SEQ ID NO: 3912 - protein, 63 aa, Methylobacterium sp.
MGPLNAAAPAFPGAAVALQPLRTAAEAQGSGDFSPLWSGQAVGLSRERPAAELTRLLATGVPS

SEQ ID NO: 3913 - protein, 79 aa, Methylobacterium sp.
MEALEHLAQAAVQKAAGTTRAELIAQQSAEEAAEASIQGATQVALANLVAGRGSGWCGSALASDKQFREIIPVLVARQR

SEQ ID NO: 3914 - protein, 91 aa, Methylobacterium sp.
LEAAAARAHAQLRTLSEIGGLVPLVAEAQEALASGRPADLDRAAHALIGEAKRHDRAIRLQLARAVTDLATASRVMRRHGRFFRRLFVLNS

SEQ ID NO: 3915 - protein, 26 aa, Methylobacterium sp.
VPTEAIGTVVFYQEAERGWIASLRSL

SEQ ID NO: 3916 - protein, 29 aa, Methylobacterium sp.
MAFAAIRMKVLLPKPDRQETSARALKAGG

SEQ ID NO: 3917 - protein, 47 aa, Methylobacterium sp.
VQATTSVDAMARPRITDGFRVPPRGPGMTTRIAGGRRRGRVDQYAGF

SEQ ID NO: 3918 - protein, 106 aa, Methylobacterium sp.
VEVGAKTAQRDVTQTREQQSLGVAEGVREGCVDRLLEEASRPIAPVPHREHLRRAKRDVDVVQGSGRRGAEAVRTSDLVLAVAGVATLGGFCLLLAADILGNLAGI

SEQ ID NO: 3919 - protein, 111 aa, Methylobacterium sp.
MDVSDLSVLVAHRHEDGIGHICVRLTLTAHTECLAVELYHLTCEGTLVERLGRRPASREGMRQCLAESCGMVLAKKGSSRIVVDEEAFWPAYEAGGNRVGQRHLDSKLQAW

SEQ ID NO: 3920 - protein, 57 aa, Methylobacterium sp.
MMASVPEEGRAALIAPIPLGRMARPEEVAAATLFLLSDEASFVAGAELCVDGGMRQV

SEQ ID NO: 3921 - protein, 81 aa, Methylobacterium sp.
MRSFPARLLSGLLSVAAGLAACQTQTAPMAPPVEAVAELPAVPPLPPRPERGAAWMKHAPQAPLDPTLWSKLNQLDRTEGC

SEQ ID NO: 3922 - protein, 45 aa, Methylobacterium sp.
MLQVPRGSWNTLRGLLCAPAPQDEGEASIAVIRALPRMFLSLEAR

SEQ ID NO: 3923 - protein, 72 aa, Methylobacterium sp.
MFSPITRALIRGEHQRLMAPLRPWSEIVAAGSSACDLPAMRMIPPSFDKITDFVGTVWLCRAVQHHHQGTQW

SEQ ID NO: 3924 - protein, 138 aa, Methylobacterium sp.
MPLTSRQMFAAGVALVVAGCGEDKPAEYVSQTGFQPFIHKREGDRITYTMLDVISEDGPLVRYVTKQQVAPGGPVGGMVNYASRRGDCHRLLYQTLGEGDTAAKMERDRPENQWVELVNGSSATAALVTACQVAKKLK

SEQ ID NO: 3925 - protein, 37 aa, Methylobacterium sp.
MSTAKATEAATMRVTRTVTHITLTVMTGPAAVRGMGT

SEQ ID NO: 3926 - protein, 62 aa, Methylobacterium sp.
MTESRPAGGGMRAASVGPSCGPWPAQALGGTPHPAGGAAQVARAHAILPGLIGDRFGRERVI

SEQ ID NO: 3927 - protein, 41 aa, Methylobacterium sp.
LWPERIGLIAGLALGVALLEERDDPTGIGRVDDLCAVPPSA

SEQ ID NO: 3928 - protein, 118 aa, Methylobacterium sp.
MLEQRVAALEKGQELIISKLDGIAKGITDGRLESEKRFGAIEGRLTGLEAKLDTKASGEALTKVGGELGGRLQGVEGKVSNIPDVRATITLTLTTIALCLGGVSVIALTLFKLFGNTP

SEQ ID NO: 3929 - protein, 33 aa, Methylobacterium sp.
MKDLERENARQWRLVAELFLETWVLAHVASRNL

SEQ ID NO: 3930 - protein, 71 aa, Methylobacterium sp.
MPETGWPGLRPEVEPDSAPAPSGVPASRVRTASEVETFGFALPSARIVSSIAVACGSAGKAAGRSPQSGPP

SEQ ID NO: 3931 - protein, 88 aa, Methylobacterium sp.
VKIPQVADRLREIAAEAGLSELSRLADELRRRPAGRKARPSSRPMTDELASEIRAYRRANPHLSQVEISRRFNVNQGRVSEVLKGVRT

SEQ ID NO: 3932 - protein, 255 aa, Methylobacterium sp.
MVAHADLMHGTSLSAVADEAARALIKVRRGPGLDARVTLPVLYPSGACVGLRIGGGEKGFMVTDDGGACAEADMAGAGEFFHRAAKETAERCGVRFDGHEMFEIEAPPDALPGFMAIVADASRRAAQLVAERHAERLDRRMRTGLTDRLIRVFGEERVEIRPQVFGASTHAWPFDAAARFGQRTVLFAAVTPSAVSVSSAYLKLDDVRRLPEAPGTVAVLSRESLFRQDQRLILGRAARILEASSSDDEFRRAAA

SEQ ID NO: 3933 - protein, 84 aa, Methylobacterium sp.
VGSRYGKANTDLADLAHISVTCEDCGRQNWWTRAQLDEAEQGGVQSLGALGRKLRCTYCVERGGSGRNLGLRATLREEADHVRE

SEQ ID NO: 3934 - protein, 69 aa, Methylobacterium sp.
VSDDSVTCPHCQHEISMTDGERLQGHVSYWGQDKVTSLDCPQCEREVFLQEYVKRWWTAGRTPQEACEL

SEQ ID NO: 3935 - protein, 135 aa, Methylobacterium sp.
MPEIAVGGRSMSVAQMSRDRVRTINVASDFTRTPGGRTKRNGPFNGVQFRTEVLEPALRQMPGEYTKLVVNLDGVDTYIGSFLEESFGGLLRGLYDTFEEAAERLEIRATGEFEVFRDLAYQYMRDQDKRNAKGR

SEQ ID NO: 3936 - protein, 184 aa, Methylobacterium sp.
MPDQAQGLTLAGTAWSFAAGLGGAAIPLGVMWLKLRLDQLSARCDTFVEFIEEVAELGLDYWLLGEADPDSPLPADGSDDAKEHVAAILKHEIQLRGAQTILQLDLARMARDLPAARRDPLRLEFAALISALTGGKFGDRTGYAEPHKAQAVVSAAARIIRIVREGRDDVSRLPNMLRFAIGRL

SEQ ID NO: 3937 - protein, 92 aa, Methylobacterium sp.
LTIPVQVDSIPALRAFVAAAEARSFKLAGEALGVSSSAIGKSIARLEAQLAAALFHRTTRTVTLTDEGALYLDRARAASERAETAGQVMRLV

SEQ ID NO: 3938 - protein, 374 aa, Methylobacterium sp.
MSELFSSFDLAGRTLRNRLVMAPMTRARAPDDAADERIALYYAQRATAGLIVSEGTPISREGQGYLFNPGIFTPGQVAGWRLTTQSVHAVGGTIFAQLWHVGRVSHPSIQEGGRTPVSATSKVAVGATAFGYDESGKPGFVAPPAPRPLATEEVGRVVADFAQAAANAVEAGFDGVEIHGANGYLFEQFLNPLVNDRTDRYGAGTMGNRLRFALEVVDAVCERIGPARVGIRLSPYGQIFDMPHYADMDETYTALAAELGRRAIAYVHLMDQSGYVMNDIVIDTFVERLHRLLREFRQNLPRTAIVLAGGMTRERAEGLIGDGTIDLAAFGQPFIANPDLVERLRNGWPLTQPDKATYYGGGAKGFIDYPPHAA

SEQ ID NO: 3939 - protein, 107 aa, Methylobacterium sp.
LSDLREHDRIDAELTRTDASSDPFAAGALRRQAQGLVEAGLARGDADVEAYAREVDALHQEPGRRDLAWRLGLDEQVTDARLRLAEMRNFVGALDRLGREGWQAVGN

SEQ ID NO: 3940 - protein, 41 aa, Methylobacterium sp.
VILEAVRRRDVERLKLEVVCDIYTGRDLIGGNMAAAAHRAG

SEQ ID NO: 3941 - protein, 94 aa, Methylobacterium sp.
MKTIILASVAALISTSAFAQTAGEFLGQDLRDRGAAYVATDRARENFGIARERAAEGNYVGAAIAQERGEIERGRADHDVIAADRDRALYRLTR

SEQ ID NO: 3942 - protein, 112 aa, Methylobacterium sp.
MLFFEQAVLQDEVGHDLLQRARPKAQVLDLVGGGGTGRIAGQPLLPGVQELVGPAVVHRAGDAFAPAQVGDAVLAAQAFQHDADLLLRRELPTLRAADVLDHGLRRLPYQPG

SEQ ID NO: 3943 - protein, 36 aa, Methylobacterium sp.
MALRMVISFRAVAIRATSLGLPTAMSQSRKVFSAAL

SEQ ID NO: 3944 - protein, 88 aa, Methylobacterium sp.
VDDLRTDLDPFDDGLKLRLPELYLTARQVLAHQPTKARDQFGREFRRRPLSDMDALQRRASVDSIRFQHGQLCREDFVGIRQPTLTKQ

SEQ ID NO: 3945 - protein, 139 aa, Methylobacterium sp.
VGIEDHLLRLARIGPQQEEPAVAEPDMGDLDLRGDAGEPNGLVAPVELVGLTRGEGERHEHARGGGGMLREPALRVAAHRVVAAGIALRPQPLEQARETEALAFGLGQLLSQQDVEARDVPVELRPGLVLTLVGEGGLV

SEQ ID NO: 3946 - protein, 52 aa, Methylobacterium sp.
MSRPGQIMTTRDMNIECRGNGWVGRSARDCYSGRCRILKSKRCKCIGNKPSF

SEQ ID NO: 3947 - protein, 78 aa, Methylobacterium sp.
MQFDADARRSLIDQGDLQRCMIDTLLSGAFETISDARDETSRLAGWDAQRRFGCSELSLLPSLVRGTRPGYFPQMVGR

SEQ ID NO: 3948 - protein, 39 aa, Methylobacterium sp.
LQPPAQTPSRASNDWVRMMLDYENERALGGRSGREAGTA

SEQ ID NO: 3949 - protein, 183 aa, Methylobacterium sp.
AGTITGGTGGGWNFTGQTPPTALGAAGEGGAGFSGPAGASLSNAGTITGGTGGGGAAGTTGFAEITGPSGAPIATGGTGGTGGIGGRGGTGAQLTGAEGFSNTGILAGGAGGIGGTGGDADSIGERPIPPDASGGTGGIGGTGGTGLRISGGTALGNAGTVRGGDGGRGGDGGRAGLPAESRG

SEQ ID NO: 3950 - protein, 245 aa, Methylobacterium sp.
MTEIRRVYEANFCVYGVRRIWRPLDREGITAARCAVARLMRAMGLQGVVRGKTVRTTIPDPAAACPLDRVNQQFEAECPNWLWGADFTDVATRGGFVHPAFVVDVFARRIVGWPVSRSARADFVLDALEQALHERRPFTGSALVCPSDRGSQYVSIRYTERLAEAGIGPSVGSVGDSYDDALAETVIGLFKAEVIHRRDPWQSFEAVEFASLEWVDGFNRRRLLEPIGNMPPAEAEARSYHQAEA

SEQ ID NO: 3951 - protein, 75 aa, Methylobacterium sp.
MVLEHQGDHASRYGAIRSIAAKIDCSGETLRNRVRRAEREQGQRAGPTTDEREQIEALERENRELRQANEILRKA

SEQ ID NO: 3952 - protein, 90 aa, Methylobacterium sp.
MSLRLQPVRVATGSHDTESQLVFSDGFLVAILVQLSDDHEDMAGMWVLEAGFGSVEHPCPPTFANLDAAQVWIAQQLSSSARSDTPRHAP

SEQ ID NO: 3953 - protein, 180 aa, Methylobacterium sp.
MTAAAREIVQTFETIDRDALAALSEKARADPTAVRTVRARTVAEGRRFRHLNYVRDLAAHVVDEPPGLLGDDTAPNPTEALLAALGTCVAVGLQANAVARGWTVRAITIESEGDINITSVWGTGDLSPKAVGLTAVRLRAHLDIAGASPEELDDLVAHAAEWSPVLNTVKNPVPVTLARA

SEQ ID NO: 3954 - protein, 90 aa, Methylobacterium sp.
MTRAIVATLVLGTPAYAAEGSPATGSGQTRSGTMDSTGANDAGSGSSPGAAGSGPSTGGLSRSGTANGTGANDAGSGATPGAKGGSSGGR

SEQ ID NO: 3955 - protein, 84 aa, Methylobacterium sp.
MPESRIAWTASDIAGVPLRRLVGRLGRIEVGICEYDGSNRLWTWWSPLAEDVWGHAPSAEAAQQHCEVWLREWLENFRPFFERD

SEQ ID NO: 3956 - protein, 359 aa, Methylobacterium sp.
MSAAAPSIAPDPHPDIPEIVRTQLRPQVAAIDAGAYPEATLRALGAAGAYRHHADGTAAGLERAIDAMSEVADACLSTAFCTWCQDALVWYLARSAEPSAAGQLQAVAAGDQLGGTGLSNPMKAFSGIEPLALSGTRVPGGYQVRGRLPWVSNLAAGHRFAAIFALEDGTRVMAVLTAGTESVGLAANTRFVALEGTGTVTVLLRDAFVPDADVIAPDAAAFVPRIRNGFVLLQTGMGLGLARGVAALMRADGRGRRQAAHLPLGPDAIVDRAGTLRERIAAVAERQADPARAAFLDTLRLRLDVSWLALEAAQSAMLQFGARGYQEGAEAFRRLREAQFVAIVTPSVKHITAELARST

SEQ ID NO: 3957 - protein, 242 aa, Methylobacterium sp.
VPPPRIALDDIGFRHGPHQILQGVSLRVTDGECVGILGASGVGKSTLLQIMAGLATPAAGTVRISDVPVAGPVPGATVMFQRPALLPWASVLDNVLLPARLSGRLRRDRAASRAEALRILGEVGLTDRIDAKPHQLSGGQQQRAALARALASAPRILLLDEPFSALDPEMRGALREDVRRLARARGLTLVIVTHDLADVAVLADRAILLGGRPARVVQDFALGPDAEGELRARFGTPDRRAA

SEQ ID NO: 3958 - protein, 355 aa, Methylobacterium sp.
MSTFERYLTLWVALCILAGIALGHVMPGVFQAIGAAEVARVNLPVAVLIWLMVIPMLLKIDFASLRHVGRHWRGIGVTLFINWAVKPFSMALLGWLFIGYLFRPYLPADQIDSYVAGLIILAAAPCTAMVFVWSNLTRGEPHFTLSQVALNDTIMVAAFAPIVGLLLGLSAITVPWGTLVLSVVLYIVIPVVLAQVLRRSLLASGGQTALDRLLARLGPVSLVALLATLVLLFGFQGEQILAQPAVISLLVVPILIQVYLNAGLAYLLNRVAGERHCVAGPSALIGASNFFELAVAAAISLFGFNSGAALATVVGVLIEVPVMLSVVWIVNRSRGWYERGAAGKGAALKPASREA

SEQ ID NO: 3959 - protein, 581 aa, Methylobacterium sp.
MDDDILHLISDEAEEVPPRAGSWTIAVVDDDRAVHDGTRYALAGYELDGRGLEILSAHSAAEARALLLERRDVAVVLLDVVMETDDAGLRLVEFIRRDLGDETARIILRTGQPGQAPERRVIVDYDINDYKAKTELTADKLFTSLTAALRAYQQLKRLDDTRRGLEIIIDAAPMLLDHKSLQRLSEGVLTQVASLLNAACAGILVLRENDASAQRFSVLAGSGLYGDHVDRDPPWPLDPKIQPIVEVAFQDRRNSFGDHWSTLYVQTASGSEIVALIDTDRPLSDTDRALIALLTSRLSIAFDNVILYEQLQRANVTLEQRVVERTAELIRANRRLAAQRSDLRRANSLKTEILGTVAHDLKNPLSVILGRSEMLTDLIALERAPKDQLATQIGHIRTSATRLIGMIDSLMADAMTDALDITLRREPVDLAALAREVCEANRPLAESKSQILTLDLPEEAYLCGDAERLREAVDNLVSNAIKYSFVGGTITIRVRYEAGDIVCAVTDHGPGLSPEDAQRLFGRFQRLSAKPTGGEGSTGLGLSIVKRIAELHRGRVEAASDGPGRGATFTIRFPHEAVALL

SEQ ID NO: 3960 - protein, 244 aa, Methylobacterium sp.
MGTGASQIFIVDDEADARAMVGDYLRMHGFEVTLCDGGRALRAAIAQRAPDLVVLDLNMPEEDGLSIVRDLKARSAIPIIMLTATASAIDRVVGLELGADDYLPKPCELRELVARVRSVLRRAQSPAAGAPAEQAPLPEIMRRIRFGTKWLELDALRLRDDHGEEQALTRSEFDLLKAFADHPKRALSRERLLDLADARDPDAFDRAIDVRINRIRKKIEPDPANPRFIRTVRGLGYVFRPEGD

SEQ ID NO: 3961 - protein, 490 aa, Methylobacterium sp.
LSAFGLWFSEPDVEDMFAASFVTGNFRQTRLYMVAAAAIYFLFAFWDLLIGTSSWPATVAIRSLIALGWMLPLTAITLVPGVRRRAEAVLLLFTIVPVWSLSLIYSYLEDGFTHGTAGTILLILYVATLLPMRVPYFAAFSGATWIGFMLGETFWARQPAGHAIVNNISVGTALALSLYAVAAREFSARRQFRTAAELRIAKAASDVALEDLKRMQAQLVQAEKLASLGQLVAGVAHEINTPIGVAITTVTTVEAEIGALVHSLEGGRMRRSDLTNGLDRLGEGARIIFANLDRAGDLVHGFKQVAVDRATEERRSFVVGTWLHDLLTSLKPLIRRHGHSIEARCPENLRLATYPGALAQVISNLTMNAVTHAFAEGRAGRMTIEVVRIGEGGVRLLFRDDGIGIPPENRDRVFDPFFTTRRNQGSTGLGLQIVHNLVTGVLEGHIALWSEVGRGTQFRIDLPGPVADGQAARQTGGTNPAPRYPHPPET

SEQ ID NO: 3962 - protein, 280 aa, Methylobacterium sp.
VSAAPVQAVLAAAPAAPAASPARPPGAGPARLLAPLAGLALLGALWFGAGLILASDPRYGAFTGFAPGPALAAFADLLRSGEAWRAAAPSLARVGQGLLYAFLAGAPLGLLVGSLPLVERALQPPFQLLRMISPLAWMPVAVLSFPSWDGAIVFLIAAAAIWPILFATAAGVKRVDPVWVTLARNLGAGPLGALRAVVIPAVTQDILTGLRLALGVAWIVLVPAEYLGVTSGLGYAINDARDTLSYDRLAALVLLIGLIGYALDSLLGRLAARARWIPAT

SEQ ID NO: 3963 - protein, 351 aa, Methylobacterium sp.
VRIGYLPITDATALLVAHARGYFEEAGLKVAEPVPVRSWSALVEGFAAGKFNLVHLLKPIPVWMRYNNKFPVKVLAWAHTNGSGIVVGGKSGIADFKDLAGKRVAVPYWYSMHNVVLQYALRESGVTPVIRGDAGAGECALQILPPPEMPAALAAGKIDGYIVAEPFNALGEIKAGARMLRFTGDIWKNHPCCVVAAHERTTVERPDWTGKVVDAVVRAQIFARANKEAVARLISKDGRGYLPMPGDVVVKAVSDYGPAYAESGAIRHPEWAANRIDFQPWPYPSATKLIVEAMGRTVVEGDATFLKGLDPDVVARDLVDDRFVAASLKRYPEGLPAGGADPYARTEVLSL

SEQ ID NO: 3964 - protein, 487 aa, Methylobacterium sp.
MTPVPSQLEAKLLLKSLRAFRRGDFSARLPLDLTGIDGEIAEAFNDIVELNQGLAKELDRVARAVGKDGRIGERGKLPAATGGWVECVDSVNSMIGDLVQPTTEVARVIGAVAKGDLGQTMQLEIEGRPLRGEFLRIGKVVNTMVDQLNSFASEVTRVAREVGSEGKLGGQAQVKGVGGTWKDLTDNVNLMAANLTGQVRNIAEVTTAVANGDLSKKITVDVKGEILELKNTINTMVDQLNSFASEVTRVAKEVGTEGKLGGQAQVKGVGGVWKDLTDNVNMMAENLTGQVRNIAEVTTAVARGDLSKKITVDVKGEILALKLTINTMVDQLNSFASEVTRVAREVGTEGKLGGQAQVEGVGGTWKDLTDNVNMMAENLTGQVRNIAEVTTAVARGDLSKKITVDVKGEILALKLTINTMVDQLNSFASEVTRVAREVGTEGKLGGQAQVEGVGGTWKDLTDNVNMMAENLTGQVRNIADVTTAVAN

SEQ ID NO: 3965 - protein, 1158 aa, Methylobacterium sp.
LELKSTINTMVDQLNSFASEVTRVAREVGTEGKLGGQAQVKGVGGTWKDLTDNVNMMAANLTGQVRGIASVVTAVAQGDLKRKLSVDAKGEIAALANTVNEMIETLATFADQVTNVAREVGVEGKLGGQARVPGAAGLWRDLTDNVNQLAANLTTQVRAIAEVATAVTKGDLARSIAVEASGEVAALKDTINEMIRNLRDTTLKNAEQDWLKTNLAKFTRMLQGERDLATVSNMILSEIAPLVSAQRGVFYMVEDDAGEPVLDLVASYAFTERKNISNRYRMRQGLVGQCAYEKKRILLTNVPGDYITIGSALGQAAPLNIIVLPVLFEQEVRAVIELASFNRFSETHQSFLDQLTESIGIVLNTIAANMRTEGLLKQSQLLTGELQSRQEELKKTNDRLELQAASLQQSEDLLKNQRERLQQTNEELEEKARLLEIQKREVEGKNREVSVAKTALEEKAEQLSLTSRYKSQFLANMSHELRTPLNSLLILSKLLSENRDGNLTDKQREFAKTINAAGSDLLSLINDILDLSKIESGTVSLEIGDVALQDLVENLNRTFRQLAEERHLAFEIAVEPGLPRSVRTDAKRLQQVLRNLLSNAFKFTETGSVSLRIGSAEGSLLRAGSQWMALSVTDTGIGIAEDKQRIIFEAFQQADGTTSRKYGGTGLGLAISREIARLLGGEIVVESRVGAGSTFTLFLPVVPPAHTGTARAPEASDGNGTAALIGRQPNAAMALSASADDRHAIHAGDHIVLIVEDDAMFASVLLELARERGFKGLIAQDGAGALSLAHRFNPHAITLDIGLPDMDGWALLDLLKNDPRTRHIPIHVISVNDEKKRGLRAGAFGFLEKPVEREGLLRALERSKEFITRPVRNLLLVEDDENQRASITALLGEENVKIFAVGTASAALEALTGGRFDCAIVDLGLPDLGGSELIERIRASQDGEELPIIVYTGRELTGAEEQHLRQTASTVILKDTRSSERLLDETALFLHRAISRVPVDDQILIERAESASLQGCRVILVDDDLRNIFSLTSALEQHGLAVLFAENGRDGIALLEANPNIDAMLIDIMMPGMDGYEMIREIRAKAAFRSLPLIAVTAKAMKGDREKCLEAGASDYVSKPIDMDQLLAVLRVQLERRNGPRAGAAAREGAQEPARTAQ

SEQ ID NO: 3966 - protein, 375 aa, Methylobacterium sp.
VLVVGGGGAFGSRLCAGLAATLACEIVLAGRDRARAERACAALRRHDPGAAVAAVALDGSRASAGTIAELGVAAAVDAAGPYRPGAYGFARACIGAGVPYIDLADGRAFVAGFSDALDAEARRAGVPALCGASSTPALSNAALDAITRDWQAVTAVEVAISPGNRAPRGLSVFESILAYVGRPVRVRRNGAWTEAPGWGLTQTRPMAGLGRRRLSLCETPDLDILPARRPELRTALFRAGLELRILHDGLRLAALPVRTGLLPSLRPFAPAFRQAAAWFERLGSDRGGMEVVAEGRDATGRPTRATWFLVAEAGDGPFVPTLPALALVRRILTGAPPAPGARPCVGELTLAEIEAEMRRLRIRTGILTEPAAPRP

SEQ ID NO: 3967 - protein, 394 aa, Methylobacterium sp.
VALDFGTLQIASIVSRIAFTSVFLVTLLRHPREIYFAVWASALVSSLTASFLMLGDPPGIALAAAKGAVVYVLYGASLAVSWVGLRLFHERPLHLPEAVTLVLGPGLLYGGLMWLGVSVEWCFTALFGSLAVSTGLCAVEIVRTPVKERLWTQYAVLSGFVGYTAIFLVSILAIHFASERISTPESGVYALLFDQWCGVFIQVGYLAMVSERAQVRISRLADTDPLTGLPNRRGLAAALGRRAATGSRGLAGAVLLIDIDHFKAINDTYGHEAGDRVLADVAERLQGVMRAADIVARWGGEEFLAVLEGADGAVSLMVAERLREAVSGRTFALDGGPIAVTVSIGASLVAAGETKIDAAVARADTALYAAKRDGRNRAVLNLPEPARQDGGRVA

SEQ ID NO: 3968 - protein, 475 aa, Methylobacterium sp.
MRRTPRFRDVLPALLPTLLLSLGSMSQPARAQEAGADAPALPYASSPDLRAATVAREVRALRAANPVAAAETAREMAKHDYDTIFRSLVAGTPLRAEDAGDVLAAFIVLQWMVANDATAEPSPAALRAIRSRFVAPMAGRPPLSEPGTRAAFAEQVKLRAVLHHAGWKAAKQLGVMPRFLAGLSGEFIPAAKLQALALTDAGLVPKGQTDRQAERPARIPVEGPPRVADARPAPAPAPAAPDASAPPRHAANWDAVEGVYFRSTTGFGVGGLMIVDFEPLIVLRDGTYYEIGDTALEDVDLAAERAARPTRFGRWARKGAGKGAETGFVLTDSKGRANDYALGDGSFFRAFPATADERVGRAYRRLSGGGNSAMGGDVAVAVESRYDFRPDGSYGRGGSVGAVNSGASTGVGTAIGRRRAPEGGRYALDRHTLTLTGADGRSRRLFFAYGSRNDPPEIDREMIFVGDDVFTPADR

SEQ ID NO: 3969 - protein, 31 aa, Methylobacterium sp.
IVPVAMEEKLRFAIREGGRTVGAGVVAAITE

SEQ ID NO: 3970 - protein, 31 aa, Methylobacterium sp.; identical to SEQ ID NO: 3969

SEQ ID NO: 3971 - protein, 238 aa, Methylobacterium sp.
MSLIVSPSSRPAPPAASPNRARVAAAAVALCTLGLAVPGRAAEPAPEPDLDRLGAGSILVRGRVVGSIPVNQHSRVEPIGGRVVTPARALPDLDATYFLTDHFALAGQAGIVSTRTSIRGSFVGNLPIGDTWSASLTAAAQFHIPLEGGFKPYLGAGIGYTIPFAYEPAKPFVTVMKADPQLGPMLQAGIDYHLGGRWYANLEFKQIFLPPLVSRIGPGSATVKLDMMIIGAGLGYRF

SEQ ID NO: 3972 - protein, 455 aa, Methylobacterium sp.
MPAVRIEEPTTLPVTKHRLPAQRSPAPRAIHWRRHALAGYALIAATFGVGGLWAALARLDRAVIGPGIVVVEGHRKVVQHLEGGIVQEVLVRDGQSVRTGDVLLRVDPLQSRASADLLRGQLDAALILEARLRAEQDQTADLELPPEIAARRSEDAVARMIGDQASQLSERRASFGAQLALIEGRVTQFRTEISGLAVEKSSVERQVALINEELAGLRTLREKNLIPLTRVLLMERERTRLEGVIGRSVAETAKAQNGIGEARMQATQLRQKLQETLTAQLLETRQKVTELREKLVVAQDVLRRHAVRAPHEGVVQGLKVYTIGQVIRSGEPLMEIVPTNDRLVISVQFAPNDLEAIKAGMRAEIRFPAFQTRRMPPIFGTLATVSRDRLIDEGTRQPYFAGTVEIDERQLPEAVRPRLHAGLPAEIVVSAGERTALDYLVAPFFDALGRGFHER

SEQ ID NO: 3973 - protein, 102 aa, Methylobacterium sp.
VLELRREGGRYLKELREARGLSQRQLAQLVGAEYYTFISQLETGRGRIPPDRYRAWADALGMPAKDLVRNVMRFYDPLTYEILFDAEPASRPPPNPAGTHRA

SEQ ID NO: 3974 - protein, 582 aa, Methylobacterium sp.
MQAALNDGLRAMRPVLVTAVVFGFFINLLLFVSPLYMLQIYDRVLPSRNETTLIGLTLIAAFGLAVYAVLEMLRARLLVRGGMIFDQEIADPIFDAAHRGTLLRPSAQHETALRDVDVLREFLTGSGTLAFCDLPWTPIFLVACFVLHPWFGWMALLGGGAILGLTLLNEIATRGLLDAANRASREAGQQAAATFRNGEVLQAMGMLADLRGLWRRRHDDVLVRQAGASDRAGLIVAATKFVRMLLQTLVLGAGAYLAIHREISAGSMIAASIIIGRTLAPIEAVVGNWKGFCAARVSYRRLRDLVALAGPEIRRVTLPRPRGLIEAENVSVAAPGSARPILTDVSFRLEPGSVVGIIGPSAAGKSTLVRAMTGIWPLVEGGMRIDGSDLRHWDPQGLGRHVGYLPQDVELFDGTVAQNIARFADAEDADVIAVAQRAGCHELIQALPDGYNTVIGKSGIGLSGGQRQRIALARALFGDPSLIVLDEPNASLDQPGEAALMRAVADLKRSGTTVVIVTHKLGLLAEADRILVLGGGGLQTCGSAEHVLGQMLGPRPNPTLLPTGIRAAQAGHQGADAQRNAG

SEQ ID NO: 3975 - protein, 331 aa, Methylobacterium sp.
MQSEVAETDFSQIEDDAARREAWIRAISPIYVAEIDKAVPVPRTVRFRSWRLGTVLFNEMCASAQAVERTPSQIAMQGVDHVVLRLYTSGRTGIDTAAGEAEIPTGGLVLFDLSQRARSVTHEMTGLNLAIPRRLFDSRVGELSDLHLGVFRKEAPLIRLLGNHMHQVRNSIDGLDERQRSLISSATVALCNAALTPASDSAHNRPAVAAIEIRQFIEANLARADLGIETLCARFGLSRTPIYALFEPDGGVATYIRNRRLARAMRMLSGVEAGPPRISGVAYACGYENLKSFSKAFHARYGVNPRGVGAGHRTDAHWESGTTLLSWIKEL

SEQ ID NO: 3976 - protein, 321 aa, Methylobacterium sp.
LEDERQRREAWIQAISPVFMPTLDRDTPVPREAGFRCWNLGRILLSAIQASPQTIERTPSQIATQGVDHVILRLYTSGRSSLDTAAGDATIAPGSFVLFDLSQRARSISAGMTGINLCIPRRLFDGRVGEVSDLHRGLFEQRGQPLLRLLSDHMRNTRHCLDTSDTAQKALLASATVALCNAAFAPPSDSAHNLPAVAAIEIRQFIEANLGRVDLGLEMLCARFGLSRTPIYALFEADGGVMTYIRNRRLALAMRLLSGVEEGGPQRISGVAYACGYENLKSFSKAFHARYGVNPRDVDAAFRIEARRETGATLLSWIKEL

SEQ ID NO: 3977 - protein, 311 aa, Methylobacterium sp.
MSSYFFRQRESASADALGPEPDLAVLQREVRRLREMLDLNSDWIWEVDAAGRYTYVSLHCLPLLGYTPEEMLGRTPFDFMPTDEAARVGAAFAAIVAEKRGFSHLLNRTIRRDGRIVVLETSGVPLLNPDGSLRGYRGIDRDITEREAAAEHLRHLARHDSLTELPNRLYLREHLGAKLGGEAAGCSVLAIDLDHFKPVNDRLGHEAGDVVLKEIGRRLAELAAARAVFAARPGGDEFVVVADALPCDAADDLAADLRAVIGRPIRLGDATVRVGASVGTARARAGDTVDTLLAAADRALYRAKSGPGGGA

SEQ ID NO: 3978 - protein, 260 aa, Methylobacterium sp.
VGRSAEVFADAPGRVLKLYVAGSDPEAIAAEFSASRLAHAQGLPSVRAHAVVARGERTGILFDRVEGRTLLRHCGVSPVRVMPGFRALALLHRRIHARSGAGLPDQHAILRESVARARISDGARMAALARLERLPRGEALCHGDLHPENVLVTRDGWRVVDWQKAVAGHPAADVARTAMLIRFGRVVGGPGRAAAMARLRDLVAFWYTLCYRQGPGPRIGLADIRAWALPIAAARLAGRVAENEDLLRAEVERLAAAKQG

SEQ ID NO: 3979 - protein, 168 aa, Methylobacterium sp.
MHDTSPKPERPDPGYSQEDWDEVSDNPELTDAELAEMRPAHEVPEVYNLLPKRGRGRPKLADAKVNLTLRIDPALLDAYRATGAGWQVLMHEALAAGRPEMDEAEAIDQAARRTAKQKAADARATRSGSYEVVGPRSGTVASGKSSTRAGALSSSSTAPGKRPGKKSA

SEQ ID NO: 3980 - protein, 105 aa, Methylobacterium sp.
MPKPEHAPGYVPNAAYTQADWDAVSDNPALTDAELGQARRGTDGMPPAIAAAFRRGGRPRSEQRKVPVTIRLDAEIVEAFKATGPGWQTRMNDALRRAACDLDAA

SEQ ID NO: 3981 - protein, 82 aa, Methylobacterium sp.
LNAKIVLLVVGLLAGGLVGYLTRPEAAEIKLGPLSVEIQGDRPAGAQGGTLTLGQLQHVGIFAGLGALIGFGIGFVVDGRRR

SEQ ID NO: 3982 - protein, 270 aa, Methylobacterium sp.
MVPGGTEGRGLGRPDRQATRVVYDAPGEPAHREIYDAMRERRVLERVAAAFDLFKLPRRLTYRLTGCSGEPNAWYDPRTRTITTCYALIESIGRIAPSETSPAGVSRQDAIRGPVLQILFHESSHALFHMLGVPILGREEDAADQVAALVLLHLGRADARAVVNGSGYFFAALGKREPLDRSAFADAHGLSWQRFYNLACLAYGSDRRRYGDIVEKGFLPTERASACEEEYGQIARAFLALLGPHLRMPPRQGQALRRALARAPSASPRH

SEQ ID NO: 3983 - protein, 186 aa, Methylobacterium sp.
MLIGYARTSTLEQDTGLEAQVRDLTALGCQRLFQEKVSSVAPRKELETALDFARSGDTLVVTKLDRLARSVSHLGRIIERLEAKGVALRILNLGVDTSTPTGKLMLNVLGGVAQFEREMMLERQREGIAKAKAAGLYRGRKPTARAKAEEIRVLARDGMSMGSIATKLGIGKSSVHRALSAREPGK

SEQ ID NO: 3984 - protein, 187 aa, Methylobacterium sp.
MLVGYARTSTLEQAAGLEAQVRDLQALGCERLFREQVSSVGDRPQLDAALAYVRDGDTLVVSKLDRLARSVTHLGQILDALTARGVALRIVSLGVDTATPTGKLMLNVLGGVAQFEREMMLERQREGIAKAKAAGLYKGRKPTARAKAAEIAALSAEGLSMAAIAARLNIGKGSVHRVIGKTRTPTA

SEQ ID NO: 3985 - protein, 400 aa, Methylobacterium sp.
MTTFSVSWTDAAGAGANANAVLQTLQAAADSWGRWLQGYGNIEIGVRVSEASGNTIATGGSSYYWTGSAYEAVPMIEIRTGSDPNGDSPDINVTVSAAYIDRLFYDPTGRQAVPSTQLDALSVLTHEVGHGLGILYLDTSTYAAHVRLGDASTFVGGNAVRVNGGPVPLDSSEGHVSVAGDLMNPTISAGSRRSISDLDLAILQDIGAPIATGRADAVTLGARNDIFSAFAGNDTVTGGEGADVIYGNQGSDVLYGNPGADRLFGGLDNDSLFGGLDADMVYGNQGADAVYGNFGDDTLFGGQGDDTLYGGQGDDVLNGNLGNDVLIGGLGADRFVFGANSGADLIRGFSQQQGDRLAFSGQSYGLGSAGNGDALLTLSGGGTVQIEGVTAAQFGAGYLV

SEQ ID NO: 3986 - protein, 79 aa, Methylobacterium sp.
MRILLSATILACAVSALCLAAPPARAQGVPPNPFASNYPSAPPPPHIVEQRERRMARARRQRGAFPAEPGLLPPARVPY

SEQ ID NO: 3987 - protein, 286 aa, Methylobacterium sp.
MRIQDASREGAVHRPADGQGAPRRAAQARLGRSGLVLAAGLALTLAAPARANPLTEVPGARAAPEEAPPPRDAEAARAEAEEARAANPSANAIIRALAPFADGNPGAPARPLAVAPDDGGPTVRVDPARSVDLTVFFAYDSARLTPEARIQLEPLGEALRARDLAGHGFLIAGHTDASGGLAHNRRLSLARARAVKAHLVETYGLAPERLRVHGWGPARPKNPAAPLSRVNRRVEVSLIAPARSGDLRFVLPVAGQACAGLADPRARVALDLDDFDAGPTPRPCAE

SEQ ID NO: 3988 - protein, 157 aa, Methylobacterium sp.
LGADLRLSLYTDFSLRLLLYLGAVKADGWATTPDIARTFGISAHHLHKAVQGLVRAGFVVAKQGRTGGVRLAREPATIRLGAVVAELEGTGCLIDCGRGPCPLAAHCLIKQALDAAERGFIRELDRFTLADVLADRTGATLGGLIAADRARQETPSA

SEQ ID NO: 3989 - protein, 140 aa, Methylobacterium sp.
MFAGELALAAAAAFTGAAFYVSAVEHPARLPLAPGPLLQHWRPSYARATRMQGGLALAATALGLLAWGTSGDPRWLLGALLAFANWPYTLAAIMPTNRVLGTIAPEDPRLRPLMLRWGRLHAVRNLLGAAATVAFLWALH

SEQ ID NO: 3990 - protein, 418 aa, Methylobacterium sp.
VPTAGFIHLKVAQEIRPVIVELGADPCALVAEAGLDPGLFGGERRFVSFTALGRLMALAAARTRCPHIGLLVGQRTALSALGLLGVLLRNSQTVGDALRALEAHLSVRDQGAVIGLGVHDDVAVLSYAPYEPEAEGAALHSERALAKAINILRALCGPEWAPTEVLLPRSTPHQTEPYGAFFRAPVRFDHEMAALVFPAALLQKRIAGADPCLRRRAEERVRRLEAVEPGTLTDQIRRYLRTAVTRQRCRAARVARQRMVHRRTLSRRLKAEGTSFRQLAGEAQFRVARQLLGDTGMSMAQIAAVLDFSEPSAFTHAFRRWSGVTPTAWRRLNRAEPMGDEVRTARHICGARGDVAARASPRAGDSLRQGELRQGEFRQGELRQGERSGCAGHRPPDPYPIGPDLGPAPQRQRVDCPT

SEQ ID NO: 3991 - protein, 358 aa, Methylobacterium sp.
MPKPVDDLRAGACEFSPSPRGTEDGDPMDLVHGAAVRAIRDVLLALDVEPDEFLHRAGVLSRGGAVPDAGSFAALGRLTALCAERTRCPHFGLMVGQRTTLASLGLLGVLMRHSGTIGDALRALEAHHGLLNRGAVISLSTNGALAMLSYAPYEPDIEGIGLHCERAIAALTQVTRALGGARWTPDEVLLPRLQPTDRQPYTAFFQAPVRFDQEIAALVFPASLLRQAIRDADPRTRQSVERRIRQIEASILADVTDDLRRRLRVTMAERHLSAEQVARTMAIHRRTLGRRLRAEGTSFRLVASETRLAVATQLLIDTDLSLAQISATLEFSEPSAFTHAFRRWTGTAPSVWRKERRG

SEQ ID NO: 3992 - protein, 445 aa, Methylobacterium sp.
VAEALALPSVLATMLRSLIEAWPEQVYAQPLVTARFLGQRTTYVCDPLHIRGLLVDQADALAREPFMMRALVPALGTGILTADGPHWREQRRTAAPMFRPERIRGFVPAMAAAARATRARWLRGGPADGIRDILPEMMRTTFDVIFATMVSGDDALEVEPFGRAIDAYLAQTSWKIALTMLKAPAWTPHPGWRAGARAARYVRGEVARTVARRRARGEPGADLLGLLLQAVDPETGEGLSDASLVDNLLTFVAAGHETTALALTWTLRVLADHPEIERRVLAEIAGLGADLADDPRAVDRLAFTRQVVLEVMRLYPPAPLIVRRAAADIRLGDTVVPAGQAVHVPVYALHRHRLLWDRPDVFDPDRFAPGPSAARDRYAYLPFGAGPRVCIGMGLALTECLVILATLLPAFRFVPERPGMPAAQFRVTLRPRNGMPMKVVVRHDS

SEQ ID NO: 3993 - protein, 225 aa, Methylobacterium sp.
MVLHGSEGAWSGYSYLTAAILAAHGFLAVPFGYSVGGDVWNAGDIREVAVDRTAEALAMLHNLPLSSKVGLYGVSRGAEHALLVTSLMVRDGVPGLPDAVAVHAAPDVICGAFIAASYRDSGDPGWRSWDPAERAWTWRGSSDALLPTMPIEIERYAGPLFLSHGTLDAMWSVAMTQRLEARLLRAARTPEVHLLAGQDHNPHGEDENEHHRRLITFLRQALGAA

SEQ ID NO: 3994 - protein, 910 aa, Methylobacterium sp.
MAYTLQILHASDWEGGLLATRRAANFAAIVDKLEDATPNSITLSTGDGWIPSPFFIAGGDPQMAATYNGVYNQLYGLNAATGYRALTASPGRADITIQNIIGVQAAVVGNHEFDAGPAEVGNIIGSSLGSAAGPADDTWVGAQFPYLSVNLNYAREAALSGRVAPDGLNATFAQTGPTATQTGTGSDKLARSAIITENGERILFVGATTQLEAQLTSLGNVTLDGVSGRDDMRALADQINAEVDRQLAANPGLNKVIVGTHLQQLANEQALAPLLRNVDILIGGGSHTLLSDANDRLLPGDVSGGAYPQFFTNASGQTLALVNTASEYAYVGRLTATFDDRGNLIRDAIDPATSGAVAVDDTTVAQLYGATAAAFTPGSKGYLVREVIEGLDADNDGVQETAGIADIIRQQDGNILGRSSVYLEGRRGEVRTEQTNLGDLSSDAALWYAQQFDGGTVVALRNGGGIRDSIGSFSATGGGAAELPPAANPEAGKRAGDVSQLDVQNALRFNNNLSLVTVSAGELERILEHAVAGTAPGATPGQFAQVSGIAYAFDATRQAQVLNGTTGTVATEGQRIRSAAITDRDGRIVDVLVRDGQVVGDPDRQIRMVTLDFLANPSSTAPALGGDSYPFPAFGENRVNLHDAVAASLPNAATFAAQGSEQDALAEYLRAFYGVTPYGAADTAPAGDTRIQNLAARADAVLARGSVIQGTVGDERLQGTALDDALRGLAGSDLIYGNQGPDLVYGNQGTDTLYGGQGSDSLYGGQDDDRLFGNRGDDRLWGNRGADTIEGNDGADIVYGNAGLDILFGGAGADTLYGGRDTDVLIGGAGDDVLVGGLAGDLYVFEVGSGRDLILGFDLSAGDQLGLAGQAFTLGSARNGDAVLTLSGGGTVELAGVAAASFGNGAGYLA

SEQ ID NO: 3995 - protein, 99 aa, Methylobacterium sp.
MFALAFDLVVADVQAHHPKGISQAYSDIRTTLAHHGFEWVQGGSLYVNASEDLAVLFAAIMALKALPRFAPSVRNIRAFRVEQWSDFTALVKGPPLTAP

SEQ ID NO: 3996 - protein, 712 aa, Methylobacterium sp.
MPRQAPVPIPWRAARAAARLLGAARLALVLPILAIPILALPILAGPARAAPEAAPFADNADSVAVVIGNRSYKQTVPVDYAHNDAEAIRAYLVERLGYRESNVFVLKDATLNEFNQVFGTERNPQSGRLWRSVREGRSNVFVYYSGHGVPDLATRQPFLLPEDGNPNQGESGYSLETLYRNLDLVKRRIGPERQLVVMVDACFTGETGRKGESLLAVSAPGFAPARPKAESGIVRVVATSGATPANWDEPNKLGLLTSRFLMGVSGLADARDQQGDGDGQVSWAELKRYLAREVEEAARRASGRAQVPEVDDAPIVLKASLPVEAVSKGVASVRDEAAWRRAETLGTREAIEAYIGGCGETCAYRPQAMDRLLAGRRRDAAAIDQENWAKFGHTRQYQAYLDSCGEVCAYRGLAEGYLGGQNPSADPRVKRCDELAAGTDDPDRPNGVTGVRLGRIEASAAIEACRGASAAYPQLRRLAYQLGRAYDRADRSKEAFAAYDRAAKAGSVSAMNNLATLYENGQGVKRQQAEALRLYRQAGEGGNVVALANAARMLEYGNGVPKDEAAAVALYRRAVAGGDVASISKLVPHYATGAHGFPKDLRQGFDLFRQAADKGDPVAMATVATLIDNGFGRYFPGVRAADMVLRALKRGELGAASVSATDTAAQKLKPDTIRTVQRAVKEADYYTGALDGRFNPVFVRALDQYARANEVE

SEQ ID NO: 3997 - protein, 102 aa, Methylobacterium sp.
VSPGALAAPARAGRRALRVLALLVWLPALLFASGFALAHLTGCRVSEATTYPCEVGGLDIGGLLYALLMMGWLLIPLLPFMGLTLILVLRLGLRALYRAWRA

SEQ ID NO: 3998 - protein, 101 aa, Methylobacterium sp.
MDPKTRPDAAEPHDSLRSFDAYADRNGQDLGQDEARDVARPERLQHEMAENPDWQAETARIASGFPRRDATEGGSIASVEATEAETPPENLDRISNPGTRR

SEQ ID NO: 3999 - protein, 147 aa, Methylobacterium sp.
MGSQPLMIPHGAYVVVCDGHKALVLRNDGPPLNPDLRVQQVFEAPPNPPTREQGADKPPRVRLGNRRSPIEQTDWHDLAEHRFADEVAEALGTIDPLPAVVVVAPPRTLAELRRALPERLRRAVVAEVDKDLTKHPIEEIGRCLVDA

SEQ ID NO: 4000 - protein, 216 aa, Methylobacterium sp.
MTRLDRQQHVLDLLVPQLEEDGYSVFIQPPRSLLPKFMAEYRPDAVAMGKPKNLAIEIVQGEAPAARLGSLSERFAGRPDWELRVYYYQPDRDDEALPPPGREAIEAAAATVEGLVAAGQPEAGLLIGWSALEALGRFLLPQKLRRPQTAGRLLESIAQAGVVTPDEAERLRALQAIRTRVAHGDLGASVRPEQVADLVAILRAALAEAGPVEAAP

SEQ ID NO: 4001 - protein, 97 aa, Methylobacterium sp.
MSWQAKRAAAKLRWKEHVREASSVGLPDGHFATEGRLAVTLFYFPAAREGGDVDNIVKLVLDALVGHIYLDDAQVERIVVQKFAPDLPSPSSRRMAS

SEQ ID NO: 4002 - protein, 561 aa, Methylobacterium sp.
MDMISPGLINLLVIAGILVVALLGIGFVFGRLYRRTTRDTAFVRTGLGGRKVVVDGGTVLLPVFHSIALVNLNTLRLEVKRSGNESLITKDRLRADITVEFYVRVEPREESIALAAQTLGDRTNDANLLRELIEAKFVDALRAVAAGMSLPDLQEQRAAFVKGVQEAVSGDLRHNGLELESASLTRLDQTPIEHFNPDNSFDAEGLARLKEITEQRRKERNATERDAEVAVAEKDREAALRQLEIRRATREAELAQERDIANKTAETRAETAQAEQRAQQSEETARIEREQAVRQREAEARQNSESARIAADLAIAQRNAEAERERQLVLQDNAIRIAERSQKQSEALAAAKAAEALAVAAEERVATAKAKEIAEREREVTVIAAKREAEREATGITVTAEAERRAAEDRADAITTLAEAEAIAAASKAEAIATLGRAEAERERVMNEARNALSPEARAYETGLKRLGIIPDALRESMRAVEKIDSIRIFDAGGMMGAGTGAASASFGDGLSGHLLRYQYNSPILGAILDEAGFSGDAGSLNALVGGLRDGKVPTASAAAP

SEQ ID NO: 4003 - protein, 487 aa, Methylobacterium sp.
MHKLLLKFGLRYDDPLEERRFVQRFTLDDLGRTQAAMVLGAFVYCSFSAMDWILSPDAWAVATTIRLGVAGLVLLPATLLLTRPAAHPWAEQIYLVYCVVPGCMLSVIYVFLRPSFDHGAAGMIVVILFVSTLLPLRVPSFALFAVLTWTCFAVFETIAIHDNPGFVLVNNAEIGAAFALSLYGVGAREFRARRQFRTTQALQIETERSEAMLADLRAAQAHLVQAEKLGALGQLVAGVAHEINTPIGLAITTATAFDNNLMQLRRTVNSGQVRRSELNRGIDRLDEGSALIFSNLMRAADLIHNFKQVATDQAAEDRRRFDVRDWLVELMSTLGPLLRRKGHQVRLTCAEGIVLDSYPGALAQVVSNLALNAVVHAFPDGRAGTLAIDVVRLGTAQIRLVFRDDGTGIPQENLQRIFDPFFTTRRDKGSTGLGLHIVYNLVTSTLQGRVELESHETIGTVFTIDLPAALSPALHTGPGVGLEQEHG

SEQ ID NO: 4004 - protein, 88 aa, Methylobacterium sp.
MTTTTKAVILMLVGAGLLGAAHPVRAEEAAPRGNQEFVGVDLDTGGVYYNGRNSGRYCLYRTVDVFNRYTGYVEARRVRRCGRGLYLP

SEQ ID NO: 4005 - protein, 95 aa, Methylobacterium sp.
VSDEARLLAEIHAARALMRAGARAEAAARPGHAALWAHATRAPGAPIDLAVARALRSDADTARRYRLMLGAQALAHAPLAAAASDGALARRRVGP

SEQ ID NO: 4006 - protein, 403 aa, Methylobacterium sp.
MTLRTILIVVPTTAGPLRLRSLAPRPGLPAPAAFADGDYRPLPWSGDYARLCAAGGPLSRLMTEGALPPHELRLTGSFDAGRSWEVPVCLAHGLVARGYRLAAEPARADLILWATGAVDLDLAVLPGDYALIDKIERSRTLLAEAPDAALMVLLPEGPERSRAEAAFRALGRVPHVLPAETVPAALAAALASLARPAAASPSVASMLRRRPRLALSAGAVVGLGLAAVVALGARHAPVSGPAGPPAGEPRPSDAAEPPPPPRPSEPARAAAAAAPPGTDPAGPPGIRVEELRATSGSSCRRVAFGADPPERRPVPVEAGERLVPTRLAPDLCGLAVRATGMRVTVGPELRAAALPPVRLADGADAYFLREGARQNLVYAVQALPEAGADAGTPGSRLVHALTR

SEQ ID NO: 4007 - protein, 330 aa, Methylobacterium sp.
MTPIRPRAPNAAVAAGLLVALAAAGPARAQSVGFDPADYGRAQLPSRQTTGDAAAYVDQNKGAFEPIAELDPKDGLAALARPIGRVDIVLKNARTGQQVGASCTGALLPGDYVLTNHHCLPQGGDLTPVKASILMDYLTLDGKGSRRFAIDPKPVEHDARLDYALARVAGNPAATYGTARLSGEAVPGNRSMLVIHHPLGRPKVMSRFRCFALKEQAEGVDLRHRCDTLGGSSGSLMFDASVAGIALHKEGGLDPKDPTSFNSATRLSAILGRSPILARIAAAQGRPVAAADPAPQPGPRPGQPPGPPPAAQPADGPLDPGRMNAILRGR

SEQ ID NO: 4008 - protein, 325 aa, Methylobacterium sp.
MPLVRAPAFRAAILAALLSAGLACLAGASPVQAQARGSAKPNIVVMGEDADEDSVPRGNRIFQRVITELAETMNLRGYNVYDETAVAMGFTQANRVRRRDAELIEVARAVQNPPLDVVAVFQIYAAASKSAYSDIVRPEVRIPGRLLNVRTGQSLGAFEVAGVQLPPLPQGCDRECLLERVGTEAKTVAGDVAAALSAKLDGVIAPRRADAGAPPPDTAAPTPAPGAVAAPGEGCGGLPSAYVVRLNGFSAQEVQAAEEYMAAFRCYEHHRPVRSSGAGAEYWYETRSDSARLGRNLRLMLEHMSAPGQVQFSGNTFVISRVATR

SEQ ID NO: 4009 - protein, 371 aa, Methylobacterium sp.
MAFGLLLAAGQAGQAQEGAAQKRAAQDSATEAALSETLNANTVSVVTGTPGGTYFRTGADLAFVLDDGDRLRILPILGRGAGANAYDLRFLKGVDLGFVRTDTLDQLRQDKRLKEIEKRIHYIAKLFNDELHVIAPKEVGTIGDLTGKRVSFDVKGSGTDYSGRAMFRELGIAVEAVNVDQPTALEMLRRGELEAVVSVAARPVAIIAGFEPDGRFHLVTVPYSDRVGEAYVPATLTGADYPKLVDGPSPVETLAVGTILGVYNHPKGSERYRKLERFTTAFFDRFERFLAPQHHPKWREVNLAASVPGWTRFRPAQDWLDSHSGETPSQGEVERFLSEQPQGAAADKEAVYQAYLRWRRAQRPEYGMARR

SEQ ID NO: 4010 - protein, 389 aa, Methylobacterium sp.
MTRSQALPSCLTYRLLPQPADLDAVRALLAAYRHMLVILGEIRRTHGLGADVVALIAHGYQRVRDETGLPARLVTLGIRDFARQPADFDPEQVSALPLDGKLFSLKGAAEIALTTLCGRRSMPYRVEGYDGPWRALSAARLTIAGDDLTIAVGVPVMPPHPAPSPKETRTMPETILTRVGRIIGGLSNAALEAVEDRNGLAVAEQALREIDAVIHEARLDLGRIKAEEHRLTARRGQLDGELTALPEKLALALASGREDLARAGISRQLDLESQIEAIDSSLGDVAERHAAAAKALQAAGAARRDAEHRIALLRRPPARGGDPKAADTLAGYGEETGRAERLARSLRAIDRATGTAGAAADPSVEELDRLHRDDAIERRLAALKGGLPA

SEQ ID NO: 4011 - protein, 66 aa, Methylobacterium sp.
MAGERGDPETTVPEEADSEKTGGDTESGMARPSLWKRLKPLHDRIAARPSSGLLADKAFYDSLNDE

SEQ ID NO: 4012 - protein, 425 aa, Methylobacterium sp.
RATAALTPFLDAVAACAGRPDLTLAVVGVEPGQTALSREQAEEVRLAVESRLQATGRVKLAAAADVVRIKALSEGTTGLSGAEAEAQIRAAFSGDASVFLVEARRAGETAALRLQALTRSASCKATSEPVIVPIRVGAGVADVDAVMEGAVEAFGQAAPGAGAVEVCPFVAEGGHSTCAGALTDRLLIALDAEARSANRVLKGARLDVRRSPPGTACTGPVTARGRFLTDRDRRSWMEVEFQRDGAVIAPTGRRRIGIEGLGCDPTPRPFLDHLAATARTDAGRLAVAAAATPFAPGQRLDLRIESRARQSLYCWVVAPDETAFVALPVRGNGASLAPLKPGEAKRYPRGYGLDEIVAGEPFENLFACFGVEGGLPPELAARWLAAAPGADGEARLLQPPDVLDLLERIRATPGVTEATARIVVR

SEQ ID NO: 4013 - protein, 462 aa, Methylobacterium sp.
MSGGYDERCAADLAGVGEGRDLSRADRAWLARVVAGAVRPNRDKPLWDLAHALAGLARATGARDGRGLVTLALDPNLATAGAVEARFAGSDAADARGLVLDGGWRTGWAGLARLLALAEFVLTAEDLAQFAAVTGWLDELAAAPDPEGAAFLAKRLARHLAAYRNAHLPLAPLERRFRALLWFLGGRRAFADDDILAFWRAEMAAGERPGFRTVAEHFVTFEAGAQLLGGLDGLAAPASLDAHAGWEERLDAALADLVAAEPAETLAGLLADWPEGPKILTGAEREDLADFLRLDPFHRTRPLTTLRAASFGRVQSGIANRLRRGGGGADIAERATCAEAESYAALAARAGALAVHLGRMLRIAAALRVSERDGLGPEARAVLDAAEADLRRVRRAGFEDRVALAAGFAAAEAALLRVAAEAERLDRALGVLGRQRPLDAAFAADRAVFAESLAAAYAGEAA

SEQ ID NO: 4014 - protein, 221 aa, Methylobacterium sp.
VSALAGPALFPFSLAAAVMTGLVLVEVLSLLVGHSASALVDGAFGQDAGLGTGLDGAAVPADAHGPLSPAALLSWLNVGRVPFLILLILGLAAFALAGFALQGLAAALVAPLPAPLAVPAAGAAALPVLRVSTRVLARLIPRDESYAVSAADLVGATAEVTLGPLDQGLPGQVRALDRHGNPHLLRARAAPDALPMPAGARVLLVDRADGVFVAIPAAPDL

SEQ ID NO: 4015 - protein, 52 aa, Methylobacterium sp.
MDDTREGTKPEDQTPDRPRLTPQGHASGTETGEDSTDPAGGAKEGQGDKAEG

SEQ ID NO: 4016 - protein, 261 aa, Methylobacterium sp.
MRRLVDLLPPAATFLAIWAAWSYATGPGGLPSYLLPPPGAVARALWSGLADGAFWPHIRFTLTATLTGYLLGSLAAVITGILVAESRLFERFVFPYIVAVQAMPKVALAPLILVWFGFGLASKVVLVGLICFFPLLVNTIGGIRRADPDLIAMARAFSRPGWWIFLHIKLPAAASAIFAGLEIGIVLALIGAVVGEFVASERGVGYLIGSATVNMNVAVMFAGVVILAAFGVLGSSLIRALQRRVVFWEGARNDLPPAGRT

SEQ ID NO: 4017 - protein, 354 aa, Methylobacterium sp.
MSIMMSIVPRRRYARRTGLPIALIALQACVLAVPAVCAEAPLRVDEAGPGLTEPRVFARDVTGEQGATIPLLIEVRHRPGQPGGSTYILGVPKGAQLSDANHAVTATEERSMIEVTDWKLADLAVTLQPEQTGAFTLAVAALSLTETGRPLPIARSVFTLRVQPRQARAAPLPMPVPATAIRPAAAIVSAEAANPTPAGRSDAAAIPLPEAPPLRPLPRQAHETGSLARARETGPDNPAVEPAADRAPGLGGPLSESPQAAARSPGPQRAALLERAERLIRSGDISGARLVLEHLVERGDARATFLLAQTCDPRMLRAWRVHGLRPDPERASALYARAAEFGLRDPRNRAEAAR

SEQ ID NO: 4018 - protein, 613 aa, Methylobacterium sp.
MAGGLGALFGLKQTPSYRASVEILIDPQALQIVGRGLARTDTPAQLDFANLESQSLILLSAKVLDRVVARLDLAEDPVLVRGAKPGIDRAGLALEALRKRLIVRRVETSLIFQLSASYPEPRRAAEIANTVAAVYFEVAASDRLAAVRRANDTLLTQLNDLRGQLDRADLAVERYRADKGLIGSGESGLLVSQQLRDLYGQITTAEAELARLSGRREKARAWAAADGPPATPEAGASAVMISLRAQHAQSTQEIAQLSRSLGQNHPQMIALAAQRAATVRLIAAEADRIRRTIDEDVRRGEEGLKLLRRRAEALVSSQTSSNEEGIRLRQLESEAEAIRRTYNLVLSRSKDLEQQEVINPSNSQIVSRAAPPLKPSDTPMPIIAAAGALLGAVLGLAAGFLFDLWRGTFASAAALSASGLPVWARLPAQRRAGRNDPDAEQALVAVARALRDRLAARPGATITVASEGLGAERLRTAHILTELLIRLGEPAQLVPGTLRPQRALAEAAGARDGNARRRPPPQAPAAPGLVVTERDFTDGESWLAIPETSDAIVLVIAPGRTTRGRLDRVIEILDGSGRFRRASLIGIVAAQPARARLARRPVPRAAAVAVRPA

SEQ ID NO: 4019 - protein, 58 aa, Methylobacterium sp.
VQIWLTSALSLWAAYWAAIFAQLAHLRRLEDGVGASACARIAGALLAAGLALHLLAWI

SEQ ID NO: 4020 - protein, 149 aa, Methylobacterium sp.
MTTLLDRAVARARQLPAAQQDEIARMMLAHSGLTAETSGRVDPQTRRAVDAFLRHLDGRYPIREVILFGSRARQTHTHESDADLALVLDWEQGDRMKVGLHMADVAFDVLMETEVLIQPLPLWATEYESPETFNNPALIEAIRRDGLRM

SEQ ID NO: 4021 - protein, 97 aa, Methylobacterium sp.
VSRYVLTPKAREDLDAIWRYSAERWDPDQAERYLRRIGQAFTGLAEGTARGKSAQDVRPGYFRLIVASHVIYYRNGTDGCVEIVRILHGRMDVERHL

SEQ ID NO: 4022 - protein, 123 aa, Methylobacterium sp.
MPCAVAKLLPLLGYAACLLTLAAMTGINLYAGPRIATAQVPMQWSLSGEPTWFAGKIVGLWFPVLIALVVGASLLLKARQGGAPSGGWADGADWLVLLGACSLLLCVHAWHVSAVMAWAAKQS

SEQ ID NO: 4023 - protein, 306 aa, Methylobacterium sp.
MPVAATLSRRFLSDVDHRTTGEVLDHPGFAQMRQPYITATMASYKTASFPGGCQSTAYRVATIGVIVCLYAAYDVEDRATWPTLARLKQTVTAFGLSSARQVDDFVARLVRTDNLVLERAPADGRLRLLKPTDKLLAWDRHVLAPYYDALQSLYPEPGYVPTRDPGFHLALRRASVRYLGPVAGFMRENTDLLPFHIMYQGVHMLMTLVNLSVAEGARAPHEPDLGAFQEAFGISRTHIRNTLLAAQQAGLLTWSGRVEKIIALTPRGLAAIDRFIADTLASHDLGYRLALGDLGHPVTPPKRRAP

SEQ ID NO: 4024 - protein, 793 aa, Methylobacterium sp.
MPAPSPGRTLFFFEKPSAMRELKRFFRSPNTVCVAAEGHLLTAEEPGDVRPDWKPWRFDALPIVLDTIPVACGQNRSGQSHAGKLAAIREALSGVDRVIIATDPGREGSMIAWEVLEHLGWRGRVDRLKLGALDDVSIRRAFAGLAAEPDSGERDYAAYLEALCRQYEDYHLGLNGTRAISLRLRPAAFREPWRFGGVQTPTLAILADLEERIRAFVPQDFFKVALHLGTAEGHALTLWHAPKERILDPEVAETIRAAAAGWSGPVAVEQKDVRRAPPRLFSKDTLARRCAKRFGWDPQHTAKLAQDLYDQGYLSYPRTESELLPEGQIGDAPAIIAAVTGVLSDLRPLFPPEAKPVIRRGKSGPYVKDPGEHHAIVPLRKVPERGRLTGDQVRLWDLVAKAYLAAHLPDGIDARTGITAEVATPLGSKRFAVSGTVVRVPGWRAVYGAEAETEAEHVPGKARREEEASAARLPPVRDGEAASATGAEIATAVTEPPRRITRGELPVVMGRLVDQVEDPAVKRALENPANPNEPKGLGTAATRDTILPKLLKSRYVTLGTGKDPAVSVTEVGLAFIGAVRAVFPAYGDPVGRAVFEAELAEIGRAATRAEALRRAEDFRQRTRARLDALIGAIAGAPTIDLDPSLIPPGGGPSGAAGRGGDRAPTPAMVAFAVSLAERKGVALPRGCKSSMRVCRAFLDAQAGPRPEGGREERGPDGVRAPSEAMLRYARSLAEARGMACPPEVEARFDACRSFLDAHAARTDTARPARKSAAPSRGRSPAPRGKPVRARRQA

SEQ ID NO: 4025 - protein, 290 aa, Methylobacterium sp.
MDLDIGEFEEVCRDLYVRALKILPPDIKAGFSELQKSETSATGRAILDTMVENVAVAERTKNILCQDTGIPIYNIRIGRDVAFDGVELKAAIRRGCERATKEFSLRSSVVHPITRTNEQTSCGIRVPIIHVDFDDSPETVAVEMIPKGSGSENGSFLQMLLPSDGIGAAKRFVIDRVIELGGRVCPPTIVGVGLGGTSDLCMHLAKVAATRPLRSVCPDPEGARIEAELSRAVNELGIGPQGLGGRSTSFAVHVELAATHITQNPVAVNIQCHSARRARATITPGGIAFA

SEQ ID NO: 4026 - protein, 500 aa, Methylobacterium sp.
MGDDIGIWNIGAYHRGMMAGRTPHLDRIAAEGMLFTDYYAEASCTAGRAAFITGELPIRTGMTTVGQAGAPIGIPAEAVTIATALKGMGYATGQFGKNHLGDKNEFLPTVHGFDEFFGYLYHLDAMEDPAHPAYPQELLNRVGPRNMVHSWATNVDDPTIDPRWGKVGKQRIEDAGTLYPKRMETVDEEIRDLALGFIDKAKADGKPFFVWLNPTRMHVTTHLSPKYQGMRNSQNGWSIQEAGMAQLDDVVGAMMKKLTDLGIDNNTIVVFTTDNGTEVFTWPDGGQTPFAQSKGTVMEGGFRAPAMIRWPGKVPAGKVENGVMSGLDWFATLVAAAGNPDITEELKKGKQIGDQTYKVHLDGYNQMDMITGKGPSKRNEVWYFGESELGAVRIGDYKYRFIDQPSGWLGDKTKPDVPYITNLRLDPFERTGWPDNGTKAGAQNYMSWFLYEFWRFVFVQQEVEKLAMTAVEFPPMQKGASFNLEAVKEKIQAARTAMAK

SEQ ID NO: 4027 - protein, 76 aa, Methylobacterium sp.
MLLSEWMRREGLSDADVAAAVGLSAEAIRKLRFRARGTSLRVAARIEALSAGQVRAHDLQPRQDKHQAAPQPEAVP

SEQ ID NO: 4028 - protein, 689 aa, Methylobacterium sp.
MVAHAEGGPEAAPPEPPPVRAKILIVDDDRRNLLAASEILSDPAIDLVLADSPEEALRRTLREDFALILLDVQMPRIDGYEVAALIRSRSRSSRVPILFLTAHNKEDMHVFRGYSAGAVDYVFKPIQPLVLKSKVDVFVDLYRKTEEIKHKAAAEKQLLLENLRVRGEKLEAEQALRRREEHQAAVLRSLPIALYTAPLGEADRRLHFTNDSIERITGFPREAFAAANLWESRLDPEDTDRVFADLRTVQDTGAVALEYRWRNADGAERHILDQVVLHRGAGDTAAELFGMWFDVTERKELELSLQHASKLEAVGRLTGGIAHDFNNMLSIVIGNLDLVKGSLQGDEKVLRRVESAIAGAHRCAELTSRLLAFSRRSPLQPRALEFVSFMPGLIKLLERTLGERITIATDLAAELPDVCVDHAQFEAAIINLAVNARDAMPNGGRLGISIRRRDTADQDGSESASVVEIAIVDTGMGMPPAVLARVFEPFFTTKEAGKGTGLGLSMVYGFVQQSEGTITVDSSPGQGTRFVIRLPALAKRSLAPEADAHATGPEAGCAVDGAGRAVLVVEDDADVRHTVTSTFEALAFKVLSAHDGSEALRILENEPDIALVFSDVNMPGAMTGIDLGHIIRRQWPQVPILLASGYLQEDQDTNGFALLQKPYRAADLIEMLRGLLSDTEQGRARHDAP

SEQ ID NO: 4029 - protein, 98 aa, Methylobacterium sp.
LSSDAHVINRAASVGASDRFVRWLGWIATVTGVLMFVSYLDQIQLNLAGQKGSVIQPLATVVNCGLWTTYGALRRDWPVSFANAPGIVLGAVALITAL

SEQ ID NO: 4030 - protein, 77 aa, Methylobacterium sp.
MTDITGFEIRITTSETGSILRAPTEREVAAKAEPLLRRVHARGELIGFSIIGPSASGIGRLKAYLEDVLIEVSRLGL

SEQ ID NO: 4031 - protein, 76 aa, Methylobacterium sp.
VSATRNEQTKLLATAINNVAVAFAVLGFVTPVVAVSFGAASAPILRTDSALFMLVWLCAGFTLHWVARRTLRSLEP

SEQ ID NO: 4032 - protein, 59 aa, Methylobacterium sp.
MDLQATIRDAIWTELLRQSEATDAAPTVSIAEDGAADIHGRIDIDALIMVITGALAGGP

SEQ ID NO: 4033 - protein, 297 aa, Methylobacterium sp.
MGSDQHYPEEAPVHRVAVDGFWMDESLVTNRQFKRFVQSTGYRTLAEIPPDPKNYPGALPHMLFAGSMVFVPPRGPVDLRHYGQWWTLLKGADWRHPYGPGSSLKGLDDHPVVHVAFQDAEAYAKWAGRALPSEAEWEFAARGGLDGAEFAWGDVFAPGGRLMANTWQGEFPYLNTADGSFRRTTPVGSFPPNGYGLVDMIGNVWEWTADWFAPRHTADAAKACCIPENPRGGREMDSLDPRSPHSPISRKVVKGGSHLCAPNYCRRYRPAARHPQPIDTSMSHVGFRTIIRERMQP

SEQ ID NO: 4034 - protein, 117 aa, Methylobacterium sp.
MTRLGRAAGRAFLVTLIPACASAQPVRSTLADPVDSRMQMSAASLMPTLRGRGLYADDGSLVGWVRDVRVSEAGNTLVAIVARRRWLGGGEVAIPVPTLRQQGASLTVAGTTRTIRA

SEQ ID NO: 4035 - protein, 376 aa, Methylobacterium sp.
MPTGIRRCTEIEGACAIHEAPPDIRVHTDLLYVPVECGALWGLYADGVRIDREAPLDADAARQVAELRVSAPRIDGRFYYLGDVVEHFGHFVVGSLSRLWALPAGADTPLLYHGAQDIERLRGLGFLEPMLGSLGLGLEALRHFRVPVRLAEVTVAARAFRENRSASRAYDGLCKAIGRPWLAGVAADGDARPAYLSKLKLPPGSLHKLENEAELVRELERRGVDIVFPEELDIRAQVRLFAERRHILGLTGSALHVSLFAAPERRILGLNWCRRLNANLPLFDALNRNRAHYYFADGVTWVRNDAYAAEGDFFLRWSLPDPASVAAALVERAADFDGIAERDAREDAARAGGPFARSVAAAGRRARAGLRRILSP

SEQ ID NO: 4036 - protein, 513 aa, Methylobacterium sp.
VARGARGTQRAAAPEAEALSAARFSHLLAAELRLVLRERLTWAILAALLAALCLAARTGAERTEAARAAVAQATEDGARTVRDARAAHARYARPSPITVNYWQDPTDAFGYMTYFMAAHAVKPPTPLGLLAAGQSDVQPAVMRISFGFSTVFDDTAYELGSAARLRLGAFDLAFVLVYLVPLAVIALAGTRLSAEQDAGILRLIAAQPIGPRRVAAAKFGAVGLVAVAGVLGGTALALLMAGGTGPLAGWGGVLALLGASLAAYTLFWVAACALAASLWRGAVAALAVLVLAWAGLTVALPTALGLAVDLLAPRPSRIAAIDASRQAQAAFYAGETGTRVASAWLAARVPDAAARPGLSEKPEIKRLARDAFYDTALRETRAALAAHARELAAWSGRLALLAPASALALALETAAGTDAARHAAFLAAATGYRGSLRAFFEPRIVAQALDPVPVCAGCPGRLDFDAYDAVPAFAPAPALAAARLQAWLSLAALLAGTLALAVLAHRRLRAWPA

SEQ ID NO: 4037 - protein, 464 aa, Methylobacterium sp.
VRRVAAELALILRDARLRWIGAVLVLLLALAGLAAWREAAAYGAEIQRVTAAERARWLGQDAKNPHSADHYGLWVFRPSAPLAVLDPGTEPFTGRMVRVEAHLFNDAVYRAVQDAGPLARAGLGSVADIVQLVVPLAAILLGFSAFAADRERGTLRLALGNGVPPGRLFAGRLAALVLALALVVGLPLLGLGALAADSLGAEGWQVWPRLLAWVAAQLAYAGAFLLVAMLASLVARTARGALAASLAAWVLLCVAAPRLAGAGVELLQPALSYREVRARIDAGFRAHRTAEANDVRVREVLARYGASDPDELPVDLRGLMMSENESHNFAVYDRELGAFFASLSAQERATAWAGIVSPRVALQALSQTLAGTDFAAHAHFVWAAERYRRTISERMNAEIRDHPQGGGRVLVSGPELWQEIPPFRHAPLPLARALADAGVPALILALWLGALAALSVPLLRRLKP

SEQ ID NO: 4038 - protein, 242 aa, Methylobacterium sp.
MANDGPVLALDGVVKRFGQRTALAGLDLILRSGEVFALLGPNGAGKTTTINLILGFLRADAGTVRVRGVDASADPVGARAHVAYIPEQVALYPTLSGLENLRYFATLAGLDLGKAEARALLAEAGLGGDAHDRAAGAYSKGMRQKVGIAIALARRAGLLLLDEPTSGLDPGASAEFSRTVRAAAERGSAVLMATHDLYRVREMADRVGVLGGGRIVEEIDPRSLDHVALERLYIERLSESAA

SEQ ID NO: 4039 - protein, 458 aa, Methylobacterium sp.
MYGAVLAGASSDAAARATPGNVILIRGGYVMTMDAVRGDLPGADILVRDGRIAEIGRGLPAPEGADIVEAAGAVVLPGFVDAHTHGAISQMRGLYGNTPETAFFPVTNRLSAHYSPEDTYIGMLLSAVESLASGITTTADFFDAVRDREHAEAGLRALRDAQIRARLLYGMTSKTAAAPIDLAHVEEWQRGWADRSAGGRLSLGLAWRLPQDLDDARAWAIKQGEWEAARRLGLPVQVHVSGTVPGRAEAMFDALIARRMLRPGLQVIHATDARDDQLAALEEAGAGLVVTPLTEHRVGYGLTRIDRFAGIRRLGFGIDGSALAGSTDMFALMRLTALTQAGAARDETAVSPRRLLELATVGGARAMGLDAEIGTLVPGRAADLQIVRLDTWNLAGFKGGDPSALLVYSARPEDVATVMVGGRLVKHDRRLLFDDLMLLDQARLSILGICRRSSQVGP

SEQ ID NO: 4040 - protein, 76 aa, Methylobacterium sp.
MRSAPFTIVISGKRYECRVAGNTESEAADTAERILHQLRQEDRVWPAQVNIDCADFEAGKRLAAYFAAITVEPDLD

SEQ ID NO: 4041 - protein, 70 aa, Methylobacterium sp.
MNDAALPTRLGPQALIGTWRRFGPVGPIYEVIGLAPTRPDGETLVRVRVLETAEELDYRLRELLDDPPAR

SEQ ID NO: 4042 - protein, 365 aa, Methylobacterium sp.
MAPLLERALGTLVMGGILLDVFLTVLYARIGTGLIAERAARLAWIAFRRAAEAAGARRGTVLSFCGPAILLLYVLLWAFGLTLGAGLIIHPGLGTGVQAGDGPTPEDFLTALYAGGSSMAIVGASDFRPTSDAYRVVYLVNSLIGLSVTSLVLTYVMQVYGALRQRNALGLQLHLLSGGTSDAGELLARLGPRAQFSAGYTHLATLGDAMAAMKETHHFYPVLFYFRFRQPYYSVSAQAQLALDTVSLIRSTLAGEDTAWLKDAAAVEALWRVAQMLVVTLETAFLPGDPVVARTIDPRERQRWRAHWERAVARLAEAGIPVAKQEMAAQAYLDLRAQWWPHIARLAPAMAYRSEDIEAHRSENS

SEQ ID NO: 4043 - protein, 447 aa, Methylobacterium sp.
VTTVTLRLRTLLATAALSLCLPLGLVASAETEPAPVQKKDVDTPQAVEAPKTAPDPAIERGRYIAVAADCVACHSNPKSGKPFSGGYGLETPFGTLLSSNITSDPETGIGRWTEAEFTRALREGLGKDGQHLYPAMPYTSYTKMSDQDVHDLWLYMKTVPPVRNAVVTNQLPFPFNIRALLMGWNLLFFEQKRFEPRADQSAAWNRGAYLSDALGHCGACHTPKNVLGGDKTSKAYHGEVLQSWYAPDITTSKTGGIGDWSKGDIVQYLKIGSNRMAVASGPMAEAVTNSTQHLTDADLAAIADYLQTLPPGPATEAPRTAATGAVMAQGKRVFDAQCKACHASDGTGIRHMTPSFPGNTAIQSHEVAGIVRTVLAGARGAITAENPTGAAMPSFAWNLSDQQIAAALTYIRNSWGNRAPPVTAEAVAGTRKSLNLNAVGRAPHPAH

SEQ ID NO: 4044 - protein, 351 aa, Methylobacterium sp.
MYDTPADARAQLAQQDFTRPQIEMIVGALVPTLTFRPEAGGAALRIGATRIGGTPDLPPGLAWPVRAAPPDAEAIAGRGNVEAAEGMRRHFRAALPYAFFAQVDLAEARGQGGPAADLPEDGRLLFFYDLIAGPWDTGGGAVRVIWDPSPRAALAAQAVPAPLAAAAAAHRAEIAQVNAAFKLPPPKPEAATPYGAPGRPMRLAARLRPPNPHSLEWAGSAKLRAAYAEEEADDFREAYDDLFAHAFDPHYGAANSGRRNQLLGSPLPEQGDPRYEAEVASRFGVQHLDAETRRARWPEIEAGARDWRLLLQIDIADFMQAREEGTVYVLIRAEDLAARRFDRAAAVYQQT

SEQ ID NO: 4045 - protein, 227 aa, Methylobacterium sp.
MAALAGNASTAQAAELSGEMPWEPGQANVPPLPDSGSERFVFFTPAEAEAVGAMADRIIPADDLSVGGREAGCVRFIDRELAGPYGRAATQYRLGRFVKGTAEQGIQSPLAPADRYRLGLAALDRHCRAAHGKGYASLPPDEQDKVLSAMEAGTLDLGEVDAKEMFERILQNVREGFLADPLYGGNKDLVSWRMLGFPGAQYDFRDVIDLKGKKLDFVPVSMIDKSL

SEQ ID NO: 4046 - protein, 291 aa, Methylobacterium sp.
MDLADAGSPEALVKRILQAEPNLPVPVPIQELCARLGIIGIEDLDSDAFEGGLVTDAKRSEGTILVKRGGEPRRRFTIAHELGHFLMAHHVPDQPGRFLCKGADMLRLTANAGDQRQRMEVEANRFAALVLLPPHLLRGAMAAFREPDLQHVRVLARDFAVGKEAAARAYVQYHPERIAVVAAGKGRVQRCYRSLSFPDIICGIGSPIPTGSLYHNGSHRPNSASDIAACPPDLWIDVKRDLRAPALYEQVYLQPNGFAMILLRLAPVPEDSAEERRLEEGWRHRFHSGRR

SEQ ID NO: 4047 - protein, 86 aa, Methylobacterium sp.
VIVDAAGAAHRATRVVGAAARRLDAQDRLLHAIVAALAPPEAETEGSGFEDLIAVLADLTEAVADVTQAVQALRSDVSARFPTVRA

SEQ ID NO: 4048 - protein, 580 aa, Methylobacterium sp.
VIVGLGWCGSLMAEELTRAGLTVVAIERGPWVETAVDFPPSVDMDELRWDTRRAMLLPPAIETITFRNDPTQKALPARDWNFNEWGYNVGGSGTHWAGMAWRFLPFDFQPYSMTVARYGAEQLLDGLIVQDWGVTYDDLEPFYDRFEKIAGVSGKAGNLKGEKIPGGNIFEGARSDEYPLPPLKTTRLTDLFTEASASLGYHPFMVPAGQTSGAYTNPLGVRMGPCTYCGYCLYYGCGNWSKSTPNNCVVPALMQRKNFSVLTESTVLRANLAPDGTTATGVTYVDKDNRTWEQPADIVVFSAFQMQNVRLMLLSKIGKPYDHATGEGVVGRAYSFQTVSGANIFFENEYLNQFIGAGALSAQVDDFNGDNFDHAGMGFIGGAGILVVSRGARPIGNADFLPPGTPRWGSAWKKAYTHSFQNGTFLFGQGTSFAHKDAYLDLDPEYKDIHGLPLLRLTYDYNENDRRSAKLIEDKSVEIGRKMGAKVVVGTNATNQHASPYQLASDHTNGGAVMGLDPKTSALNRFQQSWDVHNVFVLGASSFPNNAGYNPTGTVGALTLWTAKAIIETYLDKRGPLVAN

SEQ ID NO: 4049 - protein, 330 aa, Methylobacterium sp.
LSSFCAVLACLGAARAEAQSSDALKEPYRRPSAIPFPEAAPYAPQMATLGKMLFFDPRLSGKQNLSCASCHNPSFGFEVPVPGAIGATNKPLPRKAPTVLNAAWTPVLFWDGRAPDLETQAAGPITADAEMDGKFPEIVARLKATPEYAAWFGRLFPRDGVTQGNILTAIATYERTIVSGWAPFDRWIEGDATAISPAAQRGFALFTGKAACAGCHSGWNFTDNRFHDLGIPTRDIGRAAFEPDNPLAKHAFKTPGLRNLTYRAPFGHAGQFPDLEAIVAFYETGGLARPSKSPLMKPISLTGEERADLLAFLRSLTAEQTRTALPNLPN

SEQ ID NO: 4050 - protein, 287 aa, Methylobacterium sp.
MTSSPDVGAFARLRAAGFVCAATRLADVDLPRLGYTIGVGEDEIHAVLDVETAGGGFDALKRPKILFEPHVFYRNLSGAARTQAVSLGLAYAKWKPGAYPRDSYPRLMQALSIDETAALKACSWGLGQILGENHVAAGYHTPQAMVEAFCQGGETEHLAAMIRFIVANKLDDELRRHDWAGFARGYNGPQYAANGYDRKLAAAFAKWSRIKDTPWSPSEVEPVPDPLAPMGAGADPVLQKAAQNMPAPMLKPAPTGGLSSAPSPAPAAPGFWSRLLSTIRLNLAKGA

SEQ ID NO: 4051 - protein, 206 aa, Methylobacterium sp.
MRRFAKLLALVMAAMAASAQRVWDGTKWIARAAFGPPVPAGAGIEEAFDDVAQALRPVTPSQPAAEAVTPSAPAPKPGPAKVVEIDPVLARGRVAYAFAHAMLTADEPSTAGLDDAASAWLNSLNASELMKIHQYGAHRVGAHMAGLRPIEGLPLCPSMAEYRNALCAAAQITPQQRRDVAEWQQMLDRAFEEMVEDPAYELKCGI

SEQ ID NO: 4052 - protein, 275 aa, Methylobacterium sp.
MSAARVRGSGRSLEIIRRRPARALGRPRLLFVHGISVGAWIWGEHVLPWFAEAGFEACALSLRGHGGSWGHDRIADWRLADYTADIDQAARSLGGPLVVVGHSLGGAVIQNWVRTGGRPLGMALLAAVPPWGLAVSALRMGLLTPALFREVLAMSLHGARAADPAILRAGLFSEDVAAESFRRFVARIGEESRLIGPELQGWPPFAPLPWEAPRTFVLGGADDRFIPADEVWRTGAYYGCRPHIVPRLAHALMLEPRWEEAMAPLRDWLLTLPRT

SEQ ID NO: 4053 - protein, 840 aa, Methylobacterium sp.
MIKTFIPNDPLFGAQWHLQNTSQTIMGLPQAGGAYRNDIDVTKVWPDYTGKGVIVGVIDDGVQMNHPDLQANLLLGKFYDLDAGKAGTPNGKHGTASIGLILAPQNDQGGVGVAFGSKGIGYVASPGVFNLVAQRMLTDGVAVSSNSWGLVGPEDTTPFKYAEDQAEFDAVLTNLAKAGRNGLGTATLFAGGNERVEGSNTLFDLTSNSAYTIAVAAANADGTVATYSTPGPNVLVAAPGSGNGAGSAAQVASMVTTDLLGTAGYNQAVDGNYTNLSNTGFNGTSAATPVASGVVALMLEANPNLGYRDVQEILAYSARTPEGVATWSTNGATDWNGGGHRHNADLGFGLIDAHAAVRLAETWNKQSTFANIAGATSSFTGTGSVSLAAGQSRQFTASFAQPLRVQHVAVSVDMSMAGGSSNLSAVTLTLTGPNGATTTALIDPASYSEDQKTKMASTLTYTFDSVQNWGELSNSGAWTLSVSNASTGSRLDMKASISLIGDLATGAQTFVYTDDYAYLAGSETARAALEATAAPNVLNAAAVTSDTTVNLAERTATIAGVATRLGESARFASLIGGDGNDRLTGNDAADVLVAARGNDVLQGGGGTDTLTGGQGSDTLMGGADADLIYGNQDADLIYGNQGGDKIFGGQGDDRAFGGQGDDQLVGGAGADTLLGNAGSDLVYGNLGTDVIYGNQGADTLFGGQDSDTLMGGQDTDVLFGNLGADVIYGNLGSDVLYGGQGADTLYGGQGDDVLVGGLGDDVLVGGLGADRYVFASDPGGRDLIVGFQQASGDRIVLGGQGYTLGTARNGDALLTLTGGGVIDLAGIRADQVNASFFAAA

SEQ ID NO: 4054 - protein, 505 aa, Methylobacterium sp.
MNDLVISRANAIGKAVAVRTAPVTGRMRTYISGSSLLSGRSDDTEFLPAHLEILETPPAPQRIAALWLLCGALAAALLWSCFAKLDIFAIATGRVQVAGRSKVIQPLDPGAVKSIRVENGIQVKAGDILLELDPTVANADKQASSWDIWSLRAEIPRRQAEIKAFESGATAPPKVDFPEDIGPEIRLREESVLAAEFAQYMSAKASLEGQVGENDALKSRLAGSVAARTRLIDVLKERLGMKQELVVRAAGTRAALLESQQALESELTNLAYDKGQMMQAEAAGVSLAKKLEQLQKQSVAEQAQKLTDAQRKLDRFKEDLAKASFRVDRTTLRAPISGTVQQLAVTTIGQVVTTGQPLMVIVPSEGNIEIEALVQNTDIGFVEVGQEATIKVNAFPFTRYGTLDGRVVRVSRDAVDAKDASQTSDAATASRAQNSSIFSSTPAAQNLVFPVVIALNKTSLLVDGKDLPLTPGMTATVEVQTGSRRVIDYLFAPIRETTSTAGHER

SEQ ID NO: 4055 - protein, 129 aa, Methylobacterium sp.
MALADDLMRKAERALDTARLMTEHGATEGACGRAYYAMFHAAQAALLTVGTHPDEVIVKTHRGLIASFGRHLVLPGHIDPAFGRSFSRAEQRRIAADYAGDMPSRDDAEDGLADAEAFLQAIRIAFPSL

SEQ ID NO: 4056 - protein, 80 aa, Methylobacterium sp.
MLSIRDEEVRTLAEAVMRKSGAPNLTAAIKLALQREIKRADEAVPLIDRVAAIRAAALAKADRPPAPPLSEDERDALWAR

SEQ ID NO: 4057 - protein, 482 aa, Methylobacterium sp.
MDVTRRIFAAGAATLPFVGPGLPRTQAQSTGQDAPIIGNHAVADPLELAVDAYIYGYPLVTVEMTRRVLTNVAAPEGKNAPMGQFANLREYPDAKFRAVTAPNADTLYSSAFVDVGKEPHILSLPDEDGRYYLMPMLSAWTNVFAVPGKRTTGTGPQTYFIAGPGWSGSVPPGAQLIQAPTSLIWILGRTYCTGTPGDYRAVHALQDQYRLIPASAAGRAYTPPPGRIDPSIDMKTAVREQVDRMDATTYFNLLASLMKDNPPALADGVPLAKMASLGIMPGRSFDPASQPPAIRDAIGRAPKEASPRIMGYLKATGRHVNGWTFTTDGGDYGKDYLQRALVTAVGLGCNLPQDAVYPLTTVDAAGRRLNGASKYVMRFPAGELPPVDGFWSLTMYDADYFFVDNPINRYSVSPRDDLKANPDGSVDLFIQTESPGAMRESNWLPAPRGPFVLMLRTYWPKDALLNGSWSPPPVTRSASATL

SEQ ID NO: 4058 - protein, 492 aa, Methylobacterium sp.
MSRVLRPHQTRIIDRLRESMIAGRRRPMVQAPTGAGKTVVAGAIVRGARAKGKRVLFVVPAISLIDQTVRSFFAEGIHDVGVIQGSHPMTDASRPVQVASIQTLQRRAIPPFDIVVIDEAHRWFEMLGTWMAAPDWAAVPFVGLSATPWTKGLGRHYDDLIQVTTTAELIAAGYLAPFRVYAPSHPDLDGVRTVAGDYHEGDLGEAMNRPELVADVVRTWQQRGENRPTFVFAVDRAHAKHLQGEFERAGVACGYIDAFTKSDEREALFQRFTAGELRVIASVGCLTTGVDLDVRCIVLARPTKSEMLFVQIIGRGLRTAPGKDDCLILDHSDTHLRLGFVTDIHHDALDDGRERQKQDRKRRPEALPKECPGCSFLKPAKSPKCPACGFKPERQSEIVCEDGDLVEMTPKRERANSAEKGLMFGQLRHYARTRGYADGWAANKFRERYGVWPDRYHNAPLVQPTPTTLSWIKSRQIAWVKGKGGARAHASA

SEQ ID NO: 4059 - protein, 99 aa, Methylobacterium sp.
MSAELSEAIGRAARDEGLTAGAWVRRLLLERLDLKSAEDARSGRPVRVPEGHHAALAGALRELASAGAAVRTGDEVEAARALQAARDLLIPLALRRSAP

SEQ ID NO: 4060 - protein, 141 aa, Methylobacterium sp.
VIVAIETAMRRGELLSLRWCDVDLEQRVAHLAVTKNGDTRSVPLSSRAIRAMLDLRTERTVPTDKLFPLRPGSLEQTWMRLRERARIENLHFHDLRHEGVSRLFERGLGIAEVGAISGHKEVRMLTRYCHLRATDLAERLR

SEQ ID NO: 4061 - protein, 329 aa, Methylobacterium sp.
MLPYPVLLADIGGTYARFAILAAPEACPGPIRKVPTAAFPEPIAALQAYLDGPGTPQPRSAFLAAAGRVDGQATRMTNAPWLFDLGDIGVALGLEAARLVNDYVPQAAALHVLDEANAADLARIGPVAAGRGPRLVLGPGTGLGAAALVPVGDRLLVQTTEAGHVGFGPCERDELPWQALMPAEGRLTAEALLSGPGLARLARALAALRGVAAWQSPPEVLEAAKVGDPLAQEAVRQFARLLGRFAGDLALMFSATGGVYLAGGIAPRIVEVLQGEAYNAAFEDKPPFREVMQTIPRFVITRPEPAIDGLASLLRAADRFLFPGQDWRA

SEQ ID NO: 4062 - protein, 478 aa, Methylobacterium sp.
MTAYFITCHASVAYVRDQFRSLYGPEHLLLYHVDAKAPAALHETVRRLAETFPNVVVLPSRHYAWAGYSQVATTLAAIDCALASGPDWSHLVALSEQHCRVLDEAELVAALTPGVSYVDSTPFSAMNPGFQADIAHRFSMDYRELPGIGSFGIAPVAPDPDFLGRLRHGSNWYILSRQACAYLGTAARTAPDAARLRAAVHPDENMLQTLLAADGGRAGPIQRRETTFVAWPHISGNPDMTFRAEDFSAARAGDRLFIRKRPAQLPAPVAALLDDWASLSEAELSERIGAPLELAPEAPDPEGTALARRVASRVVRRGRGVQADLPNLRFGLRNPRFSLRFRTARIPDGIDVRILSQDLRHFRVLLLEAERPEIDFAPRRLHGRPAPLLRIRVPEFDFRREILVLEDPAHGFWTRPEDGSVTGLVRLIELYLRVAEDLAQTRAPEPARGPAAARREMSARARSFAWSLRRLLKRKRPA

SEQ ID NO: 4063 - protein, 93 aa, Methylobacterium sp.
MRTVLLIGLVGCVAAASLGHAVTAAEPPAFRAVALVCPAGIEGPDCSRENALDIAVQPVAHETECGLVGQVLASHLTLQPGERHKIACERRRG

SEQ ID NO: 4064 - protein, 189 aa, Methylobacterium sp.
MDRAAPARADRPGASRLGRRLRDELKRMAAIFAYLWTVFGILVLHEWIVLSRHGIDHRFYGLAFVNAWILAKVVLVTEHLDVLPRWAGRPPIYRIVTRSVGLALILVVAYALEETAIGLVRGRSLADSLPTIGGGGVRGYLAIGVIMAVALVPYFTFRELGRVLGRARLRALILSEPAPSAAGHGGEQR

SEQ ID NO: 4065 - protein, 415 aa, Methylobacterium sp.
VISGATRGTGRGGALARHLMKDENKAVLIPARALGSPDLAGQLRELVAQCAGGRTDRPVYHVFCSPDPAIADNAAARSRFWNLFEHEFGMTDQPYCGVEHAKGGRLHEHRAYGLVHPTGAVVDLSWDYARREKCARIVESEFGLSPVASKHARAVERALRREGRSDVADWLAASGATVAERPIARLTPRERLIEERTGVPLDDLRRQVLAAWRETADGPAFAAALAARGLVLRRGRVGPVIVDASGTARAATRLVGAAARRFEGTRIRAATVKERLAGLRLEGVDDGRCSGLAAAGRDGGAVAGHPGGPGAAGIGVGGVGLRRPGGGAVGPDGGGGRHGGHGPGAALDRLRAASGARRAMMRRHLAGLDVSLDRYRAAAERARAAAERLDEVADARQRRGMALWGVTDIWGLPLQ

SEQ ID NO: 4066 - protein, 143 aa, Methylobacterium sp.
MVIPARGLGSADLVTQIRELVAISLGGRTDRLVYHVHLDPDVGIANEARARARWWSLFEAEFCLEAQPYWGVEHRKHGRRHEHRVYGLVRPSGSVVDLAWDYARREKCGRIVEFEFGMAPVASKHARAIARHLREEGRAEVAD

SEQ ID NO: 4067 - protein, 272 aa, Methylobacterium sp.
MRRGFRTRLLGISGKLIVGLILAFIVLPALVVTLAAFNDRAILSFPPAKYSTRWFTRALTYRDFQTGLWNSLVVTAWASTIALVVGTGFAIALKRYAFRFKAALEGVLLSPLIVPHFTIGLGLLVLATGIGAARGFPVVVLTHVVVVLPFVIRSVYISLQNIDERLELAAASLGARPGRVLGTITLPLLAPGLVSGWLFAAILSFNEFTASLFVTGQATQTLPVAMYGYVREFADPTLAAVSVIYIAVTALALTVANTFLGLGKVLNVEQGR

SEQ ID NO: 4068 - protein, 472 aa, Methylobacterium sp.; identical to SEQ ID NO: 2797

SEQ ID NO: 4069 - protein, 590 aa, Methylobacterium sp.
MSRSQDRRVVAEELRLVLDGVSQSVAVGFLVSTLMLVVLWTPAPRGILLSWYAAFLIERIAAALYARRARHVVDRPDRARRVERIVFLSKIIEGSILGSLIWIALPLQIPAVSILTMSLLGATCSNGVSLLAPRRHLYLALVIPVAMLAAGALWSLGGAPYRALAICSILFVVGQYGQVVLASRRVRESIELRFENMALVEQLRGESAAAHAARRDAERANAAKSQFLAAASHDLRQPVHALGLFLQALSQTDLVGPQRRILQNAQAANVASTDMLNTLLDFSRLEAGVVTPRPRAFELQPLLDKIENDLAHLADARRLIYRTVETDRAIVSDAALLELVLRNLVLNAIRYTDRGGILIGCRRRGTNVSIDVYDTGIGIPEGKREDIFREFYQLGNPERDRQKGLGLGLAIARGIATSLGHALSLSSKEGHGSVFRILVPGTDETVPDVDVLADIPNPSGLAGARVLVVDDDAIVRDAMTALLTGWGCRCWVFEGPDDVGRHPASEPAPDALICDFRLREGRTGTEAIALLRRHWGRPIPAILITGDTAPARLREALDSGIPLVHKPVRPDILQNALLSLIAPGRPTGSL

SEQ ID NO: 4070 - protein, 268 aa, Methylobacterium sp.
MDQARTGPPPLLKIRKLRKSYGTNEVLKGISLDIHEGEVVSIIGASGSGKSTFLRCLNLMETPTSGFMDFERFAFDYEEGARRQPTPQQLCELRARIGMVFQSYNLWPHMTVLENVTEAPIRVRRMPRKEAVAEAEALLQRIGLYEKRHAYPSKLSGGQQQRVAIVRALAMAPKVMLFDEVTSALDPELVGEVLALMGSLAADGMTMLLVTHEMAFARDVGTRTLFFDGGVIAEDGPPAEIIGAPRSERLRQFLRRVLHDPARLGASA

SEQ ID NO: 4071 - protein, 137 aa, Methylobacterium sp.
MPALDGVLETVLYVEDLARADAFYRGVMSLSCIHEDFRMRAYDVAGRGVLLLFPRGGSLEPIEIPGGTIPPHDGSGPQHVAFAIGADTLPAWERHLAEAGIAVEGRTRWPRGGQSLYFRDPDGHLLEIATPGLWRGY

SEQ ID NO: 4072 - protein, 338 aa, Methylobacterium sp.
VSERIRFGVSPIAWINDDLPELGAGTPLERMFHEAAAIGYDGIELGGAFPREPAALSALLAPSGLALAAGWYASSLLTVDAEAEIEALQPHLRLLRAMGCDVFIAAECSTSIHGLRRVPLAHRPVLDWAGWRRFGRELTHLSEYLAREGFRLAYHHHLGTAVQSVTDLSAMLAHTPSHVGLVLDTGHAVLGGIDPVALIREHPERIAHVHCKDVRPPAFAAVEAAGGSFLDGVLAGMFTVPGDGSLAFGPVLRALADIKYRGWLIVEAEQDPQIADPRIYGRIGLETVRREAIGAGLTTWTGSLARAAVGAPSPGNAPSQSPAATLFPLAELALSGLA

SEQ ID NO: 4073 - protein, 205 aa, Methylobacterium sp.
MKLFYAPGACSLSPHIVLRELDLPFALEAVDLKSRTTAAGTDFTAINPKGYVPALQLEDGEVLTEGAAIVQYLADRYAPGTLAPVAGTVERARLNGHLNFISAEVHKAFGPLFDPALASEARTASIANLGRKLDVVQGTLADGRPFLTGQDFTVADAYLFVVLSWAPHLGVDLARWPRLAEFSHRVSARPAVQAAMGAEGLRKPA

SEQ ID NO: 4074 - protein, 205 aa, Methylobacterium sp.
MSGHLPNKQHAHAERGNDLYETPGAAVRALIATEWLPQRIWEPACGPGAIVRELRAAGHDVVASDLVDYGCPGQAAGVDFLTVQAAPDGIDCIVGNPPYKDANAFVERAIALCPRVMMLLRFSFYESIRRGSILDTGTLARVHCFRKRLPMMHRHGWEGPKAASGMAFAWFVWDRSHRGATLLDRLSWEDFADEAESAPVLAAAE

SEQ ID NO: 4075 - protein, 523 aa, Methylobacterium sp.
MAEASCRAVTVATTAISLVLCSPAAAAPTNEELYAMLRSVQTEQAQLRRENAEAKADLAEARRQLREALGSARLLHRRDPAGLATVSVPAPVPVARRLAPPPAVSGVVGAVEGGAGGFRAGAGGYAAGSLAFPVGRSFGLQADLAMMANGGDLGLGAAGRAFLRDSNKGLIGLYGSVDYASAIRSYGLQDVGTTTGRIAAEGALFLDRLTLDGIAGWQLGERADRFFDQVDLSWYASDDLRLSIGHRYENRIHAVAAGAEYLLPLGSAVGVSVFAEGRVGSNDYRAGLGGLRVYFGQEDKSLLRRQREDTLKVRLIDAFASRPKGFRVVPAIGPQGPAGPQGPTGATGATGPQGLTGATGATGPQGPTGPQGPAGPQGPTGATGATGPQGLTGATGATGPQGPTGPQGPAGPQGPTGATGATGPQGLTGATGATGPQGPTGPQGPAGPQGPTGATGATGPQGPTGSQGPTGATGATGPQGSTGSQGPTGATGPQGPAGPQGPTGATGPQGPAGPEGPPGATGI

SEQ ID NO: 4076 - protein, 207 aa, Methylobacterium sp.
MMTILIGYARCSTDKQDLTAQRAALEALGVAPERIYTDHGLSGTNRARPGLDQALAAARAGDTLVVQKLDRLARSVPDARAIADGLVRRGVRLALGASVYDPHDPMGRMFFNILATFAEFEADLIRARTREGMAIARAKGKLRGKQPKLSAKQQREVRRMHDVGDHSIGDLAELFSVSRPTIYRTLARSIRMRAGESPAETVTGTLS

SEQ ID NO: 4077 - protein, 137 aa, Methylobacterium sp.
MLTPFHLAYHVTDLEAARRFYGGVLGCREGRSTDSWVDFDFFGHQISLHLGEPFATARTGQVGDHRVMMPHLGVVLPLDAWEALAARIAAAGIAFDIPPVVRFAGEPGEQRTMFFFDPSGNPIEIKGFRDLAGVFAH

SEQ ID NO: 4078 - protein, 559 aa, Methylobacterium sp.
MSQRRLSLGSLSIRYQILLPLLGFLLLAGLMAAITGLVGLRVSADLSALAERTVAANEASQAARDRFRRADAVVARVTAMTDLLDMGPVTAEFRTAADALGGLLGELRASALSERMGAVAQTADTEARQWRTDAEVLLGLRAAREIPTLERMARHSERLRQRFDEAVALAGADARAQIRSTEAAAGRQIWTILGLAGAVILVGSGTAWWLARSLSRPIVDLTDATTRLAEGDTGVVLAEGRRDEIGAMIAAVRVFRDTILRSRTLEAETAQAGAAAERRAMVNGLADTFERRVGGIVGLVGASAGQLQTTAESMSANAQETADKSGRMNRAAGEAAANVDTVAAAAAQLGASVGEIGRQVQGSAGLARTAAAEAGRTAEVVQALNGAAAQIGDMVALITQIAGQTNLLALNATIEAARAGEAGRGFAVVAAEVKELASQTARVTEQITAQIARIQGATGEAVGAIDGITGRIGEISAVAAAIAAAVEEQGAATRAIVQNVAEAASGTRQVSGHITGVAQAAGQTGLAANQVLDAAAGLAQQSAQLKDEVAAFLVRVRAA

SEQ ID NO: 4079 - protein, 121 aa, Methylobacterium sp.
MLKAFEDRERAAEYLFARTEEARFAAHCGSIRALAIFAMAKLGVDGRTAEAYARVLIAAMIEGQHDEDLIARVQADLRANGIEVPRSELQGVVLRAAASQEILSRMGPPDAASASRPADPR

SEQ ID NO: 4080 - protein, 251 aa, Methylobacterium sp.
VTAPVDHAAVAAGATEALRVRVRRGDGVQDYAVPRRANQTVLDVVTEIQREQDPTLAYRFACRVGMCGSCGMTVNGRPRWTCRTRVAAVAPEGDLLLEPLRNLPVVKDLAVDMEPFFEKWRRAHGFFEPGETPPDDFAAVPPDSPARQEVDAGIECINCGVCYAACDVVAWNPDYLGPAALNRAWTLVNDVRDRGQAARLAAVAGDAGCHSCHSHMSCTEHCPKALQPTFAIAGLKRETGKAALRRLWGRG

SEQ ID NO: 4081 - protein, 109 aa, Methylobacterium sp.
MSPLLYLAQRGTAAILALTVAVHLGTILYAVRGGLTAGEILGRTQGNPGFLAFYAVFVLAAAIHAPIGLRSVLREWTGWRGRSLDLAMLALSALLAGLGLRAALAVYLA

SEQ ID NO: 4082 - protein, 114 aa, Methylobacterium sp.
MSALSVHRRPGFAAALIHRLSGIALALFLPMHFIALGTALRGADRLESFLGLTHNGFVRAAEWGLVCALAVHMALGLRVLAIEWLSYRERTAVVVSGCLAGAFAVGLLFLLSGA

SEQ ID NO: 4083 - protein, 203 aa, Methylobacterium sp.
VAHHVLDMPAAEAEIRALRIGDTVTLRRWLFGIRDATLIHMFDRDRRTRLDLAGHAVIHTAPNVHRVPPSPEAPVGYAPFCIGTTTSMRMERFTDALMEREGVRLIVGKGGMGPATLDAFAERGGAYLAIVGGAAALETTWIERIEDVDMDDLHPESLWRFAIRDFGPLLVGMDAHGGSLFAEVQRDVAARRDAVLASLEAAR

SEQ ID NO: 4084 - protein, 574 aa, Methylobacterium sp.
MTLEEVRTDILILGSGGAGLFAALHAKKTAPDLAVTLAVKGLLGKCGCTRMVQGGYNVALAPGDSVERHFMDTVEGGKWLNDQGLAWTLVTEAQVRIRELETELGCFFDRNPDGSVHQKAFAGQTFDRTVHKGDLTGIEIINRLSEQVWRRDVNRLEDHRALELIPARDGSGLSGVLMLDMRTGEPKLVRAKAVLLATGGGPTMYKYHTPSGDKSCDGLAMALRAGLPLRDMEMVQFHPTGLLAGAGTRMTGTVLEEGLRGAGGWLLDSTGARFMEAYDPRGERATRDIVSRSIVRRIRDGFATPSGGVHIRMSHLGPDDVRRRFKGMVERCADCGFDLAEGLVEVIPTAHYMMGGIQFAADCTTALPRLYAAGEDTGGVHGANRLGGNGVANSTVFGGLAGQSMARAVLGGGSLADPDPAAIEAGLARAFGPLGRPADALPAIREALYETMWNDVGILRDAAGLTRALGALDGLAEAVARAGAPDGDRRYALTWMDRLNLENLVLVSQAIARAALARTDSRGAHFREDHPETSDLATSAYTVVRRQDEAFAIAMEPVAFTHVRPGGSLLDAAA

SEQ ID NO: 4085 - protein, 99 aa, Methylobacterium sp.
MPYFLLRLEPPRPSFPFDATEAEKALFSEHAAYWIDRAERGQAVAVGPVFDAAGTWGLALVEAADDAAARMLGADDPVIRAGAGFVYTLSAVPNLILRR

SEQ ID NO: 4086 - protein, 424 aa, Methylobacterium sp.
VVLRAAAALLALAGLTAASFYAGLVHADLRIATGPPGSAIQRLIATFAAANARLHPRVRLLPVAEDSLAASARALDAGRVDLAIIRSDLPPPANGLTVAVLRRDVIAIVVPPHSPITALAHLAGHAVAIQPGPVAADDARVLDALLDYVGVPGSRVERLVLDPAGLRAALQDRRAAAVFAIGPVGAGAAVDAVAAVARASGGTPALLAIDEGEAIHRRHPGLEPVEVPVGAFRGRPAVPAATVSSLAVTYRLVAARGMLDIVAGAVARSVFTARTMLTEATPFAGQIEAPDLDDKTPLVPVHPGVAAYLTNGDQSFFDTSQNVLYLGGIALSLVGSGLALAVSVGRRRRAAQERGLIAGLVAIADRARDADAAELEALSQELHRLVGAALVRQAHGDGLPSLIGPAIAHARTAIRTRQARLAAD

SEQ ID NO: 4087 - protein, 267 aa, Methylobacterium sp.
MKIAVITPSRLKLSTLAGETDSGLYFLEHAVRSAQAQQLDRPVELRFFVGVDPGTEIPARLAEQPNLTFVHSDRKAQVAALNAALLAVDESWDLVGFLEDDDAWLPHYLSVAIRALEQFDFVSSTQLEVDEAGEAVRINDFPTPSGWLMRRSTFDRVGEISMWSKWHYDNEWLGRLAETGLRRAHLVEATAPATLQDAAQVRPWLANVLRFGGPNSHLLRHGSVLPLVRRLVHPGSGTSQIGGGAVAKQESEAEYRGLAERFGRIPW

SEQ ID NO: 4088 - protein, 504 aa, Methylobacterium sp.
MLRLAAACLASGLALTAPLAAQTSGPTAGPTLRYGLMEDPDALDPTLARTFASRMVFAALCDKLVDIGPDLKPVPQLATKWELSADEKTLTMTLRPGVRFHDGEPVNAAAAKFSIERHLKLPGSQRRGEIAPIDSVDVVDDLTFRINLKQPFAPLMAQFTDRAGMLVSPKAAERLGDKFASGPVCAGPFKFVERVPQDRIVVERFPDYWNKDQIHIQRIEFRPIPDTTVRLTNLRAGQLDLLERLAPTDAPQVARDAKLKLASTYELGFQSVLFNTAKAGSAIADPRVRAAFELAIDRAAISQVVFNGEFLPGNQWVSPKHPDYVKDYPIPKRDVAKAKALLAEAGQPKPQITLMVYANSEAPQVGQVIQAMTREAGFDVKLQATDFTTALDLADKGNYEAYLYNWSGRPDPDGNTFSFLSCKAPLNYPRYCSEGADAALQAERGSVDPEKRKAAWKALADKVLTDRPGVYLMHRKLLWAYGPKLTGFVPYPDGLARFTGLKLN

SEQ ID NO: 4089 - protein, 304 aa, Methylobacterium sp.
MSTGTPLAEAPGIAAPAGQAALVREPGTLAAFWRRLRARPSAVLGLAIVVLLVGVAAFADIVAPYDPTATDWGAVRAAPSLAHPFGGDEVGRDVLSRIIHGARASLGAGLVSVALAVALGLPIGLLAGYAGGWIDALVMRLTDALLAIPFLILAIALAAFLGPSLTNAMLAIGLSATSTFVRLTRAQVRAVAAEEFVEAARSVGNPPWRIALVHILPNIVPAILVQATLTIAAAIIAEASLSFLGLGQQPPEPSWGAMLTVAKNFMDQAPWMAIWPGLSIFLAVLAFNLLGDGLRDALDPRQRT

SEQ ID NO: 4090 - protein, 230 aa, Methylobacterium sp.
MSADMSTDIAEAPGAPLLDVRDLRVVFDAEGGAVHAVNGVSYTLREGETLGIVGESGSGKSVHVLAMLGLIPRPPGRIAGGQVLFEGEDLLALPERRLRRIRGGRIGFVFQDPMSSLNPGMTVAQQIVEPLRIHLGLSARAARLRARELLDLVRIPNAAARLDQYPHEFSGGQRQRVMIAIGLACRPKLLIADEATTALDVTVQAEIVALVQELKCELGMAIIWITHDLG

SEQ ID NO: 4091 - protein, 306 aa, Methylobacterium sp.
AHTAAPAPYPVLSVRNLSKHYPLRAWWGGKASVFRAVEDVSFEIRPGETLGLVGESGSGKSTIGRAVTMLNPPTSGTVAFEGTDLAGLGAREMRRMRARIQTVFQDPYAALNPRMSAGDYVAEVFRLHRPGMGRGERRAAVAGLFERVGLDPRFMGRYPHQFSGGQRQRICIARAIALRPSFIVADEPIAALDVSIQAQVVNLLQDLQEELGLSYLFISHDLRMVRYLCHRVAVLWRGRIVELADSDRLYEDPRHPYTRRLLSAVPLPDPAAERARLAGAVPEAFGAGRPGDLVEVAPGHWVAADG

SEQ ID NO: 4092 - protein, 269 aa, Methylobacterium sp.
VALATKRRTPEPPSLNDVYEGERQLVGIILAHPEVYSAVARILRGEDWTQNLHRGVFEVVGKLAAAGQSIALDSVLPRVGDVGPDGAPASDYLAELIAAALAPHHAEEIARILAEAARVQHRPCIYDLDLYAWAFDQSQRLRRGQFSALDALNLAEEIEDLGNEIYNKLESALRITLMHLLKWDHQPGRRTRSWTLSIRNGRLDAAKVLEKNPSLKARLPFAIDEAYRRARIDAAGETGLDEDAFPAACPYDLDAIMNRPIPWPPSEDA

SEQ ID NO: 4093 - protein, 286 aa, Methylobacterium sp.; identical to SEQ ID NO: 2831

SEQ ID NO: 4094 - protein, 81 aa, Methylobacterium sp.
MHKLLFAGIALSALAGLSNAAMAEETTVVRRDSAPSVSVERREGVVERRDITTGSVDCGSKTVHKEDGAGNSKTVHKEGCN

SEQ ID NO: 4095 - protein, 293 aa, Methylobacterium sp.
MQSDEKLKYSAPAAACAADLLLALARADGPMTLAALIERTTYSRSLLYRTLKTLGTRGFVVEEAAPGISGSLHYRLGSAAAEIGGAYQSNVPFEESIRSALRALAQRTGESASVATIEGEDVLYVMREEGRYSVLAVSRVGKRLPAHATAMGKALLARFDDGEIRALYGRGELRRFTGNTITDSGALLRNLAEVRLRGYAVEHSELVQGRCCIAFTLQAGPGPGDLLGISLSTTEARFEVEHDALILEVLSTRDALLADLSRRRVPGDRKVARDLTASLGAISRRSVPAAAGT

SEQ ID NO: 4096 - protein, 119 aa, Methylobacterium sp.
MRSALRIAAVTLALASPALAAGPNGGQTTVFDGHPIEFVASDSAVTFYLSDEDGKPVDTAGLSAKAFVQAGGRTDTLVLKPAAPNRLVADLKAPLAAGAKVVLSAKLHGHAIQARFEKR

SEQ ID NO: 4097 - protein, 143 aa, Methylobacterium sp.; identical to SEQ ID NO: 2834

SEQ ID NO: 4098 - protein, 377 aa, Methylobacterium sp.
MTPEHLCERDVEAVVATTPESVFLLSGHLTWLGERMRGWMGGPAGDAAFQAGYAVLTRDGRVGLAARAVTRMAAEAAAPDSLVLYGRACPAADADAALSLLLAEMGLAGRTIGVEWDGAGRGLARSLEPVATRDASLWLRSLRAVKTEAALRTMREAATATEAAMEAVFAAWTADADPRALRTVFRVALAERDCDFDHLVFGAPGGGVCDAARPPEPVTALFFDAGARCGRYYSDTGTTLTRAGFTAADRERHAGALAALAAAERALQPGRPASSAWAAMQDEARRIPGLVAQGHGLGLGIREWPLLGPPSDAVLSDGLGTYPVDAVLAPGMVVNLEAGGHFADGTSVQVEKSFVVGADAAVPLAAQPRDAPIRLPA

SEQ ID NO: 4099 - protein, 624 aa, Methylobacterium sp.
MTRQKTIRLTTAQAILRYFAAQQTRRDGRERPLIGGVFGIFGHGNASGFGHALATGAGGLTYHQGKSEQAMVHAAIGYARAHNLASTLAVTASIGPAATNLVTGAGTATLNRVPVLLLPGDVFASRRQGPILQGLEMAGSYDMTVNDTLRPVSRFFDRITRPEQIIHSLPHATAALLDHGQAGAVTVAVCQDVEGEAFDFPLALFERRVHDLERLAPSETALAAAAERVRAARKPLIIAGGGVRYSEAEASLAALSDACGIPVVESFAGRGAGREARLNAGGVGFIGTPAANELATEADLVLAVGTRLSDTLTGSHTLFQNPDVNFVTLNLAERDLRKMGALALRADARAGLDGLAAALEGHTAPAEWRDRADRAILRHVARVGEIVGTENPRMTGYEAVAEIKDAARREDRVVFSSSTAIGQAHTIWDSRSDAPVDMEYGFSCMGYEIPAALGAAMAGTVKGRILALIGDGTFLMGNTTEIVTAIQEGLAFTIVVVVNRGWQCIRGHQLGSYGEEFGTQFRRREGDARNLTGETLAIDYVANARSLGADGLDVHSRAELRDALEQARRSDRPFLIAAHVEDAPLPIENGAWWEFGIPRADAPEGLRETRAAFEAAAAKHRWFV

SEQ ID NO: 4100 - protein, 117 aa, Methylobacterium sp.
MIDDRDAVPLDDVLASLPAERQARIRARGAELIAEELALRDLRQAERMTQAQVAERLGGRQVYVSRLERRADMKLSTLRAYVEALGGELQLMVTFPEGRTVRLADLADEPPVKRTSA

SEQ ID NO: 4101 - protein, 110 aa, Methylobacterium sp.
MLSRTALPVLAALGSTLGACTDEPSEAALRQAVERKLTPSFDREVEQARKLGVQSPARPSITAFTKLGCKPAEAAPGYACTFDGAIDGQNQGPGTRRFFRAADGTLTMAE

SEQ ID NO: 4102 - protein, 274 aa, Methylobacterium sp.
VSVPRQTRDSVLFVTLDSCRYDTFAAARAPALKAVGPLHKAQAPSYYTYGSHAAMFVGFTPGLAHLRQPVLNPKFGKLFKLVGGGHPGKGTEGYALRGRNIVEGFAREGFRTFGTGSVGWFDPATPTGRHLTEPFGAFFYPGDTWSLDRQLAWLEPRLRHPGNVFCFLNVGETHVPYWHAGAPWDRADNPCEPFQSADRAEDCRARQRACLEFVDGRLAPLLEAFSDATILLCGDHGDCWGEDGLWEHGISHPATLTVPLLARVRGMVVDEKAA

SEQ ID NO: 4103 - protein, 294 aa, Methylobacterium sp.
MKKILLASTVLAGLTAAASAADLPRRAAPPPVFTPVPVFTWTGFYAGFNAGYGFGTSDSNRGTLVAVPGSYGLTTAAGPNLIAFQGERSADGFVGGGQIGYNWQLTPGSGVVIGIEADAQYVDFGRDRNRFAIAPVGAVQAPGALIFNPNSLTGLDYFGTVRGRLGYAFDRTLVYATGGFAYGSGGGRDFGLPNASRDEFQTGYAVGGGIEYALPTDSFLNFFRASAVTLKVEGLYVNLDQGNRNNGLFGVNAAGLPVGLSSPGVQLVSGVTNNRRDTEFAVVRAGVNYKFGSY

SEQ ID NO: 4104 - protein, 525 aa, Methylobacterium sp.
MQETMQAGALGRAAEDIRVALMTAAAVIPEVERKRGPAPMEPHLVERRSKGKAREGGGVTLYIRDGKREISTRLGPDRRGDANTLLDLYKLQKGAKARGIIAPRMVPVVAALAHLLEADRPVEVPQADGKRRPVKGARHIYLMRSTRLATLTKFFGDLAFKDVTTAKCKAYIEWRVTLPDARYKPGDPDAPLAKEASAREDLYELKKAIDLYADEHTLAWHPQVYLPKAGPGRTRWLRPTEIDRIYWAIRGRIWDPATNGWKTETVADEDGNVVTRRVLRGAETIQARRVLRRFVFVGLTTGTRNTAMRELRWHITDEGGCFDLDAGLIHRRGFGVDPTKGKPRYSSRISDRTVATLRRWREADLAAGIDQVIHKLDGTSYASSPDCIWRSTMDDAGLGDDVVPHTLRHTAATMLRVASVDVRKGADLLGMAVQTMVRVYGQWTLEGQEEAAEILADTRGLRKSMPLLALVPMPPQPVVMTTPANDDAARAKATDRRRVDIAAARSGQSGAPMPPRSPAHLASVA

SEQ ID NO: 4105 - protein, 284 aa, Methylobacterium sp.
VTYLFQILNGIGLGMLYFLLAVGLSIIFGLLQFVNFAHGAFYMLGAYLAYTMVERGVSFWLALPLAFLAVGALAALTEAVLLRRIYAQAHTFHILATVGLALAVQEIVIIVWGPIGGNLPPPDSLSGVVILGDFIYPEYRLFVIALTALLAGGLWWLLEGTRLGAIVRAGSEAPETMALLGYDTRRINTAVFGLGAGLAGLAGALAAPIRGVDPFMSVEALSVAFVVVVVGGMGSYAGALAAGLAVGIAQSLMATLWPEGARLMIYLGMAAVIVTMPRGLFGRA

SEQ ID NO: 4106 - protein, 401 aa, Methylobacterium sp.
MLDRRSFLTTSSLALASLAAPPLLRSARAASADLVVGAPLPMSGAFAANGKFAALGAAFAAEEAGTVLGRKVAARDLDTEGKPATAARRVQEAMAEGTRLFAGGILSSEALVMGKEVTNGGGVFFTTAGADEITGKECNRGTFRWSVPTHGAIAQTVRPLIEQMPKARRWYTITPQYVFGEGLLGAAKALFQEKGVEHVGNSYHSLAEKEFSGYLTNAIAAKPDVLLILSFGAQSSDTLRQAVSFGLKKRMTIVLAWASGLEQFEALGPDLCEGVYFGAQYWHGVDTPLNKALVAKVRETRKFSPNYSFAGSYLLTKLLLDGAAKAGSTDGPAVAKALEGLTYAGLTGEEEIRAADHQVIKNYYLLKGKPKAQMADKDDFVDIVSSGKSFLSPEAAGCKMA

SEQ ID NO: 4107 - protein, 591 aa, Methylobacterium sp.
MHAPSGAPCQDGSRPAPKFCFQLRPLDYARLVHPRAPGAVLFGAHLPSTKPRNADGSPKVAWQDRRWSPGALANRAVDLARFKFMSFATYPYHRPGEPKPAKVEANVVSIGASWIDLDFYKATDWKETPPETVLEAVRNICAERGWPAPSYATHSGRGLLVVWLYPVQPAQIVMARHKAIQQTLHEAFRDMGSDPSARTMTKQFRMPATYNENSGLPVSIIWPALVREIERTDFDELCRTVLPFKRLTKAEREAKEDAAKAKRTAARLAARAPREGHYGARLTGTSYWATIRADLERLLDYRHGKQGVVDGVSRNEYGAGRNAWLTSLVYAAAWDMTPEELEAYVIKCADRLGYEHAEAKDKCCSIVLRAKQAARGMRKTYKGRPVDPRYKLSPARFIETLSITPREMRRADLRILVDEARRAENAVARVVASRRAKGVKARSSQQDLRRQVGTQATEMVAEGMTVKAIAELYGASPRWVDNALRDARAIAGIGTVRKEKPTATVEWEAYTEQPVVNVADVADTLDAVPPVTHEVLRGIRKAVGSGVVAGLGVAYPANVTTKGSTLLRPTPAARQPARRALSCPDFVAVGA

SEQ ID NO: 4108 - protein, 115 aa, Methylobacterium sp.
MRAPPPLDSERVRNTTEADIRRHALEDGEDPDAGTEGYIVVPRPQDLRRILAMTQDAFAAFLRVPVGTVRNWEQGRTLPDPAARTLLALVAADPAHALGILGGDGGEPVLDLRRA

SEQ ID NO: 4109 - protein, 311 aa, Methylobacterium sp.
VLPSWREGPAKQAIFDFVRATTEPSSSTYVAPDDRIVVFDQDGTLWVEQPMYTQVTYCLERVPAVVAKEPELRNVEPFKTVLSGNREAMEKLPLEDLEKILAATLTGMTVEEFQSEVSRWLETARHPRWNRSYTELTFQPMQEVLRYLQSNAFKTYIVTGGGQDFVRVYAAKTYGIPSEQVVGTAGTTKFGYGRDGKPLLTKEPKLLLNDDKAGKVEGIHLMIGRRPFAAFGNSVGDREMLEYTHAGQGARLAMLVLHDDASREYAYGPAAGLPDSKIGTFTPALYDEARKQGWTVISMKNDWNRIFAFEA

SEQ ID NO: 4110 - protein, 349 aa, Methylobacterium sp.
MRDDGEPYEIGRLKGECVLAFWRTVDGQRKRQRYRLGTDDEAEARRRAPAVYARAIRPQGRKVKDLWDAYLLDKKGRPVAAVMPFEWKALEARFGEMDAEAIEIADCRAYIADRRAMGRKDGTIITELGRLRMVLKWAVKHKLVAHAPDIERPAAVKRKERHLTAHEVRRLAAACKAPHLELFVHLAYATAGRAGAILGLTWERCDFAREKIDLEDPEILVPHKGRAIVPMTRTLKTRLLAAKAGARSPFVIEWNAQRVGSVKKGLAAAAETAGLQHTHPHLLRHSAAVRMAETGIDMEEIRSYLGHENVATTRRIYARFSPNHLRGAAASLELDEGLEEVAPLATRVR

SEQ ID NO: 4111 - protein, 284 aa, Methylobacterium sp.
MLELTQLLANALGHHLAETYTRMFGSREPRYAEVIDESARLTIERLVGSDALYHDADHTALVALVMQDILRGRFVSRSVGPEDWLHAILAALYHDIGYVRGICAGDSLGRYVVDADGTTVGLPRGASDAALAPWHVERSKIAVRERFGGHDLVDAERVVRAIELTRFPVPNDADHAETATEAGLLRAADLIGQLGDPLYPRKLNALFREFAEVGLDRELGYADPADLATGYPAFFWSKVEPVIGEGIRALDATVEGRRWVANLYAHVFAMEHDRRRMGPDLGRP

SEQ ID NO: 4112 - protein, 343 aa, Methylobacterium sp.
VFTEPSSAGLAPGSSPAHLPGTCLIVQPIHAAGLARLRAAGLAPRFAGSVAATALAREAADCVAVVTRNAGFPAEAVAAAPRLRVIGVHGTGTDPVAVAEATRAGIAVVNTPGANARSVAEHAIGLIFALAKAIPQADRAVRAEDHDFRDRARLVELAGLTLGLVGFGAIGQATGRLAAALGMRVLAYGPTRPDADFAAVGAERVTALPELLARADMVSLHLPLTPETRGLIGRDALAGMRRGAFLINTARGALVDEDALAAALAAGTLAGAALDVVSGDALAPDHPLYTEQRAILTPHIAASTEAALIRAAERVADQVVDVLAGRRPSNLVNPDAWARRRRA

SEQ ID NO: 4113 - protein, 271 aa, Methylobacterium sp.
MTRTLNRRRLLALCTILGGSLLAASSGTRARAAELELIQPGKLLVATEGTYAPFSMRAPSGELDGLEIRVAKEIARRLGLAYTPVVIKFDSLLIGLMADQYDMTSATMDITPARQKQVAFADGWLESGARIITRKGTGIQAPADLKGRNVGAVAASTFGKLAEEQGANLKSYKAVAEAMQDLVGGNLDAVINDAVAGTYAIRDRKLPLVMIETPLSTVQKGMAIKKGKPNLHAAVNKALAEMVADGTYAKLVTPLVGYDPFPKEPIRTPAM

SEQ ID NO: 4114 - protein, 226 aa, Methylobacterium sp.
MKTLDASSYTTRLGARREQSLGQMAYDRLLDMLMRRDLPAGTVLHERRLAEMLDISRTPTREAMSRLETEGLIERQPGGMLVVKEFSLRELIEILHVRRLLERESVTLATGRIPGAVLEDLRARIEDLMAAGDPDAPGNRELDRRFHELIADSSHNALLAKTIKDLRRKTQMFNLSRMPERFEAVHREHLAVLAALRAGDASGAADAIAAHLENFKQGIIRRLSEL

SEQ ID NO: 4115 - protein, 441 aa, Methylobacterium sp.
VPGWIENTLWWHVYPLGFVGAPRSAPEQAEPVPRLRHLEAWLDYAAEMGATGLALGPIFAASTHGYDTIDHVRIDPRLGDDADFDALVAAARARGLRLLLDGVFNHVGRDFPAFAEVLRLGPDAPRAHWFRLSWPRGPGAEPDYACFEGHRQLVALNHDEPEVATYVEGVMTHWLARGADGWRLDAAYAVPPAFWARVLPRVRAAHPEAYLVGEVIHGDYARFVTESGLDAVTQYELWKAIWSALNDRNLYELAHALERHNSVLDRFVPLTFVGNHDVSRIASRLQNPHHLGAALAVLFTCGGTPAIYAGDEQGFVGIKEERAGGDDAIRPEFPATPASLPAEGWPLYRLHRELAGLRRAHPWLHRARIRIDHLANRQMVARSHAESHTLLLALNLDDAPAALPAPGGRAVEAGTGQVIDPGAAGARVLVPSHAWAVLSCA

SEQ ID NO: 4116 - protein, 257 aa, Methylobacterium sp.
MILDEDAEAPPPRRIKLSDQIAEDLCRRIARDRMEPGQRLPNERALMQHYGCAKGTIREALKSLEVQGLVTMQPGPNGGAEIRPVSIDAAALQLRRFLHFRQLDFAQVYAVRRSLEVALGLSIVGRIDDDILQQLARNIDACQAAADAGDLARGRVLELKFHDILCDASDNALLAFMCRFLNSLLRDLVEFRSGSATEHEAFGAHNIDSHRRLVSAFRAEDAEAVEAVMHEHMCCAEHFMRRLDAAFNRDLLSGERA

SEQ ID NO: 4117 - protein, 53 aa, Methylobacterium sp.
MQQTEYGRTAANAPAHRVGEDVNDVDQTSSVTLLGLAVAGAVVMLLLVRLVVG

SEQ ID NO: 4118 - protein, 124 aa, Methylobacterium sp.
MGEAVWAWQRARRLVGQPPWRAAASLAEAGERESAETLMLQDIPIWEGALKALDAETARAVRYGLPVPLPLAVPAPVAAALAAHRASVLERALRRRGRSDGGGGGPDLVPPDPGAGPAIPGRGI

SEQ ID NO: 4119 - protein, 238 aa, Methylobacterium sp.
MRWETLNAYVDGELDPQDRRAVAETLARDPVLAARVATLTRLKQGVKQEVKAAAVPPRRAPIARASLGWACAAALVVLVGAGWLALSSRPPADPARAAFTAWGAAGSPANDVRPAGGPNGFPLDLGAAGFRLVYLSPDDGSAGRLAGYEGRHGCRLAIWSGPSRGQAGLEIAQGDSGPRVARWDSEGRRYVLLTETVPAERFALLAEAAALLTTPDRTDRLRLALDRATGLSARPCTG

SEQ ID NO: 4120 - protein, 162 aa, Methylobacterium sp.
MRSIGQHLVDAWPRLFRYALALTREPDAARDLMQQSALKALSTRTTPSEPHAARAYLFQIVRHAWIDRIRRTRLHHEDELLDWPDEGFDDRLIEAIAVRQAFAALDMPCRAVVTCVDVEGLSYRETAERLGIPVGTVMSRLHRARRIMLHRIAGPSDGSEGP

SEQ ID NO: 4121 - protein, 66 aa, Methylobacterium sp.
MAAEALPDLSLQVEPNPKDPSRYRWVIRDQDHILRQCLYSLPNEQAAHSRGEAAFEEMTALRRDAQ

SEQ ID NO: 4122 - protein, 474 aa, Methylobacterium sp.
ASSSPRGFTALGDGKILFSAITAANGTELWVTDGTAAGTRLVTDINTVPDSSNPGGFTLVKPPPAPPSGGGGGEPPLVSPNTGTGGSSTSLTTTSDPAAAAGAANQAVQSLPAGLDKAAVGQAVSSFLAGLPAGTSVNVSTFTPTPGAAKISLTGPTDGSQTLVILDASALPPGTPITLNNVGFVVLSGPASLIGGDGAQVVYGDDAAQSMVLGADDDTLRGGGGNDVVGSKGGNDLLYGDAGNDTVFGGAGNDTLFGGTEQDLVYGNQDADLIYGNQGQDTLYGGQGDDRAYGGQGDDRIWGNAGADRLFGNAGADLVYGNLGADVVYGNQGADTLFGGQEADTLFGGQDADVVYGNLGADIVYGNLGNDVLYGGQGNDILYGGQGDDVLVGGLGDDILVGGLGADRYVFGANSGRDLIRGFEQASGDRISQGGQTYTLSTSQGGNALLLLSGGGTVELAGIRAEQVNTGFFA

SEQ ID NO: 4123 - protein, 356 aa, Methylobacterium sp.
VVAQAVSTFLAGLPPGTSINVSTFTPTPGATSISLTGPTDGTQTLVVLDASALPPGTPITLNNVGFVVLAGPASLVGGDGAQVVYGDDAAQSMVLGADDDTLRGGGGNDVVGSKAGNDLLYGDAGNDTVFGGIGADTLWGGTDQDLVYGNQDADLIYGNQGQDSLYGGQGEDRAYGGQGDDRIWGNAGADRLFGNAGADLVYGNQGADVVYGNQGADTLFGGQEADTLFGGQDADVVYGNLGADIVYGNLGNDVLYGGQGNDILYGGQGDDILVGGLGDDILVGGLGADRYVFGAQSGRDLIRGFDQAAGDRISLGGQGYTVSTAQNDDALLVLAGGGSVELAGIRATQVSARFFA

SEQ ID NO: 4124 - protein, 367 aa, Methylobacterium sp.
VQSLPAGLDKAAIGQAVSTFLAGLPPGTSVNVSTFTPTPGAGPISLTGPTDGTQSLVVLDASALPPGTPITLNNVGFVVLAGPASLIGGDGAQVVYGDDVAQSMVLGADDDTLRGGGGNDVVGSKAGNDLLYGDAGNDTVFGGIGADTLWGGTDQDLVYGNQDADLIYGNQGQDTLYGGQGDDRAYGGQGDDRIWGNAGADRLFGNAGADLVYGNLGADVVYGNQGADTLFGGQEADTLFGGQDADVVYGNLGADIVYGNLGNDVLYGGQGNDILYGGQGDDILVGGLGDDILVGGLGADRYVFGAQGGRDLIRGFDQGAGDRLVLGGQGYTLSTSQNGDALLLLAGGGSVELAGIRTAQVSAGFFA

SEQ ID NO: 4125 - protein, 294 aa, Methylobacterium sp.
MERIGARGSGGSLALGLTARRAPGLVLPALRGWVGGCLAAEAAQRRLFPWLAVAFGAGILLFFGLADGTPVLAAPLGAAALCLGLTPWLGTRPVILALALALTAAFLGFAAASWRVSRVAGPILARTTIGPLTGLVESLEEREEGARLVVRVARFGALSPEETPRRVRVSFKRAPPVKPGDAIEASARLLPPPEAARPGGYDFARDAWFRGIGAVGSLTGKITVRAPAEPPGLSSRLAALVDAARNALTRRIAEATGGQAGAVAAALVTGKRGLIAPATSETLRAAGIYHVVQG

SEQ ID NO: 4126 - protein, 140 aa, Methylobacterium sp.
MRVHYLARSGATRDALGIYRVELAPRSPGAGLHRHARLTETFEVHAGRLTVRIEGHTLELGPGDFVLIPPGQPHAFANRGDDPVSFTLSFTPALGREGFFEGLAELAAANRLGDEAAMDALMADYDQEPLEGFSGWSRID

SEQ ID NO: 4127 - protein, 199 aa, Methylobacterium sp.
MTNISSLASLSNITRSEGDPKVLRSGPSSRGVPDSLAKGLGWFSLALGLTELFAPHRITRALGMEGKEALVRVYGAREIGSGILSLSVDKNLGLWSRVAGDGLDIATVMTALRPDNPKRDNVVIALALLLGITAVDLIDAQASTARHSRGVGRKRSYRDRSGFPRGVQASRGAARDFKTPPDLRHAPPLAAVSQRPSVA

SEQ ID NO: 4128 - protein, 287 aa, Methylobacterium sp.
MRPAIRRRPFLPLFVTPAVLVAVAIVAAMAAILRYSLHAYVPGSLDVGGLTLENFSDLGRPIVLRALRDTVLICFETALITLVVGYPVAYALVRTRSLFLKSVILVTAVTPLFLGEVVRTYAWTVVLGNSGFVNATLRQLGLIERPIQLMFTELGVIIALVHVTLPVMVIMLAAALAHIDRDYERAAQSLGAGPVRAFLTVTLPLSMPGVAAGFTTAFAWTFSAFATPQVIGGGKVGVVSTLVYQLGLSSFNFPVAASLSLAGLVLALGTMWLVRRAARPLEALGGH

SEQ ID NO: 4129 - protein, 258 aa, Methylobacterium sp.
VSPHRARYWILAILSPLGLLALWAFVTARGLVTPVLLPPPLAVLASLKDMVAQGYSGVDLATHVLASLRRVGLAFAGGAVLGTGIGLLRGRVAEIDALFLVPSELLRPIPPLGLIPLFILWFGIGEASKVLLIFLSVFLIAMVNAQAGARACTLDTLRAARCMGASRWQSFRHVVLPSALPQIMTGLRVAMGTALTILVAAELLGGDRGLGFVILDASSFFRTTYVFAGIVLVGLIGLVSDRAIAALGRRIVHWEGRR

SEQ ID NO: 4130 - protein, 471 aa, Methylobacterium sp.
MTAHVPLSSRHPAQDSLAAVVAGLRDRFGARLSTAEALRAQHASTLTWAPSQPPDAVVFPHTTEEVQAVVRLCAEHRVPVIPFGTGSSLEGHVNAPYGGISVDLSRMDRILAVHAEDLDCVVEAGLTRKALNLSLRDQGLFFPIDPGADASFGGMASTRASGTNAVRYGTMRDAVLGLTAVLPSGEIVRTGSRARKSAAGYDLTRLLVGAEGTLGIITELTLRLSGIPEAMAAGHCSFPSVKAACDATILTIQSGLPVARIELLDAVQVRASNAYSKLSLPETPLLLVEFHGTEASVREQAERFGEIAAGEGGGAFRWATEAEARSRLWQARHDAYWAALALRPGARAVATDVCVPISHLAACVAETQRDIAESGLLAPIVGHVGDGNFHAQLLVDPEDGDEVARATGFIDRLVDRALGLDGTCTGEHGVGQKKMRFLEAEHGADALSAMRALKRALDPLGIMNPGKMLGA

SEQ ID NO: 4131 - protein, 260 aa, Methylobacterium sp.
MGRHETFDITTALSTTLTHLGGIDQLGKKDPIFAALDACRAPEAEREAFHAVHSVGTTGPGYTLEREIALDSAVEAAFNAVLATTPTTQDGRLALIAFIARRIEWSACPDGSPQEGEDTVFAQAYHALAQAIRAEQAEPIGLPDLSALSIKQLRNLYDRYVQISDIWNDALNAPWTNHAEGAGFRASNAAGDVIEAEQTRVCALYAGVVAEISRRTPSGKGFEPDWQLETLIRHELMCNGDLREAPELRAKIIRQWGAAA

SEQ ID NO: 4132 - protein, 167 aa, Methylobacterium sp.
MSRWPASTADLFDADLAAWTEAQASALREGRVDAIDAAHLSQMVEALVAERAAELQARLGVILTGLLRWAEQVDLRGHSWAATIDIQRFQVDDILRENPSLRRSVAELIAAAYPEAKARAVLESALFEESFSESCPFTDDEVLTVGFLPDPYGDDAIRGPGWWKRSP

SEQ ID NO: 4133 - protein, 123 aa, Methylobacterium sp.
MPTIRPLWRALLTVFLTVMLVGVSVANAGHGHAGHAPIGPAASAHHDGVPEQVGDLSNHAERTGDDGAAGPCGCCCHQASIVRWDSPAVPVSWRLARTLVGIRAIAFDSVAPETLPEPPRTFA

SEQ ID NO: 4134 - protein, 45 aa, Methylobacterium sp.
MGRRWIVAAALAALVAVAGWRLRDFLAQDACLDAGGAWRGGICQH

SEQ ID NO: 4135 - protein, 124 aa, Methylobacterium sp.
VRFVIDMNLSTDWAAYLQGLGHDAVHWSSIGPQDTADEDIAAWARAEDRTILTNDLDFGTLLVSTGAAKPSVVQLRTDITLSAHVGPLVAQAIDRMEAGLVAGALVTIETGRLRIRSLAPDSED

SEQ ID NO: 4136 - protein, 81 aa, Methylobacterium sp.
MTRSFKDFPRITVDPAVMGGKPCIRGMRVTVGMILGNLGSGISVEELLAGYPYLEREDVLEAMRYAAALARVRELEIEPAA

SEQ ID NO: 4137 - protein, 93 aa, Methylobacterium sp.
VPDFPASLLWVDQLRWCLAVMDADDPDLGFAASLLSHAVDKGGLTEKQGKYASRIVQRVQALWLAEALACQRRPSAPVPPPPALSEMATKGEA

SEQ ID NO: 4138 - protein, 39 aa, Methylobacterium sp.
MPRVASCISSRSGCSCSISATRSATAAPVRRRRFQLTIL

SEQ ID NO: 4139 - protein, 51 aa, Methylobacterium sp.
LATVKSPRSSTCETRWNIAPDGSGTTSGGRVQGFGAHMASPWMRSGSCAQA

SEQ ID NO: 4140 - protein, 119 aa, Methylobacterium sp.
MTSPAPPPTASEVGQPEWRAAVLAEAIRHTAHLAGPISPFALMDHLRGWLGLPEEACGGDFQAVLFMLVRCGLYDGNTMDLAKGEIWLSAETRLTAGRTLTAFLYGEAPAERADDEAES

SEQ ID NO: 4141 - protein, 41 aa, Methylobacterium sp.
VVRPEVRLSGQDEDGRMGTKRHKPEDVVAKLRQADVLIAQG

SEQ ID NO: 4142 - protein, 110 aa, Methylobacterium sp.
VSVWDRDDLCEIEPGDDRLDVPPVTMIDRLIRWHEKRAGADGRLALSLEAEGLTIAADTNRQRSLAHRQTATCLKVLRQRCCESEGAPQQAFRGHLKPKPRPRAEVRAPP

SEQ ID NO: 4143 - protein, 87 aa, Methylobacterium sp.
MHDNRALSRFELTEQGLTAYADYRRGPQGLVIAHVYAPPPLRGTGAADRLMRAVAEQARAEGVRIVPLCGYAGAWLRRSPAHRDLIA

SEQ ID NO: 4144 - protein, 319 aa, Methylobacterium sp.
VKTVFSTGHVHPRDRFDFWHDVARKDVADHTSTPKCRNTFQAELRAGSVGSIGLVLFQNSDMSVTHARCHIDLTNTDELFVCRQFGGRLALDQDGRQVVLEPGHITLLDPRLPYQGRFSEDSQVLVLKIPRQHLEARLGQTRELTARAIEPSTTENSLLSQSLAMLPAHTQDLGSTAGILLETHLLDLITLSVGLAMGGEKARTTSARSLVRVRLRAAVEARMADRNLDAATVARAAGVSVRYANEVLAEDSTSIVQLIQAKRLARCRQALEDPSQMGRSVSEIAYGWGFADMTHFGRRFKAAYGVLPSEHRRRARHDS

SEQ ID NO: 4145 - protein, 317 aa, Methylobacterium sp.
MASTSQTATAPRPPCPITGEPARRLVQWVGSRFLTDLWRYAGGVDVGHLLRPAGRFGLWESPTGLIFFDPMVPGDEAFYRAFYARIGAHEKLAGPRTQRLEFVAAARHVPDGARVLDVGCGHGGFRAYVPGARYTGLDPNFAAEDPTGAILAESVQAHAARVGPVYDVACAFQVIEHVADPLGFARALAACLRPGGTLLIGTPLWPSPNTTIPNFIMNAPPHHLTWWTPGALEALARRLGCAPVGVEPIGMDRHDALIHWMARTTPVRCRGPYFRPHWSWYGAQALSYGAALVLDRLLPLPARTRPNTLLLAARKPG

SEQ ID NO: 4146 - protein, 290 aa, Methylobacterium sp.
MTTRALKSAALPEAERFAAIRRGPGPIARAVDTTLGRGLIQAAAVAVFFTAWEIAVDAGWLTEFLVGAPSGIWRVFRASLMDGSLAVDTWYTLIEAILGFVIGTLLGSLAGLGLWYSVLVARVVEPFIVAINSVPKIALAPIVILWFGTGFVSKVALAVSLTALVALIAAYQAARDADPDLQALMASMGATKNRIFRSVIVPSTLPAIIGMFRINVGFALVGAVVGEFISSQRGLGHLIYTASSLYDLNTVWVGLFVLMFVGFVLYHVIDLVERRILPWRQVSTGGGIQV

SEQ ID NO: 4147 - protein, 281 aa, Methylobacterium sp.
MDPMPTPDSPADPKAAPVQLALRGIRKSFPAKSGPVPVLDGLSFDIHERDFVSIIGPSGCGKTTVFNVIAGLLEPDVGTMLFRGRPVPGLRGRVGYMMQKDLLFPWRTVLQNVTLGLEMKGTDPREAADTARRYLAQFGLGGFENAYPKTLSGGMRQRAALIRTLILDPDILLLDEPFSALDYQTRLYLEGVLLDAVELFGKTVVLVTHDIDEAVALSKRVVVLGGRPSRVKNVHTIALGDRSPIGARSDPRFSDHFHTLCGELDIQTRAGSASTARAEAA

SEQ ID NO: 4148 - protein, 320 aa, Methylobacterium sp.
MKPLRSTLLAALLACTSPLPALAADLKATVSQAFQSMLYLPLYVAMDEGLFEKAGIDVTKETAGAPSVALSAVISKSAQFSIHGPEWTAVAASKGAPVNVVANVVNGAAVWIATAPDFPWTDVKSLKGQTIVTGLMPTTSTSLFLKLLKENGMSKDDVTLTQVALGTEPGPFLAGQARVAVMYEPGLDQVVAKGMKVVLGFPEKYGPYAFSAVSARKDVDPAVAQAFVNGMQAAIRLMHAEPAKAVAVAKKQFPTLDPAVVEAAVKRMMTEKVYPDSVDITKEAMALGLDTQIALGNLAAQPDYATFVRRDFITKATAGN

SEQ ID NO: 4149 - protein, 473 aa, Methylobacterium sp.
MRPGLRVPASSREAEPFIGIPGGTLPSGTLEGDLVASLMHRHEIAAERLIGWLRVAIGACVFVTVIVTGAALRHQTGVPFDVFERNAWIASLGFVAIGAISIVLAVPQRWCHVFAYLFMALDVGLVLAIACLAVGERALPGNALPSAPIVWAVPLVLAVGALRYDVKVQLSAIALLALGLVGIAVGLEHRLVMDAAGRNAPIWPQLFSMPVNVMRFTLLLLAGAATALGIVRSRRLLASAVKDAVGRASLSRFLPAEIAPRLAAGDLDLRRGRRQRAVIVFVDIRDSTGMAEGMDPERLSQFFTAFRTRILTCVRRHSGVVDKFIGDGALILFGVPDEGSDDAARALLFARDLAGRVETWNTTHELPHPVRIGIGIHVGEVFCGIIGDEERLEFTVLGDAVNVASRLEQATKRYGEVVLASGAVVEGSFERHAWLEIGREPLAGRKEAITIFAPARAPTRQMASFGDLSAEPG

SEQ ID NO: 4150 - protein, 304 aa, Methylobacterium sp.
METAPDDPRRPENRLAYRAAVDRPRLTLPGGRRVAMWPVVNVEHWLIDNPMPRQILVPPTAAGLLPDLPNWAWHEYGMRVGFWRLLGAFAARGLRPTLSINGSVCTAYPRVAAAARDAGWEFMAHGFHQVPAHRVADETEMIARSVGTIADFVGAAPRGWLGPGLTETLDTPDHLRAAGLEYVGDFVVDDRPCRIATRTGPLVALPYSVELNDIPLLAIQHHRADEFVERALANLDRLSAEAAGEGPLGGAKVMGFAIHPYITGVPHRIGLLERLLDALLARSDVAFMQGSEILDWYLGTGDDA

SEQ ID NO: 4151 - protein, 186 aa, Methylobacterium sp.
MPSHAEINFAYAHWAERLVHEGWTPYLLTFMFENLRGPSHEVARQMEREVERVYATLLPRIVRNPTRPAMTGRLPVWFCASDRPVFKRAKQSLRDVMINDGRHVHAVAFLPPWSRLLEDLAAHVEAYRALYLRPEFPLVRLDVVPITQRAGYGVEYARKYTGRSLIGEDAGFVLPRALSEVRDQAA

SEQ ID NO: 4152 - protein, 202 aa, Methylobacterium sp.
MARIRTIKPEFPQSETIGALSRDARLLFVQLWTIVDDAGRARASSRVLASVLYPFDDDAMHLIEGWLQELEDQGCIRRYTVEGKPYLDVPKWLEHQKIDRPSKSKLPEFVEASRGIASNREGSMLEYRSKTMDHGTRTVDQGPRTREQNLAAGSEYGGGSHAYAPAREARDPTGDDAFGDPDPAAWDDPGQFGRDRSTGGSR

SEQ ID NO: 4153 - protein, 33 aa, Methylobacterium sp.
TNPGKIPLELIEVQVGSYTGEDDIIRVEDIYGR

SEQ ID NO: 4154 - protein, 33 aa, Methylobacterium sp.; identical to SEQ ID NO: 4153

SEQ ID NO: 4155 - protein, 338 aa, Methylobacterium sp.
MPTTPKPRAIGLATAFLLIHAGAASAVELPEAVRAWFATDRSIVCVDPDGNDRRCAIDADTHLELRRSPDASTALAFVTYLPDPTGNSTVTTAATFRAGETGWRHVRTLSEVRGPLAGKVTFGDRTATFAVAVPRRGDSHCCPTGRKAYRVALPRETPAVVGGKTDASPSRQAALDPARVIAEQMRLEKRGDMTGLFSKSLKAAYDAVPKDEPNVGLTILGGGYDVPRKVLGTSAPQYDVADPKRASVTATLHYTNEDAPEPSFDRSIVVVFIAEDGRWRIDDVHLIDPKGRRTGREVGMKRAFGRLTEERARTMVERHAPAPRAGRNEMPDNRRSVP

SEQ ID NO: 4156 - protein, 119 aa, Methylobacterium sp.
MTTAHQIASGFDRAGLSLAGVAAGCLADARARQVAVDEEQAYRNLSAAQRTVRAAVRQRAELQAAVDENAALRAEVARLQRALAASQSQTATAQAETGRMRQRALHAEGVLLRQARTMA

SEQ ID NO: 4157 - protein, 154 aa, Methylobacterium sp.
MATMDTTLDIRGRLSAIRAGWYAGAPAVSPHGRRMYSGGLVYHMTAHQEMRQPPPSHEAGQAYLRALLRDWRTAHAPLAEWDAANGGALRRCLVAAGVALRDQTDDGRERADFLVRQACLCLSTTTLAKLDAKIAKLAKVPVGPWRIGGGLAKV

SEQ ID NO: 4158 - protein, 257 aa, Methylobacterium sp.
VRLRDVAPTIDTLLALSTEELGLRLLPLLHRVASGGTRPMSLRGLLNVVLYDEVSPTGARWRNGPYPGRERDATGAVAEAWAWLEGQGLLVPVLDTDNRSDPEGRTLSRRAAQMVAEPKEAIASRHLGKEALHPRIREDVWSLYHRGRYDIAVFTAMKAVEVRVREASGLAATDLGTDLMRKAFNKENGPLADMATLPAEREARSSLFAGAIGSYKNPQSHRLVDLDDPGEAAEIIMLANHLLRIVDARGTARGHSS

SEQ ID NO: 4159 - protein, 94 aa, Methylobacterium sp.
LAFCSTDTALTAAIWTYGSSLTDPKSAFVIKQLPIASTHGAAWKLGILPFLSGFPSPIAYMLLLLPILLFLYGIGWLLGLAWGRMISGWIAPTG

SEQ ID NO: 4160 - protein, 126 aa, Methylobacterium sp.
MPPRVAARPRPEEWTDDELLTLPEAAALFWPDGPITTNTLRTAGRDGTLAITKVAGKFFTTPMAIRRMGHDETGEPLGREAAVPEASSPRTLFEARLEEARRQGRDRKRRQRAAKRSVAPQEGAGR

SEQ ID NO: 4161 - protein, 143 aa, Methylobacterium sp.
MGSRTGSRVTETPPAPAAEAQAHFSRRLALETDCDDVHAALEGGAPDFVLLDARGPAAFARGHVPGALNLPHREITPERMAAWAPGTLFVVYCAGPHCNGADKAALRLARCGRPVKLMIGGVTGWLHEGFALAEGLALASGLA

SEQ ID NO: 4162 - protein, 376 aa, Methylobacterium sp.
MDHTRHIPDPTSDRDRPLDPATVASLLACMRDGLVRRRFRLRLVGAQAPEDVSEITDRRDVAIADVGRPLQDDTAPARSEEARRCAARENLNARMRPILLALAQNAALDPAVWRARIDAPMPLTDPEIVRALSEVFASDAFRDARAACRDLTLLPPEQRAFAEAPFDLGFHRSPPAKILADYPCWDLPFSPAARAPERWTISDAADWMREWPPESGELKHPIDAWDASTADLWLRRHKLFDGQEADKTDPLVAFREGRSRKSPLTVLAGLDDDALLVLTDAVLCERLRREVMSGLMQDRADLIHVGMDMVACGYLSLDDVRAAVAAHDEAREETFRDAFADNDDWMGEWIVDWSRRLIGLYDWPLRYEFRAVSKGE

SEQ ID NO: 4163 - protein, 146 aa, Methylobacterium sp.
MSDQAFALFVLALVPLGWAFYLLPAIVAFRRQHPNRWLILAVNVMLGATGIGWAVALVWAFQAAHRAGEPGGSHGGESGLNLFVNDIRTVRVLHAADTPVVAPASGATLGTPAQRIERLNQLRAAGHVTEAEFTTLKAAVIHHPNI

SEQ ID NO: 4164 - protein, 381 aa, Methylobacterium sp.
MDVGFISEFTENDRVFRFTDGETLRSPIAVGGSDPLRQSFCHYVAAGLMPGLLHDAREDPVARGLPATDALPVGAHLSVPLRYADGTAYGTLCCFSFTPDRTLTGRDLNVLRLCADVVSAVLQKDRRASLDLEARRARIAGILEARAIDIVYQPVYRTSDGRLMSFEALSRFRAAPERAPDVWFAEAAEVGLLEELEFLAVGLALRGLERLDPSIKITLNLSPSSVLSPAFARAFAGVPLGRIVVELTEHAEVPCYAALRAALAPLRAGGLRLAIDDVGAGHATFRHVLDLSPELIKLDRSLIAGIDRDSARRALADALTIYGRRIGAEVVAEGVETWAEYAVLKEIGVTRLQGYLLGRPQPLDAARTLPLTLAALGEAGG

SEQ ID NO: 4165 - protein, 309 aa, Methylobacterium sp.
MSVSVIMSTFNRERYIAAAVESVLEQSHRAFELIVVDDASTDGTPDILARLAARDDRLRVVCNAANQGLPAGRNLCLSLARHDLVACMDDDDLMLTDRLARQVAFLRDHPEVSVVTAAARLIDDADNVIGLSVPEIDIARGRAEVRPALFLGLIHPAVMYRKGDVLRVGGYRQVALEDRDLWGRMVTAGYTVAAQPDVLLLHRRHASIMQGDLDALFEQGEYIDFNVARRLRGLEDVTLAGYRRAVAAEPLLQRISRRRRMSAGIAFRKATLFYSRREWRPFLMHMAAAMSLEPIQVCQRIAKKYSPGR

SEQ ID NO: 4166 - protein, 3079 aa, Methylobacterium sp.
MARQTFDDSIGASGNPLTIGGYVYALRTNAGATTGTLNVQRELLGDAVLDLNATSGYLSIAQASGTAFNLNSLVIDRDISVLGNTFFVGYRNGLPVISQEVGNLLSIGDQAISFGTQWQNLTEVRLFARDVLDVNVGVGFAIDDVVTTDVTAPLAPTLSAGTTATADNTPTLTGTAEIGATVTIFNGTTALGTTTAGANGAYSFTPTLPLADGSYSLTARATDLSGNVGLASAAVALRIDATAPGAPVFTAGGGLTNDTTPTVTGRAEAGSAVTIYNGTVALGTTTAAADGTFSSTPTAALGQGSYGLTATARDALGNVSPASAALAVTIDAVAPGAPTAAVPGLTNDATPIVTGTAEAGSTVTLFNGTTALGTAVAAADGTYSVTPSADLAAGTYSLSVTATDPAGNVSARSAAATTVIDLTAPLAPTLSAGSAATADSTPTLTGTAEAGATVTIFNGAAVLGTATAGANGAYSFTPTLPLADGSYSLTAVARDAAGNLGTASAPVALAIDTAAPAVPLFTAGGGLTGDPTPTLTGTAEPGATVTILNGTAVLGTALAGADGTFSFTPTDALSQGSYTLTAIARDALGNASPASANLALTVDLTAPGAPVLAPLGATNDPTPTITGTAEAGATVTILDGTAILGTAVAGANGAFSFTPDADLTPGTLNLTATARDPAGNVSVPSAALALTLDLTAPGAPVLAPLGPTNDPTPTISGTAEAGATVTILNGTAILGTAVAGMDGAFSVTPDAALTAGTLNLTATARDPAGNVSLPSAALALTIDTQAPAAPVLAALGPTNDLTPTITGTAEPGATVTILNGATVLGTAIAGLDGAFSFTAPALPAGTATLTATALDAAGNISDPSTLTFTIDTTAPDVPVITTLPGTVADSTPTIAGTAEAGAVVTLLNGTAVLGSAVADANGAFAITPAVPLPDGPLALTATARDAAGNLSPASLGLALTIDTSVPGAPDLAYDSPTNDARPVISGTAEAGATITIAAGGTTFGTGTADANGTFSVPLDRPLSEGNNALTVTATSPGGITSPAAPLNVLLDTLAPPAPEITGVPSLTNDPAPTIFGTAEAGTTVTILNGIAVLGTATADANGAFAFTPTAPLADGTATLTARAGDAAGNLSPASEPVSIRVDTAAPPTPEIDPLPVLTNDATPTVTGRAEAGSTVTLLSDGAIVGTAVADGGGLYAITPTIALADGTASLTVSARDAAGNVSGSTDPVTVVIDTLAPAAPTLADLPDAVASATPVIAGTADPNAVVTIANGGTLLGMTTAGADGTFIFTPTSPLPDGTATLTATVQDAAGNVSPASDAVTVVIDTTAPAAPVITTQPGTTTDNTPVIAGTAEPGTSVTVLDDGALLGTVTADGSGNWSLIPGAALGDGPNLITATAADTVGNISPLAAGITLTVDTGAPAAPALTSAGGALADNTPLITGTAEPGATVAIRDGDTVIGTVVADVDGAFAFTPDAPLGDGSYSLTATATDAAGLTSTPSQPLELTIDTAAPGIPTVTGGGGATQSTTPVITGTGEAGTTVTLLDGTTPVGTATVGTDGTFTVSPANPLAEGVYDLAVQLTDAAGNVGAPSAPVAVVVDTQIDAPPAIAFTVAATADGTINAAEAVATAFTVAGLDAGTVATATFSDGSRTVTVPVGADGSYAANLTGLNGTVTTSLQLADAAGNALTLTGPALSLDTLAPTGTAVADTAGGPEVASFTYQVSFPETVANVGADDFVLTGSGGATGTVTNVSGSGSSYTVTVAGITGSGALTLALSPDSDIADLAGNLATLAPAVRDVTGVPPVQPVITGYADDTGVPSDGITADATPTLTGIGTPGATVTLAAATGTGTVTATGTVSADGTWSVALPTLADGAYSITASLVGADGSPIGTSAPLALTIDATVDTGAAAALAIDATADGVINGQEASAVAFTVTGLDAGTSGTVTFADGVRTASVAVGADGAYSVDLTGFNGSVTSTLALGDAAGNTATVQGDTLSLVTGQPGTPVIAGFADDTGTPGDALTSDATPTLSGAADPGTTIRLTVGTPDGPVSVETQAGADGAWSATLPALSDGAYAATAVALDAAGNASTVSLPFPISIDATAPAGTAAADLSGGIAAQSFTVALDFPEAVVNVSPEDFVLSGTNGASGTVTEVVGTGGSYTVTVANVTGTGTLTLGLAADADITDAAGNLANLAAASRPVAVSPSAAPPTITGFSDDSGTVGDGITNDAAPTLTGTGIPGGTVTVRYDGAPGSAPLTGDVDAQGNWTLSVPTLADGTYVFSVTTTSADGTIASATADALRLTIDTVADALPAVALTVDGTADGVLTPSEAAAAQFTLSGLDAGSAAVVNFTDGTRTVTAQAAADGAYTADLSGLSGSVTSTVAVTDAAGNTASAAGNAVLVGTGTPGGGTGGDGGGNGGGVTPPGGGVGEGSTPPAIPVIGGIQDDTGTPGDGITGDSTPTVVGTGTPGSTVTVSYTDASGPQTATGTVGQDGTWQVGLPALADGSYSLVATAGTVAGTGSAPSQPLQITIDTSAPAAPVLDGVSGTDGSGPIGDASPTLTGTAEAGSTVEVRFDTPAGPAFVNGVTGPDGRWTVDLPTLADGTYTVTLDAVDAAGNRGTASAPVAIVVDTTPGGGTGGDPGDGTGGGVVTPPVGGIGEGDGTPPGSAPALTADADRTLTHAPAISGNLLLNDTGSGLHVTAVRFADGLTVQVPDEGTARVIGDYGTLTVAADGSYSYQAIGANNLPIGFGSREHFTYTATDAAGRTGETSLDIQLEGQAPQASASFDFAFTQAKVGLAGEALVLLGPDGIVRDISGIDTLHFTDGEIQNNDGNRVVDDVYYYARNLDVWQAHVDADLHYAVFGWHEGRDPNAYFQTSRYLAENPDVAAAGVNPLEHYLTSGEHEGRSPSPDFSAEAYLRSNPDVAEQGASALAHYFEFGRAEGRSVLAGESDGPNRAIGSFDAGFYLAQNPDVAATVPAGVTPESYALQHYLNYGAAELRDPNALFDTAYYLAQNPDVAAAGANPLLHYQETGWHEGRNPSAAFDTDAYLARYPDVAQASIDPLAHYIQYGLHEGRLATA

SEQ ID NO: 4167 - protein, 305 aa, Methylobacterium sp.
VRKIMPLNWDHLQVFLAVARNGQMLEASRRLGLNHATVARRIEALEAALRTTLFHRRPTGSALTDAGEQLVPTAERIEAEILTATARMRATEAEPSGTVRIGVPDGLGNLFLARELGQFATRYANLMIELVPLPRSFSLSRREADLAIALDQPTHGRLMLSKLTDYSLGLYAERAYLDRAGPLVGEHDLVHHTAVMGVDDYAYASALDYTAFLQGRTRGVFRCAGTVGQLEAVRAGAGVGILHDFAASGCPELVRVLPAIVFRRTYWLLSHPDSHEVRRIAACRDFIVQRVREERKRFLPRDDES

SEQ ID NO: 4168 - protein, 38 aa, Methylobacterium sp.
LAPPSGNPILSPERRLDDQDQSIRPLSLSEFVGQRAAR

SEQ ID NO: 4169 - protein, 70 aa, Methylobacterium sp.
MRAETAAGYCDEPSVEAFLAKVERGIYSRPRRQQGCMPKWHRAKLDQDIARRHGLAIEGMLVAEDVSELI

SEQ ID NO: 4170 - protein, 412 aa, Methylobacterium sp.
MSIPSAKGGTDTSADRLPLPPARPHLIRDDAEALAVAHDVAAVFAAGAGERDRERRLPWDEIEAFTASGLGGITVPRSHGGADVSHATLAEIFAILSAADASAGQIPQNQFGVLALVRAAARPDQQARIYADVLAGHRIGNAGPARNGRAITQVETRLAPGPEGLRLSGSRFYSTGALFAHWIPTRAVDPAGRPVLVWVRRDAPGLRVVDDRQGFGQRTTASGTVVFEDAPIEERLTLDLAPLAERPGLSGPVSQLVQAAIDAGIARSAVAAALDVLRTRARPYPYTAESVAEDPHILGEVGRLAVDLHAAEEVLARAGRALDRIAAAPVTAESSAEASVAVAKILTTEIALEASERMLELAGSSATREGYNLGRFWRDARVHTLHDPVRWKYHLVGNYALNGALPARHQWN

SEQ ID NO: 4171 - protein, 307 aa, Methylobacterium sp.
MPSEAELTDLVLGAHGFLGRRLVRRLEADGRRVIAIGRDAGDLTVPEVARAALGRAPVARIFHFATRQRTGPSQYDIQAELLAVNARMHLNVLEAWRQLQPQAKLITPGSSCIYPESRAPLTEASFGLGPLHPSVAGYALAKQVLATGCAAYARQYGLRYLHCVLATTYGPGDHTEADRSHFVGALLHRAAGEKRRGATRFTVWGDPATVREVLHADDQIDAILRADAQFTDTILNCAADTPVTVGAVAEAVLRALDWQVPIERPAESFQGTPYKMLDSGRFLAATGWRPRISLDDGLRQLVREAYA

SEQ ID NO: 4172 - protein, 320 aa, Methylobacterium sp.
MTGLPDARALPEAVVLFGASGFVGRNLAARLAGRVGRLVAVNASGTPVPGADTTLPIAALGAVPALPRDTVAIHVAAPRYDAARFATAQADLLAGNVDLANRIYGFCAERGIAEVRMASSVAVYPAGRDLLDDAVPVDLHAPPHPGEAFYAWSKRWAEIAAGLFRERYGINTIAFRLSNPYGPHDALEEAVAHVLPAFVIRALRPGEVFTIRGDPRVERDFIHVDDVVTVFERSLHRRGESLTVNLCSGTTTSLQTLAETVLRLAGVARPIAAAGQTGSAVLARRSTNALVRQAFGDLRFTSLEDGLSPTIDWYRHALGG

SEQ ID NO: 4173 - protein, 310 aa, Methylobacterium sp.
MRILVTGGAGYIGSILVPILLARGDSVTVLDTFRAGGTELAAACAYEGFRPVRGDARDHRLLDELVPQHDVLIPLAALVGAPLCREDAVGATTLNRDAVRDLVARAGGDQIIVYPTTNSGYGIGESGKFCTEETPLRPISLYGVTKCEAEDAVLASGRGVTLRLATVFGMAPRMRLDLLVNDFTHRAVNDGALVVFEGHFKRNYIHIRDVAKGFLHAIDQFAAMRGQAYNLGLSSANLSKLELCQRIKAHVPRFVYIEAPIGEDPDKRDYIVSNAKLEATGWAPDIDLDSGIRELVRGYTMLRNARFANV

SEQ ID NO: 4174 - protein, 44 aa, Methylobacterium sp.
MAGTTMPFVEGAAALVLGTGFFGFFVSRLPRFFSVAMVSLLGMS

SEQ ID NO: 4175 - protein, 65 aa, Methylobacterium sp.
MCPVMQKMITLIVHMSQFPGLLERGQLIDQLTDLEAEGIAQDAPWRTVEAIRAARLKLRVEGLMA

SEQ ID NO: 4176 - protein, 120 aa, Methylobacterium sp.
MHDNGMSGTMRGWFAALVLLGCGALPASAAEPTVRIVGTELRAPPDSHEPQRALVSLHNAGVPAAGLTLACTFQDEGGRPLDTVEAPVRDMAEGASAVTEVIYYGWPRASRAACRLTGRR

SEQ ID NO: 4177 - protein, 79 aa, Methylobacterium sp.
MTVQPTDTLPALQASLDGLGTGQALRLTNADCDRLFGVDDALLGRVRNVALGHGCIVVWDDEGLSFCRQPHATGCKPLG

SEQ ID NO: 4178 - protein, 227 aa, Methylobacterium sp.
MIVHVRNVLTPEEVALCRARLEAGAWVDGRVTAGAQAARAKNNLQIPEDAPVARELGDLILRALGRSPQFNAAALPLRVLPPLFNRYDVGMGFGAHVDGAIRMVPGAGIRMRADVSTTLFLTDPADYDGGELVIEDTYGAHAVKLPAGDMIVYPATSLHRVEPITRGSRWSAFFWSQSMVKNDGDRALLYDLDRGITGVRAGLSDDDPAVIALTASYHNLLRRWAEL

SEQ ID NO: 4179 - protein, 755 aa, Methylobacterium sp.
LLRDAGGAGALGLSLVTGLGSFLPMGAVAQDLGADAGPGMAVTLGELSVAGWGGYQPNTLNADTGLSRLPGRVQDTPQAITVVPGEVIRQQQATTLEQALRNVPGITVSAGEGNGGLNGDQFRIRGFQAKNDVYLDGLRDFGVYARDAFNIGDVVVIKGPSSETLGLGTVGGAVNIVSKKALLTDFTAVDGLGGSGPTARGSFDVNRRIDDTTAIRITGVVHQQDIQDRRGVKSDRAGVAVSLGFGLGTDTTWHLNYLYQHSERTPDYGVPTALRPGDRYARPLTEYGLDRATTYARATDRDIADVHLATSLMKWTVTPWLTVTNDTRLSFYDRSFSTTAATCTNAAGPPVATCARDFFAGGNPFVTYSAGGGQTFDQDAWGAQNVTTALAKFHTGFLRHEVVTGFDLFYQNDDRLNYAVIGTRANQRVRNPDQSAAGYALVKNPLNRRVGDGANLGYFFSDRVWLTEQFSLLGGVRVDRFVSTYSATNTANGLFSPTVTAASTGVSPKASAIWQPTPEQTYYVTYARGFSPQGQYVVNSTGIEIPNAAALKPEESDLYEIGGKIGFLDGRLGVAAALFRVDKSNSFDVDPVTGGLILGALDAGEKRRVEGFEITATGQITENWSLLAGYTHLDGTVRSGANRGRAAPYVPENAFTLWTTYDLSPVMRPLWGLPGRITVGGGVTLDDGYFPASDNITRIPGTFSLDALVSYETDTYRLAVNAYNLTDELNYSAAFSTRAVPTSGRTVLVSAGLRF

SEQ ID NO: 4180 - protein, 258 aa, Methylobacterium sp.
MREQETGPTMSAPFKDHFSSAAPGYAAHRPTYPAALAEALAELAPGRGLALDCGCGNGQLARLLAAPFARVVATDASAAQIAEASPHPRIDFRVAPAEASGLPAASVDLITAAQAAHWFDLALFYAEARRIARPGAVLALISYGVLHLDGEAEAVLRHFYTQVVGPHWPPERAHVEAGYRTLPFPFAELRAPDLAIEVDWSLDDLVGYAGTWSALRGAEAALGTSPLPDFARDLAAVWGPPETRRRVRWPLAFRLARL

SEQ ID NO: 4181 - protein, 28 aa, Methylobacterium sp.
MSKFFEEEVLSVHHWTDTLFSFRTTRDP

SEQ ID NO: 4182 - protein, 173 aa, Methylobacterium sp.
VSAHLAEAVNACAYAHADGPLIYLRRRLAKALKAAFGQPIRLLASIEEDGEGGYVPGKSRVAHLHMKPGLDPAEKSTLAKARAAIRAACGEWTGPRRRRQIVMKPTRDAGWAGYFTKYCRLAAPRMVAFLKIHGAGPRWLPSHAGPVLTMDRETNRAAKVLHEKARQIVWEAP

SEQ ID NO: 4183 - protein, 1136 aa, Methylobacterium sp.
MTALFDPRPLVLGTLQNLSLVLERSTVLSGRPGVSGLTVGGSEARAFGGLEMPITRTGRSVPAKLRYGAITVTPRPQGSAFSGSPGVHPAIERAYDNPGVRFGDRVRGSERPTSSAGETSCHFSQTSVSKTSPIREMIKAARGGRRLTGSRAAAHVLYVERVGAPEQIQRKGEPRLSGEAFGAEIERRGLARSAAAQQAYIERAGAAEGMERKPGRRITDEALDALDEASFGTIGDTLEERTRFWLAVEEAEATPKGDRVTIKPAENSTWWARVAENLDQAPPAAQKPIRDALARADGEPFDVKLTTDKAFALHQWAVALDSEAPIEISPGRGGRTQTRVIAELPHEIDGRERLQIVRDFTQKLAEKGFPYWAVIHAPDANNDARNFHVHIAYYDRPAAKMQKPGGTGEVWDFEIQDHVIYKSKTGGAKRHLTRPYQQNRDRTTHDRAWILELRKHWETVSNRVLDEAGFSKRYNLGSYERMGIDLKPLKHINARTFNKERKGALTEEGPVLARRQWDTVHDRLVKEHEERARKRQVSITNMSDHAARMVAPFPYGAHRVAEVRRLKDMGIKASFQLALLELHQDLTRLVADRIVSRPKLMMQAADEEDRKALRQGASPDAAPQDRAVTGAELFGLKRRSEIATFLTTIYDGALHFDRDNERRSQAARNNVRLIVAELKAWMAEPGRSLHAARRYAPEAVQSLDDPARTERRETSRRALQEGFRKAVEGRSAEILRALKAEVSDRSAPRAAETALAAAPASSASQGRKPAATASPTGSNHATGPSDGRPKPRYTPGRPDSPAPKIGQTGFRPRPEHADLSRFLRRPTVGTGAPCPPEPVRETPRMRQASALPQAEPAFLQAGERSRHGSSTTTLPTNQETLGRSGQPSSGVPRPSHASIAAHEDGGGPPGLLGADPGTRLGTPGPIHVGAPVTVGEHIATSPGAAHAANERGEQAVESCVLKPANVRRDGHRTSPEELESSQRRDSHPARGEGPLATGRGQRRADSAIARTDGAGASSVPASVAIGTVARSEEERRQLGPAAEGPSVSASSGSAGPPVGRRRGPVNKEGRLELVAPNLAVSVDGDEAADRVPSAEPDAAAHKSDLTVASSAADTLRIVGAQRPRKKIRTRDRGWER

SEQ ID NO: 4184 - protein, 149 aa, Methylobacterium sp.
MFFLKELPTQKMLQTYQDRFPDTDIRNIEDALRLLRRGSLLMRELEAYFAAHALSQTRFLVMMVIDREPERESLFPSEIADRLDVSRPVVTDTIRTLEKAGLLSIKSAQDGRTKQVLLTPHGRTVLANLLPGYFALITEFMTRGSRPVP

SEQ ID NO: 4185 - protein, 481 aa, Methylobacterium sp.
MAQPHAPGGTLVPRPHQAEAARAILAARAAGRPGFLLGDMTGLGKTLSVWSALAAMPEAAVLVVCPKGAMPQWRRTIRDAGLAPKDVTLVNYERTKSLMAPPEAIRRRSTRARNNALAKHGSLKRAWPLVVFDESHRLRNPYAQQTMVCRQLADAAAFTVYMSATAGQAPHELGYLGRLLGHAVGSPTETLADFRALMQRLGIGRAKGRWVNWSWSANARDCAVMADLLYTGANAIGLRRRPADIAGWPEVQRDLAPTALKPDERRLYDATWREFRREFGLAGGSTRRPAGWAADLRFRQKASLLRVAGTADFAEILLEAGEQVALSVAFLETGAALAETLRGRGWRVDAIDGTRTGEANEAARLAFQTGDLDAIVFTVTESISLHRNELPGGERTRALVVHDMRHSAIQLAQIEGRCHRDGEAAVIHYAYAEDTVEEAIAATVLRRMAAMDAMAGEDTGLLDAIADCIARPDRTPDTVSG

SEQ ID NO: 4186 - protein, 387 aa, Methylobacterium sp.
MLRRVATAASIALAALCGGQARADEILVGAHMPLTGSLARSGQAYDEGMRVATQMFNASGGKHTIRLQVIDDESTPAKAVSAVEKLVSDGAVAVIGGYGSNIVGPASDAAEKLKTTYITAGAASDELNTRGLKTFFRINNNAGYQNGMVGLVTGLKPASISILASTKESTALLAKGLQKDLTAAGIKVTLHEFDPAITDFKPLINKVKLQDKSEILMMSAYENDYVGIIRAAKVLKPPVKLIVGAWALAVPKLYQEFPDLMNNVVGTSFLPFPVEIKDEEGKRFAEAYRKAYGKDVDYHATLSFVETTILAEAIAKAAEAGTLKSGGLPEIVRATDRETVLGRVQFDGTGYNPRFAVSMGQHQAGKIVLVSPAATATGQIVFPGLPW

SEQ ID NO: 4187 - protein, 387 aa, Methylobacterium sp.
MLRRAVAAASIALAALSGGQARADEILVGAHMPLTGSLARSGQAFDEGMRVAIQMFNARSEKHKIRLQVIDDESTPAKAVSAVEKLVSDRAVAVIGGYGSNIIGPASDASDKLKTTYITAGAVSDELTARGLKTFFRINNNAGYQRGMGTLLESLKPASVSILASTKEAPALLAKGLQKDLAAKGVKVTVHEFDPAITDFKPIINKVKLQDKSDILVMSAYENDYVGIIRAAKVLKPPVKLIVGAWSLATPKMYSEFPDLMNNVVGTSFLPFPVEMKDEEGKRFAEAYKKTYNKEVEYLSTLSFVETTILAEAIARAADAGTLKTGGLPDAMRQTQRETLLGPVQFDATGDNPRFSVAMGQHRAGRIVLVSPPASATGEIVFPGLPW

SEQ ID NO: 4188 - protein, 102 aa, Methylobacterium sp.
MELSEGELGRAVDGDEQVEPSFGRVDLPQIDVEVAERVGLEAGPLGLVAVDLWQSADAVALQATMQRRAGQVRDRRLERVEAAIEWQERVTAKGDNDRLVLR

SEQ ID NO: 4189 - protein, 201 aa, Methylobacterium sp.
MTAAALVLLLAAAQVPARATPSGSARDAPAMAAATTADIDPATGLRVRNYRAPVTMPVRGGTRIDLDAVDRLRTEGAALIDVMPQRGGFDPAGGAWRIVDRHATIPGAVWLPETGRGAIEPRLAAYLAAWLARLSGGDRGHPLIFFCMADCWMSWNAVRRAADLGYRRVYWFAEGTDGWSEADRPLVPAEPPAVPPLTAAP

SEQ ID NO: 4190 - protein, 327 aa, Methylobacterium sp.
MAVQTRLTQAFGIRHPIVLAPMDPASGGALAAAVSAAGGLGLVGGGYGNREILEAEFAKAGNQRVGCGFITWSMARDPVLLDLALAHKPAAMMLSFSDPAPFAEKVRAAGVPLICQVHNLEHARRALDAGASVLVAQGTDAGGHGMTTRGTITLVPSVVDLVARERPEVLVLAAGGIADGRGIAAALMLGADGALLGTRFWATQEALIHPAAKARVVAATGDETVRTSVYDIVRNRAWPPAYTGRLMRNRFIETWHGREDELRNLVGAERERVESADRSGDYDVSNVTVGEAIGLVRDLPAAGDLVARLAAETEARLATLPRALITA

SEQ ID NO: 4191 - protein, 338 aa, Methylobacterium sp.
MKKIGFLSFGHWSPGARSEARSAGDTLLQSIDLAIAAEELGADGAYFRVHHFARQLASPFPLLAAIGARTKRIEIGTGVIDMRYENPFYMVEDAGSADLISGGRLQLGISRGSPEQVIDGWRHFGYAPAEGGSDADLGRRHAEVFLDLLQGRGFAEPNPRPMFPNPPGLLRLEPHSEGLRERIWWGSASDATAVWAARQGMNLQSSTLKADETGEPFHVQQARQIRRYRQAWKEAGHTREPRVSVSRSIFALVSDRDRAYFGRGESGDQIGIIDSMRAVFGRSYAAEPERLVAELGTDEAIAEADTLLLTVPNQLGVAYNAHLIETILKQVAPALGWR

SEQ ID NO: 4192 - protein, 253 aa, Methylobacterium sp.
MNNRFTPLFDQISDLRSIAIEARAPANHLALLTEHPVAYESNDHKAPWGTKNDNTRSARFCRALEAHFRRPISAMDLGCSGGGLVFDFLVRGHLAIGLEGSDYSLKSQRAEWRVIDDYLYTCDITKPFDVVDKTSRATHAFDVITMWEVLEHIHEEHLPQLFANVKKHLVPDGLFVGSAALYDDVVNGVSYHPTVKPEMWWRETAQRNGLEFVPKTMFDFADFCRGTGNGPLDPNFAQDPGKGFHFVMRHRAA

SEQ ID NO: 4193 - protein, 347 aa, Methylobacterium sp.
MPLTVDWSVSINGTDYTSRFNPYVMEIEVTDGSGSDGDSCRITLADDGRLIMPKKGVTIAVSILGVKVFEGILKTPRCTTAKGQGGKMVLNATGHDTEDEGKQSQHFAMEETTLGEYLSGLSKKAGYEIKVDPELAKIKQSWIGSEGRSFLEHAQLLANRYGATLKLSGKQAVLARRGKGKTPGGKDLPTVRAVSPGNIINADIEPYVGTAAVRDVRFDFFNRDKARFEEQKADVRLGIGSSKTARRVLPGKAASREDAEDRAKGAAADSERERGSGTVEIDIEPQARAEGTCIVSGVRQGIDGEYRIESVTHTLTAGDGGGSTTKLTLKQPGDEAGSDKRKAGEGD

SEQ ID NO: 4194 - protein, 301 aa, Methylobacterium sp.
MRSDLNLWDLHHHSVADWQRILAGHPGLAARWLRFAAERGFRSAQLVLGQMLLEGRGVARDPAAAHGWFARAAAIGSLDARNMVGRCHEYGWGVPVDHAAALAQYRRAAAEGHAWARYNVGCLLLYGDVPRDHAEAFRCFAAAAQAPDEAAAGKALGMLGRCHEEGWGTPPDHAAALRCYREAAAAGDGWGALNLGLLALEAGDVSGAASAIERAAALAAPNGLAAIVRALAGRDEPALAALRERVRAGLRPVGGTVPDTAPPRRIAARPLEWRLSAALLAGHLLRRGRAPRARTIPATTG

SEQ ID NO: 4195 - protein, 974 aa, Methylobacterium sp.
VGNLTSSLTLKLIDDGLAAKVKADADAMRKLGASAQDLKKLGGASSHVAKLNKELDALAKKGGKLEALKVNERQLSTLAASYKTARQEVAATAKAVAALGPGVSAKDQRAAERAHKTAMRRMDAARDAALEQARLVKAAHAEALGGSGKGRIGMARAEQQLAAATNATNAALREQVGLVGRLAAKGRAERDVLAGMGLAGRGQGAKIAADRRLVDGMGAPARAAAAAAAAAAKAAVEAEGRRRSSASGDMLRGMGGIGRREHERIAAGRRVAEGMSAAGRRTGSMAGGSLPQAGDAEGAAIFDTLKGVGASAAARRAFDATTSNWATMDEAVRRQRAILDIDEDKQEQLKAQAYQIGKDTRFSNPDVIKGQTRIGSSLPDHLKNPAVIAAITENAKDYALAMGTTLDEGSSAVLGRMLGMRMDLSTTGSAGAASLDAANKLVQWAKASGADHNDVMGYTKFGAAPGNVGGFSPEFQDALSAQLRRIGFEGSMGGNFVRAAATKLAVPTSKGLGALAAAGIDHSDYVQKGKELSAENLNKSLKLKYGKGLTDSQQARIHALMQDETVVGNRDEFIPAVAEIVQETLARKTKKGSINAQDAKSIAKAVGEFLNVSAGAVDIERLMRDVIPLLKGSPALSKYLFGQEHGGRAQALDAATLEKDTESFRNTPRDRAKGVGNITNAGFHGARDRYYGSVETFWTRLGEVANGPLTTFYETLGNSIDRVSGLPDALLGVGTAAASAGAALLTIKGAAGAGALLGLPGAAAVSAGASAAGGVATVAAGGAMATAIANEAIKNKEFAAPYLDGGMLGADPAGYGIGAGIMHAPEALKQMSDANKRRMGSLPPGMAGVPAQLPPRLPGLDGRPKVAPAPAVRPVTLNPGDELPGVASSLEQVSGKADQARSSLEQVNGVKVDPSISTGSLDAMLAKIGQVISGLQQITGLAASANSSIASVNSGAALKGRSFSDGATPGRGTD

SEQ ID NO: 4196 - protein, 118 aa, Methylobacterium sp.
MRRPISPRESAIQSAVIAHWKALGLPGTLVAAVPNAGALGQAGLTAGISDLLVLGGLVRVGFIELKRDRGVESAAQEAFRRRCEALAIPCVVAFGRDEPIAVLERWEIVRRQAGRAAA

SEQ ID NO: 4197 - protein, 78 aa, Methylobacterium sp.
MLRFLGRHAGLLAFGVVAAVVLGPLTVFWPGAGALAVALLGALGALAAHARATALRARCDVLSREVDGLSKRLLRAES

SEQ ID NO: 4198 - protein, 55 aa, Methylobacterium sp.
PPPAPGTQRYITEPPRAPETPGPMPSPAPGRGTGESLSRDLPSEAYRPPPERGGR

SEQ ID NO: 4199 - protein, 65 aa, Methylobacterium sp.
MARRQTATQAAISRAVKGAQAAGLKIGRVEIEGDRIVIHSSAEPVQAAPASDFDAWRAKRDARPA

SEQ ID NO: 4200 - protein, 88 aa, Methylobacterium sp.
MTTRFTTAAVAIALSLAAPAAFAQAGNWPHTERAPVSAYDDITTGSIGVARPQVRDGWGAVSSAKAGNANQQNFPVQQYGQTSGGPAY

SEQ ID NO: 4201 - protein, 98 aa, Methylobacterium sp.
MSCLWSGIAALALPVAAAMPGAGGPVLVVGAPGAGPAAVAEIVARADGALLRPTVLPWIVLARSDAGDFDARLRRAGAWLVLDGTALAGCAGGRGSIR

SEQ ID NO: 4202 - protein, 325 aa, Methylobacterium sp.
MPVTDAADPKPLILLTNPIHPEAVARLTPHARVVTAPDTGADTLRRLAREAAGMIVRAQLPDDILDHAPLLRGIVRHGVGLDFVPLAAANAGGIPVANLPGSNTRAVAEYAFAALFELRRRLGHLDRTLRQSGWLAAKTLANDLPEIGGTALGVLGLGEIGRAVAGIGRHGFGMRVLGTARNPRGLEGLAEPVPIERLFAESDAVVIACPLTPETRGLVGAGLIGRMRPDAVLINVARGPIVEADALADALEAGRIGGAALDVFAVQPLPEDHRLRGCPNLLLTPHVAGTTATSLRTMGLGAADAMLAILRGERPATVVNPEVYG

SEQ ID NO: 4203 - protein, 78 aa, Methylobacterium sp.
MISVQPYWLVHGEGPASRRHDTKASADREADRLARLHPGQVFVVLESVEAFRKIDVQRVSLRGPEGRVAPGLMDDIPF

SEQ ID NO: 4204 - protein, 29 aa, Methylobacterium sp.
KAFSYGMIGAFVAGLGLTLRGSLGVLAGL

SEQ ID NO: 4205 - protein, 29 aa, Methylobacterium sp.
KAFSYGMIGAFVAGLGLTLRGSLGVLAGL

SEQ ID NO: 4206 - protein, 141 aa, Methylobacterium sp.
MAGGYAPNTFAVLLVEDVPVQMMAAASALRDAGLRVVEAPTVEAATSALAADPELRAMIADIDLGGEPLMGLTLAKAVAARWPDVVLLLISGAIVPETEAMPAGARFLRKPFEPEALAEAVRGLVSAREAGRLAPDGSVMG

SEQ ID NO: 4207 - protein, 756 aa, Methylobacterium sp.
MAETDAQILRLQVANARPQDAGRGIARLGHAALTQLGLREGDVVEIVGKRHTAAIAVGPYEEDEGLNLVRLDGLQRVNAGTASGDHVEVRAASEIRPAGRVVVAPAQKNVRLQGSGEALRRTLFRRPLVAGDVISTSTQSRAAPDPRIPPELRPYLEGPTYGLQEIRLVVVSTQPRGIVFVAEGTEIELRPLFEEPKDGRRADVTYDDIGGLGDTVDQIREMVELPLRHPELFQRLGIDPPKGVLLHGPPGTGKTRLARAVANETEARFFHIAGPEIMGSRYGESEQRLREVFQEAAQNAPSIIFIDEIDSIAPKREQVTGEVERRIVAQLLTLMDGLEPRQNVVVIGATNRRDAIDEALRRPGRFDREIIIGVPDQPGRREILGIHTRGMPLAEDVDLDAVARTTYGFVGADLGALVREAAMDAVRRILPEVNLREGIPAETLEGLSVRRDDFLSAMKRIQPSALREIMIQVPDVTWDDVGGLADAQMRLREGVELPLRSPQAFRRIGIRPAKGFLLFGPPGTGKTLLAKAVAREAEANFVATKSSDLLSKWYGESEQQVSRLFQRARQVAPTVIFIDEIDSLAPARGGGLGEPAVTERVVNTILAEMDGLEELQGVVVMAATNRPNLLDPALLRPGRFDELVYVPVPDAAGRRRILAIHTRDMPLAEDVDLNLIAERTARFTGADLEDLTRRAGLLALRESLDATQVHRVHFEQAARETRPSVTPEMERDYEEMLRTLKQEGPQRQPIGFLAAR

SEQ ID NO: 4208 - protein, 90 aa, Methylobacterium sp.
MPPVEPVSPVLDTLLSLLAEAPPGRDRKAAEHAAERLDRLEYAARWDGAAPETLAAIAGARMLLGLAAYPCPRRPRIAPRHPIAGALLPH

SEQ ID NO: 4209 - protein, 196 aa, Methylobacterium sp.
VSPTRILCVEDDREIADLIAEVLAEEGFAVERAATGPEGLARLRTRPDAVICDIDLPGFSGLDLLRRAGEAGLAAPFVFLTAFGGRRNQIEARRLGCADFVTKPIDFELLVAVLRNVLQRAPVRRTVQEPAVQMTEREREILTLVSRGKSSVEIAQILAISERTTNFHIGNVMRKLNVTSRVQAAVIALSMGLLEK

SEQ ID NO: 4210 - protein, 125 aa, Methylobacterium sp.
MTEHRIVSHSKLRDEMMAVARGQQAAPPNAGGQSFESVEALMRLLTPDNRRLLAMIRDRKPQSIAELAEWSGRAAPNVTRTLAKLEAVGFIRMEENQRRKVPTAVVHKLTMEIDPFSQNDRLEIA

SEQ ID NO: 4211 - protein, 224 aa, Methylobacterium sp.
MITVVGGTKGGSGKSTVATNLAIMLASAGRDVLLVDADDQETSTDFTNLREATRPGGAGYTCVALTGAAVRSGVQRLAPKHAHVIIDTGGRDTVSQRAALSICDAYLVPFAPRSFDVWTLDKVAELVEEARAVNPELRALAFINRAEARGSENAEAAELIRSKPGLEFVPAALGARKAFAHAAASGLSVTELRPQDPKASEEIAALYGHLFDTAKISSRDPKGA

SEQ ID NO: 4212 - protein, 384 aa, Methylobacterium sp.
MSAVVYNGPRDVAVQDVPDARIERSTDVLVRITSTNICGSDLHMYEGRTDFPRGGVFGHENLGQVVEVGDAVDRVKVGNWVAIPFNIGCGFCKNCERGLSAFCLTTADRSVVPNMAGAAYGFADMGPYRGGQADLLRVPYGDYNCLKLPPDAEERQNEYVMLADIFPTGWHATELAGLRPGESIVIYGAGPVGLMAAHAAMIKGACMVMVVDRHPDRLRLAGEIGALPIDDSKGSPVDQVLELTNGIGADRGCECVGYQAHDPQGHEHPNMTMNDLVKSVKFTGGIGVVGVFTPQDPAPQDPLYKQGEIVFDHGLFWFKGQTIGVGQCNVKAYNRQLRDLISTGRAKPSFIVSHELPLEEAPNAYQHFDARDEGWTKVILKPAA

SEQ ID NO: 4213 - protein, 199 aa, Methylobacterium sp.
APTQPPFPSALPTLPRAGAAPAATGLVVAPGRVLTAAAALGGCAPRIGAAAARVLASDPAQGLALIEAPGLPASVLPTPRGTPAGVDEALTVVAASAEGSVVAPGAALGSGVVAPLQPGAAGAPVLDRAGALAGIVARYPSTPRLVAGVAPPTSYPILPGEAVLGFLRRNGIAPSAAGGSAGASAGAIAPAVVAVTCAR

SEQ ID NO: 4214 - protein, 149 aa, Methylobacterium sp.
MSKRNVEPELTAAQLQELIGMARGNSETLSTMDGNNQALFLLRTFDTADRVYGLWPDSSRPGGYDYNIMKGELGSAAMRRVAKSPNISVTAVFQENENHAELTREIYVGLETTGDAYPETYAEAFHFWINIVPANFEDTKRRIRGYILG

SEQ ID NO: 4215 - protein, 139 aa, Methylobacterium sp.
MHLETAHVLAGLIEAMPEDIPVDDPDDEAEGAPETGSARSARERRDAAQRKRDERARRKAGGMPDPRVVDAAIATAIADICIRADFRGRAKAKGSIKGLSIGLDAIIGQVMQVLVEQRNVGQPQAKKAAMQRLGLTRQA

SEQ ID NO: 4216 - protein, 244 aa, Methylobacterium sp.
VTSSHSAAGPQRVLITGGTSGIGAAIAERCRRDGYTPIILDRVPAASGACIVADLSDREQTARALDEALAGGPITRLVNNVGVVVPSEVDTQPLESLDLAVSLNLRCALQCLQAVLPGMKAAGFGRIVNMSSRAALGKELRTAYAATKAGLIGMTRVWALELGPFGITANAIGPGPIRTALFDRANPPDAPRTRAIIDAVPVRRVGTPEDVADAAAYFLGHRSGFTTGQTLYVCGGMTVGLASV

SEQ ID NO: 4217 - protein, 277 aa, Methylobacterium sp.
MPMRCHIGSALLLTGLACAMPVGAEAGAGPRVRIAYENPAPGEAREIYREVRERRVLEGLRNLLSHLRLPRTLTLRMAACGGEPDAWYAARDRTVTVCYDYVRDVRERAPATVTPGGVTRQAAILGGLAQVFLHEVGHALFDILDIPVLGREEDAADQFAALVVLRLPPEEARRAIDGGAHLFRSFAAEEAVEEAILADSHGPFAQRLYNLLCLAYGSDRRAFAYLVERASLPSARAAECAAEYGQAADAMDRVLHRHLQGRRLGRGQVRRAFRWIF

SEQ ID NO: 4218 - protein, 328 aa, Methylobacterium sp.
MPHLQPSRRAILAGGLAVAALPLSARAQGAYPTRPITLIVPFAAGGSTDVVGRLVAQKLSEVLGQQVVVENVVGAGGNVGAARVAKAEPDGYTILMGTVATHALNPLILKRKPYDPVTDFAPVALLAVVPNVLVVNPSLPAKNVQELIALLKADPKKYNYASSGIGTPLHLSGELFKSMAGVQMQHIPYRGSGPALNDVVAGQVPIQFDNLPSASEFIRAGTLRALAVTTKERASSFPDVPTLAESGLPNYETYTWNALFAPPGTPRPIVDALNAAARKALADPALVERLKTFSAKVQLSTPEELGEHVKAETAKWTPVVREAGIQAD

SEQ ID NO: 4219 - protein, 471 aa, Methylobacterium sp.
MSDLSSNLSPFRELLGEGGVVTDADSLTRYTHDQRALMQGQTPGVLRPRSTEEVQAVVRLAAHLGFGLVPQGGNTGYVGGATPEPGRGQLVVSLERMSRIRAVDAAGFTLACDAGTILADAQAAAEAQGCLLPLSLGAEGSCRLGGNIGTNAGGLQVLRYGMTRDLVLGLEVVLPDGSLFSDMRTLRKNNIGYDLKQLFVGAEGTLGLVTGVVLKLWPAQTRRATAWLQLAENAPIPEIAALVRRETADLASTFELISASSLALVADMRGADLGLAAGPGGAVLLELSASSERIPLDDVLLGTLEALMEAGHVEDAVLAQSERQRREMWTIRETIPEAEKHAGGSVKLDIAVPTSAVSSFLVRAGAVVAAEAPGTRLSFYGHVGDGNIHFNLMVPAGRDRLAFTREVEEGVAHAVYAVAVDLGGSFSAEYGIGRFKRDLLVRYGEPNRLALLSAIKRAIDPHGLMNAGAMI

SEQ ID NO: 4220 - protein, 255 aa, Methylobacterium sp.
MLAAGLAGPVTARASPITDQWSAEAAQTRQGHTYRTVLTFSYDGKVQNGRALWLVDVRCEVRSPGASKVSAVTGSGTAMLAQGGWGGNAPPVGDVYVIEAENDPEGKGRLEVDNPGCASGTPTIKRRPGEATVPTLPKVEPTGRPWMHNGSMVMIDPEAGIIAYREPKASLRPAVGPGTVLFRGTLKPGGGAHGTAYAFKEGCPPAPYAVRGRYSDRDYTLTLRGAGPVRKGCEVVGYSERSPHAVLAFSYLLDD

SEQ ID NO: 4221 - protein, 328 aa, Methylobacterium sp.
MGIAVRAAIGALLLTATSAQAWEPTKPIEIIVPFPPGGASDQMARTIQGAIQKGNLVKQPIIIVNKPAAAGGEAMLDIQKSAGDPHKLITTSSGIYMTPLATKLPVSWKDFTPVAMMAQDAFVLWVNAAKPYKTAQDFVAAAKTAAPPLKTGGNGSKREDHLISVTMEQATGTKITYVPYQGGGPASVQLAGGHIDANMNNPAEEIANWRSGSVKPLCVFSPKPMEYTQKVTADMAWSDIPTCPSQGVNVTYQMLRGMFMPGKVTPEQQAFYVDLFQKVTQTPEWKAYLERNALVPDFRAGQSFVDFLTEDERKHKELMTKAGFIATN

SEQ ID NO: 4222 - protein, 165 aa, Methylobacterium sp.
MAQASPPLPERGLSRRLVEILVALLLTGLAALALWDSYGRGAGWDNGPENGFFPARVAAILAIAAGAVLVGAVRREDSVFVTYGQLRLVAQVFVPLFLYVLAIAFLGIYLASALFMGLFMVMLGAFRWWQVALAVVLTPLVTFWVFELQFRVPLPKGPVEAMLGF

SEQ ID NO: 4223 - protein, 513 aa, Methylobacterium sp.
MDDLNQLLLGFQVALTWHNVLFMVVGVLLGIVVGVLPGLGGPNGVAILLPLTFGMDPTSAIILLSSIYWGALFGGAITSILFNIPGEAWSVATTFDGYPLAQQGRAGEALTAAFTASFIGALSGVVLITFVAPLVAKFALRFGPAEFFGVFFLTFCSFIGMGRENKAKIVASLALGFLLAAVGLDTISGDLRLTFGSPELMKGFDFLVVVIGLFGVSEILLTIEEGLHFKGKRAAIDLGVVLRTWAGLPRYWATLIRSSVVGMWMGVTPGGAIAASFMGYGLAKRFSRRPDGFGRGEIEGVLAPETAAHAAGTSALLPMLALGIPGSATAAVLLGGLMIWGLQPGPMLFIEKKEFVWGLIASMYLGNLAGLLIVLATVPVFAAIMRIPFALVAPIILVVCAIGAFTVESSRFDIWLMLIFGVVGYVFKKLDYPLAPLVLALVLGDRAEDAFRQALLGSGGDLSVFFSNALVSTLMILGLLLLVWGPLGNLRQRLTRKGGIDQPPREIAGSKAS

SEQ ID NO: 4224 - protein, 326 aa, Methylobacterium sp.
MAAEERSHGLTRRTGLALGLSAAAAVCRPFAAAAAPRRYALDPVRIAEGVWTVYGAQEAITAGNGGAIANVTLLDTREGCVLIDAGPSHRFGTALDALARDLTGKPVVRVYLTHLHADHSLGATAFPDTVLRAGPGLRTDLARFGNDLASGMYRVAGDWMRGTGVPKPAMEAREGVEDVGGRRFRLLCLSGHTREDLCLFEETSGLLFPGDLVFLDRAATTPDADLPRWRTALRTIADIPCGLLVPGHGPAEAGRRGIDQTLAWLDAVEAGIGAGFEQGLDVTEIMARPLPAWTDRIAVARYEFARSVMHLLPAIETERLPNLPTL

SEQ ID NO: 4225 - protein, 196 aa, Methylobacterium sp.
VTAKRKYARLTPATWATIEGLWASGSATLSEIAERFGVSPRAIQAHMSQRGIGKGSAAEALAANVRSEVLSRALREPDDLVARAAAIREGAVQGAEKVERLLHAALDAAAADPGKVFALAATAKALALSAQTLERLHKLKRSALGLGDDDTLSDELPTLLIEDLSASDIAAMREDDEEDDGPKARHEEDNEVVLIT

SEQ ID NO: 4226 - protein, 207 aa, Methylobacterium sp.
MTLQTWWLFLGAVFLLSGTPGPNMLHVMTCSARYGLGPSAFAMVGCLSGLVLVLIAAAAGLGAVLAASPLLFEILRYAGVAYLAWAGIRAWRGGGAAPDPATGIARAPSAGGLFRGGFLIGVSNPKLLMFVAAFLPQFIEPARAQTPQFVVLILTFAAAEAFWYAVYGVGGRRIARLLVRPGARRLFDRATGAIFLGFGAALLGGHR

SEQ ID NO: 4227 - protein, 120 aa, Methylobacterium sp.
MQRAAVWRAAIGVLTLYALVLQGLLGGVAATRMSLQATGILCSDHRADASQEPDGQAGHQSCCSTVCRLAGFALAAPEVEAIPATVPALARERHWHAVQAHAPPARTHRSAAPRAPPAAA

SEQ ID NO: 4228 - protein, 34 aa, Methylobacterium sp.
VAPAQVRAPNRPEWPHPLNEEELRALETGWGFVE

SEQ ID NO: 4229 - protein, 180 aa, Methylobacterium sp.
VARVADLAVDWGMLPMVRLNEIRLGEVAVDLPPATDAGLIFIGTIRTPWTDRLACPRQGRLDGPVCRLEIAEPFVAALAGLEQYAEVEVLYWLDRSRRDLVLQSPRRDGAVRGAFSLRSPVRPNPIGSARARLVDIAGATVRVQGLDCLDGTPLIDLKPDRCAFTPLAPPQPGDFETGPA

SEQ ID NO: 4230 - protein, 136 aa, Methylobacterium sp.
VGALFSILPMLIQFLGPVLDKAIPDAAQRAQVQADFQKAVLENQAALNAAMADVMKADAGSESWLARSARPIVVIWSLVMITWCGVVAPMLGVQKEVLAALQAVPSDLWSLASVGIGAFMLARTVEKVAPAIATRK

SEQ ID NO: 4231 - protein, 417 aa, Methylobacterium sp.
MEQRTAKGPGSASRFETLDALRGVCALAVAFFHMPFAHPLHGAPRFDNVQFCVDVFFVLSGFVLLHGYGGRLASPRQALRFMLARFGRLWPLHAATLGLLVALEAARLVYLTGHPGTPVVTPPFGAAHRPVEVLTHLLFLQDFLTFGEFSWNFPSWSIAVEFYASLALACTVMLAGPRARWTFAGLALLAALALHAASPGTLFAIQDWGILRCLFDLFVGCLAYCLRDAARVPDRWAGRAEALALALLLAVATLVPPGDWAYGAPLVFGAAIALFSHGRGTVSAAARHGLPQTLGRWSFSIYLLHLPVLQVVLTGLHYAVPRSAGLAPDAGVDLGGSLVNLAAALGIVGAATLLAGLSYRLVEQPARARFRMSDPRTRTGRTGRVSQIEKASPPPACGDWSPIGQYFWSRAVLRRPE

SEQ ID NO: 4232 - protein, 285 aa, Methylobacterium sp.
MRVVAILASHNEEVYVRACLDTYIAQGVEVYLIDNDSTDRTVEIARTYLGRGLIGIERFPRAGQFELLPMLRRKEEIADAIRADWYIHADMDEIRLPPRGQGTLARALREVDRAGYTTVNFRNFLFMPPREEPDHFHARFVETMRWYRYMEPSYPNQVKGWKRQKHFTLGERLRRLLFGLEARPGPRSVDLAGTGGHRVHFPGATLCPDDFILKHYPVLSLDHAVRKYVEKTYAETEVSVGFHGWKARAAAVDLRLPSVAELREFRGDAALDIADPITRTLIYAA

SEQ ID NO: 4233 - protein, 540 aa, Methylobacterium sp.
MTLHQHAARAALTLAALSLTTPAFAAPGQTAGLNLTAIVLFLAFVLLTLWITWQAAQRTKSTDDFYAAGGNITGFQNGLAIAGDAMSAGAFLGLTALVFTSGFDGLTYAIGYTTGMPIVVFLLAERLRKLGRYTFTDVVCTRLSEGPIRIFAACASLVVVAFYLIAQMVGAGQLIQLLFGLDYAYAVFLVGVLMICYVMFGGMVATTWVQIIKAGLLLAGATLIVVLVLVAFGFDYGALLARATAVHPKGAAILAPQAASRDPLSALSLGLALMLGTAGLPHILMRFFTVPDARAARVSVFWAATFMNYFYALVFVLGFGALTLTAANPDYVDAAGALRGGGNMAAIHLSHAVGGNAMMGFISAVAFATILAVVAGLTLAGASAVSHDLYAGVIRRGQLDERSEVRISRIATFVLGLVAIGLGLAFKGQNVAYMISLAFSVACSSTFPVLLLALYWRGLTTAGAVAGGTVGLLSALGLTLLGPAVWVKVLGNPAPIFAMDPPTLVTLPLAFATCWLVSRLDRSAQAARDRARFDLQQAAT

SEQ ID NO: 4234 - protein, 171 aa, Methylobacterium sp.
MTEPEQIARLRISLEGIEPAIWRQVEVPLTATLKALHDVIQAAFGWEGYHLHLFQVGEERYGAPDPEWEGLRPIRPEKGMRLAVLIERGVTSFTYTYNFGDDWRHEIVVEAVEAADPALEYPHLVAGARRAPPDDVGGVYRLRGVRPRDDPATPSGAQGHGGVARWSLRSS

SEQ ID NO: 4235 - protein, 91 aa, Methylobacterium sp.
MRNDAESPGWSPDLLSAQALRVQDAALILADECVLLSLGAQMAWLDLWMRPLLQASAEMQVWQERQARTARLMRRGIPGPVAREGLHLLPS

SEQ ID NO: 4236 - protein, 738 aa, Methylobacterium sp.
MQMNAGSSRRPWRILARPAARRPRVAGAFRRLVPVLARLTACLALGAHGAAARTIFVTPTGAGPGYAADGRLVAERTESFSTDTMRTVLPGDVVQLLLDTPDPAATTVYRAHVVLSRKTSLAPAAIVIRGLGPRTRLVGRSVEQVRDCPMPEDGAERACGDLYSALAAAETPDLLAALFGSAAVRATPGERAAGARPAIPIGRTGRLAEAACLDLDRVDGVVVEDLTFQDCWLVAVRALGSRRVTVRRALVVGGSYGLAARGRPGQPADHITVEDVTWVQDASGYDAASLSREGPFRCRDGRETALGCPGLMWRSIPWGVSHHGVYEHFNGALLGGADLAGPVVFRRNTVLSAYNGIRLKASACEDLPASSLSPATCPYNAGLWISENLFSYLRDNPVELETWATDAHVARNRIHNAHAWFSFDDMAGGPVYVYGNRGWFDDMPALAWSGSAPGGAPCRRRPVSAPPDAAGFDPVLDRRFDYLKARWLPVGVEAVDASGRVQRMDVEEQSCEASVAGRVVKLALPPRGAAPDTYRYPTRGPIHLFNNSWYLRAPVTGIGAAANLRHWNNAILFCEPGTPGYAPELCEARPETFDAAACGREFVRADGIGRFPGARGSLPFFDCFRWLPVDERGRDLPDLASTFDHDISSNGFPQGFGGPATFELQGRQGDPGFRAPERGDFTLLPGALARTSACRIEEADDGHLDCRPVPADAAFAGAVAPDGRLYEPPASPRFRPPD

SEQ ID NO: 4237 - protein, 548 aa, Methylobacterium sp.
MTETLKLTEFEALSPFEIKDELIKLAKATSRRTQSAFLNAGRGNPNWIATAPREAFFLLGQFALTESRRVMSHPAGLGGMPQAGGIAARLEGWLAERPDTPGAPFLSAMVPYAVTTFGFEPDAFVHELVDSIIGDNYPVPDRMLVHNERIVHEYLMWAMCGGQKPAGRFDLYAVEGGTAAMCYLFKSLKANRLLMPGDTIALGTPIFTPYLEMTHLEDYALNVVHIRAPQENKFQFPDEEIDKLLDPKIKAFFLVNPGNPTGMALSGETVAKITELVRTKRPDLMILTDDVYGTFVEGFRSLLGELPRNTIGVYSYSKYFGCTGWRLGVIAIHEDNIFDEAIAALPAAETAALDRRYGPLTLQPRQLKFIDRIVADSRDVALNHTAGLSLPQQVMMSLFSLAELMDERKAYQAACMEIVHRRVWSMIEGLGLHLTPNPNFDAYYGLIDFEFWARKNIGDEAVEYLKANVHPLDLAFRLAEVHGIVLLNGGGFEAPNWSLRVSLANLPDEVYDDIGRGVRAVARGYRDAYEASRRTAQTRAEIAEAPAE

SEQ ID NO: 4238 - protein, 99 aa, Methylobacterium sp.
MNTAVFRVSQIAMPCVGLWFGLRTYAWLSAHPAVYDPLSGSVSIGVAVWLLGGALVVALSEAIAKAYADARQTRTRPSFYAMLIAAASLALGVLSYLTK

SEQ ID NO: 4239 - protein, 180 aa, Methylobacterium sp.
TALGDGKILFSASTAANGQELWVTDGTDAGTTLLKDIRTGSGSSAPTGLTALSDGKAVFRATTPTHGSELWVTDGTAAGTTLLKDIRTGSGSSAPTGLTALSDGKAVFRATTPTHGSELWVTDGTAAGTTLLKDIRTGSDNNVMAGFTALGNGKALFRATTATNGTELWVTDGTDAGTTL

SEQ ID NO: 4240 - protein, 131 aa, Methylobacterium sp.
GFTTLGNGKVLFSAYNATDGRDLWVTDGTAAGTTLLKDFNTGFAHSQPTGFTALGDGRVVFSASTATNGQELWVTDGTAVGTTLLKDINTGSDDSQPTGFRALGDGRILFSASTAANGQELWVTDGTDAGT

SEQ ID NO: 4241 - protein, 401 aa, Methylobacterium sp.
MTDAFICDAVRTPFGRYGGALADIRADDLAAVPIRALMERNPAVAWGALDDVIYGCANQAGEDNRNVARMAGLLAGLPVEVPGVTVNRLCGSGLDALGAAARAIKAGEADLLIAGGVESMTRAPFVVGKARSAFARDLSLQDTTMGWRFVNPRMKALHGTDAMPETAENVAEDYGVSRADQDAFALRSQRRAAAAQAAGRLAEEIVPVTIPRRKGEPLVVARDEHLRPDTTPEALARLGGVVGPEGSVTAGNASGINDGAAALLVASPAAAERHGLRPRARIVASTAAGVAPRVMGVGPVPAVRKLLARTGLSLAQMDVIELNEAFAAQALAVTRELGLPDDAAQVNPDGGAIALGHPLGASGARLAIAALRQLERGGGRYGLCTMCVGVGQGIALIVERV

SEQ ID NO: 4242 - protein, 733 aa, Methylobacterium sp.
MNINPAPLRFQAGMRPSPLAFADRRSKTWTITQVVDAAVRRRRTVALVTLACFAIAAAYANLAAPTYTSMASVVLDTKLTPPSPGTVSSETTIDPAVVDSQVEILKSDKIALDVVDRLNLTRDSEFVGSKPSFVHALIGRIMALFEPDAGGAVRTDPRQAAAAALSRKVKVTRAGRSILAEITATSLDPAKAAAVANAVAEAYIQDQLSSRMEASQRTTDWMQRRLAEVRERLDAANAALAAYRAGEDDGKSGVGGTRAEREGARARAADALTRARADLDRSAQLRAAVAQGDPGSETLDQIDRLGDPALSKLVTEQRGAAPGAAVLRTLGERLDARVEAQRKAVAAAELRATLLDKQIQDLRSDGSRSDVPRTDDGRERALERAAQDAQGNYEALQNRVMRVSAFLQQQSMPVTEARIVTTALPPLSKSAPKSSLILLLGLIGGIGAGVAAAFLKDALDRRVRWSRQITHELGQPFLGTLEACPTRAREFRHAADGSPGSDRRLPVPLFIANGSGSPAVLETLCTTKVSIDQALHRETCRVVGVISANAQEGKTTLVTNLAVLLVEMRARVLVIDANLHGSGLAGLVEGDPGPGLARAVTERRALPECVVATPLGFHLLPGSVGPVPNHPVEILGSAALRQLLAEARDHYDYVLIEVPPVLSAVDARVVSDLIDAFVLVVRGGRTKRDEVEHAFTTCPAIADRIVGVVMNRTKSGERPAPASAAPSYLQGAA

SEQ ID NO: 4243 - protein, 309 aa, Methylobacterium sp.
MDLAQLRTLVHVAELGSLSKAAGRLRIAQPALSRQIRLLEDELGARLFDRHGRGMVITEAGREALRHAKRVLAETEELRASVSGPGAELTGHVAVGLPPTLADMISVPLVAAFGATHPRVRLQLVAAYTGYLLDSLYRGEIDLAVLYDPRAPRSLRIRPLMQEALFLIGPGDAGLTAEEPVPFRALAGQRLLLPSTRHGLRNMVEHFADEAGIALDIALEIDSYTALKDLVRQGYGRTILTRAPMHEDIAAGRLTAAPLVDPAPIRRLVLSFQPDRPVSRAAEFAGAAIAAIMAEQLSQGVWVGEMLAG

SEQ ID NO: 4244 - protein, 103 aa, Methylobacterium sp.
VRTLIGPIAADAAFAGLHPARGRPAYAPWRLARVPLLRFREGLGDRRAADAVRARIAWKYLLPTGCGAAPGPSGTRATLAASTMRARASRAASRWPQQRSDTT

SEQ ID NO: 4245 - protein, 462 aa, Methylobacterium sp.
VSLWLQDLSALKDRLEDWRAAGMTDLRTWLRDPEHLLAVQMLIRIERVNRQTLRLYEARDEAELFAHIPAIFDDPRADALVEVLCQLWAGATQARLVTRNRTVAGRVLDVSYAGRMLPGHEASWARFLISVEDITQREEMRRREDALARFAASLFERSPVPTLVRDESGLAAMLADLRAAGVVDLAAHMAAHPDWTEAARASLALVGANAPALALFGAADGDALAHHVAVGLGAEARRVFAEEALALWAGAGHGVRDVLFRRIDGGALHLKAQYAELPGQGDGRRLVQIALTDIGANKRAEARLETLSHTDSLTGLLNRAAYAAHLERLEAERIVPTSVIVADLNGLKAVNDRRGHDAGDALIRRFGRVLAARTPASAHAARIGGDEFAVLLPGTGAEGAAALALRIAEGIERANGGADIPLGVSLGIGTWTGEGPLKAAVTRADARMYAAKRGRRGRVRVA

SEQ ID NO: 4246 - protein, 84 aa, Methylobacterium sp.
MSDEITLVAEQCRAARALIGWSRGELSERCGVAASTLADFEAGKRAPYPRTLADVRRTLEEAGVAFIQASVDGGAGVRLKAGVA

SEQ ID NO: 4247 - protein, 394 aa, Methylobacterium sp.
MTLEEALKVASDFIEAQDPGNALNLYQQIANRIPTHVEARLGMAKAFLLQDKSLQAKSTILNVAIGNATDAAVLSDCAGILEASGFHDEAAAVRQLLVDLGNNVSRILNLLSDDLSMIDLGSSGQAVIQAPNWIAPRIAFTSLDALSVGSNHSRFGAYHPVREVIAPEAGPAVFHERAFLPCSSLLDIDHETFRAFGLQDLSAIVKSHEVVATTLADVLRDARIDRIDYIKTDLEGMDERVVRSAESLVAGAAVVQMELRFLPLFEGEPYLDETVAYMRGRGFEVLHLSTETWRYNTEHRDYTQRGRSIFADTTFIKNFEAYSLIHGKSDETVVRYCLICLLSGNVNYAEYVIETHGALVDPSVRSALKFLIFPLGNAQPAPYRRESLAHVGFS

SEQ ID NO: 4248 - protein, 810 aa, Methylobacterium sp.
MSEVLSFPPPAAAARRGWSQQELAEFYRVEAALVRAGLPIDSEQGLSDEAEPWFVFCRPDGAPIMHFARIGGRYLVASEVLDSPLWGDDFRGLINQVALRHPELLPIRQGGDGTRVTVHPAALLAALVAAATVILSSEDAEAAVLGNAAAPVPAGQLEQAPPPRTGGSAGPAEAEERDSHRMQFEALVVSAMIFAAFAAEEAESRAGLESLADPQVRTATQQDAPADAGSSASLDGAVHRSGPGTQQAQGTAGAVPAGSGSAAQPGAAAGVRPVGAEVGPDGPERAAPAPGGSLAAAEPNGHVVLRPGEAGPARAAGSPASVEPGPERSAASSSAASLGDAAGSPRAGADDTAVQSQPRSVAHPVQDAVSGGTARIERVLHRDADKGATEADEAGRGAAKGIEGEKGIRGEKGTEGAKIAGDGHAGRGPAERPGESSGKSDPGRRDSDDDLDRGGDRGDDHGGPAAARGQHAVASADAPTAEPDAISQDGRGDSRPANGSDKSDPSEHGSGKPGASAESASASHPATQASETHPAQGAEPSGKAAGGAEQSSGHGADAPGSGEHGSEKAAAASAAHAEGGPSAATHSPSSGSGRDGNVPSQHGEDKLAPAGQGEARPGASGEAASASHPHGEPTHADEAPSAGAHGRGSHGPGQTTGLGTDSAAPDPRDAAGKSAAASHLADRPLDVNRKPDAGNLETDAGHGRAADGAVLAQQPDPAVHAPAASHQTPPQTDDGSVQTRNAGAASAQGPGKALAASVDAHGNIVFPSDPGHDSAPAPGHVQVYDGAHAEVGLVGLADHPGQMYHLDLHG

SEQ ID NO: 4249 - protein, 136 aa, Methylobacterium sp.
MDESEIHTLAFLLDFDGRVHWYEQGYFVKFEIKRIEPTKERPHGLRYSFTLHAPEGERMMGFDNAHTIAPGSRYAKRQVEADHWHRDETDRGRPYTFTDAATLVGDFFGEVERILTERGVPLDAVREGTIEERTKP

SEQ ID NO: 4250 - protein, 283 aa, Methylobacterium sp.
VICDLWSEGCNAAAVLDLIGKGAHIRTVEGFHAKTYLYSDRVVLGSANASRGGLGAESEPSTRTETALWCDDAAVLEEASSWFETTWLRGTPVDAVMVEAARDELAAIRDARRISLLHTLAHEPKPFDGLDVYVTLYEDEGVSEEAEQTWDVVRGKYGADDRAAYEARGEWPFYEVAGDQLENCPEGRIYLDFTRGKKGKLTFNGIWKVRTGGHEPVGDTGRFLVLLDRLPSIHGRRIIDAEMKAFAAALASISSEDRAVSSKEIREAARQAFQAAAKQPSGK

SEQ ID NO: 4251 - protein, 171 aa, Methylobacterium sp.
MIYVAPEVHRAVRQIALDEDRSTSEIYVEAARAFLAHRGVALQGHPVPAAKVEPEPSRPIIAPSVTTDDIAGLMDALAHRIEAVLERAVERVGSPSKDDPSPPAGIRTADAMTAVLRMLREAGSDGIGSAELDQALHAARIRSGTAEQAKAVLRDAGLARYERRRWYSASG

SEQ ID NO: 4252 - protein, 108 aa, Methylobacterium sp.
MASQLSLPMPTPGVTSEDEALVRAFVADILPRDVPTYVRRVLGVASDRYGFVARIELPDGGWCDVTITGRLGEGGYAWSFPDGGAPFGWDERRRKWVRYPKLKKADDG

SEQ ID NO: 4253 - protein, 54 aa, Methylobacterium sp.
VTAVTARQAWARAATEDEILAAGISLPVALVGADLLAAIRAEAAEDAAAAPEAA

SEQ ID NO: 4254 - protein, 279 aa, Methylobacterium sp.
MALILILIAVGSVAFHLSSPWWWTPIASNWSYIDTTLIITFWITGAVFVGVVLFMAYCLWRFRHRPGRRAAYEPESPRLEAWLTAVTALGIAAMLAPGLVVWSQFVRTPADATEVEILARQWRWSFRLPGADGRLGAADIRHVGDDNPLGLDPQDRAGRDDIVVDGGDLHLALGRPVKLLMRSYDVVHNFYVPEFRAKMDIIPGMVTHFWFTPSRTGAFDAICNEVCGTSHYAMRGRVIVEDEPAFHAWLDRQETFARRAARSTGRREAGLHRPATDAR

SEQ ID NO: 4255 - protein, 588 aa, Methylobacterium sp.
MSDAITGPQGGSSLLPEADDLYHPHSWWTRYVFSQDAKVIAIQYAGTALAIGFVALVLSWLIRLQLGFPGLATFIGPAEYYQLITMHGMIMVVYLLTAVFLGGFGNYLIPLMLGARDMVFPYLNMLSYWIYLLAVLVLVASFFAPGGPTGAGWTLYPPQAILAGTPGQEWGIVLMLVSLILFIAGFTMGGVNYVVTVLQARAPGMTLMRMPLTIWGIFTATVLALLAFPALLVGAVMMLLDRLLGTSFFMPAIIEAGQRLRYGGGSPILFQHLFWFFGHPEVYIVALPAFGIVSDLISTHARKNIFGYRMMVWAILAIGALSFVVWAHHMYVSGMNPYFGFFFATTTLIIAIPTAIKVYNWVLTLWRGDIHLTVPMLFAIAFIVTFLNGGLTGLFLGNVVVDVPLSDTMFVVAHFHMVMGVAPILVIFGGLYHWYPKVTGRMLDARLGQVHFWITFLGAYLIFFPMHYLGLLGVPRRYYETAGLGFVPPSAETLNAVISLVAFVVGAAQILFLFNLLRSLRHGAPAGGNPWHATTLEWQTPETPPPHGNWGPTLPVVYRWPYDYSVPGAPEDFLPQNQPDPVRAGAVP

SEQ ID NO: 4256 - protein, 245 aa, Methylobacterium sp.
MTHTAAGDGTALQESPSNLPPTRRHRLSAEWAGDRQVFADASWRKAMMWIFLLSDTFVFGCFLIGYMTVRMSTPVPWPNPSQVFAIEIAGTPWPLLLIAIMTFVLISSSGTMAMAVAFGYRRSRRTTALLMGLTALLGAAFVGMQAFEWTKLIHEGVRPWANPWGAEQFGSAFFMITGFHGTHVTIGVIALLVMVRKVWRGDFDTGRRGTFTSRPGRYENIEIMGLYWHFVDLVWVFIFALFYLW

SEQ ID NO: 4257 - protein, 66 aa, Methylobacterium sp.
LPECLTRFLDMPLPGAPAPAAPPRVVQPRAVSRRHPNRALRGTLVWALLYNLIGFTVIAMLWQAMP

SEQ ID NO: 4258 - protein, 237 aa, Methylobacterium sp.
MTSAQSAPRPDPDPAGQAPPPGASAFLTELRDRIGTEVGISAWILVDQARIDRFAEATGDRQFVHVDPLRAAAETPFGGTVAHGYLTLSMLGGTVGEVLPAHPSVRAVLNMAADKVRFLAPVRVDTRIRSVFTLTGVSALPEGKAALRLGAAVQAEGDAGRSVLTAELTLMLLLEEAARETPGSSDRPAVPDRPVAGPDGNLPAPQRSPIRNHQTPECHTASGSRDGDPESMPPLRR

SEQ ID NO: 4259 - protein, 153 aa, Methylobacterium sp.
MQRFVRAKLHGIRVTGADLNYHGSITLDADLCREAGLDPLEFVEIWNKMSGARISTYVLYGPAGSGCCVLNGAAARTCQVGDEVIIASASYGSVDDVIGHKPRVLIFGEGNRVVDRVVYDVFRDDQGRLDMRIIEAETGAEEPPRVATQIRVV

SEQ ID NO: 4260 - protein, 516 aa, Methylobacterium sp.
MAHSWKRDRAAEHIAAKIKDVKKVEIVDFKREMSLGNIPTAKAYRMEAVHIYADILNLDDMLNCTSSEGETCHKRTLRFLDLHGRSVRRILNRTDALRVDFHNQRLHAVVHKPYDSDDEDGSAEARRLHRAVAIAQLVIDVCAATGDDDEYVPAARVRVGIDSGLALVVNNGRNGGREPLFLGDPANHAAKFSAAGSAVGIYLTNNARRAIGLPEVKEPSKTKLTASEVALSQADAELGLDVEDLAEEWRADLAKNPLSNYGFSRHTPPLRTIDISVLTPSNSRRQEAVSVYADIDGFTAYVARHLEAGTSEDVVRALHVIRAELDRVLGVDFEGRRVRFIGDCVHGLLCEGTAQTTDDEETVSTAVLCAGGLRSSFELALEKLDEEGVDVEKLGLAIGIEFGPMTLTRLGAHGDRLRCSVSRGVLASEAEQKRCTGTQTAIGQVAYDTGTQAVRDLFGPSRRFDGLDYNEAVEGLAADGDQTAKAIKAEAFAAAAPAVKRASDQVVTPYVEVGGE

SEQ ID NO: 4261 - protein, 169 aa, Methylobacterium sp.
MNMIIKGTVIGIGSTVLGDVRTNPSGREIWVGVRIRTEDGKSRFLKGMLVEAEAALIINEAVDRGESVELWLSGKPERAYPYAVRTAREGWYYDGYSDYLRGQGLKTLGIGILMLPLLGIGILMMIGSIGYFIASNQFAAQRSRAAFERGYEAAVSSSGSNEGGRLQAA

SEQ ID NO: 4262 - protein, 216 aa, Methylobacterium sp.
VKLLLVDDHALFRDAVRRVLQAGFPEALIEDADSIEAATAALGHRPGTDLVILDLSMDGIRGFEGFMAIRARFPRIPILICSGLQEAPIIREALALGAAGFVPKTSNRAAYLEAVARALEGEIFVPDSVAAAPSAGPRSASAASARMFTLSHAQMNVLILIKQGLSNKEIALCLGIGMSMVKTHATEIMRKLGVRSRTQAVIFASALDFERIGTGG

SEQ ID NO: 4263 - protein, 70 aa, Methylobacterium sp.
MSCRHQPDAPRPGSLQDAPSFARKWRRFPSALPPACNDNHRPGRLRAALLAGSGIAGLLVGLVAVAAALI

SEQ ID NO: 4264 - protein, 349 aa, Methylobacterium sp.
VLAAKLAAVRHHQGRLLGRMEALGLALESEAVFQTLVKDALKTSEIEGEILDQAQVRSSLARRLGLDRAGMVPVERPVDGLVAMLLDATTGFAAPLTEERLFRWHAGLFPDGGHGRREFTVGGWRTDRLGAMEVVSGPLGRERVHFRAPPAERVPGEIAAFLAWFETDDPGLDPVLKAAVAHIWFVTIHPFDDGNGRIARAIADLALARSEGTGRRFYSMSARLRVERAQYYETLETTQKGDLDVTTRLAWFLDVLDAALTDAETTLSAVIRNAKTWETLTTRALNERQTRMVNRLLDGFEGKLTSSKWAKIAKCSQDTALRDIEALIAAGILVKEPGGGRSTSYALAL

SEQ ID NO: 4265 - protein, 310 aa, Methylobacterium sp.
MTETLVFASAVDPVEPWREALEGLLPDIRVRTPEEIGPQDDVRYALVWKPPTGFFARHPGLRLVTILGAGADALVGRDDLPAVPVARLSDPEMARMMTHYVLFAVLRYARNIPAFEAAQRAGRWHYVHPREAREIRVGVLGLGELGSAAALELARQGFSVAGWSRTPKALPGIDCQAGPDALIPFLARSEILVVMLPLTPQTRRLIGAAEIAALPRGAALINVSRGAVIDEAALVAALRSGHLGGATLDVFETEPLAEGHALWGMENVLVTPHLASVAIPASAARQIAENIHRVRTGHAPEHRVDLSRGY

SEQ ID NO: 4266 - protein, 151 aa, Methylobacterium sp.
MTAPIPILFLNGPNANLYGLDPSGTYGTESFPVLKARCERHAETVRVALDFRQSNHEGVLVDWIQEARGTAAGLAINAAGLTYTSVAILDALLAFPGPIVEVHMSNIWKREPFRHHSYVSRAATGVVAGLGGLGYELAVTALARLVRETRP

SEQ ID NO: 4267 - protein, 374 aa, Methylobacterium sp.
MNAQTSVPGSSSPLGPGDLFPQVAPRTQGRPSFAIDTLAGRYIVLCFFGSAADPQGAAALGTALRERARFDDSRASFFGVSIDPADEAEGRVRDLMPGFRIVLDFDGALSRRCGVTSEGEGPRPYRRCWMVVDPTLHVAATFPLGEAGEAALFGYLDALPEPAAYAGFEIPAPVLVLPNVFEPALCRHLVGLYDADGGSESGVHRAGAGVMDHSFKRRRDCTIEDPALIRQIQQTIHRRVVPEIERLFFMRITRMERYIVGCYAAEDGGHFRAHRDNGQGLTAHRRFAVSINLTGDFEGGAVSFPEYNPRGIKAPPGWAVVFPTNILHKVSQVTRGRRYAFLPFVYDETGAQIRQRELARQAEAAVRAEVAAEA

SEQ ID NO: 4268 - protein, 378 aa, Methylobacterium sp.
LRAFVRQAGAAGQGVSEPSSSRVSEQASETAQSRGSRRLWLHAVAYGLILCIFAADVVTPPDNVSICFAYTVPILLGVYTGPRAAFGLALATTASSLLGSFIRPPSGGIALSFVANRLIATAAQWLVAFLIEQRKRGRAIVQAHLADERRKAETGQRFVRILTHEIASALTAIGGQSARLAKLAPGIEPAEIVARTDKIGQAVARLDALVGRIQLAAEVDGGEIALAPEHTPCMEFLRPLHTEYEAGPELSLTLVCGAETIYGDRGLLYQAVSNLVSNAIKYSHAPAAVTVSVASSDVTAGPMITVSDRGIGIDADEVERVFEPYYRARNSTGIRGLGVGLHIVRHFVEAHGGEIRIASRPGQGTSVSLHLPPEKVAA

SEQ ID NO: 4269 - protein, 455 aa, Methylobacterium sp.
MHKLVATIRRSALSGPFATAFVTRFGSAVLGFLTLLAASRLLSTYEYGVYVFLFSIGSGVGLVAVLGQQNLLLKHYRMDGASAAANGVLVRHNLAWLGLALALLLGTGSVLVLAERNLPEPYDRLHLALAFAAVFAVSEYLQNFFRIHRRFALALLPREIVWRGGCAVMLYLGSLAGVLYGATEAMELVLALFVAATAFQVVHLVRLHGADMRPGRAGAAPSEQGAERAAWRSQSLFFTANNGLHALSLYLETVIVGAVLGMEEAAFYFVALRYATLLLLPVAAIDTVGLPMIAARIQAADWPGVQRLVARLSFASFLISVAGALAMLVVGPYALALFKPDFVAHIDVLSVLCLSSVVGAFFGPGVSLLMIGGGERFLLVSNAVLFGVYGLLLCGLADVLGMLGVAVASLVVTLSYNLLVVFWVRQHWGVDNMATAILRPSTGAAGGLVPRHAAG

SEQ ID NO: 4270 - protein, 145 aa, Methylobacterium sp.
MLRPRDAEAASAALKTFDFAERHPEWVFLRVEAGCRAGRCMTIIARADETSMTPELLLNVGSSVLFNDYSFGLSGLNAWSDIVFDGAGSSAVTVTRRGDHWVVGACSDCNSWAGVKEPEPSLPEPSPPKPERFEDFHRFIDGERG

SEQ ID NO: 4271 - protein, 117 aa, Methylobacterium sp.
VAYLYARGGNIGLRSFGAHEEGSGAVATVKGHRVTIAGGFTRSGKAPSRHLVRKLGGQVFVNTKGKKWRGHMTKVKSGVYIPSEMTSGSTLAAFERVAAAELPAEAAKALAALLPGK

SEQ ID NO: 4272 - protein, 146 aa, Methylobacterium sp.
MPLVCVTRLRVRALRFLPAFALHAVRTARQVRAAPGFRGGAILRDRDWAWWTLTAWDRPEDLRSYMQAGAHRAAMPHLAHWCDESCTVHWDAAELPGWAEADKRMRDEGRASRLRHPSPRHETLSYRPPRLSASAPLRPSPRAAGM

SEQ ID NO: 4273 - protein, 452 aa, Methylobacterium sp.
VAAGGSLTINGTGVETGSTARQGGTTGARPGFGAGIFFEGGPTSGTAATLTFGAGNQSFASQIADLNGAAGNTTTGNGLGGTGGVTALAKVGTGTLTLGAANTYTGGTRLDAGAISLGRLTSAGSGAITFGSGAQTLRVEASGTLGNTLTNFGSDGDTLDLATINPNGATYTLSGTTLTVREAAANGLDSNTFTLNAVPSGFQFVLASDGQAQAGTTVRLQAIPTPPPDPGPAGPTSGDDNLVGTSGPDTISLGLGNDTYAGGAGNDLVYGNPGNDLIYGNQDADTLYGGQGDDRAYGGQGDDRAYGGQGDDRLFGNLGNDVLLGNLGNDIVYGNQGADIVYGNQGADVLYGGQGNDVLYGGQDNDTLVGGIGDDTLVGGLGADLYRFDPNSGRDLILGFNQGEGDRIALGGQTYTVSSAQNGDAVLLLSGGGVVDLVGIRADQVNAAYFAA

SEQ ID NO: 4274 - protein, 161 aa, Methylobacterium sp.
MHAKHPARSGRIPSGRRFGLAVLLGHAAGAYAFCASGILFAALSDLATAEGRAALAPVNWGRLIEGICVFPLVTVVLALWAAVLMVPLTLLILPIAWLAARRLDADAAPTAALGALASLLPAVIAFRGAPVLDLRPYGSAAVAGAAFAGIVWLLCIRPRRG

SEQ ID NO: 4275 - protein, 311 aa, Methylobacterium sp.
MHSDPETLAPPQLSLLVCTRGRSAQLARLFASLESQSLGDFEVVLVDQNEPGVLDDIVARHRGRLRIDHVRSLPGLSRARNVGLARCRAPLVAFPDDDCWYRPALVEEVVRLFAQHPEADALTGRTIDAQGRESLGAFLKSDQAIGRRNVWSAGNSNTLFVRRAAAEAVGGFDETLGVGAATRFRSGEETDFLLRILRQDRAVVFRHALTVHHDQVGNQGRHKRASDYAHGFGRVLRLHRYGLPYLGLRLARFAASGARALLRGDARTALDKALWAAGTAAGFFAALPGSASRVPDGAPSWRFRAGLTRGG

SEQ ID NO: 4276 - protein, 432 aa, Methylobacterium sp.
MSEPDTPDAGPDRSSAVAAFQKRRPGATIHLQQDRGASWMAWFFGAIVVALVAGLFLGRFARSESVRGYVSAASGLTRLDARAAGIVQAIDVKQGDRVTRGQRLMQIQVRDQTTGGVSTVTANLRSLRERKANLQRDRERLIAFLDATRGDRSETESNVASVTRAFDEQERALKEGLRQQEEMVARVQSYMNQGYATRESLNGQRRIALDYARQIAELRARRAELKQSTAERLTGQRTTATEKAAQLAATENELSAIEAQLTGYSALERLDIVSPVDGQVAGLFVEPGASVSADQILAIVGDAGAEPVIVLEVPARAIGLAKVGQDVVIKYDAFPFKTFGIAHGTITQIAGTPLRAPAVAMADAGEAVFDPTSLTRQSTYRIDVRPDSRTIRAYGVDEPIRIGSTLSADIVVEKRRLIDWMLDPIRAMRGRG

SEQ ID NO: 4277 - protein, 716 aa, Methylobacterium sp.
MSEWLRGLTGGRRRVRSLVQSETNECGLTCLAMVANYHRHDIDLAYLRALFPLSRTGMSLADIVELADTLGLDAGGYALSNIDELKGVQLPAILHWKGNHFVVLESVRGGRYRVHDPEFGLRLYERADMEQLFSGVVLEFAPRMDLKRVRAERKLTFREVFRATSGLGSTVWQISLVTVAIALLGLAMPVLLQIALDVVIPQVDLDLLHVLAIGLVLLMGFEAIGRWLRDYVTLRASTLLQLQFTRNVVGHAFRLPLNYFELRHPGDFVARVDSIEHVKAFLVGGLVTAFADSATSILIIGLMLYYAPAMAVVTMLTLVAVIGMRFLTFPKLNQATFGSLEARSEERARLLDGLRRVDSLKAHNGTELFAMRWFESFSRFANLDFRARKAGIDAELFMHLVIVLSTVATLYMGIVGVIANTLTIGTLYAFFALRTEFFERVNMLTSNLMHLSAMRVHFQRLDDVLGQEPESGLQDATFHRTLNREVRLENVTVQFGRADEPILRDVNLRIDLAAHETVAIVGVSGSGKSSLMKILASLHEPAEGRVLVDGSPLAQFGKREYRSNLGVVFADDGLFAGTVADNLALFDPAVSRAEMEAALVCVGLRDEIERLPQGYATLVSEEGGLLSTGQRRRLLLARALCRRPRLLLLDEVTANLDPTTEAALVESLKGIRAAKVFITHSERMLDQVDRVLRIEGGRLVEDARAPGAGRRIPARA

SEQ ID NO: 4278 - protein, 79 aa, Methylobacterium sp.
MHWPAAYAAYNVFRRRQYPALRCAVRQDRPVPGFIHGVIWEYGGTVMEERPPEGFQPADAQAATASAGYYLFRAPHGRA

SEQ ID NO: 4279 - protein, 416 aa, Methylobacterium sp.
MVSVKARLSAIISVLSVFALFTSGRDLSSAYERWGRADLVSHLAAANLMLSRGMSDVRFERGAAASALALDPAQMGANLQDIAARRRTVDGGLPQGLAILAADSVGRDAPEARELAERYAAWQRTRVEVDANLTKPVGARDPALPKRLADEAGALTAAAEALVGAMENQIRRRDAGLSNLLRVRELTWAARTFAGNAHLIVNDALAQKRVLTAKETLDFHVLDREAAFAFGIAQKIVESLSGMEPLKRAVLGARDGYFQGPFQARTRALLPALADLSLPRPTLAESRGQSTPALSSIMTVALTAVTELDGAASGIAAEARRDVMVQGIVMALALVLGLGGMVWVVRGVSRPIERMTSAMQRLADGDTASEIPYGERRDEIGAMSGAVQVFRQNLVRTRELEAETALARASAEEQRK

SEQ ID NO: 4280 - protein, 278 aa, Methylobacterium sp.
MDLRGLHAFRIVAESSSMTAAAERLGTVQSALSARIGQFEAAIGTRLFERLPRGVRLTAAGARLLPYAERMEILAAEAVQAARGTGTIGPFRLGAITVVAATLLPPVLARLLADHDRLDLQVATGVSRDLDAALADGTLDAAILGHRSARAGIVSRPLDSIPLALLRPTGVPIEAVGQAFTFAAGCVCRERLDRLLRERRIGARIVELGSVEGILGCVAAGLGVALLPEMLARRDGLAVERVGRLDLFIGSRPEAETQVRALLSAYRACRAAFEREMP

SEQ ID NO: 4281 - protein, 808 aa, Methylobacterium sp.
VTLGSGNDSVSLYTGVVGASAVTVADQILGGANTVTLRAAGDYAAAVFGAINLGVGNNTLSLRGAGTTVGGGAGSTGAAGSLDLSSVTGATAITKSDIGTWTLTKSGTNTNAGTLNVHAGTLALGTANALAAGSSVAVSGGNLSLGANNQSVNGVQVTGGTVGGSATLTSATAIDLQAGTVSAALAGSSTVIGLTKSTSGTATLTGANTYAGATTINDGTLAVSGGSAIADTGAVVVNTGGTLAVNAAETIGSLAGTGSTAAVNLTSDLTVATANGVSTAYAGGLTGAGSLRKTGTGTQTLTGSIANAGIDVAAGALVIGDGATAANSATLLVSSTNSTLRIDRTQAIMLANIVSGSGRLEKAGSGTTTLTGNNTAFTGTAAVTAGTLAVNGTLGDTTNQAATITVGDGTNANTGTLGGSGTIAGSVSIRNGGTISAGNSPGTLSTGNLTLATGATLMEEITGTTAGSYDRVNVTGSVSLAGTLDLRVTGTFADTVGQNLVFINNDLTDTVTGRFDALRLNGASVALSNSNTFSVDGRSYQLSYQAGDGNDVAIRDVTPAPFDPGPGPAPNTPTPGDDLIRGTGGDDRLVLGLGNDTFMGAAGNEIAYGNQGRDSLFGDAGNDSLYGGQDDDDVRGGLDNDVVYGNLGADIVYGNQGQDTLYGGQGNDTAFGGQGDDRLSGNLGDDIVYGNLGNDIVYGNAGADVLYGGQGDDVLFGGQGDDVLLGGLGNDTLVGGVGADRYAFAANPGGLDLILGFNQAEGDRISLGGQTYTLSSAQNGDALLTLSGGGTVDLAGIRAQQVDATFFA

SEQ ID NO: 4282 - protein, 74 aa, Methylobacterium sp.
MQAVQCKMARTALGLGVRDLAAAAGVSADTVARFERGDALKERTVTALQSALEAAGVIFIDENGEGAGVRLRKK

SEQ ID NO: 4283 - protein, 54 aa, Methylobacterium sp.
EDIIEPYLIQQGFVQRTPRGRVLTPQAFRHMGLAVPSADPGRQPGLFPDDGADA

SEQ ID NO: 4284 - protein, 421 aa, Methylobacterium sp.
MERRGRGLGPLRVLGAGVITGAADDDPSAIGTYASAGAKFGLGFLWIAPVLLPMMVVVVYLSAKIGRVYGKGLFAAVRDRYPPALLYPVAAGAFVGNVIEAAANLGGIGAALGLVVPLPVPVIVAGAGLLVLAFQFLGSYALLRRIFRWLALALLAYPVAAILARPDFGAVLRATFVPGMRFDAEFLAMLVACIGTSLSAYVYTWQSNQEVEEQVAEGKRSHRQRRGASDRELAATRRDVVTGMLFSNLILYSIILSTGATLHPAGQTEIESAAQAAAALEPLAGAGAKYLFAAGIVGVGFLAVPVMTTGAAYDLVQALDRPGSLNARPSEARLFYGTILVVTLVAVGLNFLGFNPMRALVWSGIVQGFSVPPLLLLMMLMTRDRRMMGERANGRLTAFLGWTTTAVTVAAALCLVATWIL

SEQ ID NO: 4285 - protein, 315 aa, Methylobacterium sp.
MRFTLRQLEYFIAAGQTGSITLASERIHISQPSISTAIAHLERELSVQLFVRHHAQGLTLTPIGREVLREAKALVEQAEGLYTLASEAGGQVRGPLSLGCMVTLAPMLVPELAHAFTTAFPATQIRYVEGDQEQLITGLRRSETEVALTYDLHVPDDIHFTPLVDLPPHVLVAEGHPLAEHAAVAMTDIVDEPMILLDLPLSREYFLALFMAEGLQPKIAARSAHQEVVRTMVANGHGYTLFNVRPRSDLALDGKRLRRVRLAGTHRPMRIGLARLKQLNRSRLVEAFETHCRAFISDAYIPGMVAPAIERRVPR

SEQ ID NO: 4286 - protein, 104 aa, Methylobacterium sp.
VKRFTLAALAALTLGTTLAAAPANAQYYDDGPRRWDRGYEDRYERRRRDDYYEDRYERRRDFGRRGGSICVTSRGNCPTRPAPFNAPCGCEIPGFGFKRGAIGG

SEQ ID NO: 4287 - protein, 371 aa, Methylobacterium sp.
VTDRLAILHVVRQFLPNRGGLEDFVANLAREQVRLGHDVRVLTLDRLFSEPGLRLPSAERIDGIAVERMPFRGSSRYPLAPGFLGRLKGADIVHVHAIDFFFDALALTKPLHRRPLVATTHGGFFHTQAHAGLKRLWFHGPTRLSARAYGAVVGCSDSDARQFAAIVPRGVPVIENGVDLAKFAGAASPVPRRTLLTLGRFSHNKRLDRLIALMRALRAQESGWQLRIVGVPSDLAVADLAAQIEAAGLGGTVSVHAGLDAAEVRALIGEASLFVSASEYEGFGIALIEAMSAGLVPVVHPNASFTDLAARHPGIALCDFADPAAAARAVREAHARLAARGRPPAEDLERYAWAGVAARYLDAYAQVRRAA

SEQ ID NO: 4288 - protein, 76 aa, Methylobacterium sp.
MTEADRNTTLVRLIRAYPALREELLDHWCEIVLMELRAAAYPEPDCPPVDEGVTARALERFRALEVEVLARSPQRF

SEQ ID NO: 4289 - protein, 71 aa, Methylobacterium sp.
MPRALPNRRGPRHHLLPHRPARHHAHGRRAHGAEAKTLRTSDLVLALLGVVLLGGLALLAAVALTAGAPAP

SEQ ID NO: 4290 - protein, 78 aa, Methylobacterium sp.
MPHFFFDIHDHELSHRDEEGSEWPDTASAQDQGRRLLADIARDEVFRHDPLHLSVSIRDDQRRVVATCALSLASTPVV

SEQ ID NO: 4291 - protein, 232 aa, Methylobacterium sp.
VSLVLAYLAALGAVAARWLARQHLADRPWLAVGSSPPIAAPAVPSSPARLGLCVFLASAGLLFSLLVAAYGMRVPRTAPVPLDPRLLWLTTSLLAGASLALHGARAAARRGREADVTAALGFASAAGLGFLGGQALAWRTLWQAGLAQGPDAAAAFFCLITALHGLHILAGLVALAWITARAALLPAPARLEPGIALCTLYWDALLAVWLVLFGLLFRTPWSGLIDALCRPG

SEQ ID NO: 4292 - protein, 110 aa, Methylobacterium sp.
MQATARATEQAHPIGLYLAVWAWLFVLSACSYLVDYLHLQGGVRWSLILLFMIVKAGLILAVFMHLAWERVALITVILIPPAALLIFIAVMAVEADYTLATRLARQVSGG

SEQ ID NO: 4293 - protein, 73 aa, Methylobacterium sp.
VLLVHLLDRFGKGWHRRLSLSALGERISTVTGHLAIGQRLLTSLSQRDEACAPEPDITASALYDGSQEPTLRA

SEQ ID NO: 4294 - protein, 266 aa, Methylobacterium sp.
MPAPNPAASPVPRSAGRPVPNASTTRDPLDSPLWPSMAERYLGGLPAIFDDRVAVALPPVTEDQTQVPLTVDARAIGPVEELLVIADLNPFPLTLRLVPKAAQAFVAFRMKIEQGTPIRAAARRDGLWHVGGRYLDAAGGGCSVPPVVEKKVDWPNLGRMRGRVWREADDLRLRLRMTHPMDNGMIANVPLFIVETLTVSDASGRQLASLTLSEAIADDPTLTLLVAGPETEALTVTARNTAGNDFRARAAVPPADAQSAEMQGRP

SEQ ID NO: 4295 - protein, 89 aa, Methylobacterium sp.
MREAVTGWLSRLGHEHMAAAAFLTGGPRGGQVPPMPTFTTFRKIGCVPAEPKPGHTCEFEIAVDGKPAAKDRARFYKAPNGSLEADAAR

SEQ ID NO: 4296 - protein, 87 aa, Methylobacterium sp.
MGLSAKPVRVAKQAPADAVEAFISKGGSVPTGAPDAAPKGAQHPLKFPPDSDLFERLERARAASAVKLPRNTWILQAIAEKLERDRT

SEQ ID NO: 4297 - protein, 309 aa, Methylobacterium sp.
MLQDASPSQSGGIRLIIVGAGASALTLASHLLRQDARAQVVLIEARAEVCAALRRGAYATILRAGLADAQAWLPPEAEAATHPLRLVRELVAHRDRLHVVQARCTGVAPTSQGIAVATEAGATWLGHAAAWAPPLSAVRCVPAGRRLRAVPASRARGRALRLDATDIPLGTGIAYLTRWLRATVRAADRRGIPWTEVLDGLRLHGPEVWRHLTPRSRATFLRHGFAAWNQLTTGLPDEARRASAAGPERGGHVFALHPVDLMPYAAQTNLLDLDIACASLAGRVLRRSTGADHPGALRRGAQPRLRASS

SEQ ID NO: 4298 - protein, 155 aa, Methylobacterium sp.
MRPRHPARLAVPVAWLLAAMGGALAADTAPATDLPDLSAARARIYAGDYGTAAAELGALTATVRHADLYNLLGFSLRKLRRFEEAARWYREALFYDPTHRPALAYQGELFVEMADLAKARNNLKLLRLLCHPAGCEEARRLEAVLAAADPSGTLR

SEQ ID NO: 4299 - protein, 547 aa, Methylobacterium sp.
MTGTIVLLDLAGWVALLLWGIHMIRTGVQRAYGADLQQVLGASLGHPLKALLAGLGVTLVLQSSTATGLMATSFAAGGLVELGPALAVMLGANVGTALIVKALSFDVAKAAPVLVLVGAVAFRRAGGPKGRALGRIAIGLGLVLLALIQLVATLEPFTSAPGLQAVLRAVSADAVIALLLGAILAWAAHSSVAVVLLVAAVAQQGIVPVETALALVLGANLGSSLNPLLASREAAGRRVALGNLLVRLVGCAAALPILSWSAASLTPVAGASRDAVADFHVLFNLALAAVGLPLLRPLSVLVVQLLPDRTAAPTEPPLHLDEGLAEPPSIALGLAARHALRMADRLEVMLTDSTRLLSGEEGSQERIRLAERDIDTRGAEIQRFLAKLDPEALSGAEQRRLAALVSFTVQIGHAADVLARNVAAQISRRHKQAGRPQFRADGDLTTMLDRLSTNLRTAASLLVTEDEVLARRLADEKQGFRSLEETRIASHVASLRDVASFEPLNRVADLDLVRDIKRINDHLVASSAYPILMKRGELLESRLKYAD

SEQ ID NO: 4300 - protein, 333 aa, Methylobacterium sp.
MDRSLLGQAVIEAEVDRLQRHAQFRKSPKLAALLVYLVHESLVGRGKRLKAYTIATEALGRPDDFDPITNSIVRVEMRRLRGTLQRIYAEAEPHQVVVELPVGRYEPVFRHPRTNGSADAAGKPDAHLSAALHESEERYAALVKASAVIEWRAEPNGHITRSLGWSERTGQEEEVYRGMGWLQALHPHDRGRTARSWVALCRAGAAFALSFRVRQQDGHYQPMLVRAVPLEQAGGTCRGWIGTMVEQIFPASGPTKADRGDLQQVLHRESEMARRVLKVAQQTVLDIDRKEIGRARAIIELNTRLRGTGVTIGEADRAAAASTGTSTPEIRPR

SEQ ID NO: 4301 - protein, 333 aa, Methylobacterium sp.
MISPIATPAASPLKEAGRGGRLTGNAAIAAACLALALLPVLLGASNYLLGLLISALILSGVSLAWALLGNLGGMVSFGHAAFFGVGGYTSALLAAKLGLPVLLAVPAGGVVAVVASLAMLPALRLSGPYFALAILAYAQIFRILATEAAWLTGGAAGFQRYPGLPTVFGFDLASRTGSYLLLVGIVALCALAYLAVRRSHVGLALRAIADSEDATRVVGVNSTFLKSLMLLLSAFITGVFGALNAHIIGFLEPDYAFSGIWSLMPIIAAIFGGYRTILGPIGGALIIYLFDQVVAKGLIAVGHQIILGFVLVVMVLAAPNGLLGLVKKGGRDA

SEQ ID NO: 4302 - protein, 523 aa, Methylobacterium sp.
MHKGTAFTQEERESLGLEGLLPTAIETLDRQVERVIGHLGAKPNDIERFIYLQELSNSNQTLFFATVMSDPARFVPIVYDPTIAEACLTYGHIYRRPQGMYLTRYMKARFEKVLRNWPVKEVRFICVSSGGRILGLGDIGANGAPIPIGKLQLYTACAGVPPESLLPIHLDLGTTNAALRADALYTGLREEPPEPGEVDAIVDAFMEAANAVFPGVCVHFEDWKGDDAIRLLKRYKDRYLVYNDDIQGTASVALAGIVTALQIKGEALADQRILFAGAGSAGTGIADMIVEAMRGEGLSEAEARGRIALFDIGGLIENGRKDLNASQKPYARDWKPTEDLTEAVKQIRPTILIGVSTVGGLFTEAVVKAVAKTCERPVIFPLSNPTDKAECTPEQAYQWTQGKALVACGVQFPDVTLDGRTFHPGQANNFYIFPAIGLAVYATKPKRIDDAMFIEAARATADQVSRADRDNGMLFPRQNNILETERTTATRVAESIFERGLATVKRPADIRAFVESLSYTPEY

SEQ ID NO: 4303 - protein, 150 aa, Methylobacterium sp.
LFRLIYKSAARHEAEEMFRPSNLPAILAASRRRNGEHGLSGVLVYTGAGFLQVLEGDRAEVLGVFERLLVDRRHRSVSVIEMGETERHLFGGWSMGFLGASPEIDARLEAAIGPVSGLERDPARRVELLRATLLLLVDAPISLLWREGLT

SEQ ID NO: 4304 - protein, 109 aa, Methylobacterium sp.
LDDTPEIREQLSQAWRSTLDAAVANGAPPQAVIETMVEVAHACFAEAFGATAAASYLQLLAEQLRAGERCETDELVRGAPDERPSRSFMPADAEALIDPDWLTRKDLFG

SEQ ID NO: 4305 - protein, 264 aa, Methylobacterium sp.
MDIWQRIENDHANIAQLIHETPNALNGPGVVRSRERLLGDLIDELDRHGAALAASLYPPLRRDPSTARLVDELAHEQTAFMRDLRALARRGGGAGWLNRFEDVTYAVDQCLHRHVHELVPAARERLSGDAAERAGHAYVRAKIEALRGRGDLLAGAGLVGGTAAAGAAIAAVAGLALLAWRLAARPRQTSNRASDHRSERAFGGAPGRSGPSRWQPLSDRAADAAPGERRDGEDMRARQERLLDESLEETFPASDPIAPKRITR

SEQ ID NO: 4306 - protein, 514 aa, Methylobacterium sp.
MPGRIVTARVGGRALLAGLAAALIAGPAGAQTLDQAAAAALENSFVLRADRARQDGAEARERGAFDAFMPTVSLLGDKPLSSRFTYGPRIEPTQIGIDSTPRSAPRQYGISADLPLFDGFQRLHTLRSAQALTDAGRFITLSQRQQVLLDAAVAYIAVLRDVRILAAREAQIGAIMRIRDATARQFEVNDATRTDVALTQSRVQEAEAARDRARAELAAARLAFKRVTQIEPERMVPPRFPDRIPRDELAYAELVRAANPGLAAARLDAKSAAFQASATVSAVLPQVNLQVTHASTFGYSPTLDRITDTTARVIARVPIYQPGAFPKIDEASALARQRGYEVQDQELATITAARTAFAKRVAIADQLRRLTERLTFLRATIRGFEVERGAGFRTVLDELNLRAELADAEVAAAAVLTERDALSLQLSAAANLLDVGQSVPADRRFETLAAVRDPLTTAALRRGGAAASVKLASRAGGDRPEPAAPALRGRIDEPAQARFGLVPYGRTGWVALTP

SEQ ID NO: 4307 - protein, 317 aa, Methylobacterium sp.
MTEIDTRIGFLARRIAGLPLRMRRRVLRATFTLSGLMRGFEKSGHARLFQRVLRQSSREARRLEREVNLHNLQTEAEWLALLVRSVPALLRDTRHVAVSDPAALERVAATGRPVILTPLHMGAYVFSLASLMVRFFPGRPLLVLRQRDDMPLETAVIERIREVGVAMRFHQVTDRMGFLEAVRFARNGAVIVNFCDLDPAYGAPAPMPVLGLDTRFAFGTDTLARLTNALVVPLACTMEPEGDLVRVGPTFEVHASAPQERARVAALVRTHIEASLRARPEQWHLWSALQDYLPVTDTVTDAAARTGEADEQIRTAA

SEQ ID NO: 4308 - protein, 409 aa, Methylobacterium sp.
MTDRVAPAPRVTKRYAAKRQAILDAAVGHFNARGVRGTALTDVAASVGLVTNSITYYYRRKEDLAAACYLRGLEWHTALLDAAQDCEAATDPAARLRAFLAAYFRDLAAIEAGTQPPQVRLGDLMALPSPQSDAVFAAYNDLFRRARALFVPERADLGRAERGARTHLVLSVVHTARLWIDRYEPQDYGRVAERIADILLGGLAGPDSRWSAAGPPLVRAPGGPTEPFLRAATVLINEEGYRGASVEKISARLSVTKGSFYHHNDNKDDLVADCFERTFAILRAEQAAAEARGGPGWDRLTACARALVRHQFDPGGPLLRCAAVGALPDGLRSEVPARLRRLWERLAFPIGDGVADGSIRPVDPTIAAQVVSSAIDAACDLGRWCPSAGPDNAPDLFVRPLFLGILTAG

SEQ ID NO: 4309 - protein, 422 aa, Methylobacterium sp.
VTALDARAPYQSRAAHCALMGALLFNAALCFLNTIGLPVTGGTVAGAEACIVMLALAFALDARAGPWLVLAVLAAYAILILVLRGSSDPKMVRDLLIPVAFYNLGLRAPDIRDADRAALAAGLVVVAMGVFEYAALPVYEQLFNVVRYYIARGTMTAAEINGLTGSLFVSGVRPDARTILPFLGPHRVSSVFLEPVSAGNFGAILFAWGLYRPGMRGRALLFGCAAVTIILADARFGAVACAAVAAALLAAHRLPRLLWFALPCAILLALAICGFESTASDRTNNFVGRLLVAADIITGLPVEGVLGISPEKVFVSDAGYAYVLLQIGLVGGLAAWLLFVLMPVGSADAWRLRCAAATYICLLLVISDSPFSIKTAALLWFLLGAADGAGEDPGCSEEEVAASAPCAGALVSPWPGLSGIAR

SEQ ID NO: 4310 - protein, 210 aa, Methylobacterium sp.
MIGEFYVLAPSRQRYLDLLPDFGKTPERKTTADSAGIIGYIIEAAKTAVHWIAESWTGETLSENPDPTTASNESSLVQMAVIDNRQLVLTGDVGPDGLHEAATYAEALVGVLSPTFMQVPHHGSRRNVTPSALNRWLGPIKPQGSATIGSAFCSAARLDEDHPRQKVVNAFTRRGYGVHKTKGRHIYNHHGTQRLGDSLAPEPFSDRVEE

SEQ ID NO: 4311 - protein, 246 aa, Methylobacterium sp.
MRLAPGLVLGALLAPLPVAAEEVAVDAGVWPYAAVGKLNVVLGANRRAFCSATLIAPRLVLSAAHCLWDGPRARWVGPQSVHFVAGWRQGTYNAHAVASSYRTGPGYAFGTTPADLARDWALIVLSEPVDIRPVPLAPAHIDDTPENGRQEIRRAGYSHARAERMSAQGQCAVENQSEPPLLLHDCRAIPGESGSALLRMGEGGPTVIGVLVARRPEGTGARSLAVPVRSFREEADRMRAELSPVR

SEQ ID NO: 4312 - protein, 267 aa, Methylobacterium sp.
MRARSGLRGGARLGHRGAVDSLFRDGLEDAYEPGRLMGSFGDRIAAEYGFTRADQDAFALESLRRALAAQAEHAFARELVGVPSGAAQVEQDEQPGKAKPEKIPTLRPAFSPDGTVTAANASSISDGAAALVLADAAGAEAAGLTPLARFVGTASHAGPPARFACAPVPAIRALLDQVGWGVGEVDLFEINEAFALVPMIAMRELGIPHARLNVHGGACALGHPLGASGARIVATLLGALKARGLRRGVASLCIGGGEATALALEIT

SEQ ID NO: 4313 - protein, 130 aa, Methylobacterium sp.
MRVLLVGYEPEVVDFSDPALPPGLDAGKIRHGIRVALEEMRGRGWTAEDCLIRPDDQAGPALKAKLSSGAFDCLVIGAGIRGWPRHLSVFERVLNAAREAAPTVPIAFNTRPEDSAEAVERVCGGQPTAG

SEQ ID NO: 4314 - protein, 62 aa, Methylobacterium sp.
VAPPQTVEFGRGLSPRDPTGILRGQGISSRHGGIGNMGGGSGRSANTGVGLGGIGANQGARF

SEQ ID NO: 4315 - protein, 333 aa, Methylobacterium sp.
MQRRSFLIGAGAALGLGRTARADVVKVRIGVGGKPLLYYLPLTIAERKGFFKEEGIDAEINDFGGGARSLQALIGGSVDVVTGAYEHTLRMQAKGQDVRAVCELGRLPAIVIGVRKDLAGQVKSVADLKGRKIGVTAPGSSTALTAQFAMIKAGLKATDAPLIGIGGGAGAIAAMKKGEIDAVSHLDPVIAKLEADGDIKVLVDTRTDEGTRLLFGGPNPAAVVYTKQDWIERHAMGTQKVVNAFAKALKWLAAASPEEIADLVPPAYHFGDRALYVQAVKNSLATYSRTGIPSRDGMNSVLELVRTLDPELQGAQIDLGRTFEDRFVKRAME

SEQ ID NO: 4316 - protein, 282 aa, Methylobacterium sp.
MDGSRHGSAERIDARVPQDAAVALRDVTIAFTLKGGKRYVAVEGIDLAVRPGEFVAVVGPTGSGKSTILNAAAGLLKPASGRVDIFGQPLGGLNGRAGYLFQADALMPWKTALDNVAVALEPQGVRRAEALERARAWLGRVGLATFTDRYPHMLSGGQRKRVALAQMLIRDPEILLMDEPFGPLDAQTRQIMGNLLLDLWAQNRKAVIFVTHDLEEAIALSDRVIVLSAGPAARIVGDFPVPLARPRDISEIRLEPRFHDLYREIWSCLRVEVTRAYADGPA

SEQ ID NO: 4317 - protein, 70 aa, Methylobacterium sp.
MANTMNAQCQSCRYFDTHKATQSAGQSGDEGLCRFNPPVTQPGPQEHGLWPVVSASDWCGHYSPEMMAGE

SEQ ID NO: 4318 - protein, 420 aa, Methylobacterium sp.
VSALALAGLASAAVAQEAPPLPRADPAAMGFSPERLARIGTVLNREVAEGRMPGAVLIIAREGKVVFHEAYGFRDKAAGAPMPRDALFNIASMTKPMTAVAVLGLVERGDLVLDDPVSAALPGRFAEQRVASLDLAGKLAGTVPAARPVSLRDLLTHTGGLVYGGRGTTEVHRMLPAGSVAAAKELDGEKFLDALQAAPLLHQPGTVWDYGFGLDVAGLVVERQTGRPLDAHLAETVFGPLGMRDTGFVIPPGSVDRYARALPADPATGKPQVLEPDATRPTKFACGGGCAVSSAEDYLRFALALMNEGELGGRRVLSPVFTRAMLTDQLGPGVRNLIGNADPTRADYGFGLGLAVRTRPGVVRLLGSVGDFSWPGSSGTNWWVDPGRKLAVVFMAHTPGAARWRYRYLINSLVYQALER

SEQ ID NO: 4319 - protein, 87 aa, Methylobacterium sp.
MIRIVKHVIVETTEERDRQVEQVEAAIRARFPDATTEVVQGLLDEDRVVEARLPLRQLAEWHVRRPQLLAEALETDTDHAADIDRQD

SEQ ID NO: 4320 - protein, 130 aa, Methylobacterium sp.
MKRFRPIVMAGTILGAVLGTVLGLGPIERGTTGSAVALAAQGCGPGFHRNAYGSCRPNAYGVPGTYRPYGAYGYRGGYAYRGAYGRRVYGGRVYGGRAYGARAYGGRVSGGRVRAGRAYGGYHGGLRGRR

SEQ ID NO: 4321 - protein, 82 aa, Methylobacterium sp.
MRYRPLPRQTLVLAGALTGLVVALPRPAEAVVCAGGVYRAGCVGPRGGVAVRRGVYGPRRVVVRGGAYRPRTVVYRRGVRRW

SEQ ID NO: 4322 - protein, 275 aa, Methylobacterium sp.
MSESPTDPGARAWSCDRFEIDAVAVCDMPLTAVFEHLRGAMDDGRQVALGFCNANMLLKALCSASYAAALKKLVLLNDGVGLDLCSLLFRGRFFRENLNGTDLVPALLGGETRERTLFLLGARPGVAEAAARNIALRYPQHRVVGTRHGYFAPGEVEAVIAEINAVAPDILLVALGNPDQETFIAENAHRIDARILMGVGALIDYTAGIAVRAPAPVRLLRLEWLYRLMREPRRLGRRYTVELALFLGLIVRLRIAALVRGRTVVAAGGATSSAP

SEQ ID NO: 4323 - protein, 347 aa, Methylobacterium sp.
MRRAEAVPRAAALRLALALAGAAGVPARAAEPACLRGVNLSGPEFGTVPGRHGTDYAYPSTRTIARFGALGLTGVRLPVRWERLQPRLGAPLDAAELLRLDAAVVAAKLAGMRTVIDLHNFAYYGADRIGTGAATAAAFADVWRRLATHFRSEPFVAFGLMNEPHDIPAADWLPAANAAVAAIRESGAPQLVLVPGTIWTGAHSWESDTPLGNNARTMLGLVDPGENVAYDVHQYLDADFSGTSGTCPRGADALGAVERLTGWLAQNRRRAYLGEIGASMQAGCPDQLAAILAHVNAHPQQWVGWAAWGAGDWWPPAYHFRLEPGTGPVTAVIQAAARAAPRCGGRP

SEQ ID NO: 4324 - protein, 386 aa, Methylobacterium sp.
MQVDPVVVASAARTPMGAFQGELKALSAPELGAAAIRAAVERAGLSREGVSEVVMGCVLPAGLGQAPARQAALGAGLPEGTPCATLNKVCGSGMKAVMLGHDMIAAGSADVVVAGGMESMSNAPYLLDKARGGHRLGHGRVLDHMFLDGLEDAYDRGRLMGTFAEDTAQHYQFTREAQDAYALESLARAKRAAEAGAFDAEIVPVSDLASDEGPRKARPDKIPTLKPAFRPDGTVTAANASSISDGAAALVLMRQSAAERGGHTPVAVIRGHASHAAAPAWFSTAPIGAMSKLSRKVGWALDDVDLFEINEAFAVVAMAAMRDLGLPHDRVNVHGGACALGHPIGASGARIVVTLLSALARTGGRRGIAALCIGGGEATALAVERL

SEQ ID NO: 4325 - protein, 294 aa, Methylobacterium sp.
MTKFVLTVTCRSTRGIVAAISGFLAEQGCNIVDASQFDDLGSGRFFMRIGFLSEEGRGAEALAAGLAPIAARFGMETAIHDEAQRMKVLLMVSRFGHCLNDLLYRWKIGALPIDIVGVVSNHFDYQKLVVNHDIPFHPVAVTKANKPEAEARIMEIVRGTGAELIVLARYMQVLSDAMCAAMSGRIINIHHSFLPSFKGANPYKQAYGRGVKLIGATAHYVTADLDEGPIIEQDTVRITHAQSAEDYVSLGRDVEAQVLARAIHAHIHHRVFLNGNRTVVFPPSPGSFASERMG

SEQ ID NO: 4326 - protein, 120 aa, Methylobacterium sp.
LNGERLSEVSRLAGVLADQVLLEPVDGDTSLAKLTALGKAALLLQDYDRPIPDRVVDVLGRALRGTEEDGAAAGGTPGTDAAAGAEEGGGEVATMPAAEDDGGPRRLFPRLIQSLRPLRG

SEQ ID NO: 4327 - protein, 246 aa, Methylobacterium sp.
MLNARCLHRPELTATLASGDRKLDNLTAPHPRTFAAGTTIVPQGTEHGYVYRLRTGWVGRVRALPDGRAQYLMVFLPGDLFAIKSVFVAAHPDAVVALSDVTVERLEQHRLRDAFDTDPEIALRCTWQIVEEERRLHNWVVSLGQGSAEERIAHVLLEFSVRLGAATGTARALQYGIPLTQDQLGNVLGLTSVHVNRVLRRLREDGLVSIRNRVVSIHDAPALERMAEPLRDATLQATARPEVAAG

SEQ ID NO: 4328 - protein, 303 aa, Methylobacterium sp.
MFAPGRLTVGVFFPIEAFQRDQPTMRDQERLAVRAEELGYAALWIRDVPLRDPDFGDVGQVYDPWVWLGWIAAQTREIALATGSIVLPLRHPLHTAKAAASVDRLSRGRFIMGVASGDRPIEFPAFGVLADERDVLFRESIAVIRKVLGEEFPALHSRFGEMLGHVDLVPKPIGRLPILVTGSSRQSLEWIAEHADGWITYPRPLERQAELAARWRATAAGLAPGTFKPFAQSLYIDLHADPHYPPQPIHLGFRSGRKALLDFLVALRSIDVHHVVLNLKYGSRSAGEVLEEIGLEVLPHLNA

SEQ ID NO: 4329 - protein, 708 aa, Methylobacterium sp.
MPSCPRLASCVPASEAIEPLSFETMLEVLPVGAMTCDLRTFTIDYANTCSIRLLHSIRDSLGIDPDRIVGTSIDVFHKQPGYQRGLLSDPARLPHKARIRFGDEWLDLHIHALPDSRGRVVRALLVWAIATAEVAKENEEYKLLRMIDDMPVAVMTVDPTSFAITYLNETSKRTLSQIETLLPARPEALLGASIDIFHRNPEHQRRLLASPENLPHRARIKLGPEVLDLQVSAVTGTAGDYIGPMLTWSVITQQVAAEARIHQLAHYDTLTGLANRATFREHLEAALDRAQPRLGLLFIDLDGFKLVNDANGHLVGDALLKRVAERLRDRCGAPGVMVARLGGDEFAILIQDGDDAAATRLAGDLVEALVEPFHVADERRLQVGASIGVAVAPLHGSDSETLLSRADMALYAAKAAGKNTFRLFEPEMERRMTQRVRLEAKLRRALEREDELFLFYQPITDIRTGRVTAREGLIRWHHPARGWIPPGDFIPIAEESGLIEKLGAWVLQRACADAMGWEDGARVAVNVSPRQLGSGRLTQSVLSALVASGLPPQRLELEVTESALLSEHVDCLGELRRIRGFGVRIALDDFGTGFSSLAHLRAFPFDKIKIDGSFVRDATSRPDCAAIVGVVADLGRRLGVTTVAEGVETEAHLALVTAEGCSEVQGYLLGRPQPHPRDAERVARLSARDAAERPAAPPADDESASAAA

SEQ ID NO: 4330 - protein, 93 aa, Methylobacterium sp.
MRNPYDVLGVPKNASEADIKKAYRKLAKAYHPDRNKDDAKAKDRFAEANSAYEIIGDAEKRKQFDRGEIDADGKPRATGFEGFGGGFGGGRGL

SEQ ID NO: 4331 - protein, 491 aa, Methylobacterium sp.
VAEFTGGTGSDTFAGTSADDIIRGLAGNDTLTGNGGNDLIYGNQGDDVILFGTATGSALAGNSTLYGGQGDDSIDYTGSTGRNLIYGNLGDDTLTGGTGNDTLFGGQGDDVLNAGGGNNLLFGGLGNDTLTGGDGNDTLTGGDGDDSIVAGSGDNLIYGNQGDDTIVGGNGAAASDTVFGGQGDDLVDYSTAAGANAIYGNLGNDTLIAGSGGDSLFGGQGDDSLVGGAGNDLLVGGQGNDTIVTGQGGSDVVYGNQGDDSITYGTPAGTAGVDTVYGGQGNDVVDYSLNTAGGNVVYGNLGDDTITGGEGFDFLYGGQGNDVISGYGYLSGGQGNDSITAVGEAGSYLLGGQGVDTLTGSLAGNDTFAFAAGDSGITASTSDLITGFGSGDSIQVQVVGGVVRAENRAAAGRSFDQQRELANEAFANGQANAIFITGAPAADGSTAASGGYLFVDTDGSGTADMSIRLTNGTLGDGDGVVQRYTAPTPDA

SEQ ID NO: 4332 - protein, 39 aa, Methylobacterium sp.
MTKLDAKTLKAVTGGTACPPAKDPCAPACKDNGGKSKKC

SEQ ID NO: 4333 - protein, 39 aa, Methylobacterium sp.; identical to SEQ ID NO: 4332

SEQ ID NO: 4334 - protein, 57 aa, Methylobacterium sp.
MRTCLLLALATGLLGLGLRLVLPVIPADAAFREVVRYYGADRPPGESGNMRETSAPY

SEQ ID NO: 4335 - protein, 57 aa, Methylobacterium sp.; identical to SEQ ID NO: 4334

SEQ ID NO: 4336 - protein, 34 aa, Methylobacterium sp.
MQKTMKAFSYGMIGAFVAGLGLTLWGSASLLAGL

SEQ ID NO: 4337 - protein, 66 aa, Methylobacterium sp.
MSQRIKPDRPIWPSLPETEVRAVPSSGPAEAPRAAPLQGGSGPGAAGPQAQRVATATVEAFGSLAG

SEQ ID NO: 4338 - protein, 162 aa, Methylobacterium sp.
MSDFAGSYLGELRRLVGSRLLLVPGTRVVVSDAGGRILLEQRSDFRLWGLPGGVPDAGEDITACAVREVFEETGLRIRDPVPFGFASAPEHEVWTYPNGDRCHYFTLLYAARAEPGPLRRAGGENLELGWFEPESPPDLMPTMARTLDAYRRWGGSGTFQML

SEQ ID NO: 4339 - protein, 369 aa, Methylobacterium sp.
MEQTLTDGVPASTAGGADLFHVAYPRVLPERKPPGHKPAAPRYTLRWHKPVGTMVSQYHAVQRTDLDLEQRRAFFDLMIGSFAEPDGPCAHEMMTFVDEQGETNAVVASYWLDATAHARWSVRATASRWFADPERQTGPTGCWRETIAVPYDRHETIYSEPHYRIGLARTADAAIVPMTTNGYFGAARDRLPIAAIDPLDSPLASDPPRARTLESRGCHLLASTPHNMTALRSGQFWQAAQAAQLEDYVENMEPKLMRGMDYLSHNKTESGTLSLRVMTNLDDDGREKAETSVLAYFLSMEQLEGWAKSHDTHLDIYRHAIAMNRKFKASREVVTWHELFVMPACSAFEYVNCHPKTGVLPFVAAYRVA

SEQ ID NO: 4340 - protein, 128 aa, Methylobacterium sp.
VAADELRQFIERIERLEEEKAGVAGDIKDVFAELKGRGFDAKAVRQILRIRKKDHAERQEEEAILELYMGALGMLADTPLGRAAMSREFQDARITISGNGIDTIETTGAGIAQATARMELQASVGGRR

SEQ ID NO: 4341 - protein, 308 aa, Methylobacterium sp.
VGFVELGRQSLPAAEHRRAELGARLFGDRRLDADGRLACTGCHDPAQGWTVRTPAAPGQRGRAGRRNPPGLRSAAAATAWGWDGRHRTLAAQVLAPLTDPGEMANPGLAPVLARIGADPGYAAAFAAAFPGAGLTAGTLADALVAYLAGLDAPTRFDRFASGDGAALSDREVAGLHLFRTRAGCANCHHGPLLSDGRFHNLRLSAFGEPAQDLGRHAVTGAAEDAGRFRTPGLRHLRETAPYGHAGLFETLAGVVNLYDRGGGEIWARNAAEAARPLHAPAARLSPHIRPLGLTDAEKASLVAFLETL

SEQ ID NO: 4342 - protein, 171 aa, Methylobacterium sp.
MSDALPAPLAPPQPARPERPRLRTLTIVENGEPVQNAAFCPWCEDLHFHGLPPGQRGAHCVREDSPYRCTGYVLDVQGTVPSAGAAVPDAPRPRGRYLHQSLDQASASLRRVVLRHVLGRKFAGTWGEGKVGRAVVSVCCDHWTPATVPEWVGGEGVFRRKRCPAVGSGAV

SEQ ID NO: 4343 - protein, 103 aa, Methylobacterium sp.
MSASKPRPTLDSLASRFARKDPPAGAPAASAQPEAAEVAAPAPSTAEASPPASKPEKDKRVQILTRIDAPTRKRLRLIAVEQDRTVQEICEQAIRDFVARHSR

SEQ ID NO: 4344 - protein, 344 aa, Methylobacterium sp.
VIRLLTPLFAASVLAASILPGQAAEKLVVSTWGGSFRDLIDEAIASKFKAETGAEVEYITGGTIDRLNKAKLAKDAPESDVTFTTAHVGWLYVNDGLFETLDLAKIPNSKNLVDQARISPAHIGTWGYVYTIGYRADLAPKGMTFGSWADLWDPKLKNSLAAPDFDPSHIIAVSAILAGGDPATWEKGQAKLEALKPNFRAFYTNDANSQQLIATGETPVQVVLTMNAYYMKGQDVPITVVIPKEGGVLGIDTVAINKGSKKAELAYKFINIALDPQVQAKIAELKKGSPTVTNAKVDPETAKLPGVFTTAEQWKTQAINIDPKLRAEKTALWRKWFAENIMAR

SEQ ID NO: 4345 - protein, 52 aa, Methylobacterium sp.
MQDEKKTAAFQVRMRPTVKAAAEKAAADESRSLASLMEYLLIEHLKAKGYLK

SEQ ID NO: 4346 - protein, 81 aa, Methylobacterium sp.
MADQKTTGELRKAAIVTDDEINAAVEALLAKPKTGSYPIGGGYLLDLGVAAEAYLFSRGAPHAGSRAPAKAAHTEHGMASR

SEQ ID NO: 4347 - protein, 81 aa, Methylobacterium sp.
MSQTDDPGGEPRTPSPAAPPAPRRNQTLSLAERRIVEAGEAGPHAPGHPDPRPDPGPETGGYDDHSPSRAPDNAKGGYGAG

SEQ ID NO: 4348 - protein, 80 aa, Methylobacterium sp.
VRSMKIIPALLGLFYGKKQRTGISSLPYSVRHRLGLPGGMAIAAMIDDRDADTAFRPRLIPTVSFADVHYALMLERIRKA

SEQ ID NO: 4349 - protein, 277 aa, Methylobacterium sp.
MSDTANTIAGAGFAATTAQAPRARRRPRVNLTGLVLPLAILVLWEASATFGWIDPVFLPAPRKVATAFWKMLTVQNLAQDFLASITIVGQAFLYGSTAAILIGIAAGLSRRVEAFFGPTFDTIRHIPGIAWLPLIVLWLGIGAPAKVLVIAKSVFFPVFLNTLQGIRNVDRNHIELARTLTLTRWQLVRRVVLPSALPSILVSLRYAAGLAWALVVVAEGLSGLEGLGFLIFRAQGLLLTDQLMVCMVLIGLIGFAIDRSMALVQRRLLRWKQGFEG

SEQ ID NO: 4350 - protein, 243 aa, Methylobacterium sp.
MATSALKPVVKLSAETQTLENLRNYLLSGAVKPGARLTEMSLAEQLGVARATLRASLNRLVTEGIVVLTPYTGWRVAALTEGDAWELWTLRASLEGLAAKLAAESMSPDRRTRIEQAMASLVVACGDGDVRSASDADFALHRTIVESIGHSRLERQYLQVEQQIRLYIMTSNALVGDLGQIVSQHEPLVEALLRADPELAAREAWIHNETEGRKLANWLHEQETDRFRAPVKRAMKPKGRHMA

SEQ ID NO: 4351 - protein, 308 aa, Methylobacterium sp.
ETSRSPALRRSREISMTLATLSLVVLASFLHAGWNLLAKRAAHIGPLFVFAYNLVACIAYAPWVLWRLSQGVAGGMTWTWAAVGIVGLSGLIHLAYSLCLQRGYQTADLSVVYPVARGTGPMLSSLGAVLLLGEMPSGRALAGLGLVVAGIGLIATQGRLAAFRKPGGVAGVQWGTATGGLIASYTVVDAYAVKALGIAPVVLDWCNNLLRFVLLAPIVAADPRGAWEALRGFRLVALGVGLLSPLSYILVLAALDGGAPLSLVAPMREMSMMVGALLGMIVLGETAGPWRLVGCAVLIGGVVLLSSA

SEQ ID NO: 4352 - protein, 388 aa, Methylobacterium sp.
MYMPPSFVSGLAFVTVPAQMRESGHSLALIGFQTIVMLPWLAKIVWAPYVERYRLPALGRHRTPAIAAAGVAVVIAMMATMTVLGDRYPVALLACLLVAATAAATVNIACDGFTIDACPAEQRSWANTAQVSGAYLGIALSGGLFLIVAARAGWTATLCGLMVLAIVLPLPFLLLSRRVDLGSVRPHRPDLRSALANPKVRIGLVIVLACSAGSRLSQSMIVPLLVDRGFTLSMVGLIDGVGGVLAGLFGTLCAGFTVRRIGTRRSLVWALAVQVACLATLAQAGYTGTMPAWLLGGAVMLMFGALSFASVALYAELMGYTSSRQPGVDFAVFQCSDAGLGMLAGPVSGFLATHLGYVGCFSIAAGASALAAGSAPWLVSRCRSIPAR

SEQ ID NO: 4353 - protein, 226 aa, Methylobacterium sp.
MQASPARALVLSGLILAGTALSGAAAQTVIVNREERPDPWIINGCTIAPNAACPGADLRHADLRNADLGGADLTGANLARADLRGANLRGALLDRANLGGAKLQIAFLQGLKARGASFVGANLDHARAAGADFSGADFTVADLEMVQAKRAQFVGARFVNTDLQETKFYEANLADAVMEGAKIRFAIFQDAWMKGCRGCPETWQQGKPVWDVYPEAGPPPATGSDP

SEQ ID NO: 4354 - protein, 114 aa, Methylobacterium sp.
MNRYDTSSTSPAEMRAHIETAKANREHIEESPDPEAELRGMVRGCDLVWGVWPDRGPGTRLGHGLCIVKGTLMMEAVIEGDLRAQVAITTLWFPTFEAARFAFDRDGDGLLLAA

SEQ ID NO: 4355 - protein, 305 aa, Methylobacterium sp.
VPVPERADRSDADDPAPVPGGDDRPFRLIADPRVAAAMRFAEARLDAPMTTAALAAAVGLSQFHFLRLFQAQTGETVSDYSRRIRLDAAARTLRTSPETIVSIALSVGYGSQAAFTRAFTARFGRSPANYRRGTRRAVAIDAARQRPVPIRSVGTIHCLGRRYLGLRPGEAEPWHDFLSALPPGSAARRDRRLLRVVHDDPRVTPPEQIRIDCCLVGTERAGEDRDLAARGFLPFEIVAGTYAAVGGTESGIGGAGDDLLDIWLARQGRYRLRGGAGRLEFRDAAAQPDAGETLVPIRALGTDAT

SEQ ID NO: 4356 - protein, 130 aa, Methylobacterium sp.
MTDPIERIATAAVPTPAGHYSQGTAWRDLVFVSGQLGPRPDGTHTADEPFETQVRQALANLLAILKEAGCGPERVLRVTAYLVGVENWPHFNRIYAEVFGEAKPARTVVPVPELNRGYLVEIEAIAARPE

SEQ ID NO: 4357 - protein, 194 aa, Methylobacterium sp.
VAKKGHDDLLDALAALPASLHWHLTLIGGGEMRAATEARAAALGLGRRVAFRGALAQPAVITAMREADLFVLPTKPAPGGDRDGLPNVLMEAASQDLPILATAFAGTPEFIASGTHGLLVPPGDPAALAAALAHLARDPDLRRRLAGAARARLVADFALDPGIDLIAARLAASAGLAPLPEVASHPARACACAS

SEQ ID NO: 4358 - protein, 793 aa, Methylobacterium sp.
MFRTAHKLVILAPLLLPAAGCLSIAGDACTDPDTTAGIAVVNEKDVTPRNCDGKFLSARNQRSVLYTGEDRPRLWTGEAPREGRDIDVRRVNAPPLGYDRAGSVTGYLGTLKLNYAAADEAVEADVAALQNSLGRRFDPDQKVAVDFRKATLDYVLKQMLGGALGLNYIAPEDLGGSVTFRTEEPVPKAQVLQIVRDILARNGLEMRSINGVFHIGKPELIGSIEATGQAGRVGERTTRILRLRKGAGSDLLALARQIIPPSIELVPTNNPDTILIRATAAEIDQAEKLIKGLVQTGLTEDRVAVIPLRQSAPEKIAGQLTEFFRSRNADPVSIVPLDGQQALLVSSKAPGMIDGVRRLAEAMDTEVRDEVSLRVIPLQHLVADEIAQRLAVIFGTGQGSGGGRPGTLAPPGARVGEALRDPAPLPRVSPASIEDGVAPPPYPYANGPGNGGPRGALPGEAAPGPSGGGIGTGQQATRIVADKTSNALLVYSNYSLFKKVREVLRALDVPPAQVVIEATVVEVELTDQLQTGVQVFLQGAGFVVGSGNIADIGIDGRTAATGSNTGGGTSGVGSTGSIGGGGSNGFGGVAAIGARIGNALRVDAVLRALQGVTKVKVISSPYLTVLNGKQARLVIGDQIPFAQRSQTANNLGNTTVTSEVVIKDTGIILDITPQIHANNSVALKVNQSVSTPVQSALGGALTPVISTRSVESDILLQSGRTVLLAGLIQDRLEQQEDGVPVLKTVPVVGDLFKQKVDNVRRVELILLLTPRVTRNASQIEDLARLLQEQVHTR

SEQ ID NO: 4359 - protein, 150 aa, Methylobacterium sp.
MLTNKGKYGLKAMLYLAGIPEGTRVGVAEIAEANNIPKKFLDAILAELRNAGFVHSKKGPGGGYTLARSAQEIRIGHVVRVLDGPLAPFPCASRSRYQRCDDCADEARCAVRLTMLEVRDGIAAVLDPLTLAAMRGLSGAADDASFFYQI

SEQ ID NO: 4360 - protein, 269 aa, Methylobacterium sp.
MTRGTRLLAALLASVALSGLAASGHAPAGEPAPPADAPLPEHFTLAVPDLPAAGAPDGRIYLDEGFEGDLAALLGEGLGRPLHLAVPTTGAPVPGRFDGVLLRLRPDDPLLASGAAVPLGYRSGLSVAMRSDTAIRRWEDLAGRTVCASAANRDGQRIARAYGAAVVTVRAPAVALMRLRTGTCDASIHDRALLDALFTSRAWAKFSATLPPVEPTLLALVPAATGPGAALRRAAAALDDPLAWRQRRARWGSTVAFEVYRDQVGGDCH

SEQ ID NO: 4361 - protein, 349 aa, Methylobacterium sp.
VRLAALGAVTLGFLGMVPSSRAETLPAINLQLTPWTVVARQKGFFKEAFEPIGTRQVNLIASGAAELLGAEAAAVGGGAIAIAQRMIYPATVHRANGLDGVVIWASEPSNRYRAPILARADNDAIKTVADLDGKKFGSSRISCYWSSPFEILEKAGLPLDSREKQGRVRYTSIDNSAVAISSVLSGATDATTAHLAAGAFTGAWLSGRLKVVGRSPDDGVYVNNAGRVTYFARRDFANKYPEVVKAFLAARERTREWTFDHVDEAAEIVARETRVPLEVAKFQITHAGEWEFMAGEPNADRARNAIRTFQAWYIEHGDDILAERKLTDQQIDAFIDGRFFAGGQYSIYN

SEQ ID NO: 4362 - protein, 258 aa, Methylobacterium sp.
MAAGRLDIRDVSKSYPQEGRPPLTVLSHIGFAVEPGSFVSLVGPSGCGKSTLLRLILGLDPDYTGDILVDGVRVSGPALSRGVVFQDHRLLPWLTLEQNVALSLENARWPASEKARAVREHIALVGLRGFEKAFPHQLSGGMAQRAAIARGLANRPEILLLDEPLGALDALTRVRLQAELQRIWRAEGVTMILVTHDVDEAIFLSDTVIVMGAGPGRVVERVTVDLAGERDRSGTDFLAHRRRILRAMDDAFGHRHAA

SEQ ID NO: 4363 - protein, 198 aa, Methylobacterium sp.
MRTEYLGHGMPNRVPLTLGTAIICLLLCCTVIGILMIPSALLATLSGRAAGVNRRWDREARRRFVGFIGADPHYIDSAVFKYEDGFRGTGIAYHDGKVFMMQAGHAVEVEWRDVRRWSYSVEAPDLLTTSSNDSQVLTHVTSDNLACAYRAAKNSGFTLQVASIDRPTWKFTTSDVSVCERWMEILSQVDERGGRLTA

SEQ ID NO: 4364 - protein, 133 aa, Methylobacterium sp.
MALLHAELISPERTIFVGEVRSMVLPSVEGDMTVLPGHAPVVTALHAGVIFATDAEGTGRRAFIRGGFADIMPTQVTILAERVRPIEELTRDQLDEEIFHLQLERDGSSNPELRAEHDVSISRLESFKASLNL

SEQ ID NO: 4365 - protein, 236 aa, Methylobacterium sp.
MLELDAVTVRFGGLVALRDVTFTVAPGEILGLVGPNGAGKTTLFNGISGLTRVRGRILFEGRDVTKLPLHRRARLGIGRTFQIPQPMQHLTVRENLAVAQVFGAGRHDPARIEEILAVMELQAQGDRPAESALALQELKRLEIAKALATEPRLLLLDEVLAGLESQAKRQFAAKLRELHRRFDLTIVIVEHDIETISGLCSRAVVLNFGEIIADGTPAQVFRDPRVIESYTGTAHA

SEQ ID NO: 4366 - protein, 222 aa, Methylobacterium sp.
VAWELWSERRFAEMARRGTGLLYATRLTLGLQRDLAAPCPTPTAKIPIEVRPLRETDLPHLFPEDRGALSRKERVELAARRFHLRAGIPTCYVALDRRTDTPCYMQWLMGASHNRMIQDTFPPRWFPELAPDEALLENAYTPAAYRGQGIMSCAMALIAERAVEIGARRVITFVENTNVPSLRGCTRAGFEPHLARIERRALLDTIRLRRFEPYDPARHAHR

SEQ ID NO: 4367 - protein, 99 aa, Methylobacterium sp.
MLRAALVLLTVLAPAGAIRAEGIKEYQIRRLLMLKTECTVSGLQVEELEGGASRFRAGCENVSHYPDGVEIQCPNTEDDRECRILTARREFPHLRALQR

SEQ ID NO: 4368 - protein, 142 aa, Methylobacterium sp.
VRWSPILATGLALPVGAAAAPAPEAALRPAFAQCRALSQEGERLRCYDRLAAILAPPRFQGRLTMQTEPFAITAPTVLRYESDGPIFVLALKDARGEVVQNLHIGGGGSATHTIAVPGTYALQVSGSESWRIWLDPVRDPTP

SEQ ID NO: 4369 - protein, 229 aa, Methylobacterium sp.
LKVSLRDPVAEEWYDHDQGSLAEIAFFADAGALREGAVVFDLGAHQAVVALQLAVRVGASGRVVALEANPHNAQVAGENILLNGARNLTLVHAAAAAKDGEIEFNESLNGQVDGGAGTHGVIRVPSRSIDSLMAEFGIPDIIYIDVEGFECAVLEGAGGALEQVKHWFVEVHGGVGLEKFGGSVDKLLAHFDAGRFERHFCRTDAGPFTPLEDARSLDGTRWFFIATRT

SEQ ID NO: 4370 - protein, 53 aa, Methylobacterium sp.
MQLITRFLKDRDGATAIEYGMIAALIAVVIIGTLQIIGTQLNAKFSSISAQLN

SEQ ID NO: 4371 - protein, 351 aa, Methylobacterium sp.
MTRRTRTRSTSPRLRAPLALLLAALAAGTARAEEARPPGISLHLPLACEPGRTCFVQHYVDRDPGPGARDYACGSRTYDKHNGTDFRVRTGAEARGEAGRVLAVAAGRVLRTRADMADGRVRGSDAAEIKGAECGNGLVVAHADGWESQYCHMARDSLVVRPGDTVAAGQPLGQVGLSGMTEFPHLHLTLRHGGQVVDPFAPATPPDSCDPAAPGRGGTLWEPKAAAALGYQAGSVLNAGFADAPVSMESVEAGAPRVPGAESGALVAYVRAIGLETGDVQSLVLTDPAGTVVAQSVQPALERPRAQSLLFVGRRRPAEGWPAGAYTARFRVERGGRVALEKTFGLAPRAP

SEQ ID NO: 4372 - protein, 548 aa, Methylobacterium sp.
MVAGAAIPEQVFDAMSGTDRFERTAILVLGMHRSGTSAVTRVLSLLGATLPERLMPRAEGNPVGYFEPMEIVSIHERLLASADTEWSDWGAFPQDWYRSGSREAFLGELTEAVIRNYGDDGLFLVKDPRLLRFVPLWRDLLTGLRVRPAAVLPFRNPIEVALSLKRRDGFPQEHGFLLWLRHVLDAEFHSRDLVRAFVSYDRLLDQKRMATYGLIESLPFDWPRKTSAAFDEIAQFLDGKLRRNTASRDDLSLLAGIPEPVRAAFRAYEALERDPYDRVAMTALDAVRAEFDRTTGIMADTFKALRRQFEADQSEALAMRSEVATYEKRVEARARELLEEVTALKQQHAEVAALHAELQHRLADIDSLHGTVHAMQVEAARQNDAIRITADQRHEALQIEAARHRDEISAARAASGALERSVGDLQEDLLRLRGAAAYADYRREQERRHRWWRREKADPERAALCALVLRSGLFDPDWYRARYLADEPDRDPIDHYLDHGRAQRLSPGPNFDAQWYAETNPDVAASGHDLFLHYLQHGREEGRPPQRR

SEQ ID NO: 4373 - protein, 155 aa, Methylobacterium sp.
MSDTVLDRLAALGLVLPPVPPPRGAFKPYARAGNIIYLAGQICEWDGEVRFSGPVGEVYDLKVGQEAAQLCALNLLASLSLALEGDLDRVVACHRLGGFVYAKPGYPDVPKVINGASDLMFALFGEAGRHARTAVGVATLPAGASVEVDGIFEVS

SEQ ID NO: 4374 - protein, 163 aa, Methylobacterium sp.
MKRVLVGIAVPLLMAAGPQQTRSAPPPAPPLRAGAIPPGDAPGARDASALPRYGGGLLLESKAGAFDEIALPNAKLERRADEVDAHNNDLFLPPEPLTVEGRVTRMSYLLPEGRTALEVVRGYQQTVKDAGGSVLFECSRDECGGSGVTAARSGGSKTGLIHR

SEQ ID NO: 4375 - protein, 46 aa, Methylobacterium sp.
LSSIKIKPACDGTYTLYRDGDAVSSGLTLYQAQELAAVLRCLEPRG

SEQ ID NO: 4376 - protein, 189 aa, Methylobacterium sp.
MLTFSFADPSLSLAAELGDAVERVFAINTYDYLPGLERSNLLASIIIKSVRAPVVGPVFAALENRSITGGIMSGGFHDPRSLPSDLLDEYARVGARAGYSTAARKLLKALPSFVAARARYLSVTAPITLVWGDEDWANLRDRAGVAAALPLPEVITLDQTGHFSALERSQAWADIILARTARPKLSAVG

SEQ ID NO: 4377 - protein, 52 aa, Methylobacterium sp.
LRTPSHKTVQGDAQASAVREWRRSLAELPTATNGFNSDGIAVAIEGLLTLAA

SEQ ID NO: 4378 - protein, 145 aa, Methylobacterium sp.
LILPPFGATLLSTAGAVVSSQTWPARLSAAAGFFVLTGQRFVIEREPRILIHVSPGLTPAEPVMPLYTIDTDDGDLFVAGSLETGIDCPLKARMEAHRVLGSMTRYALPDGEHRVLQAIVRDDIGQEVYVATITSTGEWKIPLGA

SEQ ID NO: 4379 - protein, 61 aa, Methylobacterium sp.
MERRNDREVRWAAERHARESARNQAVLLWSAIRAERRADADPGARLRPILLAAMTDEMQAR

SEQ ID NO: 4380 - protein, 172 aa, Methylobacterium sp.
MQDPDLLSAHRIGAALSLAGLAVLMLGEAGEPQPLGTATGCLVAALAAFAVDALRRGGSRRTRRPAAGRRRALLPGRQAAPAVPALSPAPAAPEAGPPEAVTAGRWAMPATQRDPRVHAALSMAVARFRSAGPPAADGGPGRGPDAGPDPGQDDARRAALADVRNRRLARRD

SEQ ID NO: 4381 - protein, 57 aa, Methylobacterium sp.
MLLALPFILVALAVLVVGVQILLVVKMADLFEAPRDARRDVRNVHARYPATPAGRYA

SEQ ID NO: 4382 - protein, 234 aa, Methylobacterium sp.
MRVMSQPVGLPEVVESDLVRQVARSLTAAIVQGHLRPGAKVSEAAVARELGISRAPVREAARLLENQGLLRASPRRGFFVRELSAADVDELYDLRICVERHAAVAASRRLTPEARVALRRQLDLMDTIAREDDPSTIVEADYQFHRMICEVAGNGRLLRLFDGLASELRIVIGLIGRLYDDPMKLARAHVPLLDAIEAGRPDAILAEVDHHLGVARREVGLLLQSLSPAKPDVL

SEQ ID NO: 4383 - protein, 311 aa, Methylobacterium sp.
MRCVLLSATFDLRALCPSALDAASDVIEFVDDPADSPETVRLALAWQPADDALTRYPNLAAVCSVGAGVDSLVTCPSLRPDLPVVRVVDPEQARAMSGFVLWHVIGHQRRFRTYAANQLARRWRYLAPPEASAVPVGLLGYGRIGQRVASDLMALGFPVSAWSRTPREGEPGGVAHHHGPEGLRAMVAGSEVLINLLPLTRETRGLIDAAFLRRLPRGAYLVQVGRGEHLVEAALLDALESGHLSGAALDVFATEPLPETHAFWEHPAVFVTPHEACHANERAIARTLRATAESVHAGRRPPDTVDTARGY

SEQ ID NO: 4384 - protein, 347 aa, Methylobacterium sp.
MSGHRPPNYLPVRPDWLAAGYEEPLKPELPIIDAHHHLWDRPGWRYLFEEYLTDVRESGHKVEASVYMQAQSMYRAEGPPAFKVIGETEFANGVAAMAASGLYGPTRVCAGIIGHVDLRGGTAVAAVLEDHLRAAGDRFRGIRHLTTWDPDASLTNPLSACPPGLLGDTAFRAGFACLAFLNLSYDAWLFHPQIDELTDLARAFPTTTIVLNHCGGVLGIGAYAGRREAIFAQWSKAIRRLAECPNVVVKLGGLGMRINGFGFEAGAVPPSSDQLAQAWRPYIETCIDAFGPARCMFESNFPVDKGSYGYGTLWNAFKRLTLQAAEDEITALFSGTAARIYAVPTRS

SEQ ID NO: 4385 - protein, 1088 aa, Methylobacterium sp.
MSSVTSALTSALYASAAQTGTRPDTVTADAFARWPVAAQAALVRSFGTGSPPSILVGQAGQRAIATLNETGTDVDVVQAPASLDTAPADLTREAFERWPGAAQIFYVRANGSGDPCRVDLGGTAPGGSTATLAETYGLANGVVLTDRGAPTAAEDALIKMPVAQLTSADFFTLSPDDQYAYFQKNGTSVSMPSGPAVLVLKLDTQPPNPTTRAILTLSSNGRPFAVEVQASDYPGFAGLTGSKIAQTSPVKASLFAAWPREIQRAYVEGRFTGATDPDTTDAFQPAFYPKVVVFTDGSKIASVTAPGAEVEMIDIPAGFGNGTTGLAAGTFLSWSPAAQLAFAREVYNSTSLPSFTLPGSTGAQALSVTLALSRNGLTLASVGDRATNLAVDPAALDLDLFHLWPIEDRVAYIDAKGGGTPRSLLTGAGTFLLSLGPDALPRLESVPTGFTTTPAALAPATFLGWSPAIRAAYLGQSGLAGVTETTVVDAAGNSVMQRSATIGTAPGPVLTATRIPSGDVVTTGSILAIDPTRGMGLPIPNAGTYGGAGGLDRDPNASSADALFPGLDGTAGRSIENKPAKVAAQFAKAPKDLAPDEFGTWNSVIQLEYLRKHGTASQGYALVIGPGPDGATATTAFMSESGTKVYTVGTLQKTDVGKMSSRDQAVLVTLDAFTKPLTGRAAALELTAGNAALLKAIDDLASAIALDPTPLKGGQTPMPLADRQVFLHQVAILKDKVAGSSIVSASSIQPQIDDLKARFERANAFATALPRKALTADPLKVEYETPALSLGEGIPPATAKISVDPDHNTKIDLSKFLTDQLGSVHPLTADSAKVINYSSPIKIKFYDGAGNQIKVSGSLNAVEISRLQAGVVQVNAPTLSTDGNQALQQCYRNLISQERQLLSLAESRASLAQTGKLAGSTQHLDVPNLVYLFQLQANLTGEAKLRADTEELNQINALVKLYGVAQNMVNRILKDNDSSGKGNISPSGGMTREEKEAGVFFAGGASHPIEIIYSNISHPNDGFGARPYERWGKLSTQLSERVTLINQESQIKMNSVNSSTKAKDRNFDLANNALTKMNEIVQKIAGAM

SEQ ID NO: 4386 - protein, 71 aa, Methylobacterium sp.
MWKLVALVQAQLPNSAHQARVHLLEQLYALEQEALERGADPGTLRSILATQAFVRRSDPLMGRMATPERPQ

SEQ ID NO: 4387 - protein, 414 aa, Methylobacterium sp.
MLASAMPAGLPMMRIDGMLLVNTNPAHGRALEVADAEMLSVAAAETVERFLEHRPDHRPTPLHALPAAARSLGVAAIHVKDEGFRLGLGSFKALGGAYAVIRLVLEEAGKRLGLALGPADLSRQDVRAVAAGMTFGCATDGNHGRSVAQGAQLVGARSAIFVHAGVSEERIAAIAFYGAEMIRCAGTYDDSVEEAARACAVNGWTVVSDTSWPGYEHIPGLVMQGYTALLREALREVPEPPTHVFIQAGVGGIAATLAGHLAVVYGANRPKLVVVEPARAACLIASAEAGKPTKVAHGEPTVMAMLECYEPSLVAWRVLSRAADAFMTVDEDDAVSAMNRLARPETGDPAIVAGESGGAGFAGLVRVVGNAAWRDAVGLGPEARVLLVNTEGATDPGRYRELTGLAPTDVACAA

SEQ ID NO: 4388 - protein, 152 aa, Methylobacterium sp.
MNVVNFAHGALFMVGAYVGVLLYGYTGSFWLSLVAAPLAMGLLGLAAEPCLLFLDEPSEGIMPILVEEMLEQFVAMKRAGTTILLVEQNVDLALDVCDRVYIAKADVGGKIATLGGRLMQATSRKLADAFFGTFAAELGTAGDPGVPAPAAA

SEQ ID NO: 4389 - protein, 254 aa, Methylobacterium sp.
LDHRAETHPPTPVWWRDDDAVAATPALDRLLALGETCAAPILLAAIPAHIAPSLGRRLDGAPGVRLAVHGLAHANHAGPGEKPAEFGPHRPLAALVADAREGLRRAREHLPQDALLPVFVPPWNRLAPDLAAALPDLGYAGLSAAAPRQAPPERVGLVRADIHIDPIDWRGTRSLADPDRLVDDLVARLGAGAPVGILTHHLAHDAALWAFLEALLPLLSGHPAVTVLDPRHLFARPPVDAGAAPWSRRPARAS

SEQ ID NO: 4390 - protein, 131 aa, Methylobacterium sp.
TALGDGKILFSASTAANGTELWVTDGTAAGTILVTDVNAATMPSFPSRFTALGNGKGVFVANDARSGFELWVTDGTAAGTSLLKDIYAGPGASSPAGFTTVGDGRVLFSARDASNGTELWVTDGTAAGTSL

SEQ ID NO: 4391 - protein, 1116 aa, Methylobacterium sp.
GGGGGGGIGGGISFGRGGAGGFGGGGGASSGFGGGGGFGGGGGNGGRGGFGGGGGGGGSARVGGFGGGNGGVGSGGGGGGLGAGGDIFVQAGATLVIVGGSLSGGAVSPGGGAGAGQAYGSGIFLQRNAGDPLPSLTLAATPGAPATFADVITDQNGAAGSTAHGAVGLSIGDATTPNTGIVTLSAVNTYTGDTTVQSGTLLVDGQIANSAVTVRSGATLGGSGTTGGVTVLSGGTFSPGNSPGLIRTGDLALTAGSTFVEQIGGATPGTDYDQTRVTGTVDLGGATLDLQRLGAYAPLLGQTFTIIDNDGADAVTGTFAGLAEGQDIVLGRYRFAISYRGGDGNDVALQVSGAPGPVVTASPGAAAFTESDNAAAVPVAVDPGLTVADPDAATLASATVAITGNFTVGEDSLAFVNNSATMGNIVGLYDAATGRLVLTSAGASATLAQWQTALRGVTYTNGSDTPTTADRTVSLTVDDGAFASPAVTRRVTVAAVNDAPVNTLPASLAVGSSGRAALSGLAVADADAGSGVLVTSLTVQAGTLTATSPPGGALVAGSGTASLTLTGTISQINAVLAAPDGLVFQGSPGTTTQLTMATRDGGHAGGPEKTDTDTASLVVDQARYAIAVAPASVSEGTGGPGNALTYTVTRTGDLSQITTVAVGFSGTATLGSDYTVAGTGTAGDGSYAAGLLTFAAGQATARVRVTTVPDGTHEPDETVVATISGPSQSGLVTTASATGTLVNDDAPPPSPGSDPDPVPVPGTWSGGRMTGLVTTIDPAAALAAALRALQGLPAGPDEAAVRAGIGAFLAGLPAGTTISVSAFEPIPGTGDIRIAGPTDGTRTIVILDASATPQGTPITLDDLGFVVLSGPPSLIGGAGAQMVYGDASAQSMVLGADDDTLHGGAGNDVVGSKAGNDLLYGDAGNDTVFGGIGADTLWGGTEQDLVYGNQDADLIYGNLGADSLYGGQGDDRAYGGQGDDRIWGNAGADRLFGNAGADLVYGNQGADVIYGNQGADTLFGGQEADTLFGGQDADVVYGNLGADLVYGNLGADVLYGGQGNDVLYGGQGDDVLVGGLGDDILVGGLGADRYVLGAGSGRDLIRGFDQAAGDRLVLGG

SEQ ID NO: 4392 - protein, 62 aa, Methylobacterium sp.
METRRGADIVARTLEALGGFGACVTDAADLPAALAAAQASRKPARLTVMIERVPARVIRRPG

SEQ ID NO: 4393 - protein, 77 aa, Methylobacterium sp.
AAAVEEQGAATQEIVRNVSQASTGTGEVTRNIAGVAGAAEETGASAAQVLGAASELSRQSEHLSAEVQRFLASVRAA

SEQ ID NO: 4394 - protein, 50 aa, Methylobacterium sp.
MSDDDRKPDDKPANIAPDAVKDPNEKTEGKPGEGPKGGGTQRDETDPGGS

SEQ ID NO: 4395 - protein, 133 aa, Methylobacterium sp.
MGDPPAPLAGLHILLVEDDYLVATELARWLRAAGADVMGPVARIEQACGLIDRRRPDAAVLEIRLEAEPGGGDTVHPLADRLDALGVPCLFVTGDPRLARLPAYGGMPCLEKPLQETDLIGELGRLLDGARAG

SEQ ID NO: 4396 - protein, 434 aa, Methylobacterium sp.
MTQHRRRGNPVRCAAAGIALAVSLGPAAAESGDLLHVGDRLKITVYEVVESADRPGAGEPQEAGTAPPVQAAYPRLDLSGEYVIESSGRVMLPLIGAFDAVERPVEALRAQIGDAFVRTFRRRPDIAVTFVQRAPVYVVGAVRNPGAFPFAAGLFVAQALALAGGDLTNAPPERALEIVRGREQRETARERLKALLVRRAVAKSESEGAALAADEGLIKLVGAETAAGLMNREQRLIKLRAQERSSARTVQERAVATAEEEVELLSQRLANYDAQVKARGDRLRIMEGLFSRQVVENERVVDIRRDYADMEGRRRDIEISLLQSRQRLEAVKRALEQGELDRRLALENEFVRVTGELREAERGFEAATTVASLLARGQGPEASEAAAVTYDILRRNGGGLETLHVGQGEMLEPGDVLRVQIGRPSEGVGKVAGK

SEQ ID NO: 4397 - protein, 324 aa, Methylobacterium sp.
MDLRQLRYFVAIVEQGSFSRAAEVLRVAQPALSQHMRHMEAELGLPLLHRGPRGAVPTEAGARLLTHARAILDRFAEIPDSVRGADRPVTGDVRIGLPGTVSEILSVPLIERVRAEHPGIRLRVAEAMSGYILDWLNRDAVDLAVLYNPAAPKGLVLRHALTEELCLFGRPAGGGDLPDGPVSLARAAALPLILPALSHGLRDLIEEVAEMDGVSVTPGIEIDSYARIKELAARGHGFGILPRAAVAAEVAAGIVRAWPIGSPPLRRRIYLAHAADRPLSAAAAAVSGHAWDLLGELVRAGVWPAELAGPDPARPLTGAAGAAI

SEQ ID NO: 4398 - protein, 145 aa, Methylobacterium sp.
MSAVIERRVLDRLIALGRATGRISSDELRAHLPTATMTAEDIAVVVLELEESGVEVEFEGPLETAGRPSPVRPVAELPPLPTAPAVAASPAPTVRAADPPASTSSAAARSGASWSGGRNTVTRAVIAAGALTVLVIAVVLLLVRR

SEQ ID NO: 4399 - protein, 74 aa, Methylobacterium sp.
MSFALALPVAEASLFTLGCLLIHALRRHADVVTGALACLLVLVTLLLAVAGTPEPVLRAHALALENGEVIQFLN

SEQ ID NO: 4400 - protein, 219 aa, Methylobacterium sp.
MIALRSLMTALPYNPAERRRAWAGAFAPYFDMAPKERDPAPGLLALTRHRFEALTLFEMTAPAQTFRRTPVMAAGQALDHLMVLFWLDGEGRVTWHGGTAAFGRLQGVVLNLAQPATLVVGPVQATGLVLPRALVGDRLPDLAALHGAVLDLASDPVSRLFFTSVQDLAENASAVRDDMLPQVTRAIATVAAAALCRLTAVCPTAIVPAPKRLLEEVPA

SEQ ID NO: 4401 - protein, 72 aa, Methylobacterium sp.
VSREELLGPATLTVWPHSIDAKAVEPREMASLVVALEEAATALRSGEGTPWVITSAGTMLPPDLLRNLLAAP

SEQ ID NO: 4402 - protein, 79 aa, Methylobacterium sp.
MPVLDDGFTYGGLVLGLAALALWLRLASRAVPNFETMLARYQDERVPSDTAPPSGLGRLVACATALALTFSAIGYAIPD

SEQ ID NO: 4403 - protein, 88 aa, Methylobacterium sp.
MTFARSTLSVALLLAALPAAAQTQAPDLTGTGGGPTTTITAPYTNREGVTKPPGDALGPRDMSSAAAERREERAIERIENSICAGCED

SEQ ID NO: 4404 - protein, 278 aa, Methylobacterium sp.
MALNLKQWLAGLFGLMLVLALAQGGLALVKLDAVADRTALLLDDTIPSVNAAHGINATIIRTRLWQFRYVTAESETARGESLAKVSEFTNDRDAQIEAYRARVSSAAEQTVYGDLQTKLAQLKPDWDRLRAFPPERHAEAMAFFRGPMNANYLAVSGAARALVDVNLAAAKTADAKVRAEQASATRATLLMLGVAVVIALGATVFSFLGVSRPIERMTSAMRRLAGGDTASEIPYGGRRDEIGAMSGAVQVFRQNLVRTRELEAETALARASAEEQRK

SEQ ID NO: 4405 - protein, 286 aa, Methylobacterium sp.
MSISIASPLAGIRDVLVGLTEEGRGDEAAASLGYGLTLARDAGAHLTVQSAALRLMTTGLPLCGFADELVGAENGRLAVLARKAAERIREDAEGAGVVCTAESPSLMYHEVVLRLSTRARLHDLTVLDTEPFAAMPDRDLMEGVLFGSGRPIIVVPTGWDTFRARRVVVAWDGSAQAARAANDALPFLRAAEAVAVVCVEETERLLSMVPGAEFAPHLARHGVAVTVDDRPVEVDVAETLRRATEQFGADMIVMGAYRHSRMREWFLGGATQSLLARSSIPLFLAH

SEQ ID NO: 4406 - protein, 200 aa, Methylobacterium sp.
MPMSIRSPLGLSVVLAALVLAQAGARAEPSAGTWTDPPAKSAAKSAVEPPEPPGAGVAQERGARSVGAKSVGAKSAETKSAETGSATPRAEPVKRKPVRAVRAPAPRRTVAARPVRRPEPVVRSATVRPVRVARPLHRDWPPAEPVYVAPRAYDPRDPRLERLWSAEEAGYLAVHGRHVAYPDGRTLRIYRPSRDDEDLD

SEQ ID NO: 4407 - protein, 74 aa, Methylobacterium sp.
VTLTDLVAAMQAREAARAARGEPPAYIVEADATGTSVTWSLPGHGLVRREPGGRCVRLRDGVEIPTTGWGYPAR

SEQ ID NO: 4408 - protein, 162 aa, Methylobacterium sp.
MEPMRKLRWEPPGGIAAEPARPDPLTSLVRLVRGPTARPDAPPVSPEDWTGLIDRVRLAAGRAREAEAHALEREQQMQELMRQVRAEAEAAEARVRAAEIRAAAAEARAETCLREAEARVEQAEARARTAETWLLRVHETIASEFAPVHRDLEPALDREAAR

SEQ ID NO: 4409 - protein, 89 aa, Methylobacterium sp.
MIKAGPFAVLAILAAGPALAQPATTAAPPAAGGTVTTQPNTTGNSPDVVISRGGTGAETATTNSAAGGNAGQPERGVPQGSANGGGGSR

SEQ ID NO: 4410 - protein, 91 aa, Methylobacterium sp.
MNAQAEAQGETLREQLGQKRAAIAAGVAAGGLSGTEAEARVADLLAGRAEPETADLRRLLMEYRDLEARPADEADVRLAEAGEVFAPEDDA

SEQ ID NO: 4411 - protein, 97 aa, Methylobacterium sp.
VTTRRPNPGPGGAVVPDPHAKEAGAMTINLSLIRSHMEVVGPDGSHVGTVDAVEGRRIKLTRKDPAAHGQHHSFDADLVAAVDDKVRLNTTDLAAGG

SEQ ID NO: 4412 - protein, 291 aa, Methylobacterium sp.
VGALLTSHADGPLAGRQPLTYKGQRVLTTELAARAFGASDKQLQDNYQNNADRFEVGKHFHKVTGAELRALKNQPDFVGLVGPQAPHLTLWTERGVARHAKILETDTAWEIFEALEDTYFRVREEARAERTAGPPVETSAREIRLMHKHALAIATAAGLAGNQLLIAANRVTKRGTGFDVLAEMGITHLVAPVNDPLVIPTKLGQDLGGLTPREVNKLLARLGYQWADKDHRDRNLWRPTPKGEALGAQLMDRERSNDTGAAQQLMWPLAATLEVLRAGLRDDAGDDGEAA

SEQ ID NO: 4413 - protein, 257 aa, Methylobacterium sp.
MNLFKQFDIYSLKARVFPALIAGLPTLALLFVIVPWDHFGMSHAIAAAMGAVLLFAFADMARHRGRVVQTRLGTGATPEQWHRGNPDVPEVSKDTFRDYMARQLKRPAPTIENEQADPARANDFYLSANAWLRDRTRDTRAFSLLFSENVTYGFRRNLLGLKMTGLVLNLLVLVFCSGILWFRPPYFAALPNMDEKLTFIIAAVVLHSAYLVFAVGKAAVRDASRAYGRQLILSTEALMKKAPAASKGVTPDGSKAG

SEQ ID NO: 4414 - protein, 146 aa, Methylobacterium sp.
MRCTLTLRTGEDPRPYAVLDRAARDLAAALVPVPSGILLLGAEHGRDVARLGALLAVHEAETGLADGALRIVPVLGTARAVLAAASFADAGPRLAALALDATALAEQALGEAERVQARAMAGLAAAAAGVPLIALARDAAGRLGDA

SEQ ID NO: 4415 - protein, 352 aa, Methylobacterium sp.
MTDRTDQEAESGRQAGRPRAPDDLPTRDENFRLLVDTIPQLVWRARGRGDWVWSSRQWQGFTGQSEAEARDRGWLAAVHPDDRARTEAAWTRAEAEDRLAVEHRLLQASTGEYRWFETRALPVGGSDGEAREWFGTATDIHDLKMAQAQQAHLLSELQHRVRNTLATVRAIARRSAETSESVEDYAMHLEGRLNAVSRVQSAIIRNPIGGLSLPLLVADELFAYRAHEGEDFTIAGPPVVVPARAAERLALALHELATNAVKFGALAQQERGSIAIAWTVEDRQKGPVLILDWTEGGLTLAGTEPQRYGFGMDVLQRMLPHDLKAEVVVAFRADGLTCRIALPLDAATPLPA

SEQ ID NO: 4416 - protein, 92 aa, Methylobacterium sp.
MPVLALAALLAGALVALPTPAATAGLDRGSPFYRAAPYVPPSAATFSAPAEAERFRPVHVHDAPPIPPGGRLPNQRAGPVRDHVVRDICIGC

SEQ ID NO: 4417 - protein, 252 aa, Methylobacterium sp.
MTEETGAPAGLDIRHLVVEEAEQSRMNGVHLVANRLAREQVRLGQSVRIVVLHPPARAVDPGVWDAPVEALPLEGHSLFGHLVQPAPRLVAGLVAGAGPGTLVHVHGARRPLLLAIGRELARRGIRYVVTIHGRYAHVADAGMRRAHRSTSLYLAMFERRILERAWFVHALTVQEAEAVRQIAPRARIAIVANAAYSSAFDAPPPPPARAFPSPDFPLFGFCGRYAAHHKGLDLLIGGLAAHRAAGGRGRLA

SEQ ID NO: 4418 - protein, 437 aa, Methylobacterium sp.
VALKLDRREPGVWISVGTHVAVVAAAIIGISAPALPEAQEGVPVEVITENQFSELTKGERNAEKPLSDAKPRADRQAEKFEEREPENAKVDSPTAPTRTADMKVANADAMALRMSEPDPAEERAKAEAKAAAEKAAAEKAEAAKAAKAAAAEKAAAEKAEAKAKAEAAKAEAEKREELAKLIEREEAEAAAEAKAKAKAEAAAKAKAEAAAKAKAEAAAKAEAERKEAEHQKQMAEKAEAEREKAEAAAKAKAEAAAKAEAAAKAAKAKAMADAKAKADAEAKARKQAEIADKFNAGDIKSLLASKAPSQSTGATGRDVQRVASLGAATGTSQKLSPSMRDALVGMLQQQIERCYSAPPGASQGVILPVLDIRLNPDGSLGSEPRVMRSGQNATDQSIAQAALRAVRRCAPYKIPAQYAPFYNDWKAINAEFEFTAT

SEQ ID NO: 4419 - protein, 92 aa, Methylobacterium sp.
VIVLLAGLWPGLAVALLLGLGIGALSGWPQDRAIPLGLGILALLLAGLATSGLVTGVAGLWLESGALMLAVYAVGCVLGSLARGQRTDPDGT

SEQ ID NO: 4420 - protein, 168 aa, Methylobacterium sp.
MPTIRRASWRPRKMFGYDVESYKTNDNWELELNYQFRNSDITPEAREMLLRLRLDIWFIRLPVEHRQIATLIKIDTHHRTTKELVESLDAAPRVYLTEEFQTRNDTRVGRSDMHGYIRYGTYHYSFVDGRVKEYTNGNQEFLWNAVRDYMYWSTVSRADKAALAAIEF

SEQ ID NO: 4421 - protein, 102 aa, Methylobacterium sp.
MARNTPKDRAAAAAALARIAEFLDVPIAGFYEPVPGSNGGAPADPARQAEIRELIRQFLRLHDPQARGRCLAYVRRVADEAGWQPAPVPGAAEETASRLKGS

SEQ ID NO: 4422 - protein, 489 aa, Methylobacterium sp.
MRTLPEDLPEDLAFAPAVTLLDLLARRAVTARALLELHLARIARFPRINAVIFTDPDAARARADAADAALERGERWGPLHGLPMTVKETNNVAGWPTTYGDPALARHVPARNAVVVDRLLAAGAIIFGKTNVPINALDWQSYNALHGTTRNPWDLARTPGGSSGGATAALAAGLVPLELGSDAGGSIRLPAHFCGVFGHKPTPGIVPNLGNERPGSLLDNDLVVSGPLARSVADLVLALDVIAGPAGPDAAAWRLQLPPPRATGLRGLRVALISDSPVAEVDQKYRDAILELGGRLRAEGAEVVADALPFDDHERHHAIYLQLLRGAASGRLPQAAFDEAVRRSAVADADASPYVSQTFSAYAQRHRDWIAASEVRAQLKRAWSAFFTRFDVVIAPAGVGPAFPIDERRPREERTLTVNGHRIDYNDQLFWAGLATLASLPATAAPIGRIDGLPVGVQIIGPYLEDRTTLAIAAELERLNPFVAPQELA

SEQ ID NO: 4423 - protein, 267 aa, Methylobacterium sp.
VSVAPAVAPEPPVLALSDVRFAYRGSEPPILDALTLDVAEGAFVAILGPSGGGKSTLLKLLAGLERPQAGTMTLAGTPIRGPRREIGMVFQKPTLLPWRSVRDNVLLPAAFASRASDAERARADHLIETVGLARAAALYPGALSGGMAQRVGLARMLMHRPQLLLLDEPFSALDAMTRERLSLELQRIWMEERSTALFVTHSIPEALFLADRIVVLAGRPGRILADMEVPLARPRTLDSLGAPEFARLARELRRLFDDSVAAGDTVR

SEQ ID NO: 4424 - protein, 363 aa, Methylobacterium sp.
MMKSPSRLRFSACLILAGLLGTHIACAQAQDRVKVGLAIPPSVTEGSVQAIAEELRLFGDENLQVEYVVLPGAGALLPQLLQRNITLALPLPETLLSAHKTGEPPLPVSYVYNAGPRNTLEIAVKADSGIKSLADLRGAAIGVGALTWGTIPQTRALLRSVGLEPGKDVQIVAVGVLGAGFHALRENRVQALNFNSTWIDLLEGEGTPARRLAFPPTFRRMIVNGFLAHRATLESDPGLIERFGRAWTKALVVCDANPRACIEAFWRRNPGVRPQGDTAGPLAANVRLLQRWIEPLLRDETGQARVPGAYDLDIIKAYIAEMRANGEFAADDIPVASYFTNALVPAYAAFDREALIARARALP

SEQ ID NO: 4425 - protein, 129 aa, Methylobacterium sp.
LGARIVPRPGSAGRHRRRRCYRRARRHGGAVAPPPETGSRPDLRPILLRPCATDDYLSDKTDILDLIRRRIKERALEPKDIRRTIRGWRPEEHYRVTCGFYDCDISQRRAYQLAAAVGLKRTKRLPFEL

SEQ ID NO: 4426 - protein, 81 aa, Methylobacterium sp.
MRPILLLALLVLPASASAQMMDGPVAGGAFGMSGADYFGDIHDRPPPDREAIRARANRHRLASAAKPRASKPRIPARRAPL

SEQ ID NO: 4427 - protein, 410 aa, Methylobacterium sp.
MSEPTPQALLRELRQQLASAIADAEAYDVPSLCVRLGLAEGSDEEAFSSKFRYAATRLAAIDSGAVLEAARRLLAEYEHFGLAEAAAHIEKANARRVSELTRRRLITVFDGAALCTEIEEIDLLRRVWPISTMLSPYSLPGFEPATLEEHIIQHTIRNYDWSNKDLLEAVGLLTCSQRQLFRFLAAVTDPVAQRRERQTELVEGINAHLRHDGYTLAVSGRISGSPIYEVRPASIGTPADAPISAALKSFNPDHIHDRWTSALERRATDPAGAITLARTLLEDVCKWVLNDAEVEFKHGDDLPVLYRRLAKVLKLAPDDHTEQVFKQILGSCQSVVESLGSLRNKLSDAHSPGPKRARPQARHAELAVNLAGAMATFLVATRQARPPAGERAGTSPADPDASKPTVQAST

SEQ ID NO: 4428 - protein, 186 aa, Methylobacterium sp.
MLIGAGSLLCRGPATPPPAPRVDAQAFAPAAAAGVPTTPGRPPAALIFAEHFPVTSGAAWEPPVAARPVPAPRVAAAPVRRPVAAQAPARRPELVVARAAERAREPLPEPLPEPLAEPAPAPVAISQPWLVPPAAIPDVEGEEDGLPGLALPFAPAAQAVGEAVGYVRGRAAALGGSVSILVDRMR

SEQ ID NO: 4429 - protein, 83 aa, Methylobacterium sp.
MSLAASPDAGVSFDPFGEKLETPHAVGLPAASRDGAGHRAVAAAFWALALLLVGCRVYLSDYPVAQAVASAGEAVRTHLAAVF

SEQ ID NO: 4430 - protein, 30 aa, Methylobacterium sp.
LSLVIMLAGAVGAIVLTLAALPAADRFLRW

SEQ ID NO: 4431 - protein, 337 aa, Methylobacterium sp.
MNLKPGKIAALAAAAILTVHAPASADWKPERPVEFVAAAGPGGGTDLFARVVQSALSKDKLLDVPVIVTNKAGGSGAETFIHAKTSGGDAYKLFFGTQDAYALPLANKLSYSLKDLEPVAAMTFDPFILWVNPKASGIQDVKGFIEKAKAAPGTIKVGGAKAKEADETLMTLIEKAAGIDLSYIPYKSGSEAAVQVAGGHIQANVNNPSESVEQWRAGVQKPLCVFEETRLTDTTVIADGMSWSSIPTCIEAGLDIKSFAQPRTIWAAKGIPPEALAYYTGLFKKVAQTEEFKGYMARGAQIPRTLTGDELKAFIEQHRATYAGYYKTNGWLKGAVD

SEQ ID NO: 4432 - protein, 160 aa, Methylobacterium sp.
MEISRRTSEIATSAATALIGLIVCYGALENGIGWEESGPSSGFFPFCVGCLIVFGSAVTGAQATFRPAEGRPPFLDRERARAAILFFLPIVAFAALSVWLGLYVAMAIYIVYAMYVPGRLRLATSIAAGLAVAAVNFVIFEKLFMVPLLKGPLLNAVGIY

SEQ ID NO: 4433 - protein, 512 aa, Methylobacterium sp.
MSNISLLLDGFGVALSTHHVLIMVGGVLLGLVVGVLPGLGAPNGVSLLLPLTFSMDPVSAIILLTSMYWGALFGGSTTSILFNIPGEPSSVATTFDGYPMARQGEAVRALTLAFSSAGIGALTGVIVITLLSGWVANFALRFGAAEYFAVYFMAFASFIGMSSGSPFKTLVSMMLGFACATIGADTISGESRLTFDFEQLIGGVSFLVAVIGLFGLGELIMTMEENLEFHGVKARLSLREIGRAVLELPRYWATIVRSALIGCWMGITPGGPTAASFMSYAIGARFAKDKTRFGKGAPEGIVAPETADHSAGSCALLPMLALGIPGSATAAVMMGGLMIWGLAPGPMLFTTRPDFVWGLIASMYLGNIIAVILVLATVPMFAYILRAPFRIVGPMITVVCIIGAYTVASHTFDIWLALIFGVAGYVFKKLDYPLAPFVLAMVLGDKAEDAFRQAMLTSGGSASIFWSNGLVGTMMALGVLLLCLPLISKLLRETGIGFRRKALPQQREIGST

SEQ ID NO: 4434 - protein, 35 aa, Methylobacterium sp.
MQDMTLKLFSYGMIGAFVCGLALTTWSAAGLLIGL

SEQ ID NO: 4435 - protein, 305 aa, Methylobacterium sp.
VTLINLSLPGNLLGGTNVGGLVSIGGNNTSSDTIADIGIAANLPGANIVNGVTSLLTPEGNLLSVAADANVQVGTGAGDLVNGLIGNDLLIGSGGDDRINGGAGNDVLDGGEGGDLIYGNQGNDTLYGRFGEDYLNGGQGDDLIYGNQGNDTIAGSLGRDTVYAGQGNDRVDYSAFSDAQLIYGNLQDDVLIGGSGADRMFGGQGNDQLVGGAGSDTLYGNLGDDILTGGSGADRFVFAGPIAGQNSGADRITDFNAGEGDRIALNGQTATAFDSGGNTILLLSGGGTIQLDGVAAGSVQSGWFA

SEQ ID NO: 4436 - protein, 752 aa, Methylobacterium sp.
MPPDDRRERPLLNPVLTLRKEPVPEAAKGGGPSEKDIVQDRLSTQRRALSARLEAIAASGATAPHAGRIHLAVEMFEDSFAPSWTPRPLFTDGRRARLVAPARNGYLVEAEVAYLPSLARHIRTASAVDARVAISRVRDIRAYGADELLRGREIEALWDRATEVEGGKAFVLWLLPFRDEGARASVVQTLMRFETERAVVPSYSAVEFPLARRDGADALVTIRGDETNLARTVRRYRGAGHARGVVTVPSRDALRTIVLSGSSFRIDPVPRIEATAPGIGAEPTPPVPNASAQPIVAVVDGGLTAQSYAGLEAWRAHDLVPPGMADHVHGNRVTSLAVHAHAWNNRLGLPRLDCRVGTARAVPREGSNYPADPARLVDYLRALARAHPETKVWNMSFNAIEPEAEADLVSFLGDEIRSIAREHGILPVISIGNRRRGGTDQLCAPADCEAALTVGGRDHAGDGIPGGPCSVSLRGPGPDGMLKPDLSWFSRLRMIGGSQQTGSSFATPLVSSLAAHTFANLRDPTPDLVRALLINATELEGHDAALGWGTPWHDHFPWTCAPGSVTLAWRATMRPGFNYYWRDIPIPPEMVKAGKLAGKGQLTAILNPLVAEDGGPNYFATRLQVALQYGTRAGGTGNLLGSMREDRAPEREARADLAKWHPVRRHIRDFGKRGGIAFSGNTMRLHARIYARDLFQFEDVTSHHDLGEQDVAFVLTLSDGSDRSDLYNSMTQQLGTFVESAVVEQTVEIEQE

SEQ ID NO: 4437 - protein, 44 aa, Methylobacterium sp.
MEACIAAAERAHEALARLEEANIDAPVRGWALWGSTDIWGLPLR

SEQ ID NO: 4438 - protein, 103 aa, Methylobacterium sp.
MAASAAIPAVPLLGIDADDPVVASVFEIARKYLKTTDGNWNTETRLEEAQIDSLDFVELVFEIEDRFGIELNFNANEQAVSEMTFGDVVELIRTALARKARTA

SEQ ID NO: 4439 - protein, 396 aa, Methylobacterium sp.
VSAVVVSGLGVAAPCGLTTADFWASLVAGRSAFTPAQALPGSGIIAAEIVESADFSGLPIPVPGACDRNAVLAVAAAREAMADAGLTPGSVAPQRVAVVIGNGGGGLTSLDTQYERLFVENKRPHPFSVVRAMGSSSASWVSIAFGAQGPCFVVASACASGTQAIGVAAQLVRAGIVDVAIAGGTEAPLSRGTLQAWNAMKIMSRTGCRPFSRDRDGLVVAEGAGIVILEREAHARARGRKPEVAVASLGSGADAGDIVAPSADGMARAMRAALAEADLSPADIAYVNAHGTGTRANDLTEVQALRAVFGGALPPVSSTKAVTGHALGGAGGLEAVATVLAMTHALAPPTAHLTDPDPDLDIDAIPLEARAMPILAAMSNSFAFGGLNASLVLRRV

SEQ ID NO: 4440 - protein, 66 aa, Methylobacterium sp.
MSDRATQLARCLMEEGIRFPVGQDGKIAPGSIRTFLADRFPGISQAEVTRGVLIAIELAKLDRGLR

SEQ ID NO: 4441 - protein, 374 aa, Methylobacterium sp.
MAYDVFWFLPTSGDTRYLGTSDFGRAPTNAYIRQIAETADRLGYDGLLIPTGASCTDPWVTAASLATVTRRIKLLVALRTSITGPTLGARQAAALDEALGGRLLLNVVVGGDATELAADGAFYDHAERYAAADEYLTVWKRLMAGETVDFEGRHVRVQGARNFHPAVQTPWPPLYFGGSSPAAHELAAKHVDAYLTWGEPPEAVAEKIADVRERAARRGRSVRFGVRLHVIVRETEEEAWAEADRLISRLTDDDIARAQANYARMDSVGQARMAALHGGRRDRLVVAPNLWAGVGLVRGGAGTALVGSPEQVVQRLNDYAALGVDTFVLSGYPHLEEAIRFAELAFPLIAGKEPVTLRDSAQTGGAFDIRAAAR

SEQ ID NO: 4442 - protein, 548 aa, Methylobacterium sp.
MSVIRLPFMWERAQLTENGPLNAGEIAQMDAVVGYAASRGMQVILEPHNFGSGFGHLIGSAETPNSAFADFWARLAGHFAGRGNVIFGLMNEPHAQTAQQWLGSANAAIAAIRATGARQEILVPGSYWSGAHSWVSSDNDTVTGPGIVDPLNNFAFEVHQYLDSDSSGTHPNVVSAAIGVERLSAVTQWAEATHSRLFLGEFGVAQDATSLAALANMMAYMRAHPVWEGATYWAAGPWWGDYMYTIEPTGLGSGQVVDRPQMDVLELFLGSAAPQGGTATGAILSGTSGADLITLPPGSVTYRGGLGNDTVYGSVDADLIYGNQGDDRVVAGSSPGTLGRDTVFGGQGQDLIDYSNNGLGSFIYGNMGDDTLTGGSGDDVLYGGQGQDLIAVGEGRNLAYGNLGDDTLIGGSGSDTLFGGQGSDVITAHSAPGAGSLIYGNFGSDLLTAGSGNDTLYGGQGADTLVAGAGSDVLVGGLGADLYVLGTGTGRVRIVGFDQSAGDRMRIGGQTFSVGTAQSGDALLTLSGGGTVDLANIRAEQVSASFFA

SEQ ID NO: 4443 - protein, 771 aa, Methylobacterium sp.
MAVPETAEAGSRFEPFAVLSFQARIAEVCQRRLGAALDGYVAATDAANRAWIDAARPLTPLGAWGEAVSYWTDFTQRSLLFWDTLRHRGNDWLAHEAAGKPPLIAFDYEIVADARRYERPANYALARIAAPPDRPTDPDKRPYVIIDPRAGHGPGIGGFKEDSEVGVALRAGHPVYMVIFFPEPVPGQTLADVAWAEAEFLRVVRDRHPTRGKPVVVGNCQGGWAAILMGALEPKGAGPIVMNGAPMSYWAGNDAENPMRYAGGLLGGSWTALLASDLGGGRFDGAYLVENFESLNPANTYFGKSYNLFAKIDTEAPRYLAFERWWGGYFLMNREEIGWIVDNLFVGNRLASGRAEWAPGRAFDLRAIRSPIILFASLGDNITPPQQAFNWVADLYPTTEDLKANGQVIVGLMHESVGHLGIFVSGSIARREHSQIVDLLDYIEHLPPGLYGMKVEEQQVDGAVRYDAVLHEVRVEDLQELQKYARKDEVPFVAVEQVSRLNAAAYESCVRPVVEALVRPETAPVLRALHPLRARRWALSDLNPFLAPLGAWADLVRTHRVRRDEAGPLATAERRGAAGIMAGWDLYRDLRDAAAETLFYAVYGTVSLTARTEVPKAASPDRDTATNRVALDQIDEGGFTDAAVRAGLLVSRLGRNQRRVSTFKRIRALVGYDVGLLAMPTEAAARVVRRQAAIVEHAPDQALATLPSLVSRAEERRRLLDVLKRLASHLDLQPEQRALIPRIEELLGAATEAEAAPDRESVSQPIRRQAS

SEQ ID NO: 4444 - protein, 531 aa, Methylobacterium sp.
VIQSEAEERARIAADLEEAQRKAQRALAQLEARTREAEMSKARLEFMLDEKGHYVGERLPQMLKRYPMPAEEIAVVPVKRGRGRPRKDGSPAQPRSEAERTASRARRSSGNRAWDKRGRSAAFRLRVPAAISDLNDTGNMVTADASTQAAIALVPDRESPGPEPEARGPEVLQPQSVEPVVQPPLAAALILPALTREVGDLLGDVDNPDEDERGQIEAGTISDKVLDIFSAEALAERAKLRDPRRLPAGYDPSWADAWVRDPLAPLPEMVREFITFGTAVDKRPEDLTDEEARLLAGPAMFPIPEDFDPADYRGRPLPPFFTREKDVSAYEWKAEITRAGGTMQKLVARNALYIDEIREIERARRRMWPYAVARRDLIKGLMEGLAVGELSFEPVSMAPADLARSVRWLVFRWADHDWLQLIANADLDLYYTRILDKVPWPEGLSRRALLERFGKGVDLTSPLNMSSQDRPPLFLFEEVEWVYGTGFGIRAADGGRIDLPRVGIAPGPDFGAIDCTVPIERDPDVDPQAWR

SEQ ID NO: 4445 - protein, 33 aa, Methylobacterium sp.
VILLDLPDRPAVMVPEIEAIEQHLARLIDDLLG

SEQ ID NO: 4446 - protein, 236 aa, Methylobacterium sp.
MLETRNLRAGYGHITVLWDLSLTFREGALTAIVGPNGAGKTTLLRALTGLIPHDGEIRLGGERLAGKTWDLAGQGIVMVPEGRLVFRDMSVEENLCLGAYPKRCRGDVSSGLDRVYGLFPRLRERRGQMAGSLSGGEAQMLAMGRGLMSQPKILLIDEPSLGLAPVIVNEVFDIVARLKEAGTTILLVEQNTRVALSVADDVHLLRGGQVRLSVPAAQVDLDRLHDLYFAREAQSA

SEQ ID NO: 4447 - protein, 290 aa, Methylobacterium sp.
MIALILQALFSGLLVGSVYALVALGIAITFGAMRIINLAHGELVLLAAYSAYVIEARAGLDPYLAVPLALVVVAIVCTALFLMIDRIREHRELNSLILTYGIGIVITNAILLVFASDVRTTNSPRLQDATSIGSVYAMNGEIVAFCLSLALMVALWWWLKKSWYGRAVRAVSSNRAAATLMGISPVRTELVSFLVAGALASFAGVALYTMSVVQPALGHALTIKAFIVTVLAGVGSIPGVFLAAILLGITEALTVTLASSALQELAGMVLFLLVLFLLPNGLFGARARRG

SEQ ID NO: 4448 - protein, 87 aa, Methylobacterium sp.
MFHHVAVALLGGFLTIALGWRSLGLGALVLAPLVASLGTLAVAVLLDRRARRAAPAGSWIRDIEAGAPRAVANDRSTDPAALCRRRA

SEQ ID NO: 4449 - protein, 102 aa, Methylobacterium sp.
MGVASDMARATQEGGSAPDTATLLQDADRYDPLRIALRNARDAFDPDRAMRERRAPAAPLIWYIEDTPDMALPRTRAGSDARPRQPDIGAVRGDFDTAAGIV

SEQ ID NO: 4450 - protein, 84 aa, Methylobacterium sp.
MTQDPNSGAPAAPEDVPPPRRGPGRAQRRYRLDPAARARIGRGLRLLYAEALTQPVPERLERLVAQLGAARPACPSEQIEEPPR

SEQ ID NO: 4451 - protein, 263 aa, Methylobacterium sp.
MTQPAAVEILTSAAPAYGITPLLSTNGRLRAAVPVLMTDGSLHGYELEVQASGGRPYVREATLGARLPAFCPMRHINADGSFCLNWEPYESLALEATADGATWWGAVLQFLRLQERARRLRRWPDRREWAHGGAAVHQRKALEAAAAISPRLRDRLFQGRVAAVRSKGCSSRGSAVRLHVDGRTMARIFVKQRRPATLRQACPCGQDERPLTLRRCRDHADRLVEIVGAMQDMATAERAFWKSFEGKACCGTMKGCPLGTAKP

SEQ ID NO: 4452 - protein, 182 aa, Methylobacterium sp.
MQADGATVVGTWMWRCGDCHILDVGAAELLTGASDLADTELPAEALARRVLLADRPAVLSALERMGRERGVVVFEYRVWTPEGIRWLLSHGRVYPAQPGMPAHGHGVLIDITHRKPPPPEPAGPEETTPSALERAARHALGARAAVDEDGSASLRLLVDMFLLEVGRVIARRAGVAGARGLH

SEQ ID NO: 4453 - protein, 104 aa, Methylobacterium sp.
VFETDDPRPSETTGTSKFGTEHASGRPLPAAAQRTLDDVAEALGLATDLLGRIDSAAPNRDIAAASLAEASALLQAFIRIEDAATRQRCLAFVQAAAAEVQGRS

SEQ ID NO: 4454 - protein, 82 aa, Methylobacterium sp.
MSSHHRAVALALAGLLALPALAAAREAHHGKTAAHQAAKPQSRAAIAASEGFTARMSRLDALMGGQQQQLAPRARSASALPN

SEQ ID NO: 4455 - protein, 117 aa, Methylobacterium sp.
MTEDLAPSRRPTARGLSFRRRSRIVPGPLRPAQTRTGGGVAAGMLTGALLGLAFLAAFTLPFVRVGGSAGEAEHKAARAAVRTSAAQADRGGAGGMAAPERAADRGVPDGPAGGRPN

SEQ ID NO: 4456 - protein, 278 aa, Methylobacterium sp.
VPSLSTRLIPPAMLDVIKRSPTLYGVGRKARFALGSRLGARPVAGIGRAHYNDFMLTSTAPDKVASYMAGAAQFVDILEAAVTEAGRDWESITRALEIGCGYGRIVRQLSRRLPGERIAVCDMIEEGARFTAAEFGAAQVPVMERAEPKPASAYDLVYLLSVYTHLPRAVVHANLADVARALRPGGIVVFTIHGQGSAEQAERYEQFWLDKPAVLAALAREGYYYARYPYYTADYGLTWFSRAAVEALVAEAAPDLEPLSYRAMQLDGHQDVFVYRKR

SEQ ID NO: 4457 - protein, 425 aa, Methylobacterium sp.
MRGLAAGLVGLGLATGWAGPAAAFQPPATVEAAQAGFDAARLEAIAAFVQRDVAAGKIPGMVLLVMRDGRPVLARAFGEQTPGTPMRTDSIHRIASTTKLFVTTAAMRLYEQGRFKLSDPVATYLPELAALTVYAGAESATEGDAPPPVAPQRAPTIHDLMRHTAGFTYWWIGPANAVRRNQRAQNLEGLYDLTGEEMLGKLAQQPLLYQPGSTFEYSIATDVLGHLLERLEGKPLDRIVAEQVLEPLGLWDTVWQVDDARAARLAEPSQRTRETDPLAWVYTWLDLRKAPKRFSGGAGLASTAGDVGRLLQMLANGGAIDGVRLLASQTVRLMLHSDHLAGIKGPRNNVDPGYGWSLVNPVRLGSGPHATPGAAGDVYWGGITGPRYMIDPAERLVVVALFQAPSLRGHYYAILRQMVYGAMTK

SEQ ID NO: 4458 - protein, 149 aa, Methylobacterium sp.
MPEADITRAQFFADDLLRWETRGPGDTANAMRRVAQRAALPFSKLWALRYRPPKAVASHVLAALQAAHAREVERQLRKLAHEVETTARIAPPSDPAVAAAAAALHAAQGEGEGVARPDVEAPRAAPATRSRPLKDHRDLPLWRALDEGE

SEQ ID NO: 4459 - protein, 61 aa, Methylobacterium sp.
MSALATYRISGSGGLLRIVTCRPEELMRLMHRIGIASYTAEVTTRPAYREMIDTLRWEEML

SEQ ID NO: 4460 - protein, 99 aa, Methylobacterium sp.
MARFIAIERETGRVYGDTGRFGSVGNVVSPADAVSLFDRQVGRAMRGFGYVKADSDAAQYDVYEIRAGDSGQASATDADARAAVREHGALAASLVTYNT

SEQ ID NO: 4461 - protein, 746 aa, Methylobacterium sp.
MSTPAASPKARLAIIGCGAVVDHHLLPALKRQGWAPSVLVDRSPERLALLAGRAGRRRADIATAADWREVADRFDAALVATPHTTHGPIGLALLEAGKHVFMEKPLATTGVEGEAMIAAASRKGLVLAVGLLRRNLTIAAWTRALVESGTIGTIRRVDAREGFVFNWATSSDALLRRDLSGGGVLMDTGAHTLDILGHWFGPMTPTRYRDDGASGVEADCVAEFLLDGGGEVRVELSRTRNLANTARIEGTHGHVEVALYRNEVVAGSPNALAFTHAGVSGTAMKPQLFPALFDAEMRDFRDAVAGGRAPLVGGEEGLASVRRIEGCYALREPLEQPWDAAHAALVDGLAPGARVVVTGASGFIGGRLVERLVRAGIDVTCIIREIGSATRLARLPVRLVKADLTDPAAIGAALRGADTVFHCAYDPRSRRQNLEGARVLIGAAADAKVRRLVHVSTFSVYEPFPPTPLTEETRDGDRAWIYVKDKLDIEGQMLAAAREGRVPTAVVQPTIVYGPFCKPWTNAPAEELIHGEVVLPDGGAGRCSAVFVDDLVDGMLLAATRDAAVGERFILSGPDTVSWGTFFSEFARALGVPGPTSWPLAEVSKQNQGFVRDVKLVLRNPKRIVQIIVRWPPARSALQAGLDALPKPLRALVDRYYFGSGGPVFGALIVPDPQKTALYTTRATAEIGKARRLLGYAPRFAFADGMRETTPYLVWAYADLVRAARRARGTSAPPAAPVGTPVADAR

SEQ ID NO: 4462 - protein, 37 aa, Methylobacterium sp.
LRVDRQGAARIGRQIVDLAVLAAGGIGLALPLILPLG

SEQ ID NO: 4463 - protein, 88 aa, Methylobacterium sp.
MTSELRATLLAATLLVGLCAAAGAAERPDGTAAPARGSGATGSTTSVGAGGLTGSGATEDGTRRTGGKAPAPATERGGSTAPAAGTTR

SEQ ID NO: 4464 - protein, 246 aa, Methylobacterium sp.
VSVIDYPLNRFTDMASLSDDEQKRLRSLGDAPVPYKRAATIRAEGDPAPCIYLMLEGWVLASMVLPSGGRQVTKVHLPGDILGTPSMALAAAAETLTALTDCVVAPVPLTRLRDLFVTHPRLAALFLMAVQVERIALMDAMAAMGKTDAREQIIGFLLDLHDRLARLGKASDGTFELPMTQEQIGEKLGMTSVHLNRSLRVLDAEGLLTRTGRLVRLNDIETLRGLSQLPRRQLRTDPEWLPVSQG

SEQ ID NO: 4465 - protein, 515 aa, Methylobacterium sp.
MTLLGDDIADLQRLLSEAQAKANAADPHALVRALEQAQQRLDRARGEAELRVVDERLQLAEKAFLRAYHAQRAAERAAGKHLSNGRNLNGESIGNLAMAMVGSDADREGLYKDLIGRTGADALSEKERARLEGAKKLGGDDFKEVLAELAASRGQEATQGKDIRDSRALLDNIKTDVASKLIPAVQSMRDGIIFMAGQGKLTAREISQRVAKAEYDERVGSVRDSYKDRITAQDNIIASIVGVEGMGLLSMTDEQKAQLEAAAKEKLRLERERDKKLKEMSGAYETTKKNIDAAAAAATQVEEQRARQVEVSRSRPGGNLPGITPIAVGGTGASDLFAGVIGQESGGRHCNADGSLVTSPKGARGISQLMPGTMRDPGFGVRPAQDDSREENLRVGREYLEKLQQEFGGDREKALAAYNAGHARVKKAVAKHGEAWLQHMPAETRHYVPTILGRVDSQQLPASHRELAASAGQAVTVNVEPLTVVHQNERGQEIQQPQKLNVTVSQAKPFNGQTR

SEQ ID NO: 4466 - protein, 127 aa, Methylobacterium sp.
MGGKRLHPDAVPTPGPWLVRGKADADATPTAAMLGIEPAANDQPGGWPYLIRQDRLIEPGACPLHLATGIQRLADAKLMAAAPDLAEILLRLVTAPDLRRADLDPHTQEVRTRAWAVLVRVAPHLEL

SEQ ID NO: 4467 - protein, 802 aa, Methylobacterium sp.
MSLVGLGLVLAPPEARAIETPYNAIEGSALAIAAYEASKEQCGYSERLGKAMADLDAFFARRHGYAWTRAKQSGPDMLIRMRNVGRVLGAQSDCVIYGKAIGYVLPAYLNAVDMDPLVMAELSTLLSGKDAAPGNRGAEPVPAPAPGSAAETVAELKRQNPNMNRSAEPEGFRSSLSRVGPNRDRGGAVAQAPAQQPSGVVPPPPGPPPQGQPTASAAERTALPPQGARPGEAPTVAPQGSTGVVANASRAIPLASAAGAATCPINTECRLAEPTFACNVDDATRLAQAGPGAGTQAGLAAVQGGRCETVAAGRLLRFEATASPQVVYATDRGVHVGYLPVGIFAPAGTADTTTCRAPGFCAIRPGPQVQACPTAENLALSTPEARTAAKCVTLSPGQVGEVVSVAAGMGPIAVGFGGNPPFLATYYLGRADLVGIEVQPTPTPASRGWCRPGDWCLIDAPALFCREKDAYERVAASPLGEARRAAIMAESSCRVLIRGNPMKPSALPVPGEGRKLIEVEHPVYRTGWTNAAAFKVVAYAPPIRYTARLSDIRVSAGRTPALTAVSLSAQGTRDASGTFRTGAKERAEFCKGYQSEDDPSALRACLAEPDTSLTVVANCEAKQVKLYGTLYALEERPHDADPDIHVDASRQWLFRDKASREWLDGTTASDEVSVATAFNALCPGTNPDAAFGIAYRDPSARYPRELHGRWFNDRRACLDPRRNEPDYDDYSYTEISAETQRSRGSEDRVNAVRRVGQGAWVIDESSKSQEDTDTFSTSAYALTRNGLRLMMNGNTSEWFRCQ

SEQ ID NO: 4468 - protein, 55 aa, Methylobacterium sp.
MTAPAPSDGRPDRPRLPARAWLLLILGLVLATYPAWRLLVFEPDPPLDALLRLRC

SEQ ID NO: 4469 - protein, 67 aa, Methylobacterium sp.
MEVAVLIFALLFAALGILGALVGLGELGHPVGAHGVQSYGWGLTVNAIALAVYFLFMWTQRYHGRRT

SEQ ID NO: 4470 - protein, 76 aa, Methylobacterium sp.
MPRYFFDTYDGTVVHDDEGRVMPDLNSARLEARHLLRDLLLDAAPEADVSRFRADIRDESGRVVVTATLTLAYADT

SEQ ID NO: 4471 - protein, 68 aa, Methylobacterium sp.
MVVAHLFRILSAVLFAAALVIAPLANPLLVSACLILGGTLAAWRGAADLGLLTGALGLARSAAVRHRA

SEQ ID NO: 4472 - protein, 89 aa, Methylobacterium sp.
MPMRLSGEEPRLDEGAAVCLTFTITDGHILVPCRVGHAALQDAFGPPGGNAMTIFRAHRDAVVDGAIRRYERSGAEGGVVTLAAADLTA

SEQ ID NO: 4473 - protein, 50 aa, Methylobacterium sp.
MNPLAIAVMLGILVAWAGLLAAALYLGNPLLLAIFAVVSVAMFIRWDVFG

SEQ ID NO: 4474 - protein, 124 aa, Methylobacterium sp.
MTTLLRGLALPALLAALLAAPLARPAAAASNTTVGVGSGAVAGALVGGPIGAVAGAIVGGVVGASTERPRRYRRVRARRSALPVRPVAQRAAPAAPRGALTPTVSAEPAPASTGSTGRRWTDPR

SEQ ID NO: 4475 - protein, 871 aa, Methylobacterium sp.
MNPELHLTRDDVRNFYTLCLGRPVESEAAAEGRRHQTALECASSLLLSGEFEAEILRPVLNGRALKHAGISDRTFRKIRAWAAQHGPAVFGQVVEDPAAWHKKWHSLLRGLVTSEPVRADFAARYAEHEAFCEALAEAAAHNEAIVAGVEEINAGRCRGYFVDVTDRSRHFVLQLRINGKTVAGVPVLEFRKELQEKYGGSGHDGFDIRFDDIPEILGLGGGTVDLIEPRTGFVLLEKHHVTFSNAAAAEQNDRTIETLRGYRSYVDGLIDALDGNRPQSVTSVAGYGRNRIFVRPPAAPPTSSRVAVVIDTRGVEPIEDSTAILREDLAALRAQTHQPVAIHLLQDAAQVGAGAEAERGAMSRFDSVARLRETLRAQTDLVVHLRPGERLEPDAIAWLAYAAERPGAHVTYADGEVERARPLSGIALDPIFRSALDIDLLLTSDTYDTPLCLGVSCLDTADLSEEADFRRGVLLGALERHGRCAFRHVPLVLSRGRGGRNAEAAARARATVQAHLDRVGSGAVLEPHVDALAAPLSERSRVRWPVQARRPISLIVPTRDSIDMVLALVSSLKECTRYLSLLRVHVISNNSVAPQTERALDVLASDEIVRISTFEGPFNWAGINDAAIRADDCAEIAVCLNNDMICRTQGWDELLRAQLARPDVDVVGGRLLYANGMLQHAGVAMTGGWMHEAMGDAPGHGLYNDRTRVAHECAAVTGAFMAFERQFYLDSGGFDAATFPITHNDVDFCLRAEKRGARILYDPEQVWIHFESVTRGLDSLDTAKTEMLHESHQALLSRLPRPDYLDLSVNPHFVRDARPFTAVAWPRRDTVLSWIDQQQTRNAAPSIAGIPAADGARDRPDATVETRARTA

SEQ ID NO: 4476 - protein, 399 aa, Methylobacterium sp.
VPMRAPLAWVEIAKGLCIGLVVLMHATLGLEEALGERGYAHAMADFAQPFRMPTFFALSGLFLGRALASGWRPFLERRVFHYLYFYTLWLLIQEVIRFPHLGGGTLAGTLNHVAWSYVEPFSTLWFLYALALFALVTRLVERVAAPAVLGVALGLAGSDVTTGWHILDVACDTYVFFYGGYRLAPQILAFGARMRARPALAAAVTAGWLLVNAVLIFTVVPTLGHTMVAEAPLVALPLGVLGVFGVIALATLLERSVAGPALAYAGYRSIVIYLAAFAPVAALRALMVRYGVPFDVGTASLALTAAGILLPLALERALRGTPAACLFVRPSAGLRAPATILRRGRSLLDTAAVASAASVASVAEAGTSVASALAAPPVHRGALVPAGAPLPLALGPRES

SEQ ID NO: 4477 - protein, 133 aa, Methylobacterium sp.
MKAGERAGLSAPARTVIAHAAYLTVAGLAFLLAPEGVARLLGVTAEPYLVRIIGLLMLCFAAYYGQFARHEDRPLIGASVAVRVCLAAAFVLLVMADLAPMPLLAFALVDLIGAAATALALRGRSTTGPLPAH

SEQ ID NO: 4478 - protein, 42 aa, Methylobacterium sp.
MHALTAQLLVMVAAVIAGVLVAEMIESPVRSWASRLAAGRRR

SEQ ID NO: 4479 - protein, 73 aa, Methylobacterium sp.
MQRRSRTPYSAGFRSETASERARHAVLNRFSYSGGFDGYEGRMTCPPSWRTSAFRDDQDRGARSAARDGSRNG

SEQ ID NO: 4480 - protein, 50 aa, Methylobacterium sp.
MIMIVGLVGMPILLMAVTLAADAMLKPYPSKDDVWRLPKVSSLRAMTFHP

SEQ ID NO: 4481 - protein, 45 aa, Methylobacterium sp.
MTLLAALALLPFAAAVHVSLVIALAKTFDGDAQNTGTAGAVPTLA

SEQ ID NO: 4482 - protein, 62 aa, Methylobacterium sp.
MPDGSDTPRPDETTEPAGDPPAPPRAPEGDPPPEPAAPPAKGGRSDELTKAGDAGDKLGDFA

SEQ ID NO: 4483 - protein, 112 aa, Methylobacterium sp.
MEPTPSSAIAEIDRFIEESRQLIARAEACRQSLIALGAREGHLLMATRTITAMGRIQATLLRQRAMLPQRAMLPEGAAPPEAERVPAVVVVARAARPWWALVGRRKAEARLS

SEQ ID NO: 4484 - protein, 66 aa, Methylobacterium sp.
MSRPALFLAAFALATAAFWLTILTDPPTSEAAPKDLAADAEPVSASALRVRFVPEELCGRFGDCPR

SEQ ID NO: 4485 - protein, 119 aa, Methylobacterium sp.
MRHMILGAALALLLPVAAQAEGDAAAGEKAFAPCKACHNFEKNGVGPDLKGVVGRKAGTYEGYNYSAALKNSGLTWDEANLKEWLKDPKGKVPGNKMVYPGLKDEKKLDDVIAYLKSKT

SEQ ID NO: 4486 - protein, 379 aa, Methylobacterium sp.
VEKSVSDPGRRPDLEWLKALAALEVVVCHSDLAVKHFSGSLIARSWYLPLSGIGVEVFFVVSGYLICLRAPAYANALSFLRARLLRLMPLYALFTGLAVAARLINPAWAWNRWDVSAGTIIGSFLILPQPHYPIVGVGWSLEHEVIFYALVALLILATRLAGEAPVWFGLALFGLGWCGALVGIAPSDAAWYLHPVSVLMTGFAAGWLYRCHEVDGRVGVAWLLMACLAVTVTLSLGTDPANTERSLRLTGASALVILFVALRDTILRLPFADRILFPLGLATYSIYLSHWFTMSALGKAVGRLRLPESAQLPVRLAVIAVAVGVGLLVYRLLERPLDRWLRAGVPIGEAFRQPFRRRRAMGPEPPPEAGIAHPIGAHE

SEQ ID NO: 4487 - protein, 116 aa, Methylobacterium sp.
MTLRPFPTLAVLLALVGPAAAQAPKPPAPPTLEQIERLEAGPRRRDFYLSPEAAESARAAEAKMEAMQRKMDARVRRATRSICEGCAGQAARRRDASAAPRDDVPGMDDPAQAPLD

SEQ ID NO: 4488 - protein, 56 aa, Methylobacterium sp.
MSPLPRLALAALAAAALAACSQAPAAPGPELSPPPPRVDAKTQLEYGGPPPRGPRY

SEQ ID NO: 4489 - protein, 76 aa, Methylobacterium sp.
MPKPRDGRRLPDRRSGRSCERGERPLAIAADRCIAAYEAVLELDDPDLRRLSEMLLLAVGKRLAREDGGALRHLMN

SEQ ID NO: 4490 - protein, 334 aa, Methylobacterium sp.
MTKPIDLADVRARLAAPILGRARTDPFTLDVHHRHPRIAAITFAPGQPIGYALAAHYPDWTDRTALANRLAAMRLFFGRLRDLEPDLAGSCDLWLADIPEAPGLAFSGAGTANILVPDAEFVAAEGYRAFRERVEAGFVDWGARDPALFWRGTMLGDPRKRLPSWRELQRARLCLAAAAPGEGVPLDAKFVGLPGDADRDAPGRREAEGLGLVAGRVPLEAFMGYRHAVDIDGNSSAWMGLFTKLLMGCTVVKVDSPLGHRQWYYDRLVPWIHLVPVSADLHDLAGVRAWLAREPGAAEAVAARGRALAAAITLDQALLDVAPRVIAHIRAPKA

SEQ ID NO: 4491 - protein, 384 aa, Methylobacterium sp.
VALLAWELGAGFGHARRLLTAARGLIAAGFRVRVCQRELWACAEEFLDLGVPNFQAPHHRSQLPPGTAFRARGYADMMAIAGYQSVEGLLPTVLGWDALIDAVQPDVIVADYAPMLALAAHGRVPLVAIGDGFVLPPTHRDRFPVLREGTRMADEATMARHAGLVLVSRRQTAGFSLPELIGGQARVVCTYPESDVYAGQRETPAAGPLTVPGGPLAPAAGGTVFFYLAADFPHTAKLLQALCDSRLPAEGFVRDAPESLRAALRANGIRLHDRPPPLSDALARAGLVVHHGGIGTIESCLAAGRPQLLLPRHFEQTLNAEVLVAQGVARRLPVPFTLAEARAQLAESAHSPDLPARAHALADALAGRLGSLDTLVAACRALAA

SEQ ID NO: 4492 - protein, 400 aa, Methylobacterium sp.
MRTVLLTYEFGAGLGHLNRLIAVAQRLQGCRLVFALPDLPLGVPLVRRTFGEAAEIVQGVVWTAPTAPESRQVPTHTFADVIALFGFAEMARLEALTAKATALLDAVKPDLVVADFAPTLRLASAGRVPTVVVGNGYTIPPGGRLLPPMRPWETMVGPASRAQEGHLLGAVNAVRARRQGAAVDFFADLFQGEHSFPCTIAEFDPYGTARAEPVVWPFNVPVIPEGPPVAERHGPAAFCYFQGNHPALAPTLAAAGSLGARAEVYVQGLDPQAVAARCARNVGVHRKPADFAVALPGTRVLVHHAGLGTAYAGVLAGTPQLVIPHNLEHAITARGLERFGSVVRVGVSPVPEPGTLTRIMKGMLADGDLQARAARAARDLAARRVPDPVGPIAAACAGFL

SEQ ID NO: 4493 - protein, 114 aa, Methylobacterium sp.
LIKRFCLALALAGGLVAAAPAASALTLPTAAGLVGATDSAVVEVRWRRHWRRHHRHRWHRHHHRRWHHHRRHRHALRHHRPLRFSVGQVHAPRVQPWRDPVRPVAGGRLTPRLD

SEQ ID NO: 4494 - protein, 64 aa, Methylobacterium sp.
MVAALKRAVRLRRTMRERDTRVEASGCAKARPLPVGEATILAERGLTARELIRMAQAARRARQD

SEQ ID NO: 4495 - protein, 300 aa, Methylobacterium sp.
LTPLFVPVGIRSADKAALLGRGGHIFLVGGTNRLLTEYVRADEDPVATGTAQAWLTLIERRRATFERLGVRYVQAIFPEKLTVLPEFFPEPVRTPGAILRRIEAGLASKPDLSASYVSTRHALATQPDPAATLLKTDSHFSPLGCWVVFRAILEHLGIVPGLTPAFGTIRAGTGDLAVRFFGIPILDTRTEADLDGLDATFRARAIRTFEYTPPGRFVGSAQSWHNPDAPIDASILVFGNSYCGAAEGHQGQMSWWFARWFRTYHFVWRADVPPGLVEKLKPDIVLCHTVERFLVEVPET

SEQ ID NO: 4496 - protein, 99 aa, Methylobacterium sp.
MRKFAIISAAALTLGTLATTAADARPRGYHGHGYAPHAGYGYGHRGRRGIGTGAAVGLGIAGLAAGAIAAGAARDAYARDGYYGRPAYGYGGPGYGYGY

SEQ ID NO: 4497 - protein, 465 aa, Methylobacterium sp.
MAGIGFELRRLSRRDQLLGPMAAVAHAALIAAGPWLYTILAIFLISAVAGPVVGADATATFRVLLIYIFSLSLVATAPVIMIGTRVLADALHRRHYADIRGLYCATLVGCAAATLALAALVLVGLSGVRAEAALVGIAGAQLVGMLWTALAFCGAVRDYRHITFAFALGLAAGAGLAIGAAYLRLGPVAMAAGVCCGFLIIFLWLTARFLATFPEPCESLGPARAALLDRLRASPALAVGALASAVGVWADKWIVWNGRFGERVDVGLIHAPLYDSPMFVASLTVIPALALFVTSLETSFFESYHAYFRAIERHATLRRIEEHVRAMEAETLRTLVGIMTVQITLCLIVLQTAPMLIQVFNLQFQQIDILRMGSIGALFQFLFIVCTTIIAFFDATRLYVALHLLFTACLIGATALVSSSRMETLALGYMSTCILLGLGSVLPFLHVLRTVNFRVFVGSAVGPKR

SEQ ID NO: 4498 - protein, 512 aa, Methylobacterium sp.
MWFEGLRQASRRLPIAVPAPTADICLVVEGCYPYVPGGVSTWVDWLIRGNPDLTFAIVALVADPSPREIRYALPANVVRFESLPLTVPLDALRWRDRAPPAVEIALADTLVALVNGGGLAALRDLVRLIRDPANHLSLGALMASQLSWRLASATYERLMPHASFLHFFWAWRALFGGLFAVVTAPLPPARVYHTISTGYAGLFAARAALETGAPTLITEHGIYTNERRVEILMAEWICDTVDKGISLQDERVDLRDIWIRTFEAHALVCYQACSRILTLYEDNQRLQRALGAPQERLAVIPNGIDLARFASVAPVGANAPPTVALIGRVVPIKDVKSFIDAVALIRRSVPGLRALVLGPTDEDPQYFEECCLRVAEHALEETLTFTGPVNIVAYMSQIHVVVLTSLSEAQPLVILEAGAAGIPTVATDVGACREMIEGRADEAPRLGPGGEVTRLVDPQQTAEAVAGLLQNEPRRRACGEAMRARVRQSYSSADALAAYARTYAAFLDGSGS

SEQ ID NO: 4499 - protein, 456 aa, Methylobacterium sp.
MTNARLLLLLVLGAVVTAAYLLSSGPEERIAKLVRDGRIGRAIIVAEGVLAQGRATPRMLTTLAGLYDAEGDPERAADLLEIHALVWPGEPDILASLAALYGRSGNAEGHVAALERLVAVRPSRETLARLAALHRLAGRFDAEFTVLDRAGDGDLLGAGDQERLAQLLVQRGRPQRAAELLARAEDRPGGQGERGRMLLFEILLETGATAEAGRRAADWLAEWRKPWLADTLLLRLAPVASAETTLALARTAIRLFPDTRFYLAKRLAEQGHGALAHTIVRGWPAPDAAVTEREIGGYVAVVHASGDPGLLRPAIAALGQAGFEEQAILAEAIEQTHGLPVLAAAWPDLPPEALLRRPLLGVRLARLGRRDDLVLWLVRSADLGALRPGEHAAWLSVLRAACGPFATFEILDRQRRRGELPGGFMAAYRQLAAQVGASDRQRRDLVSIGDGDRQVR

SEQ ID NO: 4500 - protein, 1295 aa, Methylobacterium sp.
LENRDGSTDPAKASYVIAFQSAVALADGAPIFWLNTDQNSNTGYQSFSGAATGAEYYVTLSGGLPYLYDPSTIPATGNAGYVGPITDYKIDAATNTIEFAIPRTLITDDRAGLDLKVFANSGVSLPSDFAATTYRINDPATLPAPGAKAQKIGIVYSATTANQYFGGTEAGQTAYSQLFMAAQNQATAAGVSFDVLSEADLKDVGKISGYDALVFPSFRNVAAGDVDAIQSALTTAVTQYNVGLITAGDFMTNDATGAPLGADPYIRMKTLLDLTRAGGTSTAEPVSVNATGSGFTGYQANELVRDYASMSTSWYGSADGTAPTVLATQTVTGATHDAVVATLTGGKNVHFANESLLGDNNMLQQAIDYVVDPASGPSLSLRMSRGNAIVASRTDMDQAKELSDVRPPSGPGIYDKLLPILAQWKADYNFVGSYYIDTGDGTAANGSTDWDYAKQKYYDPLLAMGNEIGSHSVTHPEDTNLLSSDQIKAEFQGSKNTIEANLKVPVTGAAVPGMPEYLRTSKDIQQYYNYITGGATLVGAGYPGAIGHLTPDDPKVYIAPNMSFDFTLVGFKGLDATQAGAVWESEWNTNTAHSEMPVVVWPWHDYGPTGWPVDPTASNYTTQMFTDFIARAYQFGSEFVTLSDLAQRVASYDASDLTYTYDTAANAVTAKLSSPDSGKFALDLGTGSTIKSVASWYAYDANSVFADRDGGIFTINLGTTADDVTHLSKIADRAELVSATGDGTNLDFTVVGEGTYIVNLKDSIGQNVEVTDKAGTKLAYTQSGDALSINLTGLGSHDVSIKQKTTPLPNLPPTVAQALTASVAEGDQPKTLDLLQGASDPNAGDVLAVSGLAYKLGSATVADAAAAGLSYDAATHTLTLDPRSALFDHLAVGTTETVTASYTIADGHGGSVGQSATFTIAGTNDAPTVANALTASLTEGAAPAQFFLLAGATDPDDGETAKLALRNLTYTLGTGAASATPPAGVSYDPNGYILLVDPGNAAFTPLAAGATQTIMLAYDIFDPAGLAVRQTETLTITGIDTPAPGGGGGGGGGSVPPGPTAGSDVLYGTGGGDRLSLGAGNDTFIGAGGADLIYGNQDDDSLAGGGGADTLYGGQGNDIVAGGQGDDRLFGNSGNDVVYGNQGNDVVYGNQGADTLFGGQGDDVVFGGQDADVVYGNLGADVVYGNKGDDVLYGGQGDDVLYGGQGNDILIGGLGNNILVGGLGADLYRFSANAAHDLILGFSEADGDRIDLQGQTFTLGTAGDGDALLLLSGGGSVQVAGVSTATFGNGAGYLA

SEQ ID NO: 4501 - protein, 80 aa, Methylobacterium sp.
MLGRLIASARSVATGTGAVRALLPSGRPRAPGAAIAPAPETMPDFPPMRPLEPPPARNDDVLQPVHEAVERDLRARGYLG

SEQ ID NO: 4502 - protein, 99 aa, Methylobacterium sp.
MRLGARSILLKLAAVFLLCAGLGVTVAPRVAEAAPLAVPSAVEAPASGLETVQYRHHHRHHGLHRGWHHRRHFHHHRRHFRPHHFHRHHHHHRRGFYRY

SEQ ID NO: 4503 - protein, 402 aa, Methylobacterium sp.
VFGPVADILLCGALAYAAALVAARGLSRAGFPVPAGGETAIDGLRGLLALAVLVHHVAIWIPVARAGAAWTTPESLLLHNLGAGSVGLFFMVTGYVFYPRVLGGLRGLDLGRLALGRLFRLYPALIASILLILSLILWRTGGARASTFHAEAAALLRWLACAGTPPLLGEADSGRMNAHVLWSLRYELLFYILVLPACCAAMDRVRGRAPTWWVPAGLLVGALLLRPFKNALPLIGYLPLFAVGMLAYEVRLREALAARLRGPAAACLGLAALALAATTQVVPGKPAALALYGAFFVCVACGNDLGGLMRARSARLLGACSYGVYLLHGVVLSALFVDLAPLTGAIPTGLLPLLIPAAAMAAVLLAALVHLAVERPGIRAGQALAQAWARAPVLGRLRARAA

SEQ ID NO: 4504 - protein, 414 aa, Methylobacterium sp.
LRLLGPAYRLFYSDPVEISRGEGVILYDSAGRDYLDAYNNVVSIGHAHPRVVEAISAQLRTLCTHTRYIQEGILRYAEDLLGMHQGRVGHAMFTCTGSEANDLAVRIAKHHTGRNGVIVTSEAYHGNSDLTAGFSPSLGDGSPLGTWVRRVPAPDPYRVDVADMGAWMADNVAAAIHDLERRGEGVAAFIADSLFSSDGIFSHPAGVLAPVAEVVRKAGGVFIADEVQSGFGRSGERLWGYERHGVDPDIVSMGKPMGNGYPVAGICVAPELVESFGRETRYFNTFGGNTVAIAAAQATLDVIRDEDLQANADRIGRRIREGLAELAKRDPRIGDVRGAGLYIGVELVRDRDTKEPDAATALGVVNGLRQRRVLISATGFNANTLKIRPPLVFGEDHVDRLLTELEGVLGSIPA

SEQ ID NO: 4505 - protein, 328 aa, Methylobacterium sp.
MLEEEAAGLCRSRYGLDGDLLRFATEKDDTFRVRNGRGEAFILKITNPGEAESEVNLQTDLLHYLAKSSPHLRVPRIIPDLDGNRYAAYVDAAGQRRLLRMMTFLPGTPLSEIEPTSAEREKVGEVLGSLRLAMSDFSHPADCREIAWDIRHLGKLSHLVGHVEDSGRRSLIEGGMRRFREIESDLTKCRMQMLHNDFSRSNIVVDRKTPEFVSGIIDFGDAVRTAVAVDVSTALLNQLSPIPREDLFADAKDVLRGYLRIADLTEDELRLIPHLVMGRVIARALLTTWRARLFPDNAAYILRNTYQGWHQLQWFLDRPFREISNTLA

SEQ ID NO: 4506 - protein, 44 aa, Methylobacterium sp.
METLDGPLPGTLLVQLSRLHRSEHARLAAAEAPSAQATGGPRDG

SEQ ID NO: 4507 - protein, 429 aa, Methylobacterium sp.
MAPPDRAASEPVVGRAILLLLVLLLCLGGVANALRKDIAKGFDEVAHVSYVAQIQREGALWPDLRALRMLDPASLAPTALPNYLNHPPPYYTALARLGPAIGADPSAVLVLRLINVGLASAAMAALLLLAAGLARSRRAFWAYAIPLVTIPTALALNGAVNNDNLAVLGGALAMLGLQRLLCGDRRAWLAAVLAGVVAAGLAKFTALLLVGGCAGPVLLWLVLRGRLPAAVLVPAALALALGAAPYAVLLAQYGSPVPEVPGHLAMMRDGARAAGWDGARLDFPAYLLNFAALFAVQFMPVLAEPGPVETAALALPLALMGLSLAGGAAALARLGTGRAHPLDPLAVAGWAAIGLVLAAHVRFGYLNHLATGWRLDAYPRYYLPLAGITAVGCACLIAGLPEGRARRGILAFLAGAPLAFGLLGAPLGG

SEQ ID NO: 4508 - protein, 74 aa, Methylobacterium sp.
MQLSTYLAPPPTPLRAANEAVPGPEPLRDARPARPDAAVLPFRPLARRHRRPAETHERRGEILLFLGVRYSRAS

SEQ ID NO: 4509 - protein, 91 aa, Methylobacterium sp.
MPPKPARFLLAALLVGLAPLPAAAAPPPGVSPGSGTENIGAGPAPGTPSGVVGFDGPPGGGVNTTGGPGALPPSTPPSNTGLPAGSPASPR

SEQ ID NO: 4510 - protein, 63 aa, Methylobacterium sp.
MNLDAQHDRTALPPAPLPATTHPIQQPTDPAEQGRTDETADRSEGEPAATPTNAFEAFGSFSG

SEQ ID NO: 4511 - protein, 93 aa, Methylobacterium sp.
MSVIESRGTSRAAASVNATPRERRARAVAHANQLRALAWVALRDGAPHGAMRAATARTAARRILQHERRAAVLNRALAQALEALVEEQADLVG

SEQ ID NO: 4512 - protein, 64 aa, Methylobacterium sp.
MPRTPEPEPYGSVEPLPVPRLRGRRTGDAEPPTNEPLDPDERPDVGLSQSGSGEEAIVRRETEI

SEQ ID NO: 4513 - protein, 423 aa, Methylobacterium sp.
MTTLTRRQALAGLGTATLAGAFPAPAIAQNAPIRIGGLTTLEGPFATGGQDAFRCVQMELERINHMAGGRRIAFIRESSNARADVALARARKLVEQDGVDIVLGPLSGAEGIALKDYSATLTGKTIVNGSSAAADTTLRNPSKNFFRFSTDGTQWMAGVGNHVRKTMGIEEVCVVAGDYAFPYAQVFGFSLEYCRAGGRATYLWSPLGTTDFASQIAQIPKSAGALVVVHGGTDGLAFMTQYAQAGGSLPIIGGSIMADQTMMSARGPHRKLMLGMVSGGPIADVNEDPNWNDFVARYRKRWANEGGFQSPSIHGVNYTTNLQGILGALEEVRGDLSGDQRAFQAALAKHRFKNPMGAEVYLDHNRQAVSDIFLTKIEEREGKPVTVAFARAPAINQTLGVPEARFLAHGAPSRNNTGCIAGT

SEQ ID NO: 4514 - protein, 63 aa, Methylobacterium sp.
MTRLLGPPPARTALRRGLAHLCRLAGAGLFLATCGVASYTAGAHYRPEPVRAADPGSAPVCPR

SEQ ID NO: 4515 - protein, 137 aa, Methylobacterium sp.
MSPTRTPPGPACPRAALDALGREVGRALPPPADGLGESLVRRALRETPGDEPDEDRLVVRFGTEWRGFIRRQNPDRLAALDALIDAQIERRALARFYRRVRNAAVAVTIAGFAVAQFGIDRLPVVRQIWRLLRGELR

SEQ ID NO: 4516 - protein, 241 aa, Methylobacterium sp.
MSAAEPQPNQAAAAEDLAPAEVEVLDAAPVAAGSSSEVVTEAVSEPESDETVEALDASAAEVDGVTEPQAGAIAAEPKEPAAVDEPTGETAAQVVSEEGVSQEPAEVAASDVARAEAPDPDSIGAESLLPVSAFAALDAADASEAGAARPAVARTTVRFTFAPVRIDVEGIGVVLANYMHNESVAILSYMRALGAARSPADMIRLNVTAMQRAADASLTCWSDIARRTAQGVPWQREKAAA

SEQ ID NO: 4517 - protein, 70 aa, Methylobacterium sp.
MGKLKPVYLYRLRLLYAAPRYYAPQSINHYLEKRGLIRRTGRALPARRHEEYEITEAGRTAFDAALAAPE

SEQ ID NO: 4518 - protein, 205 aa, Methylobacterium sp.
MIEDVIDGRTIPVSEQISTMISRIAERQQYDAVFIDSRAGLAELAAPAVLGLGATVLLFGTAQKQTIEGYRALFAALQLLAQRDRAQGRDAEWRTRLRPVLAKTSLAPGAVERYLEDMYEIYSAHIYDAETDGEQPPDSLRFAQNDKSAPHWPLIVPFSQNFVDFDPGRIPGQLVQSFYEQTFGPFLAQIQLAMVSDENIGGSQP

SEQ ID NO: 4519 - protein, 92 aa, Methylobacterium sp.
MIRAAAMETESHQRIFRCHLMVTVQAVLSEYRPGASAQMVTDLLARLEALEAKAMAEGAPVATIAAIRGAKVLIQIPPAPRMRHFPIVVSDL

SEQ ID NO: 4520 - protein, 80 aa, Methylobacterium sp.
MALYFFDVHNSQFSARDEDGKECENRDSISAEALRQLCVIAKDDPLLHMNGTIGAVVRDEHDHVVLTANLVLAVVWVGDA

SEQ ID NO: 4521 - protein, 103 aa, Methylobacterium sp.
VCAPVLSGLAAAIQLPALPAGRSGPVRAGPVHPVPAPSPCGVPAPPRPIPPLFLHGIRPALEAAFGTEDAELAPDAIAALVARLHTGPLGPAQAEASPAVAVA

SEQ ID NO: 4522 - protein, 119 aa, Methylobacterium sp.
MSKPVTDNKQTIDRTRRLIAEMREVIEDARLSVLAARDLLKQFPSPEGVGPASPLVEPPADDPSEDLTVRLVDILLDAHSVANLDDDAETRVLLETALLRVGHRLARRAGPRAAGLVLQ

SEQ ID NO: 4523 - protein, 70 aa, Methylobacterium sp.
LTARPRLLAAAALLAALVLAFVRKSPEPQDPCEAHPQAYPCALFATAPTAAAPPQDPMPHGNDPAADGTS

SEQ ID NO: 4524 - protein, 98 aa, Methylobacterium sp.
MSARRLLHTSPEGTRWSLARAGAEVFVLREGGGASERIGLVRFLDGDPAAPERRALLDLVATLAEVGSANGLAAGPVTGAPPEAGAAAAEPSPGESAS

SEQ ID NO: 4525 - protein, 53 aa, Methylobacterium sp.
MPDTSQDPATPRAVAYSERAKRQSFQTIAIIAGLILFIMVVFGFLFGAGRLIA

SEQ ID NO: 4526 - protein, 78 aa, Methylobacterium sp.
MTRPDDTGPETDPGEAPSGARAYGDRPVSGRPQGGRAPGASEPADMGSPEGTDAAENDPGGRERPDDRLEPAGGYRGR

SEQ ID NO: 4527 - protein, 51 aa, Methylobacterium sp.
MGLFVVIACAFLVAAVLEVLAFRRRNELEAEGLVTVVRPETSTYLNPPRPY

SEQ ID NO: 4528 - protein, 135 aa, Methylobacterium sp.
MDALGPLVASGRIVDLILILVAAEAALVALSPRRFGPRAPLLAGLAAGAGLLLALRAGLGGAPWPWIAGALALAGGAHLTELALRRPKTLRRREPSATSAEALALGSVSRRHERMKRRRPPPLPRPCAGEGARGA

SEQ ID NO: 4529 - protein, 112 aa, Methylobacterium sp.
VTTIIRRGRLRPALAAAAPLALLVAATLVAATVSAAAQESCRASLGPSRAAALVARCVAVSPAPVPPALVPPDLLPPCHAANPCAVIEAEIARGCDDLDEDAPDFCLAYRHR

SEQ ID NO: 4530 - protein, 67 aa, Methylobacterium sp.
MKIVSENYAACFARSHEVDTTERLMLDAIACNLRSLYGDAAAAVPDDLLVLAGRLEAPTPPADIRAA

SEQ ID NO: 4531 - protein, 238 aa, Methylobacterium sp.
VLIVNKSYLMEHGTGTLGDLRRNGNVVAVDPVDLKLAPGTRIDADLLIASSRMQDAFFREHFADLTTFYVPHHADLRIPPPGEPPARFGLGYFGALYNAPFREELATAGLCDFHKADDPAETGWMASLPHYACHYAARSWQPFDGFKPFTKGIIAARCGAVVMVDRNPEAEAALGPDYPFYIDDTSLAGIRTGVECARSGFGSPLWETARAAMARLAASVSEEAVAASVLNLSRHVGR

SEQ ID NO: 4532 - protein, 71 aa, Methylobacterium sp.
MVLLYVSAAWTGGILTLAALWQPLGPALALVAAPLGASAVTAGAACLIGLRANVRRGPPPGGVALGWPLAR

SEQ ID NO: 4533 - protein, 160 aa, Methylobacterium sp.
MQTTLLLAAAAGLVLGAGALLYAGIRIGRPRPGEVSPAPGGTPVAARRLVGTWQGRQGYAFAVALSHTGPGDIPIDGIAVLAPAGARISVQPADDDRWTRPGRRHAVRWRAPAGKRETIVQCRLHLPAAAARTGTRVQFRLTGAPETGNQGIHVMLTVDL

SEQ ID NO: 4534 - protein, 143 aa, Methylobacterium sp.
MRTVKLRPEPVLIALRWENPGDAPAETATDPLVPAIHPWIAFLLEPWLQAIEQAGPGTTHWLQETSAAMSACLGEWVDPTPAIERALDGARTASDLLVACINRAGWANADAQRQVARAAMGVLIEALTQAEASESKTELGLGF

SEQ ID NO: 4535 - protein, 97 aa, Methylobacterium sp.
VDSAEIDSAMQPARSDPGAEGPAKILTGDAVLPCRLRPEGSAAARLSLPSAVGIPELFVLSDEASGDERLARVTCRRQGADGARLWVQFLGPARLAA

SEQ ID NO: 4536 - protein, 111 aa, Methylobacterium sp.
LRRIVLAGLLVLASTAADAACRCACVSGRAVAACSSQGEMEPICSQICPEGLTPGALVEPLVPAGAIRLPGPALSDDELGRRGAETTAPNGSFNPAQGLALPSVGGTSQPQ

SEQ ID NO: 4537 - protein, 26 aa, Methylobacterium sp.
MPEELLVFGLSALTFAAYAFYRTARP

SEQ ID NO: 4538 - protein, 399 aa, Methylobacterium sp.
VRALDLAGLRADTPGTAHGIHLNNAGASLMPRPVVEAVKAYLDLEAAWSGHGAAEREAERLAGVYASVARLIGAEPDEIALTESATRAWQMAFYALARGFRPGDRLLVGRQEYGASLVALRQVAATTGARVETIPSAPDGRIDAAALAAMLDDRVRLIAATAIPSNGGLVNPVAAIGALARARGIPFLLDACQMVGQRPVDVAALGCDLLAATGRKFLRGPRGTGFLYVRRAWLDRLEPAMLDHFGAPFDGDGYRLRDDARRFETYEHDHAARLGLGVAVDYALGLGIDRIAARIGTLAGMLRQGIAALPGATVHDLGPDPAGLVTLTLAGQDSATVRAALGGAGISAGLSLHAAAPLDAAARALPPLVRLSPHAYNSEDEIGRALDVLAGLAQGRVQP

SEQ ID NO: 4539 - protein, 80 aa, Methylobacterium sp.
MRLAHVALAAALALATAGPAAAQVLSNPSSTNQALTNQSNSRANQIGTTSQNNAARMEMQRSQSAQPPAPPTGVVGVPRR

SEQ ID NO: 4540 - protein, 59 aa, Methylobacterium sp.
MDRISAGRIGLGSGAPLRAGATRDPRFVAPRSTHPGALWLAAAAPLAATLLLLAARISG

SEQ ID NO: 4541 - protein, 143 aa, Methylobacterium sp.
MAGLDRIRFAKFVKCRALMEGGATAGERAAGAAGAARIAAAAGLSLAEALRLTGSGQPRETRRDAPPRRPRPWETPPLRTDPIGLDEILAQKARTEAHRKRKAARAAEARRADLAAEAAERAALREAQEARDRAWAEARGKTG

SEQ ID NO: 4542 - protein, 60 aa, Methylobacterium sp.
VLRRILISASLYLFVAAAVMAAAFVLDRLEPDADGAVVDLGADPGAEILTTSVTSWTQAR

SEQ ID NO: 4543 - protein, 82 aa, Methylobacterium sp.
MRKLQYDTGTAAEPAGAAHADPNARAALRRLAEICIEAHGIVAREGPEEVRLPLEELLGRIGRQLGAQPENDVAAETAGAGR

SEQ ID NO: 4544 - protein, 90 aa, Methylobacterium sp.
LRVEHVSEGDPQDRPSPGRTAELLAEIAAILRVDPVIFFDGEIQERVSRDLAADELAELLALFRSIDTPNLCEAAHDLIRTLKRDRKPDS

SEQ ID NO: 4545 - protein, 121 aa, Methylobacterium sp.
MRKLAAISAAALIGLGTLASTGAEARGRGGAVAAGVIGGLAAGALVGAAASNAYGYGAPAYGYDYGYGGGYPAYGYGGYSDVGYAPTYSRRVVRSYDYGYAPAGYGYSGYSWGGPAYGYGW

SEQ ID NO: 4546 - protein, 96 aa, Methylobacterium sp.
MQIKTIAVAASLVLGLSGAALAQSTQPGAAGASDPAMRSGHGMDRSMNRMDPNTSPGSTGSTGREGGMGNMGGGSGASSNTGVGLGNQGANQGARQ

SEQ ID NO: 4547 - protein, 51 aa, Methylobacterium sp.
MSLVTILLIILIILAFGGGGFLGGGAYRGPGFGLGGILLIILIVLLATGRL

SEQ ID NO: 4548 - protein, 287 aa, Methylobacterium sp.
MDQEQSSRPDLADARHPHAGVFARTACVEADVRHAVRHAGPSGARMPAIARSPAAEAGTLFARAPDFAALGPEARAALEKAAHKRRHAHNGFIYLQDDEATHLYFVVSGHVRIASLMEDGSAVLHAILPPGESFGELGVFDGSTCCDMATAIGPTVTAAISVQSLRVLSERHPEIGAALGRVVARRYRGYVLLTRDLSLKTLAARLAQAVLRLAGHLGTRTRYRDREVGTLGSTVTQTDLGLMARGSRGNVNRVLKTWERAGWIAVADRCILILDRGRLEGLAAEDC

SEQ ID NO: 4549 - protein, 79 aa, Methylobacterium sp.
MDADRSGTEASFGMTDLEEALQGPDRAAVRAEALARLDGALLRVEARLREGLDPRQFASAESIRAALVTARGLLAAAPR

SEQ ID NO: 4550 - protein, 102 aa, Methylobacterium sp.
MAGVGTYGQYGATQATPTDAFTQPYKSYDGFDLIWRQNNLQKQMKDIETDIRNIEQNANLSDTEKMFSMQMAMNSWSAISNLRTNMLKTVSDTLKSVARNVA

SEQ ID NO: 4551 - protein, 394 aa, Methylobacterium sp.
MSGSAEITRQSVAAFNAISPVGAEVMEEARGSYRGEAVTLASDEAKLADAAEEIGMSVAHRADKKALGQRSVRQGQAAYPEALARLREYLDELPDMPREAELVDLIEQLEAFQDLLAGTGEGGAGATKEDVLAALHAFDPDVTHQFAGLEMARAQFEASGADPVFLALLDEARATYETSEVARDVRAGFAAAGIAARAAETLETDPAAVREVYRAMLRDTLHLGQLFDALGRFALLTKFETAVETFMAAAGRDLGSAGPSTDPLFLHGLLTELAKLKKMQSALDGMSDLVRLTERSLPAGQRGADVVALTSRILNFAASTGVGAADARRLLGSFEDQALPVQLAFANGLRGLHGELPDDVMPSLPARLQQVGAIMALLDGIVAAEERAFGEGQR

SEQ ID NO: 4552 - protein, 125 aa, Methylobacterium sp.
MSFGRASLGVVEGFAAQLGLPLRPARDGSVSFAFATTGTLSLTPSADGSRILVGLARPLRAPDSGRLERALACAGLQPATGRVVRAGLSGDDSLHLVLELPEAAFDLPALDVCLQELGALHDRAA

SEQ ID NO: 4553 - protein, 61 aa, Methylobacterium sp.
MPISTISDFIQLYSTGIISRECLEHEIRSWTDADEAQDRTPETEGCIVLYPDASGIWRAPA

SEQ ID NO: 4554 - protein, 133 aa, Methylobacterium sp.
MRSIGRAIAPALALACAAISAAEARQAAPPRNLECRDLRRLSDNFLLDLRIRLVFSRPRHSYVRLENTGRGWQPVAERRYLAIEPTRIVLADNAAFTTYIERLTGDYYHVDRTRTGLSVWGRCALAGGLNRLF

SEQ ID NO: 4555 - protein, 687 aa, Methylobacterium sp.
VAEAASDTVILKILTGMQAGVEVALGPGEYGLGTGPEDDIQLIDVSIRPGHARLRVSGGAVPGGRIALAGAAGALRTAAGLRIEPGSGFHEIEPLDVVTAGTTRFALGHPTSQWATVLEDADAPPPSRQAAPLGGERLRLLAVPLGALALLLAFAGWLVLGGGLTRIAGRMEGTRDDLALTRAALDQFPFGRTVAARQEVDGAVYVTGYVDTPVERRALVGALEKAGVPARTRLWVLQTIRAEVESLIAAQKLPVGFRLSEGGALTLDGLILSEARANRFVELVKDRVVGLAEVQSRIRTAQTLLGEVERLAQAAQVQPYVLLRVGDDLIEATGAIPAEKLDAFVGFLQSYARRFAREIPLRSFVQLQGAGGSERAILVGGTATGSDVALDPDQLAQGGYRPGDIVPGAGGRVAGARATTVVADAGGEGALAARRDAPARAQPDTPPARSGAAANADRDADRDADRVGDRTRDLLRRWREGRLGNDPKARALKEALDALRATDPAAGRGATPPGWYLPVLADAPEAEGAPCWAETRLRPRDAVAALFWLDLLSTSEAVSLTDQERGLQPVLLEVALNPVRAAACARRTPEGERAAAHSVYLREIGRNPAFLRFITRDLAPFGLDLTGVSLVPARYVLTRGGRRLHEGAAPDQTSRVAAIGELGVAVQTKAGLSAVVFEPDLSWKITQ

SEQ ID NO: 4556 - protein, 152 aa, Methylobacterium sp.
MQDVHQAVQALGAAIGMEGVAFDGAGNLTLIFDGAMAINFHAIEAGSFELWADLPDLGNTRDAELLASVLAANHLGEGTGAARLALRPDRSGFVLCQRVGIAGADTSALVETVAAFVASASAWNARDAGRAFAGRDAAATEPGEPGFSMIRV

SEQ ID NO: 4557 - protein, 373 aa, Methylobacterium sp.
VSEGGEKTELPTPKKERDARQKGQVARSQEVVSAGSLMAVIAYVWLAWGDINRRLAALFDVVAQLALGEFRVSAANGLSIVGMECVKILAPIVGVTIVAGISTNVLQFGVLFAFESLAPKLEKISPAAGFKRIFSMKQIVETLKSILKIVILSVLLWYVLRAALGPFAVSIGCGLPCQINLTQTVLLQTLLYSGLAFLIVALADFAYQKRSHIKSLMMSKDEVKREYKESEGDPHIKGKRKQLAQELVMSEGGSAARKGTAVVVNPTHFAVVLRYDETDAPVPVVTAKGRNLQAVHLRAEAEGSGVPIFRNAPLARQLFADTGVGETIPDELFDAVAEVLAWVARNRDRLYAGRLSHGVIDMEAGDHRPPGQG

SEQ ID NO: 4558 - protein, 61 aa, Methylobacterium sp.
VAAMLGRIWEGTKVTLALLAMIAAALISANKLDHGRRDAARPGDVARQAAEPAVTGSVGIR

SEQ ID NO: 4559 - protein, 105 aa, Methylobacterium sp.
MVERIRVVAPPALPPLRDIRPPPAWRGRTPDAARLARLTLCLAALALPVLGSKAADTVHRGGAPGPQQAAVLPTPSGRTAAPQASRRVPAFREAALAHPDAEPIR

SEQ ID NO: 4560 - protein, 50 aa, Methylobacterium sp.
VTTRTTAAGPARSGPRTPDIAEGCGGTRVIDFAICLILAVSVVGLLLAAL

SEQ ID NO: 4561 - protein, 102 aa, Methylobacterium sp.
MPRYFFDVRSGSGLVCLDYQGLDCADDAAALETARHGAGFTSHADCARNPQLTRYRFSVQDAEHRPLFTVPFTELEPDAPPARKRPRGAGRGRAGRSRSFMH

SEQ ID NO: 4562 - protein, 92 aa, Methylobacterium sp.
MIDAVQSAAGGMAAAQARFTEAAVQVARMRAGPSGTGQPTGQAPGTDLPAAARIELSQAAQEIAASRADFAANAAVARAADDTTRRLLDVRA

SEQ ID NO: 4563 - protein, 61 aa, Methylobacterium sp.
MHRTVQPLEGARRQGACAGFAASFRTRYSEVAAEPLPARHVDLILVLRRQERERARGADRH

SEQ ID NO: 4564 - protein, 97 aa, Methylobacterium sp.
MAWCRMISLEDCARDLRAYIRAGNREDLGAAQNLLLRFALDQKDLAARAAALDDLQIELTGYRVPDMTNHQRAFDTAVAGMIEQTRSVVARQIGPVR

SEQ ID NO: 4565 - protein, 42 aa, Methylobacterium sp.
MPDRETSPEGRVEHRALIDDTGGQIEHPQERLDAATRSRKHA

SEQ ID NO: 4566 - protein, 37 aa, Methylobacterium sp.
MIAASRTVILEHREIAGVLASSGLFFAGLLALACLVG

SEQ ID NO: 4567 - protein, 43 aa, Methylobacterium sp.
MVLEAAVNGRADAIVTFNQADFGTVPTSFGIALLGPADVLRRS

SEQ ID NO: 4568 - protein, 85 aa, Methylobacterium sp.
MAAGGHYALRLPASLKQAAETVARADGTSLNQFIVTAVAEKLAALKTADYFAERSKRGDPVAFDRFMNRQGGQPPAPEDQWDPAG

SEQ ID NO: 4569 - protein, 88 aa, Methylobacterium sp.
MRSTALAFAATLALTGAAFAQATTTPGSTVGNPAGSAERNLNNPGSVKSNAEKGMPGRDMPGATGTVAPGSTGTGTTMPPAGTAPAAR

SEQ ID NO: 4570 - protein, 406 aa, Methylobacterium sp.
VVAIMVSVAAMIIILYRSVLHVESADAHWWFLPWLRHILDHGVVQTLSINLPVLVPEANNAGNYTPPYLYLLSVGSYASAFADDLTVIKIVSISGAMFCAASLAYLLSGYARREIALCGAIAYLLLPSVVSNAAAWGQIESFYTGFVLIAIARAGRDDLVSCMIAFGVAVSIKLQAVFIAPFLLYLVISRRASVGLLVIPPIVYALMMVPAWMAGRPALDLAMIYVEQSHAYPWLSMNAPNPWTFVQYFRLIPQPTGMVLGIGAGLVVGLTIAGLGFVRRDSGRRDEGPELLLIALASATLIPYVLPKMGDRYFFMADTLSYALAIAHTRRWSVGAALAIQIGSFGAYLTHFTGYRVGTGLGVLAMTVAVIVICNRVLGLWHLRQGARSFGIRGRVGEGQPVVERI

SEQ ID NO: 4571 - protein, 196 aa, Methylobacterium sp.
MREAAERRIEPALGTAPGTSLGLTPLQRLVAPGDHERIVRIFGAEAAPEATPEVAPAATFEAETEVADPSDPEADLDWPSAIQLIRDAGGRVRQVRAGAEEATRRAHALVGRSAQEAEAAEQRARAAEAAAAAAQRRAEQAEAALAAAEARMRRAEEETAAARAAEAEVRLWLRRLVTCLKTEFAELAEGPDAARA

SEQ ID NO: 4572 - protein, 33 aa, Methylobacterium sp.
MLSKAFTYAMIGAFSCGLIATIVGSADVLMSVN

SEQ ID NO: 4573 - protein, 88 aa, Methylobacterium sp.
VTKTRTIALALALALPSTSALAFSFSYERPQRHAVPSPPYGSPPSAGLGVHDGAHYERCTASSAAEGNANQQTRPVKQYGQTAGGYRC

SEQ ID NO: 4574 - protein, 53 aa, Methylobacterium sp.
MATMISLACLAGGVGLAALSLRRPDRAATLERWSGVCLLAGLGLLGFALQGGR

SEQ ID NO: 4575 - protein, 28 aa, Methylobacterium sp.
MSRFEDLKFLVTLTLVVLCGSGLDALLR

SEQ ID NO: 4576 - protein, 93 aa, Methylobacterium sp.
MAPGYEIALWLEGLGLAGLAVGLWRLRVEEAARVRGLRTVLRTGSDARIAAGARPRADRTRMIPHVTGRGGTRTGTVPSAAAHALARAFARGA

SEQ ID NO: 4577 - protein, 438 aa, Methylobacterium sp.
MQSASPIPAGFAGPGWPALAAGRASAESRLVHLPYWLMLTALTFNAALAFVNGNVKPLTPSVVIALEAALTLGCLLVALLHQKREMNLALAFIVWLFLFMALRSAVVDPATSVKYFRDLLIAPTFFMLGLCTDRRYLNRYVLIGHTIVFLIGALEAFRTDLYSSLFHVKDYFIATRGLSEADFWNTDSDLFVSATRPNARFLSIADAVMANHRVSSIFLEPVSLGTYCIIVSAYVFALWRSLGWKSRAYLLFTNLFLIAACDGRLAFVTFFATLFVCMFWRRWSRYLPVLYLPGILIAAFAFVYVADPVRGNDDFVGRVAWTTDLLESYDVAEYLGMSEAFIEKAVDSGIGYIITTQSIFGLILFWILCSCCSRYETREQICYNHALCLYVCFNSLVSYGFLTIKTAALLWLVKGILEVGQTTPGTGDARPAARSLAR

SEQ ID NO: 4578 - protein, 93 aa, Methylobacterium sp.
MLLFLVAVAVVGAGLSIAILWLPVLLLGILLFLAVLIYMAPTEGIWPALGSGALALLTLQLSYIVAGFVLGRSERAGATSGLFRRAKHAHSKK

SEQ ID NO: 4579 - protein, 213 aa, Methylobacterium sp.
VTGVLIVDDHPVILQGFRRVVEDAGVAMIVEAGDPVSGYRLFHRIRPLVAVVDLAFRGSGLAGLALIKRMRALEPRARILAFSMHRDPVIAARALEAGAIGYVFKDSPVQDFLAAFDAVREGKPYLPHLLATQIAGLGAVPEPSRYDALNAREIQVSILLREGRDYRFIADNLSIGYRTVVNTCASIRKKLGARTQAELLRMIIAVEKLESHG

SEQ ID NO: 4580 - protein, 48 aa, Methylobacterium sp.
MPRWLFVILAAALFLSVAGIVLTFLRTGPTDHQPSAKPSAAAPRGAAP

SEQ ID NO: 4581 - protein, 81 aa, Methylobacterium sp.
MGTGKRYGTDPAADAAEIPGVTLQRIAAALGVPIAVFIEGVAVEPRLHETLELLRLWSLVREPELAQRVLAFLAAVIAEQS

SEQ ID NO: 4582 - protein, 169 aa, Methylobacterium sp.
MRIRIALACLAALMDLSWGLATAAQARPAQARQAQTRPATSYVSFQPQVRGLGCLQPRTRAMVARLTARVGPIEITSTCGGRHAHNSQHYRGAAIDFRPRTASVARTLAVLRGMPEVGGIGSYAGGLIHADTGPRRLAWHGSVRHRVARAHRSYARYAARRGAHRSGSV

SEQ ID NO: 4583 - protein, 94 aa, Methylobacterium sp.
MLNGPFQGLPGSSEGWTAHEAWLLPITDGVAAKAPAASSPADTVRAAARPLFMAANGLALALALLLAAETSTGWMGGQRGVPVAKAPVITASAS

SEQ ID NO: 4584 - protein, 62 aa, Methylobacterium sp.
MTKTDVDTRHASLQRAERAAGEAFGWPETPVEAARRSLLFNPTTIAAATAVTTVAATLTYFV

SEQ ID NO: 4585 - protein, 70 aa, Methylobacterium sp.
MYAPSETQVSASESERRQMDQGESLYGFRPLALPALAAAARPKKRESRPAVPATGRQGILSLVHEDEPLA

SEQ ID NO: 4586 - protein, 97 aa, Methylobacterium sp.
REGAMTDAVANPQHARIRASGDERLLRIAELVGCPVEAFRTPEGDALSDALELVKLWERIDGTGRARLLACARTEAARTGELQPTGPAGAGFHSPLR

SEQ ID NO: 4587 - protein, 349 aa, Methylobacterium sp.
MPADAVGVWNALVGRTGVPLPLRGQAAAVVELAEPPPADALCLDLRLGPDLPLVLRPVAYPFAAAFGADLEVADLPLLPDALRDALLAGLVATYTAAMPDHDLGPVTTRASGPLGDLVRPEAAEGLRWFRAALHGVAPGPVALDVGARLDTLARIFGPLAPRPVWPGIRQVLTREAAVTLGRLVLPLGHLRALAPGSVVVLDARVGPERARLRLGPALFAFEAAGGGWTCTAVTAAAAPPDRPDDTRQEGPMNTLVPTTETREADLDVASDVASDLALDVALDLDIGSITVPLAEIETWQVGSLVALAPETPRDGLEVVLRVNGRAVGAGELVRIDDRFAVRLVRLALG

SEQ ID NO: 4588 - protein, 246 aa, Methylobacterium sp.
MIRTNPPSNPHATADLPTGYPSDNTSNPRRDPFRQRDPREGAPRDGLGREDRPGTEAGFGRSLAFGERMRDAMRDPGSGEGQEDGRERRREDEPRLLAAVEPEPVGVPLGAPVPAPAASVREAGPAETGTAERVARLSERLEAAIRAELSAGAGRTLALRVPLDGLVPGLSAVTVALTPAGLDVTLVRAAGAGSADLAEAAQALALRLRNRFGGRGVRVLERTEAAEPPAGDALAAIGRLLGRSGP

SEQ ID NO: 4589 - protein, 162 aa, Methylobacterium sp.
MIGQMTILLRLKTLKEEQALRALQAKRRQVAEGEAVLDEARLAVSASAATLGSREDAIYAGILGQVVDPGTLDETRGAVVALEKGHARLTDSAERAAYTLHRLTGECEAAAEGHRAATRVRDKYTILRDDLRARAAEEAEAREEGEVEELFGRRRPGPGERP

SEQ ID NO: 4590 - protein, 218 aa, Methylobacterium sp.
VVAYYRLSELGYRLAPGLQVLPPEAFEPVPAAAALLRDAEARAAAIVAEAEQEYARRSAQGYADGLARAELESVERLLREGAQLDAGLKAVEAEMARIVMACVRRLVDSFDDEARTVAAVRGALRQMRRERRAELRVAPAHYAAMRDRIAGIVADFPEVEFVDVVEDPALVPPQIVLESSIGRVETAVDAGLDALEAIVRGAAAGHSDSSADPAGAAA

SEQ ID NO: 4591 - protein, 246 aa, Methylobacterium sp.
VIPAVALDADPAAEVRALGLAAQIAARLVRPIGHFAPGACPLPPLEPDALAALAAHPAFGVPVQRAASHALAAEAAGIDAGLIRRLREAATTRLAALLVVQPLPVLHEAARLLAGAILHRRILALVLKADRERLQAALGPAAFRVATQEAALLHAGLAEAAEPAAQAACLAAGSPDATRGAVVALGLGTLGRFAAAAEPALGRLVALRLGAEPGILTGPPPLGPGACEHVVRLLRRRMDAWSPIIA

SEQ ID NO: 4592 - protein, 165 aa, Methylobacterium sp.
MPALSMHHLGVGSAAGALGDGLREVGGVQRAAFRDAMTRKSATGPALDGPPPTEPASVAQPVVPVQRVGFENDSAARDRVRRTLELDGAVRPNDGDTILGGLQKLRGAFDARHARVGEIMASKSVDTNALLAMQMEVAQYTLLVDVSSKLTGKTTQSLDTLMKGQ

SEQ ID NO: 4593 - protein, 124 aa, Methylobacterium sp.
MFETGQLLDAGDVRLLVEMGFTALSRGRLAEAATIFAGVEAARPREEAGGIGRALVCLHRGAVDEAVRILRVLPPSDAARAFLGLAVARSGDQAEARAILTEVVENASGTASAGLAADLLAGLT

SEQ ID NO: 4594 - protein, 184 aa, Methylobacterium sp.
VRDVLTLPESRMGVLAAGGGSEVGRTTVAAILKAVGEADAVEDAIARLVAQHGAHACEVTELGGSLYARAAAAVAEGRITEALAPLSALAGTPGHRAEALLGLAVCATRLACYEDAKILAEASRGLGPGHPRASCVAGLCELELGNRRAAQEHLATAARLARRDAAYGEDLRVAQRALLLMHLA

SEQ ID NO: 4595 - protein, 132 aa, Methylobacterium sp.
MAHSGGRTGTVRWTSTQDAGDAAEVSSEIEAWLARQPAAADWAGVLGALRDGLLRAGLEPGLARDATAREIIAGLAEAEDLEAIDAALAGLSVRVDALVAPRERAGRGPARPLAELMTEVRGAGQRRDRIRL

SEQ ID NO: 4596 - protein, 126 aa, Methylobacterium sp.
MKIRNFDIGLEAYTRVGPGEDPRLPSEGAPGPSFIPEPAHLDAVLRRPSLDERLPQVLQPPALDADLLEPAVLSEVRRGTRGLFAEAARRAVGQRRRILEEAALILDEDAVLDADVRSALAALLKA

SEQ ID NO: 4597 - protein, 141 aa, Methylobacterium sp.
MSTLPLRPDSGLPVDPGAPNLHPDRRQRDFLLLTIFVLAQQGYVDRAGILAESLHLVGDASAETQLARAVLRFFAGDFAAALAVLEDLDRLAPIERFGSYRLDERQRMRRYLKARCLHEVGEPGRARDAVEIYLRHRADSV

SEQ ID NO: 4598 - protein, 187 aa, Methylobacterium sp.
MPSILDGLPRTQAELQKAHLASAIQFGEIVAQADLTARSRSIIDAMGEGLSLGDVLGITREERDALLVHGFRQLQQGDAAGAQVTLTQLYHIEPMDERVIYALAATYQAQEQYAAAAKLYLCFLAYDATNPQGYLRIAECFLAAREYPEAEAYIEAARVQAAGSACEADVDRHAGALSAAIPARPAA

SEQ ID NO: 4599 - protein, 52 aa, Methylobacterium sp.
MTLLLVVLLAPLVAAIVLAGGRPGPIIGCLCLMGIGCLIACSGLTRLVRQRA

SEQ ID NO: 4600 - protein, 239 aa, Methylobacterium sp.
MTATGTVLTDLSANLFAALLLILLILLQAGADRSDEGPAQPVEAAQLAAREHTPLDAGALVTALYDRRPEAAGLSIDLTEAEPPPLDAVVRGLDPDLPIRLYVFSHRHYSATAALLRKMGRRWQEISVPPVLGDAATGWTSAFCALLARRPAPPQFRADLAHLLGAAAGPPLRGSGGASDPLTSSMLRNPFGGWLGAVLTIATLLLGFAAVLAIEWIVPRRLPCYACRLDAKRYEGPRP

SEQ ID NO: 4601 - protein, 162 aa, Methylobacterium sp.
MLPETAVEEGPEIDPFADLLFALIATVLPAILVLLPVLHLATPRRSAPASAGVAVGGREAATIVAEAAGLRLVSADNRQIALSAVPVDPGLRESLMSLRATETPLLILIEPAGLEAAFLLEPIAASYGPVRIMQLRAATRCVEARDPALAQACALPVRTFVR

SEQ ID NO: 4602 - protein, 385 aa, Methylobacterium sp.
MRPERASVLTREVGRSTERLRVVAYGMALCIAFGLYLLVHGAGQGPTFWSASLLCGAAIAAGLARGGPSARAFRWGAAGAALIAAALPLLPALAEGAPMEAAVRVHPLWPQILVTLFAARALEEVNEQRFAAFWRAPLRTREPVASQSIAAALSLGACFALLFYQGLTLLVPVQQGGGTGLTDLVAHALAGESAIHRAIVVLFCIILAFLCEAVLQHRRDRAALAALRQALAQGHRTTPEDLHGLLAGPLAGFGHTRTVRALAQGLRSGGGAPAEDAFTAAFAAFHGASRRFVRGLLPFLPLLGFFGTVVGLATAMAALPTEGGGGRIDLSGSLSGLALKFETTLLGILASMVAALLLALLEKGEQELAAECALLAAVAERGHAA

SEQ ID NO: 4603 - protein, 395 aa, Methylobacterium sp.
MIGETLGEIPVAVTSTAGVAPGIALTSAGLSRSFGAVLFTGGASGLRPPRNVEDAAILLAEAALMIDAARRAASDARITGATASVRGGLGTAAAQIAVANDALYGVDEAGGGLIDQKAAASSDRDTAVARDVVLGSEVARLEGRIVTLDGEMAVVRSEADANIASLTDDKDAKTAQLASLDTRIAAALSANDAGKVAALRAERATIATAIASINGQIRTTREEANTRIAALAAQRSAATAELAQAKAERAAVRSQIVALDARIAELGIAIIEVESELALGRTALVIAFAQMAVLVQDSGGDRALETMRGTELDHRLDELEEAAKDLRARLLAHFEADARLAGDRRDAQADARVMAVVLGLFTALVDVTDVLRREAIPSSEADDSAGRAQRRRLAL

SEQ ID NO: 4604 - protein, 197 aa, Methylobacterium sp.
MVGRQLSAQLGRGGPELRSKLPALERAGTDSERGAAQQDAGSAALGSAAQERSLSDAQGLPALNAWSPAIGIAAEQQVERAGIIASFILNAATIPGWPPPRPFAAPAPESVRAALIMTPGLSEAGIEAQMRRDGVRRTLLARMRALLARLTHSRRLQVMLGLTILLGAIAAIEAELGDVARDTDTDDIEAGRRKLSV

SEQ ID NO: 4605 - protein, 192 aa, Methylobacterium sp.
MVASDPARRDPFGLDPEESALLASLFVEAAADLGLDGARIYAALRAGQTLGAALGLPDGVVEVLYARAHTWFAAGRSDRAEPLFRVLCALDGACADHWVGHGVCLHLRGADSEATIAFATAAALRPDWAVPHFHAAGLAVAQGGWDRAAEHLFAFRERQDRDTPEALVREAGRLAAALAQRGDRRVANRERA

SEQ ID NO: 4606 - protein, 162 aa, Methylobacterium sp.
MEALSPPGSGTETAALLNGHLRDALGLRSADLAIGLEVARNLLQRGANAEALRVYAGLILCEPANAAFQTGLANCALAAEEYHLALQAASAVVALTPRDPRGYLISGRACLGLGALAEAGEDLREAVARGREARDAVAVEEACRLLDALPDPAREADLAETN

SEQ ID NO: 4607 - protein, 151 aa, Methylobacterium sp.
VSRETFASVAAALWASLGLAPPPNSGTPTLRIDGRAVRLAPSPDGMQAVIEVAVGTLAVVPHRREAQLRQMLREGLGLVLDNRAALTFGADGTVVALAAGPCRVTEVALLRGLIEDALHLAEIHGPTLADAAGPEPDGGLPEDAGSLIFRL

SEQ ID NO: 4608 - protein, 304 aa, Methylobacterium sp.
MAIGSFPTELRSYLPASLLQADGATLKPGIDLAQAEALAKNVQAQASALPPAEARLFLAMVSQADLAPNGQIPADIGKTLAAFEGAASLLARSSGSTLDFLARVMIEQAAEQRKNALDSRLSAREQAKSELMNQAAKMEKAAEESKSAAYQAMITTVVMSSVALAASTTGAVLGGLSAVKQGSAFKDAIASGKTIKEAATSASTGLSAGWTKVGKAADGLGGAQQMGQLGQAGGGYISAQGEAVAKTLDAEGQREAARAQDSQTKADLSKDSQEALNQMIQSIIQFLKDLQEAKAEQMRALTRV

SEQ ID NO: 4609 - protein, 314 aa, Methylobacterium sp.
MSGVMASLSAMMPKVSAQDTDVLLLQITTKLKETTEASEKDKIRADTSNKKVQIEEKQRKMDEAQEKIKAAEDKMKNLSIWDKIKIGFQFLSAIMTIAAGVIAALVGAAAVATGALSPAGVAAIAGGVMMVTAGVLMLYSAIDASVAASREDGLGIAGLIEKDKLMARGKTEEEAIQGGAEKDKLSRTVIGAVTAALAIAGAIAAFPAGGGAAILALASRVTGVVSAISTMATSAGDITTGVLKYKATEEKSEGQLKQADGKRMEATIQVLDGMIDQAMTRLKGAGDRFNAMLDSLTEAIQDRGDSLSRVGLRG

SEQ ID NO: 4610 - protein, 131 aa, Methylobacterium sp.
MSRLPSPHRRRTFGLLALVLIGTSAQAADFDGAYRPRPDFGRGFEEDYGRRPPPPPPPRFPRFSAGPDLAPSPCRVFVKRRFDADGEPVIRRVRVCDEPDDLGPPRRPRFDPPPPREFPDEPRGRWDGPRW

SEQ ID NO: 4611 - protein, 39 aa, Methylobacterium sp.
MLSVLVSQCPAPEQEAVDRDPGLLTLAFALARSLRRRLT

SEQ ID NO: 4612 - protein, 389 aa, Methylobacterium sp.
MRDAGGDTPLPDEPATGPHVLLIQPQAENAGAQAIARMLATALAERGYRTGQIFFYRKTGAFDAEPGIAFCAAERPRTPLAFGRFLVDLVLRLRRARPDAVLCFQHYGNIVGAAAARLAGVPVVIANQNSARDTTPPRARLVDRWLGGFGLYGRIVVNSHDSAGDLADYPARYRARVVHIDHGFVGRGSDLAPAEARARLGLGVPPGGRLLGCVARLHPLKNLAAAVRLLPHDPAWHLALAGQGAERDTLAALADRLGCGARLHLVGELPPDRVGDFLRALDAFVFPSRAETFGLAAVEAAQAGVPVVANALPVLREVLATGAGPCALFVDTEDEAAFAEAVRRLEREPDLAAHLVRSGRGLAGRFPVDAMAGAYDDLLRARIAEARGA

SEQ ID NO: 4613 - protein, 453 aa, Methylobacterium sp.
VRGLALPRLRDLRARAGLRDLALALVLKVGGSGLAFLMLTLAARAMGLHEFGVFAYWFSALSFAAAAVLLGQEAAIMIDWQRGLDAGGPAAARAALRRSSLVVLLAGLAGGAATACAGHLAGAGWLFSGLAGAFAALLAGLVYGTHVARVVAGIAQGDGQFELTWRLFPTAGAALALVAGLPFHAETFFAWAAGGILVALAIQGAGIAAALRGVPAGAGAAGLTRVRAAPDATRAWIARSARLWLGGVLDAANQYVDVFLIGLLLSPVEAGLYYAAARLAALFAIVSAGLHVFSSREIARHAADPAGPGMRAALRLVGAATALAVGGGVLVVATGGQLLLDLFGPAFHAAYLPLVILTVGVAAMALGGPVPAVMRLTGHEAAYARIAGLFVLVRCACVAAAALADGLIGATLASALCSLACAVVLNASCRRRVGIDPSVFGLVGGTRARGTVS

SEQ ID NO: 4614 - protein, 515 aa, Methylobacterium sp.
LPQDRHAVPRAVLEHALFLAVAVALVGVPIVAHLASPAAAIVLCAAGSVVAAVYVRAAIPALLIVAFQFQNLFVSLVSPWLADTPAFNAARGYNFIITASVWLWIVGGHCLAPRARSRQLDALLRPSALALGVIGLYFGLGLARDPYAAVVYLRNAVTPFLVFQLALVIAADGPGDRLRFLRVPVYLLLAYGLAEFLARDALFELIQANGYMTFSLADIARSGEWIETMRRTGRVLRDLQDTQIVSFLNTDLFGFSAIRMYRMLGPNFHAISFGYGLLLAAFLLLRWRRPVLFCLAVALLVLVGAKGALVCLALCCAALLLDRVRPEATLPVFLAVLVLYACAVIVTGRAGGDYHVLGLFGGLHAFLGAPWGAGLGAGGNLAGDATRIDWEKAQAIGRTDWPVESAFGVLLYQVGPGVLALCAAPVCAALAAWRLSGTVPGRDLRRHLRLFALGTLAVTLNGLFQEEALFAPLALGGMLIALADRMGEGLSRLPVGAPEVRAARAPGRSAQGIPA

SEQ ID NO: 4615 - protein, 62 aa, Methylobacterium sp.
MNTDFHRPTAKIYTFPVGGRAGQAARATAPVPAPQACAADSGGYHEAAIQEEAERNRTPRGR

SEQ ID NO: 4616 - protein, 98 aa, Methylobacterium sp.
MDERRRHGRNRTYLGGTLTFNHGQQTLPCHVRNLGTAGARLDFSGAVPLPDEVDLAIPRRGEHHRVRVVWRREDSLGVAFLPRAANLIAFGDARRART

SEQ ID NO: 4617 - protein, 71 aa, Methylobacterium sp.
MSDELWQRAMAAFRESRRLMQEAERTRRSGECLRHTLADTLGEMRDFGARATIWLQVEAARPSAPSPNRRL

SEQ ID NO: 4618 - protein, 78 aa, Methylobacterium sp.
MMSAADTLVATLSKQSGTREELAGIITGLMDQYHISPDRAHMLIDRFGRTQPALANAGSELMARKQGYSERQPGYMAQ

SEQ ID NO: 4619 - protein, 109 aa, Methylobacterium sp.
VITCFIRYAIDPCRTDAFDAYARRWGEAIPRCGADLVGYFGPHEGSATTAYGVYHVENLAAYEAYRARLRDDPLGRENYAFARRERFILKEERLFLRLASGPHAARVAP

SEQ ID NO: 4620 - protein, 167 aa, Methylobacterium sp.
LLHFMRLPKGKSSFELDSYDLAILKLLQQDNAVPQRAIGEAVNLSAAAVQRRITRLQQSGVIERNVAVLNPARVGQPITLIVAVEIESERLDLLEASKASFLAAEEVQQCYYVTGDTDFILVITVQNMLAYEQLTRRLFFENHNIKHFKTFVAMDRIKTSTHLALPE

SEQ ID NO: 4621 - protein, 45 aa, Methylobacterium sp.
MTAPVSPEPAPLRHASLFRSGLGVRLALAAGLVLPLWLAILWATA

SEQ ID NO: 4622 - protein, 41 aa, Methylobacterium sp.
MVRKAALAALTAGLVAGSSGFLAGCSVLPAAGPTARAVVSG

SEQ ID NO: 4623 - protein, 42 aa, Methylobacterium sp.
MAGLFQAETMALSCAALKLASSALLAVSSRAPPLWALLSLQR

SEQ ID NO: 4624 - protein, 96 aa, Methylobacterium sp.
VLSLLLLAGLPATADAEIRPVRPCAAAKLRDPACPAQRYAVQVSADADEPAGESRTLAPRASTRLSADRTPRFAPRTDPVPPSAAARLPERPPRRA

SEQ ID NO: 4625 - protein, 59 aa, Methylobacterium sp.
MQEVPMIAVTARRILTLLALVAPASGWACRDAGPADGRATGREAGGTAIPDAVVFRHYL

SEQ ID NO: 4626 - protein, 63 aa, Methylobacterium sp.
MSRISVRLAGDGTHAVIEGKDPVVSGLTLDEAENYLTFMRASARVRRTRRLPEALRRRGERPV

SEQ ID NO: 4627 - protein, 54 aa, Methylobacterium sp.
MSLKTLSAPLLALALAAGSLSAAQAQSSNATPGAPAGDSGGNASTGSTAAPSGK

SEQ ID NO: 4628 - protein, 31 aa, Methylobacterium sp.
MRKLLLAFLLPRVVSWLRRRYGSPNHRTRPY

SEQ ID NO: 4629 - protein, 48 aa, Methylobacterium sp.
MHHVAIGLGALCCAGGAVAHFIDTTHRREGALGLAGLGFLLAGLFLER

SEQ ID NO: 4630 - protein, 198 aa, Methylobacterium sp.
VANGAAVKRSVDVTVALTALLFLVPLFLAVALLIKAETRGPIFFRQKRYGLNRQPFEILKFRTMTVLESSGAFEQACANDRRVTRIGRFLRRSSLDEMPQLLNVLMGHMSLVGPRPHATMMDDTYAAVVSDYDDRFLVRPGLTGLAQITGYRGPTDTYDKIARRIGRDRVYIRRWSLALDVMIVLQTPIQLVKDPNAL

SEQ ID NO: 4631 - protein, 334 aa, Methylobacterium sp.
MRLMHVDLTRRHALSGLALSAVAGAIAGALPLRPARAADLTYPGVNLSGGEFGDLGRPMGQGYIYPQDSAFAYYASRGMRLVRLPFKIERLQSEPFGALSERDVAELRRCAATAKRLGQLLVLDPHNYGKRDDRPMAADDLADFWKRIAALFRDDAGVAYGLMNEPVAYKPPEWRPIVERVVKTIRDLGSTQLIMVPGAGWTGAHSWISDGNAAAFEGFSDANFMFEVHQYLDANSSGTDLQTYVPGAGEGRLRDFTDWARKRACRGFLGEFGFALPAGRTEASALLAYMAANSDVWKAYAYWAGGPWWGDYAFSIEPDKNGDKPQMALLREYL

SEQ ID NO: 4632 - protein, 508 aa, Methylobacterium sp.
LSGGLARQSAANAVATGSILISGALSTIIVARLLGPADLGVVTYAAWFVSITVMVADLGIPGSLARYLPEVRGSGDASACDGLALYLFKRFVLVVGLAASLLFGLALWHLAAGSTFALHIEPGTYKTSPLFWTLIAAAVLAQSSSAFAVGLLRGHQEFGRMARIMLVSAAAQIGVTVLGSVALGLVGALSAAIVVGLAPSVFLLRKLRGGRAVAPELRTRLVRYCGAIWLAYLLSAVTWARTEILFLERSWGSEAVAFFSVGLTLANLAVQAPLLLTGPLLPVLAQNIAAKQHATAVEIYRTGMRYLAMLVFPACFGLAAIASVFVPLVYGPAFAKAVAPAVMLVVAAAFYALTAVTQIYMNAAERNRFNIVVGIIGAVSIIASGLIIIPTHGLMAAAATRTTVQVLTAAASIWYVHRHLRAPAPIGQILRIVGAAALCGLAAFAVLRAFPGPVALAPAIAAGALVYGIALKLFGCVLPQDLERARAIGSRLFAPLAAALSGAARASR

SEQ ID NO: 4633 - protein, 187 aa, Methylobacterium sp.
VVRAGAGPVRDRWLDALRAGLDARQDALRARPLRRLPPGTGDDRLIGGLDLPATLALGRPVLGRGLLAEADGGVLVVPMAERLSPATAARLAAALDTGTVAVERDGIGARHPARIGLVLLDEGQGDEAVPEGLADRLAFRIDLDGIGLGDLDAGRALPSGDRVPASPADGPRALPPPSAGEGGPCVS

SEQ ID NO: 4634 - protein, 206 aa, Methylobacterium sp.
TLVFFGMPAPRIAKMLPLGSHRYVSGKIELWDGHRQMVHPARIMDAEGLAALPPVEPIYGATEGLTSRAIGKLAIAALERLPVLPEWQDPAWLARNNWPPFAEALTAEHRPREAPPKATDPLQPPPSTPTRRRLAYDELLASQLALALLRARQRRKAGRVNAGDGTLSAAIEAGLPFRLTGAQARAVAEIRADLAADRRMLRLLRV

SEQ ID NO: 4635 - protein, 119 aa, Methylobacterium sp.
MAETRKPAIVRQPSRKYWRGHVAMYRNSVSFCVGLPSGERRCVVLPTARFWSRERREARAESLAHLHLPGTKVPRPANHSYWLTVSVPLVLAEVECRLWRSRQPVRRYPPRPIREVRHG

SEQ ID NO: 4636 - protein, 102 aa, Methylobacterium sp.
MIQSILTSGRRARTGGRRARTLLILAALAAPTGAWAQAQTGTGGGPTSTVTAPNASSVGRVMPRPGAGGAGADAQLDRTERTPQMKADDKIQKGICIGCGAK

SEQ ID NO: 4637 - protein, 119 aa, Methylobacterium sp.
SSPVNGRSCACQSPWRHSLAIYLVHQPLLLGVLTGVAALTGPHPRAGERTFRAEYVETCTRTGGGREACRIAARCTGQVLRREGLWQAQERPFTGEERLRAQALSQACYEAAEGTRGPP

SEQ ID NO: 4638 - protein, 320 aa, Methylobacterium sp.
MLSLRPAAARLGAAFAAVLALSGAPRAHEGHDHGPPPPPPERAAPRAAAVSEDLELVAIARAGTLTLHLDRFASNEPVTGATVEVEAPDGPRAARETEAGIYALPAPWLDAPGRHDLVVTVTAGSDAAVMSLALTVPVPEKPAPAGGFGQTLGQTFAPVLDGLRRHLARQDPTLPATAGAAFLLGALAAGLLRGRRAGIAVLVGLAATLALALGGGALAHEAAGRHGGRVADAGSYHVELVTRGPEVVVYVSDGMQKPVPADGFRGTAILVVQGKPARVPLEPLTGDRLAGRAASDLGAAPKGVVQITAPDGARASGRFE

SEQ ID NO: 4639 - protein, 130 aa, Methylobacterium sp.
VLDRNVSQQKLLVTLDAVMMGAVVRDAPFFRPNREPGDILFPPSAPRPRSSVKLPLPLSGSDARICPFSIREQEILSVLAEGVSNKHIARKFDIAESTVKVHVKHILRKLNMNNRTQAAIWAKSYRPIPA

SEQ ID NO: 4640 - protein, 79 aa, Methylobacterium sp.
LFDALRLRMLDRATETEPTEAERIAHAYRVASGGNAWAALVRVVEDALTDLAEAERRSLRRDRLISHGYVRGRHDGGGR

SEQ ID NO: 4641 - protein, 342 aa, Methylobacterium sp.
MTRLALWLALAGALLFGGLTAPARAQGPERLPIRIGFQSGEVNVLLSHAVAAGLFERAGLAVTLAQFPAGPAMLPALAAGEVDLAWMGEFPAVTGYANGLPIEILFMERIDATNVRLVGNPAAGIAAPADLKGKRVGVAVGSTSHYHLLRALAQAGLRADEVRLVNLTPANMPPAYAAGQIDAAFVWEPNVGALERQGARPIASTRSLGMITGGVWVARKPFVAGSPETLQRFLKAWDAAQAAYAADPAGVRAAEARRIGMSGADFDALVAGQSVAHPSFRQTLTADFLGAPGQEETSRLMRHLHGIAAFLVAEKRIQAPPADWSGLIDTRPIQTYLAGASQ

SEQ ID NO: 4642 - protein, 304 aa, Methylobacterium sp.
MARAYASTIIDAPVETVWSLIRDFNGLPSWVPGITDGEIEDGLDADVVGCVRAFRLPGGILVRERLLSLDDHRYSFSYNFETPAFPVTDYLARVTLIPVTNGDGTFAEWEATFDERPEDAGKYASIIAEGVFKAGWDALKAKIARERPPTPAGAVRWRGLPPHKVFCSSVVDAPVAAVWATMRDFAGMADWHEDIARMHMLGGVRPDKVSGVRDFLFGEGHLNEELIQLCDRTRSYTYRITKSPMPWLHYVSGLRLRPVTDSDRTFATWFGDWTAAPADDLVLIPQVHHGVYQKAFDTVAARLA

SEQ ID NO: 4643 - protein, 212 aa, Methylobacterium sp.
MDAVYVGIDVSKDRLDVHVLPSGEAFGVTRDGSGLADLCGRLRPLAPVAIVLEATGGFETVVAAGLAGAGLPVVVVNPAQVRAFAQAIGQRAKTDPIDAAVIARTLLAELPELGRLDRRQIAALAGHAPWPRQSGQWRGKSFIGGGRASVRAALFMGALVAARHNPTLKAFRDRLVGSGKPKLVAVVATARQLLTILNAMLRSKTPWQLQNA

SEQ ID NO: 4644 - protein, 767 aa, Methylobacterium sp.
MGRGQGAQAGQGAQATGPGRRPAALAQVAHGLRQHQAGDIAAAEAAYREAIRLAPGEAAAHHLLGLCLKRTGRIAEAGAALGRAAAASPRDPDILADLGLALRAAGDRDGARTAFRRALKIRGDHPKAWGGLLDLGGVGTDAVGPLRRLVAAQPARPEGYLSLAGVLSALGEAAGARDILADGLTAGALTEAALQSHGAEAHAAGRHAEALAVFALLAERRPQDPHAQIVHGCALFDRGRIDAAHAAFRSALAADPDNVTAHVNLGAIFSEIRRPNEALEHYRRAVALDPGSTLARHGLVDQQHHACEWADIAENERVLLRLLDETGTRVTPFKLLVAEQASPAAILRAARIWAAGISVPPADILPPPRPASPGRRIRVGYLSNDFFEHAVSMLAIRLFERHDRARFEVFAYSHVRDDGSALRRRLEAAFEHFVDITDLTDAEAARRIRADGIDILVDLKGYTLRARTEIFALRPAPVQVNYLGYPGTMGAPFIDYLLGDAIITPEAHQPDYSERLVRLPDCYQPNDDRRPIAAERPSRAACGLPDDAFVFCCFNNSSKIAPAVFAIWMRILARVPDSVLWLLEANPAAQDNLQYEAGAQGIDPGRLVFAPHWRTDRHLARIGHADLVLDTLPYNAHTTASDALWAGVPVLTCLGATMAGRVAASILHAAGLPDLVTTSLDAYESQAAALAADRPRLDALRARLAANRARAPLFDSARYARGIEAAYAQMHDLRCAGRPPEAFTVPREPFQDGFDPGFDPGPDSGRP

SEQ ID NO: 4645 - protein, 123 aa, Methylobacterium sp.
LATKKIVFVAFAMEDERQRDFLKGQSLHPRAPYEFIDLSVKEAYETDWKDKVRTRIRRCHGVIALVSRNSPQSTGQKWEIACAREEGKKIIGVWAYAGDRTEIAGVRTVAWSDANIAAFIDSL

SEQ ID NO: 4646 - protein, 273 aa, Methylobacterium sp.
MIAFIVAFILCLEGSAQARKEFLADEYWIGKPHSPKEKNLTRLAAMYMLGVKQSYGALYVQALQYTKVTEYFLERDIEPEEIPDWLRRTPIYKLLDKLDPPQKVACDDDGPATAPSRVQPKAALADTTVNTREKQDKRDLHGVDDDADEAVGHDADDCDDEGDCSDENDDDNDASGSGSTDNHSDGPNRVGRRDRTASPEGTRTKNAKRYPFKQDRELAVMAEGYQKRFFDDMKPNEEVPVMIRRLPDEDGWAKFEICGLLSPREYRTTRTAD

SEQ ID NO: 4647 - protein, 397 aa, Methylobacterium sp.
VTALPNRRTLATGREPRPETAIRPSFDGQDPAALLEQIPRHETILPRVDVFTLPGGYIWFGDGVDGIALTADGQLALETATFARGYQSLPPEALRARAREIDEDWVTIVDCGCHNYYHLLMLAMPRLTYARAHLPEAWAAVPAHRPSPDGRPPLLDQLIALSGEGHRIRRVEDGLYRPRNLHVIWTNFINPPALHLVDETFACFDILARNVPPAPERRFPKRIFIERVGDMRLSDPNACRSLDRYLATHGFGKVRLETLDIGDQIRLFAGASHVVAAHGAGLSNIVFGSPQLRVLELNLDLDGRGTLRPWFLLLAAARGQHYQYLNTSACELADLPMGLAFDRLMGTRRQALRLRLARLRGRLDRHLVRAAILARRLRSGRALRGSRFPGRAPPPHS

SEQ ID NO: 4648 - protein, 215 aa, Methylobacterium sp.
MSDGAALLAILGAVLLGAMSPGPSFLLISRISAARSRSEGLAAALGMGLGAALFGTLALVGLGGLLSAVDWLAALLQGAGGLYLLYLGLRIWRGAAAPLPEAGRAGGPPAGGSLARAFGAALLTQLGNPKTALVYGSLFAALLPAAPAPWLPLVLPLLILAVETAWYGLVALGFSAPRPRAVYRRARIWIDRAAGAGLGLIGARLVHEALSGRRA

SEQ ID NO: 4649 - protein, 167 aa, Methylobacterium sp.
MSASDRANITLPLPRFQQLGAIAERRGLPSASAVIEAWIGRAIEEGEIPASPPGFMAFKDDDGFLIEICGHMLPLMKPDRARMLAAVLSAAAGDTDPDLPMQFPAGRPVVLDLGEVALVVGKAGRGIRFIVKTKGAAEGEGIHLATSPTFVAGLAREIRAEFTPAAA

SEQ ID NO: 4650 - protein, 33 aa, Methylobacterium sp.
VSIAEIAEAGGFVADRNQTVRPSPWRLGRRDLA

SEQ ID NO: 4651 - protein, 72 aa, Methylobacterium sp.
MSHILSLASASAALTTVLSLLAAVASEPVPAASAARSPQAPAVVAAEAVPVRTIRTIPIDGRYDSTVRPTLR

SEQ ID NO: 4652 - protein, 69 aa, Methylobacterium sp.
MHISPDGLDKLEDLALLRAVLRTNARSAGTAERALPTLADRFGVAPTGSGRRKAEVRLDHAPRKIATGS

SEQ ID NO: 4653 - protein, 30 aa, Methylobacterium sp.
MFPGRSPAELRVGSRFMIARTAISSFGFRS

SEQ ID NO: 4654 - protein, 44 aa, Methylobacterium sp.
MMATTTRTRDMIPTDRIIVWALMAGLAIALLQYAESAALPAHFV

SEQ ID NO: 4655 - protein, 196 aa, Methylobacterium sp.
MTEHLAAGDAPMPGSTHAGSRRDRETDEPAGARRHDQAARAGGAGCGYAAVAREVTQSAERAGITAEQAIGAIQGTIRTLHQSAAAIASTVEEQSAVTHGMLALMQTAAPARLSPGRHHRPVRRSRRPIRPRDRTRQKAPSPQRGVFETIVDLERAIYASIDETDAEPEPFVWTKSADNILAGIRHFCQRNSHSNH

SEQ ID NO: 4656 - protein, 47 aa, Methylobacterium sp.
VRFSVWTSLAAHPPLGNINRARNAPCGHSAAFRQRFDGCPIHEPSGG

SEQ ID NO: 4657 - protein, 29 aa, Methylobacterium sp.
MHARGLVEAVLAIRAGRLAPEAYAAALDA

SEQ ID NO: 4658 - protein, 34 aa, Methylobacterium sp.
MAALILAMILIGVAMVTTLADDQVLVSLHRPRAS

SEQ ID NO: 4659 - protein, 64 aa, Methylobacterium sp.
MREKPLEHRGIYVKPINDPPVPRGGERLSITPTPLHTEEHMRPLMEALVEVRTRQAWGEVSRAT

SEQ ID NO: 4660 - protein, 125 aa, Methylobacterium sp.
MAVIPRDAVQRMPRVASPGLPPVDPMTRPAAFDGARDARMLASVRQAGAGGGARTDGDSMPAGSAGPVDGGDLHGATSSWRSPRTCHGRRRPEAFILDGLASGAPAPVIGETFKLDEIVEAHRPM

SEQ ID NO: 4661 - protein, 364 aa, Methylobacterium sp.
MTSVLTNTAAAVALQTLRATGRNLDATARQVSTGLRIGSAGDGAAYWAIASTLRADNGSLAAARDAIGLDRNTVEATARGLDRVINQLGAIGRTLVSAASAQTDRTKLQGDLRTALDAIRITADNTVMNGANWLSVDSDAPSFSATRNLVTAFSRQDGSVSVGTTALDTSGIVLFDTRAREGGGSAFSLTPATGSIPSLTRDIARAASVASPDGYQIQTWDGPSQRGGETLYLTWNQGLLDTQYYVRDASFGHQPFSIASMDLTSRYTDAKMVQAYVKVVDATRQILLDGAANLGVISALLTAQQDFAGRLMDINASSIGALVDADMEEAATRLKALQTQQQLGLQALSLANGASQAVLALFRQ

SEQ ID NO: 4662 - protein, 59 aa, Methylobacterium sp.
MKPAERAALKSAIKRYTRAKTASKAIALATLVKEGTHTPKGQITVQYGGQRKKKSGSAQ

SEQ ID NO: 4663 - protein, 188 aa, Methylobacterium sp.
VGLKALIRGLPLEPSDKDFDWLGPGVYFWENDARRAYEWAQAKVAQGRYKDPFVIGAIIDLGNCLDLLQRENIDLLTDAYGSLREINRKAGTKMPKNKDPRAVNKGDKLLRFRDCAVIRHVHEVIEDEELNDPDGEHYIAPFDTVRGLFVEGARAYPGGGFFSKTHTQIAVRNPCSIRGVFLPRDASA

SEQ ID NO: 4664 - protein, 80 aa, Methylobacterium sp.
MALDAVPTCCPFIQKLIMLVLDCSSRTGAARKQALFSETLRLEMDAVRARAPEGSLKVIRTIREIAEGALNLPRPLQGRL

SEQ ID NO: 4665 - protein, 94 aa, Methylobacterium sp.
MSTRQHSRRLIDEDTTDYEWSATKLDELLADPEVEGLAADMLSYGFRNGEFDPDPVYRQCREEYRRKEPAALLFFLAARLFERLLATQAARRLS

SEQ ID NO: 4666 - protein, 68 aa, Methylobacterium sp.
MQVALRRIEAPYGDELQVTVDAEALSVPRVVAVVLANAAGEDEADRIGKAVLKALQYAESLTTSTPGM

SEQ ID NO: 4667 - protein, 74 aa, Methylobacterium sp.
MLGAVLGAALPALVRPAQAEGYVARTRPCAPAPCRRPPPPPGFGYGPPRIVSGYLPRNNTLPMYNEPPARPPAW

SEQ ID NO: 4668 - protein, 386 aa, Methylobacterium sp.
VIGAHTPQGVPFVVGSHHLHREFGALGYAATHVPVPLGAEDVFTADHLNFKRIRAVSWQRTMTRRRDAHSDRSVVSLVPWAAVRRFGMARGYRLGYGRMLLPGFGEDDRSPELLIVDHPRQFWLVRQLKPKTLLYRPTDAYSHAGHKDHRVTLEIEGWLLERADGLVLTARQIEERMRQIGGGRLPLPMIVEENGVDLSIFRAKRAVTSRTSARDGGTRLFYVGSLDARFDHAFVAEAARRNPDCTFTIAGPPHADHGATYEEIPNVHLLGPVRHQDLPDLMGRADVGLLPLSDHPFNATRSPMKLYEYAAAGLPVVYRASPELCRRGLPFAFPYRGPDDFGAAVRAAALYRETGGAEMRAFAEAKSWRGIAERILDFARRVGARV

SEQ ID NO: 4669 - protein, 97 aa, Methylobacterium sp.
VLVRSAFLYASHTSALASLGKVALLLLVELPVVTLLVAFVVNGFVLHIIGGRLRRMRPGRMPVGLFARHRSERADELEHYPSHPGGEPSSRQPDHER

SEQ ID NO: 4670 - protein, 92 aa, Methylobacterium sp.
MRTATLILDLASAMLAVGGAAQAQGIFRAAEQGAARGNAVARPIGGLVGAGVGGVNGALGIHPRYRRVHALRGYHGYRHRHCYRHRHHYHCR

SEQ ID NO: 4671 - protein, 72 aa, Methylobacterium sp.
MSARTLPSVWVAATLAIGLIGVTQAAPLGAAQPNVDVTQLSTGLIVKSVTAVGMAHRSARRTARRVGRRHGY

SEQ ID NO: 4672 - protein, 91 aa, Methylobacterium sp.
MFGLTAQIRRAATSVAANIAEGHGRETGGAFVQFLRIAQGSLKELETHIILSGRVGLLASTPVALLLGRCEEIGKMLRALIRALQKPEGGR

SEQ ID NO: 4673 - protein, 238 aa, Methylobacterium sp.
MLRLRRSDPRGRASLLWVLITCALLALVAVLVLRLGNERRSYAEAIRTLETGRAALRQEIAERQAASGSLADLKAEIGRAETRERTVAQSARETEAQVAGLEARRRAAEEAIAAAATLRTDLSQARAKVDGALRESDDLQQQLAASRADRDQLSAAIAALQQKRAELAAEVSALDAERAGRVAELAKLDGLLERTRREVSQAQARAADGHRKALGQVEPSATDPPDASGEEPGAPGTR

SEQ ID NO: 4674 - protein, 43 aa, Methylobacterium sp.
MRAYAGSTGGASAQLLRAARELSHHSENLHREVGVFPAGVKAA

SEQ ID NO: 4675 - protein, 107 aa, Methylobacterium sp.
MRLVPLFSAIGLAAIAAVTVQPAPAKAGPLDGLAGAAVGFALGAMVAGQRPAYAAPRGRRVVYRQAPRRHVAQRSRPVSPRGAAISTVSDPFAGAGGGAKPIPVAGN

SEQ ID NO: 4676 - protein, 145 aa, Methylobacterium sp.
MSRFMTLALAGATALGTSVGAVQTAQAAPLPALSGNQVGGANTAVDHVGWRRGYYGGGYGYRGGYGGYGYRGYGYRRNVGGALAAGAALGLIGGAIAASAAPRYGYYGGGYGGYGGYGYPAYGYAPVGYGYGYPAYGGYYGYGGW

SEQ ID NO: 4677 - protein, 35 aa, Methylobacterium sp.
VAQLMAGADPTLLPSRMERARRAAALYAEAARRVA

SEQ ID NO: 4678 - protein, 461 aa, Methylobacterium sp.
VKSMSESFESVRDPVLSLFQSAVAEVAERIDAKPSGPGARRLERSASATFNDEATAIARRECGRDAGIGSGVRPSSPAARDLSPVDMGKVCVELALRYVRALASGNQTALAEIEDEYRTGTCDVEWVTTLRAYAGYFGPDGKRKPIPYVRPASAGPGTHEIKAGSRLALVSDWGTGARPAIEVLRSIAGVHPDVLVHLGDIYYSGTEKECEDNFLRPITRELRTKRPTLVYTLSGNHDMYCGGVGYYDLLPKLNEESLRQRASFFCLRSTDERWQFLAMDTGLHDDNPRSIADALTHLEDDELEWHCQRIEEFGGRTILLSHHQPFSAFSAIGAKPAQGKRKASNPHLMRAFERMNREGRVAAWFWGHEHSLGIYEPFSGIKVGRCIGHGAVPVSVLDDIYKPLDDLEQTPAIIEGTRLQTRGGVFAHGYAVIDVGVGSCRARYLQVTDAGTEEIFSEEIS

SEQ ID NO: 4679 - protein, 94 aa, Methylobacterium sp.
MARDRADDDALIEELAAIEHERWSHWQRYVHGKAARQPDGSLVLPAELVERWERQFDSQYEDLPEDEKESDREQVRRYLPVLKRWSQDDEKRSG

SEQ ID NO: 4680 - protein, 327 aa, Methylobacterium sp.
MRKALIIGIDHYDRLKPLKGCVADATAVADVLETNFDQSVNFTTPRLLTATDRGNPLDRRQLRTEVEAVFASDPEVALFYFAGHGFVDETGGFLCASDSQDGNDGLPLSEIMTFARQSKAKNRIIILDSCYGGIAGNRAGGGGVAEIAEGMTLLTASTEKEYAYEGGNGAPGVFTNLLVHALDGAAANLVGDVTPGSVYAHIDQSLGPWGGQRPVFKTNVKSFVSLRRAKPPISLADLKKLATLFPTPGHRIRLDPSFEPERERPDTGVAPDPANTEIFAVLQSFVKVNLVRPVGAPHMWHAAMDSQSCELTVLGEHYRRLVAEKLI

SEQ ID NO: 4681 - protein, 70 aa, Methylobacterium sp.
MTKIKGRNDGPGGRNEHYDIGSRKNVPRRNVVAEIKRGEHPGAHVVTVNGREYARDNPDGSTRDNVNRDP

SEQ ID NO: 4682 - protein, 131 aa, Methylobacterium sp.
MKRPRIEAVPKQVDVVTLADGRFATKPGIELERFLDNILDIRDHIVAGRPLPEHYYRRSTGRDYLLETRGWLHLHVGHDIDDDVLLIVEQTPERVIFIGLTDHGIFRERPAGKSFARLGSRIAKAKLPAKR

SEQ ID NO: 4683 - protein, 65 aa, Methylobacterium sp.
MALPKSDREPAARPERPRDGDLIPNETSESFRFVRRALRQGRVVSTQGLSDAEVRAVLLGQRKDA

SEQ ID NO: 4684 - protein, 74 aa, Methylobacterium sp.
MKLRIAGLAAAALVLLPGAASAQWYEREPRHHHHHHWDHHHHHGDRHGDERHHRHGYDRPIHFDRGHHHHHHGY

SEQ ID NO: 4685 - protein, 183 aa, Methylobacterium sp.
MTYLRYAPDIERPAPDEQETIHGIIETAHPVATLRLPRQDAYGPDRVRDFDEVMTFRLDGRAVAEAPVVALPVRGGRVVDLEEELQDAPVTRPGRIEDDLDAFGMRPVVSIGGIRHVATRVPLSPIASDGFVRHWPTLASAGLDRSSRPFEDLASQVIRILVDSDHSLICETALCLHILMTRG

SEQ ID NO: 4686 - protein, 37 aa, Methylobacterium sp.
VTCPHLQSTETLIALDLKDGTLTPAKFQQAITQTCHV

SEQ ID NO: 4687 - protein, 143 aa, Methylobacterium sp.
MTKAPTQAMRGMALALALALLPAPAVAHGDAAPQPIDTKGLPELGDDIRTANPYAGNALAIEIGANGYNQNCARCHGLDAKSGGMAPDLREVEAGEAGDGWFITRVLHGAKKDDRYRMPPFEGILSQEAIWAIRTYVESQPKS

SEQ ID NO: 4688 - protein, 85 aa, Methylobacterium sp.
VSGAVSSLRYGFTAGLPGFNVSDPTDGADCGPGAAVSGGAAGFGGSERAGPGASTDAVPSTRARSAGAARVEEGRSIGFCSVTIL

SEQ ID NO: 4689 - protein, 74 aa, Methylobacterium sp.
VRAPISRPAQGETASGTDTLARAMRLATQAADDTQGAAGSMLAVSDGLGRQSRAIEQQVRGSDALREPRPRAAA

SEQ ID NO: 4690 - protein, 397 aa, Methylobacterium sp.
VIEQAFRVDERDRRRRETVFGLALGTFFYVAVLSIDWITVPDVCELNLVVRLCIGVPVNLAMIGLVARRDCGDAARQWAACIVGLACSLTISAVMALSVSPGAIVYVSVNLVILGFTINLVALRPGVAALLCVVITAIMVAAAAASPFGTPGVVLIYVVLGTMVTIVCVFANWSLQNERRRTFLTLRRDKIRLRQISAQRDLLERLAAIDPLTGLANRRGFDAMLDGDIARASAGMGIGVAMIDIDCFKAFNDTYGHPRGDAVLRAVAAALAEACGPGVRLGRMGGEEFAAVAVGAEPAALRALGERLRLGVETLALPHRRNSAGRVVTVSVGLAWTCSAGTADRAALFGAADTALYRAKGAGRNCSVGAADELCAASPRGPGDARTCTEPVVRKAF

SEQ ID NO: 4691 - protein, 158 aa, Methylobacterium sp.
MKRVLLASSLALGALAMIPAAADARGFGGFHGGGFHGGGFGGFRGGGFGGWRGGGFGYRGVGFGGGWRGGYGGWRGGYYGGGWRRGYGYGLGGLGLGVGLGLAAGGLYGGYGYPGYGYGYAPVGYGAYDYGYGGGCYTVPRVRWTPYGYRRVLVERCY

SEQ ID NO: 4692 - protein, 116 aa, Methylobacterium sp.
LNAAIQREWTVNLGRRTALERLAHLFCELFIRLRAIGHTDGNSCTFPITQIELADATGLTSVHVNRTLREMRAAGLIILKGRQLTVPDLAALRKAGLFNPNYLHLECDGAHLSANA

SEQ ID NO: 4693 - protein, 38 aa, Methylobacterium sp.
VPVHQIEQHLPGNLREAHGRDRGDHVIHLAQDEDVQVA

SEQ ID NO: 4694 - protein, 36 aa, Methylobacterium sp.
MTRLKTRLTAVAVAGLAAAVALAAYAQTLALPTHFI

SEQ ID NO: 4695 - protein, 115 aa, Methylobacterium sp.
MALPLCVVRWLRSARTWIALGIFAPLRMLVMSWTMLNEAITQEAACGVRVDAVRLERVEGVLGGSAAASCAGHSRAFSAYNLHMLRRRTHLSLCIAVGSTLILTTVAAVALCWPS

SEQ ID NO: 4696 - protein, 167 aa, Methylobacterium sp.
VPSRAKPAPVANGPRRSVCGRSRRRSHPRFPLRASTRRPSHGSAWPLERSPPKWTPVRRKRARYNNGSERIDAIIDRLLEVTEQARALTDPSAIEALNVEIDRLATEVVRYAREREREPDGRTMASVSIAIDTAKATVADCRNLVGSPKEQSPLRILRPVRAPGPDA

SEQ ID NO: 4697 - protein, 29 aa, Methylobacterium sp.
MPGCGHFPHREKPDAAAQGIARFLGQVTG

SEQ ID NO: 4698 - protein, 320 aa, Methylobacterium sp.
MLALAAVLGALLPAAAQTSYPTRTITLVVPFAAGGTTDIIARMMADHMSRTLGQSLVVENVTGAGGTTGAARVAKADPDGYTLLMGNLGTQAASVGLYPRLSYDPRTDFAPIMNSASTPMLVVAKKDLPVKDFREFVAYAKANAAKLNYGSGGHGSTSHLTCLFLDTLIGASPQHVPFRGSGPALNALLGGQIDYVCDQTVAIVPTVQAREAKALVVAVKNRLPVIPDVPTSGEQGLPEFQATGWNALFAPKSTPKAMIDTLNAAARAALKDPTTRKRFLELGAELPEEAEQTPEALGNLVRTEIDKWVPIIRKAGVTVK

SEQ ID NO: 4699 - protein, 107 aa, Methylobacterium sp.
MSNEQHQGLPVAGYQAQTSDKVTVVNANKELEERCIRAAESIRDTPGMDGRMAALAITNLQQAFMWLNRAVFQPGRVALPEDAAEPRVPRHDPEAAPATALGGRPHP

SEQ ID NO: 4700 - protein, 312 aa, Methylobacterium sp.
MEMIANAGTNPADPFDWYRAALAGQIHELRLGHAPCGFFRLRRRDGTLEPVAVWPDEGGFRWAKVGRAGEPECLVEPEAEAAFCERVIAHCWRSPVPEEVYFSVVENDAPWPDMPPERTTDYANMPSDPLEALRVELEGERAEAEAWLAAGPIADQAAADRAANWALRFADMEKRAQDGRRAEKVPHEKAAKAVDARWRPVQDDAAALKARLKDAQTPFLVEKRRQEAEARAAAARTGDALPAASNASAGTAGRKTSLRTVRTAVIEDFDAALMALRENPELRELVQKLANRVATSGGALPGCRIVTTDKAA

SEQ ID NO: 4701 - protein, 74 aa, Methylobacterium sp.
MRHDAVPTARYVITATAREGIVQQTRVMAASAVVLARSWQDRGYADVKVIDPKGDPLSPEAFRIKFMDGVKRFR

SEQ ID NO: 4702 - protein, 59 aa, Methylobacterium sp.
LDVRKYFGTDGIRGRANGVITPELALKVGQAAGLVFQRGEHRHRVVIGKDTRLSGYMIE

SEQ ID NO: 4703 - protein, 66 aa, Methylobacterium sp.
VERRHAERGIRVNCVAPGPIWTPPMVPMKRPGQPRGLAPVYVMLACEAASCVSGATVAVTGGKPII

SEQ ID NO: 4704 - protein, 59 aa, Methylobacterium sp.
MERLYRGLETGLLGLGLCLGLAAFAAMSTPRDALMPREAAMPLAVTLPMLTVVTERTPR

SEQ ID NO: 4705 - protein, 91 aa, Methylobacterium sp.
MPSLRHLLVDAAAVALVGIGLTAAASGYLHNLPDPAAASPPAWDEPLTTGSIAPRGAAVETEASAPAEAESPPAWIDPPLRASRLSRHRPS

SEQ ID NO: 4706 - protein, 31 aa, Methylobacterium sp.
MFACAFCHVSPQSPGHGDFAGLRLSTQERQM

SEQ ID NO: 4707 - protein, 173 aa, Methylobacterium sp.
MLVDDTQRAAEPLARVIRKLGVVSFHDEQPGDVHWCAEAQRFEYRDRADPSRVLLEYEEGGFIYYLPVDASSLRPGETPARVRAPTTLMTAGEASEWLNATRDNGDGADVGPDWKPLDIICDACGVAQLQARSTAGRVDCRCPACEDSTAARRPVAAGARGSGFGGIEGSRGE

SEQ ID NO: 4708 - protein, 44 aa, Methylobacterium sp.
VGKGPRFIKIGGRVIYKLSDIEQWERDRRVKSTSEYEGETFQGA

SEQ ID NO: 4709 - protein, 367 aa, Methylobacterium sp.
MHVPLSHQSAMDQLLAAMAAQGIEPTHPLLANGKLERFHVEGDHKGSRNGWACIHLDAAPAGQFGCKKRHGEHKFSWRAAGITKPMTAAERRAQQAEWDRKKAEKAAAERKRHADAAEQANAKWVAAAEATDDHPYLVRKRVKAHGLKVGTWEFTNTDTGEIFTLTDNALLVPICDKSRKIHSLQAIFPDKILGQGKGARDKDFTKGGRKAGLFHVIGRPQQVDGRAVYILAEGYATGATIHELTGNCVLVCFDAGNLLPVAEAIRSSKPDAIIVLAADNDQWTITPIENPGVHHATRAAAAVGGLLAIPPFAWEDGKQDDEGKWSGPSDFNDLRALDGVEAVRRARSQPSSSVVLLATSAMTTPGR

SEQ ID NO: 4710 - protein, 43 aa, Methylobacterium sp.
VSALAALRRDLRTLTPPQVLLVALTPLGAFALGMLIVFPASFA

SEQ ID NO: 4711 - protein, 39 aa, Methylobacterium sp.
MTKLDAKTLKAVTGGTACPPAKDPCAPACKDSGGKSKKC

SEQ ID NO: 4712 - protein, 38 aa, Methylobacterium sp.
MTKLDAKTLKAVTGGTAKCDPTPACPPAKDNGGKSKKC

SEQ ID NO: 4713 - protein, 83 aa, Methylobacterium sp.
MNDDPLLARLDAALREAEHLRLEALRVQREAAVRLAEIRWSGMGLSDAMDRSLALRLGPRPARPGGETAPTRSAIPAGLLPHA

SEQ ID NO: 4714 - protein, 32 aa, Methylobacterium sp.
MEDIPESRIEHVAMMEGILISRATGGSPDRHA

SEQ ID NO: 4715 - protein, 287 aa, Methylobacterium sp.
VTVEIQTFSDAAELEADPLWQEAPITKRVRPMLLARPFRGTRIRPVITNGGDALVLHFATPDPAFGKGTVVSASPTRQIMRRQDRILIVWADRVEVIHRGGSVDFAKRRAVDEAAKDLLAHMYSATARANEVRQQVAVERIRRARVRLTASESLLRAAVEAVDEMEPGDPFLGVAVDHFVACARHLEVDRQMLGEICDRVAIEPGMPDDVVVEMLGRRLEVMTPEVWCGLAAAAGAGAFEPVRIEQHVNRLMEGPDELCLYEQVRVAAEMVDAHTNDAAAGFPARGS

SEQ ID NO: 4716 - protein, 218 aa, Methylobacterium sp.
MARGRAVPHAVRERALDLWALTTGMSGVGIALAVGIRHGTLSTIVARARAAGDARAIHRQAGPILGSKNRAAKPRPERALNLWSTDPGMSAPEIAAAAGMKLAGFLSLLNRARKAGDPRAVYRDGKPMRTPREPGAASTRRQPAFRRGPYRTRSVARALRDDILTSWAEGLDGETCGARYGVTPDYVLQVVARARESDDPRALWRRGMSPTLRALTPA

SEQ ID NO: 4717 - protein, 32 aa, Methylobacterium sp.
MTLLSVELLPIWLLPLAVIAFAMFDFEEGMDP

SEQ ID NO: 4718 - protein, 28 aa, Methylobacterium sp.
MADVCLAYGREVLIARPTTRACPRADAS

SEQ ID NO: 4719 - protein, 56 aa, Methylobacterium sp.
MRDLLKILAAGSLLTVYALAVPALIGDISAAPRRPGTAMVAEAPEPFLPAGAPRSL

SEQ ID NO: 4720 - protein, 164 aa, Methylobacterium sp.
MGEGGWRGSPPTDEPINRRPSIKGEDGRVVFDGLFDFSGANEAAFTLETKLDGDTTRTGTIVLNAETLGRLQARLGFADLSKLTGPDLVRSINAQIEATGETGLRGTLAASLDPGAAARLPPTRPASSAPAPSRRPTRSISAAPSTRAPPGSSTISAPKRSASI

SEQ ID NO: 4721 - protein, 398 aa, Methylobacterium sp.
VTPRTGRITLNAEILDALKTRTKVEALASMTLSRVTPDELVAAINAQIEATGDAGLKGTVRAALDATGRITFTTGDYGLSGAADGTGARTDRVYAASGSERTIEVRSADTSRLFTSGFDIGFGIDRKRDASGQGSWRDGTAALVAGSRAYKASDTIDFSGTNEVAFRLATRLDAATERAGRTGLQGTVRASLSATGRIVIRTTDSLDLGADGTFGGFGKDGDTAYSGVGSGRTLSLQNIDRTAATQTGIDIGFGIDNGPDATARNATRAYLREALEADAGEDDAGVRLALYFSRIGPSIRSGFDILADKALSQVIATVLNLPETTGSSSEAVTARARLIERRIDIKAFQDPRKLEAFVGRFSVMWDIRNRAPSPALSLFGGTGGAEPLYSAMSRRSWF

SEQ ID NO: 4722 - protein, 32 aa, Methylobacterium sp.
MVRTGGIDGQAMTSLELRSVRGPRPDRSADRG

SEQ ID NO: 4723 - protein, 313 aa, Methylobacterium sp.
MIEYGKFLTGGGRMAIKIMEHDWGASALGLVEAWPRALRYTLSGMLNSAFPTYLAWGPELISFYNDAYRPILGIKPEALGRPFPEVWSEAWEQIGPLTDRALGGEASYLEDYTVTVDRHGARERTLWTFAYSPVRDEGGSVRGVLCHVHETTGRARTEERLRSALREIEVQQARFGALIEHLPFAAGLFGADGRALLANPLCRRFLPSGKAPSVDPDARTQWTGFDAEGRIVSPDDYPLAQAIRGEVVRDMSFLHRTRDGDACWMRVSGIPVRQGNGGIQQAIVVLRDVDRETRAEAALRESEERFRRFAEHS

SEQ ID NO: 4724 - protein, 28 aa, Methylobacterium sp.
MATVAPAVSSAAVIVLRMSLFMGRFLVL

SEQ ID NO: 4725 - protein, 117 aa, Methylobacterium sp.
MPRSRWLPGLLLCSLTLSAAHAAPSGGPVAEHDRTIADAALRRQMKAPRLGEIWYRREGRTLCGLVRNTPGTDEAGWRMFMVVLESGQSLVEPSREEERRDKRLVLEKLKLLSAECD

SEQ ID NO: 4726 - protein, 271 aa, Methylobacterium sp.
VIAAALRVARAAEPEAVRQAPAPPVLSFDRVGFAYDGRTVMRDVSFGIRPGEIVALLGPSGCGKTTILNLVAGFLAPTEGQALLDGRPIAGPGPDRGVVFQAAALFDWMSVAENIAFSLRCAGAGRRARRRAAEEMAALVGLAGREDAYPYELSGGMRQRVGLGRVLAARPRVMLMDEPFSALDVQTREGLQEEVLRIRDRTGCTILFVTHSIDEAVFLGDRIFLLEDVSAGRFETFGVDLPGPRERTENRLAPGFLRLRETIYRRMRAPR

SEQ ID NO: 4727 - protein, 462 aa, Methylobacterium sp.
MSLERIHLDFATIRTALAAGVSALALVAESHRRAAASADDGIFTALVPADAALAQAERQQARAAAGESLPLLGLTFSVKDNLHVAGMVTTCNCPGFAIHPDESAPAVTRLERAGAVLVGKNTMDQFATGLNGTRSPEPLCRNAVDPAYIPGGSSSGSAVAVARDLVAFSLGSDTGGSGRVPAACNGIVGLKPTLGLVSTRGLVLNSRLLDCIPVFARTCRDAWEILDLIRGHDPQDPGSRPDADAIARGPVSAEPSVLAVFRPAEMPFFGDDHARAAYEAGLAVLARLGHTFREIPFGPFAEAGRLVFQSALVAERLVSYGTILAERPEAIHPAVRSAIAAGTAYSARDAFEALDALRALRRRAALELAGTATLVVPTVPTIFTIAEMLAEPMARNTQMGTYTYFVNPLDLCAVTVPGRRRPDGLPSALCFVGQAGTDHVVSALATAFEDASRAGSVLGRAL

SEQ ID NO: 4728 - protein, 56 aa, Methylobacterium sp.
MSPADTPEPNGEPTPIGDPSPEPQTPEGDPPPNPPAPQPPGPIPESDLEQVEEQPS

SEQ ID NO: 4729 - protein, 446 aa, Methylobacterium sp.
MPTPRPRPFFPALVAFESGRDTPRAFLEGCLEELTRWEPTVGAFTHTDLEGARRAADAATSRWKAGRPLSRIDGMPVGVKDNIDTDDMPTGNGSPLYDGYRPRFSAASAQALREAGAVILGKTVTTEFASTQPRGTRNPWDLARTPGGSSSGSAAAVAAGMVAGALGTQVVGSIIRPAGFCGVYGFKPSFGGINRGGSLDFLSQSCTGSIAASLEDAWILARAVAAEVGGDPGYPGLGGPLLPPAARAPRRLGLLRTAGWPVASEEARAALEAAAGVLRRAGVAVSTPETSTSLAALEGAVAEALPETLHMLAWEWRWPLNAFVARNAEALSPSSRERAAVARAVTREAYVSLLQRRRKARALFATVMDDHDALIGLTAPGAAPVGLETTGNPICVVPGSYLGGPVVAMPLLRDGGLPLGLQVLGKSDEDEVLFTHASWIRNTLRS

SEQ ID NO: 4730 - protein, 42 aa, Methylobacterium sp.
LINALAAVFTVLAVLLLRAVLKLAILPFRALRSLWRRQTAPV

SEQ ID NO: 4731 - protein, 78 aa, Methylobacterium sp.
MRTIQRLALAALASAAAAGSAMAEDRIDLTPPLYREQARVTAAVRPASELTTTPNLTAAAPAAPQAPRFVAEAGALTR

SEQ ID NO: 4732 - protein, 27 aa, Methylobacterium sp.
MVSSTGPTRVVIIVAYALMKGWGQGES

SEQ ID NO: 4733 - protein, 353 aa, Methylobacterium sp.
MLDERTRKSFPIADPEPSAFGAAAGTRDWVAEFRREQAHLIRTAPGDGASRLLPYGVGGALALALTVALTTVLPTRFPGAAAPGDRAASAPAVPRMPASELAEAREEGLTFDLARARQEAEAARAAHAQDAETLRAAHAREIEALRAAAAEAEAAAEAKGGLLARDLESARAGLAAARRQAADADAQAAESRGRSERLAGQLAEVEARARAERAGSEAALAQAARERDEARTRLAETARATPPPDTDATTVEPAATPQPVDWTLFSLRLAPAEEASATAPLVRDPQRAGSDQKGPERKAARRARASTPVRTDSAPRADRPGRTRAGTARAPAATGGPEPAPPLPGVGLAEPDA

SEQ ID NO: 4734 - protein, 81 aa, Methylobacterium sp.
MPDLLIKDLDDATFRTIAFQAEAMNRSVEDVLRELIRIGLLHDVEGRVAVADRIRSMSRPPPPGTVIEDSTEIIRALRGRI

SEQ ID NO: 4735 - protein, 343 aa, Methylobacterium sp.
MEGFWAREGEGEWPMRSVPVRAVTLLCPAMVTGGPQALHQLAFALNRRGLPTRLAYYANGGRLVREGDAVRCVAPPQNPCLVAYDKYCPVPAERFALTPDHLVVLPEVLAHLHRDYAPAQAAVWWLSVDNAFHERSALRDAGVRAALFANRELRHWAPTFYAREFLRREGVLEIAMLSDHVDDQFTTWRPEGPGPDAVVAYNPRKGGALAEAFFARHPDLTPRPITGLNRRGVWEAFRRARVYLDFSHFPGREFMPREAAGSGAVIFVRNVGAAQHFDDYPLPDAYRFLDAALEDGTLHAKVMSALAEPEPHWAVQASLRQNVRWEAETFDRQADRLVEQLSA

SEQ ID NO: 4736 - protein, 445 aa, Methylobacterium sp.
VIGYGLNEVEGKSHRLFVDAATVTEAEYAMFWENLRAGNYVSGEFMRVAKGGRKVWLEASYNPVRDADGQPYKIIKFASDITSRKNENIRQSMMIDEVPVGVMTADPSDDFKINFINKTSLSTLETIEEHLPIKASELIGRSFDIFHKNPGHQRRMLADASRLPHRAKIKVGPETLDLKVSAIRDAEGRYVGPMLTWSVVTAQVAMVAEVTRVVDALRQAIEEMRSSAKGLNTSADQSSELAASAAAGSEQMASSLQEISSQVGRVSERANQIADQANATVGTVRILAENAVKIDAVVGMIKLIADQTNLLALNATIEAARAGAAGRGFAVVAAEVKELAGQTARATEEITRQVQAIQGITQQAVSAIDTITAAVDELSRLTLTMASSVEEQAASSQEMASNIHGVSSAAGATGQLAESVRQISERLADYPAGLTQSVETFLKAS

SEQ ID NO: 4737 - protein, 281 aa, Methylobacterium sp.
MTKITSLSALLAVLASGTALAADLPRRVAPPPSFNPIPVFTWTGFYLGGNAGYAFTTRESRNRNAAFLIDDRDIGTVGGTFGFNNRGQNGFSGGLQIGANYQFTPGSGFVVGVEADAQYLDAGRRRSGVVAGAGTVLNPNAVFFDPRATAGLEYFGTVRGRLGYAFDRTLVYATGGYAYGGGSEQRYFGATDNAQMRTGWTAGAGLEYALPTESFLNFFRASAVTMKVEGLYVNLERNKGLALLAVNTVTGDVFLRTPDRRSLGDDFAVVRAGVNYKFGSY

SEQ ID NO: 4738 - protein, 31 aa, Methylobacterium sp.
LINAKIESELLSMSILTARRVWRVSIVPMDD

SEQ ID NO: 4739 - protein, 559 aa, Methylobacterium sp.
VRQIILALVVSVVIVAGGLLAGVSQYAGARRALVDDARTRALRFDAVYREASEARLQALRLAAEIVARDTLVIDPLARRDRAELARRAVPLFEQVLKPRFGVTLLGFQGTDETTFLRAHRPEQFGDSVAGRAMGAAVARGRSTVAGLEIGRASGPELRAMSPVVSGETLVGTVELGSSLFEALQIAAQATGLDFGFAMERRAAEALDRPPGPEALQKGDAVYIRFSRPEVRDLLAAAPVDLAEQAPQVVDGAGREIFARTAPVLDVSRQPVVRITLVEDLTDPLAERRGRIVLYTALGTALLLALVLAGLLQFRALRTRLERSFSGRLREVHAKAQAYDRISQSLRDLTAWKLGLLGELVLLIRDPLTAVQGALETAGRAGEPSAGAALAFAAGEVRRLNAAVADHTTMLAMRDRLRRVEAGPVDLAALAEAVAADAGGAPAIRAAVPADLRPVQANAALLRAALRTLVLTLQRGSDAAPIVIEAATEGEGIVGRIAGSGGWSAGPPGLEEVVAFGSAMHQPAGSPLILARLTVEHFGGTLALLDEPGLAGFRLTLKAA

SEQ ID NO: 4740 - protein, 488 aa, Methylobacterium sp.
MGARGVSRPSPALVLPFLTVAGLLLFEDLFNAPLAFLTGIDPETIRRCEAALLVAIAALLAARFVRRDLIHGLLEARAGKALPHLLGDVAGLLVLVLGGTVILTGVYGRDIGTVLAAGGLSLAILGLALKDVILAVFNGAALSAENAFTVGDRIRVGEVDGVVVQSTWRSTTILTKARRLVSIPNVALGTAAITNFDRPDRSEQRILEICLDYDVTAESAERILLAGVIGAAGVVLVDAPRVHAIRLERDGVLYAIRYVIADHDNGLSSDHAVIRSILSHLRDAGIGVAYPKQEVVAAERRVRVADRTFDRRVLVQQCALFRGLEPAAQARIAEALIERNLQAGALFIAAGEVRPSVFIVGEGLIRRTRVRPDQVGFVEERYVATQTFGRRALLSGLPHPAPVRAVTQSLVLELTREALAAVLRAHPEIRAPLAGNLARAPLHDVAHATEVSALESRTERPVAFYLGLLEAVAPEAPPPDGGAGPGRS

SEQ ID NO: 4741 - protein, 53 aa, Methylobacterium sp.
MAEIGRGPPAAERPNGYGHPMLDIVFLAGGLAVFALAAGYAALCERPALCERL

SEQ ID NO: 4742 - protein, 79 aa, Methylobacterium sp.
MTLALAIPVVEAAAFTAGCVLIHGHRHRPEPVTFALLGLLCLVALGGFALVLAHVGPDDPMAATAQLPFENHAAGAIRY

SEQ ID NO: 4743 - protein, 89 aa, Methylobacterium sp.
VAAWFSEEAHRQQARNLASQRAAALVRSKAGSMAIRAMADALMQKGEIKADEIAGLCREAYGGRQCEFGAWNAHWPPTLEQLRSGYIPD

SEQ ID NO: 4744 - protein, 76 aa, Methylobacterium sp.
MSSSVLLRLVRTEITAAEGRASALADAIRGRLKAGADSTDVEQALFHVLDSLTLLRAKQQALHRVAIEQQQGSAAA

SEQ ID NO: 4745 - protein, 58 aa, Methylobacterium sp.
MAVVLDIAKSLHNRHAMIFCGHGSLLGARLAAALRRGADRRYAEQRDRIERTGCAGIF

SEQ ID NO: 4746 - protein, 71 aa, Methylobacterium sp.
MGGGGHAGDAAAEAEPFVARGDDPPQHLDRRAMPLDAVIAGAMAVLATEAERRCPGPMTGWATIPARTGTR

SEQ ID NO: 4747 - protein, 57 aa, Methylobacterium sp.
VRPILDEPVPAGSARTRHRLIVPGPEEPTSKRRQRTSAEPAVLKLRQIEVQMAQARR

SEQ ID NO: 4748 - protein, 522 aa, Methylobacterium sp.
MIDTPALPNAITITWISRGLLVLALTAFGDWLFYDRIVGLSLALFLIALAATVPLTNTVQTDWRARGLAFAVLILGLLPLLEDVGVLAVLFGIGGLLGSMVLMTGGLAPGRLATLGAVRRMLVAGPFQIVTDLTAGMSRQLAAGAPRWRWQPIIGWVTPILLGALFALLFAAANPVIDAWLSAVSWSSLQPRISVGRALTWLILAALAWPFVTVRRRYPARTASPEADAPSAVPVGIAAALGLGPAVILRCLVLFNLLFALQSTLDILFLWGGLALPAGVTYAAYAHRGAYPLIVTALLAAAFVLTVMSPGGPGERLPLIRRLVYLWIGQNVLLVISAILRLDLYVAAYSLTLVRAAALIWMGLVAGGLMLIVARIALRRSNGWLLAANAALLTLVLYACAFANLAALISDYNVAHSRELGGGGGSFDLAYAMRLGPDALPAVDRYIAVATGPNRAAAIHWRVRAARETARTMQDWRGWTFRNWRLARYLAATPAPPPAPTPDVALPGGDGALPDGGAAGPR

SEQ ID NO: 4749 - protein, 345 aa, Methylobacterium sp.
VPERAHPGGRGMRPLKPIPRLHGLRPFGLFIAAETAGLATAMAGSLDMAWLPIGHGLCLAATAAAVRAERSGECTFAVLLLLLAACTGPIGPAGLLLVQSVLTRTRICTNELDAWYRRLAGDTATDPSVTLYDRLLDGRARRTGRGGPDHFPTVLHGDLVRQQALLGLIGLAYHPDYRPILAQALCSQEPSIRVHAAAVSVKLRARALAEFKRAQEAEADGPAAECAGLALRLLDLADGGFLDAEKAGVARTQALALVVGAGRPDVAACDVAARDPIGRRALAGLERWEEAVADPEAAGPVRDPEDLRLRMLCLMRCGQARALHALLGARDARAPTKRGGLHHVV

SEQ ID NO: 4750 - protein, 361 aa, Methylobacterium sp.
MATDKSAEAVRPRRFRLHGLHETALIFLVLLGIEWIAPGPAFLARLSPHPFWIPVILVSVQYGRVSGLAAAALATALASLAGWPAQTPQEDFYTYSLRIWREPALWIIGALVIGGLRSRQIRDRQALEADLQSAEVQRNALGAFCEALQAELSQFERAAATTTAGSVAAALEALHALRSGGASAAVDRLPAALAAWLGETRWSLHLAREGSLHRAAPTPREGGCEVTGALALARLYGIARRTPRTLSVFEERDAEVLDGIGIFACAIRCRYPAGTLGLLVVESVEPGRLSPALGLATSLLADTLGMVLDPARAPAASPVEVPPVDALLADAPSSGGEMMAFAAIDPACRSGRIPEAAACAR

SEQ ID NO: 4751 - protein, 762 aa, Methylobacterium sp.
MAGSMRTGPDQRPAPSPHRLAFVLAVIGSLCAAAPWPLPALSAENGSEEPIPRTLLVLYDGAREPEPADTRVHRYAEAVLNHLGFVVAYRDIRGPLPDPEAVRAYAGLLTWFAAPPAARGRYLAWAETAVRSARKLIVLGATGGEFWGTDARGIQAILGEIGLTHDRRAVEVTLGTRVVAEQRGLTRFERAPDPVVPGYDVVHAAIRAEVDVWLELGVPDRAGGGTSIAVAVTRRGGYAAAGFEFAEDRGLDKARWLIDPFAFFGRILSPDSWPVPDVTTVSGRRLYVSHVEGDGLNDVVGEGRNRMLVAQRFLSDIVEAYPDLPLTFGLTPGDLDPRLGGNETPRALVAQIWGAAQVEPAIASYTRPFDWPFFAHYSREREIARAAAVRHDLPADILRTGDPDPAVQARWSVSRGREFPRQYLARPFDLGTEVDTAADAAGVLLPDGKALRLYLWTGNAKPFEAAVAATRRRHLLNMNGGESRLDADYASVAHLAPLARPVGTERQIYAVAADEVPVEKAWRPIRTGLRGFAPTLANTGWPRRLKGYNLRYHLASLADPEALRIVRGYLDEARTAALAPVPASTYAAMVEGFFETAVTRIGPGRWRVAGRGAVRTLRLDGPGDRRVDLDRSRGVIGQTRYADALYLALDPAVEAVEVVLAAGPPAIAAPAGLVESRWQLAHLRRDAHGWRFEAQGFGAGTFRWENVAAGRYGVTARRGGATAWHGIAEADGGGLTFTIPDEAGTTLDVEVARLPPTGRGAE

SEQ ID NO: 4752 - protein, 53 aa, Methylobacterium sp.
MITVTIPLTTIPLTTISPALSFAAVVLTCLVLHAACRAAALRPQLRPVRVRRR

SEQ ID NO: 4753 - protein, 131 aa, Methylobacterium sp.
MEMITEQQVRERAYYIWEGEGRIHGRAEAHWLRAETELNRPVAAIEAPKAARKSRARAAAPVVETVAAPLAAKPAARKTVEAAPTKAAKPVAKPVTKPAAKAAGKTAAKTPAVPAGLAAKKAARPAAIALH

SEQ ID NO: 4754 - protein, 52 aa, Methylobacterium sp.
MRNASALAARLAETVTDALTRASERLLDLVGPQRQAQLIPVRVRRGPQRARR

SEQ ID NO: 4755 - protein, 78 aa, Methylobacterium sp.
MDLCLTWFARAWIGLVLLLSLADIAVMALQSGGGAAAAMYNPFDLANFLMEAILLSPALAVLIWRDRRRLRGACETAL

SEQ ID NO: 4756 - protein, 71 aa, Methylobacterium sp.
VGGGALPAGGLAAAALAPAMGLLSGLVTTLPYRLEDLFERPPLHGMWWPALGGLAAAIDLMLFAAQARGSP

SEQ ID NO: 4757 - protein, 130 aa, Methylobacterium sp.
MPPGSKDIKPDVKWQAGAPYGDPTKSDALFIRDLALSSITMDSAGWPPEIGRALEQAIRSGSVKIQKASEVEGLNFKSWHTFTPNRNNGAGYDSMGGTTQNPVGAVKTAIDSGRGLAMWTADRGDVYLSW

SEQ ID NO: 4758 - protein, 218 aa, Methylobacterium sp.
MVKNALLFASALAGALTLVPAASEAQNISGFRGGNALAGGFSGPAPGGGFGGGIGGGGFNRGGVGIGGGGFNRGGVGIGGGGFNRGGFGGAGLAGRGYGFNRGYGFNRGYYGHRYGYGYGRRGYGLGGLGVGVGLGLAGGLAAGSLYGGYGYPGYGYDDGYYGGYAPAGYGYAPVNYGYAETVTSDSSAEEACARRFRTYDPRTGTYVAKGGVRRACP

SEQ ID NO: 4759 - protein, 122 aa, Methylobacterium sp.
MEVLTLRATMLRASWTSGASIETMLELWASSLREVKGRMRPLFTHERVAASAGAFLDGLLGAERRKTGWMRAEAAGDPGPWRQQAVLGRGRWEADALRDVVRDYERLTERARTARSGVGVNG

SEQ ID NO: 4760 - protein, 170 aa, Methylobacterium sp.
VVIRSSDCHLLLPTGPQADRERVRELLDVAGVSHWVEPAKGPGAPTQVDGITVEGYDAPAIAAPLRTAHYPAVADLAQVDTVMVTPILFIMVLFVCITYGPVAIYLVELFLARIRAPALGMPYHIGTGNFGDCMVYFATPISTTAGNIYDGLWYAVFAFACTAIDLWKLP

SEQ ID NO: 4761 - protein, 74 aa, Methylobacterium sp.
VTLGAILTVILVAAYFGFVGMGAFAPALLAKPVLAGGTVTWAFAYGLFVIALGVVLTGLYVLLVNRAEARLSGE

SEQ ID NO: 4762 - protein, 49 aa, Methylobacterium sp.
LTYDRWRKEFGGLKTDRVRRVKDLEVDNQRLRKTVADLTLDKLTLQEAA

SEQ ID NO: 4763 - protein, 296 aa, Methylobacterium sp.
MIVAVLMGGMSREREVSLATGRACAAGLMKAGYEVVELDVDRRVAEHLAHLSPNVCFNALHGPLGEDGSIQGMLNILGIPYTHSGVAASALAMDKLRTKAVASALGFATPRGGRIGRRTFEATLPTSPYVLKPVADGSSIDTFVVRDPTKAPFPTGCWPFSADPLLEDLVEGIEVTATVLGDRALTVTEILPRSNFYDYAAKYTGGGSEHVLPARLPAATFDLCLERSLAMHRAIGCRGISRSDFIISASTGEPIFLEINTQPGMTPTSLAPEQAAHVGISFPELMHLLVEAASID

SEQ ID NO: 4764 - protein, 54 aa, Methylobacterium sp.
MQVLQDPGRTGAPAEARDVQHAELMPRLQDDLQERVPARRVGQAQRPPVGGQLL

SEQ ID NO: 4765 - protein, 56 aa, Methylobacterium sp.
VRAVVVMVAPAVLHGGEAVRCLDRRGGERRGLGGGRRREEPAGEREGRQRAAAEGT

SEQ ID NO: 4766 - protein, 66 aa, Methylobacterium sp.
VIEFSERDRDLIEDFLNHVLDRYKAGSIGRPMARAELSEAMALAAADAGPLRRHMRETLHRPGEDE

SEQ ID NO: 4767 - protein, 168 aa, Methylobacterium sp.
LRATLNGLAPSERAQTLFLPALAGAPEALFDLLALLPVCDVNGALTACLAAGGIGDGPAPVAALFCVDPFLRVPDLAEAVLAAGLRRVANYPSIQAVDGETGRTIAAVGYGPEEEIATLLRLRAAGLEPVGCAASADFAAALAAAGIAPVLAIPALGSGSRTFAPFTR

SEQ ID NO: 4768 - protein, 566 aa, Methylobacterium sp.
MPAPALFYGRPANDLLIGAAIGLGMTARASVQGGADFLLVLNAGRLRVMGAASIAALFPIREANGFTDAFARGEILGRVPVPVFFGAAAFDPRLDIPALAAQLARAGYAGIANFPTAIHFEGRFRATLEKSGLGYAREIALLRAARAAGLATFGYAKTREEIEGLLGAEVDILCLNFGWNAGGSLGIDGVPLDEAADRARRVFQWVRQARPGTICVVEGGPIVDSASMIRVCDEAKADGYVGGSTLDRLPLEMSVMQTASAFKTASLLRPARDEAQREHARITALAGLVGQSEAITRMVERIARLVATDLAVLVRGEPGSGRTTVARAVHVASRRPGPFFVLDAADPEIGEALFGDGAGRRGALEAGDATVVVEAIGHLSVALQERLARVVEQAIVGRFGREEQRRARLVVTAHDQAGIVPALLARIEAGQVDVPPLRDRPEDIPLLARAMLRGLGRREARPAPAAIEPAVYRLLMTRDWPGNLRELRSFLARAAAESPDGTIRSDCVARLCQAAAEIRRGPVADERAWIVDALRRNRFRRTETAAFLGLSRKTLYNKMRRYGLTE

SEQ ID NO: 4769 - protein, 45 aa, Methylobacterium sp.
VRVPAGLAERIEKRRQALQKVFGLPVSKATAVIDVLAAGLDQLEK

SEQ ID NO: 4770 - protein, 126 aa, Methylobacterium sp.
MNAAPLYGRGLDEMTGLDAAALERGMDGLTQELASGPAYTAKDRAQLEENAQAYAAEFSAARVREARRIAKLHGCSMRGGRGIPGFQLTKKATGEVVGGPRSKAAMLTPGDVARVFGGRLSTKDVL

SEQ ID NO: 4771 - protein, 108 aa, Methylobacterium sp.
MQGRDSAVRRNSIDQVSDAEFLAEVVEAFAGEELGRCVLEGPDGVSFQVCGAAKPLIEQLTTWSGPSDQDGIEVHFCDVSRRGRAYPLQGLLHLVDVCAAARAQAVPA

SEQ ID NO: 4772 - protein, 974 aa, Methylobacterium sp.
MSQRHYQSESPERVASALAFVDPTDRETWVKMAMATKAALGDLGFDIWNSWSEGSDSYSQSDARDVWRSAKENGGTGAATLFWHARNNGWKDDGSFQAPPALTAEQVAEREAQRAHKAAEDAARRTAAANLAKTLRDAGSKEISDHPYIKRKGSGLKYGAGIRRGSFPQRGWDDALLVPIYGADQKVMSLEAISPDGEKIGLKDGARSGGFYPVGQFMAAETNPSRIVIIAEGLATATACQAATGYPAVVAFSVGNLRGAGETVKRMCPDARLVVAADLGAEVKARAAAVALGACLVVPQGEGLEKGNDFWDARDILGGKVVAAQFEDAIAAGPVEAEAPVSERAVRSEAAYQDAAVQTQTAQAAPVAYAEAEEVPDELAAQLLPKFEERSAQPVAVQPASSVTSEATGEEPDFDKHFAVLGFDRSTIFVYSHSRTQVLTTSASALSKASGLIELAPLNWWEFYFQKAGKGGSGLDAAAAADWLVRLAERRGIYDDSRVRGRGVWLDDGRLVFHHGNFLTVDGVQTELSNIRSRHVYEGAAAISLAADTPMTATEGEALTATACRFRWSHSGSGLLMAGWAFLAPVCGALNWRSHIWVTGAAGSGKSTLLDKFLAKLMPSDWLLSLQGSSTEAGVRQKLKGDARPVLIDEFECNTEADVKRIESILTLIRQSSSETGAEVARGTISGHAMSFRIRSAFCLASVGVSLSRQTDEDRLTRLELAAEAVGDWDTLERELEVIAADHTYGQRMFARALKMLPVIRESAAVISRVAGKHFGRQRDGDQFGTLLAGAWCLQRDRAPTETEAKVLIEGQDWASLGAGASVQVNDSRQALDAILSSPVRVDQRTFSVAQLIEVAAGGAMAATGSQPAFDQAVHTLGLHGIRISDGEDPRRLMFAMARRELVKLVEGTDFETDLIGRLARLPGAWKSKVKKPGEAGPPEKTRFAGATSRYVSIPLSLCSSGDDVAGANESHPF

SEQ ID NO: 4773 - protein, 147 aa, Methylobacterium sp.
MYETTDLSFDAVAAEVGVARRTVLKWSSQDGYWQKRNVPTSTAERARIMAELASDLQPDQAPDAAPAEAVAEPDPREVEAKLMEKHQRMWRVVDGLSAEAVRSRDDRTARVAHTLARTFAIAQRSERIAYGLGSGETPSSTVVLERE

SEQ ID NO: 4774 - protein, 102 aa, Methylobacterium sp.
VTAQAPTLFSSPLALHRAAILACPALLQLVLNLHHPIAFSLEPSADASMTDVQRAIAAELVASHARYGDTDAGFVLLATAAETALANAEREYGAMDWAALAS

SEQ ID NO: 4775 - protein, 88 aa, Methylobacterium sp.
MAAIMPAPAPIPDRPPQRAVNPGIPTPPNPGEMPPPNLPPPPEDPDTGPTGPRVPGPDPDVDEPPDPAQVPDRLPGIPTGPGTRHAAP

SEQ ID NO: 4776 - protein, 80 aa, Methylobacterium sp.
MSHHLATAALTIVLAAPAGAALAQGPTPFAGSSAAASLGYTAAPAAMALTLPELSVRIPPADPTTTGSIRPHHGHARTGH

SEQ ID NO: 4777 - protein, 152 aa, Methylobacterium sp.
VDVFPKEPGSNAERFVSPLQGLPNVILTPHIGGSTQEAQERIGSEVARKLVDYADTGATVGTVNFPQAFISTRPGGARFAHLHRNLPGVLGRLNDVFARSGINIAGQILQTDGDLGYVVIDTDAGLADPDAVLRELAAIEGTVRARLLYERA

SEQ ID NO: 4778 - protein, 126 aa, Methylobacterium sp.
VTALYAGLFAILYCALSLRVVRARRAARVLIGVAGQPALERRVRVHANFAEYVPLALVLMLLAELSGYPRWTLHGIGLVLLAGRCVHAVGVSQVREKIRLRVGGMLATLVPILALGLMLLAATARV

SEQ ID NO: 4779 - protein, 811 aa, Methylobacterium sp.
MIVEELIGRLTLQTKGLDKAKQATKELENFRKGLKALAGSARMRLDGPAQIAKAFRAAQKEAEKLAQVQKRLGSGAGFDRADASAKKHLSTVQKLRAAYVDTAKARALFDRRPTSSGRSWIQNELEALRQYQRTLKQVHAEAAKLGVPRGRTDQLSRIRYGDRNGFGEAVAAGTIANNAGRATQYAIEQGAVTQQETNRQINAGMEAEQIAALDRRATELSAQFPSVDATKIRTMGRDARNMFPSFEMAMKALPEMVRARVMLQAAKGVDAADNEMGDFLKGADILGKTEDVGSLRELLDSYVKAVQVEGRQLPLKEYKELAKYSKAGGVNLSNEFMGSVAPTFMQSEGGGRFGTQLAAGIRSLISGKRTKKSTAALMELGLLDKKGQLKNAEKFQDNPYQYAMEDMIPALRRKGVNPDDDKAVQARMANIFSDNMTENLFTKMITQRAQVERNIKTYRSAKGLDAAGGQTRGDPYVAWEGVVSQFRNLLGTTQKENIGLAGKVGAAVAESMADVNKSLSADPAKAQAIGAGTIAGTGLLTGAAGLKLWRVLSNWYGVGKQGAIGSGGAAGTGAGAAGAAGAAAEGAAAAGAGSTAATSTGVAAVAGGLLRGLMRLIPAAAAPLTMGPDKADMDQMTLRLGKLAADREKAKAGTRADAGESDRENRRAAEMTRRDREAPFGQQASRTAWQDPPKRYSFAESDRENRRGAEMVRRDQAFPLGDTTKLASLNIDGDAVKSRLAEIQTASQKVIDTLGTQVTIKVDSSQIDAAQAKADKLKATVAGIGSVSGGVGGAGLAKGSNSFTSSGATAP

SEQ ID NO: 4780 - protein, 65 aa, Methylobacterium sp.
MPKPVSPDRPIWPPLPAETDGQPESDVGAAERAPADGAASEPAGGLAGPGTRPDPAGPVMSAVLA

SEQ ID NO: 4781 - protein, 67 aa, Methylobacterium sp.
MERDAAADSSRTTEPPAPAFAVRLRPKFREVVLPPRPPPVPRGCEAAGSGGRPDATPDDPDDPARSA

SEQ ID NO: 4782 - protein, 86 aa, Methylobacterium sp.
VRKLTFAFAVAAAMGAAALAGPASAAPGLPAGVTAPDAVTHVQMSPMERRMERRAMRRHMERRMERRAMRRHMERRMMRRHMMRNM

SEQ ID NO: 4783 - protein, 232 aa, Methylobacterium sp.
MSVRDQLFQMLHTVAGALGTDLRGRLVFVGGCTTALFITDAVTLEDVRATDDVDLIVDLAGYAAWAELQAQLRRRGFVEAYDDTVICRMKLGDLKVDFMPDDPEILGFSNRWYTKGIETAVTYPLTEDVTIRRLTPELFIATKLEAYLGRGDGDLLGSRDLEDVLLILDGRAEIIEEVRRADADIRQFVAEQFRGLLKDRDFDHLLDGNIRGPEGRVDIVRERIVALSDDGA

SEQ ID NO: 4784 - protein, 298 aa, Methylobacterium sp.
MYGLLGLEAEPARPGYELLRSLMHPDDRCLMPDGRAVRQGLLPARERFRIIHPRGVTRTLATRNEIFFAPDGRPMAAAGLVLDVTDVVRLNQVRLRDRQRFEALARDHFIVNYQSPGHDSGIVWFDYPAAFQPSLGEMRDDPYSIISVRDRARAREARESARALGRIAQGTFRFRKADGSDVACRAVEVPIFDEARRIVEWSGLIAPLSEFVSSSSGFCRAINEAVRGHHLRAARAMLDCSLAQFSEISGLSVSSLRRLEEDAACSSARMRQRAIAAFHAMGIDFICADDGSIAVIKA

SEQ ID NO: 4785 - protein, 28 aa, Methylobacterium sp.
MKWTRQRCQVALITLATEALMPSWAVIR

SEQ ID NO: 4786 - protein, 329 aa, Methylobacterium sp.
MTVLVTGGAGYIGSHMVLALLDAGEEVVVLDDLSTGFHWALPPEVPFVRGDIADTALVQRVAREHGVRSLAHFAARIVVPDSVADPLGYYLSNTVKSRALIEAAVGVGIEHIIFSSTAAVYGEPARVPVPEDLPPDPINPYGRSKLMTEWMLGDAARAHDLRYVVLRYFNVAGADPRGRSGQSTRNATHLIKAATQTALGQRPGLEVFGTDYPTPDGTCLRDYIQVSDLADAHMMALRHLRRGGGSLTLNCGYGRGFSVLEVLDTVRQISGRDFPIHFGPRRIGDPARVIAQAGRIRDELGWQPKHDDLRAIVAQAFAWERALPYRNQI

SEQ ID NO: 4787 - protein, 107 aa, Methylobacterium sp.
MLASGLASVPAAAESLSDWARRAALEIRQHLRWPTGYGRAATPRTALVRFTIDRAGSVSGIALERTSGVGGFDAAALDAVRNARPLRPPPLPPGRDSITAQLPIAFQ

SEQ ID NO: 4788 - protein, 83 aa, Methylobacterium sp.
MPIVLAVLAAALLAGPALAQVDRTGTGGGPRTTERAGNVTATGQTKPPGRAASPTAQDDPEQVPDGQTRGGISTGICIGCNAK

SEQ ID NO: 4789 - protein, 68 aa, Methylobacterium sp.
MRECGILSPNRSGVTGDPRLHGIGHALEQLYAPVLAEGVPEVWLHLLGRAGAPRDPEREGNEAGEPAE

SEQ ID NO: 4790 - protein, 30 aa, Methylobacterium sp.
VGLVFALLLILPPLGIAVLDLLRTRRSHPY

SEQ ID NO: 4791 - protein, 89 aa, Methylobacterium sp.
LPHQIIGLAAISLTVAVLLRGWGVSRRTAFALGGLGLAATALIALGDSGRRVEPGLAGPSETETMRPLQSVVVPQRPGGATAGVEAFFP

SEQ ID NO: 4792 - protein, 64 aa, Methylobacterium sp.
VDEGASEAERIAAAYACAAGGDTWAALVRAVSDALADLAEAERRSLRRDRLLSRGYVRARPIDR

SEQ ID NO: 4793 - protein, 40 aa, Methylobacterium sp.
VSADQIFVTFGIPAIAVALAYAAMRANEWAVRRGRQHPSE

SEQ ID NO: 4794 - protein, 78 aa, Methylobacterium sp.
MIQTKTMLLPLLALGLALGLGTAPAEAKGCLKGAVVGGVAGHMAGHGKAGAAAGCAIGHHEAGKKSRQPAQGGQPQGQ

SEQ ID NO: 4795 - protein, 76 aa, Methylobacterium sp.
MQAHVHAPQSPSHPDADPHPWFGVEPEALEDAARALCAVRPGSHAAERLMERAAYLRVTRSRHADDRQRASALFLG

SEQ ID NO: 4796 - protein, 280 aa, Methylobacterium sp.
MADAEHKRRQQDLLTQEGGRDEVVQRIAQRQNQLVEARANLEQLPTVHGGRLQNLRNDLAWVEQRAAETEARQAYVVVAPASGTVATLQAAPGQPADPRQLQMTIVPQTSDLSAELFVPSRAVGFIVPGQPVRLLYEAFPYQKYGAYGGRVARVSGSVVRPGETGGPLTLAEPAYKVEVTLDSPFVRVDGRSVALKPDMALRADIVLEKRSLMRWLLGPFLDIRNAIDADPLVRWLRDELPAAAAGMLSEARALPETIFGALARRAARSPEPEPRRTAER

SEQ ID NO: 4797 - protein, 709 aa, Methylobacterium sp.
MGGGSLPLILQTEAAECGLACLAMVAGFHGHRIDMNTLRRRHPVSLQGVTLRGLIEVAKALDLACRPLRYEVEHIRHLALPAVVHWDMNHFVVLKSVSGRRIVVHDPARGERRLTYAEASNHLTGIALEIVPAAGFRRRDERARLPLSTFWQHSTGLRRSIVEVIVLSLVLEALVLAGPFYMQVTVDEVVARGDRDLMAALAIGFALLTALRVAVGALRARIILIVQNVLHYQIGARLFRHLLRLPVAYFEKRHVGDVISRFGSIDPIRNLLAQGLIAALIDGVLAVLTLGMILAYSPTLALVVLVGLTLCVGLRLTLFARFRRLNEEAIRVGAREDSTFIETLRAVQSVKLNNREAEREGQWLNRFAETVNANLALGRAKIGFLAIDQALTGAEYVVTVYVAAALTLDGILTVGMIFAFMSYREQFVEKSLLLLQTALDLSLVRLHLERLSDIAVTPEEPGHERPLVPKAPLRGEITLQGVCFRYAEGEREILQDVTLTIPAGRFTTITGPSGGGKTTLVKIMLGLLEPTAGQVLIDGVPLRTYGVRDYREQVAAVMQEDHLLSGSIADNIGFLDPVLDERRMVESAVQAGVHEEILAMPMGYDSLIGDMGSSLSGGQKQRILLARALYRQPRLLFLDEGTAHLDIRNERLVNQSLRALAMTRVSVAHRPEISCGADMLVHVDGRCRAVEGPEASEALARIGHPAEAQ

SEQ ID NO: 4798 - protein, 226 aa, Methylobacterium sp.
VGREIEMLFREAGYKVDQVPACKDLLAGRGAGVDLVIIDATRDGRRGLCLASSYRSASSVGIVVIHHADSEPDPVQALEVGADDVLVQPFRHRELLARVNSLLRRMDLDKGGPVAAKTRRGIRFKGWLLDLERRQLVCEATGCCVPLTTAEYNMLTVFAQNPCRVLSRDDLSILALGRPHSMDVRSLDAQVARLRKRLSTNKPNIAYIKSVRSVGYIFCNRTHDVY

SEQ ID NO: 4799 - protein, 91 aa, Methylobacterium sp.
MARDDGPETAVDRLAFNLLGEAFRKLSAEFIRTDRAAGIRHLQAIHDEIAAAARHVEMARPDLVREGIVEGATHRVCTVLQSAGAWPRTFS

SEQ ID NO: 4800 - protein, 54 aa, Methylobacterium sp.
MAYLALITAALALGTGIAQAATRRPLAAERLEMAAGTLLLTGLALLGTGLPLFR

SEQ ID NO: 4801 - protein, 224 aa, Methylobacterium sp.
MTASASKWTRDQIAARVARDIQDGMVVNLGIGLPTLVANHLPDDREIVLHSENGIIGMGPAPAEGEADPDLTNAGKQPVTLLPGGAFFHHADSFAMMRGGHLDICVLGAFQVSAAGDLANWHTGAPDAIPAVGGAMDLAIGAKRTFVMMEHLTRQGESKLVARCTYPLTAPACVSRIYTDLAVIERVPGTAELRVVDIVEGLSFADLQAVTAVPLGDARADANA

SEQ ID NO: 4802 - protein, 239 aa, Methylobacterium sp.
MIDKISASTEQALQGVRDGATVLIGGFGHAGLPVALIDALIDQGARDLVIVSNNAGNGEAGVAALLKAGRVRKMVCSFPRQSDSYVFDALYRAGKVELELVPQGNLAERLRAAGAGIGAFFSPTGYGTDLAGDRETREIDGRNYVLEYPIRGDVALIQAERADRWGNLTYRKTARNFGPVMATAATLTIAAVHEIVELGALDPEAVITPGLFVQRVVQVPMQVPMQVPAPGPASLRAPT

SEQ ID NO: 4803 - protein, 612 aa, Methylobacterium sp.
MWVFIEGRLQIDLGGAHGPETATLDLSATGTAAARLGLVVGGTYDIAIFHADRHTSGLDFGIQIPTQAAMSVDSTADGIIDRTEARATAFTVTGFDGLSGDAVFTDGIRTTQASVSGNGTHTIDLTGFSGAVSSRLAVGSQTSGVGNTVTARAVNGAPAIGGAAAGQAIDDTVTARPFSVVTVTDPDANASAAATITITVGGTASDAGGTLSGTGLTKTGTGTYTLAIGSPAATESALRNLVFTPVANQVTPGGTVTTGFSLAVSDGEATTTDSTTTVVATSINDAPGIGGDGRIDLSQGGTAAVTTGDLTAGDPDVGQSLTYTLTGTTRGQVLVNGTALSSNGTFTQTQLAAGQIAFRQDGSADPVAGFRVTVSDGIVTSSPATVLASVALTPPPSDPGAAGPSAGDDNLTGTAGPDTIGLGLGNDTFTGGAGNDLVYGNPGNDLIYGNPDADTLYGGQGDDRAYGGQGDDRLYGNIGDDVLFGNLGADIAYGNQGNDIVYGNQGADVLYGGQGNDVLYGGQGADTLVGGIGDDTLVGGLGADLYRFDPNSARDLILGFDRGAGDRIALGGQTYTVSSAQNGDAVLLLSGGGVVDLAGIRADQVDASVFAA

SEQ ID NO: 4804 - protein, 48 aa, Methylobacterium sp.
MALPKDEKPAPVRTNRFGLIAAAILFAALVAYTIYFLTVPATPPPTPH

SEQ ID NO: 4805 - protein, 103 aa, Methylobacterium sp.
VDLGATPRNRAAARARRIALLVVLWAGPGTRADAQDSPILRELQRREQELILQMRERQRRGDIREDERRDLARREDLRREEAREMDRRRLIEAEERRALDRRR

SEQ ID NO: 4806 - protein, 122 aa, Methylobacterium sp.
VGIDDVMSRLVLNGLIGLCLAAGAPAFAADPVLPRVRADPVHAYPVPVEPPPPATILPVLAPLVNAVDPRTGRCLAGFAPDRHGFCRRHDDPPIVCPEPDFCGAGAPSLAPYGIGPALRLNY

SEQ ID NO: 4807 - protein, 416 aa, Methylobacterium sp.
MRLDVMNQIGSALNRLLSGSAETSAPGGTGNLRGATVQMAATAQQPAHSAGIGERLKTLLAPLAGALKDAKAWLQAKMQPAPAPQVPVSQPRIDTNRTATQIQGRIEYAALTKSGSEFRAGDGALTPKIRNAITHAFGYELMESFANSSDQVQASQSFMRDNNTISKIASNTALRSPQMDAVASSVRAIIGDTPVILSRKSLGLTAQDEGGPTQPAHPALAAGSQPVDRQAAADASVATIDRVMVELFGDPDDPASIEAALDRLPRELCDQLGTMNALIDGTGARVDDALKKELKTTAGRDIFALRAINPALLARPGIATNDSRALSSSVMSVAKAVQNLVNGHGIALDGKEAAPEVSAAGAKANMQARWADGFEKFLAAASARADQGHLAQAAADAPQLLATRDRLVAELDRLRS

SEQ ID NO: 4808 - protein, 99 aa, Methylobacterium sp.
GFQGAGFRGGGFHGVRAGGYRGVRAGGYRGAVAGGYRGAYGRGAYGYGRYGYGYRPYGVGVAAAGVGAAAAAAGYYGATRGGCGPDAYYDSYAGVCRAY

SEQ ID NO: 4809 - protein, 109 aa, Methylobacterium sp.
MSARHRRPVQEAWDSAHQGRDVIGPRDIESRREVMVDKNDVLSGFRRYVPHPSFEDVAWWVQAFPHCADDIRALARAAIGIQALGSLAAREEDFAQPSLRREDRDNPPP

SEQ ID NO: 4810 - protein, 282 aa, Methylobacterium sp.
MLIPALPPQPTRDERARRIATPARRAAALAALLLAAALPWGSAAQQAVPQGSDRTPPQSAPALEPDALARLRETGAALAAARSLRFTASALHDVPTAEGQSVLYAVRSRVTLRRPDHLRIDTGGDEAPAAFVSDGRTMTLYRPSAGTVATAPAPAGLEAVLRAEIAAAGQAQAFADMLLDDPGRTFTDGLTRAFVVGRSALVGGVETEVVAFASPDAQGQIWIGAQDRLPRQLWVTETAAPGRPRSGVTFSDWQLDPILDDRTFSVAGADGARPVPFTKPEL

SEQ ID NO: 4811 - protein, 189 aa, Methylobacterium sp.
MRRIGFGLLALGLGVAAAGPAEAFWVARGWRGVAVGGIHAPLVAREAVMGRCWRCAPLAAGAALAIGAGAATAPAAAMPVAMPVAAPAAATVAAAPAPADAATAPAARHAAGTQVAQANTASTHCAAGLPADSKMIYDASLRNMKSLETLRDTVVSETRSLVEAGRITEADARPAAEKAGTCLRMLAHP

SEQ ID NO: 4812 - protein, 105 aa, Methylobacterium sp.
MTERYGAEANGHVLVAGRAGRRRHIAHLAREPRFDLIEADVTGLLPPLPRMGQVFNRACAASPPHDQADPLHTMMTSVLGTIAWFSREVAPRERARPEPLAAAAV

SEQ ID NO: 4813 - protein, 424 aa, Methylobacterium sp.
MTDTKTDATLSLCIAAGARPDFLDRLLGRVAADGGLPAPYEIVVSDASADGTIKEIVERRAAEGLPVVRFRHAGAAHRPGDAASLLAALRRGRGRYRVALAEDELPVPAALCEAVAFLDAHPEVLACYAPWELHDEAPGAVATAQYALEADAVFGPGEAMELFGFLVRHGAAPEAALYRAEALRALPPPSHHCHAGFVGLARLIAEGAVAFRSRPFRRIATQDPFTGRRHESATAGAADWDLHRGGLEFYVRALLARTGTAPDPAHRPVFRDAIDAYVETRMRQAFRVATGRGDFLAAHEIHNRLSLLSLGEARPPVEGLERLPLLVAVQTLARLANETAEVERVVLVGVEDGPSISSLLRELGLERRILVAPPLEAPGEKAIRGSLVFLGEKAADARARFIEQGYAPSLVVDERDLIAGICLP

SEQ ID NO: 4814 - protein, 47 aa, Methylobacterium sp.
EDIIEPYLIQQGFVQRTPRGRVLTPQAFRHMGLAVPSAEIAPEAAEA

SEQ ID NO: 4815 - protein, 92 aa, Methylobacterium sp.
MKWILPVCALVLCVADPAFARGVPHRPAPDPSGAEARVQPNDTGAPGSLIIPRGSTGADTIFLNSAAGGNAGQPERAIPLGSGGGGDSGGSP

SEQ ID NO: 4816 - protein, 94 aa, Methylobacterium sp.
MRLTLSLILIAAVALYGASFLQAAQSGALAEAGAHPVRDGAPRSICIGCGGPVVPFDPSGGVQAGQAPDAAGKPRPAVGPPASGGAPHRPGRAP

SEQ ID NO: 4817 - protein, 64 aa, Methylobacterium sp.
MVVLDPRTGRLVSISLGIQPDTRTGPAAPRPARPPREWPPHHPEAHQEPPGAPPARLRIRREES

SEQ ID NO: 4818 - protein, 114 aa, Methylobacterium sp.
MTYAFDTLKFTQRLEQVGVGRDQAVAHAELARDMILADTATKADLAALETALKAEITGVRTDTRADVSNLRTDIQTMKREFEGSLRELELRITVKLGAIIAAAVAAIAALQKFL

SEQ ID NO: 4819 - protein, 264 aa, Methylobacterium sp.
MPPASSLEDLILALLPTDSTPVLNRVMRVMLTRERQEPVGQDAYFAARDRLLAARRIGRLRGQGGQIFLMPEQAPVEAEAPAPESWPEAALMAPLRRYLEGPFAKGLDVGEGCTLVQDTSTLGPRQGVWARPDFICVTAMRFRLLPGVQVDVHAFELKTESGGTVQAVHEALAQTRFTHFGHLVWHLPEGSRAEARLAEIEAHCAAHGIGLIRLRDPRAPEAAEILVDPRRTATRPAMIDGFLESRLNAENRARLEAVLREVRA

SEQ ID NO: 4820 - protein, 69 aa, Methylobacterium sp.
MAHISLADLMKHPPAVDAAKLDALTEADLRAQRIADGYDPEAGPPDDTEIVLPLQQVRSRLGMTHTVSG

SEQ ID NO: 4821 - protein, 36 aa, Methylobacterium sp.
MIAASRTLILRHREIAGALASSGLFVASLLMLTALL

SEQ ID NO: 4822 - protein, 34 aa, Methylobacterium sp.
MSPQADDGIIRWNTPNKDGNLGGPGAGGSGGGGG

SEQ ID NO: 4823 - protein, 164 aa, Methylobacterium sp.
MKALVLAGAALGAGLMMTPSAEAGPYGYGGYRGGYGGGFAGHRGDYGGRGFGYRGYAGRGFGYGGYGGRGFGYRAAGYGYRGGFYGGRGYGRGLGLGLAGAGIGLGVGLAAGTLAAGSYGYAAPYYGTNGYGSYGYAPVGYSYPSYGYAAPAYGYSYGAGCGCW

SEQ ID NO: 4824 - protein, 231 aa, Methylobacterium sp.
MPSVRELGELKYKITRLRMVDARYVTGIEAVGDLNKTSDQRLKEVEAVAARYEPLIASTEERALWDEFRRNWTDYLAQRANIAASADTKSQTALDDLFQLSRKHFNAALDALDRDTALNIAGGERARSTASATYQFGIQLTILFCGLALITALAGILYTLVGVTRPIDRLIRRMHALAAGDVEGRIPHIDRTNEIGAIAAAVEASRGNLVRTRQLEAETALARASAEEQRK

SEQ ID NO: 4825 - protein, 197 aa, Methylobacterium sp.
MRGMSALKTHYRPYVCPLHAVLEQIPPEARVYDIGCGSGSFLYLIRRLRSAIRAQGHDVSAEAIAAGQQLAKIEPSISVSLRGADYVPDLSDVDVVTMIDVLHHVPKREQAGFVGRIVSKMRVGSRIVILDIDAARRWRAWANQVHDLLLAREWVNPRTAASTMRLLQDAGIQAEMPRLYSTLWYGHYLISGIKTKH

SEQ ID NO: 4826 - protein, 114 aa, Methylobacterium sp.
LRNSLQGLTVAARSERAVRQELVVLAVAVPAAFLIADQIYDWIALIGSLALVLIVELLNTAIEKLCDHLHPGRHPAIGTVKDFGSAAVFCALIFALIVWVSLATMNILLPHDSL

SEQ ID NO: 4827 - protein, 541 aa, Methylobacterium sp.
MFGGMLPVLAVALTFADGTAIATSSDRLLASFAFNAILFGLLVHSAAHLLKRSIFLLIYAIFAIYSSLYVLFYVYHFNIFGQIFGESSINAVIDSNPQEAGEFLSWAFRLEHLPLPLLAGLTVAAAFAVRAPAVPAIRSRRVGFAALTAALLMLPIAAVKTNVILYNPIFFPGHATYKALANRSAVAEIQSKIDTIRIGSVDGPGEKAVTHILIIGESTTRRHMSLYDYPRDTTPRLRKLAPELEVATDACSSRGATVPALQEMLTFATRENSAPLFEKPSLLQIIKAAGFRSWWLSNHAFYGDFDNWSMVLSRPADARHFVNRVGEGTSFDEQLLPYLKDALADPSPRKFIVLHLLGAHSDYTLRYPVGFDKFTDAPLPPTPRTLTSRDAQLFNAYDNAILYNDHIVGEIIAAARAADAHATVTFVSDHGEALGEISDFFTHIDGRAPRQVYEIPLTFWMSPAFRARATPRINQLRGNLGKPFQTDAMIHTLLDLYDIRHDAHAPQRSLFAADYSVPSRFCDKMPGLPASATNPLMVTAQ

SEQ ID NO: 4828 - protein, 51 aa, Methylobacterium sp.
MRAFGPSRSSGISLAWSAPSPASMKASLASLKSDESFLRSFRVSFPAVMRS

SEQ ID NO: 4829 - protein, 324 aa, Methylobacterium sp.
MDRRQFLGCGVAFAAAGNALAPRRAIAQAFPVRPVRVVVPFTAGGTTDFTARVVCETMSRAAGHNFVVENKPGAAGVIGVKDVAASEPDGYALLFSDSSLAVTPTTNPGAKLEPLKMLQPIGLAGIFPSVLVVHPSVPARTVQELIDYTKANAGKVNFGSGGIGTVPHLQAEQFKLVTGAVITHVPYRGAAAALQDVVAGQIQMLFTAAPTALAFIQSGDLKLIATTGAERLPVVADAPTLAEVGFKDLVSAQWFGMLAPAKTPADIVKRLTELMSGALNDGPTAKKLTDQGGIMKRGTPEDFARFIESEIAKWRDVIAASKQK

SEQ ID NO: 4830 - protein, 409 aa, Methylobacterium sp.
LAGPFCGYHLARMGAEVVKVENPKGGDLARRLGADPTMAERLMGLSFVAVNAGKQSVAIDFKSADGKEIFLRLVEQADVVLENFRPKVMDRLGLGYDVLAGRNPRLVYCAISGFGQNGPWLGRPAYDQIVQGLSGAMSVTGDAATAPLRTGFPISDTIAGITAAFAISSALVEQRTTGRGRRIDVSLLEATLAAMGWVVSNHLNGSVDPQPMGNENFTAAPSGTFQTGSGPLNIAANEQKQYETLCDLVGRPDLKADVRFADRQSRKVNRPALSNELNAALQARTAKEWEALFNAHGVPAGSVLSVPEILQEEQVTGRRFVETIDATVRGGQPMRVTRPGFLLDEDYPVPTPPPQLGQDTERWLEVLGYGPEQVASLKGNGTVAAVDRPTSGPSAKPPELQPRADSPRR

SEQ ID NO: 4831 - protein, 289 aa, Methylobacterium sp.
MSDKDPAAVLADAEAWWSTAIIDMKPGVIRFAGFPIEQLIGSVSFPQMIWLMLRGGMPTPAEGALLEAALVAGVDHGPQAPSIAISRMSVTCGLPLNGAMASAINVLDDIHGGAGEQCMELYTDIARRMDEGQTLDVAVEGGLDAFIAARGKIIAGFGHRFHPIDPRAPRLLALVDAAREQGVVNGRFAEIGRAVEAALGRRKGRGIPMNIDGATAVIFAELGFASPLGRGLFILSRSVGILAHAWEQTLQGGRIKGPMPRGIPYTYTGPAQRDFPGDAAAPEAGVLRS

SEQ ID NO: 4832 - protein, 323 aa, Methylobacterium sp.
MDLRDLAFFEVIADYGHLGRAAERLGRTQPALTKCIQRLEASVGAELFARSGRGLVLTQVGEVLLTRARLMRTAMDEAIREVSEFAAGTAGHVRVGTGATMAEYLLPHVCRRLIAAAHGVTVDLQIGMSGVLRAALRESRLDLVIGPVLPGDADEFAHESFGTDEVVVVAAKGHPLCGRPLEIEALSAWKWVLPARTVAMRQWLDTVFQAHDITGPHVQIETNSITMLPRLIGETDLLSFTSTRNLLPERLGGWVERLDIDVTTLRRPLGCVHRRGSYLSPAASRVVALLRDHGAALLAEGGVGTGALAPPSGRTPQDRVGTA

SEQ ID NO: 4833 - protein, 405 aa, Methylobacterium sp.
LVPILGLAYLFNYLDRTSVGFAALQMNQAIGLTASQFGWGAGILFFSYCLLEVPSNVMMYRYGARRWLARIMITWGLAAAATAFAVGPMSFYVIRFLLGAFEAGFFPGVIWYISIWFPARYRTRVLALFMASTPLSSLLGSPISAALLSMDGILGLGGWQWMFIIEGLPACLLGLACLWMLADTPKDATWLSADERNALVTELANERYEKPKKDLWAAMKDVRVVMLTTITFAFTIGSYGIGIWLPQILKGHGLSTLTIGWVTAIPYLFATIGMLVWAQYVDRTGKKIYNLIAALVLGAAGLAASVLFTSLIPGLICLTLALIGTISARTVFYTIPQSFLTGAAAAGGLAFINSVGAFGGFVGPYLVGYLKDATGSFDAGMLGMAATLLVSVFIAASLKLVIKNA

SEQ ID NO: 4834 - protein, 99 aa, Methylobacterium sp.
VAAQALAERIGDASVTCEPRPASEEGAATALCRVGDEDLGAWMVGRGYAVAMRQGPHPYAEAGARARGRRLGLWSGVFQDPDAWRRSHRAPVARLAGGS

SEQ ID NO: 4835 - protein, 184 aa, Methylobacterium sp.
VPESARLIDGGGEIRVEDCRPVSRDGPADAADEIGVVGAADRLLLAEHLQDALQRGFQRRVPGLHRLHQGHPGLVGLQMLTLEAAGPVDLDRPGEMLDRPSHVVEDLDPARVAHARTRAPGITCARNPSVHHVSGRMSAASPCAAQASSAKRQASASAATGTSMSRSTSLSWRIAPRAAEPYRR

SEQ ID NO: 4836 - protein, 125 aa, Methylobacterium sp.
MVPSEAEIEARLAELRRRREAIDREIADHLLYLELGRRLRAGTAEAGAASAGDDADPDAADPPGPVFPGPAEAGGTGPDGGAPPRRWPAREPAAGPAVPPSVPPPLSPAAASGAARGWAARAAEA

SEQ ID NO: 4837 - protein, 591 aa, Methylobacterium sp.
MSGPGTDRAPARAGGAESGCGDAVSSALIHAVGLLERGDPRAALEAASEACFDAPGRPEPHYVYGQALAALGEHALAERAFAEAVRLRPGWPDAWVNYGLARYRRGALGDAVTAMRAALAHAPGHAAATANLAAFLRISGGAEEAADLVRQALEREPAQAGVRLNRVADLLQEERAAEALALLDAGAPPAAAPADLPILRHWHLQRALALLQLGRGAEARAALAALDALGPLPPALAPLRLWRAVLLARGEGRDEAARAAAEAMAASLDAMGPDAIPEHRIMGHYDLAKFWSGRGEHPRAFAHWREGHRLLAPSQPFSRADHLGFVEGCMAHLGAARLARGPRAANRDPAPVFIVGMPRSGTTLCEQILAAHRDVHGAGERGALAEAGACLAGGAADGPGAPARLAALDAPALDAAAGRYLAELRALAPDKARIVDKMPGNYLHLGLVGLMLPGARVIHCTRDPRDIGLSIFTFRFHGRHGYAHDLGDLGWTIRQQTRLMAHWSAALPNPVLSVALSDWVTDFDGTLARVLAHLDLPPDPACARFHERTDPVRTVSRAQVRQPINARGLGRWRTYAAELAPLIAELAPAED

SEQ ID NO: 4838 - protein, 50 aa, Methylobacterium sp.
RPYGPAAYGRPRVVYEEPVYETRRVISYERVPVGYAPVRRGWDGPYGERW

SEQ ID NO: 4839 - protein, 101 aa, Methylobacterium sp.
MRQILTLAVAGALAGTALAVLAGPAAAQMRPVACPEGRLVDGSCVNPRLAFLARQQAVCFTQVKLSYIACPGTLPGVDTRYKFPFNVVTERQRELNFVVER

SEQ ID NO: 4840 - protein, 425 aa, Methylobacterium sp.
MRLLRWAGALGLLCGAAEAADLAAPVPLAPAAFEPVWTTTVNTEFRYFSFGGTKGQPTGIAPLGARGRGSQFYLPFGLAISGQPTPDLKIDLTARGGYVDSRQETQGLMGAVRTTLDTQLSATATYLGLDGVQPFASLNLNLPTGTSYLAGTRFLARLDSDLVDVPTFGEGFNIGPSVGVNVPIGQTMLFNLTLGYTARGQYFREGAPDPITGIDAFVDTRSGDTVSVNGSLAYEDGPWSGNVAVVYSQDGTTFINRLAAIRSGSRVGLSGQVGYAWSEAWGTTLSASFNHSERNFVPNAPLPGLIAEPRNSNSNLYRVGLDTLYRTGAFALGPTLSFLYRDVNSYDPITFQFLPARERYGAGGTFTYAITDAVSLSLRGERILVHEAANPDKEFFPGSGIVPGTGQPRLSYAGWSISGGATIKF

SEQ ID NO: 4841 - protein, 362 aa, Methylobacterium sp.
LDDVLSPAQISEIYEAAIEDDGLARLVEIVGRIADVDSAGIWLRQGSEIIDLTVSEAIAASMVPYLAYYARIDPWAAAMMASSRVTLGNEIVDEAQLVQGEFYTDFARHFGMLRPMGATLGIAPGVVASVSTNRASRAHLLDGTDKARFAVLAVHLQGALRLRHRLGGERVLRRDLAAAFDGLQFGAIICGPDGTVLFANDAARALEAARLLQLRGPGGVLTAATSEQTARLRGAIAAAAGSGQPGGIQLAGAEGSDIHALVTPLPGAAPDARRGRALVTLRRADAVAGPAEGRLRQLFGLSPAQAALCVQLARGLTFEAAADERGVALSTARTHFLGVLQKTGAANLRDLLRLLGTLPQAH

SEQ ID NO: 4842 - protein, 26 aa, Methylobacterium sp.
LGAHTLPQAVLIATAAGVRPVDQDGA

SEQ ID NO: 4843 - protein, 89 aa, Methylobacterium sp.
MRSGLERTAHLLCELLERLGSIGAVSDGQFELPLTQVDLAETLGLSSVHVNRVLQALRRDGLISLRAHRLRILAPRRLSQLAEFEAGYL

SEQ ID NO: 4844 - protein, 150 aa, Methylobacterium sp.
MVTPIRNGSSSLVELAGIVVSAYVSNNPVPLSELPKLIDRVHTALNEIMNADAVDRTTELEEKATPEQIKSSITPDALISFIDGKPYKTLKRLLAGHGLDPFSYRKRFGLPADYPMVALNYAQRRSEIARGITLGIYGGRGNQHRSGARH

SEQ ID NO: 4845 - protein, 46 aa, Methylobacterium sp.
MANRSRSLEITSASSRRTASTRSLRPLTETGSTSAVTLMPTSAAAP

SEQ ID NO: 4846 - protein, 474 aa, Methylobacterium sp.
MTSILRPVDGAHRKVLVLGGDGFCGWPTSLYLSRIGYDVTIVDDLSRRGIDRTLGTDSLTPIRPIGERLAAWEAVAGRRIRFVELRVGEAYAAFRDLVAEIGPDTIVHFAEQRSAPFSMRSAREKRLTVEGNVCATHDVVCALAETGLDAHLVHLGSVGVYGYGSTGFPRPEGYLKVAAQAPGGTVEKEILYPADPESIYHLTKALDQLVLQYYAKNDRLRITDLHQGIVWGTQTEETARDERLINRFDYDGDYGTVINRFLVQAALGYPLTVHGSGRQTRAFIHIRDTVRCVALAIGDPPRRGERVRILNQVTETHRVIDLARMIARLSGTPFQHVANPRLEPEENELDVSNRGLIGLGLVPTHLEDALLAEISAIAGRYAHRCDRATIPSRTRWCAAPEPSPIAPGAGAAPSPGSAARTCAEPASPSTECALAGGAAPAPPLPQADADELEAGPPQEAWYDPEIAAPEPARL

SEQ ID NO: 4847 - protein, 47 aa, Methylobacterium sp.
MIASLPDADLRAGDPESGLVGEPAMGRTGREISVYLEILLPSPSALR

SEQ ID NO: 4848 - protein, 40 aa, Methylobacterium sp.
LLPGFLADAGLSGLSTGLAGGVHAGRGRDEDGLGKGVGAE

SEQ ID NO: 4849 - protein, 59 aa, Methylobacterium sp.
MAEIRIVLSRLTPAERAAFWNAVDLLYRVPSGSPMSMKEDRSIQYGVAQGLEALLPPVR

SEQ ID NO: 4850 - protein, 114 aa, Methylobacterium sp.
MHSSPCCGRCGIVCRSDLRLVSARSFRRDDLDDRREISSMLSEIAREILAYLHGTHRLPGARLRITTLDERFGTDPAIAAAISELARTGYVATPDAGTIELTARGYGASMSEQL

SEQ ID NO: 4851 - protein, 99 aa, Methylobacterium sp.
MPMNMYDGEEGRPLLDLIIEGMEVVDSDGTRIGSVDKVEGGHLKICRADQKPRNQPQYVTPDWIAAVDDRVRLNRTFDEARRLWASEPYARRHHLQRAI

SEQ ID NO: 4852 - protein, 40 aa, Methylobacterium sp.
MPHDQTHANVGLTGLRFAPTVASLRETAAALLRHRMRPTP

SEQ ID NO: 4853 - protein, 29 aa, Methylobacterium sp.
VADPEGNTIEFVEPDKGIFAEGPLEARDA

SEQ ID NO: 4854 - protein, 44 aa, Methylobacterium sp.
MSILTQAVTGFPAAEAPARGWFARMIQLWLEHHARVLEMGGEPL

SEQ ID NO: 4855 - protein, 66 aa, Methylobacterium sp.
MTRLPALAAAALIGVGALSSTAAEARGRGGALAAGLIGGLAAGALLGAAASAHAEPAYGYGYAPPP

SEQ ID NO: 4856 - protein, 184 aa, Methylobacterium sp.
MATTFTVGNSNGAVFADAGTTSAGQTDGTNSLSLALAQANATGDSVIINLTSNITLTGPLSPIFNANVTINGNGFSITSTSQRIFFVGTSAGLGGGGLGAGGALFVNQTGDVVLDRIDVTNNRATGGAGGPGPGGGSGGIAELTKSGTGTPTLGDIDTTAGRATTSSTATRARTCSTAARATTR

SEQ ID NO: 4857 - protein, 245 aa, Methylobacterium sp.
MQDRPQPRTVGTAGSEPADDSPHAARLQPSDGNPHGVTGPVLFEAYRTASLARSSAAPQILTRTPRHVAGGTDEIMLYRQEAGTLEGEADGRSFRLEPGDLALFDYAQPLVSRTSAFTNLVLTTSRASVPAALVGPDLHGHLIPGGSGPGRLLATEVSDPVATRPGAVSGPAGLLQARHDRLGRGVGLLAGGAPVAQGVELDRLAGHRAAHEAAGLDHPHGAVAVLDDGLPARTPLEASQHRRCP

SEQ ID NO: 4858 - protein, 82 aa, Methylobacterium sp.
VRRLARLDPEVLQRFIDALAAGEIVQPVGVRTGSSVVVMTGPFASIPAAVEAILPGDRLRVAVSIFGRPPHAVLRMADVQAI

SEQ ID NO: 4859 - protein, 70 aa, Methylobacterium sp.
MTQPLRLIRLAAVESMVGLKRACLYDRMSRGLFPKPVRLGDARNSPVAWPEHEVQAFIAQKIAARDQAAA

SEQ ID NO: 4860 - protein, 71 aa, Methylobacterium sp.
MAGSAEERLDALNSEIADLEEKQDAYVSVIAALTDQGLDTAAAKAALKRIEDQLVALRVRTATFEGDARHV

SEQ ID NO: 4861 - protein, 131 aa, Methylobacterium sp.
VPNAFNPSFLSFNLPSGNVSQSFAPFFTQQVGMTYAGNREIEERVVADVASFGRQIGRLLDGVLLLARDRPEPEFATLRTMAAEIKRVKEETRSSALRDARAALDALARADPKGLAVLLEGYAPPVPRGSP

SEQ ID NO: 4862 - protein, 90 aa, Methylobacterium sp.
VECVFGIPGEESLDIVESLRTSKIELVLTRHEQAAAFMAATCGRLTGKPGVCLATLGPGALTCRPRARASMAACSLARVVGRKAQRSSAT

SEQ ID NO: 4863 - protein, 475 aa, Methylobacterium sp.
VDRETAIARAVEALRSGAFREDLARRVAIPTESQNPARAAELDRYIEQEMRPAFERMGFSCRVLHAPSAPTPFLYAERIEAPGLTTVLGYGHGDVIHGMDEGWRQGLSPWRLLERDGLWYGRGIADNKAQHSINMAALGAVLETRGRLGFNAKWLIEMGEEVGSPGLHAICAVHKDLLAADLLIASDGPRLNRDRPTVFLGSRGEFNFNVWIDARADDHHSGNWGGLLSNPAIQLTHALATLVSPTGQIRVSGLVPEAGIPENVRSALSDCILEAAPDAPSIDPGWGEPGLTGPEKVFGWCSFEILALEVGNPRAPVNAIPSRAWARCHVRLVVGVDCDAVLPAVRRHLDRHGFHYVQIEAAEEAPPFPPTRLDPNNRWVGWALDSIARSTGKKPALLPNFGGSIPNAAFSEILDLPTLWVPHSYPGCSQHAPDEHLPVAIVEEGLRLMTGLYWDLHATDGHGSEGATARNGQDA

SEQ ID NO: 4864 - protein, 302 aa, Methylobacterium sp.
MRLIVALTCATLLTSTTCPVEAEELSGTLKKIKERGAISLGFRDSSVPFSYLDNQQKPVGMAMDFCLAIADAVREKLNDKSIKIDLLAVAPASRIALLTNGTTDLDCGANTNNPERQKVLGFTNTIFLTASKYVSKKNKNLHTVEDLRGRTIVSTSGSSNMRQIVQLNAQRKLGLTILTAKDHAEGFLLVENGRADAFVMDDILLASFIAASKDPSAYEISSEGMSKAEPYSIMLRKDDAPFKALADEAVASILTSPRMATLYDKWFTKPIPPHGINLNFPMSAQMKQAFAHPTDSPDPDAY

SEQ ID NO: 4865 - protein, 77 aa, Methylobacterium sp.
AAAVEEQGAATQEIVRNVAEASTGTGAVTRNVAGVARAAEKTGSSAAQVLASASELSRQSEHLSGEVGRFLASVRAA

SEQ ID NO: 4866 - protein, 367 aa, Methylobacterium sp.
LRIRALTMTSILTNARALTALRTLGAAGDGLDTANRRVSTGARIGSAADGAAYWSIATTLKADNASLDALKDAIGLDKTAVDAAALGLTRTVDQLRIISQALVSAQGEQADRAKIQLDIGNAQRVMRSIAESSAVGGSNWLSVQSDAPGTFATRHLVMAYSRRDGTAHLTRSALDASQFVLFDAKARIDPPDWAEVSAAPALGTLAATTAAIAARANPTIVGGYTVSTFDAPGHTHVNGLLDTGYRIDGVPALTPVQTSFSVATIDVSQGHVNRGMIEAYARVVDATLQKVMDGAALLGSTSTLLTAQRDFARQMTAINGNAIGILVDADIEVESTRLRALQAQQMLGLRALSIANAAPDTVLALFN

SEQ ID NO: 4867 - protein, 77 aa, Methylobacterium sp.
MAGEKPHGDKTHAQQQRIIEHKDGPNVPAGGGAKIRNSPPREPRSASQQESRDHHKHNNPGQEGHRPQKHGPAEEKH

SEQ ID NO: 4868 - protein, 118 aa, Methylobacterium sp.
VSGRRGIAALPPARASGVPWWPMTLGWPLPRLLAAMILAILAGAALAATPSAAHAHEGHGRHGPRAAAHAPAAARPAAPVRLKTGPDIPRIAVLTAAEHAPAAGRSDSMDFPHVRTSA

SEQ ID NO: 4869 - protein, 56 aa, Methylobacterium sp.
MRDPNSLFTTQAFRMRNRDLIYVSNAPYTELQKVLGVFSSVTGPVASAAAVYAYSK

SEQ ID NO: 4870 - protein, 76 aa, Methylobacterium sp.
VLIRNRTNLAIIASISFDAPLLPRIAEGVALLSALWTRGLSAYVAWQSLTSARSIEQRPRIDTARAASFAGSVAEF

SEQ ID NO: 4871 - protein, 31 aa, Methylobacterium sp.
PSRELFKSFIDISKSFETHKTPDRQLSAWSF

SEQ ID NO: 4872 - protein, 48 aa, Methylobacterium sp.
VRGRANGALTPELALKVGQAAGLVFQRGEHRHRVVIGKDTRLSGYMIE

SEQ ID NO: 4873 - protein, 63 aa, Methylobacterium sp.
VSAPPVTPDGRYIVVRGRLWRRADPGLDEAARARAVSALMEARRAVRAAKAAERAGDPGAGEA

SEQ ID NO: 4874 - protein, 111 aa, Methylobacterium sp.
MISEPSSRVLGAQSIKRNAAAHLRLVLHRSEEAIMKALLASSLLTVGLLATDPASGQRLEIGPDGPSVDMRSRGQRERDIERREMRRDMRRDEVPRDRRDRSVDPDDDDED

SEQ ID NO: 4875 - protein, 82 aa, Methylobacterium sp.
RPAGTALPRSVEQMTELVGRVSMKTLVRETTDLIEKLCIEAALRITRDNRASAAEMLGLSRQGLYAKMRRYGIGDLDGPDEA

SEQ ID NO: 4876 - protein, 264 aa, Methylobacterium sp.
MFADAIRRQAEDAPRAALPAVAAALWRALANGQVSEAEAETLSALIDARREASGPQRHPTSPTSSSDGAADVRGDTLSGSTGCARTGVGSRPRTDASLERRRRWAASGRLPPAIAARFTAGEQAVLALVAAETARRKDCRLAIEHMAAIAGVGRSTVKNALREARRLGLITVEERKVTGWRNDTNIVRIVSAEWTAWLRLTRRSPTPGSETPSSAEGGGVKTATGTPTQVQIRGKPRPAEPSKMLPAGSGRPLPMRPRENSRGR

SEQ ID NO: 4877 - protein, 552 aa, Methylobacterium sp.
MSLAASPISSAPSMEEPEAFHRGVELFGDWRWRLNNLYWITNKEGRRVQFQMNWAQEALFREMHYLNVILKARQLGFTTFIALFGLDQCLFNADFRAGFIADTLENAKALFADKIRFPYENLPDGLRAARPVRKASETQVLFDNNSGVRVGVSLRGGTMNLLHVSEYGKICAKSAPKAREIRTGALNTLQAGQVAFIESTAEGQEGHFFDLTEAAQATARAGRPLSLLDWKFHFAPWWKEPAYVLDPTGVPIADGYRRYFAKLEAEQGIVLSPAQQAWYAKKAEVQLGDMKREYPSTPAEAFEAAVEGAYYGEWMAKAELDGRIGTFPAEPGFLVHTAWDIGRSDYTAIWFFQIIGGRLRIVGYYQNTGEGLPFYAAKLEEMAAERGWTYGDHFWPHDGRVTEWGSGRSRIEQALTDHKLKIRIATALSLHDGINAVRTTLPLCTFDAGPTAEGAKVLKSYRKEWDDEHGIWKDRPCHDWASHGADAFRYLAGSWRAVTETVAPETRTIHTPRGAIVRPALEPVKSLTGATPGNGYSMNELWEMDQPADTRV

SEQ ID NO: 4878 - protein, 98 aa, Methylobacterium sp.
MKGRARLAWNVRQIRAARGLSQETLAVDAGVAAPYLSGIERGTVNPTVDVLDRLATALGVEIDTLLRAYDTASTPPQPLRAGRKPRQGREGPATKAGA

SEQ ID NO: 4879 - protein, 64 aa, Methylobacterium sp.
MEARSVQLIALQTWAKGMSPNKAARQLGTTTARVQELRGGRFNRFTLGELQDLTSRAGLAYQAP

SEQ ID NO: 4880 - protein, 383 aa, Methylobacterium sp.
MIEALGSNALTWPSVRPTEVSVWHGHVAFAHWLVEALRPRLVVELGTHNGVSYFAFCNAIKRLGLDARAVAVDTWEGDHQAGLYDESVYERVRRFNGQFSDFSTLKRNYFDDVVESFEDGSIDLLHIDGLHTYEAVRHDYETWRAKLSPRAVVLFHDTRAFIEGYGVHTFWDELMREGKGFNFHHSAGLGVLVHGTDVPEAVEALCSVPDQSAEATRIRQSFEVFSRIAQTLGQEAVVHALAHQGENIALHCRASQSSYYSTNAETPQGAVNGIRTGHFGFHTDNEDRPWWRLDLGGRRTFDEIRIFNRLDPDCAVRSRTIEISISDDGLIWDTVYSHDGSVFGGIDGHPLSFVRGGMEARYILLRLRETNFFHLDEVEVYRH

SEQ ID NO: 4881 - protein, 1267 aa, Methylobacterium sp.
MFEITGADIGALSDGDLRTLIILLCEADLRRRGLSTAAVTAGGNQDAADGGVDVRVALPPGTSTETLDYVPRPATVFQSKASDMPRKAILKEMRPGDTLRPAIVALAEEGGAYIMVSPGADLTDTMLTSRKSAMKEALRGLPTAAALTLDFYDRTRIATWVRDHPGLIPWVRERIGRALRGWRSFGRWSSRPADADAGYLIDDAVRIRMPGEDEGDGLGAADGIDRIRAELREPGKAVRLVGLSGVGKTRLAEALFDPAVGHNSLDPSLAIYADTADEPAPSPGGLASDLIAGRTRAILVVDNCPPETHRRLTEIVTAPGGTVSLLTIEYDIQDGEPEETAVFELTTSSLAVIEQLVARRYPTLSEVDTRNIAEFSGGNARIALALASRDPRRGSFAGLDDKLLFERLFWQRNDPDTSLLTIAQVCALLYSFDGETLEGDAAELPILSGLSGRTVDAVYAAAAELKRRQLLQARTRWRAVLPHAVANRLAAIALQDIPRQRLAAALVEGAPDRVLRSFSRRLSYLDASPEAREIVQAWLVPGGLLADIRHLNDLGITVLTNVAPVAPKAVLSALEVAMHGADDLALRDFTPLARLMRALAYEPAQFERAVALLVRLARLPKENRLHGDAAEILESLFPIRLSGTLAPIDLRLAVVSQLLRSADGAEQRVGVQLLGAVLRTDGFSSWHGFEFGARSRGYGLYPRNGQEVRDWYAAVLECAEPFLTAEGAVADGVRSAVAQAFRGLWLRGGQAAALTRLAHAVIGARGLWRDGWGAVRQTRIYGGEQLTPDGLAELGALEDVLRPQTVADKVRSVVLQGGRSLDLDDVDDPKEDFALAMDRQAATIARLAREVIADEAIWRALLPDVAAGDGYKVVLFGDGLATAAEAPRAVWAALVEQTAALPVPGISVLCGFLQGIERRDRALACALLDEVLEDPILAPWLPVLQAGTTPDEAALARLHRVLASGVAPIGRFSRLAHGDASSAIPGAELARLLLRIAESQGGGTVARDILHMRIYADRGAGRAIDPDLVEAGRTLLLGFRFAKGPGSREDYELASIARVSLAGEGGRPAIQELGRALALAMSRYEVGLYDYNHLIHALFEAHPTEMLDALFAGDGSSPRRIVNLLTELPHSGKPPMGAVSDDLLLAWCECAPAERYPLAASFAMLFAQSDEGTSPQWTSLAGCLLAQAPDPVSVFEAIIGRLHPMSWSGSLAEVLSSRQDLLDRLDIAGLPTLAEPMGRAREALRVMVDRERQRERDEDRERDGRFE

SEQ ID NO: 4882 - protein, 198 aa, Methylobacterium sp.
VLMKLVSEQSDADIAKRRALEQLAQHLRALAANLMRTSRGAGAPYHLEEQMVGCLEALAAHRAAVGHGVSTYEYQAMLDPHEAQAEARPWAGGTEEDQARWEADGTVACADAIDDIRRASLQMTASMLVDQLTQMRRGESDIYEGVRRLEAAREKRRAYHQPRLSQLASRGCGQTVAEVVAWRRPRRCRLTIFVPTEV

SEQ ID NO: 4883 - protein, 150 aa, Methylobacterium sp.
MATALNDILLGVIATIRRRTLAAFGGLPNGWWRAHQRPATSGSLSSEVGVEGVLHIDGEDAQAQRMGHFAKQLHRSTWIGLSGIERWALLLTDYGPQPGLFLRPFITLHGLGTWNTFMGGSWLRLMMTARADRSRDTASASWHRRVQRWA

SEQ ID NO: 4884 - protein, 42 aa, Methylobacterium sp.
MKTCAIPCSAGYLWMAGLASFILAVAVIAVLREIEHRRGPPG

SEQ ID NO: 4885 - protein, 129 aa, Methylobacterium sp.
MKPMPWKNGGKTLTLDADPSSEEEMQIFTSPEERMQQRALNHDRALRASELGWLGKLIGSETNSARNLAAFFLTFSLLIGVGCLIAAWWQKEQGEFWSRSAERSFSAAAAALAYVFGQGSKGSSSQGPP

SEQ ID NO: 4886 - protein, 168 aa, Methylobacterium sp.
MQFHSTLSLPAIRAAQLRHVANEKNATSADIIDSFIRAAWTDVGGGVVLPGFDFVACLDDDSGEPVVTFVCTGSLPVLLKPEQAHGVANGIRDLLAAVAARFEVDAICEGSRARFIGTRKGRGFTIQLLDDLDDPGRKPVTLLGLTASIAADLADTFETFAKRAEALR

SEQ ID NO: 4887 - protein, 314 aa, Methylobacterium sp.
MITPTTLALAALMRLRGVGRKQALRMVPGEFPAGVDVEAKVHDLVAGAGRAGDVGEIVSSARTMLADSVDAGINVLGFHDGEYPVRLRDTPDPPAILYVKGNVSPLHAPRAVAVVGTREPTEYGGKVARKLALRVAEAGYVVVSGLAHGCDTLGHEGCLDAGGVGIAVMAHGLDKVYPAANRGLAQRLVENGGCLVSEYPLGVTPMRNAFAERDRIQSGLSDAVLVIETDVKGGTMHTVRFAREQHRPLACIDHPQKWLEEDKTRGNQKMIKDGWATAIPHGEALLAFLAGVPHGAGRPGDVASSPDRQHVLGF

SEQ ID NO: 4888 - protein, 172 aa, Methylobacterium sp.
MVIFDFDQTLVDTSPVENLRANRDWRGVMSRASSLQVYDGMTSLLRDLRAAGETVAIVTKSPDMVAKAFIREHAWPIDIVVGFHQVKRRKPDPEGLLLAVRQAGASAADSCHVGDRPEDTEAAHAAGMPAIGAAWGLDDAAALRASGPDHLFETVADLRTFLFRRRRQDTAR

SEQ ID NO: 4889 - protein, 491 aa, Methylobacterium sp.
MLAWVREVVISGATDYRRYQADAMKTRYALRFTGLSVRRSKGGLVLLNAARHSRLADAPARLRDEMGELLRFKTATLAERGLKRSGTWNAETAAQKVEHFALMFGALAADPDGEVEGFGTDPGALTLALLAIPAVWDWYLSWRERRRGFFTKWEANMLSIALSLVRAETGWLRQTPGIAGHLIPIPGLVSTADVAAARADWDATCEAMYRHGRARIREIERVARVHRDPFEPILAILEADSPVGEYRKITDEILRLMPNENLYPRAAAEAIRGFLMLRFGLHLGLRQRNLRELLLCPRGRMPTPERRLEELRRGEIRWAPREGGWEVLIPSVAFKNANSSFFGRKPFRLVLPDLGGLYEKIEAWVGRHRAVLLGPAQDPDTFFVKTVKRTSASAAYDQNTFYEAWRLTIQRYGIRNPYTGRGAIEGLLPHGPHNIRDVLATHILKRTGSYEQASYAIQDTPEMVMQHYGRFLPQDKAAIAARILNQVWEAA

SEQ ID NO: 4890 - protein, 167 aa, Methylobacterium sp.
MPEDAPSRLPAETPPGGARLYAWIFLAFSVVGLLTGGLERLALLPDAAAKACRAFYLCGPRPLNTLPPFEVVHGSGSTWEQVEKDDVPPVQRRLEAENPDFNIVWHRGEETGGCSGAFNTTCRYHYHGRWGAVPKWETASKLPWIVLGCVFLVSLAVILRRRGTRTA

SEQ ID NO: 4891 - protein, 303 aa, Methylobacterium sp.
MLERFQGERGRKHLVGEMERQRLVTGTPGLAEALVDVGELARVAPGTSIIEQGGTDNDLFFIVVGDFEVVVNDHRVNMRGPGDQVGEMAAVAPSQARAATVTATTEAIVLKVDEAGFSSVADRYPEVWRRMAQELARRLEQRNALIRPANEKPRVFLFSSSEALPVARAIENALADDPFLTVVWANGVFKVTNYTLETLEEELMQSDFAVAVAHPDDKTEVRDEEWPTPRDNVVFELGFFMGSLGRQRAVLMEPKGAKLKLPSDLAGITTIKYNFQPGADVGAMMGPACNKLRAHILRLGRNV

SEQ ID NO: 4892 - protein, 135 aa, Methylobacterium sp.
MGGLDVYLDVIDVQLAKSGPDLADYIRMRLDECSQLLAVLSPITRASWWVPWEIGVATEKERFLASFVSDGATVPEFLQKWPYLQSMSDLDKYIAESKSAQLLVENYRRQGYGSTAQSRGFRSFHNSLKSSLGQR

SEQ ID NO: 4893 - protein, 154 aa, Methylobacterium sp.
MSMPAQFISALEADREPNARTAATLRKILASNGVEGALMLDDRAGTPVRLPLTASAVEAVVAVLLRLGANADVVVAQREREVSPEEASRLLGVSRPLVYHRMDTGRLRFRQVGSHRRIAMDDVLALKAEEDELREAARAFGEDTDEQEMILRGP

SEQ ID NO: 4894 - protein, 209 aa, Methylobacterium sp.
VVLKVLLDANVLLPQQQRNIILQIALKHRIELHWTKLIVEEWLRNVEPAVRGNCERRTLPLMAKYFPRAELPAMPATPYGSTDAKDRHVAAAAVHVAPSVLVTWNIRDFDRSALAGHGVTLQTPDQLISNLYDQFPDLTYEAALEAKANLSRSAPSWDDFIALLAGNGLTTFVQRIDEHHKRLSYECEDEERSEEEEDRTDYTGSSGPP

SEQ ID NO: 4895 - protein, 204 aa, Methylobacterium sp.
VKYQPPGTDILLTAAAFDIKRLNGLTPDPVNGSRFSVQTGEVSAQGLEFEARANVTENLTLVGGVSLIDAVNTGTGTTPNETTGRTVPLAGLRPVQVPDTSVSLFANYRFLGGPLAGLGIGGGVRYLGASQGDAANSFQVPANTVIDALASYDFGYLDASLKGMQLQINAQNILDEKYVQSCIYQAWCFYGAPRTVFATLRYRW

SEQ ID NO: 4896 - protein, 64 aa, Methylobacterium sp.
MADTGETRAERLKSALRDNLRRRKAQERGKEQGRKPGEADPPTQDDSPGADASGTGPDSDKTGL

SEQ ID NO: 4897 - protein, 128 aa, Methylobacterium sp.
VETDQAAGEAGGRAPLRTPLDRGAVGALPSLPQAELHPGREVGQLPAVGVLDDLKHHRGLVPGDAEPVADQGAGRAMRPARIGDDQLDATGQQLVAEGPGLLARPAGLPGIAGRPVRVGTGVWGGVKG

SEQ ID NO: 4898 - protein, 239 aa, Methylobacterium sp.
VSLTDKQRRFVDEYLVDLNATQAAIRAGYSEDTARQIGSENLSKPDIADAIAEAMAERSKRVQITADEVLRELVEVALGDVNELVEHRVGCCRFCWGEGFRYQRTRQELIRAEATHAKDNEKAVREGRETTLFDVEGGDGFHAAREPNPDCPECFGEGRGRALFKDTGRASPRARRLYSGVKLTKDGMEMKLRSQDKAIELIGRHLGMWKDKVEHDVSGGLADLLRAVDGRTRGIPSRG

SEQ ID NO: 4899 - protein, 768 aa, Methylobacterium sp.
MSDTQGLDGERDEAPQSGPDEVVRFWLDQIERYEKAFGDWTIRVEKIWKIYTEARRAEGSSRSRKLSLLWSNVSTLQPAVYARLPAPAVSRRFKDSDPVARVASELMERALIYTFEDSDLDSTLALVRDDFLLGSRGTVWVRYEADFEPILDEMGQPVMQDAAEGEEPQPAERIADERVPIDYVHWKDFGHTPGRYWQEVTAVWRKTYLTRTQLVRRFGEEKARKVGLDQCRNTSGQYLDMGARKATVYEIWDRDTGKVYFIAKACPEPLEVTEPFLKLKGFWPCPKPVYGTLHDESLVPAPDYVFCQDIVEEIDQLTGRIGKLTDALKLVGFYPKGDDSSGALQIEKALQAGVENKMIAIPGWAAFTEKGGSNQIQYLPVEQVLKVLQGCIQLRKELKSDLYEITGISDIVRGESDPNETAKAQQIKTQWGSIRIRERQKLLAKFIRDVARIAAEIIADRFQPETLMAMANLPLPSDAEVQAHMQAQAEAAAMQQQIAAARPQPVPMMPGMGGPAPMMPPPGPGPIPSGQGAMMGPEGPKAIGGGGTTVNVDTKGAGKFTEVANAKQAERYAKMMDAADEAVSIRGDIDTLADLGSKIATGRLTEAKLGIAQYAKALGADDLANGLTGGKMSEMEAYQAIADKLAPRMRVPGSGATSDYEMRVFRNSLPSLLKTPGGNAIAVDTFRSLYDYQAAVGDIAGQALRGEIPQKDADAQIRALESPFLRFKEYRKEAVRGEASPPPPASSAPPPASGQKVRRYNPATGTLE

SEQ ID NO: 4900 - protein, 643 aa, Methylobacterium sp.
MPRLPSGEYAPPAGTAATPGAFITAEQHNTFVTDIGAEMTGSARESEMRDLGALVTTTGTGAAYALALSTPWEILPDGITVGFRVHVSNTGACSLSIKDVVGPLRAVSGTDLAFGDLPARSAIQATLNRQGASAIFAGTLTANSNQITGVSSTAGLYVGQTVSANGIPSGTVVTAISGTLVSLSKAYSGATGPALITAVGPEWLLVNGGLLATANRLAIANGQLPVTLTADAQLDAAAKGTAILASGNLRVKLPAPTIAGAGYFFDLRNDGIGDVTLSTQSVDFTGSVASGNAQIFNVSSTTGLAVGMLLTMPPAPKSFTGTLTANSAIITAVTDVSGLAVGQPVSSIVAGFPSGAAIVAFDSTTVTISAPFAGTTTTNASITATVDGILPGTTITAISGNTISLSQAYVGATFVTASLSAYSTAIDGLPFFVMYPGETRRVMCDGNTFRSIVTTPFYREWFGSGRFIRPPGYARIGYHAVAPGGGGGFQGGGGGEGISDTVPASSLPASMLLTIGAAGAPSATTGSDGGVTILGTLATLAGGKGGTASGAAAAVGGGTADGINAGGAGTGSGTNPTSSINGGGGGANNVAGGTVRGGSLNAGAGGRFPNLAPGPGGGGYGSATNGVAGSAGGPGRVRIYGIA

SEQ ID NO: 4901 - protein, 90 aa, Methylobacterium sp.
VTEPLEVRRRLAAGYLTGRTLEEALAAWRSDYDAPTYRERRPQLARLGNVIRKLAAEAEAQGDADADHPGQRPKRKKAAPRPKPGRRGDV

SEQ ID NO: 4902 - protein, 251 aa, Methylobacterium sp.
LARGALGVILPVLAPGRAGLGPRRRPLRCLGLGCAAAGFWGLPALGRSGALRRGLPLRLPLGRAVAGRRRRALGWVAVRALRTLGLTLPIGLTLRGSALLAGLGPLAGGRRLRTLGGCGAFGIAVGTRLRPLALGRRRRPLRRCPLGRGTLRALGPVRTLGALRSFGTLRSFGARRSAARAFPTAARPLSAAAGAPLHVRPALGEEQGRARIVRTCGDGRGEEAGQHGSGEEELPHRSAFAARRPRSGDGA

SEQ ID NO: 4903 - protein, 405 aa, Methylobacterium sp.
MLARLCFLTMVVTALAPAAAAQTRVTIGVLNDASGVYADSGGTGSVVAARMAAEDHMAARRGLDVGVVAADHQNKPDIAAAIARQWYDRDGVDAIFDLPPSSAALAVNQITRDKNKVFVASSAGTADLTGIHCTPNTVHWTYDTVALANGTGGALVRRGGDTWFFITADYTFGHVLQHDTTAVVERNGGRVLGSVRAPFPTADFSSFLLQAQASGAKVVGLANAGRDAAGAIRQAGEFGIRQGGQALAALLISLAEIHALGPAVARGLVLTEAFYWDLNDATRRFSDRFAARFGGRKPTAYQAGVYASALHYLRAVEAVGSPGDGAAVVDRMKAMPTDDPLFGRGEIRPDGRKIHDMYLFEVKAPAEATGPWDLYKVLAVIPAQAAFRPLDAGGCPLAGLSEARR

SEQ ID NO: 4904 - protein, 194 aa, Methylobacterium sp.
VPAFVARLHAADRGEVTKLAFEFLILTALRTSEVLGARWEEIDTVEAVWTVPAVRMKKKRVHRVPLSPRALAVLDRAKVLANDSPFVFPGQKPMKPLSNMAFDMTLRRMQVPVTAHGFRSSFRDWAAEQTSYPHEVAEMAIAHVVKNRVEAAYRRGDLLDKRRGLMADWASFCDGSGPADKSKANDAASNQVNG

SEQ ID NO: 4905 - protein, 176 aa, Methylobacterium sp.
MMEVYDFHAKNLSYPKRSYAASDSKGYELIRWIHGSRRGIIGIDLGRMETVWKELGSHAALIYAASTIAVSDRMTLLDVIRGGTADFDKHGHLLNSWMGRARYSAETILSNSTKPELGQATLTQLPTLPSEPTPEPHFDQEEQARIKAEFDMVAILGNRQRDQRRERLSRRGPRRV

SEQ ID NO: 4906 - protein, 71 aa, Methylobacterium sp.
VTDHLDLPQTGFVSPAWVKRRYAISNSTMYAWVANAYLPAPLKVGPRAVRFRAEDLRAFEAQFAARDVQVI

SEQ ID NO: 4907 - protein, 33 aa, Methylobacterium sp.
AHGFELVRKPYSAEELARVLREAAQRGRTAVER

SEQ ID NO: 4908 - protein, 111 aa, Methylobacterium sp.
MNGLLRDVQTNWLPSVRTASQVDALTGRYTTSVLRHILTSEPKMLATIDKDLGERARKLTEARAVYEPLISSSDERALYDGFSKSWAEFTATVEPILDLSRSGRKAEALAL

SEQ ID NO: 4909 - protein, 69 aa, Methylobacterium sp.
VNEAAPSVVLPTAARRASVPAERSAADARTDPIAPASARTGAVRPAATTIAARRARGTSGASAVRRAVP

SEQ ID NO: 4910 - protein, 223 aa, Methylobacterium sp.
MIDGYLREHYGLTVQDGPFRGMAYIAEAAGSLFGPKILGSYEQELAQIFNQLGRYETFVDVGCAEGYFAVGALVAAPHLRTAAFDLDPRARQLCAALAEMNKVAGRLQVAELCRPEDLVALAGPKTLIMIDIEGAETNLLGSTPAEALSDCDVVVETHYTAAGCTLEFLHSYFSRTHDITIIEQSARDPAAFPPLMALGQVDRFMAQWEGRGPEPWIFAEARR

SEQ ID NO: 4911 - protein, 426 aa, Methylobacterium sp.
MATIIGDATDNTLVGGTDNDTIIGNAGNDALNGGAGGSDLIYGNAGVDTITSTKNVVVGGFVTAAVDTVYGGQGNDIVNYAGATAGVSVRAFGGLGDDSLVGFTGNDTLVGGDGNDTLGGLGGADRLVGDAGNDVLDGGAGNDVIYGNLGNDTITGSNLNVAGNLDTVFGGQGNDLIDYSASGGNSIIYGNFGDDSVVGATGVSDRIYGGQGNDTINGTGVTAGTDTVFGGQGNDVINYATTAAVGGLIYGNLGDDTVTGGAGADTLYGGQGNDNVVGGALTDVLFGNLGNDSLSGGTGADTLSGGAGADTFAYAAGDSANSVTAGAADYDSITDFVTGTDKISGLGAVGSSTNFRTVTNTSNSFTDAQTAAGGLVAGDVRYVFVANQSGTGGYLFANTDGTAGLAATDTAIQLTTGTVAATDILA

SEQ ID NO: 4912 - protein, 79 aa, Methylobacterium sp.
MTLALAIPVVEAAAFTAGCTLIHGRRHQPQWVTFALLGLLCLVAVGGLALALAGIGPSDPVQATAQISFENHAAGAIRY

SEQ ID NO: 4913 - protein, 158 aa, Methylobacterium sp.
MPTRALPLWLFTIALVIGAPILNIVYWFQVLASGTLPHDGDAVAIPMFGGVILTLMLAPLVLGTAWICLRRYHPGTRLGAWRQDRPVRSLLASLLFGGPALVLAAGAVHDLLTPGPWYEHIPVALSVPCIVWLLAMRAAFIEQRGAALPRRPARHREP

SEQ ID NO: 4914 - protein, 72 aa, Methylobacterium sp.
MFLTIGAEADRLGEHLAARSRADKSEAMRVALAGRLRLCEASLANGTEPHPPGEGGGTRYRIGSRYCSAPEP

SEQ ID NO: 4915 - protein, 66 aa, Methylobacterium sp.
MAEVSQMAFKEQALSTRVMSRLGEIVSMVEDARKLSALCASEPVAGNVAVSGDGTLCWAPMSPGNH

SEQ ID NO: 4916 - protein, 58 aa, Methylobacterium sp.
MPAASCPGRSWRPRRSGALSPDAPAQTFSPAPVGGDSEPDPGLDRLLAALDFARLLPR

SEQ ID NO: 4917 - protein, 73 aa, Methylobacterium sp.
MMRCESGLVFPDLVEVQALVSFAVGMKREDAASRLGSRRRYDTQNRTARGIEVFGFWRDPSEDGERLRHPCLR

SEQ ID NO: 4918 - protein, 280 aa, Methylobacterium sp.
MPRYARRDLLAKFHAMIDRRQPIIGGGAGTGLSAKCEEAGGIDLIVIYNSGRYRMAGRGSLAGLLAYGNANEIVKEMAREVLPVVRHTPVIAGVNGTDPFVIMDHYLDELIALGFSGVQNFPTVGLIDGTFRANLEETGMGFGHEIDMIRLANAKDLLTTPYVFNAEEAAEMARAGADIIVPHMGLTTGGAIGAETALTLADCPALIEAWAEAARRVRPGVIVLCHGGPIATPEDAAYVLANTRHCHGFYGASSMERLPAETALTERTRTFKSILFPETR

SEQ ID NO: 4919 - protein, 401 aa, Methylobacterium sp.
MSVVYVVGTCDTKEAELLYARDVARAAGARAVLVDVGTLRSSALADVPAAEVAGHHPDGAATVLGGCDRGAAIAAMAEALARFLATRDDIGAVLGLGGSGNTALVTRAMRALPVGVPKLVVSTVASGQTADYVGPSDIALMYAVVDVAGLNAISRRVIGNAAHAAAGMALRAPPQAPADKPGLGLTMFGVTTSCVTQVREALSAEYETYVFHATGTGGQSMEKLADSGLLAGLLDITTTEVADHLFGGVFPCTGDRFGAAIRTRLPYVGSAGAVDMVNFGPRETVPERYRDRTLYVHNPQVTLMRTTPEENRAIGAFIVERLNRMEGPVRFLLPLRGVSAIDAPGLPFHDPEADAALFSAIRNSWREAPNRRLVEVDAAINDPAFAQALVAAFRDAVQERP

SEQ ID NO: 4920 - protein, 233 aa, Methylobacterium sp.
MLVVRDLHVRFGQAHILQGVDLAVGPAPLAIVGRNGMGKTTLCQAIMGMVAGRGEISLDGASLAGRAPDRVALAGIALVPQGRRTFPSLTVDEHLRLVDQGPRARWTRARAYETFPRLAERRRNGGTQLSGGEQQMLAIARALLMNPRLVIMDEPSEGLAPVIVDHLAEVLRGLTQEGIGLLLVEQNLRMATAVCDHVAVMVTGRIAATLPAAELAGNEDLQRRYLGVAAVHH

SEQ ID NO: 4921 - protein, 249 aa, Methylobacterium sp.
MAPEPALQLTGIGRRFGALHAVRGVTLSVAPGERRAVLGPNGAGKTTLFNLVCGDFPPTEGRIVFFGQDITGLPAHRRTRLGIGRTYQTSLLFNGLGVLDNLYLAVRGGRPGRFSFRRPGRGDPHLARARALAERMRLTHLEERPVSDLSHGQRRQLEVGMALACDPKVLMLDEPAAGLSPGDRPELLALLRGLPRSLTLVLVEHDMDVALPASDIVTVMKDGAVAVEATPDRIGSDPTVQAIYLGKGH

SEQ ID NO: 4922 - protein, 340 aa, Methylobacterium sp.
MSARLSLPALALLLAAPLLLGLVLPQPQAQFWTVNILGRALVYGIVALSLTFLATYGGFVSLAQMTVAGIAGYGLAILVEGAVPGIVGGLPYALAVPVGLLAATLAGLLIGAIAVRTRDIYLLMITLALAMAVSRFAESNIDWFNGYEGIRNVVGPTLFGVPFRQPHLFYYVSLAAAVALYVGVLHLVRTPFGLVLQAIRDNPRRAAALGYDVALHRIAAFGVAGFIAGCGGVLTTIYNIGISPGSIGLGASVNILIISVIGGLGHPVGAFVGSLIFAVFDTFAASLYDRDRFNTLIGLVFLGIVLVSPDGIVGLVRRIPGLRRLPRPRPDAARRAAETG

SEQ ID NO: 4923 - protein, 292 aa, Methylobacterium sp.
MALAATVVLNGFTLAALYFVVASGFSLIFGLMRTVNMAHGSLYLVGAYFAYAVFEPLYDRDAWYAWYLAVPVGMAAAALAGAAMQTLLLGWMQGQELRQTLVTIGISIVVADQLLAHFGGTPRQFFAPDALFGTTELPLVGRYPTFRLVQIAVAVAVGVGLWLLLAWTKLGLMVRAGVDDRTMLAACGVNVPRVALAVFALGAALAGLGGVIGATAQPLAQGMDGRFLLTSLVVVIVGGMGSVPGTAVGAVLVGLAEQIGQALFPTYAVILTFGLMVAVLAVRPQGLMGRPA

SEQ ID NO: 4924 - protein, 223 aa, Methylobacterium sp.
MSSLPGIRACLTYCVLIILIWTVGSTAWTMWIFHRPLDEPIALAPAGRIQRNIEIRFTAPYSLALDFSFGARRAEIMALVGEGSAIGSAVALHGRSGTTVPLRWSLTDVDGKVVAGSEADTHGRTSYASDFVSRNVATFSIIPGRYRLEVNVLRDVPEFRDVPVRVHLGLPVGKVSSGWQSEFAFFAGFANVLAIWPLAGLLLLALAMLTIRDLTGPGSMRSA

SEQ ID NO: 4925 - protein, 94 aa, Methylobacterium sp.
MTHLSTLSAPTTSTLAIGPGSWRDAPLPQRNSTDARDRLRLALNARGMRLSFCVDGMLARDLATNESCGGIYPYGDFAGMHAALVAGELEVDHV

SEQ ID NO: 4926 - protein, 65 aa, Methylobacterium sp.
MSEIRMDAEARARVIAWRCGFVLDRDAASIQIKYPADGVVAGRVASFEDVPGAFVEGRLAKEVRV

SEQ ID NO: 4927 - protein, 61 aa, Methylobacterium sp.
LTDTTPDIVELTGDIVSAYVSNNSVPAAELAGLIAGVHAALQRLTGAAAAPAEAEAPVEKP

SEQ ID NO: 4928 - protein, 93 aa, Methylobacterium sp.
MPPDDRTYDEQLRERLGAGGVKRLSELIGAAGGLTPTEARHWFELSVQDWREVEALAFLALDDCEQRGAILPWHLVRWLDRRRHHKPTTSLFA

SEQ ID NO: 4929 - protein, 133 aa, Methylobacterium sp.
VATTVTTFAELNTALRAADDRAANTGAIEIVVSGTIAATADLTAVNLRAGNTLLIRGTNGGTLDGGRTHRGLFVYSGTVTIQDLTIQNASAVGGAGGLGGGGGAGLGGGLFVAADTAHGATAGHVTLSNVSFT

SEQ ID NO: 4930 - protein, 246 aa, Methylobacterium sp.
VTGASEEQIPQPVAAFNGRVRGLALSQRADRAVGLAGDIVDLVRHAVSVHATNRIVTYSDRISSQVGTSFAANAFNDVQRSLIEAEILQTVRLWDHPDIDRIGLQTAYWLSKDPAVRTILNDRHTTAPEPYPGYIADRLARQDLLWLRLDRVMALILGSDLLTRLRNFRDKRLAHWLVQTKLERAGETVPPALYGDERRLLVRTVIAADLLARATRDASFDFKGQWRIAQRNAEAFWHGCTVKPLR

SEQ ID NO: 4931 - protein, 64 aa, Methylobacterium sp.
MQRGLDPLRDAHGLRWREQADRGAIQNRGVPGTIARSASATVFDSGVQISRSFHRGFGKSASGF

SEQ ID NO: 4932 - protein, 213 aa, Methylobacterium sp.
VNGEPVGSRPDATVGPGAPKQQELFEARTQWFHVFKTMIDSGDLATLSGSAVKVYLVVKSFTNFATGRAFPALETIAEKSGLSLAQVKRELKTLEERHYLTKAKSGRRNEYRLREKVEITDGSGRPAAVATWDYLPSSVQHAMADLKNVLITGDLAGAKIVHIERLQVNVTHLHDNAVNFNVQQFNADLEKLPPAMREKLLANWKASLEREDA

SEQ ID NO: 4933 - protein, 43 aa, Methylobacterium sp.
MAHYVFSATTPTRGEELWVTDGTAEGTILLKDINTGSVGSFPA

SEQ ID NO: 4934 - protein, 154 aa, Methylobacterium sp.
MLDPVATRLARLAQDVAATRARTQQLQAQGSVLRQRLGRARRALAAAGEASAQACRTSHLLLQERTPVVLEQAGLDEAPRTPDPSLGAVHELLSILMAQAGGPERLVDVLLLAHEEAEAAGEDERALILAGLLHQLGRHLAHQVGPRAAGITLN

SEQ ID NO: 4935 - protein, 300 aa, Methylobacterium sp.
ITVDVKGEILELKNTINTMVDQLNSFASEVTRVAKEVGSEGKLGGQARVEGVAGTWADLTNNVNLMAENLTGQVRNIADVTTAVANGDLSKKITVDVRGEILELKSTINTMVDQLNSFASEVTRVAREVGTEGKLGGQAEVKGVGGVWKGLTDNVNMMAANLTGQVRNIAEVTTAVANGDLSKKITVAVEGEILELKSTINTMVDQLNSFASEVTRVAREVGIEGKLGGQAQVRGVGGTWKDLTDNVNMMAANLTGQVRNIAEVTTAVANGDLSKKITVDVRGEILELKSTINTMVDQLN

SEQ ID NO: 4936 - protein, 208 aa, Methylobacterium sp.
ITVDVKGEILELKNTINTMVDQLNSFASEVTRVAKEVGSEGKLGGQARVEGVAGTWADLTNNVNLMAENLTGQVRNIADVTTAVANGDLSKKITVDVRGEILELKSTINTMVDQLNSFASEVTRVAREVGTEGKLGGQAEVKGVGGVWKGLTDNVNMMAANLTGQVRNIAEVTTAVANGDLSKKITVAVEGEILELKSTINTMVDQLN

SEQ ID NO: 4937 - protein, 105 aa, Methylobacterium sp.
ITVDVKGEILELKNTINTMVDQLNSFASEVTRVAREVGSEGKLGGQAQVKGVGGTWKDLTDNVNLMAANLTGQVRNIAEVTTAVANGDLSKKITVDVKGEILELK

SEQ ID NO: 4938 - protein, 25 aa, Methylobacterium sp.
ECRPVTPEVAGSSPVARATFSFQLR

SEQ ID NO: 4939 - protein, 46 aa, Methylobacterium sp.
VQDGERLRTDCWEVRLGIVFAESHLPHGMGPHEVERIGSRAYRVSA

SEQ ID NO: 4940 - protein, 28 aa, Methylobacterium sp.
MQSIVPIDDVDKMEPLAHPMGVRSRDVV

SEQ ID NO: 4941 - protein, 238 aa, Methylobacterium sp.
LEAETALARASAEEQRKAGMRQMADGFEQAVGGIVGMVSSAASELQATAQGMSATAGQTASQSTSVAAAAAQAAANVNTVAAAAEELGSSVAEIGRQVSGSADLAQAAVAEANATAGLVQDLAQAASRIGDVVALISQIAGQTNLLALNATIEAARAGEAGRGFAVVAAEVKELASQTARATEEISTQIGQIQGSTDQAVGAIGGIGTRIREIAGVAASIAAAVEEQGAATQEIVRNV

SEQ ID NO: 4942 - protein, 396 aa, Methylobacterium sp.
MSSFGGSAPERSQLSEVTSDRRLSQPLAPGFIHLKVVQGLRIVVTELGADPDALAAAAGLDPRLFAAGSKLVPFTAIGRLLALGAERTRCPHLGLLVGKRTTLGSLGLVGLLMRSSDTVGAALRALEAHLSLYNRGAAAGLGIYDDTAVFSYALYEPEADGAALHTERALAKATNVLRALCGADWAPLEVMLPHSAPPNTKPYRAFFRAPVRFDQEEAALVFQAQILKQRIVTADPATHRRVEDRIRRIEAAQTTTLSDELLQYLRTAVTRQRCKAERAARLRQVTRRTLSRRLKAEGTSFKRLANEAQFRVAKQLLADTSISVTQISAILDFSEPSAFTHAFRRWSGVTPSAWRKGNWPRTEITQLDEEPGARGEILDAFAPPDLGLRPSHRRRQ

SEQ ID NO: 4943 - protein, 78 aa, Methylobacterium sp.
MNLRLQPVRVRTGSSDTDGLLVFTGEYLVAVLVQLSEEHGEHTGFWFLEAGFDGAEDLTRPTFRDLEEAQAWIEQRIG

SEQ ID NO: 4944 - protein, 181 aa, Methylobacterium sp.
MPRIGYARVSTLDQDLDGQLARLKAEGCAVIRSEKVSGASREGRAELATVLEFLRPGDELVVTRRDRLGRDTRDVLNVVHEAEQRGASVTVLDPHVSTRGEMGHVVLTVLGMVAQMERRFIKERQREGIERAKAEGVYAGGKRRLDREQVRALHAAGSEPAAIAAALGCSRMQVYRILRQA

SEQ ID NO: 4945 - protein, 968 aa, Methylobacterium sp.
LSVTGLALNGGFVGATGGPRLGAALAQDIGAIPFGAVAAAHMDADTMTDLVIATGSGISVLKGKGDGTFEAPISALAGPQGFYAVAVADLDGDGRQDIVAAGRDSSPGSLSVILRDASGGYRAPQVLNAGTIFTSIAVADLNGDGKLDLVAADPGNVNSTTPSAGSVKLFLGDGQGGFQGATSLTTGSSSVAVIAADVNRDGRTDILAANRTGGDISVLLGNASGGFTAAANFAAGSDPRTIAAADLNGDGNPDLVVTGSGAASILLSNGAGGFEPPNPIATGGLVYSASIVDFDGDGKLDLFAPIMQGSGGFAVMQGRGDGTFLAPLTFASGSGNYVGSVADVNGDGRPDALSTKLSGSGGFTVALNVTTQAAALDAATVSATLNGAATGLAIDTTAPTLTARSAQDLPLSGALSVTFSEAVVAHDPVPPPGANVIVNRGPTVTLYKNNRNDPATAIETFSRGQWTLNGNTLSVTPSAGLQPGTNYVLALDNLNLTDAAGNAIATSGSFTINPNTHSYALVPYAFSTAASPPSTGGGSSPSDPAPNLVDGVQVNTGMQTLPDGSSVPVTTIPVVTGGRTDTDTASSAADIPLVTGTGGATYLTAQVPTGYGLQALGPSTSGLNGLIAAIQSRTVAGSADQTALTGSGSGFLGALAANTNLTVRTIVPSVAPGTTTAPNQPLVIQGQPLAQDAGQQQAVVLDASQLPAGITIELRDIDFAAVVGAVTVRAPADTVVGSGSGGLSAVGALTVTPDPLRIYGDGAAQTFVGGAADDLLSGGAGTDTLLGGLGGDLIYGNLDADLIYGNQGADTLFGGQGDDRAFGGQGDDRLFGNQGNDMLLGNVGADIVYGNQGNDIVYGNQGADLLFGGQGNDVLYGGQDNDTLVGGIGDDTLVGGLGADLYRFDPNSGRDLILGFNQGEGDRIALGGQTYTVTSAQNGDALLNLSGGGVVDLAGIRADQVNASYFAA

SEQ ID NO: 4946 - protein, 26 aa, Methylobacterium sp.
VKLLVAVLLSTFVYAAILPPAVRFRD

SEQ ID NO: 4947 - protein, 64 aa, Methylobacterium sp.
VKSAPSNPGIKHVIGTIRDRGSLGADDFCCNLPRFAAENLAANEALIDTLAAEKGLTAAQLALA

SEQ ID NO: 4948 - protein, 488 aa, Methylobacterium sp.
VREIAFEIDDDSGAPVFIRLSRAIIAAIESGRLEPGRKLPGTRTLAAALKIHRNTVDAAYHEAVMQGWLVAEPARGTFVARDLPEMPAGGPPRAEAVRGANLRSCAEPVTPACGGAPMLHVSDGAPDPRLLPGAEMARAFRRALTAPEFLRSGRHDDPHGDPRGTPALREALCAHLSAERGLAASPGEILVTRGSQMALFLAAGALLGRDAVVAVEEPGYPLAVAAFRAAGARVVGVPVDADGLSIDDLERLAKVEPGLRAVYVTPHHQYPTTVTLGAGRRIRLLDLARRHGLTIIEDDYDHAYRFDGRPVLPLASRAGDVPVVHVGSLSKVLAPGLRLGYATGPAGLLARMAADRRAIDRQGDVPPEHAVALLLREGDLGRHARKTRRIYRARRDRLADLLWDALGDRLTFDVPAGGLALWARLGPGLDAARWSEAARRLGLAVTPGSAHCLNAVTAAQAFRLGFADLCDDDLRRMVALLGRAYPTR

SEQ ID NO: 4949 - protein, 114 aa, Methylobacterium sp.
VHNCLDFSFRRIEPGWPFREAGRDYLLAVDGNMQANNGETLVQLALAGVGITRVGNFHITEELATGRLVPLLDAFNPGDREAIHAVFVGGAAMPARVRVLVDFLAEHMRGNTGW

SEQ ID NO: 4950 - protein, 202 aa, Methylobacterium sp.
MRDAMQLVPMVVEQSSRGERSFDIYSRLLRERIVFLNGEVNDTVSALVCAQLLFLEAENPTRPIHLYINSPGGVVTSGLAMYDTMRHIRAPVHTLCMGTAYSMGSFLLMAGEPGERAALPNASILVHQPSGGFKGQASDILIHAEETQRTKQRMTRLYAAHCGRSYEAFERAMDRDRFMSAEEALDWGLIDRILPPRTGALA

SEQ ID NO: 4951 - protein, 118 aa, Methylobacterium sp.
VSDAGSDEFGHDIEQAYELNEPPEKVWRALSIPALREHWLPGAALVAPEPTAVTSEHEVSYRMREAAPPYLESTVTFRITPNGTGGTCLRIIHELTDARFAHLTKVAANGNVSLLRAA

SEQ ID NO: 4952 - protein, 37 aa, Methylobacterium sp.
VRQTTGLNVDEGVVRAIYIVRNPEKLRHLVATSEHST

SEQ ID NO: 4953 - protein, 217 aa, Methylobacterium sp.
MLGSVADAQDAVQDAYLRWHGLLHAGIEKPEAFLIRIVTRLCLDRLRAARRTRETYIGPWLPEPVFEAAPDEAGEDVSLVLMLALERLSPLERAAFLLHDVFGLGFEAISAALDREAAACRQLASRARRHVRAARPRFPVTPEAGARIAQAFFEASRRDDASGLQRLLAADVVAYTDGGGLRSAALNPILGRERVTAMFHGLARKIGFVRPPLLHRG

SEQ ID NO: 4954 - protein, 236 aa, Methylobacterium sp.
MKLPGLVRLLAEDDERGEPAIAHIARVIREAGHLPTTKRGRGASDMGVLEAANLLIAANATDVPSKVSETIETFRKLRQVPIRKSEGGITIDSSSWWKKLSSCTNFGDALEVLIAQSENDREDVCQAFNLSLGANRPSDLLTFRAVRFGWPEATASILLNVANAEPFRDGLQPDADLSGKRFEIRFALTEADRLFLKDQKPSGRIHEVTVRDSVIRRLSDACAAASTDAPDKEAVA

SEQ ID NO: 4955 - protein, 92 aa, Methylobacterium sp.
MGDVITFRPRPRPARPAVRHHRARIEGAVAHALDVVDELIAVLDGLDAPSVDLVPDADLEDGGDAEPSLAAPIGGPSQRVWAAGGSQDLERE

SEQ ID NO: 4956 - protein, 140 aa, Methylobacterium sp.
VKARATEVLQAKSPSGSLIEHLPAARDLADVVSLSELSLWRLRAVFRIISHFTDAADAMCCQPRCEVTQGELNDVGKFVEWHAELWGRLADRLIEEASNRIPADQDEAEDRLKILMERALIDCEYSFLAEAVHGLRMMAS

SEQ ID NO: 4957 - protein, 167 aa, Methylobacterium sp.
MSDEFGAMFDRVQQERVDAAKKEREAADEARSQARRDFDMKAACLTNVVLPTLEEAKAGFANKGLEVRFVTNATAPNVANYVDPTVRFHFAKPQGSTLALNVDASVIYTITVTHTQGGVQIHRESKNHHQTITRSDLSKQFGVGVADQLTRDQVMKVIESAFRDATR

SEQ ID NO: 4958 - protein, 68 aa, Methylobacterium sp.
MAAVNVCKANITQENKKVLYAKMLRSYETPSQVAYSVGVEVSALNKMPAADREAMCTAINDRIKAGIE

SEQ ID NO: 4959 - protein, 91 aa, Methylobacterium sp.
MGNTAGTVESVADLGPYWRAALRAASQHVDEQVAGTAMLLTAVQRLKAGMGVEGAANFLEILSRAVRDGEMVSIAIGDVTLNLKDDGVRTQ

SEQ ID NO: 4960 - protein, 862 aa, Methylobacterium sp.
MAAGLKKAADQADALTRLSAKGGTGKLAADLRNLGASASQIDAVTAAMKRYAAQNMIPANRADWTKVQASQMRTWEQSTVASLKHVIAAEREAARAAQDFASAQLAAAVKAGEASRKQRQAALEQAKAHREAIRERRRDAAATIASGAAVMAAHKGKKIGLDAVSSAASFDIAVRKQREFTDISAQIQAGLLAQAKRVGQETQFSNEDVVKAQTASMQGLPANFTPELRAAVAEGIVDNVRNFATLMETDLKEGAEIIRGYLQQSGKDISTKQKALAEANRATNQLVKMAKLGGMSGEDVGQFVKLAMSSGTTAGLTTDSLMSLAALAKRGGLRGDEAGTFVKTSAGKLVSPTKKGLAAFNAAGVEHSRFVKMPDRLSTSALEGQFRMEMGKGFTPGIRKRLDAINGDKTLLADQSRYIAAVTSAVEPILGKKKNGQVRASDRQVAAKAAGNYHKVAAQSVDVEGLLDALMKANPTLAQLNAIFTGAHGGKGAITQRQWDEFKASREEIHKSGDDPDYAAKKAREVMAGLGGSIENLKGSFDNLVLSIGTANEGLIKFSADSLGNLVDKFSKLDQGTQQALSLGAGGAALAGGAYGAFNLTKALLGFGTSSAALTGSAAALDASAAALTAAAAKLAGGSAVGDLAGGATKGKAGAAGRLAKMGPLGFLGWAGVGAGAMIGTGLLLDSFDEHRHRGNGYRGDSRRRAPTLGLDTLPQGWGAGGVDVSKGLGGGVGPYTTNREKTWGEWFFGRPTHRGGSDPTRMTLPLPAGMQGGAAAPTVAPKTDTTAFQALEQKMGEVKDKASELNGMSIAIPASSSGLGTIIQQMERIISLGPQVNAVMNAGAGNTGKVAQTLQNMRTTA

SEQ ID NO: 4961 - protein, 28 aa, Methylobacterium sp.
MAELDAMPWDEFCAEWIEAESVSRQHGN

SEQ ID NO: 4962 - protein, 170 aa, Methylobacterium sp.
MPRSKPLGWPKLMVARRLAGGATGYYWGPPTWAMKAGCTVGREALGTDYAEAKRRCDDVLNPQFDAWRTRDEGRTFDAVTVKRLTVAEVRALTAAQRAAEEKDPDASLPFPIFVDDEGAPIPQTVMDAMLDDDMVALERAADDFFPARFRASPAASSPASGADTGQTSDA

SEQ ID NO: 4963 - protein, 60 aa, Methylobacterium sp.
MSEARAFVATRSVFGLGPIDFGMFMSSPLRCGAKRLSLRADMWRRLYIRLGMLGVQHEWT

SEQ ID NO: 4964 - protein, 31 aa, Methylobacterium sp.
VPLLEALILVTPLCVGCTFWVAGRIYTGEGY

SEQ ID NO: 4965 - protein, 54 aa, Methylobacterium sp.
MGSLLAMIVGVVTFTAETGVEVVRVALVHPILQQGGRGVVFLLEVTARVRAAPR

SEQ ID NO: 4966 - protein, 80 aa, Methylobacterium sp.
VTAPDNERRRLAAEYLRGRKLEEALAAWRSDYDAPTYWERRPQLARLSNVIRRLADEAVAQDDEAADRPRGSGHENTRRG

SEQ ID NO: 4967 - protein, 31 aa, Methylobacterium sp.
MFARRTRLSLAIAIGSTLMLTTVAAVALCMP

SEQ ID NO: 4968 - protein, 92 aa, Methylobacterium sp.
MYRRRLSEQQFADELEDLEVTHRQSVGSAHIIAGESPSRGALMLIQTINAFAAMYELPEGDEPDYEPSPAEVQAHRERLFAFVAGLEAELRP

SEQ ID NO: 4969 - protein, 128 aa, Methylobacterium sp.
LGPVEWARLSPEAFAAERSAFGAWLAIDGPMQRQYRRRARAYVAARKVVLEMRMNDVELLPVEFGRRVSPFLEAPIDRSQGRQLLKQSLALECEGGPWPAVTASAEPSRQAEWEANYQENQAKAAGRT

SEQ ID NO: 4970 - protein, 112 aa, Methylobacterium sp.
MATIRGLIFAALKGVEPDSKRALAIADYLATEYRRHPQAQHIYSLRLEGPPRLLPPTVSKVTHGEHLWVSITHTPRRDPTVIAERAIFRSAQEFAAHLHYGVRKARMRKGGA

SEQ ID NO: 4971 - protein, 87 aa, Methylobacterium sp.
LALAALIGAATPAHAVDRNETMALMMAVATFNEKNCPGIQPNRQFIADTFNEFGVKTENMARQPYLGTIISTLNAFESNKPYFCESN

SEQ ID NO: 4972 - protein, 116 aa, Methylobacterium sp.
MSESDDAFTNEQLTELALMQAESTAQVGKALEATAHQALAGLVMNALLLHELERLGFVDCEALRAEAVQRALSIQPPQVGASVARVIQTIFDGKPPAAWSGADLTSVNDDLPDAKH

SEQ ID NO: 4973 - protein, 88 aa, Methylobacterium sp.
MCGHCLRVDAAVALGLLLASSVAALDASATLCRAFARERCACCHAVDSRGASLTRETPPFHLLAPRFPIDDIADVLVGGNGPPACRYA

SEQ ID NO: 4974 - protein, 56 aa, Methylobacterium sp.
MPERPHVASRPLRPEDRSFLSSPLADGSGKPDDQGVPLAVSVLVIAVVLLIVSAMG

SEQ ID NO: 4975 - protein, 35 aa, Methylobacterium sp.
MVKAASATRWLANPPSRVQPVKPGASQRFSQPVSQ

SEQ ID NO: 4976 - protein, 77 aa, Methylobacterium sp.
MAVTDCRVVGPVLVMTGVSPRYGEMVLVQSFDDLSAIYERPEGDEPNYESPEAGEAHREMLARLLAEFADPLPAPVG

SEQ ID NO: 4977 - protein, 128 aa, Methylobacterium sp.
LDLGGGEIWQAVAEPAEMTGDQGVQVTITAQVNAPVTVGRLASVVNEAVRDEEGPRGEGLHLDLHGMRQVEDEDLARADAVDLISVDTAGAAVERGPEHEMVERLRPSLLRGAYRASSLMRLCAHGRR

SEQ ID NO: 4978 - protein, 119 aa, Methylobacterium sp.
VRRYIESNLATVDAPTLMSRFGLSRTPLYQLFSECGGLYAYIRQRRLAEAMRRLRQVPAGRRPELARLAHACGFHNQTVFARAFRRRYGLNPSEVAIGELVPAGVNAADPTLLAWLREL

SEQ ID NO: 4979 - protein, 133 aa, Methylobacterium sp.
MQEIDLGKIGQWIVGNGPFDGQWAPTDFTAAEGRYPCAQTGGEDLGAEADSQCSAIKEGTFANGFRLTRHEGKSVISHIVRTTKYDQQIGAYGIEEVEVGGYGIQIADVVSMLQQQWLENAEILIRGMPDRND

SEQ ID NO: 4980 - protein, 56 aa, Methylobacterium sp.
MWAMGFVVEGAHYYTYVLPCPFSNSRSLRDAAFAARSMLKTAAMRSNREMTATDFG

SEQ ID NO: 4981 - protein, 630 aa, Methylobacterium sp.
MKIVILDSLPDDLLTVLLADNVVYRPDLRLKGSKAQVEALHWLKADAVVCTSELDPAGLSAWRPGACKDVACLDLDVGRSGTAVEIEEVEPGLWRTTVRCGDLRSGYIRAFETLEHLSLTRMVANETPIPRSSKILARRDVVLVGAGLVNLVTAYQLSRSGWIVRVIDAAPDPSTEAPWLSFGCSRGGDDARMFTLSEMDNYNDRALSLNMNSYFSKDVASLGWAASRIGSFSQSENDWISDYESVPIWLADRYNDDIFAFTRDSRNRWDRWIRDEPDLFSSCETRSGILRVYSDPDHFRSAVARQERIGAVMQVYSPDEVAVFEPALRAPAASGAIAGGILVVGFTVNAHKFMAQLISRMIDLGVSFEWETKVRAVLTDETGCVWGLDCGEKTVEASNFVVSPGAYAGELLNGTRCSGRIHGVLGAWLRLPNIEPRLEHSLKLARRGHVTEDANVTVATDVHGRPIMIIGSGYGHTGIDPTNVDEGFLRRIYNGLTDTAQTYFPEAYAACKDGGSIEASLKYCVRPWTSNGLGLFEIRPVQGGGKFVVTGGHNTGGFAQSPTISDAVAAALAGTQHDMHILYHPDRGISFLERVRSRDWCSTMSSIGTPDKAVEPSHLWDAVVRDVALS

SEQ ID NO: 4982 - protein, 80 aa, Methylobacterium sp.
MRKSFYSHTSRRIARRSAEPGRADGRHAPGARTRIARRRTCGIDAQPAILLDLTDQPAVLGPEIEAIEQHPASLVDDLLD

SEQ ID NO: 4983 - protein, 216 aa, Methylobacterium sp.
MSLRYLDDGVGLDGTFVLGFRITDEPAEKWSARMNAFKNKEKAALFGAAACLRTGVPGLLKALGLPADRTMLIPAISSRDEVASPESFISMLAAAVARSAGARFDGQAVRKKVHQPLHGIFAAAGRTAELDKAGYQAEPRAGIRHFVVVDDLVTRGGTMSRMAQALKGANPGATVHGVALGKTERRAYCGPNLDNGHVDQHWEEAWLRGERKYRER

SEQ ID NO: 4984 - protein, 249 aa, Methylobacterium sp.
MRVCLHLPGRTRITVEQALQEYGPNPPVDVFACPVCDGILSIRAQAALARTAHFAHARGADCPTIDAAAAPFENLRALDPDPVARIQRQARFRANWRRHFLHLGSLVPALAIEEFVARLDLSLEWNIWSYVGLTDAEIPIVLALLDQFSPDDAMQTHTVRPRDHWYRFWVSHGAGAGADWPWPEQGATISRGRFRYRGRGVAPAGADFIDLEIVPVSGAFLEGPEPPTLHDYRENAVNAWFVRHPAFGR

SEQ ID NO: 4985 - protein, 120 aa, Methylobacterium sp.
MARQLLLAGLWSGSAPVCAIDAPIDLPAMRERLTRFRECEFAERNRWLAWPVDDRPEPGRDGVAVTPGLRVWACDEVEVDPYAAAAGRPFDAELTLSDDVSLGRAAVVLLGLLSDRRPDA

SEQ ID NO: 4986 - protein, 97 aa, Methylobacterium sp.
MMALLRAWSQRRLDRDRLVQADASSLVERFGEGAYDVARGRVVEPRRGTVLDPARPTGHWTRVKLRIAEMSGREIGLDTATRMAMRGSHLEKGGGRW

SEQ ID NO: 4987 - protein, 39 aa, Methylobacterium sp.
MVGRSRKVVSDVVLNAVPPAVDRLAVSGRIVSGAVPVAT

SEQ ID NO: 4988 - protein, 33 aa, Methylobacterium sp.
MSSSPPIPDRTRIDAVAENESVTSILEGLEEPA

SEQ ID NO: 4989 - protein, 143 aa, Methylobacterium sp.
MNDNSTAFIATAAGLVSAYVSNNHVQAGELPGLLASVHGALVGLAQPAPAPEAPAEPLSAAQVKKSITDDGLVSFIDGKPYQTLKRHLTRHGLTPEQYRARFGLPANYPMTAPAYGARRSELAKAMGLGQIGRGAQVQQQAAE

SEQ ID NO: 4990 - protein, 82 aa, Methylobacterium sp.
VIGDMQLHASPLMTELIEDWTEVRSPGRAARRRRQGHRQRIRYVDRPKQQVIVFGNRIIAHPDIIERLRAQIPERSPLHRLF

SEQ ID NO: 4991 - protein, 78 aa, Methylobacterium sp.
MAWIQLTQASGGRKTYVNTDLIYQVTQAGKTRLHVAVAAKADDSTPLWPMHIEVAESIEQVMEMMHGAGEKVVSRLGS

SEQ ID NO: 4992 - protein, 30 aa, Methylobacterium sp.
MMRLVHPGWLATLTPAQIELFFSACSPTVH

SEQ ID NO: 4993 - protein, 181 aa, Methylobacterium sp.
MDRALTFIGTIGTALSFLPGLSDPVRWVIFASGMTIGLGGLAHMAWERRLAFAGWLDRRMPGRLVAPPAVETEHEFTSLYEVTRQAYERTRSTFLGNAADRLSNDSPLLWYVHLLDDHFPVFGTHPPSRIMERFDEVGFEYEVVGEMIIAVEQFGSRRWENLSLRASDVPEALKYVQDRAE

SEQ ID NO: 4994 - protein, 139 aa, Methylobacterium sp.
MRAVWFGLLGAVLAAGAAQAKACDLQGAELTADDGRTFRVVRISSHFDRIKSPKVNDLKADGYVLAVIEGAGQKFVLSQTYSGWGMPNNAARSYEYEEDRAAKIGSERARRAERARVDGTFDVLTGPLEGVSLRPTRCS

SEQ ID NO: 4995 - protein, 635 aa, Methylobacterium sp.
MGPGQGRPGLIDLLANGAGAVGRGITGLFGGGDAGGSFPESLPAEGTDGFGAPGYGPGDALGYGNGSFGGFTGTMETGGGRGFTGMNAGGGVGLGSFGSGITQPGPAPDLYGFTGMNPSQGVGPGTLGQLPAGFDPAAYLRANTDVAAAGIDPVQHYLNFGMQEGRAITPEGWTQTQGPPALTPTSGGGAAAPTIGGGQPTSTIGAPQAVNGLPPGFDAQTYLALNPDVAAAGLDAGTHYRAFGAQEGRAYAPPGGTSTLGPPASSPTIGPDGSVSVVSTGLVPTQGPPATTPTQGPGPTITARTGTFNPAEYLAANGDVAASGQSALDHFRNYGLKEGRAIDTLGNHFNGQAYLAANQDVAMAGMDPVEHFLKYGAQEARTLAPTDWTSPLTATTNIGTIGAPAATPTIGPAGTTPTIGAPALTPTYAPPAATPTIGAGSAVPTLGPGFTQPSWSPGGGISNPFGFSGANVGSALGATPQTFASAYPLDTNIGYSSGGSPGGGGISDFGFSGADVSGFDVNAAAPSAGTEAYSGPGATVDGPRTGTGKGSSSSAAFLADQARTRAYWDTLAKPASLYGYTNTSTPPIAAAPVVPNLTLTNLNAANAGMGGAMLGSGLNLSINSRPLAGGFGFGF

SEQ ID NO: 4996 - protein, 91 aa, Methylobacterium sp.
MSANAAGTPAPPGNSSHRTNASASRRADTPARTASGNDPDENEAVEIVVQDEADRPRPHMGPYMGPYMGPYMGPYMGPYTGPSRPTSPPRP

SEQ ID NO: 4997 - protein, 82 aa, Methylobacterium sp.
MTISELIAQLRAAGATIEVIEIAVRSLEAAMEAERTKEADRKAKQAARVRKHRDTRKGGITVTLPSRDGNSPPDPSPDGPPP

SEQ ID NO: 4998 - protein, 144 aa, Methylobacterium sp.
MMHGEEQAKAFAHHNVSARMAASGGALLGNTTATAANQLGGEGSRPSLRTAIENAYTAQKRLDETHSYVSSLADSAEALAQRISGPYPTEASPKTTDSAQRAAPQSTVQAVNHALDSVHGSISSLGSPIERLSRALGVIERAVG

SEQ ID NO: 4999 - protein, 127 aa, Methylobacterium sp.
MSTSLARAARAVTIAASDARAEAARTDHLVHVAREHAGKDMCGLAEAVRDHAEGVSEAAAWVARCAVLEGLPELVAAIEAGADVWVDGAPLSAGSIVVRPDADRAGLLPTLKAWARRGRGLLSRRAA

SEQ ID NO: 5000 - protein, 55 aa, Methylobacterium sp.
VSARPHFRVLLRVRWKLSGATWLWLVDRDGSLLLLEAARRTAGGSLLVRFAEPLR

SEQ ID NO: 5001 - protein, 41 aa, Methylobacterium sp.
MRELLTLIVFVLFLGVLHVVATAKREASLGRLPVLHLRSEP

SEQ ID NO: 5002 - protein, 78 aa, Methylobacterium sp.
MADTTEPDLAARVAAIELILKGWIAVSESATGKISGPIRAGIDDGLAEALGHGTADPERVKQLQTAVDLFFSGIPKAP

SEQ ID NO: 5003 - protein, 86 aa, Methylobacterium sp.
MDTFRDLIAGYGLSDFAADIGVQENTAKQMRKRDSVAPEYWDAWVKGAAERNLPGITYERLAKIAANKRVVAQAANTDATDPQRAA

SEQ ID NO: 5004 - protein, 37 aa, Methylobacterium sp.
MSPLAAELQTLAFYGLAALTVLGALWVAGRVVTGEGC

SEQ ID NO: 5005 - protein, 49 aa, Methylobacterium sp.
VRLHDRGGDIFAVGSMPLATAERFIEQLQGHVAAAKKQGLSVIRCEGSA

SEQ ID NO: 5006 - protein, 75 aa, Methylobacterium sp.
MSDCIREWVDLTPEFEVALEDACIATELLAAVIDEETSGNTAAQREFANAAMTDLIEALRDVEPCEEKARLALRG

SEQ ID NO: 5007 - protein, 92 aa, Methylobacterium sp.
MPREKKTLSELEEMLLARLRELPNGELVEGVNIVLSDREDGDPGVGVFWSETSATMRPLVGHAIAYGSVLVRQYQVIDDPNDEALPHATSSV

SEQ ID NO: 5008 - protein, 47 aa, Methylobacterium sp.
MAEPPRAPPAGLSGIDRDGARRRSKLLRALLLLATLAAVAWIAFHLR

SEQ ID NO: 5009 - protein, 60 aa, Methylobacterium sp.
LKSVMQMFQHPSAAHLSASTIALPAFTRVAPRKPATDEAEIVKRAIPLTIVDAHECKGDN

SEQ ID NO: 5010 - protein, 71 aa, Methylobacterium sp.
MVGSAEERLDALNREIADLELKRDAHVSIIAALTDQGLDTAAAKAVLQRIEDQLAALRVRTATFEGDARHI

SEQ ID NO: 5011 - protein, 84 aa, Methylobacterium sp.
LAVEHHVTQADILHLALKLARKAFLERAPQPPRSASPVPVATGAALIAIAEQLVELQEDARMSAADAEAHAMAPFGTDAFEVRP

SEQ ID NO: 5012 - protein, 377 aa, Methylobacterium sp.
MSFETFRTTFPALVEQRLAQISLDPDGSGGDILVAGALYKMAAAVSKTSLQGVASTALLSSMSASQLQAWLQAPENVTVFISAISNQGTMATVARSQSAMATIAGCPAAVGLILGSANAVAQVALSYVAILAVRNQPAALAAFVANAQASRLLASSQIAMDLLAASAAAMTTIAASSTMMAAIVGSGVAMTAVFGSAEAVSVLVQYSQAMQAMAASATAMAQAAASATTMAAILGSSTALAAVFGSSTARTAIHASTVAVDAIRDTPAAIAWLRANKMTTASVNIGGTNQSVITPVMAGVSKAISLSIKSGGISSASVTYSLKTKTAGSTEAAVVPLSPSATNTVAAYTSFGVTCSITIPATKNENYYPVIEFVAMD

SEQ ID NO: 5013 - protein, 81 aa, Methylobacterium sp.
MADLGVCVVSGVDGMTYEVNSRIDADLRAILREAQPDDGFQVAGSLRWADVRAGGKTYPLRGLTALAEVIAEYAERREVQA

SEQ ID NO: 5014 - protein, 77 aa, Methylobacterium sp.
MPNLLEGHPEFTRELINAARRIAKAHGHTMRKPTGRMSLHEWGMGFFRLTDAAGNIIAGPRHELTPRAVAKFYGETL

SEQ ID NO: 5015 - protein, 61 aa, Methylobacterium sp.
VATPNPTDLTTPGTLDDEAFVDAFCAIPEAVDGLWMNNNPSQEQLQSEYLVGVLEEDCGHA

SEQ ID NO: 5016 - protein, 36 aa, Methylobacterium sp.
VLAYAIDGLVAQGTVYEKQQALRLVSDALTKRGIIG

SEQ ID NO: 5017 - protein, 215 aa, Methylobacterium sp.
MNLDTAPAVATAALPPTPVPCLDPKPGLILLGRDERGRPHASAFGLDEAPAAERAAALMGFATLIVVEEHQGLASSLPKGRVFESGRAFVPFCSTQTFARLLEAAGLPDAPVPARAAAKPAEPSPPTAGSQGGGAPAGGDGGAAKPPFGWADITIGSLVLARGDDEDGYYAATVAATKADNHFVLTWRDYPDLPEFSRHRHALGLLHPGTPTKGK

SEQ ID NO: 5018 - protein, 95 aa, Methylobacterium sp.
MKFRPLHDRVVLRRIDGEEKTKGGIIIPDTVKEKPQEGEIVAVGPGARDEAGKINALDVKAGDRVLFSKWSGTEVKIDDQELLIVKESDILGVVG

SEQ ID NO: 5019 - protein, 77 aa, Methylobacterium sp.
MAAADALVATFSKQSGTREELAGIITGLMDQYRISPDRAHMLIDRFGRAQLALENAGDELMTRKQGDSERQPSLIAQ

SEQ ID NO: 5020 - protein, 110 aa, Methylobacterium sp.
VADQLRPKVPRLAALMDAAETDVLAYMGFPAAHRAKLHSTNRLERLNGEIKRRTEVVGIFPDEPSIRRLVGAILLEQNDEWAVQRCRYMTLESIAPIGDDPLVSLPNLAV

SEQ ID NO: 5021 - protein, 86 aa, Methylobacterium sp.
MMAVTCATVAAVTPVPPYSRGTVMAQSPEAVKRSISAKGSARSMSRAAAVPAKSAARVRAAARAAASSASTGTGRGGSGATVKARS

SEQ ID NO: 5022 - protein, 49 aa, Methylobacterium sp.
VIEVVEAEIVPVGEFRTMAGRQRESWYAEAIYAVAYGILIAIPIRNDDR

SEQ ID NO: 5023 - protein, 50 aa, Methylobacterium sp.
MANEPQKPSQVDAVPGSGTPKPESPEPGKAPKASEVDAQPDKPKADEAKQ

SEQ ID NO: 5024 - protein, 136 aa, Methylobacterium sp.
MSEIIAFRKVEAPSPRIGSVDVLGSNAAREVFAWQRILVRRATLSKLAFRVGIELAQSVDRKPGRGYAVRTHAQLMGVLRVTSRSKIQEAIARLQRLGFLSVEVSRGLGMANRYRLTWPPQIALPDADGDDDVCPF

SEQ ID NO: 5025 - protein, 92 aa, Methylobacterium sp.
MSMEAEIAVLRADLARTYELLTGVINTLAAQVAASRAVHDLLDAEGVLSRHRLCEQALAYAERAGLGPEVVAVMSSILAPTPTANASAGLYH

SEQ ID NO: 5026 - protein, 72 aa, Methylobacterium sp.
MPLFNSSAIERAEYDEPSSTLQIWFTGSGGPYSYYGVPPHIYQGLCAAASQGQYYAVYIRDKYSRDARFYRR

SEQ ID NO: 5027 - protein, 58 aa, Methylobacterium sp.
MTTQPTTLPDRAAAHAIERARLDALRASIAQVLSADLARLNRCLAAGTAPQATVGGAA

SEQ ID NO: 5028 - protein, 149 aa, Methylobacterium sp.
MIRRPIPPCELTQAFQQAGLEPSYPEHEGTSPQGLGTTSCAAEQAELEALAAVEFEPWDVPDDVLPTNAEWSSMANPHLATLRAATAVLGMTKDELMQLAADPTYDGLGDDMAGKLHRTAELMSSYRVMAEVAHGRLLAAMAAAQLRTA

SEQ ID NO: 5029 - protein, 51 aa, Methylobacterium sp.
MRQIAIDGLNTLSFLIRGLAAIIDQHPWVGQAIFFSPVLSALNWGPYALRY

SEQ ID NO: 5030 - protein, 81 aa, Methylobacterium sp.
MAEDKQAGTEPKVPAERADLKAQGQTSPKGEDRPGFDLGGSADRDAQQGAVPDTGPVSDPEIGNEQPTDRSQLTSKKGTPA

SEQ ID NO: 5031 - protein, 50 aa, Methylobacterium sp.
MADEPQKPSQVDAVPGSGTPKPESPEPGKAPKASEVDAQPDKPKADDAKQ

SEQ ID NO: 5032 - protein, 232 aa, Methylobacterium sp.
MTGPILIVDDDPHIRDVIRFALEKAGYATALARDGNEALARIAVEPPRLIVLDVGMPGMDGLELCRQVRRTSEVPILFLSARDEEIDRVLGLEIGGDDYVTKPFSPRELVARVGSILRRGAARTAATPEPLLSHGGLRLDPGRHEARFAGQVVAATAIEFAILAALAARPGLVLSRDQLMDAAYGGRVHVSDRTIDSHVRNIRAKFAAAGCAEVVATVHGVGFRLAACEPRA

SEQ ID NO: 5033 - protein, 516 aa, Methylobacterium sp.
VVLGVLAIVATLPLVGLFFFRVYENGLIREAEAELIAQSAVLAAVAAREIEALPEGERLLGPVVRPPEDPAARAAYRPIEPGLDLTAADILERRPAATEPARPPDQAALEIGARLQPVLLRTQVHTLAGFRITDRNGTVIAGRSEVGRSLAHLPEIADALQGRFRAVLRQRVSAHPPPPLYSISRGTGVRVFTAMPILVGDRIGGVVYASRTPSNVVRHLYGERAKLALAAAAVLAATLAIAALFSRAITRPIHALVTRSAEIARGNRAVLEQPGPLGTREIARLAQGLDRMARQLHERSDYIATFAAHVSHELKTPLTAIQGAAELLRDAQTSPADAMSGAEQVRFLDNILADTRRLTALLGRLRELARADNPDIRGTTDLATVVAGLQRACPELTVAVEGAREEPFAMSAENAGIVFAHLADNAVRHGAVTLHLAADLTGGHLRVRVQDDGEGIASQNRARIFETFFTTRREAGGTGMGLGIVRAMLLAHGGTIRVLPSDHGAAFEVLVPLRAG

SEQ ID NO: 5034 - protein, 26 aa, Methylobacterium sp.
MCGIVGMVGRDAVADQMVEALRRLEY

SEQ ID NO: 5035 - protein, 49 aa, Methylobacterium sp.
VTDPVSGALVGLLTGRDRLRVRAATLRGAGERRACIARPGRPRRSGATP

SEQ ID NO: 5036 - protein, 29 aa, Methylobacterium sp.
MSGGRSAIQRDNGPERSSLAPCIEIAPLA

SEQ ID NO: 5037 - protein, 66 aa, Methylobacterium sp.
VLRVHPLGGLGEGRNFDAHLAPLGNGIATFTGQLAVSERLLPSLSEADKAEATQADVTAPALNDGA

SEQ ID NO: 5038 - protein, 149 aa, Methylobacterium sp.
MIRRPIPPCELTQAFQQAGLEPSCPDHEGTSPQGLGTPSCADEQAELEALAAVEFEPWDVPDDVLPTNAEWSSMANPHLATLWAATAVLGMTKDELMQLAADPAHDGLGDDMASKLHRTAELMSSYRLMAEVAHGRLLAAMAAAQLRTA

SEQ ID NO: 5039 - protein, 89 aa, Methylobacterium sp.
VAAWFPEEARRRQARNLANQRAAALVRSKAGAMAIRAMADALMRKGEIGADEIEGLCREAYGGQQCEFGAWNAHWPPTLGQLRSGFIPG

SEQ ID NO: 5040 - protein, 78 aa, Methylobacterium sp.
MRRTVLFSALLLAECTPPEKAYSAMLNFFEHFIARAMKLGRADLDPFGILPVIDAVRAAYSDTLVVNGRQVEAIDAKR

SEQ ID NO: 5041 - protein, 255 aa, Methylobacterium sp.
MVDIPALRAVLPASVRIIEDAAHCFEGSRNGRRPGQDGDAAIFSFYATKNVTCGEGGAVITNDPDLAAALVQTVLHGMSAGAAQRFQSGTYRHWDIARLGTKANLPDLLAALLEPQIDRLEAQLARREQLCGRYEAALADTPFLWPEIEAGVVSARHLFPIHVPDGQRDAVLRVLGEAGIGATVNYRSVPCLTLYRSSGVPDLPISRLWGEGTLSLPLFPDLTDGEQDEVIAALRAQANTMRPSKMARHAEPALP

SEQ ID NO: 5042 - protein, 232 aa, Methylobacterium sp.
LHPLTVYAETCARAEEAVLARNSPCFTTAALRNATVFGLSPRMRFDLVVNQMTHDALEHGRITIGGDGTQWRPLVHVRDVARAILLAMRAPRRAIGGQAFNIGWENYQVGEIAHAVQRAVTVPAQITHLPGGPDRRDYHVSFAKAERALGFRASLTVEEAVVEIERAIRGKRLSNTPACYTVHWYRRLLAERGPGLRLPDTGPLHVLTEVPSTDAIIARDAVAGAPVAERVQ

SEQ ID NO: 5043 - protein, 209 aa, Methylobacterium sp.
LDGECDLVLEDEHTIVFIECKAKPITRAAMAGDASDAVLAYLEGIVASQAQALQHQSVLEKHGRITFGDGSVLDWGGRRIVRLSMTLFDYGTLQDRLVFAQLASTLANSRLNARDPADKSATRRAKKSNQIIEKLREHLQGAEGLDEELSRKIWARSLPTASLSIGQLAILLVDRNAVGKLADALMKPASFATGSVLKEFYYMREQKII

SEQ ID NO: 5044 - protein, 52 aa, Methylobacterium sp.
LELVADHLLMAHGLIEQDGAKEMLPVLRQALMTAGVLLARSTMSSDTSDRFH

SEQ ID NO: 5045 - protein, 36 aa, Methylobacterium sp.
VTCPPSDQDLSAVIAVICLLAGLIIGGAVAARGPPG

SEQ ID NO: 5046 - protein, 57 aa, Methylobacterium sp.
MDRERSAPLTAAIDACNARAVVPARAGVLEKRDWSPKVEMRTPRYTTQMRELPVAVA

SEQ ID NO: 5047 - protein, 57 aa, Methylobacterium sp.
LDGTDRAHLCGALVITGRMAETIDADRIGFGNLTYYRTQVGNPHPRLRGVSIWAFKG

SEQ ID NO: 5048 - protein, 60 aa, Methylobacterium sp.
MLRALGDPRIVLPRQAAAATVRTLAGRPPGPYPAAMDLNALILMASALTFSGFVVLLGWR

SEQ ID NO: 5049 - protein, 26 aa, Methylobacterium sp.
MNRNAAFDPAGVASHGARARPRRTGG

SEQ ID NO: 5050 - protein, 28 aa, Methylobacterium sp.
GLDAAAIVAKVNEVLPERQDGRSRLRLA

SEQ ID NO: 5051 - protein, 87 aa, Methylobacterium sp.
MMTEVDKLYFATTGETHRLRDPLCDEIRRVRIRPVRFRHLRTIVRASDGACITVCLSKPDDLGDYADFELAGAFDADLDLVVGGRRT

SEQ ID NO: 5052 - protein, 232 aa, Methylobacterium sp.
VSAALALVPASPDLSPARAALVAAFAERESVLRASGTIVQARERLSAALIARTEAQGALNALATAEAEAVTNWSFTGKGREPKPDLGKRRDLEGRLDDARVRAEAAQAAVAKLDAAGQEGERRLRAADEAVSLALSAVLMEEVEAELDEAAQLFAKARARVRAVTKLACEAQNTCAEAHRPRAGSLAYQASAMLSPAPDQWDRLGDWADTKRAVAQLIEDLRTEPTATLSLD

SEQ ID NO: 5053 - protein, 144 aa, Methylobacterium sp.
MNAQISKADIAKAEDAVDYHCEGLRGALFKLKWIDGQSVEDKRADMRKVFERFSENLLREMPDSATAQTPEPTSKAAAPKPETKKDEPTSPVDRLTKVVGEVLRADPKLSAEQAVTKAFEADPAAYDAIETERQAMIRRRGVSE

SEQ ID NO: 5054 - protein, 443 aa, Methylobacterium sp.
MTNLATLALEFADDLDRDWRTKARPEQLPPPGDWLTWLVLAGRGFGKTRTGAEWVQEQAMSGHVGRIALIAPTAADARDVMIEGDSGLLAIAPNRCRPEYQPALRRLTWPNGAIATAFSAEEPDRLRGPQHGAMWGDELAAWVNAQAVWDQAQFGLRLGRHPRALVTTTPRPIPLIRALLTDPHTVVTRGKTRDNIANLAPSRVKAMYDRYEGTRLGRQELEGEVLTDTPGALWKLEDIDGARIKPEQVPTLVRVVVAIDPAVSTRDGSNETGIVAAGVDAGGHFYVLEDASGILTPDGWGRRAVDLYAFRRADRIIGEANNGGDLIEATVRNVDQNAAFRKVHASRGKATRAEPVAALYEQGRVHHAGQFTRLEDQLTAFTPDFDRNRAGYSPDRLDALVWAITELMGRGQPDTGVIVIPPSIPNERKFSFDGGGLGLYQYD

SEQ ID NO: 5055 - protein, 80 aa, Methylobacterium sp.
MHSRFVMCAIVDSAQFGNEIVQHDTCLIPIGDQNARIDSDNVPYAADLLTVHETPRLQASEHIVGAGSGDARTRRDVRNG

SEQ ID NO: 5056 - protein, 63 aa, Methylobacterium sp.
VAKLRFCEGFAKALPGGCTAFDAKGLTSVATPIFVQWRNKGLVTVYPDADAKAKPVWQGKAVE

SEQ ID NO: 5057 - protein, 33 aa, Methylobacterium sp.
VHLRARIMCGIVGIVGRDAVADQMVEALRRLEY

SEQ ID NO: 5058 - protein, 81 aa, Methylobacterium sp.
MLGVAAPASSAMAFPSDAPRGHYGGHYTGFAADGVETTGALGVFGSRNPASCPMSSAAEGNASQQNFLVKQYGQTSGGNRC

SEQ ID NO: 5059 - protein, 48 aa, Methylobacterium sp.
MELKGWLNWVRGPVPAGPGILFGSLDARLVDVACQIAMSDPILDEAVT

SEQ ID NO: 5060 - protein, 83 aa, Methylobacterium sp.
LRTRCIVVRLHKDRLSFGDAPMTIGRQKIDPETCGDGLAFGPFPELERMADKSRQCAAQGEKDCVLYTNIPTNIPRAAAKRGR

SEQ ID NO: 5061 - protein, 163 aa, Methylobacterium sp.
MDSAREAGPVCVREPAALRPAGLTALFRPEVLAFQASQRQWGSVVELRPVSARALSWSAAFVTALVVAFLCLAQYARKEPVPGYLRPSLGSAKVFVPQVGVVREVRVGEGATVRKGQPLMIVDTQQVSAGGRDLTQAALDSLSAQRGRLARQIQAEEERVVSE

SEQ ID NO: 5062 - protein, 67 aa, Methylobacterium sp.
MLFAGTTPIVGQYLLHATGTITSVILLGISHVVVTVVCAMMLIARIEGTGQPAATPDVAPSGALQRT

SEQ ID NO: 5063 - protein, 45 aa, Methylobacterium sp.
VLGDRLQEPHLAGTDAVVGTEIDPDAQTGHRASAAPLAEAMFSGI

SEQ ID NO: 5064 - protein, 74 aa, Methylobacterium sp.
VEEQGAATQEIVRNVSQASTGTGEVTRNIAGVAGAAEETGASAAQVLGAASELSRQSEHLNAEVQRFLASVRAA

SEQ ID NO: 5065 - protein, 35 aa, Methylobacterium sp.
LPVPGPHGPKGLDLGGAGAAALDPGLPESLIGPMS

SEQ ID NO: 5066 - protein, 408 aa, Methylobacterium sp.
MAGGAGLNDRESSGSGAVSAPEDAGLGAVWDGESPEGGDVRFVLAEDGARVLHAWPGARALLHALAPAGVLPPALARQIRPAAGPGARMLRLRLDPRGIAPPTLCRAAPGRAADGRGLILLVVVGPLPILRAGPARVRMPADTPAEGTSDLMVEPLAESRVEERAAVPAPARAPVAPADREAGAPRPGDRFLWRSDAAGALTQLSGGGDALARLVGASWADLAASGRLREGEAFLDALARSRTFRGLGAILALEGGDSVAADLSGAPLGRPGQAFRGYGGFGIVRAVTLKDLTRPVANLVPLPEATGTETVAPEPPSEPPEAEAGSRESAGTPDPAAVSPVSVPVEATVSGAPVPREPPLLAPPYPLAPPFGRGLGTDPVAMATMAAPLLAAWLQQDWFGSPARTAPA

SEQ ID NO: 5067 - protein, 54 aa, Methylobacterium sp.
VVADRFDRAAIMAAAVSAARAYQEPAGCTWAEAMSVALKGAWQAAKIAKSRTAH

SEQ ID NO: 5068 - protein, 497 aa, Methylobacterium sp.
VAFLFPEVAKAARDGRLDQVIPGRSWPAWREPPAVTEKATDLDRWVTDLIERTASPMIRDRDALREIGVTCPYYAARYWSFIALQDAARDQEAHSAARAQRLKDQRDAYVTLATAARRTIEGEGKDRYHHGDAGPRGNPYWEDGARVWDERVAAREIGKAACDAATAALARAEEFIQRLTAEIDRIAPPTARPDIWKTSYATTMGNLYQLLTGEEVPDHGDIFGDLIKAPLDMIGTPIKPWGQVRTLRKRFSDPENGPGFGRGADGGMGLENLIRFRMRGPGAACIVHDALERADVMSVAMIRLADYTDAPVETVLRECLLKPYIRRHPALKEPEVLLIQLGWQEEPRPNAVQRALRETVARAKGGDIQAAAVIEILMTIGIDIDLTSRKFASGLSWLERYAGLAVADVMYGLYRESLRGDELSGALLGLIGQSDPVAGGLMGLIDLRIHTSTEPEDIELRGLIEARTERAEANIAHHRATAEAVRNYQKVPPRPAV

SEQ ID NO: 5069 - protein, 358 aa, Methylobacterium sp.
VIEQAFSTQAEADAWVAAERAQGREIRIIGPARRDEYFPGTVHHQIALGGTEKGMRSIAYIAQTFLAQAFPDLARSPQLQALKDYTLHNTGAGFVWWEFDPPNDVPASPFAFGHRVIVGHDSADGAVYARVSLFGSLNYALLLARVPSDTSRAVMTDIDPLALRAPADTQKQEFAKAVSAVIRPADPIQILGDALRTGRAEQEINKLVGRIQEFELNKTAGELMGTVAAASIKPEAERRADLTQVVAGQSQRLLVIMRKSAADMKSSWAGAGGQMVSSLLEAALRQDPASANGLSPEAIRSLELVRPVLVEQMDRDLVGGRLDQDRLAMLIGGGPGAAIMLEALIPNLVRRAASGQRT

SEQ ID NO: 5070 - protein, 139 aa, Methylobacterium sp.
MMTVGMVTALALVGGHAAVARAIWPGERVEDPGPALDPYLKAQAGALSTVVAIKERKLSDAHEALAAARKRETALRVELDAAKAEARELVDERSALRREVRRLRRVEVLAAVEGDGEGDETAGDDDGSAAPPAGPRPFQ

SEQ ID NO: 5071 - protein, 67 aa, Methylobacterium sp.
MHEDAPQNRRNGRPPLPPEDRRDQAVDVRLSPTEAKSITERAARVGMRLREFIRHAALNTRIVAPSS

SEQ ID NO: 5072 - protein, 59 aa, Methylobacterium sp.
VAHRHVADGRALSLAERAALLAYLRTPCLDRHGLVAKLLAVERWASEIAQDGLEAVLMV

SEQ ID NO: 5073 - protein, 257 aa, Methylobacterium sp.
MPKPLSAERRALDAAFGMTSGYVLDFTDRTMAEWFEEGFAIDIQSGAYDATGTSKAKRLRTFIEVEDGHTVGAVLRALWIYAEGIRNRRVDPPAEADVVTVFAFIERVERAEARPRTDALERFKADETLDELVAAIQRDIAVDKPAPALDRLHLYCMKKFAHLLDERSIPYDRAEPLHSRVGKYVKALERERELRRITVRMLKSAIGIFDDLNDVRNNGSFAHDNDLVDAAEARFIFDAISAILRFVKSVDTARFGT

SEQ ID NO: 5074 - protein, 418 aa, Methylobacterium sp.
VFWSWQSDIAQRVCREFVRSALSDALQRLAAELGLEESERPELDHDTKGEAGMVDITATILRKIEAASVFVADVTSIAETGQGKKVANPNVLIELGYALKAIGPEAIVLVANERYGGGPTDLPFDLRNRRGPITYKLDRKASDEELEAARGPLVDSLVEALSAILHVARTARDAEAQPVGQPSRNGDPSVWFPTGAALQARDWFGRAQMRRIILPDAPRSYMRIIPAGWGNTPPTAQDLHHPDGHGPRINPLGRGTNGDGGLNADGVLYYEPIENTDETETIVQWFADSGEIWGVDNKAARLIGEQTLFDIHYTTRRWATFMRTGLAALRAFGARGPILIEAGAVRLTDVQWYEVSPSARVSGLRPHACASRASRDWDDAAQIAFLKDAANQVRAAFGVRQVSIEEVDPVVRAGWQSI

SEQ ID NO: 5075 - protein, 46 aa, Methylobacterium sp.
MGIEALVIHAYREKKVERLGADTRRILGIRGPFLRRRLALRERVVS

SEQ ID NO: 5076 - protein, 45 aa, Methylobacterium sp.
VPFAQELDLIFEAHLFAIKIPALFDPPQQPGNCLRCIDPVEFSRR

SEQ ID NO: 5077 - protein, 295 aa, Methylobacterium sp.
MGDIFARSVSGALNFEYALDEALCNARLDASQLQMALLNVVINARDAMPDGGTVTIKTENLKINEEDQQLFEGLMPGEYIAVMVTDTGTGMPKEILKRVMDPFFTTKEEGKGTGLGLSMVYGYAKQSGGAARIYSEEGVGTTVKLLFPATDRPVNPMQQKQVSSSARGGTERILIVDDRADVAEMASMMLEAAGYRTVIAGDGHSALKLLTSDPDIDMMFTDIVMPGSLNGVSLSRMALVRKPKLKILLTTGFAETSSSGAIESDLEFPMISKPYTQTDLLKKVRIVLNGPDGVS

SEQ ID NO: 5078 - protein, 94 aa, Methylobacterium sp.
MTRVSLPALAGAAVVAGGFFAASIPAQARCVGIAACAQPPAGIAARPGFAANRPGIVNPGIARGNNLVGAGAGNLVGAGAGNLVGAGAGNFRPR

SEQ ID NO: 5079 - protein, 116 aa, Methylobacterium sp.
MFFLKVLQGAILIDVMIKMFLEKLQSRAIFLDYLPPGFDADAHIVGVVYDPVFSFRRSIQPILNRLVIFVGDDPEVPSDTFDSPEAIVFDNGSRIILDLRKFFRLDWHLRSLQLDH

SEQ ID NO: 5080 - protein, 110 aa, Methylobacterium sp.
MPLFAVSLLSECRVAGVVLPDPMHELAIHIVQAQDEAEARARGAELGAHRQHAYRNSDGEEVTWVFRRVVECQDLFERSFSDGMEVSSWLYRGERLCLNDGWSAPSAATG

SEQ ID NO: 5081 - protein, 67 aa, Methylobacterium sp.
MAIARSDGSALGCEEVELPGEAARAPLRLGRRSCGQHRQGRMRSSIQDRTNDLALLATMKGVQGMRS

SEQ ID NO: 5082 - protein, 52 aa, Methylobacterium sp.
MATTTLLAAQGQIILPAELGTTYSKAEPEMTSCLAVLAMMFIITMPILDLIL

SEQ ID NO: 5083 - protein, 152 aa, Methylobacterium sp.
MDIEDALDQLGRQIGIGLRLDGARACRLVFDGRTALDIEAPADRPGTVFLHSAVGLLPPTGRREAVYEMLLAGNLFGRDTGRATLGIDRDLGEILLVRQLDMAETPYAAFADAVEDCVARARAWTERLRQTHAETPAAAGDALALARFGLRI

SEQ ID NO: 5084 - protein, 508 aa, Methylobacterium sp.
MTHGISGLSPRASLDTTQAAAGTRGSFRGAAVEAAPAQPRAASALKTAWLEVRHFFASLVGMRVSTTKPETVADAASATRGVLHAMTKRDLDTLDVAEALVGMTEHGAFPQDLNRTGITEGAAGLFRPALQDLSDLQLMRLQANLCRKPDLLEGLSQLGTGFVMDADEPSVAAMAAGGQVNDLGFVMMSLHTCLRAELADRGLVPADLPGTPAALDPGLERFAQRAVANEGDLRAAIGEARVDLARARETAVLDALEQAGLYTREAEAPPEAPPAPPPAPPDNAAVNAPFGEARRAWIVETLNQAYLPQNQASERTGAVPVGPTGAFAVAQIFKRDMIGARDIAFAGERLPGTEGGTAALDANVAQFCQALGDRGATKGDILALSRVMNQATTGVVASQYMLDPDNAPGLRLADGDTVPIIADLKGGAWSITPSGTGYEIGYRAGQDLDGSAMATQGSRIFRFGEGSRLDVTLTFVLERGTEGELAVTGMRDSRIAIRAFDTEGRQLA

SEQ ID NO: 5085 - protein, 105 aa, Methylobacterium sp.
MMAQHVEVAMPLWEWSEDDVVARLIERRLPFPRHYTEIVDSLECLCCPAMISAERLAYLDAHHPEAAAFVRPLARRILDAARGAVASSDAALADAPQAEPEKDAA

SEQ ID NO: 5086 - protein, 188 aa, Methylobacterium sp.
VNAPLPAGRRILPRLAPETLALRERILSAPIMPAVEDAPWTLSPDPAEVLAIISDAEPDLHAAGYGRPQGWSAERQGRSWAEMETPAFLEEMDRAARFLSYLREHRRDRCPTRRSSAGWATIAEGIIAAPIGNGALVAAALALGFTVKPRASTAEAWLGLAETAFASLPGISPAARSSGGLAVVAASL

SEQ ID NO: 5087 - protein, 94 aa, Methylobacterium sp.
MALTSKEKQAAFRARRKAAVVEVVTLRAENAGLRDELATLKGENARLAGIVAAAKVSASAVSARPAPASVRVRLPAPPAETSPTRSPTSIRVRI

SEQ ID NO: 5088 - protein, 34 aa, Methylobacterium sp.
MPWDKLACEADKAKWKAACEVSKAPCTKLEEILK

SEQ ID NO: 5089 - protein, 88 aa, Methylobacterium sp.
LDVGSMENPLIRQCHELTAKVAGGWTDGQHAAGELMGRAREMAASLPASGKRDFFADLAKQAEAASRSLVDTEVFELFGQMLRVEAER

SEQ ID NO: 5090 - protein, 29 aa, Methylobacterium sp.
MEPASLSAILIAVGFALVAIGRLIAVFGM

SEQ ID NO: 5091 - protein, 72 aa, Methylobacterium sp.
MAVIEASTLTTEALEGYDRMMLEATLRVRNFASLAFAVWSEVLRELDKRGRVTLVSGSYDDVGNALITRNYE

SEQ ID NO: 5092 - protein, 66 aa, Methylobacterium sp.
MTHARFPDFSTPAPVARRVQAIALPAPLAHPALILAARAARLTGELLTACALIGGGCALVGFASLL

SEQ ID NO: 5093 - protein, 163 aa, Methylobacterium sp.
VEPLDFVREYVEPAITLWAERPNSPVLAVCAIAQIDILAEVVAIAQAGGTLSRGETGPFRTELGHREPAIARIRDAHDSHKHGRLRRSSGSGSSITQGQRPWRSTGSAWFLGRSRVGSVLGRKSTAILLDDGTPIDIAVLIREAMAAWDRELRRLRYRPSEEG

SEQ ID NO: 5094 - protein, 95 aa, Methylobacterium sp.
VLYGGQGDDTLNGGVGDDTLVGGLGADVYVFGATSGRDLILGFDRGAGDRIALGGQTDTVSSAQNGDAVLLLSGGGVVDLAGIRADQVDASFLAA

SEQ ID NO: 5095 - protein, 33 aa, Methylobacterium sp.
GLDAAAIVAKVNEVLPERKARTSNVVSVGRRQR

SEQ ID NO: 5096 - protein, 68 aa, Methylobacterium sp.
MPAGAVRVSIGLACAAPGTAADAVYRRADGALYDAKASGRNRTCCAPAPEPSEPPAARGGAGLRLAEA

SEQ ID NO: 5097 - protein, 70 aa, Methylobacterium sp.
MDRLNFQAWRILDFVFDHKTIERFLVEFSIVPIKNFDFANRVSVFRVINALGLAYFWMISLGMLVHGDET

SEQ ID NO: 5098 - protein, 60 aa, Methylobacterium sp.
VNRTLQEMRSAGLIVLKSKALTIPDLTALQKVALFNANYLHLEHEGAHLDANEPGERANG

SEQ ID NO: 5099 - protein, 31 aa, Methylobacterium sp.
VTAKAVVQFRPGKAMRERLNPALRQLPLAAE

SEQ ID NO: 5100 - protein, 67 aa, Methylobacterium sp.
MITRRYREPRGLHSDQAEYGFYVRLSGADRELMKRALEVATERLGGRPSNPMLLVEMMKVFTDGAEA

SEQ ID NO: 5101 - protein, 77 aa, Methylobacterium sp.
LLLSMIECRTLTFKSFFRSPEDQLVVLKHTVTSAKGRKIRVDWMDFESTTETQSIIDRLAKLNAFLKDADISFIVVT

SEQ ID NO: 5102 - protein, 79 aa, Methylobacterium sp.
MKMVARGAPADGNRGLLHQLRNDKKFAHEIGALVQDGRKHFGEAYPGQTRTSHFSNDEWAKAGYEDVAEIGHLMGLKGL

SEQ ID NO: 5103 - protein, 113 aa, Methylobacterium sp.
MMAQTLDAIPPLRNGRRGRPRRRPDKLHADKAYDARARRQECRVRGIVPRIARKGIESSERLGRHRWVVERTHAWFNRFRRRPIRYERRADIYDAFTSLAASLITLNQIRRFC

SEQ ID NO: 5104 - protein, 115 aa, Methylobacterium sp.
LADLGIAMKAAWDVADDVRTGRLVRILPDWWGGTDRWVRIVYPARLHQPRRVRAFIAFMEDEMTTSLAESADLGLFEAAALAKLQPRIDAVRRRPEPKLAEPRLAEPGLAEAKPA

SEQ ID NO: 5105 - protein, 36 aa, Methylobacterium sp.
LTGQVRNIADVTTAVANGDLSKKITVDVKGEILELK

SEQ ID NO: 5106 - protein, 35 aa, Methylobacterium sp.
LDLVEGGAGDDTQYGGDGDDVLGGQGGNDLLDGQS

SEQ ID NO: 5107 - protein, 33 aa, Methylobacterium sp.
MPFATRPAHLMRAAAIVAIAGLAGPAFAQPKKP

SEQ ID NO: 5108 - protein, 93 aa, Methylobacterium sp.
TNGTELWVTDGTDAGTTLLKDIDAGSDSSFPDGFTTLGNGKILFQATTTTNGAELWVTDGTAAGTTLLKDIEVGSASSSPRGFTALGDGKILF

SEQ ID NO: 5109 - protein, 60 aa, Methylobacterium sp.
MAAAVDPADEAGLRVGVEFETQSRDGARGEVRAERRRPPPSAGEGTLCSRGGRDEVPQEG

SEQ ID NO: 5110 - protein, 199 aa, Methylobacterium sp.
MNQEAIEPYYNELEREMLDAFYAHIRSHPMKTYLHWNMRDKNYGFHAIEHRYRVLGGEPFSIEDDKKLDLSRLFIDMYGVGYIGHPRLEKLLEENHIEARDFLNGAGEAQAFVDGKYVDLHRSTLRKVDVLANLATRSHDDKLKTLSSWTQSRGLSPKTIVSLAKEHWLVTGVIVLGGLISASLAAWRLIISVSSGTPH

SEQ ID NO: 5111 - protein, 402 aa, Methylobacterium sp.
VSLDKIVALNQSGSVQAETLSMEIYSQTRTILIVVGLLAVGLAAMLGVAIVRTISRDIASVVEPMNALAAGDASVTIPHQGAQTEIGVIAASVQVFKDNLIRTRELEAETALARASAEEQRKAGMRQMADGFEQAVGGIVGMVSSAASELQATAQGMSATAGQTASQSTSVAAAAAQAAANVNTVAAAAEELGSSVAEIGRQVSGSADLAQAAVAEANATAGLVQDLAQAASRIGDVVALISQIAGQTNLLALNATIEAARAGEAGRGFAVVAAEVKELASQTARATEEISTQIGRIQGSTDQAVGAIGGIGARIREIAGVAASIAAAVEEQGAATQEIVRNVAEASTGTGEVTRNIAGVAGAAEETGASAAQVLGAASELSRQSEHLSGEVSRFLATIRAA

SEQ ID NO: 5112 - protein, 180 aa, Methylobacterium sp.
MLSPVPVAGIDAGKHFLDLGFQPAAKGLRCENSPAGIQSVIEALRQRGVVRVALEAIGPYAQPLVTALVAAGFSVALVDPRRIKAFRTAEGLIAKTDRLDAGLIARFAARMSEHLRPAPEPEPIALKALSTRRRQLTALVILTHPSRHAPALLVVAEVDVSHRPAGGVLDREGLAELADV

SEQ ID NO: 5113 - protein, 67 aa, Methylobacterium sp.
MSELRYQQSGTWADGTPRLDVEAVEHPAEATPADARSGVSPERQRERVAAAVATTIRRFVSGGLRDA

SEQ ID NO: 5114 - protein, 33 aa, Methylobacterium sp.
MTVAQVLMSTDMARLNGCLAAGTAPQATVGGTA

SEQ ID NO: 5115 - protein, 31 aa, Methylobacterium sp.
MKLARMKIHAFVLTVPLAVMHGGEISCEIDE

SEQ ID NO: 5116 - protein, 64 aa, Methylobacterium sp.
MIPVSMGQDHVIYVLGVVAVANMFDETWCRIGITAVNNMNSVAVGIVAVTQCDGVSTTRFGTYG

SEQ ID NO: 5117 - protein, 98 aa, Methylobacterium sp.
LSSDAHVINRAASVGASDRFVRWLGRIATVTGVLMFVSYLDQIQLNLAGQKGSVIQPLATVVNCGLWTTYGALRRDWPVSFANAPGIVLGAVALITAL

SEQ ID NO: 5118 - protein, 64 aa, Methylobacterium sp.
TLKRHLTTHGLDPRAYRQRYGLPDDYPMVAPAYAAQRSALAKQIGLGRPGALAEREAGGRRKAA

SEQ ID NO: 5119 - protein, 346 aa, Methylobacterium sp.
MLSPVPVAGIDAGKHFLDLGFQPAAKGLRCENSPAGIQSVIEALRQRGVVRVALEAIGPYAQPLVTALVAAGFSVALVDPRRIKAFRTAEGLIAKTDRLDAGLIARFAARMSEHLRPAPEPEPIALKALSTRRRQLTALVAMEKTRLKQALDPLVADSHRAVIATLEAACAAVETALERRIAADPALARKRAILTSIPGIGARIAGVLITDMPELGRIDRKAAASLAGLAPHPSQSGAGPGRHAIAGGRPCLRAAFYMAGLVAARACPAFRGPYKAMREAGKPAKVAIVATGRRLVVLANPLIREDKTFPESTSALDPQYSRRLIDSAVGGGEPRRAPSPIGRGLG

SEQ ID NO: 5120 - protein, 343 aa, Methylobacterium sp.
LVGVLQRMAKGEIEAEITEAARGDEIGAVGRAVEGIKAMVARKAAEEAEVRRRSDAAAAAERKRTMVELADGFEAAVGGIVGLVSSSSTELQATAQQMTMTATETASQSTTVAAAAEQASSNVNTVASAAEELGASVREIGRQVSGSSDLAQVAVDEADRTAAQVHELSRAVTKVGDVVQLISTIAAQTNLLALNATIEAARAGEAGRGFAVVAAEVKELANQTGRATDEIASQIGHIQGATGQAVEAIGSITGRIQQISTVATTIAAAVEQQGAATQEIVRNVTQASAGTREVTSNIAGVAQASEETGAAASQVLASASELSRQSEHLSAEVQRFLATVRAA

SEQ ID NO: 5121 - protein, 32 aa, Methylobacterium sp.
AGATGWLVKPVQADKLLQVIRQVAPAVQPQAA

SEQ ID NO: 5122 - protein, 159 aa, Methylobacterium sp.
RGRLALAGNGATGGEGAALRALAAEAGIAGSVTVGGPVFGPEKDRTLRSWDFFVQSSRFDGLPIGAVEAALAGLPLIVSTATGLAEAVERHGAGFVVRDLSPGAVADALGQAARLTPEAWVRMSRAAHAMALVTGDWARSAEALQHLYAAGSDDLRLAG

SEQ ID NO: 5123 - protein, 41 aa, Methylobacterium sp.
RSRRPASEVIEAQAFEPLQHRSHAAPEPPHDAVDGRAYTLW

SEQ ID NO: 5124 - protein, 51 aa, Methylobacterium sp.
NGTELWVTDGTAAGTSLLKDINAGSSSSTPTGFTALGDGKILFSASTAANG

SEQ ID NO: 5125 - protein, 98 aa, Methylobacterium sp.
MRIEFADDDLARICTDQAYKMGLPVAVIKAARNRLVQMEAAKDERDLRNLKSLNYKKRNRQDEGIRSVCINDQYRILFTLSEDERPPVLRVIAIGDTH

SEQ ID NO: 5126 - DNA, 204 bp, Methylobacterium sp.
gagacgatcaatggtctgttcaaagccgaggtgatccatcgccgtgggccgtggcgatccttcgaggccgtcgagttcgccaccctcgaatgggtcgattggttcaacacccgccgcttgctcgaacccatcggcaacgtgcctcccgccgaggctgaggcgcgctactgtgctcgggccgaggtaagagccttggccgcctga

SEQ ID NO: 5127 - DNA, 909 bp, Methylobacterium sp.
atggccgagatccggcgcgtgtacgaggcgaacttccgcgtctacggcgtgcgcaaggtctggcggcagctcgcccgcgaggggatcgtcgtggcgcgctgcacggtggcccgactgatgcgcaccatgggcttggccggcgtcgtccgggcgcgcagggttcgcacgaccattcccgatccgaccggtgcttgcccgctcgaccgggtcaaccgccagttcaaggccgcgtgcccgaaccggctatgggtcgcagattttacctacgtggcgacctggggcggcttcatctacgcggccttcgtgatcgacgtcttcgcccgccggatcgtgggctggcgtgtctcacgctcggctctggcggacttcgtgctcgatgctctggagcaggccctgcacgagcgccgccccttcgccggcagcggcctcgtctgtcactcggatcgtggatcgcaatatgtgagcctccgctacaccgagcgcctcgccgatgcaggcatcgaaccctccgtcggcagcgtcggcgattcctatgacaatgccctcgccgagacggtgatcggcctgttcaagacggaggtcatccatcggcgcgggccgtggcgctcattcgaggccgtcgagtacgccacgttcgaatgggtagattggttcaatcagcgccggatgctcgaggttcgccggatcctgtacacgaccaacgccatcgaggccctgaacgccacgctgcgccgggccgtgcgcgcccgcgggcacttcccgaccgacgaggccgcgctgaagctgctctacctggtcttgaaccgctccgagaaggcgtggaagatggggccgcgtgagtgggtcatggccaaggcgcagttcgccgtcatcttcggcgagcgcttcacacgggccatggcggcctga

SEQ ID NO: 5128 - DNA, 219 bp, Methylobacterium sp.
gtgtggtggatcgccgagacgatcatcggcctgttcaaggccgaggtgatccatcggcgcgggccgtggcgctcgttcgaggccgtcgagtacgccacgctcgaatgggtggattggttcaatcaccgtcggttgctcgaaccgatcggcaacatgcctcccgccgaagcggaagcccgctattatgcgcaggccgaggtccaagccttggccgcctga

SEQ ID NO: 5129 - DNA, 675 bp, Methylobacterium sp.
tcgacctatcacgcccatgccgcgcggcgtgtcgaccccggcaagctgccggctcgggctcgctcggacgcggcgatcatggtcgagatccggcgcgtgttcgaggagaacttccacgtctacggggtgcggaaggtctggcggcaactcggtcgagaagggatcgcggtggcccgttgcacggtcgcccggctgatgcgggtcatgggtctgaagggcgtgcggggcaagaaggttcgcaccaccatcccggatccggccgcggcctgcccgctcgatcgggtgaaccgccagttcaaggcgccgcgccccaacgccttgtgggtcagcgacttcacctacgtcgcgacctgggccggcttcatctacgtcgcgttcgtgatcgacgcctatgcccggcgcatcgtcggttggcgggtctctcgcacggctcacgtcgccttcgtgctcgatgctcttgagcaggccctgcacgagcgtcgtcctctctggggcggcgggctcgtgcatcatagcgacaggggctcgcaatacctcgccctgcgctacacggagcggctggcggaggcgggggtcgagccctcggttggcagcgtcggggacagctacgacaatctatggacgcctcccgcggcaaggtattcctcagcgacgaccacggccttgggtgcgtga

SEQ ID NO: 5130 - DNA, 279 bp, Methylobacterium sp.
atgacgaagcgcagcacacccttttcgcctgaggtccgcgaacgcgcggtccggatggtgttcgaccaccagggcgagcacggctcgcaatatggggcgatccgctcgatcgcagccaagatcggttgttcgggcgagacgttgcggaactgggtccggcaagccgagcgggaccagggccagcgacccggaccaacgacggacgagcgcgagcggatcaaagcactggagcgcgagaaccgcgagcttcggcaggccaacgagatcctgaggaaggcg

SEQ ID NO: 5131 - DNA, 246 bp, Methylobacterium sp.
atgatcctgagcctgcaggccgtgcaggtcgcgaccggcagcgacgatgccgagagtcagctcgtcttcgccgacgggttcctggtcgcgatcctggtccgtctctcggcgcagcacggggccgatgccgggaagtggttcctcgaagccgggttcggcccgatcgatcccctcgcgccgccactgttcgcggacctgccggcggcccgggcctggatcatgcggcagctgatcgccgcggcctga

SEQ ID NO: 5132 - DNA, 906 bp, Methylobacterium sp.
atgccgtttgacgtgatcgtcgtgggaggcagcttcgccggcttggcggcggccacctacatcgcccgcggacggcgctcggtctgcgtggtcgacgcgggcagcccgcgcaaccggttcgccgcggcctcgcacggattccttggccaggacggcagcgacccacgggcgatgctcgcgcaggcccgcgcccaactcgcggcgtaccggcaggcgaccttcgtggagggtgaggcggtcgacgtccgggcgggacggggcttcaccgtcacccttgcgagcggggctatcctggacgcggctcgcctcgtcctcgcctacggcataacggacgtgcttcccgagatcccgggcttggcggagcgatggggtaggagcgtcctccattgcccctattgccacggctacgagttcgccgaccggaagctcggcgtgctggccgtgtccccgctatccgcgcatcaggccatgctgatcgccgaatgggggccgacgacgctctacctgaacggcggggacatgcccgacgaggagacatgcgcccgcctcgcgagccgtggcgttgggatcgagcccgccgccgttgcagccctcgtcggcgagggcgggacgctgtcgggcttgatgctcggcgacgggcgcacggcggccgtcgaggcactctatctcgccccgcgttcgcgcatgaacagcccgctggcggaacggctcggctgcgcgctcgacgaagggccgttcggtccggtcatccgcacggatgcctccaagctgacgaccgtcgttggggtgtatgcggcgggcgacatcgcacgggcgccccacagcgtgagttgggccgtggcggacggggtcacggcgggtgtctcggcccaccagtccctcgtgttcgcgagcttggctgcctga

SEQ ID NO: 5133 - DNA, 258 bp, Methylobacterium sp.
atgaaggtcacgagtctcgccatcgccgccctcctcgcggccgcgattcccgccacggccgccgagaatgccggcagcgcgaccagccggtcgggcacggccaacagcaccggaccgagcgacgcggggtccggctcgacacccggcgccgccgggagcggcccgtcgaccggctcgatgagccgctccggcacgacgaacagcaccggcccgaacgatgccggatccggctccaagccgccggccggcggccgctga

SEQ ID NO: 5134 - DNA, 249 bp, Methylobacterium sp.
atgccccggaccctgatcacctggacgcaggacgagaccgccggcgtgccgctcccgcgcttcgtcggccgggtcgggacggtcgtcgtggggatctgcgcctacgacggatcgagccggttctggacctggtggagcccgctggccgaggacgtctgggggcacggccaggacgccgagggtgcccggcagggctgcgaggcctggctgcgcggatggctcgagaacttcaggccgttcttcacctga

SEQ ID NO: 5135 - DNA, 915 bp, Methylobacterium sp.
ttccaggcgatcggctcggccgaggtcgcccaggtgaacctgccggtggcggtgctgatctggctcatggtcatccccatgctgctcaagatcgacttcgcggcgctgggtcaggtcggccggcattggcgcgggatcggcgtgacgctcctagtaaactgggcggtgaagccgttctcgatggcggtgctgggctggttgttcgtgggctggctcttcaggccctacctgccaggggaccagatcgacagctacatcgccggcctgatcatcctggccgcagcgccctgcaccgcgatggtgttcgtgtggtcgaacctgacgaagggcgagccgcatttcacgctcagccaggtggcgctcaacgacacgatcatggtggtggccttcgcccccatcgtcggtctgctgctcggcttgtccgcgatcaccgtcccctggagcacgctggtgctctcggtggtgctctacatcgtcctcccggtgatcgtggcgcagctggtgcggcgttcgctcctggcgtcgggcgggcaagcggcgctcgatcgtctcctgaaggtgctcgggccggtgtcgctggtggcgctcctggccacgctcgtcctgctgttcggcttccagggcgagcagatcatcgcgcagccgctggtgatcgccctgctggccgtgccgatcctcatccaggtctacttcaacgccgggctcgcctacctgctgaaccgcatcgccggcgagcagcactgcgtggccggtccctcggcgctgatcggcgcgtcgaacttcttcgagctggcggtggcggcggcgatcagcctgttcgggttccactcgggcgcggcgctggcaacggtggtcggcgtgctgatcgaggtgccggtgatgctgaccgtggtctggatcgtgaaccggagccag

SEQ ID NO: 5136 - DNA, 1755 bp, Methylobacterium sp.
atggacgatgacacccttacgctgatccccgacgatctcgacgaagcgcagccgaccgcgggggcctgggtgatcgccgtgatcgacgacgatccggccgtgcatgacggcacgcgctacgcgctggcgagctacaccctcgacgggcgcggcctggagatcctcaccgcccggtcggccgcggaggcgcgggtgctgctcgccgagcgccgcgacgtggcggtggtgctgctcgacgtggtgatggagaccgacaatgccggtctggagctggtggactacatccggcgcgagctccggcaggaaaccgtgcgcatcatcctgcggaccggccagcccgggcaggcgccggagcggcggatcatcgtcgactacgacatcaacgactacaaggcgaagaccgaacttaccgccgacaagctgttcaccagcctcaccgcggccctgcgtgcccatcagcagctcaagcgcctcgacgagacccggcgcgggctcgagatcatcatcgacgccgcgccgatgctcctcgatcacaagtcgatgcagcgcctggcggagggcgtcctcacccaggtcgcctcgctcctgaacgtcgcctgcgccggcatcctggtcctgcgcgagaccgccgccccgcaggagcgcttctgcgtcctggccggatccggctgctacggccactacgccgggcgcgagccgtgctggccgctggaggagcgggtgcaacccctcgtcgaacgggccttcgccgagcgccggcacagcttcggcgagcactggtcgaccctgtatctgcacacggcgagcggcagcgagatcgtcgcgctgatcgaggctgaccgccagctctccgagaccgaccggtcgctcatcgccctgttcacgagccggctgtcaatcgccttcgacaacgtcatcctctacgagcgtctgcagctgaccaacgccgacctggagcggcgggtggtcgagcggaccgccgagctgatccgggcaaatcgccggctggacctgcagcgctcggacctgcggcgcgccaacagtctcaagaccgagatcctcggcacgatcgcgcacgatctgaagaacccgctggcggtcatcctcggccgcgccgagatgctgtccgacctgatcgacatgcagggagaccgggagcagatgcgggcgcaggtgcagcacgtgcgcaccagcgccaaggggctgacggccatgatcgacagtctcatggccgacgcgatgaacgacgccctcgacatcagcctgcgccgggaaccggtcgacctcgcgggcctcgcccgggaggtctgcgaggccgaccggccgctggccgacgcgaaggaccagaccctggtctgcgaaggcccggacgagctgttcctctgcggcgacgccgagcgcctgcgcgaggccctcgacaacctcgtctcgaacgccatcaagtacagcccggtgggcggggcgatcacggtccgggtcagccgcgagccgggcccgcgcggcgcggaactgatctgcgccgtcgccgaccacgggcccggcctgtcgccggaggattcggcccgcgtgttcgggcgattccagcgcctgtcggccaagcccaccggcggcgagaactcgaccggtctcgggctctcgatcgtccgtcggatcgccgagcttcacggcggccgcgccacggcggagagcgccggtccgggactgggggctgtcttcgcgatccgcttcccggaagaatccgtcgggctgatctga

SEQ ID NO: 5137 - DNA, 762 bp, Methylobacterium sp.
atgaccataccagacagccccgcccccggcgccgcccgcggcggtgcggcgatcccgtcgatcgccgtggtggacgacgaggcggcgacccgcgagatggtcggggattacctgaagctccacgggttctcggtggtcctgtgcgacggcgggcgctccttgcgggagcacctcgccggccacagcccggacctgatcgtgctcgacctgaacatgcccgaggaggacgggctctccatcgtgcgcgacctcaaggcccggaccgcgatcccgatcatcatgctcacagccacggcgagcgcgatcgaccgcgtggtcgggctggaactcggggccgacgattacttgcccaagccctgcgagttgcgcgagctggtcgcccgcgtgcgctcggtcctgcgccgcgtgcagacgccgaccgccgcgccggccccgattcccatgagcgggcgccgcatccggttcggcacgaaatggctggagctcgacgccctgcggctcagcgacgatgccggtctggagcaggcgctcacccgctcggaattcgacctgctgaaggcgttcgccgacaatccgcggcgggcgctctcgcgcgagcgcctgctcgatctcgcggacgcccgcgacccggacgcgttcgaccgcgccatcgacgtgcggatcaaccgcatccgcaagaaggtcgagccggaccccggcaatccgcgctacatccgcacggtgcgaggcctcggatacatattccgacccgagggagactga

SEQ ID NO: 5138 - DNA, 2328 bp, Methylobacterium sp.
atgcgggttggacccaagatcgccctggtcggtggcgtgccgatcctcgccgccggcgcgatcgccatggccggctggctcctcctggcgcaggaggagcgcgcccggcgcggcgcggtcctggccgccgacgtgtaccacgacatcgccaccgcccgcctggtccgcgaccagtacgccgccgcggacgcgcaggaccggcccgcctacgccgagcgcttcgccagcctgaccgcacgggccgaggccggcctcggccggctcgccggcttcgcccgcatcgacgagcagcgcgcgcggaccgcctcggtggagcgggcgctggcccgctaccggggcgagatggacgccttcgtccgccggacccgggagaatgacggcctgatccgcgagatgacgcagcgggccgacaccctgatcgacctcaccgaccgggcgcgcctgcggcagcaggcctcgaacgccgacctcgcgcgctcgacagccgagaaggtcgaggcgctgcgggtcgcccggggcctcgtcgcccgcctcaacgccctgagagcccgcagcgcggagagcgccgtgctcgccgcccaagccgcggcccggagcgaggcccccgcggccggcaccgccggagcggcgctctcggagagcgacggcccgcgcgcgcagggccttttccgcgccgccagccgcgacctcgcggcggcgctgcgggccgacggccgggacgccgacgcggaggccctcgacgcgctcaccgccgaggcggcagggtggaagccggaccttcgcgcgaagctcgacgcctggatcgagcgcacattgaagatcgagacgtccggccaggagagcctgcacgacgaggtggcgcagctgctggcctattccgtggaggccaacgagatcgagcgggccacccagaacgtcgcgatcggtacgctcaagctggggccgcgcaccgcgggcgccctcctgcaccgggacgcggccctcgccgagcggatgcgcgacgagggcgagcgcctcgcccggagcgccgcctcgctgccgatctcgccgctgatccaggccgagatggtccaggccctcgacgggtggcgcgggcgcctcaccaccaccatcgggggcctgcggcagcagaacgccatgatcgtcgcgatggacgggctcgcggcgacgatgatcgacagcgcgaaggcgctcaacgacgccttcgtggaggacgccgaccggtccggcatcgtcatccagcggatcctgctcgccggcgcggccgggctcctgctgttcggcgcgctggtcgtgatcctcgtcgcccgctcgatcctggtgccgttgcgcgccctccagggcgacatggtcatgctgaccggtaacccggcgggggcggccgtgcggggcacggcgcgccgggacgagctcggcgacatcgcccgcgccaccgcggtgttcgtctccgagatcacccgccgggaaggcgcgctgcgccgggcgaaggatcaggcggacgtcgccctggtcgagttgcgccggacgcaggacaacctcgtccgggccgagaagctcgcctccctcgggcagctcgtggccggggtcgcccacgagatcaacacgccgctgggcatcgcgctcaccaccgggacgctcatgagcgacgaggcgcgggccttccgcaccggcctgtccgccggcacgctgtcgcggtcccggctgaaccacttcgtcgagcgggtcgaggagggcgccaccctgctctgcacgaatctcacccgggccgccgacctcgtccagggcttcaagcaggtcgcggtggaccgcgtcagcgacgagagccgcagcgtcgtgctggcgacctggctcgacgacctcctgacgagcctccggccgatgctgcgcaagggcggccacgtggtggagcgcgcctgccccgcggacctcgtcatcgacaccaatcccggcgtgctggcgcagatcgtgaccaacctcatcgccaacgcggtcgttcacgggttccgggcggccgagccgggacggatcaccgtggacgtgtcggaacgggagggcggactcgtgcggatggaggtccgcgacaccggtcagggcatcccgccggagcacctcgaccggatcttcgacccgttcttcacgacggctcgcagcgccggcagcacggggctcggcatgcacatcgtccacaatctcgtgaccgccaagctcggcggccgcatcgcggtcagcagcgagcccggccaggggaccgtcgtgcaggtcgactttcccgcccagggtgccggagcggccgcgcggccgcggaccggcgcgatccggacgccgtga

SEQ ID NO: 5139 - DNA, 1827 bp, Methylobacterium sp.
gtgagcacggtcctggtcttcggcgggtacggcggcttcggggctcgcctgtcgcggcggttcgcggcggccggtcacgacgtggtcgtcgccggccgccgctcggcgcgggccgaggcgttctgcgcggcccatcctccgtgccgtccccttcaggccgaccgcaacggtgccgtcgcgcccctgctggaacgcgtccgtcccgacctcgtgatcgatgcggccggccccttccaaggcagcggctacgatctgccccgggcctgtatcgccgcggcgatcccgtacctcgatctcgcggacggccgggcgttcgtgaccggcatcggccagctcgacgctgccgcacgcgcggccggcgtcgcgatcctggccggtgcatcgagcgtccccgccctgtccggtgccgtcgcccggcgcctggcgcaggggatggacgcggtcaccgccgtggagatcgcgatcagcgcctcgaaccgcgcgaccgccgggacgtcggtcgccgcggccatcctgagctatgtgggcaggccgatccggctctggcgcggacagcgctggtcggcggctgtcggctggcaggagctgcggcgcgagcgctttgccctgtccgacggcgcgtccctcggccgccgctggctggccctggcggacgtcccggacctcaacctcctgcccggccggcttccgggccggccggcggtcagcttcagggccgggaccgaactcgcggtgcagacgatcggcctctggtgcgcgagctggccggtgcgctggggctggatcccctccctgcaggggctcgcgcgcgggcttctcctggcgcagcggctgaccgcgcgctggggctcggatcggtccggcatggtcgtccggatgttcggctcggccgaagggcgccgcgtcgaacggcgctggaccctcctggcggccgacggtcatggcccggagatcccggtgctgccggcggcgatcctggccgagcggatcctggccggtgcgatcgcgcccggggcgcgcgacgccgggaccgcgctcgacctgtccgatttcgagccgagcttcgcgcgcctgtcgatccaccacgacgtgcgggagtcgggacaggccgatgcgctctacgcgcgcgtcctgggtccgcgcttcgccgaactcgcgccgcgcgtcgcggccctgcacggcgtgctgcgcgaggcgggggcgcacggccgcgccgtcgtgcgacggggccgtcaccccgtcgcgcgcggcctcgcggcgctcctcggattgccggtcgcgggcgcgcacgatctccacgtcggcttcagcgagacgcgcggggtggagcgctggacgcgcgcgttctccggtcgccggttcacgagcgcgttctccgaggagcgcggctgcgtcgtggagcggttcggtccgcttcgcttccggttcgacctcgcgcccgagggcggcggcctgcgcatggtgctgcgcggctggtccgtcgcgcgtctgcccctaccgctggcgctcgcaccccgcaccgccgcccgcgagtgggaggaggcgggattgttccacttcgacgtctcgatcgccctgccacgcgtggggctggtggtgcactaccgcggctggctcgacacggacgatcgcgcaggccgtcgatccggcttcgtcccggacgcagagccgaccgcgccgcctcgaagcggacatcccgcacagcgcccatcccggccatccagcggggatcccgggccggaaacggccctgccgatcgcgtcatcgcgcgcccgcgccccgtcccgcagcgggcacggtccggagccgcgtcacgggcgggtctga

SEQ ID NO: 5140 - DNA, 345 bp, Methylobacterium sp.
ttggctgccgcgacgctctcggccaagcgccggagcctggatcggcaactcggcgccatcctggccacgccgagccgctgcgacctgacccgcgagctccaggccaagatcagccgcgcccgcgatcagctcctggtgttcctcgcctatcctggaaaggtcgagccgaccaataacggctccgagcggctgctgcgtccggccgtcgtgcagcggaaggtgaccaacggctaccgcgccatgtgggcggctgagggcgaggccgccatccgcaccgtcgtcgacaccgcccgcatcacaggcagcagccccttcagcaccgtcctcaaaaccatcggtgcctga

SEQ ID NO: 5141 - DNA, 966 bp, Methylobacterium sp.
atgggccgcagcgaccttgaacggctgagccgcgaagagctgatcgagctggtgctgcggctgcagcggccagagaagacgtcgcgcacctcgtccaagccgcccgcgaccgatcgcaaggagcagcgggagcactccaagcccggcggcgccaagccgggtcacgagggtcacagccgcgtcgtgagcgacgatcccgatgctgtcgtcgagcatcgtcccgaggcgtgtgcgtgctgcggcgccagcctgcacgccgctcttccggcagaggtcgtcagcgtcgccgagcagatcgagctgcccgcggtggcgccagtcgtgacgcagcaccagcgtctcgcggtccgttgcccgcgctgtggggagcgggtggtcgcaccggtgccggaggcagcgcgcggcacgccgttcggcccacggctgcatgcggtggcgacgtacctgaagacctttcaggcgctctcgtacgaacggttgcaggcggcgctctccgacctgtttggcctcaccctcagccagggcgggctgatgaacctgctccgccgcgcgcagggctgcttccgtccgggtcgcgacgcggccatcgcgaccctgcgccgggccgaggtcgtcgcctgcgacgagaccggcgtgcgcatcgaaggctcgaacgcttaccactggctgttccactcggcgcaagccgtggtgcacaccgcctcgccgacgcgtggcgctgtcgtggtgcgcgagatgatggacgggcaccggcccgcggtgtggatctcggaccgctacaccgcccaacagggccacgcggatgagcaccagacctgcctggcgcatctggcccgcgatgtcgcctacgtcgtcgaggtcagcgacgatcccgtcccctggcgcctgcaactctggctaaagagcgtgttcgccctggccgagcgcgtcacgcacttggctgccgcgacgctctcggccaagcgc

SEQ ID NO: 5142 - DNA, 1788 bp, Methylobacterium sp.
atgtctctgtcgtctccccgcaaggcggacgcggtccgtcgcgtcctggccttcgtcgtccgcagctggcgcaggcgctggcccctcgtcgccggtctcaccggcgcgatcacgctcgccaccctggcggaggtgttgctgccgctcttcgcgggccgcttggtcgacgcgctctccgggagcgaccgccgcgcggcgctggacgcggcctggccggccttcctggcgatgaccgggctcggcctcgccaccgcgctgctgcggcacgtcgcctggagcctcgtggtgccgctctccctgcgtaccatgagcgacatcgtcggcaacggcttcgctcgcgtccagcgcttctcgaccgagtggcacgccaacaccttctcgggctccaccgtccggaagatctcccgcggcatgtgggcgatcgacgggctcaacgacacgctgctgctgtcactgctgcccgcgctcgtcgtcctcgtgggcacggccctggtcctcggcctgcactggccggccctcggcgcgacggtcgcgatcggcgcgggcgcctatgtcggcgcgaccgcgctgctcgcgacccgtgtcatcgcgcccgcggccgcgctctcgaacgccctcgacacccgcctcggcggcgcgctgagcgacgcgatcggcaacaacgccgtcgtcaaggccttcggcgccgaggcgcgggaggaggcgcggctcggccgcctgctggcgaagtggcagcggcggacccggcgcacgtggatgatcgtcacctggggcggcaccggccagctcgggctgctgctcgtcctgcgcaccgccatcgtcgccatcgccctgtggctgtggtggcgggagcgggcgagcccgggcgacgtcgcctacgtcctgaccgcgaccttcgtggtgcacggctacctccgcgacatcggcggccacatcaaccacctgcagcgggccatcaacgagatggaggagctggtcgccctggaggccgaacccgtcggtgtcgcggaccggcccggcgcggtcccgctcgcggtcgcgggcggggcgatccggttcgagaccgtgcgcttccactacggcgaccacacgcggcccctctacgacgggctgaccgtgacgattccggccggccagcgcgtcgggctggtggggcgctcgggttccggcaagacgaccttcgtcaagctgatccagcggctctacgacgtatcgggtgggcgcgtgacgatcgacgggcaggacgtggcgtcggcgagccaggcgagcctgcgcgcgcaggtcgccatcgtgccccaggagccggtgctgttccaccgctccctggccgagaacatcgcctacgcccggcccggcgcctcggcgcacgacatcgagcgggcggcgcgcctcgccaacgcgcacgacttcatcgcgcggctgccgaagggctacgcgacgctggtgggcgagcgcggggtcaagctgtcgggcggcgagcgccagcgggtggcgctcgcccgcgccttcctggcggacgcgccgatcctgatcctcgacgaggcgacctcgagcctggattccgagtcggaagctctggtgcaggaggccatggcgcggctgatgcgcgggcgaaccgccatcgtcatcgcccaccgcctgtccacggtgcgggccctcgaccggatcctcgtcttcgaccgcggtcgcatcgtcgaggacgggccccacgccgccctgctgcgccgcccgaacggggcgtaccgggccctgttcgagcggcaggccgacttcgcggagagcgcgtga

SEQ ID NO: 5143 - DNA, 222 bp, Methylobacterium sp.
atgttcgcgattacgggtcacggccaagcttacgctcagacgcggccgccggacggcaatctcgacttcctgtgcaacttcctcggcgactgcccggcgcgggtcgcgccgggcggtcccgatcgcgatgcccgcccgttcagcaacagcctcggccggccctgcgcgtggcgggaccgcccgaccccggagggcgtccgccgggtccgcgtctgctggtga

SEQ ID NO: 5144 - DNA, 1413 bp, Methylobacterium sp.
atgcggttcaccttccggcgcacggccgcactgctcggcctcggcgtggcagccgtcccgctgtcgagcctggcgaccccggtgacggcgaccctggcacgggcgcaggcgaccgaggtggagggaccggccctcccctacgcctcgacgtccgacctgcgggccgccacggtggcgcgggcggtgcgcgaccagcgcgccacgaacccgatcgccgcggccgagacggcgcgggaactggcccggcacgattacgacagcatcttccgcggcttcctcgacgggacgccgctgcgaccggacgatgcgggcgacgtgctcaccgccttcatcgccctgcaatggatggtcgccaacgacgcgacggtcgagccgagcgcggcggccctgcgggcgatccggacccggttcgtggcgccgatggcggaacggccgcccctgtctcagccggccgcgcgggccgccttcgccgagcaggtcaagctgcgcgccgtgctccaccatgccggctggcaggcggccaagcggctcggcgtactgccgcgtttcctggcgggcctgtccagcgagttcatcccggtcgccacgctgcggactctggcgctgaccgaggacgggctggtgccgaagggccgggccggacgcgcggccccgaagccgcctccggtcgcggagagaccgcccgtgccggacgcgcggccggctccctccccggctccctccgtcccggacgcggccggtcccccgcgccacgccgccaactgggattcggtcgagggcgtgtacttccgttcgaccaccgggttcggcgtcggcggtctcatgacgatcgatttcgagccgctgatcttcctgcgcgacggaacctactacgagatcgccgacaccgcgctggaagacgtggacctcgccgccgagcgggccgcacggcccaagcggttcgggcggtggaccgccaagggcgccggcttcgtcctgacggacgcgcgcggccgcgcgaacgactacgccctcggcgacggcagcttcttccgggccttcccggccgccgccaatgagcgggtggcgcgggcgtatcggcggctgtcgggcggcggcaacaccgccctgggcggcgacgtcgcgatcgccgtcgagagccgctacgacttccacgcggacgggagttacggtcgcggcggctcggtcggcgcgacgaattcgggggcgagcaccggagtcggcacggcgatcgcccgtcggcgcgcgccggagggcggccgctacgccctcgatcgccacacgctgacgctgaccacggcggacggccgcacccggcgcctgttcttcgcctacggctcgcagaaggatccccccgagatcgaccgcgagatgatcttcgtgggcgacgacgtcttcagtccggcggactga

SEQ ID NO: 5145 - DNA, 471 bp, Methylobacterium sp.
atggaggccaagctctgcttcatcggccatgccctgatggagaaccgctcggccctgatcgtggacacctgcctgacgtccgcagacggccacgccgagcgcatcgccgcgctggcgatgatcgagccgagggcggaccgccccaaggccatctccgtgggtgctgacaaggcctatgacgcggaggacttcgtcaacgagctgagatcgatgaacgtgcgagcgcacgtggcccagaacaccagcggccgccgctcgtccatcgatcgacgaaccactcgccatgtcggctatggcatgagccagaagatccgcaagcgcatcgaggagggctttggctggatcaagacggtgggcggccagcggaaaacccgcttcagaggccgcgacagggttgggtgggccttcgccttcaccgcggcggcctacaacttggttcgcctgcccaagctgctcggagctctggcttga

SEQ ID NO: 5146 - DNA, 648 bp, Methylobacterium sp.
atgcggggttcggatcagcgttcggggaggttgttctcctatgtggacttggaggctcgggtccgacccgaccaccccctgcgcacgatccggcagctcacggacgtggcgctcgcagcgctgagcggggacttctccgtgctctatgcggcccggatgggtcgcccgtcgatcccgcctgagatgctgctgcgggcgatgctcctgcaggcgttctactcgatccgctcggagcggcagttgatggagcggctggagttcgacctgttgttccgctggttcgtggggctgggtgtcgacgatccggcctgggatcactcgagcttcagcaagaaccgggaccggctgctggccggcgagatcgccgccaagttcctggcagccgtgctcgcccagccacgggtgaagcggctcctgtccagtgaccacttcagcgtcgacggcacgctgatcgaagcctgggcctcgatgaagagcgtcaagcccaaggatcaaagcggggaccaagctccaccacccgctggcggacgtaacgccgaggtcgacttcaagggtcagaagcgttcgaacgagccgaccccgaagccaggctctaccgcaagggcccgggcatggaggccaagctctgcttcatcggccatgccctga

SEQ ID NO: 5147 - DNA, 1365 bp, Methylobacterium sp.
atgaccgtcacgcgcgccgcgatcccgagcccgtcccccgtgcgaagaaggtccgatcgggaccggtcgggctccgccgacctgacgaactggcgcgcgtacgccgtcgccggctacgcgctcatcgtcgcgacgttcggggtggtcggcacctgggccgccgtcgcgcgcctcgaccgggcggtcatcagtcccggggtggtggtcgcggaaggcagccgcaaagtggtgcagcacctcgaaggcggcatcgtccaggaggtgctggtccgggacggccaggcggttcgcgcgggcgacgtcctgctacgcatcgatcccgtgcaatcgcgagccagcaacgatctgctccgcggccagctcgacggggccctgatcctcgaagcgcgcctccgcgcggagcagggccaggcgcaggatctgctcctgccgccggagatcgcggagcggcgcgccgagccggccgtcgccggcctgatcgacgaccaggccagccagctgtcggagcgccgcgcgtccttccaggcgcagctcggcctcatcgaggcgcgggtcacgcagctgaagacggagatttccgggctaacggtcgagaaggcctcgggcgagcagcaggtcgccctgatccagcaggagctggagggcctgcgcggcctccaggagaagaacctcatcccgctctcgcgcgttctgatgatggagcgcgagcacgcgcgcctccgaggcgtgatcggacggtccgtggcggagaccgccaaggcgcagaacggcatcaacgaggcggggatgcagaccgcgcagctcaagcagaagctgcaggaatcgctgaccgcgcagctcctcgacacgcgccagaagatcgcagaactgcgcgagaagctcatcgtggcccgggatgtcctccgtcggcacgaggtccgggcgtcgcaccagggcgtcatccagggattgaaggtctacacgatcggccaggtggtccgctcgggcgagccgctgatggagatcgttccgacgaacgacaggctcgtgatcagcgtgcagttcgcgccgaacgatctcgaggcggttcatgccggcatgcgggccgaggtgaagtttccggcttttcagacgcgccgcatgtcggcgatcttcgggacgctgacgatggtgtcccgcgaccgcctgatcgacgacggcaccaagcaggcctatttcgccggcaccgtggagatcgacgaccatcaactcccggacgacgtacgaccacgcctcctggcgggcctgcccgccgaggtcgtcgtctcggccggcgagcgcacggcactcgactatctggtggcgccgttcttcgatgctctgggacgcagtttccatgaacgatag

SEQ ID NO: 5148 - DNA, 327 bp, Methylobacterium sp.
gtgtatgcccatcagcaacgcctggactccgaggaggtgctggagctgcgtcgggagggtggacggtatctgaaggaactgcgggaggcgcgcggcctgtcgcaacgacagctcgcagcccttgtcggtgcggattactacaccttcatctcgcagctggagaccgggcgcggtcgtattcctccggatcggtatcgcgcgtgggccgaggccctggcgatcgagccgagaacgttcgtccggaacgtgatgcgcttctacgacccgatcacccacgagatcctgtttggcgatcggagcgcgaagcctgagggcaacgaggcgtag

SEQ ID NO: 5149 - DNA, 870 bp, Methylobacterium sp.
atgataggcaacctgaacatcgagctgctgcgctcgttcctggccgtcgtcgagagccgcagcttcaccgccgccgcgcaggctctcggtctgcggcaatccacggtgagcgggcacatcgcgcggctcgagcaggcgctcggtcgcgcgctcctgacgcgggacacgcaccgggtcgcacccacgccggacggtcaggccatgatcggcttcgcccgcgacgtggtggacgcgcaggaccggctgcgcgccttcttctcgccggaaggcctgcgcggccgcatccggctcggcgtctccgaggactacaccctgtcgaccctggcgcaggtcctggcccgcttcgctgatcggcacgacgcggtcgatctccagatcacggtcgggctgagccgcgccctgtaccagggctacgatgcgggcgagctcgacgtgatcttctgcaagcggaggcgcggcgacccgcgggggaccttggcctgggcggaggacctgatctggacgggccggcctggcctcgtgccggacccggccaagcccttgccccttgtgctctacccgccaccgtcgatgacccgcaccctggcgctcgacgccctcgaggcggtgggccggtcgtggcgggtggcctgcaccagcggaagcctgatggggctgcgggccgccgtcgaggcgggcctgggcatcgcgccgcactcggccaagatcctgccgccgggcctcgccgcgatctccgaggcggccggcctgccgccgctcggcgcggttgagttcgtcgtgctcggcccgggtcgccaccacacggcggcgaccgcgctgcaggagacgatcctggcgagcacgggcgagcttcagggcgccacgcgctag

SEQ ID NO: 5150 - DNA, 1734 bp, Methylobacterium sp.
ttgaccaacggcctgcgctcgctccggccggtcctggcgactgccgtggtgttcgggctcttcatcaatctgctgctgttcgtcagcccgctctacatgctccagatctacgaccgcgtgatccccagccggagtgagacgaccctggcggggatcacgctgatcgcggcgttcggccttgccgtctacgcgatgctggagatgctgcgcgcgcgcctcctggtgcgcggcggtgtggtgttcgatcggaagatcgccacacccatcttcgatgccgcccatcgtggcacattgctcaggcccggcgcgcagcacgatacggcgctgcgcgacgtggacgtcctccgggagttcctgaccggcagcggcatgctggcgttctgcgatctgccttggataccgatcttcctgctcgcctgcttcatcctgcatccctggttcgggtggatggcgctcgtgggcggcggcacgatcctcggcctcacgctgctcaacgaggtcgccacacgtcggacgctcgacgccgccagtcaggcctcgcgcgaagcggggcagaacgccgccacggtctttcggaatggagaggtgctgcaggccatgggcatggtcgcgtccatgcgcgggctctgggggcgccgccacgacgacgtcctgctccttcaggcgcgggccagcgatcgcgcgggcctgatcgtcgcgggcacgaagttcgtccgcatgctgctgcagaccctggtgctgggcatcggcgcgtatctggcgattcaccgcgagatctcggccgggtcgatgatcgccgcgtccatcatcatcggccgcaccctcgcgccgatcgaggccgtcgtcggcaactggaagggcttcacggcggcgcgggccagctatcggcgattggccgatctcgtggccgtcgccggctcggagacgcgccgcctcgtcctgccgcggccgcgcggcctgatcgaggccgagaccatctcggtggcggcccccggcgcgacgcgccccatcctcaaggcggtgagcgtccggctcgagcccggcagcgtcgtcgggatcatcggcccgagtgccgccggaaaatcgacgctcgtgcgcgccctcaccggggtctggcccttgctggaaggcacggtgcgcatcgacgggtccgacctgaaccactgggacagcgccctgctcgggcagcatgtcggttacctgcctcaggacgtcgagctgttcgacgggaccgtcgcgcagaacatcgcgcgcttcgctgaccgggacgacgcgcgcgtcatcgaggttgcccgacgggctggctgtcacgaactgatccagtcgcttccggagggctacaatacggtgatcgggcgagggggacacgggctgtcaggcggtcagcggcagcgcatcgctctggcccgcgcgctctacggcgagccgagcctggtcgtgctcgacgagcccaatgcgagtctcgaccagcccggcgaggcggcgctgatgcgcgccgtcgcggacctgaagcgatccgggacgacggtggtgctggtgacccacaaggtgagcctgctggaggaggccgaccgtatcctgctcatgagcgagggccgcgtacagctctccggcacgcccgagcaggtcctcgcccacgtcaccggccagcggccggtcccgaccctggtgccgcccgtcggccccgcggcatcccagagccgcagctccgacgaacagcggagcgcgggataa

SEQ ID NO: 5151 - DNA, 417 bp, Methylobacterium sp.
atgacacgggctgggaacgatgcacggctgtccctcgactatgtgtccgtcgaggatctgaacgcagctctccgcgtgttccgccggctgccgctggatttgctgggctttctggtcctgctgccgatcgtcctcatcggactgtctcggctcggtacggccctcaatccaccctacggtctttacatcttcgggtgggatctcgtgacctggggcctgctcctgatgctcgccctgctgttcggcctgctctggtggcggggtcgacaggtcgggcgcctcttgaacgaccgggacatcctcgcttcgccagtcatgagcctgctgtcggtgccgagtgtcttggcccggcgagcccagacaattggcatggaatggaccggcttctacggaccgctccgtccaacacggaagtga

SEQ ID NO: 5152 - DNA, 372 bp, Methylobacterium sp.
gtgatcgctgacggcgccggccgcgcgatcgcctttcggatcgcaccgggacaggcccatgaactgccccacgcgctgcccttactcggtcacttgccgggcattccccaatgggtcgtggcggatcggggctactccagccaacgcttccggcagcagttgcgagaggtcggggcaacacctgctatcccgtccaagagtaacgaggcccccgagcgctgcccggactggatctacaccaaccgcaacgtcgtcgagcggctttgggcacggctcaaggagtggcgggcggttgccacgcgctatgagaaaaccgcctccagcttcaccggagtcctctgcctcgccgcagccctcgatcacctcaggtga

SEQ ID NO: 5153 - DNA, 372 bp, Methylobacterium sp.
atgggggcgctgctcgacccggtcctcggccccgccttcgcgtcgggccggatcgtcgacgggatcctcctgctcgtcgccgccgaggcgctcgccctcgcgtggctcgcccgccgggtcggcctgccgctgccgtccctgctggccaacctcgcctccggcgccgcgctgatgctggccctgcgggcggccctggtgggagccggctggagcgcggtcgccgggtggatgctcgccgggctcgtcgcccatctcgccgacctcgtcctgcgggtccgggcggccacggcacaacgccgcagcgcggcgccggccggaacaacgcccgcgacggccgcgttcacgcgcgtcacaagtttcaaacagctctaa

SEQ ID NO: 5154 - DNA, 1335 bp, Methylobacterium sp.
atggccaaggtgtttcgcgcgtgggacgtcgatcagggctggctgctgccgccctcgctgcacgagttcgtgccgcctgggcacatggcgcacttcgtccgcgatacggtgcgagaggcgctggacctctcggccatcctcgacacctacacagaggagcgcggatacccgccctaccatcccggcatgatggtagcgctcctgctctacggctacagccgcggcctgtactcctcgcgccagctcgcccgcgcctgtgaggagcgggtcgacgtcatggccgtgaccggcctgaatcgaccggatttccgcaccatcgccgacttccgcaagcgccacctcgtggccctgtccgacctgttcgtgcaggtgctgcgcctatgtcgggcggcgggtctcgtcgagttcgctcacgtggcggtggacgggaccaagctgaaggcgaacgcctcgcgccacaaagccatgagctacggccggatgaagacggccgagccggccctgactgctgaggtccaagcctggttggatcgcgcgggcgaggctgacgcagcggaggatcaggctcacggtgccagccgtcggggcgacgagaccccggactggatggccgacaagcagcggcggctggaagcaatccgcgccgccaaggccgcgctggaggcggaggcggctgatccgcccgatcccgaggacgagagcgggccgggcgcctcgtcgggcatgcgttggcagggccggccactacgcggcgaagacggcagtccgcccgaccgggcgcagcgcaacttcaccgacccagacagccggatcctgcccacgcgtgatggcttcgtacagggctacaacggccaggtcgcagtcgacgcggcgcatcaggtgatcgtcgcgtatcggctcgtgaccaactcggccgatcaccgcgcgctcgtgccgcttgtagacgggctccgcgcccaccttgggcgcaagccgcgggaggtctcgggcgatgccggcttcgccaacgaggcgaacctcgccgcgctgaaggagcgcggcatcacgggctacctcgctccgggccgggcgcgtcatggcgaggcggacgcagccggccgccggaggctgaccaagatgccgttgatgagcgcgatggccgcccgcctgaagcgggctgggcgccgcagtcggtaccgtcttagaaagcaggtcgtcgagccggtgttcggacagatcaagcaggcccgaggcttccgacagttcctgatgagagggctcgatcaggtccggggcgagtgggcgatgatctgcaccgctcacaacctgctgaagctggcacagtcaggccgctga

SEQ ID NO: 5155 - DNA, 222 bp, Methylobacterium sp.
atgccggattatcgcctgcgcggggcggttcgtggcgaggacggcgagatcggcgcgccgcgcgtcgacgaggtgctcacggccgcggacgcgaaggaggcggtgcgcctcgccaaccgccgctcgctgacgatcgaggacgacgcggtgaacgccctgtggctggtcgacgcccacggcaccctgctctggtccctgcgccgggccgaccgggaaccctga

SEQ ID NO: 5156 - DNA, 324 bp, Methylobacterium sp.
gtgaggatcctgttcgtctgcggccgggcgcgcgcccgcagcccgaccgcggaacagatcttcgcgcggctgcccggcatcgagaccgcgagcgcgggggtgtcccccgacgccgacgagccggtggacgccgatcatctcgcctgggcggagatcgtcgtcgtcatggagcgcgcgcaccggcgaaagctgatgcgccgcttcggggccgccctgcgcgggacccgcctcgtctgcctcgacattcccgacgtgcacgacttcatggcgccggcgctggtgacgctgctcgacgcgcgcgccggccgcttcctgccgcgctga

SEQ ID NO: 5157 - DNA, 2676 bp, Methylobacterium sp.
atggaccaggcgaaaccccgacgcgagacgacgatcgcgcgggcgggtgcggggcggacgggctacgtcacggtccggggcgcgcgggagcacaacctgcgcgacatcgacgtggagatgccgcgcgacgcgctcgtcgtgttcacgggcgtctccggatccggcaagtcatcgctggcgttcggcaccctctacgcggaggcgcagcgccgctacttcgaatcggtcgcgccctacgcgcggcggatgatcgaccaggtcggcgtccccgacgtcgacgcgatcgagggcctcccgcccgctgtcgcgctccagcagcagcgcggcacacccagcgcgcgctcgtcggtcggcagcgtcacgaccctgtcgagcctcgtgcgcctgatgtactcgcgcgccggcacctacccgcccggccagccgatgctctacgccgaggatttctcgcccaacacgccgcagggcgcctgcccgtcctgcggcggcctcgggcgggtctaccaggctacggaagcctcgatggtgccggacccgtctctgacgatccgcgagcgggccgtcgcggcctggccgcaggcctggggcggccagaacctgcgggacatcctcgtcagccggggcgtcgacgtcgacacgccctggaaagcgctgccccggaagctccgggactggatcctgttcacggatgagcagccgcaggagcccgtctatgccggcctctccccggaccagacgcggctcgcacgccgccgcggcctggagccgagttacatgggcaccttcaccagcgcccgccgccacgtgctcggcaccttcaccaactcgcagagcgcgctgatgcgccgccgcgccgcgcgctacctcgtgagcgaggattgcccggcctgccacggcaagcggctgaagcccgaggcgctctcggtgacgttcgcggggctcgatatcggcgcgctctcgcgcatgccgctctccgcgctcgccgaggccctgcggccggcggccgaggaccgccagcccgaggccgaggccgcacccgccatcctcgaccgcgcggtgggccggaaggatcgcgccgagcgggccgcgtcagggggctcggctcatgcgggcgcgccggacgtgcgcgtcacgccgaacctgtcgatcgagaagcgcctcgccgcccagcgcctggcctcggacctcatcgcgcgcatcgggacgctcgcggatctgggcctgggctacctctcgctggaccgtgtcaccacgaccctgtcgtcgggtgagctgcagcgcctccgcctcgcgacccagctgcgctcgcagctgttcggcgtcgtctacgtgctcgacgagcccacggccggtctgcacccggccgacggggacgccatgcacgacgcgctggccgggctgctcgccgcgggcaattcgctcttcgtcgtcgagcacgacatcggcaccatgcgccgcgccgactggctggtcgacgtcgggccggaagcgggcgagaacggcggcacgatcctctacagcgggcccccggagggcctgcgtgacatcgcggcgtcccggacgcggctctacctgttcgggctggcggaggcgcccccgcggccgtcgcgggagcccgcggggtggctgcgcctcgaaggcatcgttcgcaacaacctcaagggcgtctcggtcccctttccgatcgggtgtctcaccgccgtgaccggcgtctcgggctccgggaagtcgagcttggtcagtcaggcgctgctcgagctcgtcggcgagcgtctcggccggccggtgcagaccgaggacgagccggacgatcccctggacgaggtgccgggcccgtcggaaggccgcatcgccggcggcatggacgggatcgggcgcctggtgcgggtcgaccagaagcccatcgggcgcacgccgcgttcgaacctcgccacctacacgggcctgttcgacgccgtccgcaagctgttcgccgcgaccccggaggctcggcggcgccgctacgatgcgggccgcttctccttcaacgtggccaaggggcgctgcccggcctgcgagggcgagggcttcgtcagcgtcgaactgttgttcatgccgagcgtctacgccccctgcccgacctgccacggcacgcgctacgcgccggagacgctgggggtgacgtggaacgggctgagcatcgcggacgtgctcgcgctgaccgtcgaccgggcctgcgcggccttcgcggacgagccgtccgtgctgcggccgctcaccgtgctgcgcgatctcggcctcggctacctgcggctcggccagccggcgaccgaactctccggcggagaggcccagcgcatcaagctcgccaccgagctgcagcgcgggcagcgcggcggcacgctctatgtcctcgacgagccgacgaccggcctgcacccgaccgacgtcgaccgcctcatggtccagctcaacggtctggtcgacgcgggcaacaccgtcgtcatggtcgagcacgacatgcgcgtcgttgcccaagccgaccacgtgatcgacatgggccccggcggcggcgaccagggcggcaccgtcgtggccgccggccggcccgagatcgtcgccgcggccgcggccggccgcacggcgcactatctgcgcgaggaactcgcgacggtccgcacgcgaccaccgggctga

SEQ ID NO: 5158 - DNA, 261 bp, Methylobacterium sp.
atgcatcagttcatcggcttatttgccatcttcgtcacgctggccggcgtgctccacacctggggtgccccgcgctgggcgatcgccggcctctgcctgatcggtctcctcggcgtgtcggccgccgtcgtcggcatccagcccaaagtggccccgtcgccggtgtcccaggcgcaatcgctcaacgacgcgatgcagcccgtcttcgaaggcgtctgggacccgctgcggcccggccggttgctgacaacgtcccggtag

SEQ ID NO: 5159 - DNA, 573 bp, Methylobacterium sp.
atgctcgtcggctacgcccgcacctcaaccttggaacagggcgccggccttgaggctcaggtgcgagatctcaaagcgctcgggtgcgagcggctgtttcaggagcaggtgtcctcagtagggacccggccgcagctcgccgctgccctcgatttcgtgcgggatggggatacccttgtcgtgacgaagctcgaccggctcgcccggtccgtctcgcacctcggcacgatcctcgacgcgctcgcggctaagggcgtggcactgcggatcgtcagcctcggcgtcgacacctcgacccccaccggcaagctgatgctcaacgttctcggtggcgtggcgcagttcgagcgcgagatgatgctagagcgccagcgcgagggcatcgccaaggcgaaggccgaaggcgcctacaagggccgcaaacccaccgccagggccaggacggcggagatcgaggccttggccgccacgggcctgagcatggccgctatcgctgcgcagctcggcatcgggaagggctcggtacaccgggcgatcggcaaggcacgtccggcgcctgccaagatggggtga

SEQ ID NO: 5160 - DNA, 993 bp, Methylobacterium sp.
atgatccgacccgccgccgctctgctcgccgccggcctcctcggtgctccggcccgcgccaacgacagcgcggccgagctcaatgccggcggcctcgtcctgctgcgcgagcccgggatcgcgctggtgagcgaggacctgtcgatcgcccgcgaccggatcgacgtgtcctacctgttccgcaatcaggttcaggaggcgcgcacggtccggatcgccttcccgctgccgccgatcgacgggcgggaactcagcttctcggccctggcgctgccccggcccgacagcccgaacttcgtcggcttcaccgtcacggtgaacggcaagcccctcgagcccgagctggaggagcgcgccttcgtgggcgagcgcgaggtgacggacctgctgcgccggcacggcctgccgctgaacccgctgcgcttcgacgcgatcggcgcggcggccaagcggatcggcgcgcccgaatgggccgcgctggtcaaggccgggctcttccccgacgtccccgacacgccggaccggatgaccgaggggctgtggcgcggcgaggccaagttccactggctccagaccttcccgcctgggcaggaagtccgcatcgcccacagctacgcgccggtgaccggcttccacctgctcgagccgaaggcggcgtcccgcgcggcctaccgggcgacctactgcctggacgaggcggggctcgcggcgatccggcgcctgcacgcgaaggcgccggatcccggcggctacctgcgggcgaccgtggtgccctacatcgtcaccacggcgcgcaactgggccgcgccgatcgggcgcttcaccctgacggtcgacaagggcagcccggaggcggtcgtcagcttctgccgcacggacatccggaagaccgggccgaccacgttccgctgggaggcccgggactacgtgcccgaccaggacctgcgcgtgctgatcgtccagccggcctcggcgaccccggggacgcgttag

SEQ ID NO: 5161 - DNA, 816 bp, Methylobacterium sp.
atgcggacccacgatctgccgcgcgccgcgcgggcgcgcctcggccgctccggcctgttactcgccgtcggcctcgccctcgcgctggtcgcgcccgcccgggcgaacccgctcaccgaggtgccgggggcccggtcatcgcagccggacgaagcgcccccgccgcgggacccggccgcggagcgggcggagaccgaggaggcgcgggccgcaaatccgggtgcgaccgcgatcatccggtcgctcgcgcccttcgccgacggcaatccgggagcgcccgcgcggccgctggcgatcagccccgacgacggcggcccggcggtccgcgtcgttcccgcccggtcgatcgatctcaccgtgttcttcgcctacgacagcgcgcgcctgacccccgaagcgcgcatccagctcgaaccgctcggcgaggccctgcgcgccgagccgctcgcgggccacggcttcctgatcgccggtcacaccgacgcggccggcggccgcgcctacaatcgccgcctctccctggcccgggcccgggccgtgaaggcgcatctcgtcgagacctacggcatcgcgccggagcgcctgcgcgtccacggctggggacccgcgcggccgaaggatcccgacgcacccctgtcacgggtgaaccgcagggtggaggtcagcctgatcgcgccggcccgcagcggtgccctccgcttcgtcctgccggtcgcggatcgcacctgcaccgacctggccgatccgcgcctgcggacggatctcgacctcgacgatttcggcgcggcgccgaccccgcgtccctgtgccgaatga

SEQ ID NO: 5162 - DNA, 150 bp, Methylobacterium sp.
atgttcgtcgccctctcggccggcttcgttgccatgggcctcttcaacgcggccgccttcgcgaccggccggatgttcccggcggagcccgcgccgagcgcatcacctgttccgccgggcctcacggcggccgcggattcgggacgctga

SEQ ID NO: 5163 - DNA, 201 bp, Methylobacterium sp.
gtgaccacgctgttcgtcggcggcctcatggccatcccgacgctcgggaaatgggccacgcaggtcacggaggtgctcgcctccctgctggcgatcgccaccgtgctggtcgcgatcctgtacctctgcgatcgctggcccgactacttcgccaatccgcggatgccggtcggcctgacggcgacgcccttcgccgactga

SEQ ID NO: 5164 - DNA, 117 bp, Methylobacterium sp.
atgaaatccatgctccgtgtgaccacggccctcgcgggcgttgccttcgcgggttcggccttcgccgccgacctgccgcgccgcgccgccccgccgccggtgttcacccccgtcccg

SEQ ID NO: 5165 - DNA, 1965 bp, Methylobacterium sp.
atgcggaccggttgggtacttgccggcgcgctcggctgcgcgctcggcgtcacgccgacccaggcgcggatcacccagatcgaggtcgtcaccgtcgagccgttcgccgacggcgctgagttcggacctgccggcgcgtacgagcgggtcatcggtgccgcccgcggcgaactcgatccggcagatccggccaatgccggcatcgtcgacatcgcgctggcgccgcgcaacgcgcgcggcatggtcgaatacaggaccgacctgttcatcctgcgcccgaaggaccccgcccgcggcagcggtacgctgctgttcgaggtgctgaaccgcggccgcaagttcctcttcaactgggtgctggacgcgccggcccaaggggcccaagccgtcaacgatccgcgcaacgccgtcgacgccggaaccggcctcgtcctgcgtcgcggcgacacgatcgtctggtcgggatgggaggcggacgcgctgcgccagcagggcggcatggccatcgacgtgccggttgcctccaggaacggcaagccgatcgtggagatcgtgcgcgacgaactcgtgagcgcgacgcgcgggccgccggaggcgcccttctatctcaccttcaaggcggccagcccggacaaggccggcacgcagctgaccgtgcgccgccgggaggccgacccgcctcggccggttccggaggaggcgtggcactacgcgacgccgcggcaactcgaactcctgcccaagggaacgaagccgctgccgggctcgatctaccagttcacctaccgcgccaccgagccgaaggtgctcggcatcggcttcgccgcgacgcgcgacgtggtcgcctacctgcgcggcgatgccgccggtggtgccaacccggcgggcggagcgatccggcacgcggtcgcgctcggcatttcccagagcgggcggtacctgcgcgacttcatcgcccagggcttcaatcgcgacgaggccgggcgccgggtcttcgacggcgtgctgtcgcacatcgcggggatcggcggcgtcttcctgaacgcgcgcttcggccaaccgtcccgcaccaacacgcagcacgaggaccatctctatccggagaatgccttcccgttctccgcggcggctcagcacgacccggtgacgggacggaccggcgcgctgctgcgcgacgacggcttcgacccgctgctgatcgaggtgaacaccggcaccgagtactggcagaagggtgcctcgctgctggcgacggatcccctgggccgcaccgacctggccttgcccgacacgacacgcgtctacttggtctcgagcggcttccactacgggcgcgccgggctgacctcgagcagaggcccctgcgccaacatgcgcagcaccctcaatccggcgcctgccctccgggcgcttctcgtcgcactcgaggactgggtgacgctcggcacgcccccgcccgacagccggatcccgcgcctgtcggacggcacgctggtggagccggccgaggccggctatcccttcatcgtcggtgtgccggtcccgaccgccccgaacacgatcgcccgcttcagcacctacgttgatcccaagcccgagagcgggcctcagtaccggccgctcgtgccccgcgtcgacgcggatggaaacgacgtggcaggcattcgcctgccggccgtcgccgcaccgcgcgcgaccttcacgggctggaatctctacgccgatcccttcccggcgggggccctctgcgaccgggaggggagccagcttccgttcgcccggacccgggcggagcgggaggccaacggggatccgcggccctcgctggaggagcgctacccggatccggatgcctacctggctgccgtgaccgagtccgtggacgcactggttcgggatcgcctgctcctgcgcgaggacggcgaccgccttgtccgggcggcgcggcaggagtccgcgccatga

SEQ ID NO: 5166 - DNA, 1359 bp, Methylobacterium sp.
atgcccgctgtcggaacgttcagggtctgcgcgccgggacggccgccgttcgcggcggccgtggcagagggcgtggccgaggcggtcgcgctgccatccgtgctcgtcacgatgctgggcagcctgatcgaggcgtggccccggcagatctacactcaacccctggtgaccacccgcttcctcggccagcggacgacctacgtctgcgatcccggccacatccgcagcctgatggtcgaccaggccgaggcgctggagcgggagccgttcatgctccgggcgctggccccggccctcggcgcgggggtcctcaccgcggacggggaccactggcggcgtcagcgcaggaccgcgaccccgatgttccgcccggaccgggtccggagcttcgtgccggccatggcccgggccgccgcggcgacgcgggcgcgctggcgcgacgccgatcccgccgggagcgagcgggacatcctgcgcgagatgatgcgcacgacgttcgacgtcatcgtcgccacgatggtgtcgggcgatccccacctggaggtcgggcccttcggtgccgcgatggacgcctatctcggccagaccagctggaagatcgccctggagatgctgcgggcgccggcctgggtcccgcatccggggtcccgggccggggcggaggcggtgcgctacctgcgcggcgaggtcgcccgcacgatcgcgcgccgccgggcccgcggcgagcccggctccgacctcctcggcctcctgctgcaggcgcgggacccggagaccggcgcgccgctcacggaggcgagcctcgtcgacaacctgctgaccttcgtgtccgccggccacgagaccaccgccctggcgctggcctggaccttccgggtcctggccgagcacccggaggtggaggggcgcgtcgtcgccgagatggcgcgcctcggcgccgatccggccgccggtcccgaatccgatcccgatcccgtggaccggctcccctacacccgccaggtgctcctcgaggtgatgcgcctctatccgccggccccgctgatcgtgcggcggacgcgggccccggtccggctcggggacacggtcgtgccggccgggcagtcggtccacgtgccggtctacgccctgcaccggcacgcgctgctctgggacaggccggaggcgttcgaccccggccgcttcgcgccggagcgggccgccgcgcgcgaccgctacgcctacctgcccttcggcgccggtccgcgggtctgcatcggcatgggcctcgccctgaccgagtgcctcgtcgtcctggctacgctgctgcccgccttccgcctccggccggtgacggcggagatgccggcggcgcagttc

SEQ ID NO: 5167 - DNA, 2094 bp, Methylobacterium sp.
ttgccgagagccaacccggtatccgcgctgcggcgggccgcccgcaccgcgctcatcctgctcgggatgacctgcctcgccccgctcgcgccggccagggccgccccggatccggcagccttcgccgacaatgccgacgccgtggcggtggtgatcgggaaccgcagctacaagcagaccgtgcctgtcgactacgcgcacaacgatgccgacgcgatccgcgcctacctgatcgagcgcctgggctaccgcgagagcaacgtcttcctcctgaaggacgcgaccctcaacgagttcaaccaggtcttcggcaccgagcggaacccccaatccggccgcctctggcgcagcgtgcgcgagggccgctcgaacgtcttcgtgtactattccggccacggcgtcccggatctcgccaccaagcagccgttcctgctgcccgaggacggcaacccaaaccagggcgagagcgggtacgcgctggagaccctgtaccgcaacctcgagctcgtgaagcgcaagatcggcgccgaccaccagctcgtcgtgatggtcgatgcctgcttcaccggcgagaccggccgcaagggcgagagcctgctggcggtgtccgcgcccggcttcgcgcccgcgcggccgaagacggagggcggcatcgtccggctggtggcgacatcgggcgcgacaccggccaactgggacgaggcgaacaagctcggcctgctgaccagccggttcctgatgggcgtgtcgggcctcgccgacgcgcgggaccatcagggcgacggcgacgggctcgtgcagtggacggagctgaagcgctacctccgccgcgaggtggaggacgcggcccgccgcgcgtcgggccgcgagcaggtgcccgagatcgacgaggccccgatcgtcctcaaggcatccctgccggtggcggccgtcgcgaagggggtcgaggccatccgggacgaggcggcctggcggcgggccgaagcgctcgggacccgggaaggcttcgaggcctatatcggcgcctgcggcgagacctgcctgtaccggcctcaggccatggacaggctcctggccgggcggcgccgggacgcggcggtgatcgaccaggagaactgggccaagttcgggacccagcggcagtatcaggcctatctcgattcctgcggcgaggtctgcgcctatcgcagccttgccgagggctatctcggcggcaagaacccgagcgccgatccgcgcgtcaagcgctgcgacgagctcgcggccggcacggacgatcccgaccgtccgagcggggtcgcgggcgtgaagctcggccggatcgagcctgcggccgccatcgacgcctgccgcggggccgcggccgcctatccggacctgcgccggctctcctaccagctcggccgcgcctacgaccgggccgaccgctacaaggaggccttcgccgcctacgaccgcgccgccaaggccgggagcatctcggcgctgaacaacctcgccgccctctacgagaacggccagggcgtgaagcgccagcaggccgaggcgttccgcctctaccggcaggcgggcgaaggcgggaacgtggtggcgctggccaacgccgcccggatgctggaatacggcaacggaatcccgaaggacgaggcgcaggcggtcgccctgtatcgccgcgccgtggccgggggcgacgtcgcgtcgatcagcaagctcgtgccgcactacgccacgggtgcctacggcttcccgaaggacctgcgccagggcttcgacctcttccggcaggctgcggaccggggcgacccggtggccatggccacgatggcgacgctgatcgacaacggcttcgggcggtatttccccggcgtgcgctcggccgacatggtcctgcgcgcgctgaagcacggagaactcggcgccgcctccgtctcggcgaccgacaccgccgcccagaagctcaagcccgagacgatccgctcggtgcagcgcgcgatcaaggacgcggattactacaccggtgccctggacgggcggttcaatccggtcttcgtccgcgccctcgatcagtacgcccgggcgaacgagaccgaatga

SEQ ID NO: 5168 - DNA, 318 bp, Methylobacterium sp.
atggccatccgcacgatggcgcggccgagcccgtcccggcgacgcctgcgcgtgatcctcatcctgctgctgatcacgtggctgccggtcgtacccttcgcgctcggcctcgcgctgacgagcctgaccggctgcaccgtcaacgaggcggggacgcacccctgcccggtggccggacacgatatcggcggcctgctctacacgctgacgatgacgggctggctgctgatcccgttcctgcccttcatggccctgacactgctgctcaccgtcgtgcagggcctgctgatgatccttcgagcgtggttgcggcgatga

SEQ ID NO: 5169 - DNA, 1518 bp, Methylobacterium sp.
atgcacaaactcctgagcagacttggcctgcgcttcgaaaatcccatcgaggagcgcgccttcgtcgcacgattcaccctcgacgacctacaccggacgcaggcggcaatgctgctcggcgcctttatctactgcgccttcgcggtgtgggactggatcctcgacccggcgcactggatcgaaacgctgtttcttcgcctcgccgtcgcggttgctgcgctcctgcctgccaccgcggcgctgagctggcctgctgcgcggctctgggctgaggagatctatctcagctactgcgtcgtgcccggctgcgtgctcagcctgatctacctgcggttggaacctggcttcgatcacgccgccgcgggcatgatcatcgtcatcctgtttgtctcgacgctgttgcctttgcgcctgccctcgctcgccgcgttctgcggcctgacttggctctgctttgccgtttgcgagatcctcgcggagcgcgagcggcccggaatgcgcttcgtgaacaatttcgaaatcggtatggcctacgcgctgtcgctctacgcagtaggcgcacgggaggtgcgtgcgcggcgccagttccagacggaggaggcgcttcggctagagacggagcgctcagaggcggccctgtccgaactgcgcgacgcgcaggctcatctcgtgcaatccgagaagctgacagccctcggccaactcgtggcaggggtcgctcacgagatcaacacgcctattggtctcgcattgaccacctcgaccgccgccgaaagcgacctgaaacatctccagtgcgccatcgagtcggggcagctgcgccgatccgagcttacgcaaggcctgacccggttaagcgaaggcatgcggctactgttcgcgaatctgacgcgggccgccgacctcgtgcacagcttcaagcaggtcgcagttgaccaagccaacgaggagcggcgcatattcgagttgcagagctggctcgaggacctgatgcggacgcttgggccccttgcgcggcgcaaggggcacgcggtgcggatccgctgtgaggacaaaattgcactcgactcctatccgggtgcgctagcgcaggtactcagtaatctggcactcaacgccatcgtgcacggctacccagacggtcgatcgggcgtactcgacgttacggtgtctcgtttcggcgcggaccggctgcacattatcgtggcagacgatggtatcggtatcccgccggagaacctgctcaaggtgttcgacccattcttcactacgcggcgtggaaaaggtagtacgggtcttggcctgcacatcgtgttcaatctcgtcacttcgacgctgcaaggtcagatcactttatcgagtaacgaaggtagaggcgcgtgcttcaccatcgacttgccagtctcgatagatgaaggggaagcgcgcgacccacccaaaccgcatcgagcgaaccacgtgtccgctcctgtgcagtcgtcgccctcactcgaacctgatacaaacgggtggaagtga

SEQ ID NO: 5170 - DNA, 258 bp, Methylobacterium sp.
atgaccaagaccaagatcctcgtgctcgccgccagccttctctgcgccgcgggtcccgccctcgcccaggaggccgcgccgcagcacggaaaccaggagttcctcggcgtcgatctcgacaacggcggcgtctactacaacggtcgcaactctggccgttactgcgtctaccgcacggtcgaggtctacaatcgctacaccggctacttcgaggcgcggcgtgcccgccgctgcggccgcggtctctacctgccgtga

SEQ ID NO: 5171 - DNA, 513 bp, Methylobacterium sp.
gtgagcgacgcggcacggctcctcgccgagatccacgcggcccgcgccctcgtgcgcgatgcggcggcgaccgcccggccggaccacgcgggcctctgggctcacgcgacccgggcgcccgacggaccggtcgacctcgccactgtgcgggcgatccgcggcgacccggcgacggcccggcgctaccggacgatgctcggcgccctggcgctcgcccacgcgccgctcgccgcggccgcctcggacggcgcgatcctccggcgccgggtcggcgccttcgcgctggagatcctcgaggccgcggacggcgcgccgccgctcctcgtcctgcgcggcgagtccgggcagatgccgcgggtgatcgaggcttggctcggtgacgagacggtccgactcgacctcggtcctgcgatcgagggcgcggcggtgctcgccctcgacccggccgtgccggaagcggccctcatgggccgcatgctccgcgacccggcctgcgcggtgttcctgctttga

SEQ ID NO: 5172 - DNA, 1131 bp, Methylobacterium sp.
atgacgcgtccggccatcctcgtcgtcgtgcccacgacccgcggaccgctggtgctgcgcgggctcaggccgcgccccggccttccggccccggccgccttcgcggacggcgattatcgcccgctgccctggtcggccgattacgcccgactctgcggggccgccggcccgctcgcccggtgggcgggtcggacgcccgagccccacgagctgcggctgtcgggctccttcgacgccggacgctcctgggaggttccggtgtgtttagcgcacggcctcgccgagggcggccacccgctcgccgcggcaccggaagaggccgacctcatcctctgggcgaccggcgcggtcgatctcgacctcgcggtcctgcccggcgactacgcgctcctcgacaaggtcgagcgctccaccgcgatgatcgccgaggctccggacgccgcgctggccgtcctcctgccggacgggccggagcgcgcgcaggccgaggccgtcttccgcggcatgggccggaacgtgcggatcctgccgtcgcacagcgtgcccgaagccctggccgcattgaccgcgctgcgggatccggagagggccgagacgccgccggcgcggcggtggcagcgtctggcgctgccggccggcgccgtcgcggcggccggactcgccggtgtgctcgcgctcggggccacgcggcccgatccgatcagcgagccgcgccccgaggcgccggccggtcctgccggccctcaccccggggccgaagcccggatcgcaccgccgatccacgtttcggagctgcgcgccccggcgggatcctcctgccgccgcgtggccttcggggccgacccgcccgagcggcgcccggtgccggcggaatcgggcgaccacctggccgcgagccggctcacgccggacctgtgcgggctcgccatcggtgtggagccgggcctgcgcgcgcaggtcggaccggaactgcgcgacgccgccctcccggccgtccggctggcggacggcgcgctcggctatttcctgcgcgagggcgcgcggcagaacctcgtctacacggtccaggccgttccggaggccggaaccggcgcggttgccggtcgcctggtccacaccctggtgcgctga

SEQ ID NO: 5173 - DNA, 981 bp, Methylobacterium sp.
atgatctcgatgcgccggagaggccctctcctgctggggacggcctgcgcgctgatcgtgctcggccgcggcgacgccgcgcgggcgcagagcgtcggcttcgatcccgccgattacggccgggcgcagctgcccctgcgccagacgaccggcgacgcggccgcctatgtcgaccagaacaagggcgctttcgagcccgtgagcgagctcgacccgaaggacggcctcgcggccctcgcccggccgatcggccgcgtcgacatcgtgctccagaacggccgcaccgggcagcaggtcggtgcatcctgcacggggacgctcctgcccggcgactacgtgctgaccaaccatcattgcctgccgcaatcgggcgacctgcgcccggtcaaggcgtcgatcctgatggattacctaactctcgacgggaaaggctcccgccgcttcgagatcgacccgaaacccgtcgagttcgacgcccgcctcgacttcgccctcgcccgcgtcgcgggcaatccgacggcgacgtacggcgccgcgcggctctcgggcgagccagtgacggccaaccgctcgatgctggtcatccaccatcccctcggacgtccgaaggtgatgagccgcttccgctgcttcgccatgaaggaccaggcggagggcccggacctgcgccaccgctgcgacacgctcggcggctcgtccgggtcgctgatgttcgacgcctccgtggccggcatcgcgctccacaaggagggcggcctcgatcccaaggatccgacgagcttcaacagcgcgacccggctctcggcgatcctgggccggagcccgaccctggcgcggatcgcggcggcccaggggcgcccggtcgccgccgcggatccggggaccaggccggtcgcgcctagcccgacacctcagcccaagccggcgaccgacggacccctcgatccggccgggatgaacgccatcctgcggggacgctga

SEQ ID NO: 5174 - DNA, 954 bp, Methylobacterium sp.
atgcccctcgtccgcaccacggcgttccgcgccgcctgcctcgccgtcctggccctcgggtccgcctacgcggcgccggcccgggcgcagaccaagcccaacgtcgtcgtgatgggcgaggacgctgacgaggacgcggtgccccgcggcaaccgcatcttccagcgggtgattcacgagctgtccgagaccatgaacctgcgcggctacaacgtctacgacgagaccgccgtcgcgatggggttcacccaggccaaccgggtgcgccggcgggatgccgagctgatcgaggtcgcccgcgcggtccagaatccgccgctcgacgtggtggcggtgttccagatctacgcgtcggcgtcgaaatccgcctactcggatatcgtccgtccggagatccgtatccccggccgcctcctcaacgtccgcaccggtcagtcgctcggctcgttcgaggtggccgggctccagctgccgcccctgccccaggggtgcgaccgcgagtgcctgctcgagcgggtcggcgccgaggcaaagacggtggccgccgacctcgcggccgcgctcaccgcgaagctcgacggcgtgatcgcgccccgccgcggtgccgatgccggcgctgcgccccctgacgccgcgccggtcggcggcgccgtggcggcggcgcccggcggcgagagctgcgggggtttgcccagcgcctacgtcgtccgtctgagcggcttctcggcccaggaggtccaggcggccgaggagtatatggcggctttccgctgctacgagcaccatcgtccggtgcgcgcgagtggggccagcaccgagtactggtacgagacccgctcggattccgcccggctcggccggaacctgcgcctgatgctggagcacatgagcgcgccgggtcaggtccagttctcgggcaacaccttcgtcatcagccgcgtggcgacgcggtag

SEQ ID NO: 5175 - DNA, 252 bp, Methylobacterium sp.
atgatccgcacgccaacgctgatcctgctcggcacactgacactggccggaggcaccctcggatcgacctcggccgccctcgccgatccgccctgggcccgcggcgagcgcggcttccgccacggcggcccaccaccctgggcgcccgcacacggctatcgccgtcaccgtgagttcggtggctacgggcgcagggacgcgcggttctacgaagggcgacgttacggcggttaccgctacgatcgctactga

SEQ ID NO: 5176 - DNA, 1335 bp, Methylobacterium sp.
atgaggcgcctcctcctcgccgcgctgctgctcgccccggcggcggcgcgcgccgaccccgcgacgcaggcgctgacaccgttcctcgacgcggtggcggcctgtaccggccggccggacctgacgctcgcggtcgtcggcgtcgagcccggccagacggccctgtcgcgcgagcagtccgaggaggtgcgcctagccgtcgagacgcggctccaggcgaccggccgggtcaggctggcggcggcggccgacgtcgtgcggatcaaggccctgcacgagggcacgacgggcctctcgggcgcggaggccgaggcgcagatccggtccgccttcgcgggggatgcggccgtgttcctggtcgagccccgtcgggccggcgagaccgcctccgtccggctccaggccgtgacgcagagtgccgcctgcaaggcgacgagcgaccctctggtcgtaccgatccatgtcggcgccggcgtcgcagacgtcgacgcggtcatggacggtgcggtgaaggctttcgcgcaggccgcaccgaatgccggcgccgtcgaagtctgcccgttcgtggcggagggcggccattccacctgcgccggcgccctcacggaccgcctcgtcatcgccctcgacgcggaggcccgctcggccaaccggatgctccgcggcgcgcgcctcgacgtgcgccgccggccgcccggcaccgcctgcgccggcaccgtcaccgcgcgcggccgcttccgcaccgaccacgaccggcaatcctggatggaggtcgagttccagcgcgagggcgccgtcctggccccgacggggcgacgccggatcgcgacggaggggctcggatgcgatcccgtcccgcggccgttcctggatcacctcgccgccaccgcgcgcaccgatgccggccgcctctcggtggcggctgccgccacgccgttcgcggccggtcagcgcctggagatgcgcatcgagtcccgcgtcgcgcagaacctgtactgctgggtggtcgcggccgacgagaccgccttcgtcgccctgccggtgcgcgacaacgcggcctcgcagctggccctcaagccgggagactcgcggcgctatccgcggggctacggcctcgacgagatcgtcgcgggggagcccttcgagaacctgttcgcctgcttcggcgtaccgggcggcctgccgccggaactcgccgcgcggtggctggcggcggcgccgggcgccgacggcgaggcgcgtctcctgcagcccccggacgtgctggacctcctcgaccggatccgggccacgcccggggtcaccgaggccgccgcgcgcgtcgtggtgcgctga

SEQ ID NO: 5177 - DNA, 1392 bp, Methylobacterium sp.
atgacgggcggatacgatgagcgctgcgcggccgacctcgccaatgtcggcgacggccgcgatctctcccgcgccgaccgtgcctggctcgcccgcgtggtcacgggtgccgtgcgcccgaaccgcgacaagcccctgtgggacctcgcccacgccctcgcggcgctggccggggcggccggggcccgcgacgggcgcgatctcatcaccctcgccctggacccgggcctcgcgcgaccggccgccctctcggcgcgcttcagcggcggcccggccgtcgacgaccgcggccccgtgctcggcaccgcctggtccaccggctgggccgggctcgcccggctcctcgcgctggccgagttcgtgctcaccgccgaggacctggcacagttcgcgaccgtcgcgggctggctcgacgagctcgccgccgcgcccgacgcggaaagcgcggcgatcctggccaagcggctggcccggcatctcgccgcctaccggaacgcccacctgccgctggcgccgctggaacggcgcttccgggcgctcctgaccttcctgggcggccgccggtccgtcgcggacgacgacatcctcgatttctggcgcgccgagatggcgacgggcgagcggccgggcttccgcatcgtcgcggagcatttcgtgaccttcgaggcggccggccgtctcctcgaaggcctcgatgccctctcggcgcccgccgccctcgacgcccacgcgggctgggaggagcggctggacgcggccctgggcgatctcgcggccgccgaacccgccgcggcgctggcgaccgtcctggcggactggccggagggcccgaagatcctcaccggcgccgagcgcgaggatctggccgacttcctgcgcctcgagccctaccaccggacccgcccgctgacgacgctccgggccgtgagcttcggccgggtccagtcgggcatcgccaaccgcctgcgccgcggcggcggcggcgccgccatcgccgagcgggcgacctgtttggaggccgagagctacgccgaactccggacgcgcgcgggactgctcgcggcccatctcggccggatgctgcgcatcgcggcggccctccggatcgccgatcgcgacgcgctgcccgaggcggtgcgggccgcgctggaggccgccgaggccgacctgcgccgcgtccgacgcgccggattcgacgatcgggagggcctctcggccgggttcgcggccgccgaaccggcgctgctgcgcctcgccgaggcggcggccgatctggagcggtcgctcgacggcctcgcccggcaccggccgctggacgcgctgttcccggcggatcgggacgtcttcgcggtcgcgttcgcggcggcctatgccggggaggccgcggcgtga

SEQ ID NO: 5178 - DNA, 306 bp, Methylobacterium sp.
ttgccgcccgtccggctttctgagcggttcatcgacacgaggaacagcatcgctatgccggtacgtctgatcacgactgctctgcttctgtcagtgggagccacggccgcgctcgccgcgcccatgtcggccgacgacaaggcggcgctccagcagcaatgcatgggcgacttcacgaccttctgcggtggcatgccgcccgatgatgggcccgagactcaggcctgtttcgagaagaacatggccaagctgtcgccgggctgccagggcgccatccagagctacaagcagggcaagaagggctga

SEQ ID NO: 5179 - DNA, 423 bp, Methylobacterium sp.
atggatacgacgaaaagggccgtcggcggcctaagcctgccaaagatcaaggtgacggcggaggaccgcgagcgcctagctgggctggcgtccgccgcgatggaccgtatgccggacctggcgggctatctgtcggacgagctcgaccgggctcagctcgtgcgggccgggaggtccgctgtcgggttcgtgcggatgggcagcgaggtcgagttccgcgacgacacgaccggtaaggtgcaggttgtgagcctcgtctatccgggggaagccgacatcggactgggaaggatctcggtgctgacgccggtcggcgcggccctgctcggcctgagcggggggcagtccatcgcctgggtgacccggaccggagccgccaagcgactgacagtgctcgacgtgcgcgagccggccttcgcctga

SEQ ID NO: 5180 - DNA, 327 bp, Methylobacterium sp.
atggcgaagacgagacgcgagttcacacccgagttcaaacgcgaagcggtcgccctgctggagagcagcggccggccgcagatgcaggtcgcggccgagctcgggatccagccctcgatgctgaggcagtggcgcgccacgctgaacggggcctcaccccgaccgcggccggccggatcgacggggagtgcgccaccaagcccggtcgcctcgccgtccgatcaggccgccgagatcgcccgcctgcggcgtgagctcgaccgtacgcgcatggagcgcgacgtactaaaaaaagccatcggcatcttcgcggagatgcccaagtga

SEQ ID NO: 5181 - DNA, 276 bp, Methylobacterium sp.
atggcccagccgctgtcggccgcaccggtgaagccggccggagccgcgccgaggctcccggccgacgctcaggcctacgtgacgcggcgaaggggctgcaatcactggggtggcgaggacgcctacgacgaggctcgcggtcgggagatcgccgccgcggcgaaggcgctgcgctgcgacgccatcgacgcggacgaggcacgcttgcgccgccgctacggaaaggatccagcggtcctgaaggccttcgacagagcggacggcgagagtggctga

SEQ ID NO: 5182 - DNA, 957 bp, Methylobacterium sp.
ttgaaggcgatggtgttgacgaagttcggcgggccggacagcttcgagctccgggagctgccggaccctcggccgggaccccggcaggtccgcgtggccgtgcatgccacgtcgatcaacccgctcgactgccagatccgtcgcggcgactacgccgatcaggtcgcgctgccggccatcatcgggcacgacgtgtccggcgtcgtcgacgaggtcggatccgacgtgaccgagttccgcgcgggggatgaggtctattacacgccgcggatcttcggcggtccgggatcgtacgccgagtaccacgtcgcggataccggcatcgtcgcgcgcaagccggacaacctcacccattccgaagccgcgagcgtcagcctcgtcggcgtgaccgtctgggaaggtctggtcgagcgggcccgattgcaggtcaccgagaccgtcctcgtccacggcggtgccgggggcgtcggggcgatcgccgtccaggtggcgaaggccatcggcgcgcggatcctggcgacggcgcgcggcagcgacgtggcgcgcgtcgagcggctcggagcctcggccgtcatcgatttcgagcgcgaggactatgtggacgccgtcgatcgcctgaccgggggcaggggcgtcgacgtcgtcctggacacgatcggccgcgacacgctcgcgcgctccccgcgcatcctccgcgaggacgggcgcgtcgtcaccctggtcgacaccgcgacgcctcagaacctcatcgacgcctggggccggaacgccacctaccacttcgtcttctcgcgccagaatggccgcaagctcgatgccgtgacgcgcctcctcgagcgcggcctcgtggtgccgcgggtcggcctggagtttcccctcgacgaggtcgccagtgcccacgcgcgctccgaggagggccggctcggaggcaagatcatgctccgggtgagatcgtga

SEQ ID NO: 5183 - DNA, 477 bp, Methylobacterium sp.
atggacatcgctggcgcgtatcggatcccggtcgcgcgggaggccgtctgggcagcgctgaacgatccggaggtgctcgcccgctgcatccccggctgcaaggagctggttcaggcctccccggaggagatgaccgccaaggtcgccctcaaggtcgggccggtctcggcgaccttcgcgggcacggtccgcctggaggacatgcgccctcccgagggctacagcctcgtcggccagggcaacggcggcatggcgggcttcgccaagggccgcgccgcggtcagcctcgcggcggagggcggcgagacgctcctgacctacaccgccaaggcggaggtcggcggcaagatcgcgacgctgggcggccggctcatgcaggcgaccgcgcgcaagctcgccgacgagttcttcggcaagttcgccgccgaactcggggcgaccggcgactcggccgcgcccagagcggccgaggcctag

SEQ ID NO: 5184 - DNA, 639 bp, Methylobacterium sp.
gtgaagctctggacttgggtcaagcgcggcagcactgcgagcttgcttgctctgacgtttgcccagggcggcggcgcggcggcagagactgcaccgcgatcgggtcgttacggcagcctcgtcctcgcggtgcggggcggcagcgtatcgggcgtcttcgcggacgtgcgcggcgggatcaacggcatgccgtccttcagctgcatcttccttctgcgcggcacgctgtccggcccccgcgcggcgctcgagacttggtacccaggcgaggcggagcgcatcgccggcaccctcaccttcacggcggagggggccgagctgagactggtggaagaccatggcggctgctcgatgacgacgggcagcatggtagacaagccctacaccctgccgcgggaggtgccggaaggcggggcgcgacctgagaactggcgcggtgtcggactggtgaccgctcgacgcgccgctctccggaccgagttcggccaagccccgagacggatcccttatcttgtggcggacgacgcggtcgtggtgctggagcgccgggagggctgggtgcgggcgctctaccaaggcggcaaggcgcccattgttggatggctcccggcgacggacctagccgtcgaggagccgtga

SEQ ID NO: 5185 - DNA, 1557 bp, Methylobacterium sp.
atgcagcgggcccgatcgcgccggcgcctcgtcggcgcgtgcctcgccctcggcctgatcgcggccggacccggagccggatccgcaggcacgctcacgcgggcgcaggtcgaggcgcagctgccggcgctggaggcgctggcgcagcgggccgtcgacgcgggcgcggtgccgggcctcgcggtcgcggtcgtcctcggcgacgagacgctcctcctgaagggatacggcctcaggcaggccgggaagcccgagccggtcggccccgacacggtcttccagatcgcctccctgtccaagcccgtcaccgcgacgatcgtggccgccctggtcggcgacggggtggtcgactgggattcgcgcgtcgcggatctcgatcccgccttccagctgcacgagccctacccgaccgcgcaggtcacggtgcgcgacttcctcaaccatcgcagcggcctgccggggaccgccggcgacgatctggaggcgatcggcttcggccgcgacgcgatcctgcaccggctgcgcctcgcgccgcccgcctccagcttccgcgccggatacgcctacagcaatttcggcttcaccgagggcgcggtcgccgccgcgaagccgaccggccagccctgggaggcagtggcccgggaccggctgttccggccgctcgggatgaccgccaccggcacgacccacgcggatttcctcagccggcccgaccgcgcggcgctccacgtccgggccggcggcgtctggaccgccaagatcgagcgggatcccgacgcgcaggcgccggccggcggcgtcagcagcgatgtccgcgacctctcccgatggctccagctcgtgatcggcaagggccgtttcgagggcgcgcaacgcgtcgcggcccaggccctggcgcagacgcacgtcccgctcatggcccgcggccgcaaccccgtgaccggcggcgcgtccttctacggcctcggctggaacgtcgagtacggccgccacggcctcgtctggggccacgcgggcgccttcagcgtcggcgcgcagacgctcgtctcgatccatccggaggccggcctcgggatcctcgtcctgaccaacgccttcccgtccggcgtgccggaagggctggccgacagcttcgccgacctcgtcttcgacggccgcgtcggccgggactgggtgacggcctggggcgcggcctacgagaacctgttcgcgcccggcatcgccgccgacaaggcggcctacggcacgccgccggcgccgcccgccgcgcccctggcgctctcggcctatgccgggcgctacgccagcgcctatgtcggcgaggccgtggtggcggaggcggacggcgccctgacgctgacggtcggcccggcgggcgcgcgccgctaccccctccggcacttcgaccgcgacctcttcctcagcttcccggacgccgaggcgcccgaccgcccctccgccgtccgcttcgccatcggcagcgacggccgggccgcagccgtgacggtggacgcgctcgacgcgagcgggctcggcaccctcgcgcggcgagactga

SEQ ID NO: 5186 - DNA, 327 bp, Methylobacterium sp.
atggatcagtccgcagccgccagaacggaccaccccgcgaccgaacaggaccctctcgccgagttgccggcgggcgatttcgtcaggcgatggcggcagatcaccggcgagccaccggccattctcctgagttcacggtccgagatgatcgcgctgctcgtggagagcgtgcccatggctcctctcaccccgcagggcgagatccccggcacggcagagtccgcggaaacgccatttcaggatcgcggctcggacgggcccgacggggcggcctcgggatcctccgcgcgcagtgagcagcgaagcgcgagccacggaccggcctga

SEQ ID NO: 5187 - DNA, 696 bp, Methylobacterium sp.
gtgggcaaggaggatcgcggggtgacggtcacggagatcgagcgggcggaggcgggcccgcggcgcggcgggcggccgacccgggctgaggcggcccggcgcgaggcgcacctgatcgcggtggcgacgaccctgttcctggagcgcggcttcgacgccacctccatcgacgcggtggccgaggccgccggcatgagcaagccgacggtctacgcgcgctaccgcgacaagcgggccctgttcgaggcggtcctgcgcgagcggatcgccgcgtggctggcgccgctctcggcggccgccgaggcccaggccgcgcagggcgggagcgatgacgtcgagaccgccctggaggatctcagccgcaccctgctggcccacgggcagtcgccgggcgcggcgatgctcaagcgcaacctcgtggcccaggcgctgcagtttcccgaactcgcccgcctcgcccacgaggagggctggctgcgcggcgtgcgcgcggtggcgcagctgctcgacgccttcgcgcggcgcgggcggatcgccgtggcggatcccgagatcgcggccgacctgttcctcagcctcgtcctcggccggtcgtcccaggcgaccctctacggcatcgccaccgacccggaggcgcaggagcggcggcggcaggcggcggtgcggctgttcctcgacggggtgcgcccgcgctga

SEQ ID NO: 5188 - DNA, 357 bp, Methylobacterium sp.
gatgccggcgccgtggtccgcgcctacgatcccgagggcatggagcaggcgcgaccgctcctgcccggcgtcgccttcgcggaggacgcctaccactgcgccgagggcgccgacgcgctggtcctcgtcaccgagtgggacgcgttccgggccctcgacctcgaccggctgcgggcggcgatgcagcgaccggtcctcgtggatctccgcaacgtctaccgagccgccgacgtccgggcgcacggcttcgcctacagcagcgtgggccgccctgacgagcccggtgaccagcccggtgacgagtccgggatcccgccggttctgccccccgcggacgccgtcgccgggaccgcgtga

SEQ ID NO: 5189 - DNA, 2385 bp, Methylobacterium sp.
atgtcatctccgagctccggtcgcacgctgttcttcttcgagaagccctcggcgatgcgccagttgcagcgcttcttccgctcaccgagcacggtctgcgtggccgccgagggacacctgctgtcggccgaggagccgggcagcatccggcccgagtggaagccctggcgcttcgacctcctcccgatcgtccttcccacgatccccgtcggctacggcacgaaccggtccgggcagtcgcacgcgccgaagatcgccgcgatccggcaggcgctgagcggcgtggaccgcgtgatcatcgccacggatccgggtcgcgagggctcgatgatcgcgtgggaagtgctcgagcatctcggctggagcggcagggtcgaccggctcaagctcggcgcgctcgacgaggtctcgatccgacgcgccttcgcggccctggccaaggatcccgattcgggcgagcgcgactacgccgcctacctcgaggcgctctgccggcagtacgaggactatcatctcggcctgaacggcacgcgggcgatctcgctgcgcctgcgcccgcccgccttccgggagccctggcgcttcggcggcgtgcagacgccgaccctcgccatcctggccgacctggaggagcgaatccggtccttcgtgccgcaggacttcttcaaggtcgcgctgcacctcacgagcgatgcgggcgcggcgatcaccctctggcatgccccgaaggaccggatcctcgacgcggaaaccgccgagacgatccggtccgccgcggcgacgtggtcgggccctcttgcggtcgcgcacagggatgtccggcgcgcgccgccccggctgttctcgaaggacaccctggcgcgacgctgcgccaagcggttcggctgggacccgcagcacacggccggcgtcgcccaggacctctacgatcaggggtacctcagctacccgcgcacggagtcggagcacctgcccgagggccaggccggcgatgccgccgcgatcatctcggccgtcacgaccgtcctgaccgacctgagcgcgatcgtcccgcgcgacgctgcgccgctgatccgtcgcggcctgaaaggccactacgtcgcggatccgggcgagcaccacgctatcgtgcccctgcgcaaggcacccgcgcgcggccgtctcggcaccgatcagttccgcttgtgggaactcgtggcgaaggcctatctcgccgcgcacctgcccgacggggtcgacgcgcgcacgagcgtcacggcggatgtcgcgacaccgctgggcgtgaagcggttcgccgtctccggcagcgtcgtgcgcgcgccgggctggcgcgcgctctacggcagcgaggccgagctcgaagcggatgccgtgcccggcaagaccaagcgcgaggcggaagccaccgccacccgtctgccgctcgtgaccgacggcgagggcgcctccgccgtcgcggcggagatcgccactgcgatgaccgagccgccgcggcgcatcacccgaggcgaattaccggtggtgatgggccggctgatcgaccaagtggacgatccggccgccaagcgcgccctggaaaaccccgccaacccgaacgagccgaagggtctgggtacggccgcgacgcgcgacacgatcctgcccaagctcctgaggagccgctacatcacgctgtctaccggcaaggacccggccatcgaggtcaccgaggtcggcctgaccttcgtccgcgcggtgcgcagcgtgttcccggcctacggagatccggtcgggcgcgccatgttcgaggcggaactcgccgagatcgggcgggcggccacgcgcgccgaggctgtcgctcgtgcgaccgccttccgccagcgcacccgcgcccgcctcgacgaactgatcgccgcgatcgcgcaggcgccgacggtccgcctcgatccgagcctgatcccggccggtcagggcgaccagcggccgccgacgccggccatgatggcgttcgccgtgagcctttccgagcggaagggcgtgacgctgccgcgtggctgccggagcagtatcagcgtctgccgcgcgttcctcgacacccatgccggcccgcgtgccgggcaggaggacgacgccggccgcgcagacggccggcggagcccgagcgcggcgatggtcggctacgcgcgcagcctcgcccagcagcgcggcatcccgtgcccgccggacgcggagacggacttcgacgcgtgccgacgcttcctcgacgcgcacgccgcgcggccagggcaggggagggacgaggcgagcgccggcggggcgacgagcaagcggtccgcggagcgggagaagcggcggggccgtgtgacccggacaccgcgaccggcagcggcacgccggcgggcctga

SEQ ID NO: 5190 - DNA, 873 bp, Methylobacterium sp.
atggatctcgacatccgcgaattcgaagaggtctgccgcgacctctacgtccgcgccctgaagatcctgccgcccgacatcaaggcgggcttcgccgacctgcagcgggccgagaccagcgccaccggccgcgccatcctcgacacgatggtggagaacgtcgcggtcgcggagcgcacgaagaatatcctctgccaggataccggcatcccgatctacaacgtcgtgatcggcgccgacgtgcgcttcgacggcgccgccctgaaggccgcgatccggcgcggctgcgaacgggccacgaaggagttctccttacgctcctcggtggtccacccgatcacccgaaagaacgagcagacctcctgcggcatccgcgtgccgatcatccacgtcgatttcgacgaccggcccgagaccgtcgcggtggagatgatcccgaagggctccggctccgagaacggctcgttcctgcagatgctgctgccctcggacgggatcggcgcggccaagcgcttcgtcatcgaccgggtgatcgagctcggcggccgggtctgcccgccgaccatcgtgggcgtcgggctcggcggcacctcggacctgtgcatgcatctggccaaggtggcggcgacccggccgctgcgctcggtctgctccgatcccgaaggcgcccggatcgaggccgagctgtcgcgggcggtgaacgaactcggcatcggcccgcaggggctcgggggccggtccacgagcttcgccgtccatgtcgagctcgccgcgacccacatcacccagaacccggtcgcggtgaacatccagtgccactcggcccgccgcgcccgcgcgacgctcacgcccggcggcatcgcgttcgattga

SEQ ID NO: 5191 - DNA, 657 bp, Methylobacterium sp.
gtgccgaccggccggcggctgacgccggaggcccgcgagcgccagatcgtcgagggcgcggtcgcctacttcgccgaggtcggcctcgacgggcacacccgggagctcgcccgccggctgggcatcacgcagccgctgctgttccgctacttcccgaccaaggcggcactgatcgagcggatctacgaggaggtctatctcaggcgctgggatcccggctgggaggcgacggtgcgcgaccccgcgctccccgtcctcgagcgcttccggcgcttcgagatcgactaccagcgccggatcgacgactacgcgtggctgcggatcttcgtgtcggcgggcctcaaggggttcgatctgccgagccgctacctcggcatggtccgcgcgcgcatcttcgcgccgctgctcgccgggatgcgcgccgagtcgaacctgccggacccggaggtgcagccgctcgccgcggacgagttcgagctcctgttcggcatccacggcgcgctggtctacgtcggcctgcgctcgcgggtctacggcatggacggcacggcggaccgcgacgcggtccgggccgccatgctcgacgccgcccttccggggctgctcgccacccaccgccgggtggtgacggcggcgcggtcgtccggcgccctctag

SEQ ID NO: 5192 - DNA, 453 bp, Methylobacterium sp.
atgcctgatctgcccgcccgcttcgccgagctcatcctggcgttcgcgccactgttcgtccaccgctcgtggcgacacgcgcaactgctgctgatcggtgcgatcctgaccccggggcggcgcacggtggcgagtgccctgcgcatcatgggtcgcgcgcaggatcggcggttcgtggacgttcaccgcatcctcaaccgcgccgcgtggagcccgcgtgctggcggccgtatcctgctcgggctgctgatcgccgctttcgctccacgcggtcccgtcgtcttggctctcgacgacacgatcgagcgccgccgcggcaagcggatcgcggccaagggcatctaccgcgatccggttcgctcctccgacagccatttcgtcaaggcgagcggcctgcgttggatgagcctaatggtgctcgccccgatcccctgggcggggcgcgtctgggcg

SEQ ID NO: 5193 - DNA, 921 bp, Methylobacterium sp.
tggatgagcctaatggtgctcgccccgatcccctgggcggggcgcgtctgggcgctgccgttcctgaccgcgttggtgccgtccgagcgcgcctgtcgcgaacgcggccgtcggcataagcctctgctcgatgtcggacgccaagtcgctctccaggctcgccgctggctgcgcgcacgcgacctcgtggtggtgggcgacagcggcttctcggccttgctgttcctcgacgcgatgcgccgcgcccgcatcacgacgatcacccgcctgcggctggatgcctctctctacgagccggccccaccgcggccgcccggcacgattggacgcccgcggaccaaaggcgcgcggctgccgacgctcgccgcgatcctcgcggccaaggacacgcgctggcacgcggtcgtggtgctcggctggtacgaggcgggcgagcgcacccttgagatcgcctccgggaccgcggtgtggcggcacggcggtctgccggtcgtgccgatccgatgggtgctggtgcgcgatccagagagccgttttgcaccgcaggccctgctctgcaccgaaccgatgcgcgagcccgcgcagatcgtgggatggttcgtgcgtcgctggaccgttgaggtcaccttccaggaagcgcgcgcccatctcagtgtcgagacgcagcggcagtggtcggacaaggccatcgcccgcaccacgccctgcctgctcgccctgttctcaatcgtcacgctgctggctgcacggctcccagtccgccaacggcaacggatcgcggccgccgcgtggtaccccaaaccgcgcccgaccttcgccgatgctctggccgccgcacgctatgcgatctggcgggagcggactttggcaatatcaccgcgccgacgcgcccgaacaaaaccccgcttccgtttgccagcg

SEQ ID NO: 5194 - DNA, 903 bp, Methylobacterium sp.
atgctgatggacctgtcggacgtcgcgctcttctgctccatcgtctcagccggaagcctgtccgccgcggggcggctgtcgggtcattcgccgatggcggtcagccgccgcctagttgccttggaggcggagctcggggtgcgccttctccatcgcaccacccggaccatagccctgacagcggatggcgagacgttcctcccgcttgcccaagccatgctcgacgcgaaggccgccgccatggcggctttctcggagcgtcacgaaggcttaagcggcgtcctgcgcgtgacagcgcccaaccggatcgggcgtgcgctcgtggtgccgcaggccgtacggctgatggctgagaacccactgctccacgtagacctgatgttcagcgacaggatcgtggacatcgcggcatccggcatcgacgtcgcgctgcgggtcgccacgctgcaggcatccgagctggtcgccgtgaagctggccgacaacccacgcatcctctgcgccgcgccgagctacctcgcaagacatggacgccccgaacggctcgtcgacctcgacgatcacacttgtctgacgctgcacgcgatggacgcgtggccgttcacccagggcgggaagcccgtcgcgaaacggatcggcggccgcttggcggccaacagcgtcgatacggttcccggcgcctgcgttgccggcgccggtctcgcgctcctgacttactgggacgtggctcgggacctgaccgacggcacgctcgtcgaggtcaccctgaccgataccgagcccgagcggctcgccatttgggctgtactcccgaccaagcaacacacgcccgcccgcgtgcgcaggttcctcgacgtcatgaaagaagaactggccgcgcatccacgctcccgaacgccttga

SEQ ID NO: 5195 - DNA, 231 bp, Methylobacterium sp.
gtgacagcggttcacaacgagcagaccaagctgctggcgacggccctgaacaacatcgccgttgcctacgtcgtcatcggcttcgtcacgccgatgatggccgcgagcttcggtgtgccgagtgcaccggcgctgcgcgtcgagaacgcgatcttcacgctcgtttggctggggaccggctgcgcactacattacggtgcgaggcgtgccctccggagcctgaagccgtga

SEQ ID NO: 5196 - DNA, 258 bp, Methylobacterium sp.
gtgccgcgtagccatcaggaagcgaccgccgtgctgccggcctcgcggatcgaggtgagcccgcgccgcggcctgcgtcgcgaggaatcggctcgctacgtcggcgtcagcccctcgaaattcgacgagatggtccgggacggccgcatgccgaagccgaagcggatcgacgggtgcgtggtttgggacctccggcgcctcgacttggcgtgggacgcgctcggcggcgatgatgcggcgtcgaatccctgggactga

SEQ ID NO: 5197 - DNA, 882 bp, Methylobacterium sp.
atgtctctggcgctctcggtcctgtccgggctaggcgctcaggcggagaccgccgggagcctctccacgacgacggccgtcagcggcagcgccgccgcgatgtacaatctcgggatcctctacatcaacggccagggcgtgaagcaggatttcggcacggccggacgctggttcgagaagtcggccgccggcggcgacgtcgacgccatgctcaacctcggcagcctgtactacaacggccagggcgtgaagcaggactacgccgctgcggccgcgtggttcgagaaggccgccctggcgggcaacgccgaggccatgaacaacctcggcagtctctacgatgccggccagggcgtgacgcaggactacgccaccgcccgcagctggtacgagaaggcggcggccgccggtgccgcgtcggccctgtacaatctcggtctactctacgccaacggtcagggcgtcgggcaggattacggcgcggccgcgtcctggttcgggaaggccgccgccgccggcaacgttgacgcgatgaacgccctcggcagcctgcacctcaacggtcagggcgtgaagcgggacgccgccgcggcccgccgctggttcgagaaggcggtcgccggcggcaacgtggacgcgatgaacaacctcggcagcctctacctgaacggccagggcgtgaagccggacgccgccgcggcccgccgctggttcgagaaggcggccgccgccggccacgcggaggcgatgaacaatctcggcttcctctacgtcaatggtcgcggggtgaagcaggatttcgaggtcgcccggcggtggttcgagaaggccgccggcggcgccgcggccgcgaacgtccccggcgacatcgcgctccgctag

SEQ ID NO: 5198 - DNA, 1464 bp, Methylobacterium sp.
atgacgatgaacgaatctgccccgggccaccccatcctgcgcgaggttccgatcggcatcgccgccaccgggatgcggcacgagacggactcgatgggcgggatcgacgtgccggcggaccgctactggggcgcgcagacgcagcgctcgctccagcacttctcgatcggcgacgatcgcatgcccaagcgggtctaccacgcctacggctacgtcaagaaggccgccgccctggtcaacgccgccgccggccgcctggaggattggcgcgcgcaggccatcgtccaggccgccgacgagacgatcgcgggcaagctcgacgcgcactatccgctctacgtctggcagaccggctccggcacccagtccaacatgaacgtcaacgaggtgctgtcgaaccgcgccatccagctcctcggcgggacgctcggctccaagagcccggtccacccgaacgaccacgtcaacatgggccagtcgtcgaacgacaccttcccaaccgcgatgcacgtcgccacggtgctcgaactcgacgaggtcctgctccccaaggcgcgggcgctggccgacgcgatcgacgccaaggcccaggcctggatggacgtggtcaagaccggccggacccacctgcaggacgcgacgccgctgacggtcggccaggaatggtcgggctacgtggcgcagatgcgcgacgcgctggccctcatcgagtcgtcgcgcgccgggctgtacaagctggcggccggcggcaccgcggtcggcaccggcctcaacgccccggagggcttcagcgcggagatcgccgccaagatcgccgatctcaccggcaagccgttcgtcacggcgcccaacaagttcgccgcgcaggggtcgctggacgccatggtcgccgccatggcggcggtgcgcgggctcgcggtcgcgctgatgaagatcgccaacgacatgcgctggctcgcctcggggccgcgctgcggcctcggcgagctgctgcttcccgccaacgagccgggctcctcgatcatgcccggcaaggtcaacccgacccagtgcgaggccctggtgatggtctgcatccaggtgatcggcgaggacaacgcggtcgccttcgcgggctcgcagggcaacttcgagctcaacgcgatgcgcccgatcatcatcaacaacacgctgcacgcgatccgcgtgctgggcgacgcctgcgagaaattccggacctactcggtcgcgggcacggagctcaaccggacgcggatcgacgagaccgtgaaccagtcgctgatgctggtcacggccctgtcgccggtgatcggctacgacctcgcctccaagatcgcccaccgcgccaacgacgagggcacgaccctgcgcgaggccgccctggccgagggcgtcccggccgagcgcttcgacgcggtgtgcgatcccaggaccatgatcggccacgggctggccggcgcctga

SEQ ID NO: 5199 - DNA, 1143 bp, Methylobacterium sp.
atggcaacgatccgaaagcgaacgcttccatcgggcaaggtccgatggctggcggggtattctgatggcggagggaagcgccgcttccgccaattcgagacgaagaaggaggcagacgccttcctcgtccaggcgcgcacccaggtcgcgaccggcgtgcacacgcccgactcggtctcgccgaccgtcgccgaggccgcggagctctggctgaagcgatgcgagcgcgacaagctcgagcggactacgctgctgcagtatcgcggccacctgacccaccacatcgggccccggctcggcgcggtgaagctctcgcggctcacggtgccactgatcaacgagttcgccgatcagctcctcacggccggccgctcacgggtgctcgtgtcccgggtgatggtgagcctgtcttcgatcgtgacggaggcgcagcggcgcgggctggtgacggcgaacaacgtgcggagcgccaaaccggtgcggcgctcatcccgcgaggacaaacggccggagatgcccagccgggacgagctgaaggcgatcattgcggcgacgcctgatcagtggcggccgctcatcctaacggcgatcttcaccggcctgcggggttccgagctgcgcgggctgacatggggcgatgtggatctgaggcgcggcgtgctgagcgtccggcagcgggtggatcgcttcaacaccttcgggccgccgaagtcgaaggccgggacccgggacatcccgctgccgccgaacctgctcaccaccctgaaggcgtggaagctcgcctgcccgaacgggccgctcggcctggtcttcccgacggtagacggtacggtccagggccacgccaacatcctccaccggtgcttctggccgcttcaggtaaaggccggagttacggtgctgaaggatggccaaaatgagcaggggagggcaatcaaggttccggaggcgaagttctcgctccatgccctgcggcatgccgctgcggcgctctggatcgaacaagggctatcgccgaagcgtatccagaccttgatgggccatgcctcgatcgcccagaccttcgatcagtacggctacctgttcgaggcccgagacgatgaagctgccatgatggcgggcgttgagaagggtctgctctga

SEQ ID NO: 5200 - DNA, 1638 bp, Methylobacterium sp.
gtgaggccggccgcggcataccgggccgggcagcgcgccctggcggccggcttcatctcggcgctgctcctcggtcacggcccggcgtcggcgcgcaccttcgtgttctgctcggaaggcagcccggaatccttcgatcccgcccgcgccacgaccacaaccacgatgaacgccgcgtggcaggtctacaatacgctcgtggagttcacgcccggcaccacgacgatccgcccggccctcgccgaatcctggacggtctcggaggatggccggacctacgtcttcgccctgcgggacggcgtccgcttccacgccaacgcgcgcttcacccccacgcgcgccctgaacgccgacgacgtggtgttctcgttcgcccggcagaggcgctccgagcccgacggtgccgcgcagggcttcacctacttccacgatctcggcctcgccgacctgatcgaggccgtcgacgccccggatccgcgccacgtccgcttccggctgcgcgaggccgacaccaccttcctcgccaacatcgcgcaggccttcggcgccatcctgtccgccgagtacgcggccgccctcgcggccggcaacgcgtcggacgacctcgcccgggcgcccatcgggacgggcccgttcgtcttcgaggggtaccggccggatcaggtcctccgctaccgcgccttcccggattactggcgcggcggcgcggacgggagcgaaccgggcgagcggcccgacggtctcgtcttcgcgatcacgccgaacgcggcggtccggctgaacaagctgcgggccggagagtgccacgccatggcgttcccggcgaccggcgacctcgacgcgatccgggcggagccgggcctgacgctgctcgcgctggccgagctgaacgtcgcctatctcgccctcaacacgacccgcgcgcccttcggcgacgtccgggtgcggcgcgcggtcaacctcgccatcgaccggcgggcgatcgtggcgggcgtctacggcgacgcgggaatcctggcgcaggggccgctgccgcccgggatctgggcccacgacgcggacctgccggatacccccttcgaccgcggcgaggcgctgcgcctcctggccgaggccgggctcgccgacggcttcgacgtggacctgtggtatccgccagtcagccgaccctacaacccgaatggccggcgcgtcgccgacatgatccaggccgacctcgcgcaggtgggcatccgcgcgcgcccggtcacgcgtccctggaacgcgtaccgcgccgccctgtacggcggagagcccacgctgatgctctacggctggacgagcgacaacggcgacccggacaacttcctgaacgtcctgctcggctgcaaggccgcccagaccggcggcgccaacctcgcccgctggtgcgacccggcctacgaccggctggtcgaggccgcccgccgcaccggcgaccgggaggcgcgccaggctctgtaccggcaggctcaggccatcgcccggcgcgccatgccctgggtgcccctggcccacacaaaggtgcatctggcgctccgcaacgacgtgctgggcctgacgatggatcccctcggccgccacctgttcgagacggtgcggttccgcgatccccgctga

SEQ ID NO: 5201 - DNA, 723 bp, Methylobacterium sp.
atgagcagcactctccaggaccgcagcgtcgtcgtcttcggcggcacctcgggcatcggcctcgcggccgcccgccaggccgaggcggcgggcgcgtcggtcatcgtggtcggccgcgacgcggcgggcgccgagcgcgtcgcggcggagaacggcttcgccggctggcgcgccgccgacgtgacgcggcccgagacggtcgcggccgccctggccgacatcccccgcgtcgaccacctcgcgctgatggccggcaccttcgtggccggcaaggtccgcgaggccgaggtcgaccacctgaagcgggccttcgacgagcggatctgggccgcggcttatgccctgcgcgccctcggcgaccggctggccggcgacggatcggtcacgctcatctccggcgccctggcggaccgtccgaacgcccaggggaccgccgtgctggcggcggcgtcggccgcgatggaggcgttcgcccgcggcctcgccctcgaactcgcaccggtgcgggtgaacgcgctctcgcccggcaccaccgacaccccgctcctggcccgcacgctcggcgcccaccgcgacgcctacgtggccggcctcaccgagcggctgccgcagcggcgcctcggcaccgccgaggaggccggcgcagccgtcgtcttcctgatgggcaacggcttcatgaacggcgagaccctgcacatcgacggcggcggccgcctgatctga

SEQ ID NO: 5202 - DNA, 1767 bp, Methylobacterium sp.
ttgtcgtggttctgggggctcgggtttttctacgcgatccatgtcacgctgacatacggctggctcgggtttcttgccttcgccttgccgaacgcgaccggtctcggcctgttcggctggatgctcggcgcgccccgtcggaatctcgacgcgatcgtggccgccgtgcagggcccctacgccctcctgttcatgggggcccagttcttcgccgtcgcgatcacgatcttcggtttcgcggcctacgcgtggctccccctgttcggccacgacgccgccgtgggcgtgatcgcgctggtcctcgtcgcctgctcgctcggccacgccgtcccgctgcgcgggatccgcatcgtccattgcggagcgctggcggtcgggctcgccgcgagcgtgatcctgctcggcggtctgtccgcgcaccgggacggctggcaagtcccgctgcaggccttcgacgagcgcttctacgggctcgtcgtcccctcgctggtcggcttcctgctcggcccctggatggacatccagcattggcagcgggcggtcgagatccggcgctcgggcgggtcggtgcgcgcggcctacgtgaccggcgcgctcctgttcctcggtctcctgacgatcaacgcgctcatggccgcgcgggcggggctcggcatgccggtcgtctcgtccgacggcctgtcgggagcctacgcggccgtggcgcaggcgatcgggcgcgaacccgcgaccggcgtcgcggtggccttcgtgatctggacggcgatcgccgccgcgaccacgatcgacagcttctacagcgccacgcgctggctcgggatctcggtcacggcacgcagcaattccccactcctcgccttcgtgccggccggcctcgtggcgtcgccggtctggatcctcggtgccgcgctcgccacagcggcggcggcgatctgggcgaacctctcgctcctctacctgatgatgcccttcgccacgctcctcgtcggggcggcggcgtgtctcgtgtgcgagtcgctcggcgcgacccgccgctacgacccggtcctcacatccatgatcggggcgacggcgtgcctgatcttcgtgacgggctatctggccccgagctgggcgctgctggccatcgcgccgctgatcggcctgatcggcgcactcccgatgatcgcggaggtcctcggctggcgcgcggcgccgccggtcgcggagctgatcccggcggcggagcgggcgccgcgggcggcgccggtgcccgtggccgtggaccagaccgacgccgtcgcgtcgcacgggttcgacgggcactggttcgtcctgcgcctcatcccgacctacgacgacaccaactcggtcgggaacgtctacttcgccaattacgtgcgctgggtcgggaaggcccgcgagctgttcttcaacatctgcatgccggatttcgatctgaaatcgacggacttctacatcctgacgaagtccttccagcacgacttccgccgggaggcgatggagttcgagccggtcaccgtccgcatctcgatcgcgagccacaaccggaagtttgtgaccctggcgcacgagatccacagcgaggtcaacggcctcctcggccggggcgagcagtcgctgatgttcgtggacaccgtccactatcgcccgctcgatattccgcgggcgatcatcgagggcttcctgccctactggccgaaaacgtccccgcacgccgtcgcggacgggagcggcccgaccggcgtggcgccgctcggcgtctga

SEQ ID NO: 5203 - DNA, 729 bp, Methylobacterium sp.
atgcagacacctaccaacatcgtccggtttcgtcagcctgaggacatcgacgatcccctgacggacgtgctgcgcgccggtgcccgccgcctgctcgcccaggccgtggagctggaagccgaggcctttctgagtgcaatgcaggatcttcggctgccggacggacgcgcacgcctcgtgcggcacggccatggcccggagcgggcgatccagaccggcatcggcccggtgccggtggcgcgggtccgtgtgcgggatcgcggtgcgagcgggtccgaggaccggatccggttcacctcggcgctcctgccgaagtgggcgcggcgcacccgcagcctggatgcgctgctgccggtgctgtacctgcgcggcgtgtcgaccggcgacttccaggacgcgctggccgcccttctggggcgtgacgccccaaacctgtcgccggccgtcatcgcccggctgaccacgacctgggcggacgagtacgcccgctggcagggccgtgacctctcggcccgtcgctacgtctacgtctgggctgatggtgtctacctgcaggcccggatggaggagcaggccgagtgcatgctcgtgctgatcggggcgacgcccgagggtcgcaaggagctcgtcggcttccaggtgggcgtgcgcgagagcgcccagagctggcgcgagctgctcgtcgacgtgaagcggcgcgggctgtcgatcgcgcccgagatcgcggtc

SEQ ID NO: 5204 - DNA, 702 bp, Methylobacterium sp.
atggagacacctaccaacctcgtccgacttcgtcatcccgaagacctcgacgatcccctgaccgaggtgctgcgtagcggcgctcgccgcctgctcgcccaagctgtcgagatggaggcggacgcgttcctgagcgcgatgcaggacctgcggctgcaggatggacgggcccggctggtgcggcacggtcacgggccggagcgggcgatccaaaccggcatcggcccggtgccggtcgcgcgggtccgcgtccgagaccgcggcgcgagcgggtctgaggaccgggtccggttcacctcgaccatcctgccgaagtggacgcggcgtacccccagcctggatgcgctgctgccggtgccgtacctgcgcggcatctcgaccggcgacttccaggacgcgctggccgccctgctgggtcgtgacgccccgaacctgtcgccggccgtcatcgcccggctgacggcgacgtgggcggatgagtacgcccgctggcagggccgcgatctctccgcgcgccgctacgcctacatctgggctgacggcgtctatctgcaggcgcggatggccgagcaggcggactgtatgctcgtgctgatcggggcgacgcgcgagggcaagaaggagctcgtcgggttccaagtgggtgcgcgcgagagtgcccagagctggcgcgagttgctcgtcgacgtgaagcggcgcggg

SEQ ID NO: 5205 - DNA, 240 bp, Methylobacterium sp.
ctcgtcgacgtgaagcggcgcgggctgtcgatcgcgcccgagatcgcggtcggcgacggcgcgctcggcttctggcgggccttggacgaggtcttccctggcaccgctcaccagcggtgttgggtccacaagacggccaacgtcctcgacaaggtgccgaaatccgtccagccggccatgaaggcggacctgcgcgagatccacggcgcgccgacccgggcggcggccgaggcggcgctg

SEQ ID NO: 5206 - DNA, 219 bp, Methylobacterium sp.
gacctgcgcgagatccacggcgcgccgacccgggcggcggccgaggcggcgctggccgtcttcgtcgagaagtacggggccaagtacccccgcgccgccgcctgcctgaccaaggatcgtgacaggctgttggcgttctacgacttcccggccgagcactgggatcacctgcgcagctcgaacccgatcgagagcgtgttcgctacagtgcggcatcgg

SEQ ID NO: 5207 - DNA, 2565 bp, Methylobacterium sp.
atgaacgtcaactcggccggcaagcgcccgattatgccggcctgggaacgtcgatgcctcgacgcctcgccggaggagatagctcgctggggcaccctctaccccgagagcaccaacaccggcctgctgtgcgggcatctggtcggcgtcgatatcgacgttctgcaacccgcgctcacggacgccatcgctgatcgcgcgcgccgcattctcggaccgacgccgctggagcggatcggtcgcgagcccaagctgctcctcggctaccggctcgcggttccggccgacaagatccagacggccgcgctccacttcaccgacgacccgcaggagaagccaaccaaggtagaggtgctgctgcggggccagcaatttgtggcgttcggcattcatcccgagaccgccgcaccctaccgctggcctgacgcctcgccgcttacggtcgacttcgccgaccttcccgagaccactgaggaagccctgcggctgttcgtggccgaggcggaggtgatcctgcgcgaggctggtgcggccaccaagcgtgagcgcaggcagaccgagcgcgcccgcgagaccaaaggccgccgcgcggccgggttcgggctcaacgagaagccaaaccgcgagaccatcgccgacgcgctgcgcagcatcccgaacgattttgactatgacgggtggatccggattgggttcgctctctacgacggcctgggggaggccggccgcgacctctgggaggactggtccgcgacctccccgaacgatgacgcggcgttcacatcgcggaagtggtcgagcttcgccggcggccggtccgtgaagatcgccaccctgttctggcacgctgccgagaacggatggcgtcggcctggcgctggccgatccggtgcgccgaagcgcgatcgtgctgagcgccgcgctagcgccgacccggaagccgagatcagcggggaggacgacggtcgccccgtcgtgcggttcgtcgctggcaaggtgccggaggcggtcgaccgcatggaggcgctactgctggcgtcccccgtcgagatctactctcgagccggcgcgctcgtgcggcccgtgatcgacgcggtgcccgcggccaagggccggatgacaacggtggcgcgtatgtgccccctcaccaccgtcagcctcgcagacatggcagccagaaccatgcggtttcagaggtacgacggccgcgccgaagactggctggacatcaacccgcccgtcgagatgacggcgacgctcctggcccgcgaggggcaatggcgggtgccggcggttgcgggcatcatcaccacgccgacgctgcgccccgatggctcgctgctgacggtcgcaggctacgacttggcgacgcggctctaccttgccctggatcccggcttcaccatgccgaagctgacggagcggcccgataagcgcgaggccgctgaagcgctgggcttcatcgagactctgttggccggcttccccttcgttgggccagttgaccgcgcagttgcgctatcgggcgtcctcacggctctggtccgcggcgtcctgccgacggcaccgctgcacgcgatccgcgcctttacccccggttcggggaaaagctacttggtcgacctcgctgccgtcatcgcgaccggccggcgctgcccggtgatcgccgccggcaagaccgaggaggagaccgaaaagcgcctgggcgcgctcctgcgcgatgcggtaccggtcgtgtcgatcgacaacgtaaacggcgagctgggcggcgacatgctctgccagctcacggaacgccctctcgtccgggtacgcatcctcggcaagtccgaggctccggaactcgagtgccggtcgaccaccttcgccaccggcaacaaccttgtgctgaccggcgacatgacccgccgtgcgctggtctgctccctcgatgctgaggtggatcgccccgagctgcgggacttcgactttgaccccattgcgacggtgctggctgaccgtggggcctacgttgcagcggctctgaccgtgatccgcgcctatcgcgtggcgggatcgccgtccgtctgcggggccatcggctcctatgaggactggtccgacatggtgcgctcgcccctcgtctggcttggccatgcggacccggtggcgagcatggagacggcccgcgaagaggatccggagctgtccgcgatccgcgagctgttcgagcactggcggtctcatctgcgcctatcgagcgggtacaccaccaacaccatcatccggacggcctgcgatcgggatgcgggcagccacttcgccggtcccggcgatttcaagctggccgagttccgcgacctgttgctacggcaggccggtgacggcggggcagtgaacagccgccgcctcggcaaatggctgtcccggatcaagggccgtgtggtcgacggccaccggatcgagatgaaggctgacgcgagcaacggcaaccgcttctcgctctgccaagtcagcgtccccgagtaccccgcaggcagcccggtcgcagccgactaccgcgcctcttcggcaccggagttctga

SEQ ID NO: 5208 - DNA, 384 bp, Methylobacterium sp.
atggacatggccgagcgcttctcccagatccgaaagataatgccacctgccagttgcgccgtggcctcttggtatcctggtgcggatctcgtcgatgccttcgcggtgacgcttcccggaccgaggccgcatgacctgtcgaggctggctcaagccacactcttaaacccgccctcctggatcacggcggctatgacagtgcgtgacgcggcggtgagccttttcggcgttcgaacgtctggggagataaggggccgcctgaagaccgacagccgtgaccggatcgacttcttcccggtactctcacggtctgagcgcgagatcgtcctgggcgaggatgaccgccatctcgattttcgcctgtcgcttcttcttagggtgtga

SEQ ID NO: 5209 - DNA, 807 bp, Methylobacterium sp.
atgtcgcgcgcaggcatccgccggacctacggcgccatctcgggcgcggtcctcgtcttcatcgtgctgccgctggtggtcatcgtctgggtgtcattcttcgccaaccgcatcctcgccttcccggcgagcggctacaccctcgactggtacgcgcgcgccctcgacacggacgcctttcgcgatggcttcgtcaccagtgtggagacggcgctgttcgccacggcggcgagcctcaccctcggcgtgccggcgagcctcggcctggtgcgcggccgcttccccggccgcgacgccgtgcaggccctgctgcttgcaccgatggtcgtacccggcatcgtcggcggcgccgccctgttcatagccttcatcgaggtcgaggcgctgctcgacatccaggtggccggcacgctcggcggtctgctcgtggcgcacacgctgatcgcgctgccctggaccatccgtctggtcagcgcgtccctcgcgtcggccgatcgggcgatcgaggaggccgcggcgagcctcggagccgacccgctcaccgtgctgcggcgcgtgacccttccggcgatccggcccgcgatcgtcgcggccgccctgttctccttcgtgatctcgttcatcgatctggagaagtcgatcttcctcgtcggcccgggacgcacgacgctgcagatcgccctggtcaactacctcgaatggaacctcgacgggacggtcgcggccgtcgccgccgtccagatcctgatcgtcgggacggcgctcctcgtcagcgaccgctacgcgcgtctcgcccaagccttctga

SEQ ID NO: 5210 - DNA, 1842 bp, Methylobacterium sp.
atgagcccgtctcaggaggagcggatcgcggccgagcagttgcgcctcgtcctggacggcgtgacgcagtcggtcgccgtcggtttcctcgtctcgacgctcatgctggccgtgctgtggagcctggtgccccacgccgtcctgctgagctggtacggcgcgttcctcgtcgagcggttcggggcggcggcctacgcgcatcgggtccgcgccgcgatcggcgagcccgaccgcgcccgccgggtcgagcgcgtcatcttcctgagcaagatcgtcgagggcgcgatcctgggatcgctgatctggatcgcgctgccgctccaggtcccggcggtgagcatcctgaccatgtcgctgctgggcgcgacctgcagcaacggcgtctcgctcctggcgccgcggcggcacctctacctcgccctcgtcgtgcccgtcgccgtcctggccgcgggaaccctctggtcgctcggcggcgcgccctaccgcgccctggcaatctgctcgatcctcttcgtggtcgggcagtacggtcaggtcgtgctcgccagccgccgcgtgcgggaatcgatcgagctccgcttcgagaacgcggccctcgtggagcagctgcgcgcggagaccgccgcggcgcaccgggcccgccgcgacgccgagcacgccaacaccgcgaagtcgcagttcctcgcggcggccagccacgacctgcgccagccggtccacgcccagggcctcttcctccaggcgctgagccagacggatctcgccgcgccgcagcggcggatcctgcagaacgcccagaccgcgaacgtcgcgtcgaccgacatgctcaacacgcttctggacttctcgcgcctggaggccggagtcatcacgccgcggccccgcgccttcgagctgcagccgctcctcgacaagatcgagaacgagctggccccgctggccgacgccaagcgcctgatctatcggacgccccagacggacctggcgatcgtctcggacgcggccctgctggagctggtcctgcgcaatctcgtcctcaacgccatccggtacaccgagcgcggcggcgtcctcatcggctgccggcgccggcgcgcgggcgtgtcgatcgaagtctacgacaccgggatcggcatcccggccgacaagcgcgaggacatcttccgggagttctaccagctcgggaatcccgagcgcgatcgtcacaagggtctgggactggggctggcgatcgcgcgcgggatcgccgcctcgctcgatcacccgctctccctctcgtcgaaggtggggagcggcagcgtcttccgcatcctcgtcccccggacgctcgacgccgggcgggacgccgggctcgacgacgcgcccgcggccgccatcgcggagagcggcggcctggtcggcgcccgcatcctgatcgtcgacgacgatgccatcgtccgcgacgcgatggtggcgctcctctccggctggggttgcctgtgccgggccttcgaggacccgaccgacgtcaccgacctgccgccgcaggggccgccgccggacgcgctgatctgcgactaccgcctgcgcaggggccagaccggcgccgaagccatcgcgacgctgcggcagcattggggacggccgatcccggcgatcctcatcaccggcgacaccgcgcccgtccgcatgcgggaggccttggacagcggggtccctctgattcacaagccggtccggcccgaccttctccagaaggcgctcgccgcgctgatcccgcccggccggccacccgtcggtcccgtgggcgcggaggttcggcgcggaccggagacgacggatctcgtccgcgcggagggatag

SEQ ID NO: 5211 - DNA, 807 bp, Methylobacterium sp.
atggctcacatcgagacggccgcgcccccgctcctgaagatcaggaagctgcacaagagctacggcaccaacgaggtcctgaagggcatctccctcgacatccacgagggcgaggtcgtgtcgattatcggtgcgagcggctcgggcaagagcacgttcctgcgctgcctgaacctcatggagacgccgacctccggcttcatggatttcgagcgcttcgccttcgactacgagcagggcgcccgccgccagccgacgccgcagcagctctgcgagttgcgggcgcggatcggcatggtcttccagagctacaatctctggccgcacatgaccgtgctggagaacgtcatcgaggcgccgatccgggtgcggcggatgccgcgccggcaggccgttgcggaggcggaggcactgctccagcgcatcggcctctacgagaagcggcacgcctacccgtcgaagctctcgggcgggcagcagcagcgcgtggcgatcgtgcgcgccctggcgatggcgcccaaggtgatgctgttcgacgaggtgacctcggccctcgatccggagttggtcggcgaggtgctggcgctgatgggctccctcgcggcggacgggatgacgatgctgctcgtcacccacgagatggccttcgcccgggatgtcggcacccgcaccctgttcttcgacggcggcgtgatcgccgaagacgggccgcccgacgccatcatcggcgcgccccggagcgagcggctgcgccagttcctccggcgcgtcctgcaccagcccgccgcgccgggacagacggcgtga

SEQ ID NO: 5212 - DNA, 423 bp, Methylobacterium sp.
atgcagcagcagatctcggtcatcacgctcggcgtctcatcgctcggccgctcgcgcgccttctacggcgacggcttcggctgggctcccgtgttcgagaacgacgagatcgtcttctaccagatgaacgggttcatgctcggaacctggcagaaccccaacctcgaccaggatatgcggcgcgcgagcgaaccgagcccgagcgcgttctgcctcgcccacaacgtcccgaaccgcggcgacgtcgcgcccaccatcgcgcggctcatcgcggcgggcgggacgctcctgcgcgcggccgacgaaccgccccacggcggattccgcggatatctgagcgatccggacggacatgcctgggagatcgcctggaacccggcctggcggatcgatgcgcgcggacttgtgacgttcggactctga

SEQ ID NO: 5213 - DNA, 381 bp, Methylobacterium sp.
gtgacatcctcgaccggacaacgacccgccgtcctgctcattgaggacgaggcgatccagatgatggtcctgtccgacctcattgaggaggcgggctgcgacgtcgttgaggcgacgacgaccaccaaggccatccagatccttgagaaccggccggacatccggatcgtcttcgccgacctcgacatgcgcggatcggtgatggggctgcgcctcgcggcgctcatccgggaacgttggccgcccatcgagttgatcctcaccggcgcggtcaagcccgacctgtcgagcatcccggcgcggggcgtgtttcacgacaagccgttccagcaacgcaagctcgtccagtgcatccgcgagttcgcgtcggtcagccaatag

SEQ ID NO: 5214 - DNA, 414 bp, Methylobacterium sp.
gtgcccgagctcaacgccatcctggagacggcgctgtacgtcgcggacctcgaccgcgccgaggccttctatcgcgacacgatgggactgcgctgcctcttcaccgacttccgcatgcgcgccttcgacgtcggcggccgcggtgtcctcctgctcttcccggagggcgggtccctgcagccgatcgagacgccgggcggtctcataccgccccatgacggccgcggcccggcccatatcgcgttctcgatcgacgccgacgccctcgcgccctgggaggaccatctcgcggccgccggcgtggccgtcgaagggcgcacccgctggccgcggggcggcgtcagcgtctatttccgcgacccggacgggcacctgctcgaactggccacacccggcctctggaagggctactga

SEQ ID NO: 5215 - DNA, 1200 bp, Methylobacterium sp.
atggcacgacgcaaagcaccccgtattcctgatgcgatcctggaccagcttctggccggtgcggatccgaagacggccttcgaggccgatggcctcctggacgagttgaagaaggctctggccgagcgggcgctcaacgccgagatggaccaccatctggcgggcgaggacgctggcaacacgcgcaacggctatggccgcaagacggtcacgaccgagacgggccggatcgagctggcgatcccccgcgaccggcaggcgacgttcgatccgcagctgatcgcctggtatcagcgccgctttcccggcttcgacgacaagatcgtgtcgatgtacgcgcgcggcatgagcactcgagagatcgtcgcgcacctgcgcgagctctacgggatcgaggtctcacccgacctgatcagtgcggtgaccgacgcggtcctggaggaggtcgccgcctggcaagcccggccgctggagccggtctacccgatcgtgttcttcgacgccctgcggatcaaggtgcgtgacgagggcgtggtccgcaacaaggccgtccacatcgcgctgggcgtgcgtgccgacggctccaaggagatcctcggcctgtggctggagcagaacgagggcgccaagttctggttgcgggtcatgaacgagctcaggaaccgcggcgtcgaggacgtgctgctggccgtggtcgatggcctgaagggcttccccgacgcgatccgggcggtgttccccgaggcgctggtccagacctgcatcgttcacctcctgcgccacagcctcgacttcgtgtcctacaaggaccgcaagctcgtggcgggggcgctgaaggacatctaccgcgcgctcgatgccgcggctggcgaggcggcgttggcggccttcgaggcgagcgaatggggtcggcgctacccggccatcgctcagagctggcgacgagcctggggcgaggtgatcccgttttacgccttccccggcgaggttcgccggatcctgtacaccacggatgagatggacaagacccatcgcgccttccgtggtagttttctcagggcgcgggcgacctcgtggcgaagcgcggggcctcggctgcaagccccgccgggccgccttcattcgagccttgccgatttgaggcgtccgcgcaccgtcttcgatgggcgcggcgtccagtgcgctacgacccgctcgtag

SEQ ID NO: 5216 - DNA, 1221 bp, Methylobacterium sp.
atggcacgacgcaaagcaccccgtatccctgacgcgatcctggaccagctcctggccggggccgatccgaagacggccttcgaggccgatggcctcctggacgagttgaagaaggccctggccgagcgggcgctcaatgccgagatggaccaccatctggcgggcgaggaggccggcaacacgcgcaacggctatggccgcaagacggtcaccaccgagaccggccggatcgagctttcgatcccgcgcgaccggcaggcgacgttcgatccgcagctgatcgcccggtatcagcgccgctttcccggcttcgacgacaagatcgtgtcgatgtacgcgcgtggcatgagcacccgggagatcgtcgcgcacctgcgcgagctctacggcatcgaggtctcacccgacctgatcagcgcggtgaccgacgcggttctggaggaggtcgctgcctggcaggcccggccgctggagccggtctacccgatcgtgttcttcgacgccctgcggatcaaggtgcgtgacgagggcgtggtccgcaacaaggccgtccacatcgcgctgggcgtgcgcgccgacggctccaaggagatcctcggcctgtggctggagcagaacgagggcgccaagttctggctacgggtcatgaacgagctgaagaaccgcggcgtcgaggacgtgctgctggccgtggtcgatggcctgaagggcttccccgacgcgatccgggcggtgttccccgaggcgctggtccagacctgcatcgtccacctgctacgccatagcctcgacttcgtgtcctacaaggaccgcaagctcgtggcgggtgcgctgaaggacatctaccgcgcgctcgatgccgcggctggcgaggcggccttggcggccttcgagacgagcgaatggggtcggcgctatccggccatcgcccagagctggcgacgggcctggggcgaggtgatcccgttttatgccttccccggcgaggttcgccggatcctgtacaccacgaacgccatcgaggccctgaacgccacgctgcgccgggccgtgcgcgcccgcgggcacttcccgaccgacgaggccgcgctgaagctgctctacctggtcttgaaccgctccgagaaggcatggaagatgggcccgcgtgagtgggtcatggccaaggcgcagttcgccgtcatcttcggcgagcgcttcacacgggccatggcggcctga

SEQ ID NO: 5217 - DNA, 1221 bp, Methylobacterium sp.; identical to SEQ ID NO: 5216

SEQ ID NO: 5218 - DNA, 1221 bp, Methylobacterium sp.
atggcacgacgcaaagcaccccgtatccctgacgcgatcctggaccagctcctggccggggccgatccgaagacggccttcgaggccgatggcctcctggacgagttgaagaaggccctggccgagcgggcgctcaatgccgagatggaccaccatctggcgggcgaggaggccggcaacacgcgcaacggctatggccgcaagacggtcaccaccgagaccggccggatcgagctttcgatcccgcgcgaccggcaggcgacgttcgatccgcagctgatcgcccggtatcagcgccgctttcccggcttcgacgacaagatcgtgtcgatgtacgcgcgtggcatgagcacccgggagatcgtcgcgcacctgcgcgagctctacggcatcgaggtctcacccgacctgatcagcgcggtgaccgacgcggttctggaggaggtcgctgcctggcaggcccggccgctggagccggtctacccgatcgtgttcttcgacgccctgcggatcaaggtgcgtgacgagggcgtggtccgcaacaaggccgtccacatcgcgctgggcgtgcgcgccgacggctccaaggagatcctcggcctgtggctggagcagaacgagggcgccaagttctggctacgggtcatgaacgagctgaagaaccgcggcgtcgaggacgtgctgctggccgtggtcgatggcctgaagggcttccccgacgcgatccgggcggtgttccccgaggcgctggtccagacctgcatcgtccacctgctacgccatagcctcgacttcgtgtcctacaaggaccgcaagctcgtggcgggtgcgctgaaggacatctaccgcgcgctcgatgccgcggctggcgaggcggccttggcggccttcgagacgagcgaatggggtcggcgctatccggccatcgcccagagctggcgacgggcctggggcgaggtgatcccgttttatgccttccccggcgaggttcgccggatcctgtacaccacgaacgccatcgaggccctgaacgccacgctgcgccgggccgtgcgcgcccgcgggcacttcccgaccgacgaggccgcgctgaagctgctctacctggtcttgaaccgctccgagaaggcatggaagatgggcccgcgtgagtgggtcatggccaaggcgcagttcgccgtcatcttcggcgagcgcttcacccgggccatggcggcctga

SEQ ID NO: 5219 - DNA, 564 bp, Methylobacterium sp.
atgcggttcgacgcctgctgggatccggcctgcggcgagggccacatgttcgaggtcctgctggagtatttcggcggcggcggctggggctccgacatcttcgactatggccgcggctatcgggtcgaggattttctcgacgaaggcacggtgatcgggtcgcccgaggacgggatggcgcccgagttcatcatcaccaatccgccgttccgtccggcaaccgcattcaccctgcgcgcgctgacgctggcccccgtggtcgcgatgctgctgcgcacggtgtgggtcgagggcgttcagcgctacgagaccctgttccgtgatcggccgccgacgctactcgcgccgttcgtcgaacgcgtgccgatgacgaagggccgctgggacccggatgctggcacggccacgtcctacgcttggttcgtgtgggtgcgcgggcgcgatccgcacgcgccgttctggatcccgcccggctgccggcagcggctgaccaagccaaccgaccgcacgcgcttcgctgttcagacggcgacgcccctcttcgacctcgcggcagcggagtag

SEQ ID NO: 5220 - DNA, 5292 bp, Methylobacterium sp.
atggtcgccgtcaaccagatcgcggtgaacgagacccgcttcgtctacacgacggagggggtcgatcgcgttcgcgcgcagaacgagcaagtcgcgtcctcgctcgacaaggtgacgtcggcctccggtaaggccacggatgccgagggcaaagccgcgtcgtcgtcggacaaggcggcgcaggcccgggcgaagctcgccgcggtccaggagcgatttcagcggcagatgcaggccgaggcgcagatcctcggcatggcgcagtcgcagcaggacgcgctgaccgccgccaccgagcgcttcgccgatgcccagtctcaggccgcccggtccgcctctgcgttgcagagcgcggccaacgacaacaccggggcgctggagcggcagggcgaggcgttcaaggccgccggcaagttcgcgctggagcacccgatcatcgtggcggccgccagcgtcgcggcggcccgggcgctgtccggcttcgccgccacggcggccgggtcgctggcgaccgcgtccgccgtgacggcgcggtatgccgcgacctcgaccgagatgggcacgacggtcgccgccggcgcggctctggcgtcgcgcgggctctccggcctgtccacgggcgcggccgcggcggcggtcggcctggagaccttcgccacgaaggcggccggcctcacgaccaccaccagcctgctgtcgcgcgccctttcgctcgtgccggcctacttcctgccgatcgccgcggccttcgcggtgttcgagttggcctcggcggcgatcaagaaggcctacgcggacctcaaccagctcgtgcagctcggtgagaaggcgcagagcctcgacatcggcgcaccgttcctgaagagcttcgaggccatcgcccccaagatccaggcgacgaaggatcagatcgacgccgcgatcggcaaggcctccagcttcctcaaggactcctggggttccggcaacggcctgtcgaagctgttcaacgacatcagctcgacgggcgtggccggggcgggtggcctgcaggcgacggccctctcggacaccgccacctcgatccaggagcgcatccaggcggccctcgccggcatgaaggagcttgacgagctcggcctgcacctcgccagcatccaggtgggcgagaaggtattcgggccggagttcgtcgagcgcctacgggtcagcaacacctcggccgagcagctgtccgcggcgctccaggccgccgccgagaaggaggtgctgaagcaggagcaggtcgaccgggcgctcgcgctgaaccgccagatctccgacacgaagcaggccatcagcgaggcatgggcggtcacggtcgacttctcggccgccgcgctgctgctgaatgaggcgtggctgaagatcctccaggccgtgcagtgggtcgtcgagacgatcaacagcgccatcagcgccgtcggcaacttcgcgtccgcggtggcctccggcatcggcggggccttcgacgcggtcagcaacaaggtgagcggcctgctgacccagatgggcgtcctgtcggcgcagcagaaggtcgtggccagcgagacgccgaagatcgacggcacctatggcccgcagcagccgaccatcacggctcggcagttcccctacgtcttcgggccggaggcgccgaaggccgcggccgcggcggcgaagcagtcgaagcaggcggctcaggaggcggtcagctcctacgacaacctgatccagcgcacgaaggatcggatcgaggagctcgacctcgagacccagtcggtcggcaagtcgtccgaggcggtgatcaagctgaagctcgcccacgacctggagcgggcggccaagaaggacgggatcaccgtcaccgccgagatgcgggcggagaccgaccggctcggcaccagcctcgccgcctcgaccgagaacctcgccaacgcgaagcgccagctggagctgacccgggaggcgcagcgcgagctcggcgacaccttcggcaccttcgcggaggatgtgatcctcggcgggcagaagatgagcgaggcgttcgcgggcctcgccaagacgctcgcctccagctccctgaaggcgctcctcaccggccagggcgggctcgccggcctgttcgggaccgcgggcgagaagagcagcgacctcggcggcttactcggcggcaagatcagcttcggcagcctattcggcggtggatcgtcaaacgacgccggctcgccgctgcctggtgcgcagggcccgtccctgcccagcagcagcctgttcggaggcctgttcgacggagagaagatcacgaaggcgctgggcctcggggccgagagcggaatcggcaacgcgctgtcgaacgcgctgaagcccaaggggaacggcgggatcctgtcgtcgccgctgggcggcgcgatcgcgtccgtcggcgccggcgcggccatcggctacagcagccagagcccgctgatgggcgcgctcggcggcggcctcgccggcctcgccagcggcaacccgctgctcgcggtagcgggcgccggcgcaggcctcctcggcggcctgttcggtcagagcgaggccaagaagcaggccaagcggcaactccagcaggagcttcaggcccggcgcgaggccctcgaccaggcgcgcccgcagatcgagcagctcgccctgaccttcgagggcggctcaatcggcaacatcggcaagacgatctccgatgcgctgagccaggccaagcaggcgatcaagaccgccagcgacggcggcgatcaggccctcgccgacaagctgatgaaggactaccagtcctacgtcgcgcgcctgaccgcggtgttcgcggagggcttcaacggtgtcgcggccgagatgcaggccgggtttggcgccggcggcccgttctctcaggccatctcctccgtccagcagctcggcgaggtgctcaagggctttgtcacggatgccggtcggctgagcccggccgctgtcgcagcggcgcagaccgcggcggtgaccggcgccctcgcggcgctccagccgcccccgaacctgtccgcgacccagaccgagctcgcccggatcaacggcacggccaccggcctcaaccaggtgctgaaggatctcggcctgtccgcggaccaggcggccgccgcgatcaaggacggcacgaacaaggctctcgacgcgctgcggacgaagttcagcgacgacctcggccgcaagatcaacgacgccctgaacaaggggtatctgaacgacgcggcagacctcgtgaaggaggtagcgagcctctcgcaggatgcgtccgcgatcggtggcgacctcgggcaggtggacacctacttcaccgcggccgcgcagaagatcgtggacggcagccagcttgccggcagcgccttcgacgagctgatcacgaagttcccggagctcgccggcaaggtccacgagttctccgagaccgcgtccatgagcgcggaccaggcggccaaggccgcgcaggaggcgctgtccgccatccaggaccggatgcgcgggtacgaggaccggtacgtcgcggccaccttcgagaccgagagcctgccgggcaagctgctggcgttcgaccgggccgcggagtgggagcgctggcaggagggcgcgaagggcaaccaggcgatcgtcgagctcgagcgggcgcagggcgccgagcggctcaagatcatcaacgacttcgccaaagccgccacggaggcgctgaacgcccgtctgaagggctacgcggaccggctcttcaacgccggcaacgacacctcgaccctcggcggccagcttgccgcctacgaccggcaggcgcagcaggagcgcgaggacgaggccaaggccggcggccaggccctcgtgcagttggagatgacccaggcggccgagcgcgcgaagatcgtcgccgactatgccaagcaggcggccgacgcgctcaagcagcagatgtccgcggcgcagaccgccttcgagacgttcgtcaagaacatcaagacgtacctggacaatctgcgctcgggtggctcctcgccactgtcgccgaaggaccgtctcgccgcggcgcagagccagtacgacgcgcagctcgcgctggcccagggcggcgaccggaccgcgctcgacaacatcacgcagtacagcgatgcgctgctcgccgcgtccaagggctacaacgcctccggcgagggctaccaggcgacctatcagaagatcctggacgacctggcgaagctgccgacgcaggtctcagccgagcagttcatcgtcgatgcgatcaacgacagccgcgacgcgatcgtgtccgccaccgacgcgatgaagctggagctgaaggagggcctgatcgcgaacagcccgcagctcatcgccgcggcgctcctccagtatttcaacatgctggacacgtcggtgaacgggctgctcgactatagcgagttcacggcaggcctcggaccgctcgccaccgaggcggagcagcagcaggcccgggccatcttcaacgccatcgacgcgaatggcgacggccagctcagcaagctggaattgcagaacgcctcatcctaccggctcgagcagtacaccgcctccacggacgccaacacagatcaggcgaacaacatcggcaacgcccagaaggcgacgatggacaatcaggccgcctacctgaacagcatcaacaacctgaccaatgcggcctacgcgacgcagcagcagctcgtgagcctcaacgcaagcatcaacagccagaacgctttcatccagcagaataccggcttcacgaacagctatctcgccacgcagggccaatacttcggcgacacgtacctgctgcaggggcagatcctgaacaacctgcgctcggccaacgccaagaacggcgccccggtctacgcgacgggcggttgggtgagcggcccgggcaccggtacgtcggatagcatctcggcccgcctgtcgaacggcgagttcgtcgtgaacgccgcctccgcccggctgaacgggccgctccttgaggcgctgaacgacaaccgccccttcgcgatgccgaccatcggcgtgccggctggtggcgggcgcgacgatgccgcgctgatcgccgagctgcgggcgctgcgggcggaggtcgcgcggctgactcagctcgccgatgagggcaacagcatcgccgcggaggggcactccggcacgcgggctgcggtggggcggaacacggcggcgctcgagaccggcaacaccgtggcctcgcgcaagtcgctcgagcgccccgtgaaggccgcctga

SEQ ID NO: 5221 - DNA, 834 bp, Methylobacterium sp.
gtgctcggtcgggtcgaccatcgctcccggttggtcgtcgaacgccgggtcaacggtgccggatcgcacccgaggcaagcctatccctgcaacgagctcatcgtgatgctcggcggccgcgctgtcgtacgacgcaccggtgacggtcaggacgagaagtgcctcgccggggccggaacggcctggaccggaccggtcggattcatggagaaggcggaactctcggaggccatctcgtgcctccacgtgtgcctgccgcgggccctcatcgagcacagtgccctggcggactacggcatcgacgcctcgctggtcgaactcgccttcgtcggcggcttggccgatccgctcctcgtcagcttcgcgcgggcgttcgagggcatgctcggcaggccacaatcgccgacggaccggttgttcgtcgatggtctgacgaccgctttggcggcccacctgatcgccaattacacggtcgaccgctggaagccgtccaccgctccgcgaaagctcgacgagcgccgcctcaagcgagtgaccgattacatcgaagcgcattacgccgaacccattcccctcgaacgcctcgcggccgaggcctgcctcagccccttccacttcgcgcgcctgttccgcgaggcgacaggcctgaccccgcatcgctacgtgacggaccggcgggtccgagcggcccgggaggcgctggcgcttggtcgggccacgctgatggagatcgcggtcgagcagggctttggcacccaggacaacttcacgcgggtgttccgcaggagcaccggcctgacgccggggcagtaccgggccacggtccgtcgctga

SEQ ID NO: 5222 - DNA, 414 bp, Methylobacterium sp.
atgctcacgccgttccacctcgcctaccacgtcaccgacctcgacgcggcgcgccgcttctacgggggcgtcctcggctgccaggagggccgcagcaccgagacctgggtcgatttcgacttcttcggccatcagctgtcgctgcacctgggcgagcccttcgccaccacccggagcgggaaggtcggcgaccacacggtgatgatgccgcatctgggcgtggtgctgccgctcgacgcctgggaggcgctcgccggccgcgtcgaggcggccggcatcgccttcgacatcccgccggtcgtccgcttcgccggcgagcccggcgagcagcgcacgatgttcttcttcgacccgagcggcaacccgatcgaggtcaagggtttccgggatctggccggcgtcttcgcgcactga

SEQ ID NO: 5223 - DNA, 753 bp, Methylobacterium sp.
gtgacggctcccgtcggtcacgcggccgtcgacccgggcgcaggcgagacgctgcgggtgcgtgtccggcgcggcgagaccgtcgcggactacgcggtgccgcgccgggccaaccagacggtgctcgacgtcgtcaccgagatccagcgcgaccaggaccccaccctcgcctaccggttcgcctgccgggtcggcatgtgcggctcctgcggcatgacggtgaacgggcgcccgcgctggacctgccgcacccgcgtcgccgccgtggcgccggacggggtgctgacgctcgagcccctgcgcaacctgccggtggtgaaggacctcgcggtcgacatggagcccttcttcgagaagtggcgccgggcccacggcttcttcgagccgggcgagaacccgcccgaggatttcgcggtcgtggaaccggaatccgccgcgcgccgggaggtcgatgccggcatcgagtgcatcaattgcggcgtctgctacgccgcctgcgatctggtgacgtggaaccccgactatctcgggcccgcggccctcaatcgggcctggacgctggtcaacgacgtgcgcgaccgcgaccgggatcggctcgccgcggtggcgggcgatgccggctgccactcctgccacagccacatgagctgcaccgagcactgcccgaagggcctgagcccgaccttctcgatcgccggcctcaagcgcgagaccggcaaggcggcgctgcgccggttctggaggcgcggatga

SEQ ID NO: 5224 - DNA, 330 bp, Methylobacterium sp.
atgagcgcgctcctgtacctcgcccagcgcggcaccgcggcgatcctcgcggtcacggtcgcggtccatctcggcacgatcctctacgcggtgcgcggcgggctcacggccggcgagatcctgggccgaacacagggcaacgtggcgttcctgctgttctacgcggtcttcgttctggcggccgcgatccacgccccgatcggcctgcgcagcgtcctgcgcgagtggaccggctggcgcggccgctccctcgacgtcgccatgatcgctctctcggccctgctcgccgggctgggcctgcgggcggcactcgcggtgtacgcggcatga

SEQ ID NO: 5225 - DNA, 378 bp, Methylobacterium sp.
atgaggaccgccacgagcacggccgggcgggccggcatcacccgcgcgtccctgcgccggcccggcttcgccgccgcgctgatccaccggctctcggggatcgccctggcgctgttcctgccgatgcacttcatcgcgctcggcaccgcgctccagggtgccgaccggctggagagcttcctcggcctcacccataacggctttgtccgcacggccgaatggggcctcgtctgcgcgctcgccgtccacatggcgctggggctgcgggtgctcgccatcgagtggctgcgcttccgcgagcgcaatgcccgcgtcgtggcaggctgtctcgcggccgccttcgcggtcggcctgctgttcctcctgagcggggcctga

SEQ ID NO: 5226 - DNA, 612 bp, Methylobacterium sp.
gtggcccaccacgtcctcgacatgccggccactgaggccgagatccgggcgctccggatcggcgacaccgtcaccctgcggcgctggctgttcggcatccgcgacgcgaccctgatccacatgttcgaccgggaccgccgcacccggctcgacctcgacggccacgcggtgatccacaccgcgccgaacgtccaccgcgtcccggtctccaacgaggcgccggtcggcttcgcgccgttctgcatcggcaccaccacgtcgatgcgcatggagcgcttcaccgacgcgctgatggagcgcgagggcgtgcgcctcatcgtcggcaagggcggcatggggccggcgaccctcgacgccttcgcgcggcgcggcggcgcctacctggcgatcgtcggcggcgcggcggcgctggagaccacctggatcgagaccatcgtggacgtcgacctcgacgatctccatcccgagagcctgtggcagttcgcgatccgcgatttcgggccgctgctggtcggcatggattcgcacggcggctcgctctttgccgacgtgcagcgcgacgtggccgcccggcgcgacgccgtcatcgcctccctcgaggacgcccgatga

SEQ ID NO: 5227 - DNA, 1725 bp, Methylobacterium sp.
atgagccccgaacaggtcgagaccgacatcctgatcctcggctccggcggggccgggctgttcgcggcgctccacgccaagaaggtcgcgccggacctcgacgtcaccgtcgcggtgaagggtctgctggggaaatgcggctgcacccgcatggtccagggcggctacaacgtggcgctggcgccgggcgactcggtcgagcggcacttcatggacacgatcgagggcggcaagtggctgaacgatcaggcgctcgcctggacgctcgtcaccgaggcgcagatgcggatccgcgagctggagaccgagctcggctgcttcttcgaccgcaacccggacggcagcgtccaccagaaggccttcgccggccagaccttcgaccggacggtgcacaagggcgacctcaccggcatcgagatcatcaaccgcctgtccgagcaggtctggcgccgggacgtgcgccgcctggaggaccaccgcgccctggaactgatcccggcccgggacggatcggggctggcgggcgtgctgatgctcgacatgcgcaccggcgagccgaagctggtgcgggcgaaggccgtgctgctcgccaccggcggcgggccgaccatgtacaagtaccacacgccgtcgggcgacaagtcctgcgacggtctcgccatggctttgcgcgccgggctgccgttgcgcgacatggagatggtgcagtttcacccgaccgggctgctcgccggcgccggcacccgcatgaccgggacggtgctggaggagggcctgcgcggggccggcggctggctcctcgattccaccggccagcgcttcatggaggcctacgacccgcgggccgagcgggcgacccgggacgtggtcagccgctcgatcatgcggcggttgcgcgacggcttcgccacgccgagcgggggcgtccacatccagatgagccatctcggccccgaggacgtgcgccgccggttcaagggcatggtcgagcgctgcgccgattgcggcttcgacctcgcgggcgggctcgtcgaggtcatccccaccgcccactacatgatgggcggcctccagttcgcggtcgactgcaccaccgcgctgccgcgcctttacgctgccggcgaggataccggcggcgtccacggggcgaaccgtctgggtggcaacggcgtcgcgaactccacggtgttcggggggctggccggccagtccatggcgcgggccgtgacgcgcgaggggcgcctcgccgagcccgatccggccgccatcgaggcgggcctcgcccgcgcctacgggccgctcggccggccggcggagtcgctgccggagatccgcgaggcgctctacgagacgatgtgggccgatgtcggcatcctgcgggacgcggccgggctgacccgggcgctcgccaccctcgacgggctctccgacgcggtcgcccgggccggcgcgccggacggcgaccgccgctacgcgctcacctggatggaccggctgaacctcgagaacctcgtgctggtctcccaggcggtcgcccgggcggcgctcgcccgcaccgacagccgcggcgcccatttccgcgaggatttcccggaggcctcggatctcgcgacctcgcacttcaccgtggtccgccagcgcggcggggcgctcgacctcgcgatggagccggtgcacttcacgcatgtgcggcccggcggctcgctcctcgacgccgccgcctga

SEQ ID NO: 5228 - DNA, 300 bp, Methylobacterium sp.
atggcctacttcctgctccgcctggaaccgccccgcccgagcttcccgttcgacgcgacggaggccgagaaggcgctgttctcggcgcattccggctactggatggagcaggcggccgccggcaccgccatcgcggtcggacccgtcttcgagtccggcggcacctggggcctggccctggtcgaggccgacgacgcggcccgggccgaggcgctcggcgaagcagatcccgtcctgatggcgcaggcaggcttccgatacaccgtctcgcccgttccatccctgatcctgcggcgctga

SEQ ID NO: 5229 - DNA, 1326 bp, Methylobacterium sp.
atgctggcggatcggcagatcagcgcggcacggatgatccggcgttccagaacgacagtcatcgtcctcggcgtcatcgccggggccgccgtcgctgctctgctcatccatctcctcctcggcctgctctctctcgacatcgcggtcgccaagaccagcaccgaggatcgggaggccgcgcaggccctcacgcagctcttccagacccagcatccgcgggtgcgcatccggacgatcttcgagccggatcgcctcggcgcctcggcggccctggacaagggcgagacccagctcgccctggtgcgcagcgacgccgcgccgaaggacgggcagaccctggtcatcctgcgccgcgacgcggtggtcttcgtcgcgcccgggggcagccccgtcgacagcgtggccaagctgcggggcagcaccgtcggtctcctcgacgggcggaagctcgacccgcgcctgctcgacctgatcctgacgcatttcggcgtgcccccgagcagcgtgcatcgcaggatcctgacgatcgaccagctgacggaggccgcccgcagccgccagatcggttcggtgttcgtcgtcgccccggtcgggagcgcgctctggctgccgctgttcacggcgctgcgcaaaggctccgggacggtgaagctgttcgaggtcgacgaggcggcggcgatcgccaaggagcaccccgtgctcgacacgatcgacgtgcccaagggcgcgttcctcggctccctgccggcaccgggcgacgacatcaccacgctgtccgtcagccaccggctcgtggcccgcggcgccatgccggactggctcgcgggcgagatcacccgcgaggttctcaccggcaagccgcggctcgtcgcgctcgacgacgatctggccggcatcgaggcccccgacaccgacgacaaggtccaggcactcccgatccacccgggcgcgacggcgtacctgaccgggaaccagcccagcctgagcgatcaggcgcagaacgcggcctactgggtcgggctcatgatcagcgcgctggcctccctcggcgcggcgggcatcggcctgtatcggcgcttccggccgctgcagccgcccacccgggtcatgcgcctcctggagatctggctgtccgtgtcgagcgccgatccggccgaactcgatcatctggagcgggaggccgacacgctcgcggcggagacgatccggatggaggcccacaggcggacggagagcgtcgagatccgcctcgtcgccctgctcgtcgcgcatgtccgcgaggccgtccagcgccggcggcggcacgtggcgcaacggatgacttag

SEQ ID NO: 5230 - DNA, 552 bp, Methylobacterium sp.
tacttcctggagcacgcgatcgcgagcgccaacgcccaggagctcgaccggccggcgacgatccacttcttcgtcgggatcgaccccgggatcgagatcccggcgcagctcgccgcgcacccgcaggtcaccttcgcgcgcggcccgcagaggggccagatccccgcgctgaacgccgccatcggtgccgtcgacgacagctgggacctcgtcggcttcctcgaggacgacgatcactggctgccgccctatctgggcttcgcgctgagggccctcgagagcttcgatttcgtctcctcgacgcagctcgagaccgacgaggccggcgaggtggtgcggatcaacgacttcgcgacgccgtcgggctggctgatgcggcggacgaccttcgcgcaggtcggcgcgatcagcccggcctccaagtggcactacgacaacgagtggctcggccgcctcgccgagaccggcctgcgccgcgcccacctcgtcgaggcgacggcgcccgtcacgctgcaggacgcgatccaggtccgcccgtggctcgccaacgtc

SEQ ID NO: 5231 - DNA, 1488 bp, Methylobacterium sp.
atgttgcgttacgccgcctgtctcctcgccgggctcgccctcaccgggcccgccgccgcgcagaccctgcgctacggcatgatggaggatccggacgccctcgacccgacgctcgcccggaccttcgcgagccggatggtgttcgccgcgctctgcgacaagctcgtggatatcggcccggacctgaagccggtgccgcagctcgccacctcctgggagctgtcgcccgacgagaaggcgctgaccatgcacctgcgcccgggcgtgctgttccacgacggcgagaagctcgacgccgccgccgccaagttctcgatcgagcggcacatgaagatgccgggctcgcagcgccgctcggagatcgcgccgatcgactccgtcgacgtggtcgacgacctgaccttccgcatcaacctgaagcagccgttcgcgccgctgctggcgcagttcaccgaccgggccggcatgatggtctcgcccaaggccgccgagcggctcggcgacaagttcgcctccgcgccggtctgcgccggtccgtacaagttcgtggagcgggtgccgcaggaccggatcgtggtcgagcgcttccccgactactggaacaaggacgcgatccacatccagcggatcgagttccggccgatccccgacgccaccgtgcggctcaccaacctccgcgcgggtcagctcgacctcttggagcgcctcgcccccaccgacgtggcgcaggtgaagcgcgacgccaagctgaagctggactccacctacgagctcggcttccaggagatcctgttcaacccccacaaggccggctcgccggtctccgacccgaaggtgcgcgccgctttcgaggcggccatcgaccgcaacgccatcaatcaggtggtctacaacggcgagttcctggccgggaaccagtgggtcaacccgaagaacccgaactacgtcgccgagtacccgatccccaagcgggacgtcgccaaggccaaggcgctgctggccgaggccggcaagccgaacccgcagatcacgctgaccgtctacgccaacagcgagtcgccgcaggtcggccaggtgatccaggcgatgaccaaggaggccggcttcgacgtgaagatccaggccgtggacttcaccacggcgctcgatgccgccgacaagggcaattacgaggcgcagctctattcctggagcggccgctcggacccggacggcaacacgttcagcttcctggcctgcaaggcggcgctgaactatccgaaatactgcagcccggaagccgacgcggcgctccaggccgagcggggcactgtcgacccggccaagcgcaaggccgcctggaaggccctggccgatcaggtgcttaaggatcgcccgggcatctacatcctgcaccgcaagctgctctgggcctacagccagaagatcacgggtttcgtgccctacccagacgggctcgtgcgcttcaccgggctgaagctgaactga

SEQ ID NO: 5232 - DNA, 930 bp, Methylobacterium sp.
atgagcaccggcagcgagatcgcccgcgccgaggcggtcggcctggaggccgccccgtccggcgcccccgcccacgccatcctccgagagcccggcaccctcgcggccttctggcgacgcctgcgcgcgcgcaggagcgcggtcgtgggcctcgtcatcgtcggcctgctggtgctgatggcggtgttcgcgccctggatcgctccctacgacccgacagccaccgactggggcaacgtccgcgggcccccgagcctcgcgcacccgttcggcggcgacgaggtcgggcgcgacgtgctctcgcggatcatcttcggcacccgggcctcactcggcgccggcctcgtctcggtcgcgttggcggtgtccctcggcctgcccctgggattgctcgccggctacgcgggcggctggatcgacggcgcgatctcccggctcaccgacgcgctgctggcgatcccattcctgatcctggcgatcgcgctcgccgccttcctaggcccgagcctcgtcaacgcgatgatcgcgatcggcctctcggcgacctcgaccttcatccggctgacccgcgcgcaggtgcgcgccgtggcggcggaggagttcgtcgaggcggcccgcgccatgggcaacccgccctggcggatcgcccgggtccacatcctgcccaacatcgtcccggcgatcctcgtgcaggcgacgctcaccatcgcggccgcgatcatcgcggaggcgagcctgtcgttcctcggcctcggccagcagccgcccgacccgtcctggggggcgatgctcaacaccgccaagaacttcatggacgaggcgccctggatggcgatctggcccggcctgtcgatcttcctggcggtgctcgccttcaacctgttcggcgacggcctacgggatgccctcgatccgaggcagcggacatga

SEQ ID NO: 5233 - DNA, 1017 bp, Methylobacterium sp.
atgatcaagcctctcctcgacgtccgcgacctcgcggtcgccttcgacacggacggcggcgcggtccacgcggtcaacggcgtgtcctacaccctgcacgagggcgagacgctggggatcgtcggcgagtccggctccggcaagagcgtgcacgtgctggccatgctgggcctgatcccgcgcccgcccggccgcatcaccggcgggcaggtgctgttcgaggggcgcgacctcctcgccctgaaggagcaggacctgcgcgagatccgcggcggcgcgatcggcttcgtgttccaggacccgatgagctcgctcaaccccggcatgaccgtggcggcgcagatcgtcgagccgctgcgcatccatctcggcctcgacgcccgcgcggcccgcgcccgggcccgggagctgctcgacctcgtgcgcatcccgaacgcggccgcgcgcctcgaccagtacccgcacgagttctccggcggccagcgccagcgcgtgatgatcgcgatcggcctgagctgccggccgaagcttctgatcgccgacgaggcgaccacggcgctcgacgtcaccgtccaggccgagatcgtcgccctggtgcaggagctgaagcgtgagctcggcatggcgatcatctggatcacccacgatctcggtgtggtggcgggcatcagcgacaccgtgcaggtgatgtatgccggccggatcctggagcgcggcccggtcgacgacatcttcgccgatccccgcaacgcctacacgctcggcctgctgcggtccctgccggatctctccggcggccgcgccgggcggcggcgcctccaccagatcgagggcgcgccgccggacatgcgccatctcccgccgggcgacccgttcgcgccgcgcaacgcctacgcgacgccgcgctgccgagccgagatgccgcccctggcgcaggcgcccggcgccgctccgggccacctcgtcgccgcctggtacgacctgccgaagctcctggatgaggaggccgcgcgatga

SEQ ID NO: 5234 - DNA, 924 bp, Methylobacterium sp.
atgaacgcgtcgcagcagccggttgtctcggtgcgcgacctgtccaagcactatcccctccgctcctggtggggcggcaagggcgcggtgttccgcgccgtcgagggcgtgagcttcgacatccgccccggcgagaccctggggctcgtgggcgaatccggttccggcaagtcgaccatcggccgggccgtgaccatgctgaacccgccgacctcgggcaccattgcgttcgagggcaccgacctagccaagctctcggcgggcgcgatgcgcaggatgcgggcccggatccagaccgtgttccaagatccctacgcggccctcaacccgcggatgagcgcgggcgagtacgtcgcggaggcgttcaagctgcaccggcgcgacatgcgcggcccggagcggcgggaggcggtggcggccctgttccagcgggtcgggctcgatccgcgcttcatggggcgctacccgcaccagttctcgggcggccagcggcagcgcatctgcatcgcccgggcgatcgccctgaagcccagcttcatcgtcgccgacgagccgatcgcggcgcttgacgtctcgatccaggcgcaggtggtgaacctgctgcaggacctgcaggacgagatgggcctgtcctacctgttcatctcgcacgacctgcggatggtgcgctacctctgccaccgggtcgcggtgctctggcgcgggcggatcgtcgagctggccgaggccgacgccctctacgacgacccgcgccatccctacacgcgccgcctgctggcggcggtgccggtgccgcacccggccgaggagcgcgcccgcctcgcagcgcgcgacctcgccggtcacgaccagccgcccgacgggccgctcaccgaggtggcgccggggcactgggtggcgctgccgagagggcagcaggcgtga

SEQ ID NO: 5235 - DNA, 255 bp, Methylobacterium sp.
atgggcgacgccatgatccgaccggcggagttctgggacacggtcggcggcctcgtgaccgccaaggtcgagccggtgatcggccgcgccgacaggcaccgcggcccggtgatcgactacctgcgcgacctggaggccctggcgcggcgccagtgctccagccgcgagacggtccagatcatcgcctcgggccggcggctcctcggggaccgcagcgagatcgggccgtcggacggaccgttcactcgcgcctga

SEQ ID NO: 5236 - DNA, 294 bp, Methylobacterium sp.
gtggatcagtggcgcaagatgcatcccgcgaagccggcggcgtgcgtcgcgcgggagattaacgcgcctatccggacggtcgagaagtggttcaagggtgaggcaaagccctcccttgattacgtcggcccgatcctgaaccggtacggcctggccttcgtcgtcggcgcgatggcgaatccgcttccttggctggacgacctcgcccgggaagagcggaagctgaagctgctcgccgagcggcaggcgatcgacgacatgctcgccgaggactggcggagggctcagcgatga

SEQ ID NO: 5237 - DNA, 273 bp, Methylobacterium sp.
atggctgcgctcacacgaatctccggccagaagcggctcgtcgccatgcgcatctcactcggcctgaagctctccgcggtgatcgggctgctggccctggtggcgatcggcatcgctgccttcgcggttcgacaatcgaactgggagcaggagcgggcggccgccacggaccggatctggaacgccggccttcaggcgggcgccctggggcaggcgatcgagcacgcggtggtgcaggccacggccctctacaccgcggaggacacgacgtag

SEQ ID NO: 5238 - DNA, 1170 bp, Methylobacterium sp.
atgcccatcggcctgcaggatttcgacttcggcctgggcgagacggccgacgccctgcgcgccgaggtggagcgcttcgcgcgcgctgagatcgccccccgcgcggcggcgatcgatgccagcaacgcgtttcccgcggacctctggcgcaagctcggcgccctcggcgttctgggcgtcaccgtcgaggagacctatggcggcgccggcatgggctacctcgagcacgcggtggccatggaggagatcagccgggcctcggcctcggtcgggctgtcctacggcgcgcattccaacctctgcgtgaaccagatccgccgcaacggcaccgaggcgcagaagcggcgctacctgccgaagctgatcgcgggcgagcatgtcggcgcgctcgcgatgtccgagccgggctccggcagcgacgtcgtctccatgcggctgcgggccgacaggcgcggcgaccgctacgtcctgaacggcaccaagatgtggatcaccaacggtcccgacgccgacgtcctggtggtctacgccaagacggatcccgaggccggtccgcgggggatcacggcgttcctggtcgagaaggattttcccggcttctccaccgcgcagaagctcgacaagctcggcatgcgcggctcgaacacctgcgagctgctgttccaagactgcgagataccggaggagaacgtcctgggcgcggtcgggcgcggcgtcggcgtgctgatgtcgggcctcgactacgagcgcgccgtgctggccgccgggccgctcggcatcatgcgcgcctgcctcgacgtcgtcctgccctacctccacgagcgccggcagttcggtcggccgatcggcgagttccagctcatgcagggcaagatcgccgacatgtacacggcgacgaacgccgcccgggcctacgtctacgcggtggcgcgggcctgcgaccgcgggcgggcgacgcgccgggacgccgcgggcgcgatcctgttcgcggccgagcgcgcgaccgcggtagccctcgacgcgatccaggcgctcggcggcaacggctacatcaacgactatccgaccggccgcctgctgcgcgacgccaagctctacgagatcggcgccggcacgagcgagatccggcggatgctgatcggccgcgaattgttcgccgagacggcctga

SEQ ID NO: 5239 - DNA, 231 bp, Methylobacterium sp.
atgcggaccatcattctctcgggcgccctgttcgcggccctgtgcggcgcggcgagcgccgaggagaccaccgtcatccgccgcgacgggcccgccgtcgtcgaccaccgcgacaccgtcgtcgagaagcgtgaggtcaccaccggcagcgtcgattgcggctcgaagaccgtccacaaggaggacggcatgggcaactccaagaccgtccacaaggaaggctgcaactga

SEQ ID NO: 5240 - DNA, 672 bp, Methylobacterium sp.
atgttcgtattctcgattgtgcagcaaaaagggggcgtcggcaaaacaaccctggcgatcagcattgccgctgagcttcgtgcacgcggcaaaaaggcaatcttgatcgatgccgatccgcaggcctcagccgtcgcatgggcgagcccgcgtaaactcggctttgaggtgcgcgccgagctgatcggcggacagacggtgtcgcaatggctgcggaatgttctcaagcagcaggccgacttcgtgatcgtcgacaccccagcgggactcgggcctgcttttcgggccgctatcgatatcgccgatctcatcatcgtcccgtgcggcccctcgagcctcgatctcaatgccgcgcgccagacgctgtctcaggtaagctccgctctgcgcagtgacgcgcgctcacaggcgcggatcgtgaccatcccgacccgggtcgatgttcagcatccggaaggccaacagatcgccgaggaattgagctccttcggcgagccagttgggccggcgctcagccatgacgtgtattacgtccgctccttcagccaaggcgtggcggtcaccacagcggcgccggcgagccccgcggcggccgagatccgagctgtgacggacttcctgctgcgacggctggccgagcggaacggcgggcttgaacggaacggtgcatag

SEQ ID NO: 5241 - DNA, 372 bp, Methylobacterium sp.
atgacgcttccgatcacgccaagccgccacacgccgctgccggttcattcacgcaatccgcgccgcgcctacgacgtcgatggcttcgagatcacgccgatgacgttccagcaggcgatggacaaaggggtgctggccgtccgggtgatctgcggctgcgggcacgtcgaagagaccccgatctatgtgggggcgtggccatcgacgagcttcgtgcctgatgccggcatgacgctccggtgcagcgcatgctcgacgccggacccatggactgagcccgtttggcccgccataccgagcacagatggtcttgaaccgtcctgtctgctcccagaccagctccccgagtcggatcccggcttggtccggtag

SEQ ID NO: 5242 - DNA, 1521 bp, Methylobacterium sp.
ttgaacggcgcgctgaggagccggcagtcggcccaggcggcgctgcgggagcttgatcggcaggactacctccagaaccacctccggttcgtgcagcgcttctttcgcgagaaagagggctacgacatgatcgtgggcccgcaccaccggatcatgtgcgagacgctcgaccgggtgctgcgcggggagatctcccggctcatcatcaacgtgccgccgcgctacaccaagaccgaggcggcggtggtgcacctgatcgcccacgggctcgcgctgaacccggcctcccggtacatccacgcgtcgttcaacggcccgctggcgctgctcaactcgaccagcgtcaaggacgtcatgcggctgccggcctaccgggagttctggcaccgcgagccgcgcgacgacctcgactcgaaagagctgtggcgcacccccgagggcggcgggatgaaggccggctcggccggcggcccgatcacgggtttcggtgccggcctgatgtacgagggcgcctggcgcttcaccggcgcgctcatcatcgacgacccgctgaagccgaaggatgcgcctcacgagacgatgcgcaaggcggtgaacgacaactggaacgccaccttcgcgagccgtctggcgaccgaagacgtgccggtcatcgtcatcatgcagcggctgcacgtcgacgacttctcgggcttcctcctgaagggcggcgctgggtgcaagtggcaccacctgctcctgcccgtgctgatcgacaacgccgcggagtacccggcggagttcacgcacggcatcccgatcgcgcacggcctgcctgacgggccgctctggccctacaagcacaacgccgagcagatcgaggccctgcgccacgacagctacaccttcgccggccagtacatgcaggtgcccgtcgtctcgggcggcaacctcttcaacgaggactggctgcacggctacgacgagctgccgaagctcgaataccggatgatctacgccgacaccgccatgaaggacggtgagcggaacgattactcggtgttccagctctggggcaaaggcgtcgacggccgcgcctacctgatcgaccaggtgcgcgggaagtggctggcgccggagctggagaaggtcgcccgcgccttctggtggatgcacgccgacatggagacccaccacttcggggcgctccgggcgatgaaggtcgaggacaaggcgtccgggaccgggctcatccagaccctcgtgcggccctacgccggcgagggcgggcgcaagggcatcgccattccggtgatcccgatccagcgcgacaaggacaaggtgcagcgcgccaacgacgcgctcccccagttcgcgtgcggcaacgtgcgcgtgccgaccgatgcggcgtggttcccggcctggaagagcgagctgctcgccttcccgagcggcagccacgacgaccaggtcgacccaacctgcgacgcggtcagcgacatgctggtcaacgtctcgaactcccgtctcgtgtttggttga

SEQ ID NO: 5243 - DNA, 1608 bp, Methylobacterium sp.
gtgaagccggaggcgcagcgcaaggccgagcgtgagaaggcggtcgccctgatccgggccctcgaccgcgaggagatcgtcaccgaggcgcgcgagcggttcatgccgttcgtgcgcttcaccatgccggacccgcaggacccggacgacgcgaagcgctcggcctacgatgaccaggacttccaccgtgcgatcggcctcgccctggagaaggtcgagcgcggcgacatgccgttcctgatcctgaccgtgccgccccgccacgggaagtcgcagctcacctcgcggcacttcccggcgtggctgctcgggcgcgacccgcgccggcacatcgtggtcgccgcgcacacggacaatctggccgaggacttcggcgccgacgtgcgcaacatcatgtcgacgccgcagtacaagcaggtgttccccgaggtggccttccagcggggcggcaacgccaagaaccgcctccagacgaccaagggcgggctcgccttcttcgtcggccgcgggacggccctgatcggccgcggcgccgacttcctgatcctggacgaccttatcaagaacgccgaggaagcccggtccgcggccgtgcgcgaggaagtctgggagtgggtcgtcaaggtcgccatgacccggcgcatgtcggcccgcagcccggtcgtcatcatcatgcagcgctggcacgaggacgacccggtcggccgcatcaccgacccgacgaacccgaagcacgacccgatgctggcctcgaaattcaagatcatcgatctgccggcgctcgcggtggacgacgacccgctcggccggccgaagggcagggcgctctggccgctgtcgaagggccagccgaagttcgacgaggagttcctggagcagcagcggcgcctcgatccgaccggcttccacgcgctctaccagcagcagccgtccgccgtggacgggacgctgttcctgcgcgacaacatccgcctctacagccccgacgagctgccggcgaacctgacgccctactgcacgtcggaccacgcggtcggcgaggaccggaagaagcacgacgcctccgtgctgctcgggggtgggctcgaccgcggcaacaacctctggctcaccaactgcatctgggagcgctgggcaaccgaccgcatcgtcgaggcgatgctggacatggcccaggagctgaacccgctgatctgggcggctgagcgcggccacatctcgaagtcaatcgggccgttcctgcgcaagcgaatgcacgagcgcaacatcttcttcccgctgcgcgagatcacaccgagcgagaacaaggaagtccgggcccaggctattgccggtcgggtcgcccagggcaaggtgttcttcccgcggcacgccgcctggactgagcgggcgatcgacgagctgctgaaattcccgaacggccggaacgacgacttcgtggacgccctggcctacttcggcatcctgctccagagcatgttcgcgcccggccggtccgagcaggagcggcgcgcggccgagcccaagacgggctcctacgcctggatcaaggcgatgcagaagcgccaggagcaggccgaacagttccgggaaggtggaggatactga

SEQ ID NO: 5244 - DNA, 642 bp, Methylobacterium sp.
atgctcgtcgacgatcacgccgtcgtgcgggagggctatcggcggctcctggagcggcagcccgacatggaggtcgccgccgaggccggggacggcgcggaggcctatcgcgcctaccggatggcggagccggacgtcgtcatcatggacatcagcatgcccggccgcggtgggatcgacgccatccgtcagattcggcaggtggatccgagcgcccgcatcctcgtctttagcgtgcatgccgcggtgagctacgcgctccaggccatacgcgccggcgcccgtggctacatcaccaagagcagcgcttcggatctcctgatcgatgcggtgcggagcgtgttcagcaacaagctgaccctgtgcgcggagatctcacacttgctggccgcgagccggctggcggaggagacgtccccgatcgaccagctgtcgcctcgggaattcgagatcctgcggatgatcctcgacgcgcggcacacggacgcgatcgcggccgatctcagcctttcgcccaagaccgtcgcgaattatcactacgccatcaaatcgaagctcggcgtcagctcggacgtggagctcgtctactgctgcatccggtgcgggctgatcgatcccttcgcggtcgtcggagcggactag

SEQ ID NO: 5245 - DNA, 804 bp, Methylobacterium sp.
atgaatgacgagaccgaggctcgcggcgcgggggaggacctgctgttctccgtcgcggagggtgtggccaccatcacgctgaaccggcccgagcggaagaacgccttcaccttcccgatgatcgaggcctggacggcggccctgcagcgctgccgcgccgacgcggcaatccgcgtcgtggtggtgaccggtgcgggctcggccttctgcagcggcggcgacatcgtcgagatgggcgagcgcctcgaccagccgccggcccggcgcaaggaggagctctacgggcggatccagcgcatcccgctgacgctggaggatctcgacaagccggtgatcgccgccctgaacggcgtggcgaccggcgcgggcctcgacctcgccctgatgtgcgacctgcgcttcgcggcgaagagtgcccgcttcgccgagacctacgtgcgggtcggcctcgtccccggcgcgggcggcgcccacttcctgccccgcctcgtcgggaccgcgaaggcgctggagctgttcttcaccggcgatttcgtcgatgccgacgaggcgctccggatcggcatggtcaacggcgtccacgccgatgcggacctgatgccggcggtggcggcgctggcgcgcaagatcgccaaggcgccgccgctgacgctgagcctgatcaagcgcgcggtctaccagggcatgcgcaacgacctgcgcaccaacctcgacctgatctcctcgcattacgccgtcatcaccgccacgcccgagcaccgggaggcggtgcaggccttcatcggggggcgcgacaggacctga

SEQ ID NO: 5246 - DNA, 1740 bp, Methylobacterium sp.
atgaaccgcgccgacgctccgcagggctacgatgccgacgtgatcgtcgtgggtgccgggcccatcggcctgacgacgggcaacgccctgcgccaccatggcgtgtcgtgcctgatcctcgaagagcggaccgacgtgaaggcctactcgcgcgccaacaacctctgggcgcgaccacaggaactgctcgccggaatcggcctgcgcgacctgctggccgagaacagctacgcgatccacaccatcaatttcttcgtcaacggcacgccgacgacgcccatccccatcgccgacgtcgcgagcccctacccgaaggtgctctacagcggccaggacgtcatcgaacggaccctggccggcgagttcgcgtcgcggggcgggaagctcgaccggggttgcacggtgaccggcgtcgaacaggacgacgagagcgtcacagtggtactccggcggggcaaggacgggccggaggagcgccgccgctgtcggtatctcgtggcagccgacggcgccaagagcactattcgaccgatgctgggcctggatttcgagcccgaacgcttgccgaactgcatgaaccggcaggtcgacgccaagctgtcatggcgccgttcaatggagcccgaccagctctggttcttctactacgagcggggctttgccggcatcctgccggtctggggcggctaccaccggttgttcttcctggccgacgacgcgggcgtcccagaccgagatccgacgcttgatgagatgcaggcggtggcgcgagaggtgacgggtgacgagaccctgaccctgagcgacccgcagtggttgacgcacagccgcttccagtacggcgtctcgcctgagtacgtgcgcggccgcgtgttcctggcgggcgatgccgggcacctgtccctgcccatcggcggccagggcatgaacgcgggcctgcacgactcggtcgagatcgcgtggcggttggcgatgaccctgcggggcgaggcgggtccggttgtcctcgcctcctatgacggcgagcgcggcggcgagcacgcccggctgagcgcgcagcaggcccgggggttccggtggaccgtctaccgcggggcggtcaccgacacggtactggggttggccgcgaaggctctgccgaacctgggttcgctgctgcagggtaccgacgacatgcaacagatgggcgtcgagtacccgaagagcctcctgaacgaggaccgcctctccggcctagcgaccttgctacggtcggggccgaagccgggccagcgtgcaccggacgcggaggtgacgcataacggcgaggcgacgagcctgtttccattcctctgcaacccggatgggcacaccaccggctgggcgctgctgtgcttcgacggtcggtcctcggacgcgggggaatcgctgctcgacatcatcgaggccgtcgcgccttggccctgggtgcggccgcgcctcgtgctggctggtccgatggtcgatagcaggagcgtccccgtcctgtcggacatggacgggaaggctcacggagcgtacgggctggagggtcggccggcgttggtgctcgttcggccggacggccatatcgccttccgcagcgatgccgatcgagccgattgcctggtggcctattgccggaaggttttcggctccgcgcgcgaagctcccgaggctgacgcgcggcgaatggagccgaggctcatgaccgaagaatgtcgtggtcgccagctagactaa

SEQ ID NO: 5247 - DNA, 1341 bp, Methylobacterium sp.
atggcacgtactgacgtcgacgcggagattctccgattcgaatctgagacgggggagatccggcaggcccctgaaccagttggcctccgagtgactacgctcgtcctcgccgccttcctcacgattggcgtgggactctcggccgtcgcccgggtcgaccgggtcgtgaccagcgatcgtggtcggatcatcccgagccaaggtccgatcctgtttcaggcgctggacgcgtcgatcatcaagagtctcgatgcccgagagggcgagcaggtccacaaggggcagctgctggcgacgcttgatccaacattcgcgtctgccgacgttgaccaggcgagcaagcaactcgcgagtctcgatgcgcagatcgagcgggcgaaggctgaacaggcccatcggtcctacgacccgcacagcagcgacccggaccgcgtcccctacgataaactgcagaaacagctcttcgaccagcgagcctcccagctcaagtcccagctcgccagcttcgacgccaagatcgcgcagacgaaagcgaccatcaagaagctggaaggcgacgaggcgcgctacacggagcgcgaaaagatctccgggcagatcgagggtatgcgtcagcaacttgtcgagaagcaggccggcagccttctcaatctgctgatcgcgagcgactcgcgccttgagatgctgcgcacgatggagaacgggcgcaacgccatggtcgaggcacgccagcagctcagttccctgcaggctgaccgagacgcattcctgcagcaatggctctcgcagagcagccaggatctcgtcaccgcgcagggaacccgcgatacggtcgtcgcccaactcgcgaaggctgcgcgccacaaagatttggtgcagctccatgcgcccgctgatgccgtggtgctgacgcgggccaaagtctcggtcggatccgtcctgcgcgaaggtgacaccctgatgaccttggtcgcgctcgacgcacccattgaggcagagatcaacattgcggcgagccaggtgggctttgtgcgcgcaggcgatccggtcacactgaaagtcgacgctttcaacttcgtggagcacggctttgcggaggggcatctccgttgggttagtgagggctccttcagcttgaatgaagatggtcaaccggttccgccttactacaaggcgcgcgtctcgatcgatcagctcaagttcacgcgagttcctgtcggatttcgcctgatccccggcatgaccctaaccgcggatatccacatcggtgaccgctcggtgctcgcctatgttctaacaggcgcgtcgcgcgggctaagcggggcgatgcgcgaaccgtga

SEQ ID NO: 5248 - DNA, 900 bp, Methylobacterium sp.
gtggccgctaccgtcgccgcccgcgggctcttcccggtgaaggtcgtggccgacgtgctcggcgtggcccgctccaacctcgtcgagcagatacggagtgggtcgcggtcgcgcggtccctatcgtcgtgccgacgacgaggccgtcctgatcgccatccgcgccatcacggacgtgcggccgacctacggctatcggcgagtgacggcgatcctgaaccggacgcggcgcgccactggcgagcccgccctaaaccacaagcgggtgttccgcctgatgaagcgggacagcctactcctccagcgccacacgggcgggcgacccgtgcgcgcccacgagggccgtgtgatcgccgcggcctcgaaccagcgctggtcctcggatgggctggagatcggctgctggaacggcgaggcggtgcgggtagccttcgccatcgacacccatgatcgcgaggtgatcgcctgggtggcctccacgggtgggatcaccggccagatggtgcgggatctcatgctgacctgcgtggaggcgcgcttcggcagcctggaagctcgcttcggcagcctttgcgcgacccatcccgtgcagtggctggccgataacggctctgcctttacggccgccgagacgctgtccttcgcggcagccctgaacctcgtgccctgcttcgcgccggtacgctcgcccgagagcaacggggtgagcgaggcgttcgtgaagacgctcaagcgcgactatgcccgcgtccaaccccggcccgacgccaacacggtcctggcgcggatcggcgcctggatcaccgactacaacgaacaccatccccatcgtgggctcggcatgcgctcgccgcgcgagttcatccgtgctcagatgcaaccagccccgtgtccggtttga

SEQ ID NO: 5249 - DNA, 411 bp, Methylobacterium sp.
gtgcgctggtgctcggatcacctcgaactgcgctgccgggacggagcggtcgtccgcgtgctgtttgccatcgacgcgtgcgaccgtgagatcatcgcgtggtcggcgaccacgacgggcgtctcggccgagatggtctgcaacctgatgatcgcctgctgcgagcgccggttcggcgcgacgaagaccccgcacccggtcgagtggctgtccgacaacggctccgcctacatcgccaaggagactgctcagacggccgccgcgctcggcctacggctgctgcacaccccggtgcgttcgccgcagagcaacggcatcgcggaggcgttcgtgaagacgctcaagcgcgactatgcccgcttggcgatcttggccgacgccgagaccgtgatgcggcttctgtcggcttga

SEQ ID NO: 5250 - DNA, 459 bp, Methylobacterium sp.
gtgcgggtcgccttcgcgctcgattgctgcgatcgggaagcgatgagctacgtggcgaccacggcgggcatcacgggcgaggacgtccgcgacctgatgatggcggccgtcgagcatcgcttcggggcggtcaaccagctaccgagcctgatcgagtggctgactgacaacggcagttgctacgtcgcccgcgacactcgccgcttcgcccgcgaactcggcttgataccgaagacgacgccgctggagagcccgcagagcaacggcatggccgaagcgttcgtgcgaaccttgaaacgcgactacgtgcgtgtctcggtgctaccggatgccgagagcgtgctgcgccagctccccgtttggctggcgcactacaacgaccttcatcctcatcgcgcgctcggctaccgctcgccgcgcgagttcatcacccgatcaacccaggagaccctgtccggt

SEQ ID NO: 5251 - DNA, 507 bp, Methylobacterium sp.
gtgcgcgcaatcctgttgatctgcctgctcggcttcctcggcgtgacggccgtcctgaagctgcgcgacgccacgaggccggcgccggtggccctcgccgtcacgccgccgccggagccggttcccgcagtcgatgccgccggcgtggctctccaggccgggcgcaacggccacttctacgtcaacgcgctgctggacggccgctcgctgccgatgatggtcgatacgggagcgagcgcctgcgccttctccgaggaggacgccgcgcggatcgggatccgggtgactccagccgatttcacccgagtctggaacaccgcgaacggcacggtccgcgtggcgccgatccggatcgccatcgtgcagatcggatcgatcacggtgcgggacgtggatgcggtcgtgatcccgcgcggactcctgtcgacgagcctgctgggcatgtcgttcctcaggcgtctgcgcgatttcggtatctccggcagcacgatgacgctcaggggctga

SEQ ID NO: 5252 - DNA, 861 bp, Methylobacterium sp.
atgttcgacgcgaccaagatgctcgccgacgccctcggcgagcacctggccctgacctaccagcggaccttcggcagccgggagccgcgctacgccgagatcatcgaggccgcggcgcgcctgacgatcgagcggatcgtcgggagcgacgccctctaccacgacggcgaccacacggccctcgtcaccctggtcgcccaggacatcctccgcggccgcttcctgcagcagggcatcacgcccgaggactggctgcacatgatcctggccgccctctaccacgacatcggctacgtgcgcggcgtctgcgccggagaccggctgcaggccttcgtcatcgacgcgcagggcacgaccgtcagcctgccccggggcgcctcggacgcggcgctggcgccctaccacgtggagcgctcgaagctggccgtgcaggagcgcttcggcacgcacgatctcgttgacgcgtcccgggtcatccgggcgatcgagctgacccgcttcccggtccccgaggacgattcccatcgcgagaccgggaccgaggccggcctgctgcgggcggccgacctgatcggtcagctcggcgacccgctctacccgcgcaaattgaacgccctgttccacgaattcgccgagatcggcgtcaacgcggaactcggctacgacagcccggccgacctcgcggagcgctacccgtctttcttctggggcaagatcgagcccgtgatcggggacgcgatccggttcctcgacctcacggtcgaggggcggggctgggtcgcgaacctctacgcccacgtcttcgccatcgagcacgaccgccggcgcatgggcccgcatccgggaccggaccccctctga

SEQ ID NO: 5253 - DNA, 981 bp, Methylobacterium sp.
gtgatcaccggtccgtgcctcatcgtccagccgatccacgcggcgggcctcgaccggttgcgcgcggccgggctggagccccgcccggcgagcgggaccgatcctgagacgctggcgcgcgaggtcgccgactgcgtcgccgtcatcacccgcaacaccggcttcccggcccgcgccatcgcggcggcgccgggcctgcgggtgatcggtgtccacggcaccggcaccgaccacgtcgccaccgccgaggcgaccgcggccgggatcgcggtggtcaatacgcccggcgccaacgccgtctcggtggccgagcagacgctggcgctgatcttcgccctggccaaggccctgccggaggccgaccgctcggtccgggccggcgacgacagcttcaagttcaccgcccggctggtcgagctcgccggcctgacgctgggcctcgtcggcttcggggcgatcgggcaggcgaccgcccggctcgccgccgccctgggcctgcgggtgctggcctacggcccgagccgaccggacgccgacttcgccaatgccggcgccctgcgggccgcctcggtcgacgcgctcctggcggagtccgacatcgtctccctgcacgtgccgctgaccccgggcacccgcggcctgatcggccgggaccagctcgcgcggatgaagcgggacgccttcctgatcaacaccagccgcggcggcctgatcgacgaggcggccctggtggaggcgctggaggccggcacgatcgcgggcgccgggctcgacgtcttcgcccgggagccgctgccggtcgaccacccgctggcccgccagccccgggcgatcctgacgccccatgtcggcggctccaccggggcggccctgatccgcaccgccgagaccgccgcgacccgcgtggtcgacgtcctcgccggccggcggccgggcgggctggtcaacccggacgtctgggagcggcgccgcggagtgtga

SEQ ID NO: 5254 - DNA, 114 bp, Methylobacterium sp.
atgttcgccagcccgcacgccttcgtcctgcaccatcgcgagcgcctcgccgtgctcgtctcctcggccctgttcctcgcgggcgcgctgccgctgttctgggccatcggctga

SEQ ID NO: 5255 - DNA, 810 bp, Methylobacterium sp.
atgaaccgccgccacgttctcgccctcgccgccctctgcgccagcctcggcgcagggctcctcgccgcccccgcgacccgcgcggccgagggcaagctggagctgatcgagcccggcaagctgatcgtggcgacggacagcaccttcgcgcccttcagcatgcgcacgccgaacggcgagctcgacgggctggaggtccgggtcatgcgcgaggtctgccgccggctcgggctcgagtacagcccggtcaacatcaagttcgacgccctgctggtgggcctgatggccgatcagtacgacatcaccagcgagtcgatggacatcacccccgcccggcagaagcaggtcgccttcgcggacgggtggctcgaatccggcgcgcggatcgtgacccgcaaggataccggcatcaaggggccggcggatctcaagggccgcaacgtcggcgccctctcggcctcgaccttcggcaagctcgccgaggagaacggcgccaccctgaagagctacaagacggccgcggacgccatgcaggacctcgtcggcggcaacatcgacgcggtgatcaacgacgcggtggccggcaactacgccatcaaggcgcgcaagctgcccctggtgatgatcgagacaccgctgagcacggtccagaagggcttcgccatcaagaagggcaagccgaacctgcacgccgccgtcaacaaggcgctcggcgagatggtcgcggacggtacttacgccaagctcgtcaccccgctgatcggctatgatccggccccgaaggagccgatccgcacgcccgccatgtga

SEQ ID NO: 5256 - DNA, 681 bp, Methylobacterium sp.
atgaagaccctcgacgccgcgtcgtacacgacggcgctcagtgcacggcgcgagcagagcctcggccagatggcctacgaccggctgctcgacatgctcgtccgccgcgaccttccggccggcaccgtgctgcacgagcgccgcctcgccgagatgctcgacatctcccggaccccgacccgcgaggcgatgtcgcggctggagaccgaggggttgatcgagcggcagcccggcgggatgctcgtggtcaaggaattctccctgcgcgagctgatcgagatcctgcatgtccgccgcctgctggagcgggagagcgtcgcgctggccaccggccggatcgccgacgcggtgctggcggacctgcagcgtcagatggaggcgctcttggcggcgggcgacccggacgcgccgggcaactgggaggtcgaccggcgcttccacgacctgatcgcggagcacagccacaacgcgaccctcgccaagacgatcaaggacctgcggctcaagacgcagatgttcaacctgagccggatgcccgagcggttcgaggcggtccatcgcgagcacctcgcggtggtcgccgccctgcgggccaaggacgcggcggcggcggcggacgcgatcgcggcccatctcgagaatttcaagcagggcatcatccggcgcctgagcgaagtctga

SEQ ID NO: 5257 - DNA, 306 bp, Methylobacterium sp.
gtgattctgtccgcgggtttggagcctgaggaggatgggacggccgctctcgtgccgctgcggccagactttgatgccgcggccctgcgaacgctggccaagagctcgcgcgatccggatcagacccgccgccttctggctctgtcggcgatctacgcgggcagtctgcgctccgaggcggccgctctcggcgggtttgggcttcagaccgtgcgggactgggtgctcgccttcaacgctgagcgacgtccccccatcgctttggtccggcgtgagtgcgagttttccggtttcgtgagcccctga

SEQ ID NO: 5258 - DNA, 642 bp, Methylobacterium sp.
atgcccgcacccgcaccggtcgtcgccgacgcccgcgcccgctacctgccgctcatcgcccgcgaggccgccggcaccggcctgcccctcgcggtggccgacgccgtcgcgcggatcgagagcggctacgaccccacagtggtcggcagcgtcggtgaggtcggcctgatgcaggtccgcccgaccaccgcggcgatgctcggcttccgcggcaccgtcgccgagctggcgtcgccggagatcaacgtccgctacggcgtccgctacctcgccgaggcgtggcgccgggccgacggcgacctctgccgggccctgatgaagtaccgggccggccacggttcggaggcgatgtcgccgctgtcgcagctctactgcgcccgcgcccaggcgattctcggcaacccggaggcgcgcgtcgtccgggcgagcgcccgcgcggccgcgccggaccgcctcgccgcgcgttcggcgggccccgtccaccggacgcgcgtcgccgccgtcccggcgaagccgatgtcgttctgggaggcgcaccgggcgcgcatcgcccggctcaacgccgccgtggtgtcgcgctggcgggcgcgcggctggtcggccgcgcccgacgggtcctccggcgagccggccggcggctag

SEQ ID NO: 5259 - DNA, 1272 bp, Methylobacterium sp.
atgccgatcgtgctcaggcccgacggcgtcccggcgctcctcccctggctctggctggatctggaactgcgcgaccgaggcctgcaggctggaacgctcagagcctacgcgggagtctcctgcctactggaggactggttcgccctcagaggggtcgattgcacggctaggttgaggaaccagcagtcgttcgaggactgggaagtccgcgacctacggaaccacctctacagactcacgccggctggagcgcgcgtgcgtcggcacgccatcgcgaagcgcgaccgtctcgtcgaagaaggacggcgcgaagtcggagaggagcccatccgactcctcgaaggcgtggtgtcccaaccggtcctgaaacaacgcatctccgtcgccgcgatctatctacgctggctcgacgaaaccctgtcacgcatgatcttccccgatcctcgacagagggcggaggccgagcatgtgttgacgcacctcgccgacggcctctgcgagctcaaggtccgtgccctggaagttcgacgcgaaggcttggccctccaccaacagaaactactcctgtcggccattcttcccccgcccgccgaccagccccaaacccgtccgctcttccacgaaagcgtccgccatcgaaacttcgccttcatcctcctgctcgcgtcgaccggactgcgtatcggcgaggctctcggcctcaagatgcaggatgtcgtgcttcagaacgactggctgagcgtaacagtccggcgtcgacccgacgacccggaggatccccggccgcgacgcccgcaggcgaagacgctggagcgcaccatcaccctccctcacgtcgccgcggtcgccctactcgactggtgcgacttccaccggaagatcgagcggctttacggcccagagcacggatcgccgttcgtgtttctggcctgcaatatacacgaggccgctaacttccccgctactccgctcagtctggccggcgcggataagatcttccgggatctgcgggaaagattgccacctgaagcaggaaacgtcaccgcccaccggctgcggcacagctggatggaccacctctggacgagtctgcgcgcggccggcccccaggatccgttcgtgatcgacgtgatcaactatgccgcgggctggcgcccgggttccggtcaggcccaggcgtactcgcagcgagcccagcgcgaagctgccgacggtttcgcggcgatcttccagaagcaactcgtgtccctgctcgagcctgatcgcaaatga

SEQ ID NO: 5260 - DNA, 1329 bp, Methylobacterium sp.
gtggcgtcctggatcgaacaggcagtctggtggcaggtctttcccctcggcttcgtcggagcccccgacgaagccgacccggccgcaccggtcacgcaccgcctcgcccacctgcacggctggctcgactacgcggtcgagctcggcgcgtccgggctggcgctcgggccgatcttcgcggcctccacgcacggctacgacacggtcgaccatttccgcatcgatccgcgcctcggcgacgaggccgatttcgacgccctggtcgcggcggcccgggcccgcggcctccgcgtcctgctcgacggcgtgttcaaccatgtcgggcgggcgcacccggccttccaggacgtcctccggcacgggcccgaatccgagcgggccggctggttccggctgacctggccgcggggctccgggccgggcatcgagccggactacgcctgcttcgaggggcaccggcagctcgtcacgctcaaccacgacgacccgcgcgtcgccgaccacgtcgccgccgtcatgggccactggctcgcccggggcgccgacggctggcggctggacgcggcctacgcggtgccgccgcgcttctgggcgcgcgtgctgcggcaggtccgcctcgcgcatccggaggcctacatcgtcggcgaggtgatccacggcgactacgcccgcatcgtgcaggacaccggcatggattcggtgacccagtacgagctctggaaggcgatctggagcgccctcaacgatcgcaacctgttcgagctggcccacgccctggaacggcacaacggccttctcgacaggttcgcgcccctgaccttcgtgggcaaccacgacgtgacgcgcatcgcgagccggctcaccgacgagcggcacctgccgcacgcgctggcgatcctgctgacctgcggcgggacgccctcgatctacgccggcgacgagcaggccttccgcggcgtgaaggaggagcgggtcggcggcgacgacgccatccggccggccttcccgccgacgcccgcggatctcgctccctacggctggccggtctaccggctgcaccgggacctgatcgccctccggcggcgccacgccgggctccaccgtgcgcgggcgcgggcgctgcacctcgccaacgcgcagatcgtgctcgcgctgggcgacgggagcgcgcgggtgctgacggccctgaacctcgccgacacggacgcgacgctgccggcgccggaggcccgggcgatcgaagccggcaccggcgatctcgccgaggccggcagccccgacgcccgcgtgacccttccggcccacggctgggccgtcctggccgtgtga

SEQ ID NO: 5261 - DNA, 510 bp, Methylobacterium sp.
atgtggggcaccgacctgaccaccacctggacggccgagggacaggtcgcggtgttcgtggccatcgatcaccgctcggccgagtgcgtgggcatccatgcggcgcgccgggccacgcgcttcgaggcgctggagccgatccgccaaggggtgcggcagcgcttcggtggcttttcggccgagatcgcctccggcctgagcgtccggcacgatcacggcagccagtacatggcggacgccttccaggcggagctcgcgttcctaggcatcgcgagttcgcccgccttcgtgcgcgccccggaggggattggctgcgccgagcgcttcatccgcaccctcaaggagaacctgttgtgggtcgagcacttcgagacggtcgaggatctgcgccacgcgctgctggcgttccgggatctctacaatgagacgtggctgatcgagcgacacgggttccggccaccggccgatatttgcgccgcgcagctaccacccgcggccatcgccgcgtag

SEQ ID NO: 5262 - DNA, 3390 bp, Methylobacterium sp.
ctcgctgcgctcggcgatgccgaggccgcgcgcctcgccggaatgccgccggaccgggacggcctcgccgcttggctggacgcggtcgtcgacgccgcggaggcgcgccgacaggggaatccgtcccgggccgccaccggcgacgccgtcctgcggcgggcgctggcgtcggtcctgcgctacgccgtggccgagggcgggacggagaccgtcgcccggctggccgaccggcgccgcccgaacccgaagacgccgcgcgcctaccagcgcctgtcctgggccgagccgctccacctcgccctgcgggccgccctcgtgcacgccccggaggccgattacgacgcggccgtcgcgttcctgaacgcgcggatcgccgaggaccacgactggccggcggcctgcgccttcgcgttcatcctggccgacgaccgggccgccccgcacccgctccagcccgtcgcggtggtcgaggccgccgctgcggcggggatcgacgtggcggccgacacggcctacctgccgctcctcgccgacgcgccgccggaggccgtcgcgggctggcgcgccaagcgcagctaccacgtctacttcgtctactgcgccctcgacgcggccgaggcggccgcgaccctgctggcggtcgcccgcgccgccgggcagccggccctgccggccctcgactggctgctgcactacgccctcgacgaggagcgccgctcggtcgccctggcgatcctgtcgacgggcgaggccggcgcgcttccggccctgctgtcccatctccacgagaagcccgtcgcggccgccctcgacgcggcgctggaggcggaccccgccgcgatcctgccccgctgcctcgcggccctcgcgggcggtcggtccgagcccgccctgcgcgcccgggtgaaccgggcgctcgacgcccacgggatcgaccgggtccgcggctggctcgcggcgtcgggcgggcgcggggccggcatcctcgacgccctggcggaggcccgcgcggtgcccctcgcggagcccgccgcctggccgcgggtgctgcgcgacccgccctggcggaccaaggcccggacccgggacgacctcgtcctcgccctcgcgccgctgccgacgccgttcgcgcacgcggtgccggaggtcgccccgagctactggcgggcgcggaacgccgtgaccctcgacggtccggaggcgctgtcggccttcgtggcggccaccgagctgtcccatccgacgcagggctggagccggatcccgcccccgctctccgagccgccgcgcgacgatccgccggccctggtcgcctgggtcgccgcgcgcgtcgcccagatcgacgaggcctgccattactgggcgaactcgccctatcgccagttggtcggcagcctggagcggcagcccgagcccctggcgctcgccctctgggcccagtcgcgcgtcgttgcgggatgcttccacgtctcgcagtggccggagatcgtgtgggcgatgctgtcgcggttcggcgagcgggcgatgccgggcctcgtcgggctggtcgaggccgatccggtcgggctcctgccggcggtcctggcggtggacgatggccgcctcgccccgcccgccgcccgcgccctcaccaagctcaagaaggcccgcgagccggccctggcctggctgcgccgccatcccgagaccgccctcacccgcctcttgcccgacgccgtgggccggcccggggcgctgcgcgacgccggcgagcacgccctgcgcgtgctggcgcaggaccgggcggacggccgcgccatcatcgcttccgtggccgcgcgctacgcggaccaggcaccggacgtgaccgaggcggtcgcgcaggtgctcgaccgcgatcccctcgcccgcgtccccgccaaggtcggcaagccgcccgcctgggtcgtgccgtccatgctgacccggccgcgactgcgggacgggactgccctgccggacgcggcgatcctgaccgtctgcgagatgctgtccttcaccaacccggacgccgtctacgccggcgtgccgatggtccgcgaagcctgcaccgaagcgagcctcgcggccttcgcgtgggacctgttctccgcctggatcgccgccgggacgccctcgaaggacggctgggccctgcgcgcgctgggctggttcggcaccgacgccacggcccgcgacctgacccgcctgatccgccgctggcccggcgaggccgcccacgcccgcgcggtcaccggactcgacgttctggtcgatatcggcaccgacgtcgcgctgatgaacctcaacggcatcgccgagaagctgaagttcaaggggctccaggagaaggcccggcagaagatcgcccagctcgccgaggcccgcggcctcacccccgaggagttggccgaccgcctcgcccccgacctcgacctcgacgagcgcggcggcctcgacctcgatttcggcccccgcgggttccgggtcgggttcgacgagaccctcaagccctgggtccgggacgccgccggccagaggctcaaggatctgcccaagcccgccaaggccgacgaggccggcaaggccgcggcggcggtggcccgctggggggccctgaagaaggacgcgcgggctgtggcgagcctgcaggtggcccgcctggaggcgatgctcgccggcgcccgccgggtccagccgacggtgttcggcccctgcttcgccgcacacccgctcgtgcgccacctcgcccagcgcctcgtctgggccaccttcgcggatgccgacccgcggaccggcccgggcctgaccttccgggttgccgaggacctgacctacacggatgccgacgacgcgccgctcgacctcgacctgaccggggcggccccgggcctgatcggcctcgtccatcccctgcaactcgaggccggggcgctggcggcctggggggcgctgttcggcgactacgagatcgtccagcccttcccgcagctcgcccgcgagacctacgccttcacggaggccgaggctgccgcatcgaccacgagccgcttcgccgggaccgtcgtggaggccaaccgcctgcgcggcatggccgcccggggctggcccctcggggcaccccaggatgccggggtggtgtggtggatcgagcgcgccgtgaccttcccggggggcgccgccggccaggcgtcgctgaccttctcggagggcctgttcaccggcgcggtggagttcgaggaccgggagcagaccctcggcgacctcaccctcggttcgccctggagcagccggtcggatccgggccagcggaccttcggcgagctcgcgccggtgacggcgagcgagctcctgcgcgggccgagcctcctcgccgggacgcggctgcggtga

SEQ ID NO: 5263 - DNA, 2406 bp, Methylobacterium sp.
cgcggcgcggggcgcctggaccggctgctcgccgccggcagcgcgccgcaggcggcccccgaggccctgccgtccgtgctccgggatccaccctggcggcggcgcggggccgcgctcgcccggtcggaacgggcggtggcgccgatcccgacgcccttcgcgcacggcttcgaccccgacgaggccctcgaccgcagcaccttctacttcgaggccgggacgctggtggagtccatgacggacctcgcggcgcggatccgcgccaccgaggcggaggccctctacgacatgccgatcccgccgccggccgagcccgtgcccgccgccgacgcggatccggccatcgccctggcctggctcgaccgccggctcgacctggaccgcgacgcgttcaccggcttcttctacttcaactacgggccctggttccggatggtcgggtggcagcccgagcccctggcgctgatgctgtgggagaagaccgggccgcagcgcgcccactacgtcgcgtggcggcgcaccatcgcggtgatgctgtcgcgcttcggcgcgcgggccgtgcccggcctcgtccgcctcgtcgcggcggatccggcgcagctcctgccggaggtcgagtcggtggacgccgccgacctcgccccggtcgccgcccgggccttccaccgcacccgcaagctgcggccggccgcggccgcgtggctgcgcgcccatccccgcaccgccgcgctgcggctcctgcccgagaccctcgggcccgccggcccggaccgcgacgcggccgacgcggccctgcgcttcctcgccgccgaacccgcggggcgcgccgccctcgacgccgccgtcgcggcctacgcggagcgggatcccggcgtgcccgaagcggtggccgccggcgtcgacagcgacccgctggagcaggtgccgtccaagccgccgaagctccccgactgggtggtccccgccgccctgccccgcccggtcctgcggagcggcggcgccctgcacgacgccgccgtcaccgccctgtgcgagatgctcgccttctccgacccgctcgcgccctacgcgggcgtcgcgcaggtccgcgccgcctgcacgccggagagcctcgacgccttcgcggtcgcgctgttccagtcctggatcgccgccggcgccaagtcgacgggagagtgggcgatgcaggcgctcgccctgatcgggggcgaccacgccgcccgcgacctcacccggcagatccgcgcctgggggcaggccggcctcaagccgcgcggcaaggccggcatcgccgtgctcgccgggatcggcaccgacgtggcgctgatgaacctcagcgccatcgccgagaagagcccgctgctgcagctgcgcgaggccgcccgcgccgccatcgtcgacgccgccgaggcccgcggcctcgacgaggtcgacctcgccgaccggctctcccccgatctcggcctcgacgcgcgcggcgggctcgacctgtccttcggggagcgccggttccgggtcggcttcgacgagactctgaagcccgtcctgcgcgacgccgagggccggcggctcgccgccctgccccgcccgaccaaggcggacgatcccgaatccgccaaggcggcgtcccggcactgggcggccgtgcgcaaggacgccgaggcggcggccggcctgcagatcacccggctcgaggccatgctggcgtcccagcgccgcgtcgccccgggggtgttctggccgttcttcgccgcccacccgctgatccgccacctcgccgggcggctcgtctggggcctctacccggacgccgcgcccgcgacgccgccggggcgcgtcttccgcctcgcggaggatctctcgccgaccgacgccgcggacgacgccctcgccctcgacgtcgcggcggccgagggcgtggtcggcctcgtccaccccctccacctcgacccggaggaacggaccgcctggagcggcctgttcgccgattacgagatcgcccagccgttcccgcagatcgcccgcgagaccttcgcgttcaccgaggccgagcgggccgccgccgagacccaccgcttcgacggggtccgggtgggcggccgccgcctgcgggggctgcggccccagggctggtcgaccgacacggggagcgagcacgtccatgcggtgcagcgtccggtcgcgctgcccgacggcacccgcctcgtcgcggtcctccgattcgaggacgggttctggcaccggcccggcccggagggcgacgggatccagaccctgcggaccctgaccctgtcggagaccggctggcgcgccgcggcgacccaccggttcggcgacctcgacccggtgaccgcgagcgaggtcctgcggacgccgagcctgctcgccgccgccggcgacgcgtga

SEQ ID NO: 5264 - DNA, 441 bp, Methylobacterium sp.
atgtgcaatctgtactcggggatgccgtccgccgactacgagggcgagacccgctccatccggctcggcggacactcgacctcgatcaggatcgaggtgatgttctggaacgtgctcgaggacatcgccgccgctcagggcatgacccttccgcgcctcgtgacgcttctctacgacgaagtgctcgctctccacggtgaggcacgcaatttcgcctcgctcctgcggtgcgcgtgcctgaggcacctcgagatgaaggcggcgcgcctcgcctcggcgcatcggcgcgccgtggaacagcgcggcagggtcgcgggggacgtcgacggcgccctggaccggatcgacgaccgtgacgtcggcgtcggacacgtcgcgcggaccgcgcgcgccctgcgcggcgacgcggtccggccgcgcgatgcccgcggcgagggctga

SEQ ID NO: 5265 - DNA, 1527 bp, Methylobacterium sp.
atggatatgcctgtcgacgtcgtcgtggccggagccgggccggtggggctcctcaccgccatcgagctgaccctcgggggcgcgcgtgtccgaatgctggagcgcctcaccgagccgagcaccaccatcaaggcgctggggctcggccccctgggcgtcgaggcgctgcagcggcgggggatgggcgcggcgatcgaggccgtcgaggcgcggagcctcgcggcgatggatcgcctgccgggtcagatcggcggtggtccgcgcggggcagaggtcagcggccatttcggcttcctgttcattcgccgcgacccccaggcggagccggaccggcgcatgcgcgcggtcgatcagcagagcctcgaagccatgctgctcgaccgcgccgcggcgctcgggatcgacctgcgccgcggctgcacgctcacgggcttcacggaggcggccgacggggtcgaggtggcctggaccgcgccgacgggcgacgcgcgcgtccgctgcgcctatctcgtcggctgcgacggcggccgcagcgcggtccgcaagatggccggcttcgcgttccccggcacgccgccgacgatgaccatgtaccaggcgatcgccgatctcgacgatcccgccggcacgctgccggtcggctggcaccgagggccggggggcgtcttcggccacgggccgttcccgcgccgcctgttcatgctggatttcagcggcccgccggccgaccggcaggcgccggtcacgcgcgacgagatcgagaccgcgctgcgccgggtcagcggcacggacgtccgcgtcgcccggatcgcggtcgcgaaccggtgggccgacaacacgcgcctcgtcgacacctaccgccggggccgcgtgctgctcgccggcgacgcggcgcatgtccacgcgcccttcggcggccagggcctgagcctcggcctgggcgacgccgccaatctcggctggaagctcgccgccgtgctgcgcggggagatgcccgagagcctgctcgacacctacacggccgagcggcgcccggtggccgaggccgtcacggccaacacccgcgcccaggcggcgatcctgcggcccgatccgcaatcgggcgcgctgcgcgacctgatggcgcggctcctggagagcgacgaggtcagccggatcctcggcggcctgatgcgcggcctgagcgcccggtacgatctcggctcggccgaggacgcggtcggccggatggccggcgacgggccgctcggcgccagcggcgcgacgctctacggcgcgatgcaggacggccggggcctcctcgtcgacggcagcgccgacggcgcggcctcccggatggtcgccgcggcgacgggccgggtgacctgcgtggcggtcccggacgggccctcgacgctggtccgccccgacgggtgcgtcgcctggacgggcgcggcgaccgccctcgacggcctgcgggaggcggtcggccgctggttcggcccgtcaccggccgggccgctcggcgcgccggctccgatgtgctaa

SEQ ID NO: 5266 - DNA, 1431 bp, Methylobacterium sp.
gtgacacccttcaggctcaagcaggtcctggccgtctgggacgcgcgcgagctggatctcaaatgggccctcgtcggccgcatcgcgctgatcgcgatcctctgcgctgccggagcggccgcctacgcgatgcacgacgtcgcggcgaagacccgacagcggaacgccgagacggccgatgaggtgcacaagcagctccgcctccagctcctgcggatcgagcgggcggccgacattccccaacgcttcccggattgggagatcgtcacccggtacgctctgcaacccggccagtgcgtgcagctgatcccggcggaggccggtccgatacggtcgagctgcgtgggcgtcgaggcgcacgcgcgggccgcacccgactggttcgcgacgctttaccggttcctcttcttcgccggatccaccgtcagcctgccgctcgagcatcatgggtcgcggatcgggatcgtcgaagcggacatcgatcccgacgcggtcgtcgggtcggcgtggatcgtgctgaagcaggtgtccggcgctctcgcggccatgaccgtcgtcctgtgcgtgctggtctacggcgcggtggcgcacgcgctgcgtcccgccaacgacatcctgatcggtatcgatcgcgtcgcgaagggcgacctcggatggcgtctgcccagcctccgcctgcgcgagctccgacgcatcgcgacggtcttcaatcagctcgccagccatctccaagtcgccacgcgggaacgtgccgagctcgcgcgccggctgatcgatgcccaggagcaggagcggcgatggctgtcgctcgaactgcacgacgacgtcgcgcagcgtctgacggcgttgagccttctcgcccggtcgatccaggagggcgcgcgctcctcgtcgccttcggtcgtggccgagagtgccgaactcgccaccatggcgtcggacgccgtgcgcgcgctccggagcaccctcgccgcgctcaggccgccggagatcgacgatctcgggctgcgggtcgcgctccggagtctgatcgccgcccaggcgcagcgcgccgggggccggatccacgtcacgctcgcggccgacgcgcaggccgatcgcctgccctccgacgcggcggcccatatctaccggatcgttcaggaaggcctcaccaacgccgtccgccacgcggccgcgcacaccgtcgcgatcgcgctgaacgtcgcggagaccgacggcggcgccgaggtccagctgatcctcacggacgacgggagcggcgcgcccgcggaggcgctcgagcgcccgcattccggtctcggcctgctcggcatgcgcgatcgcgttcacgcgctcggcgggcagatcgtgacggatacgtccccgggcggcggattccgcctgcgggtccgctttcacgccgcgctcgcgagcgaagaggtgtcatga

SEQ ID NO: 5267 - DNA, 336 bp, Methylobacterium sp.
atgcggcggatcggcgcgaggcgggcggacggcgcggtcgcgctgatcggcccgcgcgtccgagccctccccgccgccctcccgtccgcacttccggcgctccgcgactgggtcgtcgccggtctcgcccgcgaggccgagcagcgccggctgttcccgtggctggcggtggccttcggcggcgggatcctggtctatttcgcggcggccgacggggcgccgagtccggccgcgcccctgatcgcggccgccctcgcgctggcgccggtccccgcactcggcgcgcggccggcggccctggcggcggcgctcgcggtggcgtccgcgttcctcggc

SEQ ID NO: 5268 - DNA, 477 bp, Methylobacterium sp.
atggcgagtgtcgtgcaccgcgggcccggcccgaacgctgtgatcggcggcatgcgggtctcctatctcgcgcgcagcgacgagaccggcgacggcctcggcatctaccgggtcgcgatggatccccggacgccgggcgcgggactgcaccgccacgcccggctgaccgagacgttctcggtcgaggcgggccggctcgcgctccacgtcgacggtgtggaccacgacctcggaccgggcgatttcgcgctcatcccgcccggcgtcgcgcacgccttcgccaatcgcggcgaccgcccggtgcgcttcacgctgagcttcgcgccggcgctcggccgcgagggcttcttcgagggtctggcccgcctcgccgcggagggccggctcggcgacgccgccgcgatgaccgacctgatggcccgctacgatcaggaaccgctggccgggttcgccggctggagttcggtcagcggctga

SEQ ID NO: 5269 - DNA, 294 bp, Methylobacterium sp.
atgatggcagcgcggcgctggctaagcgcgatggggctggcgctgcttccggcgaccgcccaggccgctctgccgccgtcctggcaacgcgtgcgtgaagtccaggccgtcgcggaggcggccgcgcgggtcctgggatcgcgtccgatcgatgcagtcgagcgcgtcgacggggagcgctaccgcgtccgggcgggtgactgccgggtcacggtccgcgtcgtcgtccgcccccgagcacagccgggaccgcaggccttcgacgcgataccggacgctccggactgcccctag

SEQ ID NO: 5270 - DNA, 405 bp, Methylobacterium sp.
atggatgacaggcagatggcccgcgggctggcttggttcgggatcgggctcggcctcgccgagaccttcgcgccccggcgcgtcgcggccgcgaccggcctcgacggccacgagggcctgatccagctctacggcctgcgcgagatcgcctcgggcgcggcgatcctggctgccgccgagccggagcggcttctcggcctgcgggtgggcggggatctcctcgatgccggcctgctggcggcccgcgccacgccctcgaacccgcggcgcaaccgcaccctggcggcggccctggcggtggcgcccgtcgtcatgctggatgccgccatctggctgagagcgcgcgacaggcgcagcccatctccgggcgatcccggccggaagcccggcgcgatcgcgcgatga

SEQ ID NO: 5271 - DNA, 906 bp, Methylobacterium sp.
atggccaccctcgcacgctcggaggtcctggcgctcgatcgcgcagcgcgggcccggccgcgcatcccctcgggggtcggcggcgtcctgccgggcacgctgctggtcgtcctggcgcttctcgggccgctcgccctgatgctccgctacagcttcaaccggttcgtccccggtgagctgatggtcgaggggctcaccctcgccaactacgccaagtttctgcacgacagcttctatcgggacgtcttgctgacgaccctctgggtggcggccctctcaacgctgatctgcctcgtgctcggcttcccggtcgcctatgccctggtgcggcaggtcgggccacgctggaagtcgaagctcctgatcctcatcatcctgccgctcctcatgggcaacgcggtccgcaccgccgcctggatggtcattctcggcgacaagggccttctcgccgccctgctctccgggatggggctcacgccgccccggttgatgtacacccccagcgccgtggtgatcggcctcgtctcggtgacgctgcccttcatgatcgtgacgctgcagagcgtgctcgagcggatcgatccggtcctggaagaggcggccgagagtctgggcgccgggcacctcacgatcctgcggcgggtcgtgctgcccctcgcgctgcccgggctgctcgctggcacgatgctgtgcttcatcctgtcgatgaacgcctacgccacgccggtgctgatcggcggaccgcaattccacatgatggcgcccgaggtctaccagcaggtcgccaaggcgatgaactggccgttcggtgcggccctcgccttcgtgctgatgacggtcaccctcgtgctgaccaccaccgccaacgtcctcgtacagcgccgctaccggcgctggtcggagtag

SEQ ID NO: 5272 - DNA, 819 bp, Methylobacterium sp.
ttggcggcgatttggctgacggccctgatccgggcgctgacctccgggaccgtggtggtgctcgcctccgtcctggccgagtggctgggaccggtctggggcgcgctcgtcgtcagcctgccggtctctgccgggccggcctacgtgttcatggcgatggagcacgacgccgccttcgtggccggggcggccctgaacggcttcgcggcgaacgccgcgacgggcctgttcctgatcgtctacgcccaccgggcggccggccgggacatgaccgccaccctcgggccggcgatcctggcgtggctcgcggcggccctgccggtctcggctttcacgtggacgccgacgacggcgttcctgctcaacgccctggtgtacggggccggcgcgctctcgacccggcatgttgtgcgcgcgaccctcgtcaggagcgccgtcgtcgtgaggccgcgcccgctggatctgctgatccgcgcgagtgccgtcgcgctgttcgtcgccgccctcctggcgctgagtacggccctcggccccgccaggaccggggtcatcgccgccttcccggtcacgatgacgagcgccttcgtcatcctccatcgccgcatcggcggggcggcgatggcgcggctggcgagcgtcgcgatccgcggggtgttcggcttcggcctgaccctgctgacgctccacctgacgatccagccctacggtgccgcgctcgcgctgacggtcgcgctcctcgtctcgctggtctactcggcgggactcctcgtggtgcagccccgtcccggtcggcaggagcccggcatcgtcacgcgctga

SEQ ID NO: 5273 - DNA, 867 bp, Methylobacterium sp.
atgagcggtctgccccgcgccgcgccggactcggtcccggactcgatcccggactcggctccggcgacgaccccgctggcgcgcaccggaatccgccgccgcgggatcctggtgccggcagtcagcgccgccacggtgctggcagccctcggcctctggctggtcgccacccgtgtaggctgggtgaagccgctgttcctgccgccgccggaggcggtcctggcggccttcggtcaggcttggcgcggggagatcgacggcgccccgctcgggctccacatcggcgacagcctcctgcgcgtcctcggcgccttcgcgctcgccgccctggtgggcatcccggtcgggctcgccatgggcacgagccggatcgcccggggcatcctcgacccgccgatcgagttctaccggccgctgccgccgctcgcctacctgcccctgatgatcatctggttcgggatcggcgagctgtcgaaggtgctgctgatcttcctcgcctgcctcgccccggtggcgctcgccgcgcgggcgggggtgcgctccgcctcggtcgaccagatcaacgccgcgcgcgccctcggggcgagccgctggcaggtcctgcgccacgtggtcttcccggcggcgctgccggagatcctgatcggcctgcggatcggcatgggcgtgggctggaccaccctggtggccgccgagatggtggcggcccaggccggcctcggccagctcgtcctcaacgcctccaatttcctgcggaccgacgtggtggtgatgggcatcctgctgatcggcctgttcgcgggcctgttcgagctcgggatgcggggcctggagcgcgtgctggtgccctggaagggccgacactag

SEQ ID NO: 5274 - DNA, 333 bp, Methylobacterium sp.
atgcgctccatgcctcatacacatccgccctacgccgccgagttccgccgccagatggtcgaattggtccgtgccggacgcgacccggccgatctcgcccacgagttcgagccctccgcccaggccatccgcaactggttcgctcaagccgaccgcggtgagagccgtggcgcctccaagagtgacgtcctgacgctcgccgagcgggaggaactggcccgtctacgccgcgaggtgcggcagcttcggttggagcgcgacgtcctctcaaaggccgcggcctggttcgcacgggagagcggcgcggtgccgtcgggctcttccagttcatga

SEQ ID NO: 5275 - DNA, 462 bp, Methylobacterium sp.
atgcgtcgcgccctcgccgccctggttctcgccctcccgcccgccgtcccgctcaccgccgcggcggacgatcttccgccgccggtcgcggcggcggccgcgcgggccgaggcgtcctgcgggtccgagccggccacgctcaagccgggtttcgtcacccgccaggacgtgaacggcgacgccgtaccggacttcatcctggatttcgcggccgtccaatgcggcgatgacgagtccgccgcgtgcggcaccgcgggctgcgagatgcaggtcttcgcctcgacgacggacgggttcgtggacgccttcgacgccgtcgcccacgacctccgcttccgcacggtgggaggccgcccggcggtcatcgtcgatatgaccggggcgacgtgcggacgatccgggcaggatccgtgcggcgcgatcgccgtctggaacggcaggacattcggccggacacggtag

SEQ ID NO: 5276 - DNA, 450 bp, Methylobacterium sp.
atgcacgcggtccatgaactcccgcccatcaccatcacgacccgcgacttcgaccggctcgtggtcttcgggctcgacgcctatctccgtggcgaccgccgagccgacttcctgctttcggagctgaagcgggcgaccctatgcccgccccgcgcgctgccgggcgaggtcgtctcggtccaccgctgggtgcactaccggctcaatgacgatccgaccgtgcgagggcaactcctcgtgcatccccacgatctcaccgacctgccgggcggactctcggtcgcgagcccgctcggcacggcgctgctcggcctgcgggtgggcgatcggatgcccttccgaatcgacgatgccggcatccagcacgtcgtggcagtcgtgggcatcggccggcgcttctcagatgagccggtccgcggccgtggggcgcccgcgccgcgcgaggcctag

SEQ ID NO: 5277 - DNA, 258 bp, Methylobacterium sp.
atggccgaaggcgcggaaggaatgcgcgactggcacgtactcatcgtcggcggtttgcccaccgacggccaaaagcgggcaacggtcatcggcgggatcgcagacggccttcgccgcggcggagcaggtgtgcggatcgtgaaggcagccgatcgctccgagttcgatacggaagccggacggctcaaggatgcccgcagccacctcaatctgattgagattgcctaccctgggctggtcgacgtgccggccggatga

SEQ ID NO: 5278 - DNA, 636 bp, Methylobacterium sp.
atgcggatcctgctcctcaaccccaacacctcggcggcgatgaccgcgcgcatggcgcgggccgccgaggcggcgctcgcccccgacgcgcacatcaccgcgctcaccgccgcgacgggcctaccctacatcgcgagccgggccgaggcgcagctcgccggcgcggccgtgctggagacgctcgccgcccaccattccggccacgacgccgcggtgatcgccgcctacggcgatcccgggctggtcgccgcgcgggagctgttcgacctgccggtcgtcggtatggccgaggccgcgatgctgaccgcctgccagctcggagcgcggttcgcggtcgtcaccttcgcgcccgccctgctgccctggtacgaggacgcggtggcgctggccgggctgtcggcgcgctgcgccggcctccacgcggtgcgccggccgttccaggcggtgacggacgtgcaggacgagctgcggcccgagatcctggccctggccgagcgggcggtgggggagggggccgacgtcgtgatcctagccggcgcgccgctcgccggcctcgccgcgaccctgcgggacgcggtgccggtgccgctggtcgacccgctggcggccgccctgggccaagcgcaggccctggtg

SEQ ID NO: 5279 - DNA, 1419 bp, Methylobacterium sp.
atgaacgcccccgttcccgccccgcggacccgcccggacgcggcgacgatcgcgggtctcgccgaggccctgcgggccgtgctcggggaccgggtgacggcgagcccggcggtgcgcgagcagcacgccaaccagctcacctgggcgccgtgcgagccgccggacctcgtggtcttcccgcacgccaccgcggaggtgcaggccgtcgtgcgcgcctgtgccgagcgcgacgtgccgatcgtgccctacggcgtcggcacctccctcgagggccacgtcaacgcgccgttcggcggcgtctcgatcgacacgggggcgatgaaccgcgtccgcgcggtccatgccgacgacctcgactgcacggtcgaggccggcgtcacccgcagggcgctgaacgcgtacctgcgcgataccggcctgttcttccccatcgatcccggggcggacgccacgatcggcgggatggcggcgacgcgggcgtcgggcaccaacgccgtacgctacgggacgatgaaggacgcggtgctcgcgctcaccgcggtgatgccgaacggcgacatcgtcacgaccgcccggcgggcgcgcaagtcgtcggccggctacgatctcacccggctcctcgtcggctcggagggcaccctcgggatcatcaccgaggtcacgctgcgcctgcacggcatccccgaggcgatctcggcgggcatctgcccgttcccctcgatcaaggcggcctgcgacgccacgatcctgacgatccagtccggcatcccggtcgcgcgcatcgagctgctcgacgaggtgcaggtggcggcctgcaaccgctactcgaagctcagcctgccggagaccccgctgctcctcgtcgagttccacggcacggacgcgggcgtgcgcgagcaggccgagcggttcggcgagatcgccgccgatctcggcggcggcccgttcgactgggcgaccggggccgaccagcgcgcgcgcctctggcaggcgcgccacgacgtgtattgggcctcggtcgcgctgcggccgggccccacgatcaagaacatgtcgaccgacgtctgcgtgccgatctcgcggctcgcggaatgcgtggaggcgacgaagcgcgacatcgccgcgaccgggctcacggcgccgatcgccggtcatgtcggcgacggcaacttccacaccctgccgctcgtcgatgccgacagccccgaggagatgtccgcggtggccggcttcctcgaccggctcgtcgcccgcgcgctggacctgggcggcacctgcacgggcgagcacgggatcggccagaagaagatgcgcttcatggaaagcgagcacgggccggaggcgctcggcctcatgcggaccctgaagcgcgcgatcgacccccggaacctcatgaatcccggcaagctgattccctga

SEQ ID NO: 5280 - DNA, 759 bp, Methylobacterium sp.
atgatgcgcgcgctcgaagggcaggtcgcctgggtgacgggggccggatccgggatcgggcaggcggccgccgtcgctctggcgcgggccggcatgcggctcgcgctcaccggacggggacaggaggccctcgcgcgcaccgcggagatggtccgcgctgcgggcggcgaggcgctggtcgccccggccgacatgggcgtggccgacgacgtgcagcgcgcctgggaggcggttcacgccgcgtggcggcgctgcgacctgctggtgaactcggcgggcctcaacgtgccgcagcgcggctggagcgagatcacgccggccggcatcgacgccgtggtcggcatcaatctcaacggccccttctacgcggcgcgggcggtgctgccgaccatgcgggcgcagcggagcggcctgatcatccacgtctcctcctgggccggccgctacgtctccaagctgacgggaccggcctattccgccgccaagcacgggctcgtggcgctctcggagagtctgaaccaagaggagtgcggccacggcatccggtcctgctgcatctgccccggcgaggtcgccacgcccctcctcgacaagcggccggtcccggtcaccgcggaggaccgcgggcgcatgctccagccggaggatctcgccgagacgatcctgttcgtcgcccgcctgccggtctccgtctgcgtcaacgagatcctgatcagcccgacctggaaccgcggctatctcgagggcgtgaagctctga

SEQ ID NO: 5281 - DNA, 1620 bp, Methylobacterium sp.
atgtcgatcgtgggcgttcaggtctcgtccgtcggcgcggtgatgatggaggggcgcaaggccgccgtccgcgcccaggtcgagtcggcgcacggcatcgtggcggcgttcgcccggcaggcggaggccggcgccgtctcggccgacgaggcgcggcggcgcgcggcggaggcgctgcgggccatgcgctacaacggcggcgactacgtcttcgtctacagctcggagccgggcaacatcggccgcaacgtcgtgcatcccgatcccaggatcgagggcacgcggtcccgcgacgacgcggcgatgaagaagaccttcgtctggacgatgatccagcacgcccgggagggcggcggcttcaccgagtaccgctgggcccgcctcggcgagaccgagcccgccccgaaggtcgcctactcgctcgcctacgagccctggcaatgggtgatcagctcggccctgtacgtggacgacatccacgccctggaccgggcgcggatggtcaccaccctgctgtggctgatacccctcgggatcgcgatcgggctggtcgggttcctgctggcgcgcagcatcacccgccccctgagcgccttcacggccgccctgcgccgcctcgccggcggcgcgacggacgtcgccatcccgggtctcggccggcgcgacgagatcggccagatggccgaggccgccggcgtgttccgggacagcatgatcgaggcgcggaccctgtcgaccgagcagcgcgccgagcaggagcgtcggcaggagcgggcccagtggatggaggcggtgacccgcagcttcgacaccgaggcgagccagctcctggcccgggtcgacaccgccgcggccgacatgcgggaggcctgtcgggcgatggccgacaccgccgcgcaggcgtcgcggcaggccggctcggccgccggggcggcgcagcaggccgccgccaacgtgcagacggtggcggcggcgaccgaggagctgtccgcctcgatcggcgagatcggcgggcaggtcaccaagtcggccgcgatcgccggtcaggcggtgagcgaggcggagcggaccgaccggcagatccgcggcctcgccgcggcggcggagcggatcggggaggtcgtgcggatcatctcggcgatcgccgagcagaccaacctgctggcgctgaacgccacgatcgaggcggcgcgggcgggcgaatcgggacgcggcttcgcggtggtcgccgccgaggtgaagggcctggccgggcagaccgcgaaggccacggaggagatcaccgcgcagatcgcggcgatccagggcgagacgacggaggcggtcggcgcggtccactcgatcgggaggaccgtcgacacgatgaacgcgatcgccagcgcgatcgcggcggcggtcgagcagcagcggttcgccaccgggcacatctcgcagaacatcgacgaggccgcccgggggaccgacgcggtgagcgcgaacgtggtctcggcctcgtcggcggcggaggcgacgcaccgcgtggccggggaggtcggtgccgcggccggcgacgtctgccgcagcgccgaggccctgcgcgccgaggtgatgcgcttcctcgtcgagatgcgcgccgcctga

SEQ ID NO: 5282 - DNA, 1206 bp, Methylobacterium sp.
atgaccagcgaccgcaagctgaaagttgtggctgtcgcgggcagcggcacgctgttcttccacgcggcggtgctcggcaccttcctcgccgcgtccgccgctccgacaccgctgtaccggttctaccaggagacctacgcgctctcccccgtgatcacgaccgcggtgttcgcggtctacgcgctggcgctcctcaaggcgctcctcgtcgccgggtcgatctcggaccatctgggccgacggccggtgatcttcggcgcgctgctcctcgagctggtggcgatggccctgttcacgacggccaacggggcgtggggactgatcgcggcgcgcttcgtccagggcgtggcgactggcatcgcggcgagttcgctcggcgccgcgctcgtcgacgtcgaccgggcgcgggcccagctcgtgaacgcgatcatgccgctgatcgggatggcggcgggcgcgctcgggaccagcgccctcgtgcagtacggcccgcatcccctccacctcgtctacgcgatcctggccgcggtgttcgccgcgcaggccgcgctcctctggctcacgcccgagaccggggagcgccgcgcgggcgccctgcgggccctgaggccgcgcgtcgtgattccgccgcaggccagacggccgctggccgcgatcacgccgaccaacatcgcgacctggatgctcggaggcttctacctctccatcgtcccctcgctggtcgtcgcggcgacgggcagccggacaccgttgacgagcggcgtcatggtcgcggccctgatggtcgccggcgccttcgcggtcctccagcggcgcggacgcgacgccgcggccaacctcacgatcgggacgctcgccatgaccgccggcctcgtcatcgtgctcgccggcatgcacggcgggagcgtgccggttctgatcggcgggaccctggtcggcggggccggcttcgggacgagcttcctcggcgccctcgggacgatcgtcccgctggcgaagccgagcgagcgggccgagctcctcgcgagctactacgtcgagagctacctggcgttcagcctgccggtgatctgtgccgggtatctcgtgcgccggatcggctacgtgacgaccgccgacctgtacgcggccgcgatcctcgccatgagcgcggccgggttcctggcgcggcgggcgttgacgtcgcgacgcgtctcgcccggctga

SEQ ID NO: 5283 - DNA, 276 bp, Methylobacterium sp.
atgaccgagatgctgcgcgacaatgtcgagcgaggccgcttcgagctgcaggtcggcggtgacgtcgtcttcgcgacctatcggcgggaacccggccagctcgtcatcagccacgtgtacgcgccgccggtcctgcgcggcaccggggcggccgaccggctcatggaaggcgtcgcggcgcacgcgcgcgccgagggcgatcggatcgtgcccctgtgcggctacgcccgggcgtggctgcgcgggcatcggacgcatcgcgacctgctcgcgtga

SEQ ID NO: 5284 - DNA, 1542 bp, Methylobacterium sp.
atggccacatcgctgatccgcagccggcggatgatcacccgtaccctggaccacgatcgctgggaggagatcgccgacggcgcggtgctgcagacggacggggtgatcgcggcggtcggtacctacgcggacctgcacgcccgctaccccgacgcccccgtgatcggctccggccgcgagatcctgctgccgggcttcgtcaacggccaccaccatgtcggcctgacgccggtgcagctcggctcccccgacatgcccctggagctgtggttcgtcacccggatggtggcgcgcaacctgaacctctacctcgacaccctgtactcggccttcgagatggtcggctccgggatcaccacggtccagcacatccacggctggatgcccggcagcctggaggaggtcgaggcgcgctccaacgaggtgctgcgcgcctatcgcgacatcggcatgcgggtctcgtactgcttcgcggtccgcgaccagaaccgcctcgtctaccaggccgacatggacttcgtggcgagcctgccggcgccgctgcaggacccgatgaagcgctggttcgagcgcttccagatgtccctggaggacaatttcgccctcttccgcagcctgcatgccgggcaggagggcgcgtcgcgggcgaagatccagctcgcgccggccaacctccactggtgctccgacgcggccctcgaagggctcgccggtctgtccgaatcctacgacgtgccgatgcacatgcacctcgtcgagaccgcctaccagaaggcctacgcggagaagcgcggcggcgggaccgccctcgagtacctcgaccggttcggcatgttggggccccggctgacgctcggccacggcgtctggctgaacgaagccgacatcgagcgggtcgccgcgaccggcacctgcatctgccacaattgctcgtcgaacttccggctgcgctccggcgtggcggcgctcaaccgcttcgaggcgaaggggatcaacacggcgatcggcctcgacgaggccggcatcaacgacgaccgcgacatgctgcaggagatgcgcctcgtgctgcgcgcccaccgggtgcccggcatggacgaggccgacgtgccgagcatggcccaggtgctgcgcatggcgaccgtcggcggcgcccgcaccaccccctacggcgacagcctcggcacaatcgaagtcggcaagggcgccgacatggtcctgatcgactgggaccagatcgcctacccgtatctcgacccggagacgccgctcctcgacgcggtgatccagcgggccaagaccggcggcgtcaccgcggttctgtgcgagggcgaagtgctctacgcggacggccgcttcacccgggtcgaccgcgacgccgccctgaaggcgctccacgacgacctgtcgcgggcgctctcggacgacgaggtcgagcggcgccagctctcgaaggcgctgctcccccacgcgcggcgcttctacgccaactacatcgacccgtcgcggcacgagccgttctaccgcccgagctcgcgcgtctga

SEQ ID NO: 5285 - DNA, 807 bp, Methylobacterium sp.
ttggcctctgatctccgctccgacgacgccgtcgcgtgccgcggcgtcgccaaggtctgggcggccggtaccgcccgcgcccacgaggccctgcgcgacatcgacctcaccgtgcggcccggcgagttcgtggtgttcctcggcccctcgggctgcgggaagagcacgctgctctacctgatcgccgggctcgaatccgcctccggcggcgagcttctggctttcggcgaaccggtcaccgggccgtcgccggagcgcagcctgatcttccaggagacctcgctgctgccgtggctcagcgtctggcagaacgtcagcttcggcctgtcgctgaagggcgtgcctgaggccgagcgccggagcgtcgcccgggccgcgctccagcgcgtcggcctcgccgaggccttcgacaagcggccggacgagctgtccggcggcatgcgccagcgcgtggcggtggcccgggcgctggccatgcgcccgaaggtcctgctgatggacgagcccttcgcggcgctcgacgtccagacccgccagaagatgcaggacttcctgctcgacgtctggcgcgacagcggcgcctcggtgctgttcgtgacccatcacatcgacgaggcggtggcgctcgccgaccgggtggtggtgttcaccgcgcgaccggggcggatcaagacgatcgtccgcaacgacctcgcccgcccgcgtgacccgttctcgcccgaggccgaggctttgcggcgccacctcaccgagctcctgcgcgacgaggtcgaccgggccttcgccgagcaggaagcgctcgtctga

SEQ ID NO: 5286 - DNA, 930 bp, Methylobacterium sp.
atggccaccttcctcgcccgcgccgccgccgtcccgcaggaccggccgcgcctcccgctcggtcagcgcctcgcgctgcccgaagggctcgtccccctgctccgccggaccggctggatgctgatctcggtcggctgcttcgccggcctctgggagctgctctgggcgctcggcatcgccgacgccaagctcctcccgccgccgcacatcttcctcggcaacctcgccgagcaggcgcgcttcttcaacaccgcgcagcgctggcagatcggcaccgggatgaataccggcccgagccccgccatggcggtgctgatcaccgtgctcgcctcgaccggccgggtgctggcgggcctcgccctggcggcctccctgtcgatcctggtcggcgtggcgatccgctacttcaagctgttcgagcggctgaccctgccgaccatcacgctcctggcgccggtctcgccgatcgcgtggctgccggtggcgatcttcatgttcgggatcggcaacgccccggcgatcttcatggtgttcatcgctctgttcttcacgatggtgctctcgaccatccagcagatcgacggggtcaaccgcaactacatcaacgtcgcccggaccatgggggcgtcgaagcgccagatctacgcccgggtgatcgtgccggcgatcctgccggggctgctcgcggtgctgcgcctcaacctgttcggcgcctggatggtggtgctcgtcgccgaggcgaccggcgtgggctacgggctcggccaggtgatcatgctggcgcgcaacaccttcaacccgtcgctggtcttcttcaccatcacgctgatcggcctgctcggcttcgccttcgacctgctgttccggctggtccagcggcggctgctgtactggctgccgcgcgacgcggggtcctcccttggcctctga

SEQ ID NO: 5287 - DNA, 1053 bp, Methylobacterium sp.
atgtgcgaccgtcacggcgtttatcgcgtcccggatctcacgcggttcaagcccagccgcaggcgcttcctcggcgggaccgccgccgcgctgaccctggcggtgggcccgggcctgaccggcccggccgcggcggccaccggcatccgcgcgacccacggcaccgggttctgtaacctcaacttcttcctggccgaggcgatgcagctcgccaaggatgacgggctgacgatcgacttcgtcaacacgccgaccttctcggatcaggtcaccttcctcggcatgggccaggtcgatgccggcgtgatgccctacacgagcttcatggccctctacgacgcgggtgctcccgtgaagatcgtggccggcggcggcatcgagggctgcgtgctcgtggcccagcccggcctcgacagcccggagaagctcaagggcaagacgctcgggacattccagctcgatacgctggaggtgctgccctacgactggctgaagaagaacggcgtcgccttcaaggacatcacggtccgctacatgggctcgaccccggaggccgtggaggcgttccgcgccggggcgctggacatcatctcgaccatcgagccgtacggaacggccctgctcaccgacgtgaagggcgcggtgaagctctccgacggcacagacatctacggcaagggctacacggactgcgtgctggcggtccgcaacgagctgatcgccaagaacccggccgccgtgaaggccctgatcaagggcatgatgaaggcgcaaggcttggccgagagcgacccccaggccgccctgaacaagctcgtcggctcctactacaagacctcgatgagcaacgcccagctcgccatgggccggcagccctcggtggtggacgcccgcaaccagacgcagttcatcctcgaccggaccgattccgtcgccgagatgggctacatcaagaggaagcccggccgcgacgcgatcgactggaccctgctggaacaggtcatcgcagagaacccggacctctacggcaagctcaagctgaagtcggcctga

SEQ ID NO: 5288 - DNA, 954 bp, Methylobacterium sp.
ttggcggacagcgcgcacacggccgatcggtcgatccctccctgcccgatcaccggtgcccccgcgctgcgctgcgtcgagcgcctggacgccggcttcctgacgctcctctggcactattccgggcgcgtcgatgtcgggccgctgctgcgtcccgccggcacgttccggctctgggaatcccccacgggattgatcttcttcgatccgccggtggccggcgatgcggccttctaccgggcgttctacggccggatcgccgcgcacgataagctcgccggcccggagacggagcgcctggaattccgccaggccgccgcgcacgtgccgtccggggcccgggtgctcgatgtcggctgcggccacggcgggttccgcgcctacgtgccggacgccacctataccggcctcgacccgaacttctccgccgaggacccgaccggcgcgatcctcgacgagaccgtggaggcgcacgcggcgcgcgtcgggccggtctacgacgtcgcctgcgcgttccaggtgatcgagcacgtggcggacccgctgggtttcgcccaagcgctcgcggcctgcgtcaagccgggcggcgtggtcctgatcggcacgccgctctggccctcgcccaacaccacgatcccgaacttcgtcatcaacgcgccgccccaccacctgacgtggtggacgcccagagccctggaggcgctggccgggacgctcggctgcacgcccgaggccgtccacgccatcggcatggaccggcacgattcgctgatccactggatggccaaggtcagccccgtccgctgccgcgaccgcttcttccggcggacgtggtcctgggcggcggcgctcgccttcgcgtacggcgtcggcgccgtcctcgaccgcgtcctgccggtgccgaagcggacccgcccgaacgcgctgctgctcgcggcgcgcaaggcggcctga

SEQ ID NO: 5289 - DNA, 1467 bp, Methylobacterium sp.
atgcaggacgaagctccggacgccaccgccgaaatcacgctggtgaagggggcccggtgggtcgtcgcctgggatccggacagcggcggtcacgtctaccgcaccggcgcggacgtcgccttcgcggacggcgccctcatccatgtcgggccgggctacgcgggtcccgagccggcccggaccgtcgacgcctccggctgcatgatcatgcccgggctcgtcgacatccacacgcacctgttctcggagccgatgaacaaggggatgtgggacgaggtcggcagccagcggctctacaacacctcgctctacgagtacctgccgatcctgcggcccgacgctgaggggacgcgggccgcctacggggtcgcgctcgcggagctcgccctgtcgggcgtcaccaccgtctgcgacctcgccctgccgagcgcgggctggctggatctcctcggcgcctcgggcctgcgggtctgcatcgccccgatgttccgatccgggcgctggctcacccgcaacggccacagcgtggactacgagtgggacgcggcggcgggcctgcgcggcctggagcaggccctcgccgagatcgcggcggcggaggggcacccgagcgggcgcctctccggcatgctctgcccggcgcaggtcgacacctgcacggcggagctgctgcgggacgcccattccgaggcggtcgcgcgcgacctgcgcttccaaacccacgcggcgcagtccctgtcggaattccacgagatcacccgccgcaccgggatgacgccgatcgagtggctcgacgatctcggcgtgctcaccgagcggaccatcgtgggccacgggatcttcctcgacgaccatccctggacccactggcacagcccgggctcggacctgcgccgcctggccgagcgcggcgccacggtcgcccactgcccaacggtattcgcccggcgcggcatcgcgctccaccatttcgggcgctacctccaggccggagtcaacatggggatcggcaccgacgtctacccgcacaacatgctcgacgagatgcgcctcgtctcgtacctcgcccgggtcgtcgccgagaatccccgcgacacccgcgcggcggacgtgttccacgccgccacggtgggcggcgccagggcgctcgggcgcgaggacatcggccggctcgaaccgggctgcaaggccgacttcgtgctcgtggactgcgggcatccggccatgcgcccgtgccgcgatcccgtgcagtcgctgatctactcggccggcgaccgcgcggttcggcaggtcttcgtcggcggccgcgagatcgtccgcgacgggcgcgccctgacgatcgactacgccgccgccgcggccgcgctggaggaggcgcagggccgcgcgctcgcgcaggtccggcagctcgactgggccgggcgcggccccgacgccatcgcgccgccgaccttcccggggctgtga

SEQ ID NO: 5290 - DNA, 681 bp, Methylobacterium sp.
atgcggcctcgcgacaccaccgagcccgcgcgcatcctgatcatcaacccgaacgcgtcccgggcggtgacggccgccatcgacgccgccctggcgccgctgcggctgccgggcggccccatcctcgcggtgaccgacctgccggagggcccggagagcatcgcgacccagcgggacgcggattcggtggtgatgccgctcgtccggtgcgtggcggacgatccgtccgacgccttcgtgatcgcctgcttcagcgatccgggcctgcacgcggtccgggaggcggcgagcggtcgcccggtgatgggcatcgccgagtgggggatcctgcgggccctgacgctcggggagcgcttcggcatcgtggccctgtctgagggcagcgtccggcgccagcgccgcacggtgcgccagatgggcctcggggatcgctatgccgggagccggccggtggaggcgcgggcctccgagacggcggacgccgcgatgggcccgcgcctgatcgcggccggtcggaccctggtcgagcgcgacggcgccgacgtggtcgtgctcggctgcgccggcatggcgcgccaccgggccgccgcggaggccgcgatcgggtgccccgttatcgagccctgccagcaggcggccgccgcggccctcggggccgtgctgctccgggccgccccgtga

SEQ ID NO: 5291 - DNA, 837 bp, Methylobacterium sp.
atgtcggacgccgtgaccggaccggcagccatcgccggagagagccacgaggccccgccgcgcgacaaggagcgcctgcgcgcgggcgtcctcgtcctgctcgtgcagatcgcgcttcttgcggccctgctgtcggcctgggaatggcagacgcgcctgaacccgcaagcgtcgttcctgttcggttcgccctccgcgatcggccgcttcctctggcagggtctcgccgacggcacgctcctgcgcgacgcgggcgtcacggcccttgagacggggcttggattcctgatcggcaacgtcgtggggacgctcgctggcctgtcgctctggtactcgaccttcgtctcgcgggtcgtccagcccttcatcgtcgcgatcggctcgatcccgatcatcgcgctcgccccgatcatcatcatctggttcgggacgggcctcgcctcgaaggtcgcgatgtcgacgctgtcggtcgtcgtggtcgccctcgtgacctcctacaagggcgcgctcggcgtcgatccggaccagatcaacctcctgcggaccctcggcgcgcggaagccgcagatcttcgccaagctcgtcgtgccgtcgagcctcgccgacatcttcgccggcctgaagctgaccgtcggcttcgcgctgatcggcgccatcgtcggcgagttcatgtcgtcgtccgtggggctgggccacgccatcttccaggcgggctccctctacgcgatcccgaaggtgttcgccgcgctggtcggcacgatcgcgctggccctcgtcctgaccttcctggtcggtcgggctgaacggatcctcatgccctggcgggatcatctctga

SEQ ID NO: 5292 - DNA, 861 bp, Methylobacterium sp.
atgtccgaaggccccccgcacgccgcgacccaccccgcgcctccgcttgccgtcgagcacctcgccaaggcgtatcggacgggcggtcgcctcctgccggtcgtcggcgacctcaccttcgcgctcgcccgcggagagatcgtggcgatcgtcgggccttcgggctgcgggaagaccacgctgctcaacgccgtctgcggtctgacgccggtggattcgggccgcatcctctggaacggcgtgcccctcgaccggcgcggacggccgccgagcgggatcggctacatgctgcagaaggatctgctgctgccctggcgcacggccctcgacaacgtgaagctcgggaccgaactgcgcgggatgccgcgcgggcaggccgacgagcgggcgcgggcgctcctcgaccagctcggcctgcacgggttcgccggggcctatcccgcgaccctgtcgggcggcatgcgccagcgcgtggcgctcgcccgcaccctgatcaacgatccggacgtcctgctgttcgacgagcccttcgcggcgctcgacttccagacgaagctgctgatcgaggccgacacggtgcggctcgtgcgcgagggggccaagtccgccctcctgatcacgcacgacatcgaggaggccgtctcgatcgccgaccgcgtcctcgtgctgagcgggcggccgaccgccgtcaaagccagctacacgatcgacctcgactgcgcgcccgacgacatgatcggcgcccgggagagcgctggtttcggcgattacgtccgccagatctgggccgatctcgatatcccacgctccacgctcggcggtgccgggcgtggcatccgccgcgctgccgcgaggtcgtga

SEQ ID NO: 5293 - DNA, 954 bp, Methylobacterium sp.
atggctggtctggcggtcggtgcgccgctggtcgcacgggccgcgggcctcaagaccgtccgcttcagcgaggccgtgcataacctcggctacatcaacctctatgtcgggattcacgccgggatcttcgagaagaacggcctcgccatgcaggtgagcgccgccggcggcgacacgcagaccttcgcggccgtgctgggcggctcggcggatttcgccatcggcgatcccacgatggtggtgatctcgcgcgagaacggcggccccgggatggtcgtcggcaccgttgttcagcgggcccactacttcgcggtctcgaagactgtcgagcccttcaccgacccgaaaggcttcaagggcaagcggatcgccacctcgccggagcccaacaccaacttcagcgtcaccaagcggctcctcgagagcaacggcatgaagctcggcgccgacgcgacgatcgtgccggtgagccccggaaccgagatcgccgccatgctcgcgggtgcggccgacatcgcggtcgcctatcagccgggcgtggcgcaggcggtggcgcagggcgccaggatcgtgttcgatttctcgaactacgtcggacccttctgcaacaccgggatcatggtgctgcccggcacgatccagaaggatcccgagaccgtgcaggctctggtgacggccttcgaggaggccgggcgcaggacctacggcgatcccgactacgccaaaaaggtcgcgcggctggaattcccggatctgccgggcgaggtcgtggacgcggcgatcgaggccgagctgaaatacaagattccggcttcaaccgtcgtgaccgagaaggacgcctgggaaagcctgatgggcatgcagaagtacctcggcaacatcaagggcacgctcaccttcgatcaggtcgtcgacaatacctttgccgacaaggccgcgaagcgcgccggttga

SEQ ID NO: 5294 - DNA, 1500 bp, Methylobacterium sp.
gtgctcctgctggaagccgggcgcgactggcgctccgccgatgcgccgccggcgctgcgctcggccaacatcatcccgttcatgtatgacctggcccatcaggcggactggcagtggccggggctgatgagccggcggacccgcgtgcaggagccccgcttctactggcgcggtcgcgcgctcggcggcagttcgacggtcaacgcgcagatcgcgatccgcggcgtgcccgccgccttcgacgcctgggcggagcagggctgcaccggctggtcggcctcggatgtgctgccgctcttcgaccggatcgaggacgatgccgatttcggcaccgaagacggcgcccggcgcggcggtccgctcccggtccaccgcgcgaagccggaggcctggggcgcggtggatctggggcttcgcgcggccgccctcgcggccggccatccctggaaggcggacctcaatgcgccgacgggcgagggagtctcgtgcaacccgatcaacagccgcgacagtcaccgcgtcaccaccaatgacggctacctggaaccggcgcgcgaccggccgaatcttgagatccgctgcgaggccctggtcgatcgcgtcctgttcgcgggacgacgggcaaccggcctgcgcgtgcgcttcggtgcggaaccctggaccgagatccagggccgcgagatcgttctgtgcgccggcgccgtccacagcccggcgatcctgatgcgctccgggatcggcccggccgagccgctgcgcgcccttggcatccccgtccggcaggcgcacgaggcggtcggccgcaacttcatggaccatccgatcctgcgggcgacgatggatctgaagccggaacaccgagccctcggtccggatgcgcgccacaccaattgctgcgtcacctattcgagcggcctctcgggcggcggggagcgcgacatgatcttcgtcgcctacaaccaccggaccctgaccgggccggaaccgacgccgcagggcgccgtcggcgtcggcctctacgacgcgttctcgcgcgggacgctgcacctcaccgcggccgatccggaggccaacccggtcatcgacgagaatatgctcgatgacccgcgggatcgcctgcggatgcgcgacgcggtgcgccgcctcgcgggcttggcggcgcatccggccctggccgatctcgcaacggcgatccggttcggcgagagcccgcttccgatcggcgacgccgcgcgcctcccggatgacgaactcgatgccctgatgctcgccgaggccggggacatccagcacgccgccggcacgtgccgcatgaccggctggcaggacgcgtccggggtcgtcgaccccgatctcaaggttcgcggaatggatgggctgcgggtttgcgacgcctccatcatgcccagcgattgccgcgcaaacctacacttcacctgcgtgatgatcggcgaaaatcttgcgcggcgcatgttgacgggcggatcgcgtcacccgtga

SEQ ID NO: 5295 - DNA, 501 bp, Methylobacterium sp.
atgaaggatcgctggctccgtctccgtgccgacgactgcgtgacgccgtcgggtcacatcgtcgatccctattacgtgctcgagacgccggacatcgccctcgtgctgggcatcgacgcggccgatcacgtcatcctcgtacgccagtaccgtcatgcctatggcggcccgagcctggagcttccgggcggggccatcgaccccgccgaccccgacatcctggcggccgccgagcgcgagatgcgcgaggagaccggctacatcttcgccgatgccgagcgcgtggtcaccctgaacgcggatccggcccgctacgccaaccgcatgcatctcgtccgcgcgcgcgtgacagcggccgggccggcgcagccggatcccgccgaggacatcgccgtggtgcgcgtaccgcgagccgaggccttacagctcgcccagtcgggcgccatcgtcggagccgtgcacgccgccatgctcctgatcggcctgtccagcaccggatga

SEQ ID NO: 5296 - DNA, 603 bp, Methylobacterium sp.
atgacgactgatcacacagcaaacccgtggctgacgctttcgagtgagacgtaccacgaggacaagtacctgcgtctagacgtcgaccaggtgcgacatcaatcgggtgtcgagcacccctataccgcggtccgcttcaaggtttttggcctcacggttctgccgatcgacgatgccggccgcaccttcctcgtggggcaatatcgctatctgctcgatcgctacctctgggagttgcctcgcggcgggggcgcagttgacgtgccgccgatcgagacggccaagcgtgaactcgcggaggagacaggccactcggccgcgcactggtttgagctgcccaagctgactgcctcgccggagatcacgagcgaatgggcgccctgctacatcgcctggggcctgtgcccaatcagtgcggaagctgacccgcaggagagcctcagcattcgccgcctgcccttcggcgaagcggtcaacgcagtgcttgcgggcgaggtcgtcgacgcagcgagcgtcgcgctccttcttggaacagcggagcgggctcgccgtgggcagttgcctcaagatctcactgcgttgctaggcacaggcggcctttag

SEQ ID NO: 5297 - DNA, 759 bp, Methylobacterium sp.
atggatgcgatggatcgagagaacggcacgacgcgtctgggcatgctgacgccctcgtcgaacagcgtcctcgagccggccacggcgcatctgctggccggcgtcgcgggcgtgagcgcccacttcgcccgcttccgcgtgacggagatcggcctgtcggcggcggccctggaccagttcgaccccgagccgatcctggcggcggccgaactgctcgccgatgcccgcgtcgcagcgatcctgtggaacgggacctccggcgcgtggctcggcttcgacgcggacgagcgcctgagcgccgcgatcaccgaccggaccgggtgcccggcctccaccgccgcgctcgccttccgcgacctgttccgcgcccgggatttccggcggatcggcctcgtcacgccctataccggcgacgtgcagcgccggatccaggccaactggggcgcggccggcttcgactgcgccgccgagcgccacctcggcctgtcggagaacttcgccttcgccgagaccggcccggaggccatcgccggcatggtccgggcggtggcggccgagggcgtcgacgcggtggcgatcgtgtgcacgaacctcgcgggcgccgcgctcgccccgaccctggaggcggaactcggcgtgccggtgatcgattcggtggccgtcaccctgtggaagggcctggagctggcgggctgcccgacggcgcatctcgccgcgcacggccgcgccttcgcggcgggcggggcgggccgcccgtga

SEQ ID NO: 5298 - DNA, 357 bp, Methylobacterium sp.
atgtcagcgacgacacctggtcgccagtcgcttggctttggggatgacctggatgcctttgatccggctgagttcgccctagtcaagcccaaagcgcccaagcccgaacccgagatctctcggaaggctgccgaggccgtaggctttcgcagccgcgaggcgcagaaggccgagccagcgccggccaagatccaacagcgccgtcgtcgcactggccggaacgcccagttgaaccttaaggccaagcccgagaccatcgccgcgttcacgcgcatcgctgatgccaagggctggggcttgggcgaggcctttgagcacgccaccgcgctgctcgagcgagagtacgctaccaagtag

SEQ ID NO: 5299 - DNA, 639 bp, Methylobacterium sp.
ctgaaggccggccgccgccagcacgccgccatcgtgttcgtcgacatgcgcggctcgaccaccctcgccgagagcctggatccgcaccggctctccgagttcctgtccgccttccggcggcgggtgacgcgcctcgcccgcctgcggggcggtgtggtcgacaagttcatcggcgacggcgccctggtggtgttcggcctgcccgagccccggcccgacgacgccgcccgcgcgctcgccttcgcgcaggacctcgtcgcggtgatcgcccgctggaccgacagggccggacccgcgcaggccgtgcggatcggtgtcggcgtccattacggcgaggtgttctgcgggatcatcggcgaggaggcgcgctacgagttcaccgtgctgggcgacgccgtcaacgtcgccgcccgcctcgagcaagcgaccaagctccacggcgtcccgatcctggtctcggaggccgcgcggcgggccgcgggggcgccggccgaggcgtggcgcgaggtcagccgcgagcccctgcggggacgccgcgagggcatggcctaccacacgcccgccgcctcgggagcggccggtcccggcccccgccgggaagaagatatcggactctcggcggtcgaaccggcactctga

SEQ ID NO: 5300 - DNA, 915 bp, Methylobacterium sp.
atggagacgtcccccgacgatccccgccggcccgagaaccgtctcgcctaccgcgccgccgtggaccgaccgcgcctgaccttgccgggcggcaagcacgtcgcggtctggccggtggtcaacgtcgagcactggctgatcgacaacccgatgccgcgccagatcctggtgccgccgaccgccgcgagcctgctcccggatatccccaactgggcgtggcacgagtacgggatgcgggtcggcttctggcgcttcctcgaggccttcgtcagccgcggaatccgcccgacgctgtcgatcaacggctcggtctgcacggcctatccccgcgtcgccgaggccgcccacgcggccggctgggagttcatggcccacggcttccaccaggtcccgacgcaccgggtcgcggaccagccggcgatgatcgcgcgcaccgtcgcggcgatcaccgagaccacggggcgcccgccgcgcggctggctcggaccgggcctcaccgagaccctcgacacgcccgaccacctgcgcgcggccggcctcgcgtacgtcggcgacttcgtggtcgacgaccgcccctgccgggtagcgacgcgcacgggcgacctcgtcgccctcccctactccgtcgagctcaacgacatcccgctgctggccatccagcaccaccgggccgacgagttcgtggagcgggcgctcgcccatctcgaccggctcgccgccgaggccgccggctccggccccctcggcggcgccaaggtgatgggcttcgcgatccacccctacatcaccggcgtgccgcaccggatcggcctgctggagcggctgctcgacgccatcctcgcccgcgacgacgcggtgttcatgcaggggggcgagatcctcgactggtaccgcgccaccggcgacgaatcctga

SEQ ID NO: 5301 - DNA, 633 bp, Methylobacterium sp.
atgcacttcgactccggcgagatctccactctcgtctggaaggctgccgcgaaactcgatgtggtttcgccgcgcaccggtcgccggctgcatgtcacgccgcgcaggctgagacataccttggctacgaatttcgcggctctgggcatccccccattcgcgatcgccgaggctctcgatcattcgagcctgaacacggtcatggtctacgtggacaatatcagggtcatccaagagaggatagaccatgccttggccgagtatatggccgaggtttccgggggcttcctgggccgattgatacccgacgaggttgccgccggcggatcggcggcagaccgcatctatgccgatttcggagaaggcgaggtcgaggcagtcggcaactgcggtctatcaagcgagtgcaacctcgccccgccgatatcctgctataaatgtcgcttcttccgcccgtggctcgacgcctcccacgaacgggtgctggaaatggtcgaggcgcgagcgcatcggttgcgtgaagccggtgcgatcgaacgtctggtcgagctcaacgtcgacgcgatccgtgccattcgtaatctcatgaacgaagcgtcggcgcttcggaaggccggtggaggtagcatataa

SEQ ID NO: 5302 - DNA, 456 bp, Methylobacterium sp.
gtgcggtcggacctggccggggggcgcatgtcccggcagcgcaagcgggacgcggtgttgtggcttctgcgtggtgaggacctggagagcgtctcgcgcggcctgggcgtgacggcggcgaccttgtcgggccggcgcgatgcattcctggcggcgggcgaggccagcctgtccacccggcccctcgatgcggaggcgctggagagcgggcgtctcaaggccaagctcggcgagatgctgctggagcgcgaggtgctggagaccaaggtcgccgccctggaggcgcgtggccccggccctttttggcccgcaggcggtcgcagccatgagccggaccgtctcgccggccagcggcagcgtctagggctggctcgggtgtgccggatctggcgcgtgtcgcgcggtacgcctgcggtgaaggccgcggtcgttctcccgatggggtgtcaggcagcg

SEQ ID NO: 5303 - DNA, 402 bp, Methylobacterium sp.
atgcctaaattctacttccacctccgtggcccggaagttctggaccacgacgacgaaggcttggatctcgccagcgttgaggcggcatatcttgaggccttcaaggctgtgccgggaatgggctccgatctggcctccaccgcgaagaacccaatccggtatggcttcgagatcaccgatgcgcatggcaccgttctgatggcggtgcctttcgctgaggtactcgatcgcgggcaaaagcgcacaaaacaaccggccaagctacagctccacaaaggtcgagcggagatgaggcgcacggcaggactgattgtagagcttcgcgaagcgcacgcgaagttgaatgtgacgctggcagagacccagcgtctcctcgatatcgcgaagcgaactggtcgctag

SEQ ID NO: 5304 - DNA, 198 bp, Methylobacterium sp.
atggtcgagacgttcttcaagacgctgaagagcgagttggtctggcgcaccgcgttccagacgcgagccgaggccaccatcgcgctggcccgttacatcgatggcttctacaatccctgccgccgtcactcggcgctgggcttcaaaagccccacccagttcgagaagggtatcgcccaccaaaccgctctccactga

SEQ ID NO: 5305 - DNA, 480 bp, Methylobacterium sp.
gtggcgctcctgttcaacatcgatccagacagcgctgaggacagcgttccgttgtcggcgatcatcgacagcgttcacgttgatgatcgagagcgcgtcctggccgtgatccgccgcagcgcccaagaaggcgccacgtacctcaacgaataccgcgtcgtctcggccgatggccagacacgctgggtcctctcgcgggggcgcttcacaaaggaccatgctggccgcccggtgggcggcagcgggatccttgtcgacatcacggggatgaggatcagagagggcacgttcgatgatgttgagtccgggcagattgcggcgcccttggaacgagcagccgaccacgccatcagtgcgcagcaggcgatcgttgatctgcaagaccctgagctgaaggcctgtgcagacgcgctactgatggccctagggcgcaagcttgccgagcgagaagtcctggaacggcgcaaaggtatgcactga

SEQ ID NO: 5306 - DNA, 1602 bp, Methylobacterium sp.
atgatgaccagaatcaaggcgctgttactgggctcctcggccctgatgatcccgatcggcggtgcgcacgccgccgatctcccgacgttcaaggctgcgccggtcgagttcgtacgcgtttgcaacgcctacggcgccggatttttctacatccccgggaccgatacctgcattcgtctgtccggacgagcgcggtatgacttcctgtatcagaccagcaaggttcgcacgggcggcggcggcgacctcaccggctatctcggcctgatgcgtctgaacctcgattcgcggacccagaccgattacggaaccctgcgcgccttcctgcgcatcgatgtcgccaaccgcagcggcccgttcctgacctcgggatcccggcagcgcgagagcttggccatcgcgggcctcggcgccgacgccttcggccgcacgcagacctacgtcaacgccgataaggccttcattcagttcgccgggctcaccgcgggccgcgcgtcctccttcttcgacttctacgcgcacgatttcgagctgatcggcggcacggccggttccgatacgttcagcacgaacctgctcgcctactcggcgatcctcgggaacggcatcacgctgaccgcctcgatggaagatccgacctaccggcgcttcccgatcttcggcaccggctcggcagtcggcgccttcacggccggcggcggcttcgcgggctacagcaacgccttcaacccgttcaccccctcgacctggctggcgccgatcgtcgtcggtcccggcaacgtcgccttcgtcgacgtcacccagaagagccgcatgccggacttcgtcggcgcggcccgcatcgaccaggcctggggctcggcgcagctctcggccgccgtccacgagatcaatgccggcgacgccggcagcacggtcgcgggcatcaccaccgccacgaccggcctgggcatctcgccgacgggacgcgcctcgaacgcctacggctgggcggtccagggcggcctgaaggtcaacctgccgttcatcgcgacgggcgacacgctctacctccagggcgcctacgggcagggtgccatcgcctatacgggcatctccaactacacggcgccgtacgacgccctcggcgcggcgccggtcggcggcggctcgttcgcgcaatactacgcggacgcggtgctcaaccccgcgaccggccgcctcgaactgtcgacctcgttctccgctgtcgcctccctgctccattactggtcgcccgcctggcgctcggccttcttcggcagctacgcgcagatcgactacaactccaaggggcgcaacgcgctgggcgtcctgggcttcggcttcgccccggccggcgccagcacgtcgaatgccctggccttcgccacgagtcccatcctccggggcaacaaccagatgatcaccggcgccagcctgatctggacccccgtgaaagatctcgatatcggcgtcgagggcgagtacatccgcacggcgctcaacagcggcgtcacgccggacatctccaagaacgcgctgcgctacgtcaattcgcaggatgcggcccaatttcggttccgcgtgcagcgggatttctga

SEQ ID NO: 5307 - DNA, 294 bp, Methylobacterium sp.
atgaagaacatcatcctggcctgctcgatgggcgcgatgctgatcgcgggacctgctctcgctcaggacggtggcgccaccatcgaccccagcctcatcgtccggaccaacggcagcggtctcgatgcgtggtccgcctccgagggcaacgacaaggcgggcggcatgtgggagggtgcgaccggctacagcgccgcgatccagcggcccagcgcggtcgagaccgtcccggccaatcgccagtggagccatctcaacagccgcgagcgtcgccgcggccagcccgcctactga

SEQ ID NO: 5308 - DNA, 1386 bp, Methylobacterium sp.
gtgcgccttcttgaggtccggcgcaccagcggcttccgggtcgcgtgcctgttcttcgcgaccttcgggaccgcctcgctcgcgctgtcgggctttctctacgtcgacacgcgcagctacggccgcaaggccgcgttcgagtgggtcgagtgggaatcgaagcacctcctgaacctgtcgccgcgcgcgctgcgcgagcggatcgacgcctccgaggatttcgccgagggcgggcggccgctcgtcctgttcgggcccgaccacgtgcgccgggccggcgcgccgatcgccttccccgacaaggcgcccatcgggaagccgttcatcctggcgcagccgctggatcaccgcagccgcacgctcttcagccagctcaccgagcttccgagcggcgagtacgtcctggtcagccggtcggcccaggatctccagtccctcgagaaggcgctggtcgagaccttcgtctggggcatggccgccaccatcgtgatcggcctgatcggtgccgtcgtgttcggcgccggctcgctgcggcagaacgatgcgatcaccaaggcggtcgagcgcatcatgcgcggcgacctgagcgagcgcctgccgacgcggggcgtgtcggccgatctcgcccacctcacgcgcgtcgtcaacgacatgctcgatcagctcgagcggctgatgctggagatcaagggcgtcaacgagaacatcgcccacgacctgcgcaccccgctgacccgggtggtcggcacgctggagcggtcgctgcgcaaggccgacagcgtcgtggcctttcgcgccttcaacgaggacgtcctggccgaggtcaagagcatcgtcgtccggttctcggctctgctgcgcatctccgagatggaggaccgcctgcgccgatcgggcttcacccaggtcgatctcggccggctgctcgaggatgcggtggagtactacgagcccctggcgatcgagcgcgacatccgactcctctgggaccggccggacggcctgtgcacgatcgagggcgaccgcagcctgatcttcgaggcggtgagcaacctgatcgacaacgccctgaagttcacgccgggcggcgggcgggtgacggtcgcgctgctccggaatccgacagggatccaggtcaccgatacgggctgcggcatccccgcggaggagctgagtgccgtgcgcgcccggtatcgccgcggcgcgctgaagaccgacaagagcgggttcgggatcggcctgagcctcgtcgattccatcgcgcggctgcacagcgccaccttcgacatcgcctccgacgggagcggctgccgcgtgaccctcagctggatccacagcgtctcgggtcactcgtcgatcgatctcctgccggccgcgtccctctga

SEQ ID NO: 5309 - DNA, 669 bp, Methylobacterium sp.
ttggtagtcgaggacgaccggcgggttgccgcggagatcggttcggccctcgcggaatacggatttcaggtcgacgaagcgccgagtggcagcatcggattacgcaaggccctggacggtaactttgacgtgatcgtgctcgaccgaatgctcccggagatcgacggcctgtcgctgctgaccgagctgcgcgccgcgaaggtctcgacgccggtcctgatcctcagcgccctgtcggccgtcaacgagcgcgtcgacgggctgcgagccggcggcgacgactacttggccaagccgttcgagttcatcgagctgaccgcccgcgtcgacgcgctggcgcggcgcaagatggcggccgaggcggtgaacgaactcgtggtgggcgacctgcgcctcgacctgatcgagcgcgtcctccactgcggggaccgcgagatcgagctcctgcccaaggagttcgcgatcatcgagttcctgatgcagaacgccggcacgctggtgagccggaagatgatcttcgaatccgtctggggctacagcttcaaccaccagtccagcgtcatcgacgtccacatcggcaagatccgcaagaagctcgatcccgacgggctgaacccgcggatccacacggtgcgcaacacgggcttcatcctccgtgcgccttcttga

SEQ ID NO: 5310 - DNA, 1386 bp, Methylobacterium sp.
atgacccgtttcaacgacgcccccgggagcggcgccgaggctgccgcgcgggcgcaccagcacgcggccgagatcgacccgctgcggcaggacggggccggcgaggccctggtccacgccgtgccgccaccgccgcgcaagcgcccgttcctcgtggcgttcctggcactcggcagcgccctcggcctcggcgcctggcaccattgggaaacctaccaggcctccctggagactcagaccgaggccgtgaacttcgtccccacggtccgcaccgggccggcgcaggtggatgacgggccgatgacgctgaccctgccgggccagaccgaggccttcgatcatgccgacatcttcgcccgcgccaccggctacatcgccgagcgccgcgtcgacatcgggtcgcgggtcaagaagggcgatctcctggtccggatcgccgcgccggacctcgaccagcaggccaggcaggccgaggcccagctcggccaattcaaggcgcagctcgcggtcgcgcaggcggatgtcgagcaggccaaggccagcgtgacgctggcgaacgtgaccgacgcccgcaccgcgacgctggccgggcaaggctgggcctcgaagcagaacgccgaccagacccgggcggggatgctgaccgccaccgcgaccctcgccgccgcgcaggcgaaggtgaaggtcgcggaagccaacatcaccgcccagcaggtgaccgtcgaccggctccgcacgctgaccaccttcgagaacgtcgtcgcgccgttcgacggcatcgtgaccgcccgcagggtcgatgtcggcgacctcgtccacggcgatgccggctccgggacgccgctcttcacggtcgacagcaccgatgtcctgcgcgtcgcggtgcaggtgccgcaatcggccgccgtgggcatccgggacggggtgaaggcgcgggtccaggtggcgcagatcccggaccgcatcttcgccggcacggtgtcgcgcagctcggtggctctccaatcctcggtgcggacgctggacacggaggtcgacgtcgccaatcccgacggtgtcctgcggccgggcctctacgtcgccgtcaccttcgcggtgccgcgcacgcatccgcgggtgaccgttccgtccgaggcgctcatcttcgacgcggacgggacgcgcgtggccgtggtcggggcggacgacaccgtccggctccggccgatcacgatcgcgcgcgatctcggcacgcgcctcgagctgcgcagcggcctcgacagcggcgagaccgtggtcctcaacccgcccgccggccttcaggacggcagccgcgtcgccccccggggctccgtcgcctcccaggtgccgacagccaagctctccgagcaggcgagcgcggagtga

SEQ ID NO: 5311 - DNA, 1215 bp, Methylobacterium sp.
atggcgtcgatccggagttgcgtgctctcggtcgcgatcggcttcgccgcgctcgccgggccggcccttgccgagccgatccgcgtcaaggtcggcgtcctcaacgacatgtcgggcgtctacgccgataccggcggcaagggctccgtcgtcgccgcgcagatggcggtcgaggacttcgccaagaccgagccgggcgtgcaggtcgagatcgtctcggccgaccaccagaacaaacccgatatcggcgccgccgtcgcccgccagtggtacgaccgcgacggcgtcgacgcgatcctcgacgtgccgacctcctcggtggcgctggcggtgagccaggtcacccgcgagaagaacaaggtcttcatcgactcgggagccggcaccacggagctgaccggcaagcagtgctcgccgaacacgatccagtggacctacgacacctacgccctggcgcacggcacggccggcgccatgctcaagcgcggcggcgacacgtggtacttcctcaccgccgactacgcgttcggcctctcccttcagaacgaggcgaaggccgtgatcgacacgggcggcgggcgggtactgggcgccgcgcgggtcccgttccccgccacggacttctcctcgttcctgctgcaggcgcaggcctcgggcgcgaaggtggtgggtctggccaacgcgggcggcgacacggtcaacgcggtcaagcaggcgcacgagttcgggctgaccgacggcggccagaagctcgccgccctgttgatctacgccgtcgacgtccacgcgatcggcctgcagaccgcgcagggcctcgtgctgaccgagtcgttctactgggatctcaacccggagacgcgggccttctcggagcgcttctacccgcgcaacggcaacagcatgccgacgatgaaccacgcgggcgtctatgccgggctcctgcactacctgaaggccgtagcggcgacgaagtcgacggacccgcagaagaccatggcctggatgaaggccaacccgaccgacgacccgctgttcggcaagggtgtggtccgggcggacgggcgcaagatccacccgatgtacctgttcgaggtgaaggcgccgtccgagtcgaagggcccatgggacctctacaaggtgctggagacgatccccgccgagcaggccttccgccccctctccgagggcggctgcccgctcgtcgccaagccgtag

SEQ ID NO: 5312 - DNA, 1626 bp, Methylobacterium sp.
atgcagaccctgcgcggcgccgacatcgtggcccggaccctggaggcgctcggcgtcacccggatcttcaccctgtcgggcaaccacatcatgccggtcttcgacgccctgctggagaccgggatcagcctcgtccacacccgccaggaggcggcctgcgtccacatggccgacgcctggggccggctgaccggcgaggtcggcgtcgccctggtgaccggtgggcagggccacaccaacggcgcggcggcgcttaccacggcgctcgcggccgagtcgcccgtgctgctgctctccggccatgcgggcctgtcggagctcgggcgcggcgccttccaggaactggcccaggccgacatcgcccggccgatgaccaaggccgcctggaccgccgggtcggtcgccgccctcgggccggacctcgcccgggccttccggatcgcccgggaggggcggcccggcccggtccatctcagcctgccggtcgacctgctggagacggccgtccccgccgcctcggtgcggatcccggaccgggccgcggccgccatccgggccgccgagccggcgccggatctcgtggccgacctcctcgctgccctcgcgggggcggaacggccgctgatcgcctgcggcccggcactgtgcgacgcctccggccgggctgccatggcaacgcttgaggaaaccctcggcctgccggtcgtcggcatggagagcccgcgcggggtcaacgatccggcgctcggcgccttcgccgaggtcctggcgcggaccgacctcctcgtgctcctcggcaagccgctcgacttcaccctgcgcttcggcgcggcccctgccctcgcgcccgactgccgcttcgccctcgtcgatcccgatccggcgctgctggcccgcgcgccggccgaccgcctcgcggtctcggggctcgccgatccgcggccggtgctggcggcgctgaccgcgcgcgccaccgccctcccccgccgggaggcctggcaccgggaggcgcgggccgccctcgcctaccggccgcccgcctgggcggatttccacgggacgggtcagcgcctgcacccggtggagctgtgccgggcggtcgacgccttcctggaacgccgccccgacggcacgctgatctgcgacggcggcgagatcgggcaatggccgcaggccctggtccgcgccgggcgccggctgatcaacggcgtctcgggcacgatcggcgcgtcgatccccttcgcgatcgccgccgcactggagcggcccggcgccccggtggtcgcggtgctgggcgacggcaccttcggcttccacatggccgagttcgacaccgccgtgcgctatcggatcccgttcatcgcggtggtcggcaacgacgcgcgctggaacgccgagcaccagatccagctgcgcagctacggccccgagcggacgcgccactgcgacctgctcccgacccgctacgacacggtcgtccaggccctcggcggcttcggggcgctggtgaccgaggcggccgagcttccggcggcgctggaggcggcccaggccagcggcctgccggcctgcgtcaatgtgatgatcgagagcgtgccggcgccggtgatccgccgtcccggctga

SEQ ID NO: 5313 - DNA, 609 bp, Methylobacterium sp.
atggtcaacaagcacgtcgcgatccggaccgaggacggcgtatgcgggacgcacgtcgtcgcgccggacggcgcggggccctggccggccgtgatcctgtacatggatgccggcggtatccgaccggccctcggcgacatggcgcggcggctcgcgaccggcggctatcgcgttctgttaccggatctcttctaccgctacgggccctatggccccttcgtccccgcggacgtattcaaaggcgatttccgcgcaatcctcggcccgctgatggcgacgaccgacaatctcaaggccgcggccgataccgcggcgctcctcgcctatctcgacacgcgcggcgacgtcgcggggcgcgcggtccgggcggtgggcttctgcatgggcggccgcatggccatcacggcggccggcacgtatccggaccggttcgcggccgtcgccagctaccacggcggcaatctcgcgaccgaggaacccgcgagcccgcatcgtgtggcgcccgcgctgagggccgaagtgtatatcgcggccgccgagaacgacggaagctacccgcccgcgatggccgagcggctggagacggcgctgtcgcgagcgagtgtctga

SEQ ID NO: 5314 - DNA, 246 bp, Methylobacterium sp.
atgacgacgactgcaacgcgccccgccggcgcgaacgataccggcttgtctctcgcccaggacttgttgtcgggcgccgaggcaatcgccctcttcatgttcggagaggcgaccgaggccaacaagcgcaaggtctaccacgccgcgcagaagctcggcctgccgacgttccggattggtggcaccctgtgcgcccggcgctcgacgatcctcgcgtggatcgagcggcaggagaatgctgcgtga

SEQ ID NO: 5315 - DNA, 792 bp, Methylobacterium sp.
atgccacccgccgagggaacccccatctggttcgagctgaacgcggccgacccggacgtcgcccaggccttctacgaggcggtcgctggctggcgcgtcgcgccgtcgccgatgcccgagcacggcggctaccggatcgcggaggccgacggggcgcccgtggccgggatccggcgaccgacgcccgaggcccccggcctccccggctgggcggtctacctcgcgacctcggacgtcgacgccctggcggcccgcgcggtcgatctcggcggcgcggtccggttcgggcccgtggacatcccccatgtcggccgcttcgccatggtgagcgacccgcagggcgtggtcttcgccgcgatgaatccggcccatcccggcgcgagccgggccttcgggccggtgccgctcgagacggagcggacgcgcggccacggcgtctggatcgagctcgccacccccgatcccgcggcggccatcgccttctacggggcgctgttcggctgggagaagctcggcgccatgccgatgggcgacttgggcgagtacgccttcatcgggcggggcgacctgcgccccggcgcggtgatgtcgagcgcggccaccggcgcgccggcccgctggaactggtacatccacgtcgccgacatcgacgccgcgctcgcgaccgtccgggcggcgggcggcacggtcctccaggggcccgacccgatccccggcggcagctacgcggccaacatcgccgatccggcgggccaccagctcggcctcgccggcccgcggcaagccacgtga

SEQ ID NO: 5316 - DNA, 144 bp, Methylobacterium sp.
atgagcaagccgaagcctccgaccaacgcgctcctgacaccggagaagcgcaccgaggacgtcgatcagacgatccgtcctctgagcctgtccgagttcatcggtcagcgcgcggcgcgggcgaacatgcaggtgttcatcgag

SEQ ID NO: 5317 - DNA, 171 bp, Methylobacterium sp.
gtggaggcgttccgcgccaaggtcgagcgtggcatctactcgcagcctgtcaggcagcagggatgtctgccgaaatggcatcgggagcggctgacgcacgacatcgccctccggcacgggctgcagcacgagctaccgcttatccggaaggactttgagcatctgatctga

SEQ ID NO: 5318 - DNA, 1182 bp, Methylobacterium sp.
gtcaaggacagcctgaacgtcgccgggttcgcgaccggctggggcagccggctctacgcgggggagggggccggggaggccgtcgaccgcgacgagacgccggtggcgcgcctgcgtgcggccggggcggtgatcctgggcaagaccaacgtcccggagctgaccgtccaaggctacaccggcaacccggtccacggggtcacccggaacccgtgggatccggcgctgacgccggggggctccagcggcggcgccgtcgcggcggtggcgtccgggatcgggcccctggcggtcgggaccgacgcgggcggctcgatccgccgccccgcctcgcataccggcctcgtcggcctcaagccgacggccggccgggtgtcgcggacgggcgggctgccgccgatcatgctcgacctcgaggtggtcgggccgatggcgcgcaccgtcgaggacctcgcggcggccatgcgggtcctcggggcggccgagccggattccgtcgcgccgcacggcttcggcccgttcgggagcgccgcggtgccggaacgcccgctgcggatcctgcacgtcccggccttcgggacggccccggtcgaccccgagatcgccgacagcgtcgccgaggcggccgggcgcctcgccggcctcggccaccgggtcgagaccggccgcttcgacgcggcgacggccatcacggcggcgtggccggtcctgggccaggcgggcatcgcgtggctgatgcgcgcgcatcagggcggactcgacgcgctcggccccgacatccgcgccctggcggaggccggggcggccctgtcggcggccgacctgttcgaggtgcagcggatggcactggcactgcgccgggacctcgccgccctgtttgccgaccacgacctgctgatgacccccgcggccgcggcgctgccatggccggcggaggacacccatccgccgtgcatcgccggggtaccggtgggcccccgcggctcggcgaccttcacgggcttcgtcaacgccgccggctgcccggggatctcgatcccctgccgcccctcgggcgccgggctgccgatcgggttccagctcgtggcgccctggggtggcgacgagaccctggtcgcgatggcggccgcctacgaggcggcccatccctggcggatggtctgggaggacgcggccccgtga

SEQ ID NO: 5319 - DNA, 201 bp, Methylobacterium sp.
atggcctacgatcgtcctgcctggactggctccacgccctacgatgtcgaaaccacgggctcgttcggcgccccgctcggcggccgctacgatcgcgacccctggacctgcccgcagagctcggccgcggagggcaatgccaaccagcagaacttcccggtcaagcagtacggccagaccgccggcggcaaccgctgctga

SEQ ID NO: 5320 - DNA, 1245 bp, Methylobacterium sp.
atgagcctgcacctggacgatcccgtcaccgacccggtcgaagatcggctgccgccgccgccgtcgccgccgcaccggatccgctcggacgccgaggcgatcgcggccgcgcgggccgtggcccggatcttcgcggcgggcgccgccgagcgcgaccgcgaccggcgcctgccctgggcggagatcgcggccttcacggagagcgggctcggcggcatcacggtgccgcgcgaacacggcggcgccggggtctcgcacgcgacgctcgcggaggtcttcgcgatcctggccgccgccgacggctcggcggcgcagatcccccagaaccagttcggcgtcctggcgctggtcgcggccgccgccagccccgcccagcaggcgcggatctaccgcgacgtgctcgccggccaccggatcggcaatgccggccccgcccgcaacggcaaggcgatcaccggcgtggacacgcggctgaccgccggtccggagggcccgcggctcagcggcacgcgcttctactccacgggcgcgctcttcgcccactggatcccgacgcgcgcggtcggccccgacggcgggccgctcctggtcttcgtgcgccgggacgcccccggcgtgcgggtggtggacgactggcagggcttcggccagcgcaccacggcgagcggcagcgtgatcttcgcgcaggccccggtcgaggcggagctgacgatcgacctcgcgcccctggccgggcgcccgggcctgttcgggccggtctcgcagctgatccacgcggcgatcgacgccgggctcgcccggggcgcggtcgccgccgccctcgacttcctgcgcacccggacccggccctatcccttcaccgccgagaccgtcgcggaggatccccacatcctcggcgaggtcgggcggctcaccgtcgacctgcacgccgccgaggaggtcctggcccgggccggacgggcgctcgaccggatcgccgcggcccccgtcaccgcccagagcgcggccgaggcctcggtggcggtggcgcaggccaagatcctcaccaccgaggcggccctggaggcctccgagcggctgctcgagctcgccggcgccgcggcgacccgcgacgggtacaatctcggccggtactggcgcgacgcccgggtccacaccctgcacgaccccgtgcggtggaagtatcacctcctcgggaaccacgccctgaacggcgtgctgcccgcccggcaccagtggaactga

SEQ ID NO: 5321 - DNA, 963 bp, Methylobacterium sp.
gtgccgctgcgacggcgtccgacggccgcgcggcggccgagcgagaagcggatcgcaccgaccgtctcgactcccgaccacggcctttccgaactcgcccagatcgaggtcaatctcgaagccgacaccagcaccctgtgggctttcatgcgcccgcagggccgcccgtgccagaatcccgagatgctggccgatttcagccggctgcaggatggcatcgagcgcggcttcggcaacggcggcctcgacctgaactactttgtcttcggttcacgatttcccggcgtgttcagtctcggcggtgatctgagcctgttcgcgagcaggatccgcgcgggcgacgaggccgcgctggtcggttacggcaacgcgtgcgtcgatgtccttcatcgcaacatgaacgcgctgaacctgccgatcatcacgatcggcctcgttcagggcgacgcgctgggcggggggttcgagggcctgctctcgttcgacgtgatcgtcgccgagaagggcaccaagttcggcttcccggagatcctcttcgggctcttccccggtatgggggcctacagcttcctcgcccggcgtctggggaccatcagggctcaggagatgatcctcgatggaagaacctacaccgcggaggagatgcacgaactggggatcgttcacgtcctcgccgagcgcggccagggcgaggcggccgtgcgcgcctacatcgccggcaaccaccggcgccgcaacgggcagcaggcgatctatcgagccgcccgggaggtcaatcgcatatcgttggaggaactgagaaagatcgtctcggtctgggcggccgccgcgatgaatctcacggacagggatctgtgcatcatggagcggctcgtcctggctcaggacaggctcaggggaaaagcccaggccgctcaggcccgcacggtgaccgcgcgggggctggcggcgtcaactcgctag

SEQ ID NO: 5322 - DNA, 927 bp, Methylobacterium sp.
atgccggggcctgagcgcgacatcgtcatcggggcggacggcttcctcgggcgcaacctcgtccagcggctccgggccgagggccgcgaggtcgtcgagatcggtcgggcggcgggcgacctctccgagtgggcgaacgtcgagcgggcgctgcgcgcggcgcccccgagcagccggatcttccacgtggtgacccgccagcgcaccggcgcggtgcagtatgacatccagggcgagctcctggcgatcaacgcccgggtccacctgaacgtcctcgaggcgtggcgcctgttccagccgcaggccaagctcgtctccacgggctcgtcctgcacctatccggaatcggcggagccgctccccgaggcgcggttcgggcagggagccacgcatccctcggtgatcggctacgggctcgccaagcaggtcctggcgacgggctcggcggcctacgcgcaccagtacggcctgtgtttcctgcactgcgtactggcgaccctgtacggaccgcacgacaacaaggcctccgaccgcagccacttcgtcggcgccctgctcgaccgggccgtgcgggagaaggcggcgggcgctgcgcagttcgaggtctggggcaacccgcagaccgtccgcgaggtgctgtacgtcgacgaccagatcgacgcgatcctggcggccgaccgggcgttcgacaacgagatcctcaactgcgccgccaacacgcccgtcaccgtcgaggcggtggcgcgggcggccctggtggccctcgactggtccgtccccctggtcagcccgcccggctcgttccaaggcgcggcctacaagatgctcgactcgtcgcggttcctcgaccggagcggctggcggccgcgcatcgctctcgaggcgggcctgcgcaggcttgtcgcggcggagtacgccgaccgttag

SEQ ID NO: 5323 - DNA, 978 bp, Methylobacterium sp.
gtggccgccctccccctaacctccctgcccgacaccgtcgtcgtcgtcggtgcgaccgggttcgtgggccggaacctcgtcgcgcatctcgccgaccgcgtgccgcggctgatcgcggtcagcccctccggccgcgcggtgccgggggcgcatgaggccgcgcgcttcgatgccctggaggcgctgtcggttcccgccgacgccatcgtcgtcaacgtcgccgcgcagcgctacgacgccgacaaattcgagactgcgcagagcgacctgctgaccggcaatgccgagatcgccaaccgcctctaccggttctgcctgacgaagggcatccgcgaggtgcgtgcggcctcgagcgtcgcggtctacccggcggccctcgatcccctcgacgacgcgcaggctgtcgacctcaacgcgccgcccaaccggaacgaggccttctacgcgtggtcgaagcgctggtcggaggtgatcgccgacctccacgccgagcgctacgggatccacacaatcagcttccgcctgagcaacccctacggtccccacgactcgacggatccgcgcaaggcgcacgtcctgccggccttcgtgatgcgcgcgctcgcaccgggggagcgcttcgagatcaagggcaacccgctggtcgagcgcgacttcatctacgtcggcgacgtcgtcgacgtgttcgcccgctccctggagatgcgggagacgagcgatgcgctcaacctctgccgcggcgagaccacgaccctgctcgacctcgcccgcaccatcctggaggtcgccggggaggaccggccggtgcacgcccccgacacggcgacccacggcgtgctcgcgcgccgctcgaccaaccagcggctgcgcgagcgcttagggatgtcgaccttcacgggactcgcggacgggctgcggccgacgatcgcgtggtatcgcgaggcctatcgcgacggggcgcatcatgccggggcctga

SEQ ID NO: 5324 - DNA, 933 bp, Methylobacterium sp.
atgagaattctgatcaccggcggcgcgggctatatcgggacgatcctggtgccgatgcttctggagcgcggccatcacgtgacggtgctcgacacgttcaagtccggcgctccggacctgttctcggcctgccagtacgacacgttcgagccgatcaagggtgatgcgcgcgacacgcgcatcctggacgagctgatcccgaaacacgacgtgctcatccccctcgcggccctggtcggcgcgcccctgtgtaaggaggacgcgatcggcgccacgacgctcaaccgcgacgccgtgatcgccctggtcgagcgcgcgggcggcggccagaggatcgtctacccgacgaccaactcgggttacggcgtcggcgaggccggcaagttctgcaccgaggactcgcccctgcggccgatctcgctctacggcaccaccaaggtcgaggccgagaaggccgtgctcgaaagcggccgcggcgtcaccctgcggctggcgacggtgttcggcatggcgccgcggatgcggctcgacctcctcgtcaacgacttcacgcaccgggccgtgaccgaccgggcgctcctggtgttcgagggccacttcaagcgcaactacatccacatccgcgacgtcgccaaaggcttcatccatgcgatggacaattacgaccggatgcgcggcgaggcgtacaatctcggcctgtcgagcgccaacctgtcgaagctggaactctgcgaacgcatcaaggtgcacgttccgaacttcgtctacgtcgaggccccgatcggagaggatccggacaagcgcgactacatcgtgtccaacgagaagctggaggcgaccggctggttccccgatttcgatctcgaccggggcatcaaggagctgatcaagggcttccggatgatccgcaactcgcggttcgccaacgtctga

SEQ ID NO: 5325 - DNA, 396 bp, Methylobacterium sp.
gtggccgccgcgacggagcccttgacggagagcgccgacgcgttggtcttgggcacagacttcttcggcttcttggcttcgcgatttccgcgcttctgttccgctgccatgatctcgctcctggatacgatgacagccccgacgacgtcgtcctcaccgttcgggcgtcggctggtctggaagcaaccggatcgcggtcgcgaccggggtctcgaacaggccgaagacggcaacgaggcggtcgcttgcccagagttcggcatgatgccccgcgatcagacccgctgcctgccgcttggcgtcgccgtcgttgcgcgctgtgatgacgcaagtcgtgagcacaccaccggtcggggcgagccgatggacctgataggcgcggcgcgcgtgtcgtga

SEQ ID NO: 5326 - DNA, 312 bp, Methylobacterium sp.
ttgcaggccgaggtcgaggctgacccgaccttcgacccgccggcacttcgcacccgtcccgacctctggccgcacctcgccttcgtaagcaacgccttcagcgagctgtcctcggaccggccgctgggggcgttgggcggttgcggcccgatcccgtggagcgccatcgagcggtatgcggcgcgctacgagctcgacgacctcgaatccttcgagcggttcgcgcacctcatccgtgcgcaggaccgggcctatctcaccatcatggctgagaagcagaagagcgggagcggcggcaagggtaaaccgtag

SEQ ID NO: 5327 - DNA, 246 bp, Methylobacterium sp.
atggtagagttcgttcgcccgctgatgtgcccagtgatgcggaagctgatcgggatgatcgtccgcatgtcgcagcaccccggccttcaggagcagggacagttgattgatcagctcacggagctcgagaccgagggcatagccagggatgttccttggcggaccgtggaggcaatccgcgccacccggttgaggctgcgcgtcgagggtctgatgccccggacgccactcccgcgcggtcactga

SEQ ID NO: 5328 - DNA, 951 bp, Methylobacterium sp.
atggcgctgcgggagccccgcgcggacacggcggacgcctgtcccgggctcgcgggcggtgtcgggcgacgggcgcgggccattcccctccgccggcgcctcaccgtcgcggcggcggggcgcggccggctcctcgccgcggcgccgctgccgctgctcctggcgctcgcggccacgacgacgccggagcccgtcgcggtcgggctcggcgggctcgccctggcgtggctctcgctgcgggtgcagcgcctgcgcggggccgcgtgcgccgcgacgcggcagcggaacaacctcgcgcgcctgaccgcgccgacggtcgcccgatgggtcgccgagacggatcgcgccgcccggcgccccggctgggagcaggaggcgacggtgctcttcgccgacatccgcggcttcacccgcctctgcgagggcatggcgcccggcgaggtcgcggcgttcctcgccccgttccggtcccgcgccgcgcgggcgatcgaggcggcgggcgggctcgtcgacaagttcgtcggcgacgaggtgatggcggtgttcggcgtgccggacgcggcgcccggggatgccggtcgcaccgtcgcggcggcccgcgcgctcgcggccgcgatggcggcctggagcggggaacgcgggcaggccggcctgccaccggtgcgggtcggcgtcgggctgcatcgcggcccggtcttcatcggcgtcatcggggcggagcgcgtcgagttcacggcggtcggcgacaccgtcaacgtggcccgtcgcctggaacagatgacccacgcgctgccctgcgactgcctcgcctcggaggcggtggtgcgggccgcgccgtccggcggggcgcggatcgtcgccgtcgggcccgtgcgcggcgcccgcaccgtcctgcgcctgttcaccctccggctcgacccggcggcgccgtctcgggacgggtccgagtga

SEQ ID NO: 5329 - DNA, 1098 bp, Methylobacterium sp.
atgaatctgctgaagcggttgttcggacgcgccgatgcggcacgggcggcggaggcggcgccggacgaaccgcttctcgtcaacgcctacgcgaccgtgcgcgacctgcccgcgctccccttcgaccacgcgctgaacggccggcgggacctgtccgaccccgaattgcagccccatctcgacgggttcatcggctacgtcatgggacggggcgacgggcagatgaccgccctccgctaccatctctggcgccacctgcagcgcgtccgcaaccacgtcagcttcgcggtcgccgcgtccgacctgccgcgcgtggaggcctgggcgctcgcggcgaacgccgtcctcttcctgcccgacggctccgtgcgcgcgcccgacatggcgctcctcctgtcggccgcgggcgagacggatccggccgcgcgtctgccctatccgcccgacgccgtcgcgcgccgcgcccggaccctggagcacctggaggatctggacccgaagccgccggccggcatgccccccgcgctcggcgaggcggaactcgcgctgcgaccgccggcggaggtgctccggcgggctttggccctgctctacgtcgcggcttgggggcaggccttcggcgccggaacgacgctgcgcgagccggggcagagggcgctgaatccgaccggcttcgcggccctgtcgccggccgagcgcgcccagatcgaggcggcggacccgaaggacgccgcggcggcgtcctggcgctacgaggccgcgaacaccctgctgtgggcgctcggcgtgcgcgcggcccggatcgccgaccgcgacgccacggtcgacgtcgacgcgctctggcgggcggtcgcgccgctcgcccgggacgcgggcgcggccgacgccgcgcggctgcggccgcccggcgagatcctggaggcgctggaccgcgcgtggcgggcgcactgggtcgtccggcaggcgcggcagaaggggacgaccctggcggggctcaacggcgacgtcgtggcggagcgccacgtcgcgctgaactggctgaccggcttccagaacgaccgcgacacgccgtgggacgcgaccgacacgccgacgtga

SEQ ID NO: 5330 - DNA, 348 bp, Methylobacterium sp.
atgcagtcgtcgcggtgggccggcgccttcctggctgccggcctgatcgtcgcgttcgccccgccggcgcgggccgacgccgccctggtcctgcgggagacccggctgcacacgccgccggactcgcacgagccgcagcgggcgatggtcaacctgcgcaacaccggcccggacctcgcgacgaacgtgaccgtcctgtgcaccttcacgggggccggcgggacggtgctcgacacgcagcaggcctcggtgccggaggtcgtgagcctcgccgacgtgcaggccgagacgatctactacggctggccccgcgcgagcagcgccacctgccgcctcgccgagccgtag

SEQ ID NO: 5331 - DNA, 960 bp, Methylobacterium sp.
atgtccaagcccaaccctcgcaccgcagctgcgattaccctgcgcgacggcgccagcgcgattgcggacctcgaaacccaacaccgcatggccgagcgcgcgctctccggagcggaaggcgccctacaagaggcgtcggccaagtatgatgctgcgctcggcgaagggcgcgaggccgcactcgcggcccgtcaggtccgcaccacggccgaggtcgatctcgatattgctcgccgcaacgtcgacactctaggccgcaaactggcggatgcgcacgaggccctgcggctcgcggggatcgagcacaagcggaccgaggccgagcgtctgcgcagcgtcttcgaggagacggtgcgtcaggggctcgcgcgcatgggcgttgacgcgcgttccattcttcgcgcctgggcagaggcggagcttgccattcgggaagcgcgggctgcgcaggggcccaagggccccgctattcccgatgcggaggagtttcgcagcgtccgccgaggagctgataaagagatccggcgcacccggatcacgcgatggatccggcccgggacgcgggagccttacgccgacgagatcgagcgggagattatccgccacggcagcataggcttcctccccaacccgtgcatgtcaggcggcggccgcgaaatcgccgagcgcggcgttttcgaccgtgtcacttacgagaaggcggtcggcgcgatccatatgccgaagctgatcgaaagcttgtgtgttccagccctcgtcggcggccaggtgccgggctggatgccagtcgagggtcatgtcgatccgcgcacgatcctgactcggctggccgagcttgagcatcctgcagccgaacccaagggcgagctgcagaccgtcgataccttcgtgcatctcgtcggcgccgaggctgccgcggcctgggactgtcaggaattccgtgtgcgggcggcgggttga

SEQ ID NO: 5332 - DNA, 2691 bp, Methylobacterium sp.
cccctcgcacgcctcgaccaacgcggcctcgacgctctcctcgccggccacgcgctggcccccgacagcctcgccgacctctacccgctcacccccctgcaggagggcctgctcttccacgcccgcctcgagcccggggacgcggcctaccgcaaccaggtccgcctcgacctcgaacccctcgatcccgaccgcttcgcccgcgccgtccgcgccaccctcgagcgccacgacgtcctgcgcaccgccatcctcgaccccgccgacggcccgcccctccaggccgtcctcgatgccgtgcccgaacccctcacccgcctcgactggaccggggagccgtcgagccaggacgcgccgcacgaggatgccctcgccgcccgcctcgccgaacgcctcgccgactgcctcgccgccctggccgccgaggagcgcgcccggcccttcgacctcgcccgggccccgctcctgcgcctcgtcctggtccgcaccggaccggaccgccaccacctcgtgctcaccgtccaccacctgatcctcgacggatggagcaccgcacgcctcgtcgccgaggtgctcgcccgctaccgcggagaggagcccgagcccgtcacaggacgcttcgccgactacctcgcctggctcgcccgccagccgcgggccgccgccgagcgcttctggcagcacgccctcgccggcctcgacgcccccacccgcctcgccgacaccttcgacccgcccggcatgaccggcatgaccggcgcgcccggcgcccgcgacggacagcgcccgcccggccacggggaggtccggcatcacggcgaggtccggcaccgggtgccggccgccgccgccgggcggctgctcgcccgcgcccgggccgcgcacctcaccctcaacacctgcgtccaggccgcctgggcccggctcgtggccgcccgcaccgggcaggcgcgcgtcgccttcggcaccaccgtggccgggcgcccggccgacctgcccggggccgagaccgtgctcgggctgttcatcaacaccctgccggtggtcgtggacctcgacccggcccggcccctcggcgcgtggctggcgggcgtgcaggaggccggtctcggcctgcgcgagcacggccacctgccgctcgccgccatccagcgcctcgccggccccgcgggcgcgggcacgggcacaggtacgggtacgggcggcctgttcgacagcctcgtggtgttcgagaactaccccgtcgaccaagccctcgccgccgcccgccacggccgggacggaaacggaaacagggacggaaacggcgacggcgacggaaacggtggcggcgacggagacgctgccgacccgcacgccttgcgcctcggcccggccatcgtcgccgagaccacgcactaccccgtcaccctcgtggtccacccggagaccggtcccgacgggacgcggctggccctgcgcctgagctacgccgccgaccgcctgggacacgcggacgccgaggcgctgctcgccgccttcgtggcccagctcgccgccctggccgaggccgacccggcaaccccgctcggggcgctgccgccgccgctgcccgacagcgaccgggcggtgatcgggtcggcgaacgcgaccgcgcgggcctacccggacggcgccggcgacgtcctcgccgccttcgcagaccaccgcgcgcacgacccggacgcgatcgcggtgaccgacgcgcagggcgcgctcacccgccgcgccctcgacagcgcggcctccgcgctggcccgacgcctcgtccgcgccggggccggtcccgacactctggtcggcgtcgggctggagcggtcctgcgcgctgctcgtcgcctggctcgccgtgctcaagacgggagccgcgatcctgcccctcaaccccgagctgccgcgtccgcgcctcgtcgcgaccgcccgagaggcggccctgcgcctcctcgtcaccgagtccggcccggccgcgcggatgcccgggccggcggagcttccggacctgcagatcctgaccccggacctggcagaggcggcggacgatccggcgctgccggccgcggcgccgcacccggacgccctggcctacctcatctacacgtccggctcgaccggcacgcccaagggctgcgccaacacccgcgccgccatcgccaaccgcctcgcctggatgcgggcccatttcgcggtcggccccgccgacgtgatcctgcacaagaccccggtctccttcgacgtcgccgtctgggagatcctcctgcccctcgtcagcggcgcccgcctagtcatggcgcccccccaggcccaccgcgacccggacgcgctggccgccctgatccggcggcacgcggtgacgatcgtgcacttcgtgcccgccctgctggaggcgttcctggcgtccggccggctcgccgcctgcccgagcctgtcccgcatcgtgtgcagcggcgaggcgctcgcccccgacctcgcggccgccgtccgcgcccagagccgggccgacctggcgaatctctacgggccgacggaggcggccatcgacgtcagcgcctggacctgcggacccgagccggacgccccgcgcgtgccgatcgggcacccgatcgccaacacgcagctccacgtcctcgacgacgcgctgcacccggtgccggtgggggtggtgggcgagctctac

SEQ ID NO: 5333 - DNA, 1635 bp, Methylobacterium sp.
cgacgcctgtcgcgccgggacagcttcttcgagcggggcggcgactcgatcctcgccctccagctcgtcgcccgcgcccgggagagcggcctcgcgctgaccccgcgggacgtcttcacccacccgcgcctcgccgccctggcggcgcatctcgacgcggccccgaacagcgcggccgcgccgcccccccaggtcgacccggcgcgcgaggccggtccggttcccctcaccccgatccagcgccggttcctcgacggccccgtcccgaaccggcagcactggaaccaggcgatcgtgctcgcgccccgggcccccctcgacccgggccgcctcgcggaagcgctcgcggccgtcgaggccgctcatcccgcgctgcgcctgcgcttcgcgcgggacgcgcacggggcctggacccagacctgccgggcaccggggcaggagcccccgctgtggcggcgcgcggcggacggcgcgccggccttcgcggccctcgccgcgcaagcccagacgagcctcgacctggccgaagggccggtctggcgggccgtgcacgtcaccctgccggcggaggggaccgagcgcctcctcctcgtcgcccaccacctcgtggtcgacgccatgtcgtggcgtatcctgatccaggacctcgcggcggcgctcgccgggcggccgctcgcgcccccgccgacgagcttcccgggttgggcccgcagcctcgacgtcctggcccggcaccccggacatgccgggcgccgcgaatcctggctggctggctggctggccggggggccgggcgccgatgccgcgttgcggccggtccggcccgaggcacccaacgtcgaatccgcccagaccgagatcgccgacagcctcgacgccgacaccaccgacgccttcctccgccgggccggccggccctacagcgcccatcccgacgagatcctgctcaccgccctgtcgatcgcgctggcgcggcgcggcgacgggacggcggtgggcgtgattctcgagcgccacggtcgcgatgccgacgcgctggccgacgcgctcgccgaacccctcccggaacccgtcgccgaacccctctccgacgcgcaggacggcccgaccctgccccgccacgacctgagccggacggtgggctggttcaccacgctggtgccgctgcggctcgaccccctcggcggcgagccggacctgccgccggacgacgacgcccgcggcctcgccctcggtgctgccctcggtgctgctctctgccgggtgaaggaagcccgccgcgccctgccccagcccgacctcagccacgatctcctgcgccacggccccgcagcggacctgcgccaccgcatcgccgcgacacccgagcccggcatcctcctcaactacctcggccagatcgacgccgaccgcgccgaccccgacgcgcccttcgccctcgcccccgagagcgcggggcccatgcgcgacccccacagccccgcaggcgccgagctcaccctcaccgccctcgtgcgcgccggccgcctccacctcgcctggcgcttcagccccgaccgccacgacgccgccgccatcgccgccatcgcccgcgacacccggcagaccctcgaagccctcctcgcgcactgcgcc

SEQ ID NO: 5334 - DNA, 204 bp, Methylobacterium sp.
atgttcaagaatacggcgcgcgctgctctttgcctggcctgtctctggtcggtcacgccggccctggcggccccgaaggagatgccccagggcaagcgtgacgagatgtcgatgaaggacaccaagcacgaagtggtgatgcagcggaaggagaataaggaagccaacaagaacgtcgacagcctcatcacgaaccgcaagtga

SEQ ID NO: 5335 - DNA, 1413 bp, Methylobacterium sp.
atggatcgtgcgcagcaactcctgaggtcgctgaccaaggacgcccgcatcgtggagattggcccgagcttcagcccgctcgcgccgaagcgcgacggctggaacacgttcgtcatcgatcacgcgccgcgctcggagctcatcgagaagtatcacgaccagacggtcgaccgcatcgaggaggtcgatttcgtctggacaggcggctcgatcgcggacgcggtcccagtcgaccagcacggcaccttcgacgcgttcatcgccagccacgtcatcgagcacacgaccgacatcgtgaccttcctgcgcgcctccgagacgctgcttcggccggacggcgtggtgatcctggccgtgcccgacaagcgcaaatgcttcgatttctaccgttccctcaccgggacggcggacgcggtcgcggcgttcctggagaagcggaaccggcacacggtccggacccacatcgactacgccctgaacatggcgctgaaggacaacggcacggtcggcgcctggtcgggccgggacacgcggccggccattccggcgaatccgctcaccgacgagccgcagtggctcggcgccgcgcaactgccgtactacgccgacgcgcatgcctgggtgttcgtgccggcaagcttcaatctgatgatcctggagctggcgcagctcggctacatcgatctgcgcgtcgaggattttctcgaccgggacgcgacggaattcttcgtctggctccgcaagggacggcagcagctggcgccggacgagatccgcgagcagcgcaccgcgctgatgcagcgcgccatcgtcgagctggcggagcaggtgcagcaactgcccgagacgtccctcgtcgagatggcctcggcgggggcgctgcgggatcagctcctcaaggcgacttaccggaccgaggcgctccgcaccgtgctggcagcgctgcgggccagcatcggccgtttcgggctggatcgggccaagtttaagcgcctgatcggcgcggcgagccagaaggttccggggaacctctcggcggcggtccagcacaagatcctgctgaccgaggcgaccaagatcctcgacggcatcacggatcctgcggtcgaggccgacgatcgggatcccgccgtcatcgacggcgccgtcttggtggcgccgctcggcgcggcccagttcggggatccgctgctcgccgccgaactcgagcgcgagcgccagcgcgcccgggccgtccgcatggtgctggacgccgtgctcggaagcctgcgcggccgcgccctcgacaagaagcggttccgggacctcgtcacgcaggccgccgcgcggacgccgaatgacggccccgaatcggcccgccacgcggtgctgtccgaggaatcgcggcgggttctcggcctgccggtcgcctga

SEQ ID NO: 5336 - DNA, 687 bp, Methylobacterium sp.
atgagcgtcctcgccacggcactgctcaccggtgcgagcctcggtctgtccatcgccgcgccgatcgggccgacgagcttgctgtgcgttcagcgaacgctgtcagggggcctgtcgaccggcctcgccaccgggctcggtgtcgccaccgtgcacctgacatacgggggtctcgtcatgcgctggggcgcggacctcgctgcggtgtggtcgaacggcgccgttctctccctgatctcgggggctgtgcttctcgccctcgcgttccgggtgcttcgcagcgtctcggtgctgcaggagggccgcgcgtgccgcgacacgctggcggtgagctacggcagcgcggtcgtgctggccttggcgaatccggtcacccccgtgctgttcctggccgcgatgccggctttcctcgagcgcgggaccgcgccgttcccggttctggcggccggtgtcttcgtgggctcgttcggctggtgggtggtgctcaacaccgcggtgtccctgttccggcgctgcgtgaccagccaggttctgaatcggatgaacaaggccgcgggccttcttctcgccctcctggcgctgagcttgctcgttcgggggctggacggtggcacggtggcccgttccagcagcgcgggcgtgagcggggtgtcgggcgcgggcgtccgagcgccgagccggctctga

SEQ ID NO: 5337 - DNA, 711 bp, Methylobacterium sp.
atgcctgaaccgctcctcgcgacgaccggcctgcgcgccggctacggcggcaagcccgtgctgcagggcgtcgacctcgcggtccggcccggcgagatcgtggcggtgatcggccgcaacggcgtcggcaagtcgacgctgatgcgcagcctcgtcgggctcttgcccgcctccgcgggcggcatcgcgttccggggcgcggcggtcgaggggctcgccgcccaccggcgtgcccgcctcggcatcggctacgtgccgcagggccgcgacgtcttcccgcgcatgagcgtcgccgacaacctgacggtcggcgcgtcgctgctgccgaagggcgagcggccggattacgagcgcgccttcgggccgttcccgatcctgcgcgagcggcgcgggcagcgggcggggacgctctcgggcgggcagcagcagcagctcgccatcggccgcgtcctcgtcggcgggccggcgctgatcctgctcgacgagccctccgagggcatccagccctcggtggtgcagcagatcggccgcaccctggtcgatctcaacaagcgcaccggggtgacgatcgtgttcgtggagcagaacctcgacctgatccgcgccatggcccagcgcagctacgtcatggacaagggccggatcgtcgcggagctgacggcccgggacctcgacgaccgcgacctcgtgcggcgccacctcgccgtctga

SEQ ID NO: 5338 - DNA, 993 bp, Methylobacterium sp.
atgcagtggctcgaccagtccatcatggcccgcaagggcgtcgccggtggcaagcccggccgggagcacacgatcaccgaggccgagcagggccgctaccactacgtctacgggcccttcgccgagccggtgctgaccgtcgatcccggcgccgtcgtcaccgtcgagacccacgacgccttcgagggcaagatccgccacgagaccgacagcccgacgcagatcctgaacttcccctacctcaacccgcagaacgggccgatctacgtcaacggcgccgagaagggcgactgcctcgcggtggcgatccgctcgatccggccgcgcggcccgcagccctgcggcacgacgctgatcatgccggaattcggcggcctcgtcgccaccggcgacaccgcgcttctcaatccgccgctccccgagcgggtgcgcaagctcgaggtcacggccgagaacggcgtgcgctggaacgaccggatcacgctgccctaccagccgttcatcggcacgatcggcacctcgccggagatcgaggcgatctcctcgctgcagccggactattacggcggcaacatggacctgccggacgtgggcgtcggcgcggtgatctacctgccggtgaacgcgaagggcgcgctcctctacctcggcgactgccacgccgcgcagggcgacggcgagctctgcggcgtcgcggtggagcacccgacccacacgacggtgcagatcgacctgatcaagggctggacgttccgctggccgcggctcgagaccgaggacttttacatgacgatcggctcgtcccgcccgatggaggacgccgcgcgcatcgcctaccgggagctgatccgctggctcgcggccgatttcggcttcgacgagatcgacgcctacatgctgctcacgcagtgcgggcgcgtgcggctcggcaacatggtcgatccgaaatacacgctcggcgcctcgatcacgaaggcgatcgcccacgcctga

SEQ ID NO: 5339 - DNA, 288 bp, Methylobacterium sp.
atgcacatcggacgcgtggcgggcgcgacccgcaacctcggagcgccgcgggactgggacccggcgaaggacggcatctgcggcggcctgccgatccgcgacgagccgcacagcccgggcgtgaaccgcatggtctcggcgtggctgccgacgccggaggagatcgcgctcatcgctgccggcgccccgatctacctcggcgtgctcggcatcgagcacccgcccgtctcgctgttcgtcggcaacccgccggcggacgatgccgcccagccggaggagcggtcatga

SEQ ID NO: 5340 - DNA, 984 bp, Methylobacterium sp.
atggccttgaggaccagactcaccgacgccttcgggctgcggcaaccgatcgtgctggcccccatggacccggcctcggggggcgccctcgcggcggcggtgagcgccgccggcggcctcggcctgatcggcggcggctacggcgatcacgcgacgctcgaccgggaattcgcccgcgcgggcaatcagcgggtcggctgcggcttcatcacgtggtccatggcccgggacccgtcgctcctggacgcggcgctcgcccggtcgccggctgccctgatgctctccttcgcggatcccgcgcccttcgcggaccggatccgcgccgccggcgtgccgctgatctgccaggtgcacaccctggcgcatgcgaggcgtgccctggaggtcggcgcggccgtggtggtggcgcaggggacggaggccggcggccacggcctgaccgcccgcggcaccgcggcgttcgtgccggcggtcgccgacctgatcgcccgcgagcgccccgagacgctgctcctcgcggcaggcggcatcgcggacgggcgcggtctcgccgccgccctggcgctgggggccgacggtgtcctgatggggacgcggttctgggccagccgggaggcgctgatccacccggccgcgaagcagcgggttctcgccgccaccggcgacgacacgatccgcacgcaggtctacgacatcgcccgccagcgggcctggccggcgccctataccgggcggctcctgcgcaacaccttcatcgagacgtggcacggccgcgaggacgcgctgcgcgcggcctcgggcgatcggcgccgcgacgtggaggatgccgacgcggcgggcgactacgacgtcgccaacgtcacggtcggcgaggccgtggggctgatcgacgacctgccgggcgccggcgacctcgtcctgcgcatcgccgaggaggccgaggccgcgatccgccggatctccggcatggccgcggcgccgtga

SEQ ID NO: 5341 - DNA, 1308 bp, Methylobacterium sp.
atgaggctgcttcggtcgatctacggccaggttctgctcggcatcgcgctgggcatcggcgtcggcgtggtcgcgcccgacttcgcggtgggctgcaagatcctcggcgacatgttcatcaacctgatcaagatgatcgtcgcccccgtcatcttctgcaccgtcgtggtcggcatcgcgcatgtcggcgacatgaagagcgtcggccggatgggcctgaagaccatcctgtacttcgaggtcgccacgacggtggcgctcgccgcgggcctcctgttcgtcaacctgctgcggccgggcgacggcgtgaacgccacggtcgacagcctcgacgccaagctcgtggccggcatcgccggcaaggcccacgcgcagtcgccgatggagatcgtcgccaacatcatcccgcacagcgcggtcgacgccttcgccaagggcgacctgatccaggtgatgttcttctcggtgctcgtcggcatgggtctggcgatgctaggccggcgcggcgagttccccctcaaggtggtccacgccttcggcgacgtgctgatgaaggtcgtcggcctgatcatgcacttcgcgccgatcggcgccttcggggcgatggccttcaccatcggcaagttcgggctcggcatcctcgcccagtacgggatgctgatcgtctccctctacctgaccttcatcgtgttcatcgccgtcttcctcggcggcgtgatgcgcttctacgtcggcctgagcctgtggaagctgttccgctacagccgcgaggagctgttcatcctgctcggcaccacgagctcggaatcggtgctgccgcggatcatggccaagctcaacggcctcggggtcgacaagagcgtcaccggcctcgtgatgcccgccggcctgtccttcaacatggacggctcgtgcatctacctgaccatggcgatcggcttcatcgcccaggccctcaacgtgccgctgacctgggagcaggagctcggcatcctcgccatcgcgctggtgacctcgaagggcgtcgcgggcgtggccggcgccatcctgttcgtgctcgccgcgacgctccaggcctcgcagctcctgccggtggcgggcatcgccctgatcatcggggtggaccgcatcctgaacgagctgcgctgcgtgaccaacgcggtcggcaacatggtggcgaccctcgtgatcgcccgctgggagggcaagatcgacctcgcccacgcccgggcggtgctcgacggccgcatcaccccgaacctcgacctcctcgacgacgaggacgaggtggcggacgcgatccccgcc

SEQ ID NO: 5342 - DNA, 1005 bp, Methylobacterium sp.
atgcgcagacgcgacgttctggccggggccgcggcgctcctggcgggccccgtcccggggcgggcccaggaggtcggcgccgtggcgatcgcccgccagccgagcctcggccacctgccgctgatgctgatggaggagcagggcctgctccagaaggccgcggccgcccgcggcgtggcggggctccaggcgcgctatctcaccctcgcgggcggcgcggcgatgaacgacgccctgctctccgggacgatccagttcgcggccggcggcgtgccgcccctcgtgctgctctggtcgaagaccgagggcaccgccatggcggtgaagggcgtggcggcgatgaacagcatgccgctcctgatgaacaccagcaatccgaaggtgcaccggctcgccgacttcaccgaccgggacaagatcgcgctccccgccgtgaaggtctcggtccaggcgatgttcctgcagatggccgccgagaaggaactcggcgcaggccgccgcaacgacctcgaccggctcaccgtcaccctctcgcatcccgacgggatggcggcgctcctcgggggcagcgaggtgacggcccacttcaccgccgcgccgatccaggagctggagctgcgccggcccggcatccgcacggtgctcaacagcttcgacgtgctgggcgagccctcgaccttcaacgtggtctgggcgtcctcggccttcgcgggcgccaacccccgggtcgtcgcggccttcggcgccgccctggacgacgcgctcgccgcgatcacggccgatccgtcggaggcggcgcgcgcctacgtgcggctcgcccgcgacgggagcgatgtcggcctgatcaccgagatcctgaaggacccgcaggtcaccttcacggcgacgccccgggcggtcggcaaggtcgccgacttcatggcccgcaccggcacgatccgtcgccggccggagagctggaaggacctgttcttcgcgggcgtccacgacaaggcgggcagctga

SEQ ID NO: 5343 - DNA, 747 bp, Methylobacterium sp.
atgaacacgatcctgatcaccggctgctcgtccggcttcggcctggagacggcgcgcaccttcctcgaacggggctggcacgtggtcgccacgatgcgcgggccgcggagcgacctgctggcgccctccgatcgtctcagcctcctgccgctcgacgtgaccgaccctgacagcatcgcccgcgcggtcgcggcggccggaccggtcgacgcactggtcaacaacgccggcgtcgggctcctgaacgcgctggagggtgtctcgatggacgccgcgcgggaggtgttcgagaccaacaccctcggcaccatcgcgatgacccgggccgtgctgccgcaattccgggcgcgccgcgcgggcgtcgtcgtcaacgtgacgtcgagcgtgacgcagcgcccgctgcacctgctgtccgtctactcggcgagcaaggcggcggtgaacgccttcaccgagtccctggcactggaactcgaaccgttcggaatccgcgcccgcctggtcattcccggacgggccccgaagaccgcgttcggcgccaacgcgcgcgcccgcatgggcatggacatccccgaggcctacgcggccgtggccgcgaaggtcttcgccggcatccagcaggcggacggggacctgacccggtcctcggatgtggcggaggcggtgtggcgcgcggtgacggacccgtcgtgccccatgcgtctgccggccggcgccgacgctgtggcgtgggccaaggcgggctga

SEQ ID NO: 5344 - DNA, 906 bp, Methylobacterium sp.
atgaccgatccgctcacccaggtggtcggcctcctccggccgagcgccccgctgtccaagctcgtcaccggctccggtcactgggcggtgcggcgcacggattccgggctgccgttctacgccgccgtgctcgagggcgggtgccgcctcgcgatcgacggcgaggccggtatcgtgctcggagagggcgacttcgtcctcatccccgcggcccacgcgttcaccaccaccagcctcgagccgccgaccctgcggcgcaccgcgcagcgtcccgtcgcggtgagccccggcgtgttccggctcggcgacgccgaggggccgccgaatgtccggatgctcgtgggccactgcgtcttcgcgtcgagcgacgcggacctgctcgtctcgcttctgccccggtacgtccatgtgcgcggcgccgcccggctggccaccctgctcggcctcctgaacgaggagacccgcgccgaccggccgggccgcgacgtggtcctggcgcgcctgctggaggtcgtgctgatcgaggcgctgcgcgccaccgccgggccggcggcgccctcgggactgctgcgcgggctcgccgacgaccggctcgccgccgcgctgcggcggatgcacgaccggccgacggcgagctggacggtggccgcgctcgcgcgcgaggcgggcctctcccggtccacgttcttcgagcggttccgccgcgccgtcggggtcgccccgatggagtacctgctggcgtggcggatggcgctggcgaaggatctgctgagccgcgaggcggtcgggatggccgaggtggccgcgcgggtgggctacagctcggcgagcacgttcagcgtcgccttcgcccggcacgtcggccggccgccgatccggtacgcccgcgagtggcaggcgcggtga

SEQ ID NO: 5345 - DNA, 1131 bp, Methylobacterium sp.
gtggagacagttcattccggtggccggccgctcacgcgcgccgcgctcgccggccggagacgtgcgctcgaagacgggcggacggtctcgcgcagggagctctcggccgcgggccgggacgcggccaaggccctgaacctgcgccctgccctgcgttccatcctctcggcgctctgcgccgtgtggggtgagcaggagtgggaacgcctggtggtgtggccctcgaacgagcacctgtgcgggatgaccgggctgtcggagcgcgcgctccgctacggcctgcgcgacctcgtggccctggagatcatcacgccccgggacagcgcgaacggcaagcgtttcgccatccgcgggccgggcggcgccgtcatcgacgcgtacggtttcgacctgactcccgtcgtcgcccggaagggagaatgggcgaccgcgatcatggaagcgaccgcgagggacgctcagcgtggccgcgcgttcgatctcctgaccgttcgtcgccgcgcggtgtcagaggctctcgccgccctgcgcgcccgcttcccggcgacggatgccgccgatctgctcgcggcgcaggaggccctggagcgcagcacgccgaggagacgcgcttccggcgcggaccctgacgtcgtcctcgacgcctggggagaactgcaagtcatggcggaggatcggttctatcaagccgcctctgccggcaattccagccgtcacatagaacaagacaccggatctcctaccgatccttgtgcaaaggctcccggaaaggagcctgagccgacccgtaggctcgaaccgtcactcgtcgcggccgcttgccctgtcgctgccgagttcggcgtcaccctcagaacggaagcggatgtcatcgagatcggccggctgatgcggggcgggatcggcgcgcatccgtcggcctggagcgaggcttgcaaagccctcggtccgttccaggcctcggtgctcgtgctgatcgtcgcgcaactccacgacgacgacgtgcgccggggtgagatccggatcaggaacccaggcggctacttcaggcagctcgtccgcctgtgttccgaaggtcgctacgggctcgaagccgagctcatggcgatgcggaggaggaagatgacgtga

SEQ ID NO: 5346 - DNA, 1017 bp, Methylobacterium sp.
atgaagacgatcgggttcctgtccttcgggcactggtcgccgaccggcgggtcggcgacgcgcagtgcggccgacacactcctccagtcgatcgacctcgcggtcgccgcggaggagctcgggacggacggcgcctatttccgggtccaccatttcgcgcgccagctcgcctcgcccttcccgctgctggcggcagtcggcgcccggacgaagcgcatcgagatcggcaccggcgtcatcgacatgcgctacgagaacccgttctccatggtcgagaatgccggcgcggcggacctcatcgcgggcggacgcctgcagctcgggctcagccgcggctcgcccgagcaggtcatcgacggctggcggcacttcggcttcgccccggccgagggcgagacggacgccgatatggggcgccggcacaccgaggtcttcctcgacctcctgaagggaacggggttcgccgcgcccaacccgcggccgatgttcgccaacccgccgggactcctgtgcctggagccgcattccgaggggttgcgggaccgcatctggtggggatcggcctccgacgcgaccgcgatctgggcggcgcagcagggcatgaacctgcagagctcgaccctgaaggcggaagagaccggcgagccgttccacgtccagcaggccaggcagatccgccgctaccggcaggcgtggcaggatgcggggcacgcccgcacgccgcgggtctcggtctcgcgctcgatcttcgcgctcgtgaacgacctcgaccgcgcctatttcgggcgcggcacgagcagcgaccaggtcggcatcatcgacaacatgcgcgcggtgttcggccgctcctacgccgcggagccggaccggctggtcgatgagctgcgcgccgacgcggcgatcgcggaggccgacaccctgctgctgacggtcccgaaccagctgggcgtcgcctacaacgcccacctcatcgagagcctgctcacgcacgtggcccccgcgctcgggtggcgctga

SEQ ID NO: 5347 - DNA, 807 bp, Methylobacterium sp.
gtggagacggcgagcgacggcacgctgtcctcctccctcgccttcatgctgcccggcacgccgcgcgcggaagttgaggccgtcttcaaggccgagggtcagcccgcggaggccgtcccgattccgacgaacccgagcctcgttcggatcggctcggaggtcatcctgatcgatgccggctcgggcaactcgttccagcccacggccggcaagctcggcgagacgctggagagccggaacatctcacgtgaggcgatcacccaggtcgtgttcacgcatgcccatcccgatcatctctggggcgcggtcgacgatttcgacgacagcgaacggtttcccaacgcccgctacgtggtgccggcggaggaatgggatttctggacccgcgaggatgtcgagaccctggtgccggactggctcaagggcctctcggcaggctcgcggcggatcctacgacgccttgaggcgaaggtggagcgccgcaaacccggcgagagcattgctcccggcctctcatacgttgcgtcgccgggtcacacgcccggccacgcctccgtcctcgtcgaagccagaggggagcaggtgctgatcggcggcgatgccctgagccatgcggttctgtcgttccgtcggcctgcctgggccttcggaagcgatctcgaccgtgacctcgcggcaagtacccgcctcgcccttctggaccgcttggcgaccgagcggatgatgctcgtcggctttcatctccctggctcgggcgtcggacgtgtcgagcgcgctggtcatagctaccgcttcatacagacctga

SEQ ID NO: 5348 - DNA, 849 bp, Methylobacterium sp.
atggacgaccaggacaagcaatttatcacgcagcagatcctcgacgtcggccgccagctctatgccgccctcgacagcaagatcatgacggctcacgcgcagcagctggcgcagatgcaagatgtccggcgcctcgccgtggttcagctcgcaccgaagaacgacttctgcctcgtgacggatcatccgatcgcctacgagagcaacgatcacacggttccgcgtggaacaaaggatgacaatacgcgcaatcagcggttctgccacgcggtcgagagccatttcggccgaaaggtcagggccctggacctcggctgcgcggggggcggcctcgtcttcgattttctcatccgaggcaatgcggccttcgggatcgaggggagcgattactcccttcgcgcgcagcgcgccgaatggtccatcatcccggactatctgaagacatgcgatattaccaagcccttcgctctgatggatcagagatcagggacgaaagcgaaatttgacgtcatcacgatgtgggaggtcctcgagcacatcgaggaatcgctgcttcctcagctgttcgcgaacgtgaaatcccacttggcggacggcggtcttttcgtgggctccgccgcgacatacgacgatgtcgccaacggcgtgagctaccacccgacggtcaagccggagacgtggtggcgcgagcttgtccggcagcacgggctggaatttgtcccgatgaccatgttccagttcaaggatttctgccgaggctccgggaacgagaacgcgttctacgacgcggatttcagcaagaatcccgagctcggcttccacttcgtgatgaagcaccgccccgcttaa

SEQ ID NO: 5349 - DNA, 1053 bp, Methylobacterium sp.
atgacggcctcagccgccctgaaggatccgcgccgctacttcgaggcgatcggtgccgaccgcgcctccgaggccttggcgccgccggtctgcctctatctggaggtcacgaaccgctgcaacctgctgtgcgagacctgcccgcgcaccttcgagaccctggaacccccggccgacatgagctgggatctgttcacgcggatcgtcgaccaggtgccgaacgtcgcccgggtcgtgctccacggggtcggcgagcccatgctggtcaaggacctgccgcggatggtccgctacctcaaggatcgcggcacctacgtcctgttcaacaccaacggcaccctgatgcagccgaagcgcttccgggagctgatcgacaccggtctcgacgaactgcgcgtgtccctcgatgccgccgatcgggcctcttaccgcagggtgcgcggcaaggatttcttcgaccgcatcgtgcgcgacgtcggcaaattcgtcgcgttccagaaggcgagtggcgccacgacgccccgggtctcgctctggctgacgggcctcaaggagaccgtggaccagctcccggccttcgtgcgactcgccgccgagatgggcgtgaccgaggtgcacctgcagcgcctcgtcttcgacgaggccgggtacggcatggcccgcgccgacctgtcgctgttcgagagcgcgcgggccgaggagaccgcggcgatcgccgaggccgaggccctgggccgctccctgggggtgacgctcgacgcctcgggcgcgacagagcccgggatcagcctgaagcgtcaggaggaccgcgcctgggccacctgtcgtcgaccctggtccctgatgtacgtcaccgcccacggtcgggcgctgccctgctgcatcgcgccgttctcggtgcgcggctattccaactacacgctgggagacgccacgcaggccacgctccgagagatctggaacggcgcggcctatcgcgacttccggacgtcgctcctctccgacgtgccgcccgccccgtgccggaactgcggcctgcgctggagtctctga

SEQ ID NO: 5350 - DNA, 648 bp, Methylobacterium sp.
atgactctccgccgccgcgcgctgcctctggccgccctcgccctggccctaccgctggcgaccccgctggcgaccgtggcggcgcgggcgcaggaccggctgccgaccatcccgccccaggactacacgcccgagcagaagcaggcggccgaggccttcgcgcaggcgcgcggcaagccgcccttcgggccgttcgagccgctcatgtactcgccggaggtgatgacgctcgcccggtcgatgggcgactacctccgcttcaagccgaagatcggcaccacgctctcggaactggtcatcctgatgaccgcccgccgctggacgcaggactacgagtggtacgtccacgcgccgatcgccgagaaggccggcatctccgccgacatcatcgcggcgatccgcgacggccgccggccggcgaagatgagcgacgacgagaccctcgtgtacgatttcaccgccgagctccaggacacgaaacgcgtctccgacgcgaccttcgcgcgcgccgaggcccggttcggcaagcccggcgtggtcgatctggcggcgatctcgggctactacacgttcctggcgatggagctgaacgcggcccgctacccgattcccgccgacggcaagccgctgccgcgcatgcccgagtaa

SEQ ID NO: 5351 - DNA, 915 bp, Methylobacterium sp.
atgagctatccggcccgggtgcaggtgatcgaggtcgggccgcgcgacgggctccagaacgagcccgcgccggtgccgatcgccgccagggtggcgctgatcgaggccctggccgaggccgggctgacccgcatcgaggccggcagcttcgtgtcgccccgatgggtgccgcagatggccgagaccgcggaggtcctggcgcggctgcgcccccggcccgaggtcggctattccgttctggtcccgaacctgcagggcctggagcgggccctcgcctccggcgtccgggacatcgcggtgttcgccgccgcctccgagagcttctcccggcgcaacgtcaacggctcgatcgccgagaccctcgaccgcttcgccccggtgctggaggcggcgcgcgcgaacgacctgcgggtgcggggctacgtctcctgtgtcctgggctgcccctacgagggcgacgtcgcgccggcggcggtcgcccgcgtcgccgcgtccctccacgcgatgggctgccacgagatcgccctcggcgacacgatcgggaccgggacgccgcgcgcggcccggcggctggtcgagcgggtggccgccgacgtgccgctgcaggcgatcgccctgcacttccacgacacctacgggcaggccctggccaacatcctcgcctgcctcgaactcggcgtgtcggccgtggacgccgcggtggcgggcctcgggggctgcccctacgcgccgggggccgccggcaacgtcgccaccgaggacgtcgtctacatgctgcgcggcatgggcatcgagaccgggatcgatctcgatgccctcgccgcggccgggcggtcgatcgcgtcccagctcggccgggagccggcctcgaaggtcgcccgcgcgctggccgccgcgccgccgccgacaccctga

SEQ ID NO: 5352 - DNA, 399 bp, Methylobacterium sp.
atgtccgaaatcacggaggccgcaccggcggcggagccagactacgaccggctgctgcgcgccaacctgcggcgggtcttcaacgagcgggacgcggacgcgcgagcggccgccctggacgagttctacgtggccgagccgatcctgttcgagccggacaatgtcgtgcgcgggcgggccgcgatcggtgcggtcgccgggacgctgctggaccggttcggaccgaccttccgcttcgtgcccgtcggcaggggggtcgggcaccacggaatgggatcgctgcgctgggaagccggtccggagggcggaccggtcgcggtcaccgggacggacgtcgccgagatcgtggacggcaggatcggacgactctgggtgctgctcgacccgccggccacctga

SEQ ID NO: 5353 - DNA, 900 bp, Methylobacterium sp.
atggaactgaagtggatcgaggacttcctcagcctcgccgagacccgtagcttctcacgctcggccgaggcgcgtcacgtcacgcaatcggcgttcagccgccgcatccgctccctggaggtctggctcggcacggccttgctcgaccgaagcacctacccgatcaccctcacggcggacgggcgccacttcctcgagaccgccgaggaggtggtgcgcctcctcaccctcagccgcgccgacttccgcaaccgcagcgagcggtcgagcctgcccgtcgtcgccatcactgccctgcattcgctctgcctctccttcctgccgcgctggctcggcacgctccggggcgagctcggcgcgatgagcagccgcgtgctgccggagaacttcaacatctgcctccaggccctggtcgagggcggctacgacctcatgctgacctatcaccatccgggcatcccgatcccgctcgggcccgatcgctttccctgcctcgtcgtgggccaggacagcctcgtggccgtggcggcgccggcggatctcccccgcgaccgggaaggccgcctgccgctcctgcaatattcccgcggctccttcctgggccggctcgccgccatcgcccaggcccgggagggcgcgcccgcgacctatccggtccacacgaacgagaactcgatggccgaggccctgcggtcgatggcgctcgcgggacacggggtcgcgtggctgccgaggagcctcgtggccggcgagatcgcggcgggcgcgctcgccatcgtcagccccgagatgtcgatggagatccggctgtaccgcagcgcggagcgggcccggccgttcctagaggccgtctggtcggccgccgccgcggattcgaagaactattccggttcggaatag

SEQ ID NO: 5354 - DNA, 531 bp, Methylobacterium sp.
atgcaggagacgggcgcacacctgtcccgccgcggcttcctgggcgccgcgggctcgacgctgctcgcggtcgcggtcatgccggacggcagcgtgaccgggcgggcctgggcgcagatgccgaaggcgacgaagcccgagaccttcgcctcgctcgtgcagatgtcgcgcgactgctacccgcacgaccgcgtcgccgacaggtactacgccgccgcggtgcagatcctcgacgacgcggcgcggaccgctccaggagaactgacgctcctcgaggacgggatggccgcgctcaaccgggcggccgtcgagaggcaccgcctgccctacgccaaggttccgcaggatacggaccgggcagccctcctcgagaccatcgagccgaccccgttcttccagaaggtgcgggccaacctcatcgtcggtctctacaaccagaaggagctgtggccgatcttcggctacgagggcgcctccttcgacaagggcggctacctggagcgcggcttcgacgacatcgactggctctga

SEQ ID NO: 5355 - DNA, 594 bp, Methylobacterium sp.
atgactgagcatccggtggccgggcccgccttggccgttgacgtgaccgtcgaccctctagcaaccccttacttcgactacatcctagatggcgtgcgccttgatctagcgcaccttgagccacggggactgacattctttgtcaaaaatctcgggcgggaccttacagtcgacgtgaagttctccaaccattgcttcaccgtggatttcgatcccgccgttcacaaccctgcgcatgtgatcatggatcataagcggcggcgcgcatacgaccctgagcggcacgcactctcgcgtgggctccccgacatgatcgcggcgttgccgagcgcggcggtgtacctaacgccatcggacaggaactacgtctacgttgcccgcctcgtgacgcccgccggtatggtctacccgatgtatttccacctgcggcgcgccaaggacacggctccgcgcaacctgcaaatggtggtcgagagcgcctacccggtggaagacgcgagggccgtgctggcaggcacgacgaaaatcagcttcgccgttctgtgcgccaaggtgttcaggggcgagcgcatacgtccgcaggcccggcgctag

SEQ ID NO: 5356 - DNA, 483 bp, Methylobacterium sp.
gtgcgcctgcgcgccgtcgcgctctccaggtctgtctcaatgacactcgctcgtgaccctgatgcccatctctccagcacaactgacgcggccaaactctcgctgccgctgtcctggtggcgcgtcttcgcccctgaggcgctcgatatggcggcgcagtgccgcctgtccgctgccctgaatgccgtgcagcccctgccgtcccccgactggtccgctgcttgccggggcgattcggcggctgcgatccatatcgccctcaacgtcctcgccgaggctatcgcctttcctgggcgcctcgatccggcgatgtcggcgatctgcctctgtgccgtacgaggtgacggctcctgcatcgacctgctcgtgcacgtgctcgggcggcgcgctcgacgccgggctgatctcaaggtgctctgcctcgcccatgcttggtgctccgttccgcgccgcggttccgaccgcgtcggcgtcgcccgctga

SEQ ID NO: 5357 - DNA, 729 bp, Methylobacterium sp.
atggacgtcgtcgcacgccgccggggccggccccgcaaggcgccggtcgtcccggtcgcgcagctgccgcggaccgggctgcacgagcaggcggcgggccggctcagggacatgatcgtgcgcggcgtgctgccggccggcgcgtccctcgtggagacggacctgtccgtcgccctcggggtcagccggacaccgttgcgggaagcgctcaagctcctggccgcggaggggctggtcgaactgcaccagaaccgcagcgcccgcgtcccggactggacgccggaggagatcctcgaactgttcgaggcgctcgccgggatcgagcggctgaccgcggaactcgcggcgccgcggatctccgaaaccctgatggacgcgctgcgcggcaagcaggcgcagctcgaccggatgcaccgggaccaagtgctcgacgcctatttcgccctgaaccaggagatccaccggacgatcgtcgaggccgcccggaaccgtccgctggcggaggcccacgcggcgctccaggcccgagcccagtgggcgcgcctgcgcgcgctctccagcggcagccgctgggaggaatcggcccgcgagcaccgggatctgttcgaggcgctcgccgcgcgggacgccgccgcggccgggaccgtcgcccaccgccacgtgctgcggaccggcgtggtgattgccgagacgctccaggcccggcgcacggaccccgcggcgccgtaa

SEQ ID NO: 5358 - DNA, 984 bp, Methylobacterium sp.
atggaggacgccgtgatggaactcgtgaccaagcccctgcgggacgagggtcctctgccgctcctggtcacgccgccggagggcgccgcgggcacggcgctcgcggacgcgctgccggcgatccgggccgcggccgaggcgcacctccacgccgcgggcggcctgctgctccgcggcttcagcctcgacgggcccgacgcgttccgcagcttcgcggcgggcttcggccacgacctcctgagctacgagttcggctcgacgccgcgcagccccgtgacccagggggtctacacctcgaccgagtacccgccccaccagcacatcccgctgcacaacgagcaggcctacgcccgcgactggccgatgaagatctggttctactgccagcaggcggcgcccgaggggggcgagacgccgctcgccgacagccgcgcgatctaccgcgccgtgcccgagccgatccgcgcgcgcttcgccgagcagggcctgatgtacgtgcgcaactacggcaacgggctcgacgtggcctgggagcaggtgttcggcacacaggaccggggggcggtcgaggcgtactgcgccggccacgggatcacctgcgagtggaagccggacggcgacctccgcacccggcaggtctgccagggcaccgcccgccaccccgagaccggcgagccggtgtggttcaaccaggcccacctgttccacgtctcgaacctcgagccggaggtgcgcgcgaccctcctcgacctcgtcgacgagccggacctgccgcgcaacgtctactacggcgacggcagcccgatccccgacgcggatctcgacgcgatccgcgccgtgctcgccgagcacaccgtcgtctttccctggcagtccggcgacgtggtgatgctggacaacatgctgaccgcccacgcgcggactcccttcaagggcccgcgcaaggtcgtggtggcgatggcgcaagccggccgcgcgcagtga

SEQ ID NO: 5359 - DNA, 1944 bp, Methylobacterium sp.
atgcaagcggtcgcgcgatcggaatcccttgcggcggcgccctgcgccggccccgcggaccgggccggccgccgcggcggatggcgtgaccggtggcgcgcgccgcggctgcgcgtcgtgctggccctgggtttcggcacgctcggcttcctgacgaccctgacgctcgccgccctggtgagccgcgaggcgacccgacggctcgaggcggaggtcggcggccagctcgccgagatcgccggtcagatggcccggagcctcgatatcgggatgttcgagcgctggcgcgacatccagatcgccgccgcctcggacagtctgcgcgatcccgggaccggaacggccgccaagcgcgccgtgttggagcggctccaggcgacctacccggcctactcgatcatcgggctgatcgacgccgacgggcgcttctccgtcaccagcaccggcgccctggagggcgccgacgtctccggccgcgactatttccgcggcggccgcgcgggcccctacctgggcgacgtgcatccggccaagctcctcgaggcgctgatgcccccggacgaggccgccgcgcgcgcggcgtcgcgcgagcccctgcggctcctcgacgtcgcggcgccggtgcgggcgccggacggccgcgtcctcggggtgctggccgcccatctcgactggacctgggcgcgcgacatggcccgcatcctcgaggctggcctccggggccaccgccagggcgccgagatcctgatcctgtcccgcgacggcaccgtgctcctcgggccgcccgccctgcagggcgcccccctgccccgctcggtgctggcgggcggccggcccctcgatccggagggcacgagccgggtcggcccctggccggacggcgccgcgtatctcagcgcccgcgcgtccacggccggccaccgcgactatccgggcctcggctggcaggtggtggtgcggcagacggccgaccgggccctgacctcggtggcggccctgcgcgggggcatcctggcggcgggcagcgcggtggccctcgcggcggcgctgctcgcgtggctgctcgccggcctgatcgcccgccccctgctggacttggcggccgcggccgagaccctgggccgcgaccagcccctgccgccgctgccgcgctccttcgtgcgcgagggcgcgacgatcgccgacgccctggcggcggcggcggacgagcgcgcccggcgcgccgagacgcaccggctgctgatcgacgaactcaatcaccgggtgaagaataccctcgccaccgtgcaggcgatggcggcgcagagcctgaagaatctgggcgccggcgcggcggccgggcgcgacgccttcgaggcgcggctcctcgccctgtcgcgcgcccacgacatcctgacccgcgagagctgggcgagcgcggatctgcgcggcatcgccgcccaggcggtgcgacccttcctgggtccggaccccgcgggcgacgatccgtcgaaccgcgattcttccggtcgggagacttcggaccgtgacgctgcgggtggggacactgcggaccgggacactctgggtgcgaacaccccgcgcatcaccctggacggccccgacctgcggctgccgcccgagggcgccctcgcgctcacgatgatcctgcacgaattgtgcaccaacgcggtcaagcacggcgccctgtcggttccaggcgggcgggccgcactggcctggacggtggaggcgggtccggacaccgagaccctgcggctgacctggcgtgagtgcggcggcccgccggtcgtctcgccgtcgcggaaggggttcggcacccgcctgctcgagcggggcctcgccgggggcaggaccgccagcctcacctacgaggccggcggcctcgtctacgtggcggccaatcccctgcccgcggcgcgtctccacaccggacgggcctga

SEQ ID NO: 5360 - DNA, 819 bp, Methylobacterium sp.
atgcggacgagcctgcggcgcgatctcgactggttcagcttccacggcgcggtgctgctgctggccgggctctgcctcgtcctgctggcggcacccaccgtgatcgtcgtggtggtgtcgttcaccagcggcttctccctgcgcttcccgccgccgggctactccctgcgctggtacgcggcgctcgcggaggccgagcagctccgggccgccgcctggaacagcctcgtggtggcgggctggacgaccctgctgtcggtggcgctgggcaccgcggcggcgctcgccatcgcccggtcgccgcggctctccgcgcggctcctcgacagcctgttcctgtcgcccctcgtcctgccggccctggccttcgggctcgccgccctgatgctgttcagcctcgccggcatcccggtctcgccgctcaccctcgtgctgggccacaccgtggtctgcgtgccctacgtggtccgcaccaccgtggcggccctgtcgcagatggacccggtgctcctcgagagctcgacctccctcggcgcctcgcgcctctacacgttccgccgggtgaccctgccgctgatccggcccgggatcctggccggcggcttcatcgccttcatggcgagcttcgacaacgtcccggtctcgctgttcctgcgcgacgccgccaccgacatgctgccgatccgcatgtggcaggacctggagggccgcctcgacgtcacggtggcggcggcctccagcctgctgatcctcgtgaccgtggtgctcgccgccgtgatggagcgggccgccggcctgtcccgccggatggcaggctga

SEQ ID NO: 5361 - DNA, 903 bp, Methylobacterium sp.
gtgagcgccggcccggccacggcggcgggcccggtcgcggcgcccctccgcccgggccgcgcctggacagcggcctacgacatccgcctcgcgctgccgctcggggcgttcttcctcgtcttcttcctggcgccgctggcgctgctgctgctcgtgagcttctacgccgatccggccatgacccggttcggcctcgaccagtacgcccggttcctgctcgacccgttctccctgcgggtgctcggcgcgaccctgtggctcggcgtcgaggtcacggcgctgaccctcctgctcggcctgccgctggcgctgctcctgacctgggcgcccggccggctgcgcggcctgctgaccctgatcgtgctgctgccgctgctcacgagcgtggtggtgcggaccttcgcgtggatcgtgatcctggggcgccagggcatcgtcaacgccgcgctcctcggcctcggcctcaccgacgcgcccctcaagctgctctacaccgagggcggcctcgtcctggcgctggcgcaggtgcagctgccgctgatggtcttgcccctggtcaccgccctgtcgcggatcgacccgaacctcgccgacgcctcggcggcgctcggggcgggggcgtggcgcaccttcctccgggtgacgctgccgctctgcctgcccggcatcgtggcgggctgcctgctgaccttcgcggcggcgatcaccgccttcatcacacagtcgctgatcggcggcgggcagatgctgttcatgcccatgtacctgtaccagcaggcgtcctcgctcaacaactggccgttcgcggcggcgatcgcgatcgtcttcctcgtggcggtgctcgcctgcgtcacgctcctcaacctcgcgggccgcctgtcgggcggccgcgcgcgggcctga

SEQ ID NO: 5362 - DNA, 1044 bp, Methylobacterium sp.
atgcccctgcaccgccgcagcctcctcgccggcgccctgaccctcggtgccgcgcaggccttcccgggcctgtcccgcgcccaggcgcgcaagctcgtcttcgcgaccttcacgggcagctgggaggaggcgcaccgggccgtgctcgtgccggccttccgcaagagctcgggcggcgacgtcatcctcgacccgatgctgtcagtggaccagatcgccaaggtccaggcggcccgcgccaacccgccgatcgacgtgatgctgcacgatccgggccccgccctcacggccatagcccaggacctcgtcgagccatacccggtggcccagtccgcccattacggcgacctgatcgcggacgcgcaggagccgatgggcccggcgccgttcttccagatcgtcggcctgacctacaatcccgagaaggtgaagacgccgccgacctcctgggccgacctgtggaagcccgagtacaggggccgggtcggcatcaccaacctgaactcgacgctgggcaccggcttcctcgtggagatcgcccgcatgcacggcggctcggagaccgacgtcgagccgggcttcaaggcgctggaggcgctcaagccgaacctcgccgccgtcgcggccaatccgggcgccctggcggccctctaccagcaggagcaggtcgacatcgggccgggcaatttcaacgcgatccagatcctgaaggcccggggcgttccggtggagttcgcggcgcccaaggagggcatcatcgccttcaagacgacgatccacatcgtcaagaacacgccgtcgaaagagctggccttcaagctgatcgaggccgcgctgtcgccggaggtgcaggccaagctgatgcagagcccctacctgatcgtgccgaccaaccggaaggtcgccatcgacggcgaggtcgcgaaagtcctggcgaaggacgcggacgagctgaagcgcaagtcggtgttccaggactgggccgcgatcaaccgcggccggccggcctggatcgagcgcttcaaccgcgagatccgggtgtga

SEQ ID NO: 5363 - DNA, 474 bp, Methylobacterium sp.
atgtctgacccgatcaccctcgacacggtcgcggccgggcgcctgcgcgatgccggccacctgaactacggcaagcgcggcggcggcacgatctggcagcacacgacgatcgcccgcctgtccgcgatcgaccggccaacgctgagcgccgaggagaccaagcggctcggcgtgtcgcgcctccgcgagtggtgcgtcgacggggtcgcggtcggcagcctcgagacggcgatcgccgcgctggccgtgcctccggtgctcaccgaggaggagaccgccatcctggcgcgcgtgcctgccgactgggtcgagctgcacgcctttcgcgaggcgctcggcgcggagtggggcgcgccggttggagcgacgctcatcatgctccggcagaagggcgcgatccagaacgagcggcggccgggcgagacgcgcccgcagccctggatccgccggacgccggaggccggccatgggtga

SEQ ID NO: 5364 - DNA, 405 bp, Methylobacterium sp.
atggtgagttctaacgacccgccccgcgccgaacgcgtcgaggtgatcacctccgtccagcggcgtcggcattggaccacgcaggagaaggtgcgcctcgtcgaggagacctatctgcccggtcagtccgtctcgctcgtcgcccgccgccacgggctgaacgccaaccagctgttcacgtggcgtcggctgatggagcgcggcgcgttcacggccgccggtgccggtgaagaggtggtgccagcctccgagctgcgggctgcccagcagcagatccgcgaactgcagcggctcctgggcaagaagacgctcgagaccgagatcctgcgcgaggcgatggagcgggtcgtcgcccccaaaaagttgccctcgcgcgtgacctcgtggccggaggacggccggtga

SEQ ID NO: 5365 - DNA, 294 bp, Methylobacterium sp.
atgtcatccgatccgaccgccccgccggtgcacggcgagatcctgtccggcgttcagcgtcgacggcgctggtccaccactgagaagatccgcctcgtcgaggagagccagcagcccggctcgtccgtgtcgttcgtcgctcgccgctacggcatctcgcccagcctgccgttctcgtggaagcggcgcatgctggagggcggccatcaggctgtgcacgccgacgaggaggtcgtcggcaccagccgggttcgcgagctggagcggcgcgtgcgcgacctcgaacgcctgctc

SEQ ID NO: 5366 - DNA, 885 bp, Methylobacterium sp.
atgccgagcgccacgacggacgacgggatacggctccactacgaggagagcggccgggggacgccgctgatcttcgtccacgagttcgccggcgatcaccgcagctacgaggcgcagctgcgccatttcggccggcgctatcgcgcggtcgcgttcaacgcccggggatacccgccctccgacgtgccggaggccgtctcggcctacgcgcaggcgcgcgccgccgacgacatcctggccgtcctcgaccatctcggcgcgccgaaggcccacgtcgccggcatctccatgggcgccttcgcgaccctgcatttcggcctgcggcaccccggccgcgcgctgtcgctgtgtctcggcggctgcggctacggcgcggagcccgagcggcaggccctgttccgcgccgaggcggacgccaccgccgcgatgctgctccgcgacggcatggcggccttcgcggagcgctacgccgtcgggccgacgcgggtgcagttcgagaccaaggacccgcgcggacacgccgagttcaagcggatgctggccgagcactcggccctcggctcggccaacacccaggccggcgtgcagaaggggcggccgtcgctctacgatctcacggacgagctggggcgcatgaccgtcccgaccctgatcgtcgccggcgacgaggactggccctgcctcgcccccagcctgatgctcaagcgggtcattccctccgcggccctcgccgtgctgcccaataccggccacgccctctcggtcgaggagcccgacgcctacaaccgcctgctggacgacttcctggcgcaggtggagagcggccgctggccgatgcgcgacccccgggcgatctcggcgacgatcaccggcatcaggggctga

SEQ ID NO: 5367 - DNA, 552 bp, Methylobacterium sp.
atggcccgcgctctgccggacgttacctccatcgaagagggtgttgggctcctccggacccagctcctgtcgatctccgacgcgatcgcgcgcacgcgtcaggagatcgcagacctccggcaggaacaggagacgagccgcgcgcgcgatgagctcctcgccgtggtgcagggcaccgaagacgccaccaacgcgatcctgacggcttcggagaaggtggatacgctcgcgcgcggcatcgtgagacggtcgggcgaggacgccaaccgggccgacgcccgggccattcagatcgagatgcagacgatcttcgaatcctgcaatttccaggacctcaccggccagcggatctcgaaggtcgtgcgcacgatcgtcctcgtcgaggagcggatcggcgagatgctgcgcgtctggtccgggcccggcgacgcgccgtcacggccgaatccgacgaccgacacgcgcagcgaggaggcggccctgctcaacggccccgtcctgcccggcgacgcctcggtatcgcaggacacggtcgacgcgatgttcccgtaa

SEQ ID NO: 5368 - DNA, 282 bp, Methylobacterium sp.
atgacgcgcatgatcggaccgtggagcgcgcccgccgcgtggcctgtccgcgcgctcgcggtctgcgccgtccttgccggatcggggccggccctcgcgctggagaatccggcctcggccttctgcgcgacgatgggcgggcagacgatcctcgcgaagctgcccgatggcggcacgatcgggctctgcgcccttccggggcggaagatcgtcgaggaatggacgctgtaccggatgctccacggcgtgaagccggcacccgacgccgacccgttccgctag

SEQ ID NO: 5369 - DNA, 1422 bp, Methylobacterium sp.
atgccgtccttccgcaacaacgccgtcgacccgcagcagatctccagcgcgttcgacagcatcgccaacgccttcaaggtcacgccccaggagatcctggccggcgcgaagtcgcgcgagacgatgcagaaggtccagtacctcgccgacgcctacaagctcgcccaggacccgaacagcgaccagggccagctcgaccgcctcgcctcgatcgcgggcgcctacgcgccgagccagagcctgacggcggtggaccgaaacaacgccacctcgctccggacgaacgcggccgacaacgcccgcgcgctccaggttgcccgcgaggggcaggccggcgagacgacccgcaccctcctgtcgccggtcggggaggggcagacccgcttcatcccgccgtccgtcgcgagcctgtacgggctgccggcgcagcagatcggcgccgtgaaggcgaacgaggggcagacggtggcgctgcccggcggcgggacggtcgaggggcgcgagaagcccctgacggaggacgccgtcaaggcgcgggtgctggccggcatggagccggcggcgcagcgcgcggccgccttcggcaacacgcccgtcgagaccgtaatgaccccgcagggcccgcgcatctcctcgcgtctggacgcgatcggacaggccccggcgccggacacccagaaggctcagttcttcaactacgacaccccggacgggaagtccggcaccgcccgcacggacggctcgggcaagctcgtcgacacccagaccggggccgagctgccgccgggctcgcgcacctacacggcccagctcacaggcaacaagacggacacggggctcggcgcgagcgcgaagtccaacatcgagacgcagctcctggatctgtcgaacctggagcagagcgtcaacgcgctcgacaagatcgccacgagcaatccgcagtcgatcggcctcaccgggcaggttctgggcatcggccaggacgccatggcgacgatgaaggaagctgcgaccatgttcgggcccaaggcccaggactatctcaagcaggtcgaggacggttctctgcctccggagatgtcgcgatacttcaacccgaacatcccccaggcgacgttgcttgagaacaccatcctggcgcagtacgccaagatgcaggacccgaacggccggctcagcaatcagcagatggagatcgccgccaaggcgctcgggatcgacggcatgctcaagtcggctgacaagacgaaggccgtcatcgccggcatccggcagcagattgcgcagaagcgcgccatgctcggcggcgccgcgccggccgccaacgcgatccggccgccggacgctgctggtgggcccgccccggcgccggccggtgcgcctgttcgtcggaagtggaccgccagcggggagctacagtga

SEQ ID NO: 5370 - DNA, 807 bp, Methylobacterium sp.
atggaacgggaccggcggcacaaggccttcatgcgccgcggggagatcctgccggagccgggcgtcgaagcgccggtcgagggcgaggccgaggcccagccggaggccaagcccgccgaaagcccgcgggagaagcaccagcgagaacgtcgtgagcgagaggccgagcgcgtcgcggcccgccgggcggagtacgacctgcccgagggcaagcagtgggcgatggtcgaggcctgcgtcggccggaccggcgagctgtgcgagaagctgacccaggcgaagatcccgcacttccgccctcgcgacgagatcgaccaggtcctcagctcgggccggatccgcaagatgcaggtgccgctgttcgaccgcaccgtgttcgtcggcctgaaggatcgaggccagctcgaggagctcgccgccgagcatccctggctgatggagcggcgagtctacggggacatgccgtggctacgtcgggacaagacatgggcctgggacgtcgagcacgttgagcgctgcgtgctgggtcaggacaaggacggccacccggtgatcgcggcggccaccatcccggacaaacagatgcgcgagttcgccgagaccctgatcggctcgatgccggtgttcgacgtcgaggaggtgttcagcatcggcgagagcgtgcgcgtcgccgacggcccgttcgccagcttctccggcgtcgtcgaggagttcgatgcaggccgcggcatggtgaaggtcgaggtctcgatcttcggccgccccacgcccgtcgagctcgaactgcaccaggtcgagcggcagtga

SEQ ID NO: 5371 - DNA, 1290 bp, Methylobacterium sp.
atgtccgacgaccgctaccaccggaaggcgctcggcaaccgcccgctccgtcccgagacgctgatgctcggctacggctacgacccggccctgtccgagggcgcggtgaagccgccggtcttcctgacatcgaccttcgtcttcacctcggccgagcacggcaaagccttcttcgactacgtctccggacggcgcgaaccgccggtcggcgaggcggcggggctggtctactcgcgcttcaatcacccgaacagcgagatcgtcgaggatcggctggccgtcttcgaggaggccgaggccgcgctggtcttctcctccggcatgtcggcgatcgccaccacgatcctggccttcgcgcggcccggcgacgcgatcctgcactcgcagcccctgtacggcggcaccgagaccctgatcgccaagaccctggccggattcggcatcgcgccgttcgggttctccgacggcaccgatccggcgagcgtgcgcgccgcggctgacagcgcggccgacgcaggacgcgtcagcgtcgtcatggtcgagaccccctcgaacccgctcaacaccctcgtcgacctcggcctcgtccgggcggtcgccgaggagatcggcgcccggcagggtggcgaggcgccggtcgtcgtctgcgacaacaccctgctcgggcccctcttccagcacccgctgcgcgaaggtgccgacatctcggtctactccctgacgaagtatgtcggcggccattcggacctgatcgccggcgccgccctcggctcggcggcgcggatgaagccggtgcggctgctgcgctcggcgatcgggaccggactcgacccgcattcctgctggatgctggggcgctcgctcgagaccctgtcgctgcggatgaatgccgccaaccgcaacggcgagatcgtcggccggatgctggcggcgcacccgaaggtggcgcgcctccaccatctcgcgcatctcgagcccggatcgcggcaggcgcaggtctacgccaagcagtgcgcggcgccgggctcgacgttctcgttcgacatcgtcggcggcgaggccgaggcgttccgggttctcaacggcctccagctgttcaagctcgccgtcagcctgggcggaacggagtcgctcgccagccacccggcctccacgacccattcgggcgtgccgaagacggtgcgcgaccgactcgggatcacggacgcgaccatccgggtgtcgatcgggatcgagcacccggacgatctggtcgcggacctcgcggcggctctgtccgtcctgggctag

SEQ ID NO: 5372 - DNA, 2118 bp, Methylobacterium sp.
atggcccccagcgccacccacgatctcgggacgagcctcttccggccggaaagggtcgcggttgtcggcgcatccgacgacgcgagcaagacgaccgcccggccgctgcgcttcctgcgccggtccgggttcggcggcaccgtctacccggtcaatccccaccgggagaccgtcctcggcgagcgggcgtggccctccatcgagagcctgccggagacgccggaccatgccttcgtcctggcgccgaccgaaggcgtcctcgaggccgtcgccgcctgcgccgcccggggcgttcccctcgtcagcgtcctggcggggggcttcggcgaggcggggaaggccgggcgcgcgcgtgaggccgaactcactgccatcctcgccggaagccgaacccggctcctcggcccgaacagcatcggcatcgtcaacgtcaacaccggcctcgtgctgaccgccaacgccgccttcgcggagcccacgctgccggcgggcggactgttcgtcgcctcccattccggcagcatgatcggggcgatcctgtcccgggggctcgccaaggggatcggcttcgcgggcttcgtctcgacgggggccgagctcgatctgtccctcggtgagatctgcgcggcgaccctcgacgatccgctgatcgacacctatgcgctctttctggagagcatcgcacacggcagtgcgatccgggccttcgcgctcgccgccgccgcccggggcaagcccgtcattgcctacaaacttgggcgctcggcgcagggggctgagctgtcgcaatcccataccggggcgatcgccggcgaggatgggatcgccgacgcattcctgaaggattgcggcatcgtccgcgtcgagacgctggaaggtctgatcgaaggcgcggcgatgctgcggcgggtcggccggtccgggcgcagcgtcgccgccaagccacaggtggcagtcgtgacgacgaccgggggtggcgcggcgatggtggtcgaccagctcggcctgcgcgacgtcgcggtcgtgtcgcccagcgtggagacgatggccgctctcgccgcacggggcgtggctgcggcgcccggtcggatcgtggacttgacgctcgcgggcacccgaccggccgtgatgaaggccgccctcgacacgctcctcgccgcccccgaattcgacgtcgtggtcgcggtcgccggctcctcggcacggttccagcccgagctcttggtgccgggcatcgtcgaggccgcgtcgggagcgacgaagccgctcgttgccttcgtcgctcccgaggcccccgaggccttggcgcgcttggccggggccggcatcccgtgcttccggactccggaagcctgcggtgacgtcgtggccgccgtgctcgggcgccgcccggccaagcccatggtcccgaccaagcccgtgaccgatgccgaggccgccctcgcgcggcccgcgtcccctcaccagctcgacgaggccgagggctacgcggtgctggcccgcctcggtgtccccgtcgccccgcacgcggccgtaacgcccgacgcgacggcatccccggtcggctatccggcggcggtcaagctgctctcggcggaggtgctgcacaagacggaactcgggggcgtcgtcctcaacgtccgggacgatgccggcctgcgggatgccctcatccgcatcgtccggaacgtgccgcgtgcggccccggaagtcgcggtggagcggctgctcgtccaggcgatggcccagggcgtcggcgaggtgcttctcagcctgcggcaggatccggatgccgggcccgtggtgatgctcgcggccggcggcgtcctggcggagatccaccgggaccgcagcctgcgcctcgcccccgtcgaccgggacgaggcgctggcgatgatcggcgaggtccgggccttgaaggccctcgcgggctaccggagccgcccgaagggcgatctcgatgccctcgcggatgccgtcgtggcgatctcccgggcagggccggagatccttgaggccgagatcaacccgctgatcgtgcgggacgaggggcagggcgtcgtggcggtcgatgcggtcgtccgcctcgcggctacgcaggaaggatctgcagcatga

SEQ ID NO: 5373 - DNA, 549 bp, Methylobacterium sp.
gtgatcctgcctcctctccgccggaccgcggccgacgcgcggacggtggccaccgtcgcccacgacggccaggtcgacaaggccggcaggccgtatatcgagcatgcggcgcgcgtggctgccggcgtgctcgggctgtcggaggggtgcccgttctggtccgacctggagcgggacgaggcgctgcaggccgcgtggctgcacgatgtggtcgaggacacccgctacgggttcggcgacttggccaaggagggcttcagcgacaacgtgctgacctcggtcgccatgctcacgaagcccggaggtcgtgtcacctacgcggcctggatcaacaacatcgcgaaagtgggcaccctccgggcgacactcgtcaagctcgccgacctcgaggacaattcggatcccgggcgtctggcgctcctgcccgcggaaacccgcgagcggcttcatctcaagtacgagccggccaaggcaatcctgcgcgcggcggcggcggcgaagggctggctcggttcaaccacgacggtcgaaggcagcgggccgcgttag

SEQ ID NO: 5374 - DNA, 276 bp, Methylobacterium sp.
atgagcagcacccgcaagacggcgcttcgtggcgccctcctcggcctcgccctcgcaggcccggcgctggccgacgacacgccgacgacggcgggcgcggtcgaccggctcaagggcctcgccaacgaggcggtcggcggcgccaagcgcggcgtcggcaacctgacggacgacgaggcgctgaaggccgaggggcgcgaccagaagctccggggccaggcccagcaggagcgcggcaaggccaaggacgccgtcgagaacgccctcgacaagtag

SEQ ID NO: 5375 - DNA, 861 bp, Methylobacterium sp.
atggaatggagtgacgtcagggtctttctcgctgtcgcgcgatccggcacgctcggcggcgccgcgcgttcccttcagacaagccatccgaccgtcggcaggcgtctgcgcgcgcttgagcaggcgatcggtcacacgctctttcagcggactgcggacggtctggtcctgaccgaagagggccacgggatcatcgcgctggcggagcagatggaggaaggcgcgctggccatggagcgccggctcgcggggcaggagcagaacctcaagggcagtctgcgcatctcatcggcggactggtttggggcgtatgtcctgcctcccatcctggcggatttctcaagggcctaccccaatgtcgacgttgaaatcctgaccggcacgcgcctgttcaacctcgcacagcgggaggcggacgtcgcttttcgtatcgtgccgttcaacactgccgatgtcgtacagcggcggctcttcaggctcgaatacggcgtctacatcgccgaggaggcgccagaccccggatacggcgatgggacgggtttccggctgatcacccatgagacatcgacgggtcacttcccggacatcgcgtggctcatcgagagttttcccaacgcaagaccggtcctgcgatcgaacaaccgcaacgtccaagggcgcatgtgcaagcaaggcgtcggcatcgcggtcttgccccgcgtcgtcggcactcagatccccggtatccgcaggctggaaacgccgacgcaaccgccagcccgagatatctggatgggataccaccgagatctgcggcgtcttcggcgtcttcgtgcgttcatttcgaccgtatcggaccatctcgtgaacgcgaccgtatga

SEQ ID NO: 5376 - DNA, 1467 bp, Methylobacterium sp.
atgagcgcgaccgagcagtcattcgagccacgtccgagcgaggagcagccagggagcgcggaggcgcgagccgcaacccggccggaacacttcgacgtgctgatcctcggcagtggccagggcggcaagctgctggcctggcatctggggcacgcggggcggcgggtcgccgtggtcgagcgccgctgggtcgggggctcgtgtcccaacatcgcctgcctgcccagcaagaacgagatctggagcgccaaggtcgcccacctcgtgcgcaacgccgcgcggttcgggaccatcaccggtccggtcacgaccgacatggaagcggtccgccaacgcaagcgcgcgatggtcgaaggtgaagtcgcgttccacctcaaggcctatggcgacgccggcgtcgacctagtcatgggcagcgggcgcttcgtcgcgccgaagacgctggaggtgcggctcaacgacggcggcacgcgcgtgctgacgggcgatcaggtgttcctcaacctgggaacgcacgcgaccatccccgccatacccgggctcgcggaggccgctccgctcacccacatcgagaccctggaactcgatgccgtgcctgcgcacctgatcgtgctgggcggcggctatatcgggctggaaatggcgcaggcgctcggccgcttcggcagccgtgtgaccatccttcagaccggccctcaactcctgagcaatgaggatgccgacgtcgccgacgagatgcagcagatcctcgctgccgaggacatcgaggtcattacgggcgccgagacgctgagcgtgacgggccgctccgggcaggctgtcagtctcgtcgtgcgcacaggcgaaggcgagcggacgatcgggggaagccacatcctcgtcgccgccgggcgtacgcctaatacgcaagggatcgggctggaggaggccggcgttgcgttgacggatcgaggcttcatccgcgtgaatgagcgcctggagaccagcgcgcccggagtatgggcgctcggcgaggcggcggggagcccgcagtttacccacgtctccgtcgacgacttccggatcatccgggacaatctcgccggcggtcggcgcagcacccaggaccgcctggtcccggccaacatgttcaccgagccgccgctcgcccgcgtcgggctgaacgagcgcgaggcgcagcgccagggcgtccccgtccgggtggcgcggctgccgatgagcgccgtgctgaggacgcagacgaccggcgagacgcagggtttcatgaaggccctggtcggtgaggatgaccgcatcctgggctttaccatgatcggctccgaggccggcgaggttgtggctgtggtgcagacggcgatgctggctggactgcctcaccagcggctgcgggatgccgtcctggcgcacccgaccatggcggaggggctcggttcgctcttcgcgggcgtgccgccccgctcctcgtag

SEQ ID NO: 5377 - DNA, 1383 bp, Methylobacterium sp.
atggacgaccactacgatgccctcgtgatcggcagcggcgagggcggcaagttcctggcgtggcacctcgccaaggccggccagagggtcgcggtgatcgagcgccgctggatcgggggctcctgccccaacaccaactgcctgccgagcaagaacgagatctggagcgccgagatcgcccaccgcgcccggcaggccgaccggtacggcatcgagaccggaccggtcgcggtggatatgggccgggtggtcgcgcgcaagcgggcgatggtccgcgacctcatcgacatgcacctcgaccgctaccgcgagagcggcgcggaactcgtcatgggaacggcccgcttcacgggccccagagcgctcacggtcgcgctgaacgcgggcggctcgcgcgcgctgacggccgagcagatcttcctgaatctcggcacccgcgcgaccatcccggacgtcccgggcctgcgcgaggccgggccgctcactcatatcgaggcactcgaactcgacgccgtgcccgcccacctcgtcgtcctcggcggcggctacgtgggcctcgaactggcccaggcctaccgccggttcggcagcgcggtgacggtgatcgagcacgggccccggatcgcgggccgcgaggatccggacgtggcgtccgccctcgcgcagctcctcgaggccgaggggttggcgatccgcaccggcacggaggtggtccgcgtgcgcggccgctcgggcgaggccgtggagatcacggtgcgcggcggcgctggtgaggcggtcatcgccgcgagccacatcctcgtcgcggcggggcgcgcgccgaacacagacggcatcggtctcgaccgcgcgggcgtggcgctcaccgagcggggcgtcatcgaggtcgacgaccacctccggacgagcgcgccgggcgtctgggccatcggcgagtgcgcgggcagcccggccttcacccacgcctccgcggacgatttccgcgtgatccgcgacacgctggcgggcatcccgcgctcgaccgcgggccggctgatgccgtcttgcctgttcaccgacccgccgctggcgcgggtcgggtcgaccgagacggaggcgcgggccgacggtcacgccgtccgggtggcgcggctgccgatggcggccgtgctgcgcacgcggacgaccgggcagaccgacggcttcatgaaggccgtcatcggcccggacgaccgcatcctcggattcacgatgctcggcgcggaggccggcgaggtcatggccgcggtccaggtcgccatgctcgccggcctgccctacacggcgttgcgcgacgcgatcctcgcccatccgactaccgcggaggggctgaacagcctgttcgcggccgtccccgcccgctga

SEQ ID NO: 5378 - DNA, 1290 bp, Methylobacterium sp.
gtggagcaggacagcggcgaggatgacgggcagcctgccgctcaggtgcggacgcccatctccagacctctcgacctcctgaacttcctgctgatcgatgtgaacggggcgatcaagccctacctcaacgtctacctctacgtgcatcgcggatgggacgacgcctcggtcgggcttgttggcaccgtgtcgggcatcgtcggcatcgtggcgcagacgcccatcgggacggccatcgacgcggtgcgggacaagcgcgtgatcctgctcggcgccctggtcgcgctctctcttgccacgctcctcgtcgcgctcttcccgcaattctggcccgtgctcgcagcctcctgcgtgctggccgccgttggaggcatgctgagcccggccatcgcgacgctcacgctcggcctattcccggccgacaagctcgcccagcgcttcggccgcaacgccgccctggagcggaccgggaacgtcgccatcgccgtgctgatcggactggtcggctggctgttcccggaccgggcggtctttctcctggtcccggcctgcgccatcgtctcggccgcggcgctctactccatcccgcggggtgccatcgatgcgcgccgggcccgcggcggcggtgaggacgacgcggagcaagccccggccgggtggcggaccctgctgacctgccggccgctcatgatcttcgcggcctgcgtggggcttttccatttcgccaacgcgccgctgctgaccctcgtcgcccaggagatcgggcaggcgcgccctgactggtcgtcggtcatcgtctccgtctgcatcgtcggagcacagacggtgatggtgccgatggggctcatcgtcggccgccgggccgagcgctggggccgcaagcccctcctcgtgatcggcttcgccgcgctgcccgcccgggccctgctctatctggtctggcgcgacccgtactggctgatcgcggtgcagtgcctcgacggcgtgggcgccgggctgctcagtgcggtgaagcccctggtgatagccgacatcacccgcgggaccggccgctacaacgccgcccacggcctgatcgggaccgtgcagggcgcgggcgcttccctgtcattcgtcatcgccggaaccttggtccaccatgtggggttcgatgcggcctatctcgcgtgcgccgccgtggcggcggtcgcgctgggggtgctcgtggtgctgctgccggagaccgcccccgggaagcctcgggtcggcctgccggcgcggctgcgggcgttgcgacccggcaaggcatga

SEQ ID NO: 5379 - DNA, 1608 bp, Methylobacterium sp.
gtgccggtgatcgaatccgctctagatccgcgcgcgcccgaggcccgcgccaatgccgaggccatgcgcgccctggtggcggacctgcgcgcgaccgccgaccgcgtccgcctcggcggcggggaggccgcgcgggagcgccatcgcgcccgcggcaagctcctgccccgggaccggatccgggcgctgatcgacccgttctcgcccttcctggaaatcggccaactcgccgggcacggcctctacggcggcgaggtcccctcggccgggatcgtcaccggcatcggccgcgtcgcggggcgcgagtgcgtgatcgtcgccaacgacgcgaccgtgaagggcggcacctacttcccgatgacggtgcagaagcacctccgggcgcaggagatcgcgcagcagaaccggctgccctgcctctacctcgtcgacagcggcggcgcgcatctgcccagccaggacgaggtcttcccgggccgggaccatttcggccgcatcttctacaaccaggcgacgatgtcggcgcagggcatcgcccagatcgccgtggtgatgggctcctgcaccgccggcggcgcctacgtgccggcgctgtgcgacgagtcgatcatcgtccgcggccagggcacgatcttcctcggcgggccgccgctggtgaaggccgcgaccggcgagatggtcagcgccgaggaactcgggggcgccgacgtgcacgcccggatctcgggcgtgaccgaccacatggcggagaccgacgcccacgccctcggcatcgcccgccgcatcgtggccaacctgaacgcggtgaagcgccccgcgctcgcgccgcggcagcccgagccgccgcgctacgccgccgaggagatctacgcggcggtgccggccgaccgccggacgccctacgacgtgcgcgaggtgatcgccaggctggtggacggcagcgacttcgacgagttcaagcacctctacggccagaccctggtctgcggcttcgcccatatctggggctacccggtggggatcgtcgccaacaacggcatcctgttctcggagagtgccctgaagggcgcccacttcgtcgagctctgcgcccagcgcggcgtgcccctggtgttcctccagaacatcaccggcttcatggtcggccggcgctacgaggccggcggcatcgccaaggacggggccaagatggtcaccgccgtcgcgaccgcggcggtgccgaaattcaccgtcctgatcggcggcagcttcggggccggcaattacggcatgtgcgggcgggcctacgggccgcgcttcctctggatgtggccgaacgcgaggatcggcgtgatgggcggcgagcaggccgcctcggtcctggccacggtccggcgcgacggtgtcgagggccgcggcggcacgtggtcggcggaggacgaggcggcgttcaaggcgccgatccgggcgcagtacgaggagcagggccacccctactattccagcgcccggctctgggacgacggggtgatcgacccggccgacacgcgccgcgtcctggcgctcggtctctcggcgagcctcaacgcgccgattcccgagacccgcttcggcctgttccggatgtag

SEQ ID NO: 5380 - DNA, 603 bp, Methylobacterium sp.
gtgggtcgcaccgccggatcgaacgggccgcgcacggccgccgccatccgccgggccgggcttcggctcatctatcgccacggctacgaggcgatgaccctgcgcgccctggccgccgaggtcgggatccaggcggcctcgctctacaaccacatccgcagcaagcaggatctgctgttcgacatcgtccgcgaccacatggagacgctgctggcgcggaccgacgcggcgctggcggcggcgaccggcaccccgacggaccgtctccgcgccttcgtggcgcaccacgtcacgtaccatctcgagaagaagcaggaagtcttcatcgcgaatttcgagctgcgctcgctcgacccgccgcattacgcggcgatcgtcgccctgcgccgggcctacgaagaccgattggtcgcgctgctcgagcggggatcggaggcgggggagctggacgtccgggatgcgcgggtcgccggctacgcgatcctcgggatgctcaccagcgcctgcacgtggtaccggcccgacggccggatgaccaaggcggcgatcgtcgccctgcacaccgacatggcgttgcggggttgcgtcaggcgtcagccatag

SEQ ID NO: 5381 - DNA, 114 bp, Methylobacterium sp.
gtgctgatcgaggagtttcggaaggccggcgagctgccggatgccgcggcgggctggcggatggagatccatgacgcgaacggcaccgtcctgcgcacgctgccgctctcctga

SEQ ID NO: 5382 - DNA, 405 bp, Methylobacterium sp.
atggcagacgccgtcgcgtcgcaacgcgctgtgctgattgtcgaggacgatcccgtgcagctcatggatgcggctgcagcccttcgcgacgtgggatacgcggtcgcggaagccgccactgtcgaagccgcccaggctcatctggcggcccgtcccgaacttgtggccatggtcgcggacgtggacttggcaggcgagcccttgagtggcttcaccctggccaaagccgtcgcggcgcgctggcccgaactggcgatcctgatcgtgtcgggtgtggcttggccggccgaggagcagatgccgatgggcgctcgctacctgcgcaaaccgttcacaccggaggggctggccggggcgctgggggctgtgctggcggcgcggggtgtagggtccgtgccacattga

SEQ ID NO: 5383 - DNA, 225 bp, Methylobacterium sp.
atgaccgcggaggaacggctggctgagctgaaggcggcggacacgcgccgtcagacacgtcgcagggaggctctgaagcagaagggcatgacccagcagaacgtgtggctgaagccgtcggtcaaagccgtcatcgaccaggcgatccagaacggtcggttcaagagccgtaccgaggcgatcgagtgggcgctcgcgtctgccttcgaggagaagtcggcatga

SEQ ID NO: 5384 - DNA, 1167 bp, Methylobacterium sp.
atgcacgaattcacggagctgcgcggccgcgaggcggccttcccggaggcggagttctccgcccggcaggcggcggcccgggccgccatcgcgggtgccggccacgacgccctcgtggtgaccggcccggagacgatctactggctgaccggccgccagacggcgggctatttcgccttccaggcgctcctcgtgcccgtggacggcgacccggccctcctggtccggcagctggaattgccgggcgcggccgccaacacgtggctcgacgacatccaggcctatccggacggcgccgacccggccgcggccctggcggccctcgtgcgcgggcgcggggtcgcccggccggccctggagcgggacggctggttcgtcgcgccggcgctcgcggcgcggatcgacgccgccctcggaagcggcccgctgcccgacggatcgggcctgctcgcgcccctgcgggcggtgaagtcggcggccgaattggcggcgatccgggccgccgcccggtacgcgcaggccgggctcgccgcggggctcgacgcctgcgcggcgggcaccgacgagaacgccgtcgccgccgccatgctggcggccgcgacggccgccgggtccgaggccgtggcgatggagccgctggtcgcgtcgggcccgcgcagcgggctgccgcacatgacgtggcggcggcgccggctcgagccgggcgacgcggtcttcctcgagctcgccggaagccacgcccgctaccacgcggcgctgatgcgcagcgtctggatcggtccgccgccggccgaggcgcagcggatgatggactgcgccctgcgcgccctcgacgcggcgctcggcgcgatccgccccggccatccctgcgccgccccgcacgcggcggcgcaggccgtgatcgacgcggcgggctacggcccggccttccgcaagcggatcggctactcgatgggcgtcgccttcgcgccggactggggggagggtgccctgctctcgctcttcaccggacaggaccggccgatcgagcccggcatggtcttccacctgccggccaccctgcgccgctacggtgcctggacggtcggcgcctcggagaccgtcatcgtcaccgcagacggggtcgagcccctgtccgacctgccgcgcaccctgtcggtgcggtaa

SEQ ID NO: 5385 - DNA, 342 bp, Methylobacterium sp.
atgggcgtcgatatcgcgcgcgtgaaggcgctcatcgcgacgttggaggcggtgacctccgccccccattttcacaggacggccttccggacgccgcgcaagaccttcgcgacgctggacgaggtgggccacgacatcaacctgatgttcgacccggacctgcgcgacttcttctgcgagcaggtgccggcggctttcagccccgttccgggcggctgggggcggatgggcgcgacgcggtgcgacctcgcgatcgtcgacgaggcgaccctgatgtcggccctgacggcggcccaccggctcgccgcgccgaagccgcgcgcgcggcgcggcggcgcctga

SEQ ID NO: 5386 - DNA, 471 bp, Methylobacterium sp.
gtggacaggatgatgctgtcgcgtaggggcgtgtccggactggccgcgctggtggctgggctcgtggcgagcagggcctcagcggacccggcggctggccccaaaacgcatcgggtcgcgatgcaggtcagttccaacgagggtggcgtgttcgacctcgccctcaacaatgccgtgaatctcgctcgcgagtacagcgatcaggccgaagagcttgaggtcgagatcgttgcctacgggccgggtctgcacatgctgcgggccgacacatcacccgtgaggttgaggatccactccatcacggagagcgtgcccggaatcgtactttcggcctgcggcaatacagtcaaagccatggagaaggctgaggggcatacggtggaattgctgcctcatgtcggcgtggtgacggcaggagcggtccgtctcgtcgcgctgcaggaggcgggatggagctatctccgagtatga

SEQ ID NO: 5387 - DNA, 1680 bp, Methylobacterium sp.
atgacctcacgccgcgacttcctgcagatcgctgccgccaccgcggcgttggtgccatcgggctggacccgcgccttcgcccagcagcgcctgacccaggacgacctcctggccttcgagccgatgggcaacgtcaccctggtccacctgaccgacatccacgcgcagttgcggcccgtgctgttccgcgagccctcgaccaatctcggggtgggcgccgcgcgcggtcaggtcccccatgtcaccggacgcgcctatctggacctctacggcatccccggcgcctctcagctggcctatgcgctcacgccggaggactacgtcgcgctggcccgcagctatggccggatgggcggcctcgaccggatcgccacggtactcgacgcgatccgcgccgagcgcggcgacaaggtgctgttcctggacggcggcgatacctggcagaacagctacacctcgatggtgagcaggggccaggacatggtcgactgcatggcgctgctgaagcccgacgccatgaccgggcactgggagttcaccctcggtaccgagcgggtcaaggagatcgtggacgggctcggctgcccgttcctgggccagaacgtccgcgacgccgaatggaacgagccggccttcgaggccacgaagatgttcgagcgcggcggcgcgaaggtcgcggtgatcgggcaggccttcccctacacgcccatcgccaaccctcgctggatgatccccggctggtccttcggcatccgcgaggaggacgtgcaggcgagcgtcgacaaggcccggaaggacggcgccgacctcgtcgtgctgctctcccacaacggcttcgacgtggaccgcaagctcgcctcgcgggtgaagggaatcgacgtcgtcctcaccggccacacgcacgacgcgctgcctcaggcggtgaaggtcggcaacaccctgctcatcgcatcgggcagccacggcaagttcctcacccgcgtcgacctcgacgtgcgggacggcgccgtgaagggctaccgctcgaagctcatcccgatcttctccgacgtgatcgcccctcagaaggcgatggcggacaagatcctggcgatccgcgcgccccacgaggcgatgctgaaggaggagctcggccggaccgaggccctgctctaccggcggggcaacttcaacggcacgctcgacgacatgatctgcgatgcgctcctgtccgagcgcgaggccgagatcgccctctcgcccggcttccgctggggcacgacgctcctgcccggccagccgatcacccgcgaggacgtctacaacgccaccgccatcacctacccggcggcttatcggatgcccatgaccggcgcccggctgaaggaggtgctggaggacgtggccgacaacctcttcaacgccgatccctactaccagcagggtggcgacatggtgcgggtgggcggcgtgtcctacgccatcgacgtcgctcgcccggccggcagccgcatctccgacctcaccctcctgcgcaccggcaaacccatcgaggcgggcaccagctacaccgtggcgggatgggcgagcgtcaacgagggcaccgaggggccgccgatctgggacgtcgtcgcctcgcacatcaaggccaagggcacggtgaacccgacgcccgcgcaggtcaccgtccgcggcgcctag

SEQ ID NO: 5388 - DNA, 576 bp, Methylobacterium sp.
atgtcgacccggcgccggttcctggcgggtgccctcgcgctcggcctgcccgccaaggccatggcccaggcgatccagggtgatgacggcctctaccgggagccctggttcctcgaaagcttcctcgaccttccggacgatctgaaggcggcgcgcgagcacggcaaacgtctggccgtcctctgggaactcaagggctgccccttctgcaagcagatccacctcgtgaacttcgcggatccggcgacgagcgccttcatccgggagcgcttcgagatcctgcaactgaacttcatcggttcgcgggaagtgaccgatttcgacggtcagatcctctccgagaaggctttcgcggagaagtacggcgttcgctccacgcccagcattcagttctttccgtcggaggatgaggcgctcgggggcaagccgcctctgcagcgcgaggttctgcggctgcgggggtatgcgccacctgaggagttccggcgaaccttcgccttcgtcgccgaacgggcctacgagcggacgaacctgcaggactacctgcgctccccgaaggcagcgcagcggggctga

SEQ ID NO: 5389 - DNA, 342 bp, Methylobacterium sp.
atggcgggggcgtgggggctcgccctgtggcccggctccgtcgaggccgccgaactgatcaagttcgagcggcgcggctgcccgtggtgcaaggcctgggacaaggagatcgggtcgatctacccgaagacggatgtcgggaagcgggcccctttgcgccgtgtcgatctcgacgcaggcatcccgcccggactcacgctcaagcgcccgatccgctacacaccgacattcgtcctcgtcgaagacgggtccgagctcgaccggatcgagggctatccgggtgaggacttcttctgggggcgggccgagcggttgctcgaacggctgcccgcttccccgtga

SEQ ID NO: 5390 - DNA, 1044 bp, Methylobacterium sp.
atgtccgacatcctgcctgcatatctcctccgggcggcgctcgggctcgttcttggagcgctgctcggcacggtcgcacggcggggtcgcttctgcacgctcggcgccattgaggatgcggtctacgcgcacgacacccgtcgcgcgcgggcgtggctgctggcaaccggtatcgccatcctcggcacccagcttctggaaaccggtggtggtctcgatctcgcccggtcgatctacacggggccgcgcctggaatggggcgcgatgatcctcggcggggcgatgttcggttttgggatggcactcgtagggacatgtagcttcggagcgctcatccggcttggcgggggagatctacgcgcgctcctcgtcctgctcgtgctcggcctctcagcctacatggcgatcagcggcgtcacggcgctcctgcgcgtgacgatgaccgagccgctgagcatcgacatcggaagccagcgcctcggggagctcctgcgcctggatcagacaggccgaattgtcgtgggcgtcgtcgcggccgccgggctttgtatcgcggcgctcgcgagccgcgccttccgggagacgaagcggcttctgttcggcgccatcgtcgtcggatgcgtggtcgtcgccggatggtggaccaacggaatcgcgggcttcgacgagttcgagacccgggcggtcggctccttcagcttcgctcggccggtcggtgatacgttgctctacgtcatgctcgcgagcggcacgaagatcgacttcggcgtggcctcggtcttcggtgtcctccttggatccttcgcgtcggcgcgccacgcgggcgaattccattgggaggcgcccgatgatgcccgggaggtgaagcgccaccttttcggggcgttcctgatgggcacgggcggcgtcacggcgctgggctgcacaatcggtcagggattgagcggtctctcgacgctgtcggtcggatcgatgctcgccctcggcgcgatcctcgtcggggctcgcgcgggtctctactacctcgtggaccggcacgcgtga

SEQ ID NO: 5391 - DNA, 333 bp, Methylobacterium sp.
gtgaccggcctgtcgctccacgccgtcgacgccgccacgggccggccggccgaggggatgcgcgtgcgcgtcctgcgcgccgggggaaagcggcgggtgatcgccgagggccgcctcggggcggacgggaccctcgaccatccggtcgtgcggacgcggctcgccgccggcctctacgaggtcgtcttcgtcatcggggacttcgtcggagccgcgggcgaggggttcctggaggaggccgcgatccgcttccggctcgacgaccccgaccgccactgccacctgccgctgaagttcaccgccttcggggtggcgctgttccgcggctgctga

SEQ ID NO: 5392 - DNA, 1251 bp, Methylobacterium sp.
atgagcaacggtctgacgccgacggccgaccggatcgtcgtggccagcgaggccgactggaacgacgcctggtacctcgtctgcatgaaggtctcgacgatcggcttcgtcgtcgtcgatgcccgcgagcgggtcgccaccctcgacgcgctgcgggcggccggaatcaccgacatcgccgcccacctcgacgcgcatccggacgtggccgaccgcctgcggcacgggatggtcatcctcgacgtcaacgaggcggcggtgcggatgttcggcgcgggcggccgcgcggacatgatcgggcagcgcacgcagcgcttcttcgacccgctctgcaccgcccaggtcaattccgcccgggccttcgcggcgggcgcaacctcgttccagcagcaggcgcacagcgtccggctcgacggatcgcgcttcgagacgctgttctgcgtggtcccgcgggcggacggcgccacctccggcctgtggctcgcctccttcgtggacatcaccgagcacgtcgcgcggcagatgtcgctggaggtgctgcgcgacgaactcgcccacgtctcccggatctcgacgctgggcgagctgtcggcgtcgatcgcgcacgagctcgggcagcccctgtcgtcgatcggcatgaccgccggggcgatgctgcgcctgctcgatcgcgcggatctcgaccgcgacctgctccggcggcaatgccagcgcattgtcgatcaggtcacgcgggccggggacatcatcgatcgcacccgccgcatggccgccaagcgggacagcgtccgcgcgcccgtctccgtggcggaggtcctggccgaggccgcgcggttcgtggcgcacgacctgaaccgcacagagatcaggctcaccgtcgccccggcggacgcggccgcgcaggtcgtcgcggaccggatccagctgcagcaggtcttcgtcaacctgctgatgaacgccatccagatccatcggcaggcgcggacccccgggcccgagatcgcggtggagaccgtctgccgggacgggtcgatcacggtcgacgtcatcgataacgggcccggcctcgatcccggcaccctcgaccggctgttcgacggcttcttcacgacgcgggccgaggggctcggcctcggtctccggatctgccggaccatcgtggcggcccatggcggctcgatcgacgcgagcccccgcgacggggcgccgggcgcccgcttctcggtttgcctgccgctcgcccggtcctga

SEQ ID NO: 5393 - DNA, 399 bp, Methylobacterium sp.
atgtcgaagcgcgatgcagtctttccgcccggacggcaagccctctacgacaagcaccgctactcggccgcgatccggtccggcgacctgcttttcgtctccggccaagtcggcagccgcgaggatggctcgcctgaaccggatttcggtgcgcaggttcgccgtgccttcgacaggctgaactccgttctcgcggcggccggctgcagtttcgacgacgtggtggacgtgacaaccttccacaccgaccctgaaacgcagttcgacacagtgatggcggtacgcgacgtaatgatcggcgaaccgccctatccgaactggactgccgtcggcgtgacctggctcgcgggcttcgacttcgagatcaaggtcatcgcccgtcttccgaccccggtctga

SEQ ID NO: 5394 - DNA, 666 bp, Methylobacterium sp.
atgcacgagctcggccccgacttcgtcggcccggcggcggagcctcggccttccgaaccctgcggtcccgagatcgccgcatccgactggccgagcgtgcggcagtggcggaaggagacccgcgccgcgctcatcgcgcggcggctcggcatgtccgcccaggaccgcgccgcccggagcgagcggatcgggcagggtctccgagccgctctaccttcgccatcgggcctatcgatcggtctctactggcccttcaggggcgagttcgatcccagatcactcctgacggagctgcgcgggagcggggcgcgactggcgcttccggtcgtcgtcgagaaggcgcgcccgctccggttccgggtctggtcgccgggcgatcgcatgatccgcggcgtctggaacatacccgttcccgcagagggcgagactgtcgacccggacgtcctgatcgcgccgctcgtcggcttcgatcaggccgggtaccgcctgggatacggcggcggcttctatgaccggaccatcgcgtccatgtcgaccaagccgcgggtcatcggcgtcggcttcgagcttgcgcggctcgcgacgatccacccgcaggcgcacgacgtccccatggacatcatcgtgacggaaggcggcgtctggccccgcacggagcgatcctga

SEQ ID NO: 5395 - DNA, 1218 bp, Methylobacterium sp.
ttggtcgcgaacatcgcggccaatgtcctgacgcgggggactctgatcggccccttcctgtacagtctcgccaacctcgccgaggtgatgttggccgtccgtctcctgcggaggacctacgagcacgacgccctgctgcaatccacgagatccgccctgcggttcctcgcgatcgcgggattgctggcaccggccgcgagcggcgtcctgggaggtttgacggcgcatctcgtcttcggcgaacccctgttgcgatcgttcggcacctgggtcgcgagcgacggcctgggactcatcgtcttcacgcccttcctgctctcgctgttccgaggcgattacgcgaacgcgctcgcggagcggagctggcgggaccggctcgaagcggccgccttgctcgtcctcgcaggctcggtcgcgtacgcgaccttcttctgcacgagccgccccttgctgttcctgatcttcccgcccctcatcctgatcgctttccggctgggccgcctgggtgtcaccgcggccgcgatggtcgtggccgtcatcggaggcgtcgcaacgatgtacggtcgcgggccgatggtcctgatcgcggccgacgccgtcacgcaggcgcaggcgttccaggtgtttctggccttcatcctgctgacctgcctgcccgtcgcggcggaggtctccgcgcgggcgcggctcacggccgagctggccgcgcacgatcgagagatgacgaggagcgccttcaccgattccctgacagggctgctcaaccgggcgggtttcgagcatcagatcgagaccatcctgcccatcagggctctgccgcccgtcagcctgatcgcgatcgacgtagatcatttcaagcagatcaacgaccgctgggggcatccggcgggcgatcgcgcgctcgagactctcggatcactgctcgcgtcgcagatccgcccgggggatctggtcgcgcgcctcggcggcgacgagttcgtgatccttctacgcgagagcgatctcgagcgcgcgcgggcggtgtgcgagcggatccgcgcgagcgcacgcgccgcggcgttctcgaccagtgccgggtccgaggcgccggtcagcctgagcatgggcctggccgtcgcgcgcgtgggcgagcgctacgaagcgctggctcagcgggccgacagcgctctgtacgaggcgaagcacgccggtcgcaacgccctccgatgggccgcctga

SEQ ID NO: 5396 - DNA, 888 bp, Methylobacterium sp.
atgacgatcgttccccatcccgccgcccagcgcggcggccgacagcggttggccgcgcgtaggcagcctggatccgcgaccaccagccggatcaccgtcccgctcggcagcgccgcggccctgggctgcggccacgtccagcccgcaattcagcagatctgcgcacccgaactgatggctgcagcccaggccgcgctcgacggcgcgttccgggcgaccttcgtgcccgatcccctgctcggaccaggcttgtctcaactcggatccgtgctggcctccatggtcaaacggcacgggtccctcatcgaggcggccatcacggacgtcctggagcgaagcgggcgctacgtcgtgctccgcaacgtcgcgatgccgatcaccgttccgacccaggaactcgtccgcgccagcagcgtcgcccagctcaaccagacctcgatcgaactcacgggcgcggtcgcgcagtcggtatttctcgacctgatcgtcgtcgaccggaaagagagccgagccatcatcgcggaggtcaaaagaggctccggaaaaaatgaggccaggaaaattcaccaagtcgaatgggtactgcggtgcgcgcaggtccagggccgctcgtttctggcttcactcggctatgaggtcgcgcaaatccgcgcggtgctgatcgacgtctatggacgggccgggtacggtgatgacattacggtgagcggaccggccatagatcagctgttcgcgaccccggtcttggcagcgctcgagactgtgacggcggcgcttcaagcccgattgcacgcggctgtgccggaccttctgacgatggcgttggcgagcctcgccgttcctgagaacgtcaaacacccgcactcgcccgggccgctcgcgccctga

SEQ ID NO: 5397 - DNA, 315 bp, Methylobacterium sp.
atggcgcgcgacggcaaccgaccccacccgagcgccctggcgcgatatccggttccgatcgagctgatctcggccctgttccgcgccgacgacgcggagcgcgaccggctgctcgcgccgatgccggcctacggccgcgcccggatcgccgcctactgcgccgagcacgcgcggctcgaggcgctcggcctgaaggtcgcgcgctcctgcgacgaggccacgctggtcagggctgcgggcgaaacggtcggcgccgacctcttcgcgcgctcgcgggcgcccgcaccgtcgccgatccagctccaggccgcctga

SEQ ID NO: 5398 - DNA, 276 bp, Methylobacterium sp.
atgcgcgccagcaagcctgtcactgtcaccctcggcgacttgcaggaccgcgtcgaagcgcgcgtgaagtccggcagctacgccagcgtgagcgaagtcgtcagagctggattgcgggccctcgatcgcgaggaggcagccctggatgccgtcctccggcagcgggttcaggaggcgctcgacgatccgcgcccgccgatcccggcggatcaggtcttcaccgcgttgcaggcccatcacgccgcgcggatgaaggcggccaagcgtggcgcgtag

SEQ ID NO: 5399 - DNA, 444 bp, Methylobacterium sp.
atgcccgcttccgccagcctagaagaacgcccgccgctggtcatcccgacgaccgacctgctttcgctgcgggagatcgtgaccgcgacccacccgtcggatccccgagccgcggtagcggcatggctggcggaggagctcgaccgcgccgcggtggtcgcgcctgaggcctttccgccgcgcgtgatcaccatgcatgcggaggtctcgtaccgggacgacgtcacggaccaggtcgggcgcatgaagctcgtctaccctggcgaggaggatgcggagggacatgccatctcggtcttgtcaccggttggtgcagccctcgtcggtttgtccgagggacagtcgatccgctggcgaacaccgtccggcgggttccgcggcctgaccgtcctccgcgtgctgttccagccgtacggcggggccggtgccagcgatggcccgtag

SEQ ID NO: 5400 - DNA, 231 bp, Methylobacterium sp.
atgtcacgctacttcatcagcacggacgaccatgttgaggtgatggacgaagagggggtcgaggtgccgtgccgtgacgctctgcgagacctgcttcggcagacgctcacagcgatcctccgcgacgagggcgagatgacgggcgtcgatgagtttacggccaaggccttcgacgagcgcggtcgtctcgtcatgcaggcgcgggctaccttctcggtcaccgaccaatag

SEQ ID NO: 5401 - DNA, 231 bp, Methylobacterium sp.
atgccgcgctacttcatcgacaccgccgaccacgtcgccgtccgggacgacgagggcacggttctcccggaccgggccgccctgcgggacctgctgcgccggaccctgacggcgctcctgcacgacgagggcgaggagaccggggtgaacgacttcaccgcccgcgcctacgacgaggacggtcgcctcgtgatgcgggcccgggccaacttccacgtcgtggacccgtag

SEQ ID NO: 5402 - DNA, 852 bp, Methylobacterium sp.
gtggctgatcgcccgatcctcctgcgcgaggccgaggtccgcgcgtttctcaccggccggcggacgcagctccgccagcccctcgacccgcagccgcagttcttcgatgtaccgatcctggaggggcgcggcgtcggccgcgtcggccatccgggcgagctgtggccgttccggtgcatcagcacggcggtcgagcgcgacttccagtgctgggcccggcgggctgtgccgcacctcgccgtcggcgatcgcctgtgggggcaagagccctggcaggttgcccacgagacgctcgattacgagaccggcggcgaatacgacgtgttcgagtggcgggaggacgagtacggcgacccgcgcccgttcctgggcggagatgcccgcttcggcacaagggcggggctgttctacagcgccgatggtcaggacgagaacccgtcgaacttctacccgctgatcggcatccgcggcgacgtgctgcggcccgccgagatcaactggatgccggccgaggacatgccgcgctgggccagccgctgcacgctcctggtcacggccgttcgcgtcgagcgcctgcacgacatcagccgcgatgacgcgatggccgaggggatcgtccagacctggggcgacttccgcggccacccgccggagtgggcgcttcgcgagggcgaggacgcgtcgcacttctacgacaaccggacctcggtcgagaacttccgcttgttctgggaccacgtccacggccctgacgcttgggcggccaacccctgggtcgcggccgccacgatcgccctacagcccggcaacatcgatagcccggcacaagccgcggaggccgcccatgcctga

SEQ ID NO: 5403 - DNA, 1272 bp, Methylobacterium sp.
atgggagagctgtgcgtgccggatcactccgccaagactcactccgccgagacgaacagggacgggccgctcgcgggcgtgcgggtggtcgacctgaccagcgtgatcatggggccctcggcgacgcatatcctggcggatctcggggccgacgtgatcaagatcgagacgccggagggcgattccttccggcactaccggccggcccgcggcgccgggatgggcggcaacttcctgcacctcaaccgcaacaagcgcagcgtccgcctcgacctgaagcggccggcggcgcgggccgccctcgaccggctgatcgccaccgccgacgtgttcgtccactcgatgcggcccgacgcgatcctgcgcctgggctacggctacgcgcgggtgcgcacgctcaagtccgacatcgtctactgcggcgcctacgggttcggggccgacggcccctacgcccacaaggcggcctacgacgacctgatccaggcgggctccggtctcgcggccctgcagacagccgtcaccggccagcccggctacctgcccacggtgctgtgcgacaagatcgccggtcaggccatcgcctgcgcgatcctcgccgccctctacgagcgccgggccggcggcggcgggcaggcggtcgaggtgccgatgttcgagaccatggtggagttcaacttcgtcgagcacatggtcggctacgccttcgagccgccgctcggcccgccgggcttcaaccgggtcctgagcccgcggcgcaagccctaccggacccgggacggccacgcctgcatcctgccctactcggaccggaactggcgcgacttcttcatccataccggccggctcgaattcttggacgatccgcgcttcgcgccgctcgccgtgcgggtggagaacatcgagatcctctacgcgctggtggaggaggaggcgccgcgccggaccaccgccgagtgggtggcgttctgcgactcggtgagcatcccgtgcatgccggtcctcggcctggagaacctgccggaggacgcgcacctgaaggcggtgggcttcttcggcagcgccgagcacccgagcgaggggcgctaccgcacgatgcgccggccggtctcgttcagcggcagccgcttcgcgatccgccgccacgcccccaggcacggcgagcacaccgccgaggtcctggccgaggccggcctcgacccggccgagatcgccgccctgatcgacgcaccggacaagccagacaccgcgcccctggaggccgcccgatga

SEQ ID NO: 5404 - DNA, 288 bp, Methylobacterium sp.
atgatcagacgatgtctgctgctcctggtctcggcgctctcgctgccgctgcagaccggcgtggcgctggccgagagcgaaatgccggcagggggcgccttcatgagcagttacacttcggatccctacttcgacccgcggtcgcggtactcgcaggctcactctaccggagacatccgcggacagccgatgctggccgaaccgggcgacgcccagccgccctgcgagctcttcgacacggcctgcgcggccgccttcgagcgctcacgcccccacgcgtatcgctag

SEQ ID NO: 5405 - DNA, 339 bp, Methylobacterium sp.
atggccgcccgccctcgcttcgccagcaccgcgcaggccatgcgcgcctcggccgccatccgccgcgccgtcccaacggcagggggagccgctcggctcgcccatcacctcggcctgcacgccgtctcggtcgcccagtggacgttctgcccgacgcagcacgtcgaggcagtcgaggccgcctcgggtgtgtcccggcacgacctgcgcccggacctctacccgcgcgccggcaagggccgtgacctgacgcccgaccaggccgtcgccgcgcatctcgcggccggcgatcacttcgcccgcaccggccggtgcctctcttcggaggcgcacacatga

SEQ ID NO: 5406 - DNA, 1077 bp, Methylobacterium sp.
gtgcgcgctcccgctgtcgtcggcctcgtcctgctgctgatggccggtccgggcccggcctcggcacaggtcgaaccgtctccggcggccgaggggaccgggtctgccgcggcccgcggcgagaccgtcgtggtcgtgcgggcgacgaccgacgaggccgaggtcgccgacctcctcgcgggcttccgcgaggcccatcccggcgtggcggtctcctacaccaagatgaactccgcgaccctgtacgacggcttcgtggaggaggccgcggccggcacggtcaaggcggacatcgtgtggagttccgccatggatcgccagatcaagctggtgaacgacggctacgccgcccactacgcgtcccccgaggcttcctccctgccggcctgggccgtgtggcgcaacgaggccttcggcgtcacggccgagccgatcgccgtcgcctacaacaggacgctcctcccgccggagcaggttccccagacccgcgccgacctgatccgagccctcaccgaccaccccgagacgtggaaggggaaggtcgccgcctacgatccggagcggagcggtgtcgggtcgctcatcctcgcgcaggacgcggacgtgacgtcccggacgtgggacctcgtctccgccctcgggcaggccggcgtgaagctctacacccggacggagaccatgctcgaccgcatcgccgcgggcgaggccatcctcgcctacggcgtgttcggcgcctacgccctcgaacgggcccggcacgatccggcgatcggcctcgtgctgcccacggactatacgctcctcgtctcgcggatcgccttcatcgcgaaggacgcgccgcatcccgccgccgcccgcatgttcctcgactacatgctctcccgcgaggggcaggcgcggctcgccgcccggtcgctgacgccggcccggacggatgcccgccgggccgacgacccggtcgcgtccgccccggccctgcggccggtcccggtcgggccggagctgctggccaacctcgaccagatccggcacgcccgcatgctgcggcgctggcggcgcgccatggaaggccgctga

SEQ ID NO: 5407 - DNA, 1401 bp, Methylobacterium sp.
gtgacccggccgcgcgcgccctcgatccggcggcgcctgctcgtccgcatgctgctcccggccctggcgctcgcgctgctcctgggcttcgccggagcgctcgtgatccggaacgtcgtggagaccacccacgatcgcctgctcgacgggtccgtcctggcgatcgccgagcggctgaccgtggaggacggcgaggtgtcggtcgacctgccccgcgtcgccctcgggatgctggagagccaggcgcaggaccggatctactacagcgtcacctacggcggggcgctggtgaccggctatcgcgacctcccaggcctggacgtcgatacgctcccgctcggggtgacgacccatcgcgacggcatcgtccgcggggcggccgtgcggatcgccgcccaggcccggcgggtctacgggaagcccaacccggtcctcgtgcaggtcgccgagacgcgcgaggcccgtcagggcctggagcgacgcctgctcgccgggctcgcgctggccgagctggggctgatggggctgatcggggcgctgtcgtggtacagcatcgacagcagcctgaggccgctgacccggctgagcgacgcgatcgaccggcgggcggtcccgggcgcgatcaacctgcagccgctcgacgtggccggggtgccccgcgaggcgctggccccggtgctcgccctcaacacgctgctcgagcgcctggagcagtcgatcgcgggggagcgcaccttcacgtcggacgcctcgcaccagctgcggacgccgctcgccgtgctcaggatgcacgtggaactgctccgcaggctcacgcccggcgaaccggcccacgccgcggcgatcgacgatatcgacggagccgcgcggcgcctggaacgcctgctcgcgcaactgatcgcgctcgcccgcgccgatgcgggcgcggccggcacggacgcccccgcggcgatcaccgacctgaacgacatcgcggcccgcgtggtcacggagcaggtgccccacgccctcgcgcgcgggggcgagatcgcgctcgatcgccccgacggcgcggtgccggtcgtcggcgatccgttcatcgtcggcgagatcctcaccaatctcgtggacaacgcgatccgctacaaccgtcccgaaggcaccaccgtcgtccgtgtccggcgcacggagatcggagcctgcgtggacgtcgaggacgagggcccgggcataccgccggaggtgcgcgagaaggtcttcgagcggttctaccgtgtcgcgacgagagacggtcctgacggcagcggcctcgggctcgcgatcgttcgagccctcgcggaccggatcggcggagcggtcacgctcggttcccggcccgggggatcgggactggtcgcgcgggcgagcttccgtgtgccgtag

SEQ ID NO: 5408 - DNA, 1008 bp, Methylobacterium sp.
atgcggcgatcgatcctgttcctggcggcctgtctgctggccggcatcacgccggcggcctccgccgggcccgcagcggacggcgtcgccgatctcggcagctacgccgcccgcgtggaggttcacccgttcgagagcctgacgctgaccgaccggcagttcctcaccggcacgtccgagggagcgaagccgatcacggtcgcggggatcctgcgcgtcgccaaggcggggaccgagcgcctgccgaccgtgatcctgatgcacggctccgggggcctgggcggcaacatcgagttctggcagcgggcgctggcggcgcgcgggatctcgaccttcgccatcgacggcttcaccgggcgcggcctgaccagcgtcaacaccgaccagagcctcctggcgcgcacgaacctgatcctcgacatctaccgggcgttgggcgtgctggcgaagcatccgcgggtcgacccggcgcggatcgccgtgatgggcttctcgcgcggggggcaggcggcgctctatgccagcctcaagcgcttcgacgccgcctggaaccgctccggcgtgatccccgccctctacctgccggtctacccggactgctcgatccgcttccgggacgacacggccgtggcggatcggccgatccggatcttcggtggcgggggcgacgactacaatcccgccgccacctgcgcggcctacgcggagcggctgagggcggccggcgccgatgtcgacctgaccgtctttcccggagcgcagcacgtcttcgacaacccggccgggccgacccagcccgtggtcgcccggggcgcgcagaccgtccgcgcctgcgcgatcagcgaggcggcggacggcgccctcgtggcgggcccggacgccacgccgttcacctacgcggacccgtgcgtgcagcgcgacccgcatatcggctccgacgccgccgcccgcgccgggatactggcgcgtgtctcgcacgcgctggacgtcgcgttccggggacggtga

SEQ ID NO: 5409 - DNA, 2538 bp, Methylobacterium sp.
ttggcgcgcgagctgtccggcggcggcctgagggtcgtgctgctggagagcggcggcctcgaccggatggagagcgcggacgcgctggacgccatcgtgaatgtcgggcggccgcgcgcgacccagtgggccgtccggaaccggatcgtgggtggtagctcgcacacgtggggcggccggtgcgcgcctttcgacaccatcgacttcgagcagcgtgcctgggtcccggagagcgggtggccgttccagcgcgacgcactcgatccttatctcgagcggacggccaagtatctcgggctcgcctacggcaaccatttcagcgacgcgcgcttctgggagctgttcggttcgcagccggcctggtccgagccggatcctcggatgctcctgcccttcttctggcagttcagccgcgacgacgcggaatcctatccgttcgagtacacgcgcttcgggcggaaactggacgagaagttgggcccgaacgtcacgttgatcagcggcgcgaccgtcgtcgcgatcgacgtgaacgggacgggcgacagggtacagggcgtccaagtcgcggcgcccgacggcgccatcgtcaagctgccggcccgccatgtcgtcctgtgtgccggcgggatcgagaatgcgcggctcctcctcgcctccgatcatcaggtcccgggcggcctcgggaacaggttcgaccgcgtgggtcgctacctgatggatcatctgcgcgggccggtcgcgcatttcgaccctcaccggtcgcgcgcgctgcagcggcggttcggccgctacaccatcgaggatcggctgttccggggcgggctccgcctgagccccgacgtccagcgaagccgtcagctcctgaactgcgcggtctggctcggagagacgctcgcccccgacgacccgggcgacgcgatccggaggattctggtcggcaagccgcgggcgaaggacatcctgacgctgacgtcgaacctgccgctgctcctgcgcggctgccgggaccatttcatcgcgcgcaacggctttccgcggaagctgtccgagctgagcctcgaatgcatggtcgagcagcggccggatcccgagagccgggtcatgctctccgatcggcgggatcacctgggcagccggctgcccctgatcgactggcgcagtcacgaagatgaaggccgcacgatgcgcgagacggcgcggctcgtcgtctccgagttcgcccgcctgggcctgcccgtgcccgagctggcagactgggtgcgcgaagaggcgccgatcccgctcagcttcgtcgatgtcgcccacccgaccggcaccacccgcatggccgacgatgccaccaggggcgtcgtcgatgcgcgaggccaggttcacgggatcgacggcctgttcgtcacgggaagttcggtgttcccgacgggaggccactgcaatcccacgcagatgatcgtcgccctggcgatccgcctcgccgacctgctgaaggtccgggagcagcgcgacaccgtggtctccgacctccgaacgtctccgcccgtccccgccgatctccgcgtcctcgtgacgggggcgacggggcggatcggccgcatcctggtggaggacctgcaggaacgcggctacgcggtcagggccgtcacgtcccagcccctgaccgaggcgcagccgcgcacgggtcggatcgagtggcggaccttcgacttcacggcggatcaggattacgccggcctcgtccacggctgcgcggccgtcatgcatctcgccgccgagctcgggaagcaggaccggatgcaggccatcaatgtcgaggcgacgcggcgcctggccgaagccgccgagcgggacggcgtccgggccttctgctacatgagcaccgtctccgtctatggcagcggccgcgcgcgcaccatgacggagacggccccggttctcaccagcagcgtcgacgtcaaatccgagtactgggccctcgactacgttcgcgcctacggtcgaacgaagctcgccggcgaagaggccatcaggcgggtcgcctcgacccttccctacgtgatcctgcgccccacggtggtcgtcgacctccataatctcatcggcttgcgcgactggagcctctcgaagcgcctcttcgcggcgcaccggccctcccatcacgtctacgtccgggacgtcacggacgcggcgatctggacgatgacgcggtccctgtccggggcttggccggcgggcgaggtccaggtcttcaatctctccgatcacgaggcgcgcgatgcgcggatcggcgacttcatgcggcgggcgttcgcgatcagccgcgatccccgcttccgggtcatcccgatgccggccgtcgtcgactggctccacgatttcctgcgcaaccggacgctgcccttgcgcaatcctctctggaggatgcggttccccaacgatcgtctgcggcaggccgggtatcgacaccgctacggaatggccagagcccgcgccatggcgctggacatcctgcgagcggaaacacgggagcgaacacgggcctga

SEQ ID NO: 5410 - DNA, 975 bp, Methylobacterium sp.
atgccgggcacgaaccgtcgcgatctggtgcgggccgcgctcgccggaggggccgtcctgggtctcggcggccgcgcccgcgccaccgcacccttcggcggagcgcaggcgccgggcttctaccggacgcgtgtcggcagctgcgaggtcacgatcctcaacgacggggcgcgcagcttcccgatgccggaccgcttcgtgcgcaacgttccccgggacgaggcgctcggcgccgcgcgggcggcctacatgccccccggccaggtgacggtgccgttcaacccgacgctgatcaacacgggcgcgaagctcgtcttgatcgataccggcaacggcccggtcccgggcgcgcccgtcggccgcctcgcggcgaacctcgcggcggccgggatcaggcccgaggacatcgacctcgtcctgctctcgcacctccatcccgaccacacgaacggcctcaagcgggcggacggctccctagccttcccgaacgccgagatccgggccgccgcgcccgactgggcgttctggatgagcgacgccaacatggcccgcgccgccgacccggtgacgcagggctacttcgccaacacccgccgggtgctcggcgacctgaaggaccggatcggcaccttcgcgtgggacgaggagatcgtgcccgggatcaccgccctcgccgcccccggacacacgccgggccacacggccttcgcggtcgcctcgggcgcggaccgtctgctggttcagtccgacgtgaccaacatcccggccttcttcctgcagcacccggactggcacgtgatgtacgatcacgacgccgatcaggcgcaggcgacgcgccaccgcttctacgacatggccgcgtccgagagggccctcgtggtcggttaccacttccccttcccttcgctcggccacgtggaacgggacggaccgggctaccggctcgtgcccatcgcctggaccggcgcgctctga

SEQ ID NO: 5411 - DNA, 288 bp, Methylobacterium sp.
atgaacatcacgatggtcgggtcgggctatgtcggtctggtctctggcgcgtgctttgcggatttcggccacacggtcgtgtgcgtcgacagcaatcgcggccggatcgacgcgctgaatgccggccggatgccgatctacgagccgggcctcgaggccctggtcgccgagaacgtccgccaggaccgcctgtccttcatcaccgacctggaagcggcggtcggtcaggccgacgcggtcttcatcgcggtgggcacgccctcccgccgcggcgacggcttcgccgac

SEQ ID NO: 5412 - DNA, 2973 bp, Methylobacterium sp.
ttgggcatcgtgtcaacgagctatgtcggacggtccgtagagcgcgttgaggacgccgccctgctctccgggctcggccgctacatcgacgatctcggcacgcggcccggcacgctgcacgcgtcgatcctgcgctcgccccacgcccatgcggacatcctcgccattgacgtccaggcggccaaggcgctgcccggcgtcaccgccgtgatcacgggccgcgaccttgatgccgtcaccaccggtctcgtccccgccctgcgggcggccgtcgatgcccgcgccatcgcggtggaccgggtgcgctatgtcggcgagccggtggctatcgtcgtcgcccgcgaccgctacctcgcggaggacggctgcgacctgatcgaggttcagtaccgggtccgcccggcggtggtcgacccgctggcggccctcgcccccgacagcgagatcctgcacgagggtgtcggcgcgaatctcgtgagcgaccggcgtttccgctacggtgaccccgaggtcgccttcgcagatagcccgcacagcctgtccgtgaccgtgcgctacccgcgcaacaccggctcgccgatggagacctacggcgtcgtcgcttcctacgaccccaccgacgactcctacgacgtgctcgcgaacttccaggggccgttcagcattcacgcggtcgttgcccgggcgctcaaggtgccgggcaaccgcctgcgcctgcgcacgcccccggattccggcggcagctttggggtgaaacagggcgtcgccccctacgcggtcctgatcgccgccacggcccgcctcgtgggacggccggtgaagtggatcgaggaccggctggagcacctctcggcctccgtctccgccacgaaccgggtcacgaccctccgggccgccttcgaggcggacgggcgcgtcaccgctctcgattgggatcaggtcgaggattgcggcgcctacctgcgggcgcccgaacccgccacgctctaccggatgcacggcaacctcaccggcgcctacgccatccgcaacgtcgccgtacgcaaccgggtggtgctcaccaacaagaccccgaccggcctcgtgcgcggctttggcgggccgcaggtttactatccgctcgaacggctgatgcagcgcatcgccgtgacgctgggcctcgatcccttcgcggtgatccgggcaaacctaatcccggccgacgcctttccctaccgcaccgcgacaggcgctctctacgattccggcaattaccagcgcgccctcgacgaagccgcccgggatggcgggctcgtcgagttgaagcggcgacgggacgccgcccgcgccgagggccgcctctatgggatcggcctgacggcggcggtcgagcccagcgtctccaacatgggctacatcaccaccgtcctgacggcggaggagcgcaccaaggccgggccgaagaacggcgcgcaatcgaccgccaccatcaccctcgatccggtcggctcggtgacggtgcaggtcgcttcggtgccgcagggccaagggcaccggacagtgctggcccaggtggtggccgacgtcctcggcctcccgatggagcaggtccgggtcacggccgacctcgacaccgccaaggacgcatggtccattgcctccggcaactatgcgagccgcttcgccgccgccgtggcgggggtcgcgcacctcgccgccacccgcctgcgcgacaggctcgcgcggatcgcggcggcgcagctgaacctacgtcccgaggacctgctcttcgcggatgggcgcatcgcctcgcgattgaacccggatgcaggcctgcccttcgcgcgggtggccgccacgagccactggtcgccgggcctcgtgcccgaggatctcggcgcggtgatccgcgagacggtgttctggacgcccccggagctgaccgctccggacgcggaggaccatatcaattcctccctctgccacggcttcatcttcgacatctgcggcctggagatcgaccgggtcacggggaaaatcgccatcgaccgctacgtctcgatgcacgattgcgggcgcgtactgcacccgggcatggtcgagggccaggtgcgcggcggcttcgcgcaggcgctcggcgcggcagtctacgaggaactcgcctacggcgacgacggcgccttcctgtccggcaccttcgccgattacctcctgcccaccgcgaccgaggtgccggacctgcgcatcctgcacgtcgagagcccgtctcccttcacgccgctcggcgcgaagggggtcggtgagggaaactgcatgtcgacgccggtctgcctcgccaacgcggtggccgacgccctcgacctcgaggccatcgacctgcccctgacgcctgccaagctcgccgccctcgcggcagggggcgacgagccggcgccgccggccggtcgagccgcgaaggccgccgcgaaggcgggcgaccggaccctgcgcggcgacggcgcggccaccgtcactgccccgccggagacggtctgggcgatgctcctcgacccggacgtgctcgcctccgtcattcccggttcgcatggggtgcggaagctctccgacacaaggttccgggccgacgtcaccctcggcgtcggtccggtgaagggtcgctacaaggccgaggtgatcctctccgatctcgatgagccccgggcggtgacgctcaccggcacggtgacgggcggcctcggcagcggcggcggcaccggccgtttgaccctggagcccgacggctcggggggcacgcggatcgcctacgtctacgaggcggcggtgggcggcaaggtcgcggcggtgggcggacgcctcctcgacggggccgcgcgggtgatcatcggcgggttcttcacggccctcgcccggcgagccggcgggtccggcaagcgcgggctccgcctcccggtcgccctgcgatggctcctcgcgcgtctgggggtgtccgcatga

SEQ ID NO: 5413 - DNA, 210 bp, Methylobacterium sp.
atgacggtctcggacagcgcggtcccctacgtgctgggcgctgcggcggtgcgctcggtcgaggtcatcgacggcggcggcacactggcgatccgattgcggtcgcccgacgacagtgagttctgcgtcctgctgccgatcggtgtcgtgggcgacctcctctttcaactcgcggatgtgatgagcgtcagccttgacccacgcccatga

SEQ ID NO: 5414 - DNA, 972 bp, Methylobacterium sp.
atggccatccggcacgacgacctgatcgtgatcgacgggctgatcgtctccgacttcgggcccgaggtcttcgccgacatgcgacgtggcggcgtcacggcggccaactgcacctgctccgtctgggaggatttcgccacgaccatgcggacgatggcccgctggcggcgctggttccgcgagcacgccgacctgatcaccccggtccacgacgtcgccgatatccaccgcgcgaaggcggagcgccgcaccggcatcatccacggctggcagaacaccagcgcgatcgaggaccgcatcgagtacctggagctgttccacgcgctcggcctacggatcgtccagctgacctacaacacccagaacctcgtcggctcgggctgctacgagtcccgcgacagcgggttgtccgatttcggccgcgacgtgctggccgagatgaaccgcctcggcatcctgtgcgacctttcgcatgtcggaccgaagaccagcgaagacgcgatccgcgcctcgcagcgacgcgtcgcctactcccactgcctgcccgccgccctgaaggatcatccgcgcaacaagacggacgcgcagctgcgcttcatcgccgagcggggcggcttcgtgggcgtgaccatgttcccgccgttcctggcccggggcgcggccgcgacgatcgaggactatctcgacgccatcgcgtacgtgatcgacctggtcggcgaagagaacaccggcatcggcactgacttcacccagggctacggacaggccttcttcgactacatcacccacgacaagggtgacggtcgcaagctcacggatttcggtgaggtcctgaaccccgaaggcatccgcgtcatcggcgacttcccgaacctcaccgccgcgatggagcggcgcggctggccggccgcccgcatcgagcgcgtcatgggcggcaactggctcgccctgctcggcgacgtctgggcctga

SEQ ID NO: 5415 - DNA, 174 bp, Methylobacterium sp.
gtgctgccgcgggtgaccgaggactgtcgcgcgcggctgtgccgggtcgagttcgaccgcgtgcctggcgtgggacatctgtcgatggccgaggacgctgcgccggccgccctcgaccggatcggtgaccgctccgccggcgtgccggcaccgggcgactgcggtgagccttga

SEQ ID NO: 5416 - DNA, 930 bp, Methylobacterium sp.
atgctgacggcgctgctcgccgccgccccggcccgcgcgcaggcccccgcgcaggcccctgccccggcaccggcggggccggcgaccaagcccgagagcgatcccgctcaagagacgatccgcaagctcaacgcttatgtcgggctcctcaaccggaccctgcgggcgcaggactcgctcggccgctatcagagctgggtcaacatgaagaccggtccgaccggccgcgagcggatcatctacggcctctacgggctctacgacgtgcgcggcgagatcgcgaaggcggaggccgcgacggcgcagccgcccgcgatgccggacctcgacggcgccgtgaagacctacatcgccgcctatcaggcgctcgccccgacggtcaccgaggcggagggctactacgagcggcaggattaccgcgcggacaagatggagcagggcaaggcgctccacgccaagctcgccgtcgcggggccggccttcctggcggcgcgcgccaaggtcgatgccgcgctgcgggtcgagaaggagaagagcgacgcgctggaactcgccgccctcgaggcgcgggagggccgcaaggcgcgctggcacgtcgcgaacgtgatgaccgcctgccgcaaggtcatggacctgctgcccaccgacgccaagccggtcgtcgacatggcggccttcgacgccgcgctcgggcgctacgccgtcgccgtgaaggacatggacgggtacagcgccgccaacccgaactctttccacgtgttcgagagccggccgcgcgcgctcctgggcaagctgcgcgagttcgacgacaagctcgccaaggccaggggcgatgcccggcgcggcgccgggcgcgacgtgacctggatcgtcaacgactacaacatgatggtgtcgaccgcgcagacggccacgaccttctcgcgctga

SEQ ID NO: 5417 - DNA, 1602 bp, Methylobacterium sp.
atgttcggcaagatcctcatcgccaaccgcggggagatcgcctgccgggtgattgccaccgcccggcgcctcggcatcggcacggtcgcggtctattcggaggcggatgccggcgcccgccacacctggatggccgacgaggcgtggccgatcgggcccgccccggcgcgcgagagctacctcgtggccgagcggatcctcgacgtcgcccggcgcgccggggcggaggcgatccatccgggctacggcttcctgtcggagaacgcggacttcgccggcgcctgcgccggggccggcctcgtgttcgtcggcccgccctcggcggcgatccgcgccatgggctccaaggccgaggccaaggcgctgatggagcgcgccggggtcccgctggtgccgggctatcacggcgccgcgcaggatgtcccggcgctgaaggaggcggccgcccggatcggctacccggtcttgatcaaggcctcggccggcggcggcggcaagggcatgcgcgtcgtcgaggcggccgcggcgttcgaggccgcgctcgccggcgcgcagcgcgaggcgcgagcctccttcggcgacgaccgggtgctgatcgaggcgtacctgacccgcccccggcacatcgagatccaggtcttcgccgacagccacggcaacaccgtctcgctgttcgagcgcgactgctcgatccagcgccgccaccagaaggtgatcgaggaggcgcccgcctcggggatggatccggtccggcgcgcgcggatgggcgaggccgcggtcgcggcggcgcgggcggtcggctatgtcggcgccggcacggtggagttcatcgccgagggcgagaccttctacttcatggagatgaacacccggctccaggtcgagcatccggtgaccgagatggtcaccggcctcgacctggtggagtggcagctgcgcgtggccgcgggcgagcggctgccgctcggcgccccggatctggccctgcgcggccacgcgatcgaggcgcgggtctacgccgaggatccggcgcgcgatttcctgccggcggtcggcaccctcgcccacctgcgccagccggaggcggtgccggggcgggtgcgggtcgagaccggcatcgtgcagggcgaccggatcaccccggattacgacccgatgatcgccaagctggtcgtctggggcgaggaccgggcggccgcgatccggcagctcgcgaccgccctcgccgcctacgaggtggtcggcgtgacgaccaatctcagtctcctgcgcgccgtcgccggccatcccgcctaccgcgcggccgacctcgacaccggcttcatcgcccgccacgccgacgacctgctggcgccgcttgcgaccggtgcggtcgatcccgcgctctgggccgccgccgccctgaccgtcctgcgcgaccggcgcacggccgtcgccgcgcaggcgcaggcgagcggcgacccgtggtcgccctgggccgatccggatgcgtggcggatgaacggggcgggctaccaggacctgcagttccgccacggcgacgcgccgcccgtcaccctgcgggcatgcccccgccccgacggcagcgcccgcctcgacctg

SEQ ID NO: 5418 - DNA, 996 bp, Methylobacterium sp.
ttgttcgcacgcgtcggacagcccgcggcctgcccctggcggctggcgctgatcacgctgctgcagttctccgagaacccgtccgaccgccgtgcggccgatgctgtacgggctcgcatcgactggatttacctgctcgccctcgacctgaccgatcccggtttcgacgcctcggtcctgagtgaattccgctcccgcctcgtggccggcgaagccgaggccctgctgttcgacaccctgctcaccctctgccgcgagcgcggcctcttggccaagcgtggccgccagcgcacagacgcgacccacgtcctcggtgctttccgcagcctcaaccgcctcggctgcgccatcgagaccttgcgggccgcgctgaacgccctggctgtcgtcgcaccggactggctgcgcgcctatacggatccgagttggatcgagcgctacggccgttccatcggcgacttccatatctcgcagggcgagacggcgcgccgcgcctgcgcggagacgatcggtgacgacgggcaccggctgcttgcagccgtcgacaccaaggctgcaccgggctggctgcgcaacgtccccgccatggtggtccttcgccgcgtctggctgcagaatttccacgtcgccgaaccacccgctgaaggatcggagggagacgggcggatccgctggcggacggaggccgagggcattccgcccgccctggcgatggtcgcctcgccctacgatccggacgtgcactacgccaagaagcgcgcgaccacatggatcggtggcaccgtccatctgaccgagacctgcgacgacgcccagccaccgctgatcgtccacgtcgcgacgacaccggccccggcgtggaccgggcggtgctcgacccgctgcacgcggcgctggcgacgcaggatctgcttccggcgcgccatctcgtcgatgctgcctatatcgacgccgacggcctcgtggccgccgcgcgagatcacgacgtcgccctga

SEQ ID NO: 5419 - DNA, 1512 bp, Methylobacterium sp.
gtgagcgccgccgcgccggtcctgtcggaggccgcggccgccgaggaggagccggggctcgcctccggcgccgcggtgacgcgccgctcgttcgacgcggcgcgctgggtggcgctcgcctccgtcggcaacgtcgtcctgagcttcggggtattcctcgtgctcgcgcgcctcatcgggcccgccgagttcgggatggtggcgatcgccgccgtcttcatcgacatccttcagatcgtggcccgctgcggcctgcccgacgcggtggtccagcgcgccgacctcgacgaagacttcgccgccaccgccttctgggtgatgctcgttacgggcatcctgtgcgccgtgggcctcgtggccctggccggcccgatcgcctggatcttcgacctgccggcgctgcagccggtcctgtgcgcgctctccgcctgcttcgtgatcacggccgcgggcgcgatccacgaggcgcggctccagcggagcttcggcttccgcaagctcgccctgcgggcgctcggcgccaacgtgctcggcggggccgcggccctcgtgctggccctcgacggctacggcgtctggagcctggtggtccagcggctcgtcgccgcgatcgcgaccacgctcctgacctgggcggcggcccgctggatcccgcccctgcggctgcacctcgcttccgtgcgcgagcaggtcgccttcggctcgcgactgttatgcacctacctgctgctcgtcgcctcgatccggagccaggaggtgatcgcggcctacttcctgtccgcgaccgatgtcggctacctgcgcctcgcgtggcgctgcatcgacctcgtgagccaggtcgcggtgatcccgctcaccaccgtcgggctgaccacctacgcgcgcctccaggaccggccgggcgagctggccgcggccttccacggcttcaccgaggcctccgcgtttctggccgtgccagccttcttcggcatggcggccgtggccccgaccctcatcccgttcctgttcggcgaccagtggcatgacgcggcgccggtgctgcggacgctcgcgctcctcgccccggaattcgtcgccacctcgatgctgtggatgatcttcacggccctgggccgcaacggcacggccctgcggctcgccggcgcgcagttcggactcggcgccgtggcggcattcgtgaccgcgcccttcggcctcgccgccctggtcgccgggcacgtggtgcgggcctacctgttcacgcccgcgatcgtcgccagcgcggggcgcgtcgtcccggtcacgaacgagcggctcgtgcggctcctcgcgccgatcacgctctgcgccggcgcgatggccgggctggtgctgctcgtccaggggccgatccatgccgcgctcggggaccggttcggcctgttcgcggcggtcgggctcgggatcgcggcctatctgggcctcgcctggatcttcatgcgcggcacgctccgcacggccgtcggcctgttcctgagacgccccgcctga

SEQ ID NO: 5420 - DNA, 1227 bp, Methylobacterium sp.
atgaccgaagtgctccacgccgacgcgctcgcggaacgcgcccctcgggaccgggcgcaggcctcgcggtccgacgtcgccgcgcggccgcgggtcctgttcgtgagccataccggcaccatgtcgggggccgagctcgtgctccgcgacgccgtccggccctgggcgggctccagcgccttcctgttcgaggacggcgcgctgaccgaggccctccgcaatgagggtctggagatccgcctcgcgcgccgccggtccgcgctggcgggcctcaagcgcgatgtctccccgttgagcgccctgccggtcctgggccagctcggcgccctggcgctggagatcgccagggcggcccgggcctgcgatgtggtctacgccaactcgcagaaggccttcctgctctcgtccctggcggcccgcgccgtcgggcgtcccctgatctggcacctgcacgacatcctcgacggcgcgcatttcggccgggcgcagcgcgttctgcaggtccggctcgccaatctctgcgctgcccgggtgatcgtgccctccgaggccgccgcgcgggccttcgtccaggccggcggccgccggtccctcatccgtatcgtgccaaacggcctcgacgtcgatccggcgccctgccccgccgcgacgctgcgggcggagttcggcttgccggacggccccctcgtcggcgtcttcagccgcctcgcgccgtggaagggccaggacgtcttgatcgaggcgctcgcgaccctgcccggcctcagctgcgtcgtggtcggggcgccgctcttcggcgaggatgcctatgcgacgcatctgcgcgatctcgcgacgcggctcgggctttcggaccgggtgctgttcctcggacagcgcgacgacgtcccccggctgatgcaggcggtcgacgcggtcgtgcacccctcggtcgatcccgaaccgttcggccgtaccctggttgaggcgatgctggtcggcgtgccggtgatcgccaccgacaccggcgcgtccgccgagatcctcgacggcggcgcggccgggacgctggtgtcaccgcgtcggccggaccgcctcgcggcggccctttcggcgctgttcgccgatcccgattccttccgggcgcgcaccgcgctcgcccaggagcgggcgccgtcccgctacggcgccgaccgcatgcagcgcgatctcgccgacatcatcctccaggtcgccggccgggcctga

SEQ ID NO: 5421 - DNA, 1170 bp, Methylobacterium sp.
atgcgtgtcgcgatcgttcacgactggttgtacatcgtcggtggcgccgagcgtgtcctcgaacagctgctgcggatctatccggacgcggacgtcttcgcgctcttcgacttcctgcccgaggcggaccgggcgcggctgggctacacccaggcgcatacgagcttcatccagcgcatgcccttcgcgcggacgcggcaccgcaactacctgccgctgatgccgctcgcgatcgagcagttcgacctgtcggcctacgacctcgtcatctcgagcagctacgcggtggcgaagggcgtcctcaccgggcccgaccagctccacgtctcctacatccactcgcccatgcgctacgcctgggacatgcagcacacctacctgcgggagagcggctgcgacgcgggcatgaagagcgtgctcgcccgtctgatcctgcaccggatgcgagtctgggatttccgcactgcggccggtcccaacgcgatcgtggccaactccgccttcgtcgcccgccgcatccacaaggtctacggccgcactgccgaggtcatccacccgccgatcacgctgccgagccagcggtatgacgggccgcgcggcaaccacttcctcgtggccagccggctggtgccgtacaagaacgtcgaggcggtgatccgcgcgttcgcgctgctccccgacctcgaactcgtggtggcgggcaccgggcccgatgccgcgcggctgcgcgagatcgcggggccgaacgtgtccttctccggcttcgtgcccgacgcggagctgcgccacctcatggccacggcccgcgccttcatcttcgcggccgaggaggatttcgggatcatcgtggtcgaggccacgtcggagggcacgccggtcctcgcgctgggtcgcggcggcgcccgcgagacggtccagacccgcggcccgcagcgcaccgggatgttcttcgacacgcccgagcccgtggcgatcgccgagtgcgtccagcgcttcctgctgcaggagggccacttcacccgcgaggcctgctgggcgcaggccgagctgttctcggccgagctgttccgcagccggttctcgaccttcgtcgacgaccagatggcgatgcaccgggccgcctgcgagacgcgcccgcggatcctgccgcgcctcgaagccgtcggctga

SEQ ID NO: 5422 - DNA, 1593 bp, Methylobacterium sp.
atgaagcgacgcacgctgttgcagggagccggcgccctcgtcgccggcgccgtcgcggcgccggccctcgtccgcgcggaggcggcccggaccctgcgcttcatcccgcagcaggatctcgtcaccctcgatccggtgacgaccttcgcgtacatcacccgcaaccacggctacatggtcttcgacacgctctacggcatggacgcggcctatcgcgccacgccgcagatggtcgagggccatcgggtcgaggcggacgggcgccgctgggacttgatcctgcgggcgggcctgcgcttccacgacgggacgccggtgctggcccgcgactgcgtcgcgtcgctgcggcgctgggcgaagcgcgacccgttcggcggctccctcatggaggcgaccgacgaactctccgcgcccgacgaccggacgatccggttccgcctgaaacacccgttcccgctgctgccaatcgcgctgggcaaggcgtccgtcccggtctgcgccatgatgccggagcgcctcgccgccatcgacccgttccagcaggtgccggagctcatcggctcgggaccgttccgcttcaagcccgacgagcgggtgcccggcgaccgcgtcgtctacacccgcttcgaggactacgtgccgcgcccggacggcccgctgacctggacctcgggtccgaaggtcgtccatttcgaccgggtcgagtggcgcgtcatcggcgacacctccacggcgacctccgcgctgatcgccggcgaggcggactggcaggaatacgcctcgcacgaccagatcgcgctcctgcaggcggccaagggcgtgagcacccgcgtcctcgacccgaccggcttcgtgaccatgctgcgggtcaaccacctgcagccgcccttcaacaacccggcgatccggcgggctctctggggcgggatcgaccagaccgcgtgcatgcagggggtcgtcggcgccgaggatcccggcctgttccacgtgcccctcggcttcttctgcccgggcacgccgatggcctcgacggacgggttgcagccgctcacggatccgcgcgatccggcgcgggtgcgcgccgatctcaaggcggccggctacggcggcgagaccgtgctgctgatggtgccgtcgaactcggcgccgctgctggcgctcggccaggtcgcggccgacctgctgcagcgggtcggcatgacggtggaggtctacgcggtcgagttcaacgcgatgctgcagcggcgcaaccgaaaggggccggtctcggagggcggctggagcgccttcgtcaccaactggtccggcatggattggctgaaccccgcgggctacatcgccctgcgcggcaccggcgagagcggctacgccggctgggccacgaccccgcggatcgagtccctgcgcgacgcgtggctcaccgccccggacgaggcggcgcgcgccgccctgtgccgggacatccagctccaggcgatgcaggacgtgccctactacccgctgggccagtacctgcagccgaccgcctaccgctcccgcctcaccgggatcctcgacgggttcccgacgttctggaacgtccggcccgcctga

SEQ ID NO: 5423 - DNA, 2280 bp, Methylobacterium sp.
gtgccccccgcccgccccggggcgggcgcggcgcgctggatcccgcccgcgatcctggccgccggcctcctcgcgaccgggctgagcacggccctcagctggcaggcggcggcgctgcgcgaccgcctgaccttcgagcacgccaccgagatcgagctgcgcacggtcgaggaccagttccgcacctacacggcgctcttgcgcggcgctgccggcctgttcgcagccgacggcgacaccgtcacgctggcccagttccgggcctacgtgcagcggatcgagttccagcgcctctaccccggcttcctcggcatcggcttcacgccgaccctgcccgcctccgcgcgcgagacgttcgccgcgcgcgccgcagccctgggcgtcgagaatgcccgggtccggccgccgaccgataacccgatgatcagcccggtcctgttcgccgagccgccgaacccgcgcaacctcgccgccatcggcttcgacgtgatgtcggacccggtgcggcgcgacatggtcgagcgggcccgcgacaccggccagccggcagcctcggcgcggatccagctcgtgcaggagatcgacgcgaacaagcaggcgggcttcctcgtcgccatgccggtctatgccggcggcgccgtgccgccggacctcgaggaccggcggcggcgcttcctgggcttcgtgttcggcgccttccgggccgacgacctgttcaacagcatcgtggcggcggaggccgaggaggacgcggccttcgccatctacgacggcgcgccgagcgaggcgaacctgctgcaccggtccgcgcgggcctccgctgcgggagcggggcgcctcacccgcgaggcgcatctcgagctcggcggccgcacctggaccgtggcgttcgcgcagcgcgtctcgccccggcgcggctcggcgctgccggagatctggctcgtctgcggcggcggcctgttcgccaccgctctgctggccttcgcggcctaccggcagcgccgcacgcaggacgagatccgccagctcaacgcgtcgctggaggcccgcgtcgaggagcggacgcgcgatctccgggcggcggccgaccgtctgcggcaggccggggaggagcgggcgcgcatggaggaggcgctgcgccagtcgcagaagatggaggcggtgggccagctcaccggcgggctggcgcacgacttcaacaaccttctggcgggcatctcgggctcgctggagctcatcgaggcccgcatcgcccaggggcggtcgaaggatgtcggcaagtacatcgcggccgcccagggcgccgcccggcgggccgcggccctgacccaccgcctgctcgcgttctcgcgccgccagacgctggcgcccagggcgatcgacgccgaccggctggtccgcgggatgctggacctgatccagcgcacggtcgggccgagcgtcgaggtgcggcacgtcggggcggacgggctctgggtcgccctcgcggacccgtcccagctggagaacgcgctcctgaacctctgcatcaacgcgcgggacgcgatgcccgggggcggccggatcaccatcgagaccgacaaccgctggatcgaccggcagcaggccgacgcccaggacatgccggaagggccgtacctgtcgctgtgcgtgtccgataccggcaccggcatggccccggaggtcgtcgcccgggccttcgacccgttcttcaccaccaagccgatgggcgaaggcaccggcctcggcctgtcgatgatatacggcttcgccaagcagtcgggcggtcaggtccggatcacctcaacggtcggccagggcacgaatgtgtgcatctacctgccgcggcacttcggcgaggcggacgcggacgggcccgacccaggcaggggcctgatggcgcaggccgaggcgggcgagaccgtgctgatcgtggacgacgagccgacggtgcgcatgctggtgacggacgtgctgagcgacctcggctacacggcgatcgaggccgcggacggcgcgggcgggctcagcgtgctgcaatcgggtgcgcggatcgacctgctcgtcacggatgtcggcctgcccggcggcatgaacgggcgccagatggcggacgccgcccgggtcgcacgaccggacctgaaggtgctgttcatcaccggcttcgccgagaccgcgctgccgggcgacgggcgtctcgagcccggcatggcggtgctgaccaagcccttcgccgtggaggccctggccgcccgcatccgcgagctgatcgcgcgctga

SEQ ID NO: 5424 - DNA, 1092 bp, Methylobacterium sp.
gtggcggaggcggcgggtggccgggatgcgcgggcgaacaatttcgggtctctgcgactcctgttcgcgggcctcgtgatcctcgcgcacgcccccgagctcgtggacgggaatcggtcacgggagttgctgacgcaggtcttcggaaccctgtccctgggggagatcgccgtcgacggcttcttcctcgtgagcggctacctgatcaccgcgagctaccgcgccaagcgctccttcggcgactatctcgcgcggcgggcgctgcggatctacccggccttcgtggtcgcgtccctgctctgcatcgccgtcgtcgcgcccctcggcggcggcaacctcgcggccgcctcgccgctcgagacgctgctgcggctgtcgctgctgctgatgccggtggtcccgggcgccttcgccgagctgccctacccgctgctgaacggctcgatgtggaccatcccgtgcgagttcggctgctacctcctgctcggcctcttcggcaccgcccgcgccctgcgccgccgcgggcgctatctcggcctgctcgggggactcggcagcctcctcgccctgcgctggctcttcctgccggtcgggcatccgggcgacaccctcggatccctgtcggagatgatccgcctcaccttcgtgttctgctgcggcggcgccttccggctgttcgccgaccggatcgcctacacgcggcgcggcgcgacccgcgccgccctgctgctcctgccgctgatgttcagccggccgctggccgagccggccttcgcgatcctcggcggctacctgatcttctggttcgccttcgcggtgcgccccaccgccctcagccgcgccaccgcccaggtcgacccgtcctacgggctctacctctacgcgtggccggtgcagaacctgctggtcgcgcggatccccggcatctcgccctggacggtcgccgccctcgccctcgcggccgccatcccgctcggccttctgagctggtacctgatcgagcggccgatgctccggttccgaccgggaccgggcggtgcgcggccggagcccggcgcgatcccggcggccgggtccgccctcggggcctag

SEQ ID NO: 5425 - DNA, 1494 bp, Methylobacterium sp.
atgccgcagactccgagacacacagagacgctcgaggcgcagctgttcgatctcgcgcccgtgtccctctggttgcaggatctcggcgcgctgaaggcccggctcgacgcgtggcgggaggccggcatggtcgacctccgcgcctggctgcgcgatcccgggcacctgcggacctgccagagcctgatccggatcgtccgggtcaaccgcagcacgctcgcgacctacgacgcgcgggacgaggccgaattgttcgcccacatccccgcgatcttcaacgatccgcgcgcggacgccctgatcgaggtgctgtgccagctctgggccggggcgacccaggtccgcctcgtcacgcagaaccgcaccgtcgcggggcgcgtcatcgacgtgagctacgcgggacagatgctgccggggcacgaggccgactgggcgcgctacctgatctcgatcgaggacatcacgcagcgcgaggcgctgcggcgggagagcgactcggaccggcgcaccgaagccctgttccagcacgcgccggtcccgaccctgatccgcgacgagtcggagctcgccgcccggctggcggcgctgcgggccgacgggatcacggacctcgccggccatctggcggcccatcccggctggctcgccgaggccgaggcctcccgccggatcgtcgacgcgaaccgccccgccctggcgctgttcggcgtcgacacccgcgccgccctcgcgcggcacctgagcggcgggctgggcgaggcgccgctgcagctcttccgcgaggagctggccgagctctgggacggcgccgcgccgcggagccgggacatcgcggcccgcggccgcgacgggcggcacctgcacctcaagatgcagcgctccccggtcccggcgaccggcgacgggcggcgcctcgtccagatcgccctcacggatatcggcgacaacaagcgctccgaggcgcgcctcgagatcctgagcctcaccgatccgctgaccggcctgcgcaaccgcctgggctacgcggccgagctcgaccggctcgaggccgaccggaccgtgccgacctccgtgatcgtcgcggacctgaacgatctgaaggtgaccaacgacgaccggggccacgaggccggcgacgacgtgctccgccggttcggggccatcctggcgcgccacagccccgtcacggcccgcccggcccggatcggcggcgacgagttcgtgatcctgctgccgggtctcgacgccgcgggcgccgccgcgctggcccggcggatcctggacgggatcgacggcgagaaccggtccggcgcggccgtcatcagcgccgccctcggctcggccacgtggcgcggggacgggtccctgaaggccgccgtggcgtgcgcggattcccacatgtacgcggcgaagcggcgctaccgcgacggcgcgtgggacggggagccgcccgtgccgggcacgtccgtcttcagccaggcgtcgctgcgctga

SEQ ID NO: 5426 - DNA, 744 bp, Methylobacterium sp.
atgggaccgggaccgacatccgcatcgtccgccacctgcgcgatcggcgtgatggcgaaggcgccgcgcagcggccgctccaagacgcggctctgcccgccgctgaatcccgaccaggccgcgctcctgagcgccgccttcctgcgcgacacgaccgccaacatcctggaggcggcgcgcgctgcgccgatcgctgcctacgcggcctacgcgccgcgcggcgccgaggcgctggtagtcccacacctcgcctgcggaacgcggctcgtcccggccgacggcggcattccggccccggcggcggtcgagggcttcggcctctgcctgctgcaggccgtcggaggcatgctcgcggagggtcatgcggcggcctgcgtgctcagcgccgacatcccgacgctgccgacgcgccgcctcgtccaggccgcccggatcctgctcgcgccgggagaccgggccgtgctcggcgcgtgcgacgacggcggctactacatcctcggcctcaagcaggcccatgcccgcctgttcgccgacatcgcctggagcaccgacaccgtcgcggccgccacccgcgcccaggcgcgcgagatcggcctcgcccttgtcgaactggagccctggtacgacgtcgacgacgcggcctcgctcgcccggctctccgccgacaaaaccggctacgccgccccggcgacgcgcgcggtcctggcgcggctcgcggagacgtcggaggccgtgccggcatga

SEQ ID NO: 5427 - DNA, 699 bp, Methylobacterium sp.
atgcatccggtcagcatcgtcatcccgaccctgaacgaggtcgaggcgatcggcgcggtgatccgcgagatcccgccggcctacgcggccgacgtcatcgtcgccgacagcggctcgaccgacgggacgcaggccatcgcccgggccgcgggcgcccgggtgatcgaggccgggtgcggctacggccgagcctgcgcgctcggggcggccgcggccgccccggcctcgcgcgtgatcgtctacctcgacggcgacggcgcggaccgcggcgacctgatcgaccggatcgccgggccggtgctcgccggcagccaggacctcgtcctcgcctcgcgcacccttgggagccgcgagcccgggtcgatgctctggcaccaggtgctcgccggccgcctcgccggcctcggcatcggcctgcgctacggcgtgcgctacaccgacatgtgcgccttccgcgccatcgaccgcgccgcgctgcgggccctcgacctgcgcgagctgacctacggctggaacatcgagatgcagatgcaggccgcgcgtgcgggcctgcgcatccgcgaggtgccgatgccctatcggcgtcggatgggcggatcctcgaaggtggccggttcgctcgctgggacgctgcgggccgctacgcggatcggcgcgacctacctgcgcgtcgccgccgggccggcgcggggcgcgtga

SEQ ID NO: 5428 - DNA, 588 bp, Methylobacterium sp.
gtggcatcgggacggcgcgcgctgaagatggaggaaacccgcgcgaggctgatccgcgcggcgcgtgcagcctttgccgagaagggctacgcagcggcgtcgatggatgagctgacggaagcggccggcctgacgcgcggcgcgctctatcacaacttcggcgacaagaagggcctgcttcaggccgtcatcgcgcagctcgacgccgagatggtcgctaaggcgcgggtcgcgcgcgagagggcgccaacgccctggctcggcttcctcgacgagggcgtcgcctacatcgagttggccctcgagccggagatccagcgcatcgtgctcctcgacggaccggcagtgctgggcgatccgtcgcgatggccgggccagaccgcctgcctgcgcacgacgaccgagacgatccaggccctcgtggaggccgggacggtcaagcctgtcgatgccgaggccgcggcgcgcctgatcaacggcgcggcgctcaacgccgcgctctgggtcgccgcgtccgacgatccaccggccgtcctcggcagggccaccgaggccttccggtgcttggcgaacggcctcctgaagtag

SEQ ID NO: 5429 - DNA, 1572 bp, Methylobacterium sp.
atgagcctgttcatcaccagcacggcgttctcgatccccgccctgttcggcgcgctcggcgccctcgccaccggcccggctgccgccttcctgggcaagcaggtcttcgtccgcgcgcagtccctggccgccaagggacgcatggacgacctcgtgatgatcggcctcagcgcgatggcggcagtcttcgggatcagtctgttcgccctgatgggctggtgcctcggccgcttcctcggccaggcgcacgattggtggggcaactgcctgctgccgcgccgggcgctcggcggcgcggacaccggcgcggatgccggctccgtctgcggcataaacccctacggcatgatcgtgatcctggacgtcgcggtggcggcaatcctggccggggccgtctggctgttcggccgcgtcaacgtcaaccgcttctccatgcacggcgtctaccgcaaccgcctgacccggggcttcctcggctcggcgcggacgcggcgcgacgccgatcccttcacggacttcgacgaggaggacagcccgcgcatcgccgatctcgggaccgagaagcggctgctgcccgtcgtcaacatgacgctcaatctgacggatctcctccacaccgagtgggcggagcggaaggccgcctccttcaccgcgacacccttcgcctgcggctcggcgatcctcgaccgcgccgacagggcgcgcgaccggcccggcaccgacggcccgcgcggggcctacatccgcacgtcgcaatatgccgggatggagaccccgggcgaccgtgtcagcgcgggccgggggccgctgctgggcggtctgctgacgatctccggggccgcggtcagcccgaactggggctatcactcgtcgcgcctgatcgcgttcctgatgaccctgttcaacgtccggctcggcgcctggctgcccaaccccgcggtggcccgccgggacgacctgaagctcgccaagccgaggaactccgtgctcgcgctcctgagcgagctcggcggccgcagcaccgatgtccggcaggcgatctacctctcggatggcggccatttcgacaatctcggcgtctacgagatgctgcggcggcgctgcgcgcggatcgtggtgatcgacgcgggccaggacgaacgctgcacgttcttcgacctcggcaacgtgatccggaaggccgaggtggacgggttggcgaaggtccagatgggcgagatgcgcattctcccccgcgcgacgatcgagcgcgagggcaagcgtgccggtgcgctgggctacgcgcggggtacgatcgcgtatccgggggcccgcgacgcggcatcgctgatctacatcaagccgagcttcctcgacgacatccccgccgaagtccgcgcctacggcgccaccagcccggccttcccgcacgagagcacggccaaccagtggttctcggagagccagttcgagagctatcgcgccctgggcttctaccaggtcagcaagatgttcggctcgcagctcacgaccttgtcggactggtccgtgtatctcgacagcgagatcgggcgccggaccgcggattcctag

SEQ ID NO: 5430 - DNA, 1215 bp, Methylobacterium sp.
atgagcgccagtgtcgcggacatccaggcggatgcctctccccaccatctgcccgccctgacgacgggccgggacgcgtggttcctcgacaccgagcaggcgctcgcggaggagatggatcatttctgcgggccgccggagcccggcgatcgcgcgccctggcaggcgcgggccgaccaggcccggctcgccgccctgtgcctctccggcggcgggatccgcagcgccaccttctgcctcggcgccctgcaggccctggccagccggcggatgctcggcgagttccactacctgtcgacggtatcggggggcggtttcgccggcggctggttgcagacgttcatccgtcagtgcggcggcatcgccgaggccgagcgccagctcggcggctcgggcaacgagatcttcgccaagctgcggcgctacacgaactacctgaccccggaggtcgggatcctgtcgcgcgacacctgggccggcatcgtcctctacatccggaacacgatcctcaactggttgatcatcttcccgctgctgctgttcgtccccctcgcgctgctcgcctaccggacggcgctcgaggctgcgagcggcagcacgctgtggctgcccctggtgctcggcagcgcggcgctgttcgtcgcgacgttcagcgcctgcaccctcctgccgagccatcggccgcggacgggcggcgtcacggcgtacgcgtccccggcgcggatcgcggcctgcatcatcgcgccgacctgcgtctgggccctcgcgctgccgttcacgctccgcgcgctgttcgagcagccgctgccgctctcgggcctctccctgtgccgcctgggcctcgcctacttcgccgtccaggtcgcggcctatctcagcggcctgatctggcagacctcgaagggccatccgggcctctggctgtacgagcggaatctcggtccctggctcgccagcagcctcgtctcggccgggctgatctgcgtctgcgccgacgcgtccatcggctggctggtcggtggctccgccgccggcttcgacgcggcgaaagccgaggtctctcaggtcctgacggtcgcggccccgccggcgctgatcgtcatccaccttctccaaagcgtcatcttcatcgggttccggaagagcgccgagtgcgccgacctcgaccgcgagtgggtcgcgcgggtcgacggccagctcctgctggccgcgatg

SEQ ID NO: 5431 - DNA, 711 bp, Methylobacterium sp.
ttgaaactcgtgcgcggcgaccgtggccggaacttcctgctgctcggcatcagcctcctcttcgtcgccgccggcctcgggataatcgccaccggcgcggatggcggcgtcacggcgacggtgttcttcggcgtgtgcgcggccgtcgccgtgtggcagctgcggccggacctgctcgaatcagagagccgttcggcggggtccctggcggcgcagttccccggccccgtgatcctgcgcgcgtcggtgcggaaactcctgttcctggcgctgatggccgccggcttcggcggcgtgacgctctggatggtgctgcacgaggcgccctccacggcgatgcaactgctgctctggccgggcgtcgtgctcttcctcggaggcgtccccttcctcatcctcacggcgatccgcggctcggcgctgcacctcgacgagacgggcttcaccgtcgtgcaggtgggccgcgcgcggcgcgtccggtggcgtgacgtgagcgtgttcgagccggtctccatgcccggttcgggacaacgcctcgtgacgttcgacgacgcgagcgccggcgcgacgcgcctcggggcgatgaaccggcgcctggtcgggcgcaacgcgggtctgccggacagctatgggctggatcccgacgcactcgccagcctgctcacggcctggcgcaagcgggccctgcagcgggaggacgatcgcttctga

SEQ ID NO: 5432 - DNA, 792 bp, Methylobacterium sp.
atgatcgagatccgcaacctgagcgtccgctacgggcagggcaccgacgcggtcggcgcgctgtcggggatcgacctgaccatcggtcccggggagttcgtggtggcgctcggcgcctcgggctgcggcaagaccaccctgctctcggcgatcgcgggatttctggcgcccaccgagggccgcatcctcctcgacggcgagccggtccgggggccgggggccgagcggggcgtggtgttccagcgccacgccctgatgccctggctggacgtcgccgagaacgtggccttcgggccgaagatgcggggcgtgccccgggcggagcggcggcggatcgccctggcgacgctcgacctcgtcggcctgcccgactgcgccgaccggaaggtctacgagctctcgggcgggatgcagcagcgggtcggcctcgcccgggcactcgccggagacccgcgcgccctgctgatggacgagccgctcggcgcgctggacgccttcacccgcgagcagatccaggagctgatcctccggatctggcatcggaccggcaagatggccttcttcatcacccacgacgtcgaggaggcggtattcctcgccacccggctggtgatcatgagcccgcggcccggccgcatcgtcgagacgctggacctgcccttctcccgggcgttcgtcgagggccgcgacgcgcgggccgtgaagtcggaccccgccttcatcgccgtgcgcgagcgcgtgctcgcgcgcatccgcggcggcgccggcgcggcgcccgaggccgtccgatga

SEQ ID NO: 5433 - DNA, 678 bp, Methylobacterium sp.
atgccacgcgtcgcaggccaagccgtcatcgccgacgacgacccgttcttccggatcgcgctcgcgagcatcctcaccggccatcttgggttcgacggcgtccatcaggccggatcgctcgacgaggccctggagacgctggccgagaagccggacgtccgcttcgcgctgttcgacctcgcgatgcccgggatggagagcgccgccagcctctcggcggtgcgcgagtgttttcccgaggtcctgacggtcgtggtttctggctcgaccgaccgcgaggacgtcttcctcgccctgcgggccggggtgcacggcttcgttcccaaaggcacctcggtcgaggcgctgatccaggccttgggcatggtgttcaacggcttcgtctacgtgcccgcctttgtgacccgggtgcccggcgagggcgcgccgacggcgccggccgcttggcgggaggccgcccgcgacccgaccgcctccctcacgccgcgacagcgccaagtgctcgacctgatcgtcgccgggcaatccaacaaggagatcgcccgctcgctcgcccttggtgagggtacggtcaagatccacgtcgcggcactcctcaaagcgctcggcgtggccaaccggtccgccgccgcggcctgggccggggccaaccttggccgggtacgggcctcgccctag

SEQ ID NO: 5434 - DNA, 1068 bp, Methylobacterium sp.
atgcacgctatcacatcggacgccgtcgtcatcggcgtcgacacgcacaaggatgtccacgtcgccgtcgcgatcaacggactgggcgcacggcttgccaccgcatccttcccggtgacctgcgcggggtatcgcgaggtggccgcctgggcagccgcgcacggtgtcgtgcatgccttcggcatcgagggaaccggctcctacggtgccggcctcatgcgggccctgactgccatgggcttgcgcgtcatcgaagttggtcgggtcaaccggcagctccgtcgccgccagggcaagaccgataccgtcgatgccaagtcggcggcacgggctgttctggccggtgaggctatcgacgagcccaagctcggcgatggggccgtcgagatgatccgtcgccttaagatcgctcgcgaccccgcgctcaaggtgcgaacccaggcgatggtcacgctcaagacgctgctggtcaatgcaccacaagcgctacgcgagcggctcatcggcatcaccggcaagatgacgctcatccgcgcgatcgccgcgttgcggccgggagcgccggtctctaccaccgcatccgccaaggtggcgcttcgcgcactggccaatcggtggctggtgctggatgccgagatcaaggaacacgacgccgtcctcgaacaatcggtgcgtgcccaggccccagcgctgatggaagcgcctggcgtgtcgaccggtaccatcgccgagatgctcgtcgttctgggcgacaatctccagcggatccggtcggaagccgcattcgcgaagctctgcggcgtttgtccggtgccggcatcgagcggaaagaccagccgccatcgcctgaaccgtagtggcaatcgccgggcgaacgccgccctgtaccgcgtcgctgtggtccggatgcggcatcatctgccgacccgggaatacatccagcgccgaaccagcaaaggcaagccgcctcgcgagatccgccgatgcttgaagcgctacatcgcccgagaaatcttccgacacctgtgtatcgggtcggcttcagtgcccgacagaaaaaccgcttga

SEQ ID NO: 5435 - DNA, 186 bp, Methylobacterium sp.
ttggccgagcgcagcggtgtcgctgcgacgacgctcgcgcacttcgaggtgggaaagcgtgatccctatacccgaacgctggcggacgtgcgtcgcactcttgaggcggccggcgtgatcttcatttccgctgacgaggtcggggggcccggcgtccgccgcacccgggagaccaccgttgcgtaa

SEQ ID NO: 5436 - DNA, 336 bp, Methylobacterium sp.
atggtcatcggcacgcgcgtcctgacgatccggagcctggacgcggatatttccgtcccggtccggctctgcgcgcccgaatacgccgatgggcattggatctgccgctatacgatcggttggcccgagcatccgtgggacagcttcggagccggcgtcgatgcgttgcaggcgctccatctgacgatgcagaagatcggcatcgacctctacagtagcgcggcccacaaggccggcaccctgaagtgggagaagcctgcggatggatacggctttcccatcccgaagaatggccgcgatctcctgatcggtatggacaagatcttcgaggggtga

SEQ ID NO: 5437 - DNA, 1923 bp, Methylobacterium sp.
atggcagcgcccgacggcatccgcgcggtgaccttgtcgagcggcggcctggccgaagtgaccctggtccatgccgtcgacggcgacggcacgatcgggctcagcgtccggcccgagcaggtcgacgacatcctcaagagcctcgtcgtgcgcgatcccgtcggcaccgtcggcgccctgcgcctggacggggtggatcaggccgacgagaccctgcggacgatgccgttcaccgcggacgacctgtccgcgccggcccgcctcgtgggcaagctgcagggcgtcccgatccgggtccagagcggcggtcgcacgctcgaagggcgggtgctcggcgtgtccgagcggaatgccgggaccgagaccggcgacgtctcgatcctgaccgtcctgaccgcgaccggcacgctcgaatccgtgccgatcgaggacggcgcctccgtgacgatccaggactcggccatggcggccaagatcgccgaggcgatcgcggcggccgggaaggccaaggtcggcgacgcccaccgggtcgagatcgccgtctccgggcggggccagcgcgaggtccggttgacctacgtcgtcgccgcgcccgtctggaagacgagctaccgcatcgtcgatggcggcggccgcgcgaacctgcaggcctgggccatcatcgagaacgccctcggcgccgactggacgggcgtcgacgtcaccctctcgtccgggtcgccggtggcgctcctccagcgcctgcacaagcgctactggcgcaagagaccggaggcgccggtgatggtcgaggatgtcggcatgccggacctcgacccgggcacggtcgcgtcgaagtcggtcgcgcgcctgcgcgccccggcccccgccgccgcgccccttccggccccgatggcgcggatggacacccgcgacagccgcatggaggccgcggaaccgagctacgacgccgcggccgccaccgcgggcgccgccgccagcgagggggatgtcgcggcgaacttcacgctgccgcatccggtcgatctgcgcgccggcggcacgctgtcggtgccgttcctcgataccgagatcgaggccgagcgggtcgccctctggaagccgggccagggggttcacccgatcgcggccctccggatccgcaacagcgccggcgcgaccctgccggcgggcctcatcaccctctacgaccgcaaggccggctacctgggggacgcccgcctgcctgcgacgcccgtcggcgagcagcggctcgccagcttcgccctcgaccgcaaggtcgccgtccaggcggagaccgcgccgagcgacgccctgaccaagatcaccgtggtcgacggcgtggcgcgcgcgacggtgatcgcccgggaggtcacgacctacacgatcaagggcgcgccggacgccgcccgctccgtgatcatcgagcatccccgacgggatggctggaccctcaccgcgtccgcccgcgacagcgagacccccacggcctatcgcctcaaggtcgcggttcccgccggcgggacggccgagacacgggccgtgctcgagcgcgtccggatcgacgcgtacgatctggtcgacgccgacgaggcgctgctcgtccggtgggcctccctggcgaccgacccggagctgggcggcaagctcaagatcctctcccaggcccgcgccgaggtcgccgcggcgacccggaccgtcgaggagatcggcgagcgcgcggcgaaggtgcaggcggagcaggagcgcatccgcagcaatctcggcgccgttccgaaggacagcgagctggcgcgccgctatctcagccgcatgggtgcccaggaggacgagctggcgaagctcgatgccgcccggacccaggccgaggacgggctcagggcgtcgcaggcgcggatccggtcgctgatcgcggcgctctga

SEQ ID NO: 5438 - DNA, 537 bp, Methylobacterium sp.
atgtacaggatctcggcgatgctcgtcctggcgaccagtcccgcgctcgccgcgccggccgcggctggcgatccgggtacgcgcgcgccgttcatccgcgagcaccgctgcgccgtcgtggagcgtctcgacgccatccacaggcgcgggccggtcgacgtctcgcgcgaccgcttcatcgtcgtcgcgccgcacggacaggcgcagcgctacgtccagtgcatcttccaggatcgggatacgcggatgttctgcgaggccgcgtcgggcgcctacgggccacccggccgaaggcgcctgcggctggatgcgacggcccggcaggcgctggcggcgctcggatacgtccaggcggacccggcggagaactacgcgcgcctcgtggagttgggaacgccgcccgacatgggcatcgtcgcggacctgatgctggcggcgctgcacgatgcctacggcgcccgcccgggcgacattctcgatatcgaggccccgcacggcggaatgccggggcggggctgcggcgcgcccgtatcctga

SEQ ID NO: 5439 - DNA, 966 bp, Methylobacterium sp.
atgacggggcgcggaccggcccgcgcgacgcggcggcgtgtgctcgccggcggcgtgctggcgacgggcgcggcggcgtcgggcaccgtgcgggcggaggtccacccggcgcgggccggagaggtccgccacggcacggtccgggccgacggcgtggacgtcttctaccgggaggccggtcgccccgacgccccggtcatcctgctgctgcacggcttcgccaactcgtccttctacttccggcacctcatgcccaagctggccgatcgcttccgcctgatcgcgccggacctgccctccttcgggttcacgcacgtcccggaggatcgcgcctacgtctacgacttcgcgtcgctgtcgcgcacggcggaggcgttcgtcggcgcgctcggcctcgaccgctacatcctctacacgttcgattacggggcgccggtcggatgggacctggcgctcgcccatcccgaccgggtcgccggcatcgtgtcccagaacggcaacgcctatctcgacgggctcggcgacgcggcctgggcgccgctgcgggcctactgggccgcgccgaacgcggccgccgtcgcggcgatccgcgcccgcatgaccctcgacggcgtcagggccgcctacgtccagggtgtgcccgacccgtcccgcatcgagcccgaggcctacacgctcgacgcggccatcctggcgcggccgggcaatgccgaccggcaggtcacgctcaagctcgactacgagcgcaatctcgcgcgttacccgctgatccaggccttcttccgcgcgcgccgcccgaagctcctcgccgtctgggggcgcaacgacgcgttcttcatcccgcccggcgccgaggcgttccggcgcgacatcccggaggcgcgcgtcaccttcctcgacaccgggcacttcgccctggagacggacggcgacgcgatcgcggaggagatccggcgcttcttctga

SEQ ID NO: 5440 - DNA, 360 bp, Methylobacterium sp.
atggttgagccttcccgcacagaggaggaagggaaggcgcgcaccggcgcgtcctcctggcccgacaacctcccgccccgccccctggtgatcttcccgcgcggcgaggccgccctcgacgtgctctcgaccgtcccggaggggccgccccggcgcttccgctggcgcgcccggatccaccgggtcgcccatgccgaggggccggagcggatcgccgccgaatggtggcgcgcgcccggcgcggatcgcgactactaccgcatcgagtgcgaggccgggcaccggctctggctctaccgcgacggcccgcacgcccccgaccgcccggccgcgtggtacgtccacgggctgttcgcgtga

SEQ ID NO: 5441 - DNA, 930 bp, Methylobacterium sp.
ttgcgcatcctcgtcgccacagacttttcgacccgctcacagcgggccgtgcgacgcgccggcatcctggcgcaacagaccggagccgacgtcatgctgatgcacgtcgtgaacggagcgggttcccggcaggtcgcacgggacgttcgcgaggcgcagcgcatgaccgttgagcaggccgcggtcgtgccggaactcttccgcgtggactgccgctcgctcgtcgtccccggacgcctgcccgacccggtgctcaacgcggcggcggcgcggcaggtcgacctgatcgtggtcggctcagatcatggaaaggacgcgcaaggccttggccagacggtccgcgacctgatccgcgccgccccgtgcccgatcctcgtggtcaatcggtccgtcgtgggtccctacgccgaagtcacggtcccggtcgacctctcggccgcgtcggcgcgggcattgcacagcgtcgcgtcgctgggcctcgcagaccgcgcccgcgtcaccgtcgtccacgccttcgacgtgctgggcaagccgagattgtcggggttcggcattccgcgcgagcagatcgaaggctacgtcgagagttggcgctccgtgtacgcggaggagactgaagcctttctcgaagccgaggggctcgcaagacggaactgggtgaggcggacggaggaggggcgcccggacgaggtaatcgccagcctagcggcgcgaacctgctccgagctcctcgtcatgggcacgcgtggccggaccgggttcaggagggccctgctgggaagcgtcaccgaagccgtcctcgccgccggccaggcggacgtgctggtggtcccgccgccccggcccggctcatccagcaggtcggaacgatcaggatggcccttgtccgccaaggccgagcgcacggccctacaggtcgtcacggcgtga

SEQ ID NO: 5442 - DNA, 633 bp, Methylobacterium sp.
atgcatccctatgtctcggacggcctgcatgccgatcccttcgacgccttccgcgtccgcgcccatcgcggcccgatgggcggcgacccccgcggacggcacggtccccacggtcacccgggtcgcggtcccggcgagcgccggatgttcggccgcggcggccgcggcgacctcgcgcgcttcttcgcccacggcgacctgcgcctcgtcatcctccacctgatcgccgagaagccgcgccacggctacgagatcatcaaggcgatcgaggagcgggtcggcggcgcctacagcccgagccccgggaccgtctacccgacgctgaccctcctggaggaactcggccacgtcacggtgacccccggggagggcaccaagcggctgcacgcgatcacgcccgaggggcaggccttcctggacggcaaccgcccgaccctcgaggcgatcctcgcccggatggcggaggccgaggccgcccgggccgacggtcccccgccctcggtcgtgcgcgccaaggaggggctgaagctcgccctgcagatgcggctcgcccgcggtccgctcagcgccgagcaggccgccgccatcacggcggccctggaggcggcgaccgccgcggtggagcgggcgtga

SEQ ID NO: 5443 - DNA, 231 bp, Methylobacterium sp.
ctggccgagcgcgtcacgcacttggctgccgcgacgctctcggccaagcgccgcagcctggatcggcaactcggcgccatcctggctacgccgagccgctgtgacctgacccgcgacctgcaggccaagatcagccgcgcgcgcgatcagctcctggtgttcctcgcctatcccggacaggtcgagccgaccaataacggctccgagcggctgctgcgtccggccgtcgtg

SEQ ID NO: 5444 - DNA, 2034 bp, Methylobacterium sp.
ggttacgggttcgtggagcccggccccggatccttcatcgcgggcgctcagatcaccggcgggaacggcggtgccggcggtgccgccggcggtcccggcgcttccggcggtgccggcggtaacggcggcatcggactgttcctctacgggagcacgggcacgaacaccggccagatcacgggcggaaatggcggcctgggcggtgccgcgaacggtgggatggcgggcgtcgcgggccagggtggggccggcttgtccggcgcgaacatcgcgatcaccaacaccggcacgatctcgggcggcttcaccggcggcagcacaaccgtccgggccgtcgctatcaacgtcacgggcggcaccaacagcctgaccccgagcacaggaacgctgaacggcggcctcgggatcgccggcggcgccacgacattgcgcgtcctcggcaacgctcccaacaatctcggacccgtagccaacgccggcacgttcgacatctcggggaccacggccggcgcctcgatcaccacgctctcgggcaccggcgggacgacgctcggcgcgcagaccctgaccatcaccaatggttcgaccagctacagcggcgcgatctccggtaccggcggcgtggcggtcaacggtggcacgcagacgctgacgggggccagcacctactccggcggcaccacgatcggttcgaacggcggcgcggtgtcgagcacccttcaactcggcggtccgacctcggccggcacggggacgatcagcttcggcacgatgtcgggcacggcgacagcgcgcctggggctcaatgtggccgcccagccgaccaacggcggcaccttcgccaacaccatctccaacttcggttcggggaacgagatcgcgctcgccggcctgaccaactccagcgtcagctacaacagtgcgaacagctcgatcaccataaccggcacccgctccggtggcgggcaggtgagcgagaacttcgtgctgtcggccccccgaacgaccagcttcgcggcggtgtcggacggccagggcggcacgatcgtgcgcgccgctacggccccgaaccccacgaaccccacgaaccccaccaatccatctcagccggccaacccagctccctgctacgtgaccgggacgcggatccgtgtcctgcgcgatcgggtcatctcggacgtgccggtagagcagctcgcggtggacgatctcgccatcacggctgccggtacgccgcgcccgatccgttggatcggcacccgcgcgtacccgggatcgacggttcccccggccgagcgccccgtccgcatccgggccgacgcgttgggcgagggtgtgcccgcccgcgacctgcttgtttctccagatcactgcctgtggctggacgggctgttcgtggcagcgggacatctggtcaacggctcgagcatcacgcgtggcgagatggtggcggatctcacctactggcacgtcgagttggacacgcacgacctgctgctcgcggagaatgctccggcggagagcttcctggcggcacccggcgtgcgcgggggcttcgatggcgtacaggccctcgatgtcggcaccggacgcatgccctacgctgcgcgcgccgaactcggccccgacttggccgccctgcgcgggcgcttagccctccgcgctgtctcgttcgacggtgctgctgagccgggcccggtgcgcgcgtggctggaccgatgcgtcgtggcgggcgatggcctgctgcacgtcgggggctgggcgcgcgacgaggcgcaacccgacaccccgctgtgcttggacgtgttggtggacggtgtcgtcgtcgcgttcgcggtggcggccgagttcaggtcggaccttgccgcggccggtttcggcgacgggcgatgcggcttcgacctgggtgtggatgtacgcctcgcgccgcacgtgcatcatagtgtcgaagtgcgtcgctcggccgatggcctcttgatgtgtgccaagcggatggatgcgacaggggcttggaccgcactgttggcagcgtag

SEQ ID NO: 5445 - DNA, 156 bp, Methylobacterium sp.
atgatgcggcgcctggatggtttcgcccgcggcctcggtctcgacgaggcggccacccgccggatcgtcgagaagatcgtcgcagagatgccggaccggtcggacgaggagcggctcgacaccgcccgccagcacatgatcatcgcgtcggcgtag

SEQ ID NO: 5446 - DNA, 1581 bp, Methylobacterium sp.
atgggcgcgatctacaccgtcgagctgcaggcccataccgggtctgccgtcgagagcttctatgtggcgtcgggcgagttcaacacgggcccggccgacgtgccggcgcaccagcacttccacccgtcgctgcagaccccggccaacttcgagcgctccctgttcgggaacggcagtaccagcggcgcggccagcatcggcttcggtgagatcgtgatcgtcaacgcgcacggccggtacgatgcctggccggattacgccttcgacggccggccgtgcatcgtgaaggcgattccgatcgacgagcagaccggcaaggcggcgtgggcctacaaggatgcgccggtgctgatccgcggcacgatcgacagcctcgacatcaccgacgccttcacgacgatccggctccgcgtctacgatcgcctctcggacctggacaagccgctcctgacgcagcggtacggcgggacgacgctggcgggcgggcagggcgccgacggcaccgcggacctgaaggacaccctgaagccggcgatctacggcttcaaggccagcgtcagcccggtcacggtcaacccgtacgatctgatctaccaggtgtcgctgcgggcgtgcgtcagcatcgtggcgtacgacggcggcgtgcagctcaccaacgcgggcgacttcggcacggtcgctgcgctgctcgccgcgaccctcaccccgggcaaatacgccacctgcctcgcctccggcatgttccggctcggcggatcgcccgccttcgccgtgaccgcggacgtcacggcggccggggcggggaccgcggcggacatcgcccggcagatgctgctggacttcgggctcgccgggagcgacctggacacggcctcgttcagcgccctggcggcgaagaacccggccctgtgcggcgtcctggtgaccggcgacacctcggtgctgtcgtgcgtcagccaggtgctggcgagcgtcggaggctggatcatccccgacggccggggcgtgttcacggtcggccgcctcgagctcccgaccggccacccggtcgccctgttcgaggaatggcaggtcgaggagaagctggaacgcctcgcgcccggtgacagcaaccgcggcatcccggcctatcgcatcatcgtccggtacgggcagctcggtcggacgctcgcggattccgacgtggcgggttcggtgagccccgatcggacggccgcgctggcgctggagtggcgcgaggccaccgccgaggacggctcgatcaagggccgccacctgctcgcgcaggagatgaccttcgacacctgcctggtgaacgccgcggacgcgcaggcggaggctcagcgcctgctgtcgatctacggcacccggcgggacatctggcgcatccaggtcgacatgaccgacctggattaccgctacgaccagtcggccggcgatcccttcacgctgatcatcggcctcggcgccgaggtgcagctctcggcaccgcgcttcctcaacccgccaaagaacctgatcgtgatcgggcgggtcgaggactgcaacaagaaccgcattcagttcgatctctgggggtga

SEQ ID NO: 5447 - DNA, 471 bp, Methylobacterium sp.
ttgaagaagctgctccgcaaggcgcatgtcaaaccgctcaagcaggtggcggcgctgccgttccgcgtcggcgccgacggccggatcgaggttctgctgatcacctcgcgggatacggggcgctggatcatcccgaagggctggccgatgaccggccgcaaggcccatcaggccgccgcgcgggaggcctacgaggaggcggggctcgaggggcagatcgccgcgaacccggtcggccggtaccactaccagaagcgcttcgaccacggccgcgccttcccctgcatggtccgcgtctacccgctgcgggtcgaggcccagcacgaacgctggccggaacaggcccagcgcaccctgcaatggttcccgcccgaggaggcggcgcgcctcgtccacgaggacgagctccaggaactcctgacggatttcgcggcgcggccggtcgagatccgcggcgacgggcgcggctga

SEQ ID NO: 5448 - DNA, 1509 bp, Methylobacterium sp.
atggcagaactccgagaggggccggaagcgacggcgccgcccgcgttctcgaagcgccggagcctggcctggatgggattctgccagggcgggctgttcctggcacagttcggcacctcgctggcgctcgcgcgcctgctgacaccgcacgagaccggcatcttcagcctcgccgccgccatcgcgggcctgctgtccacgctgcgctcctgcggcctgtcgagctacatcgtccgggcggagcgggtggacgcggccctgctggcgagcgtgttcacggtgaacctgatgctgtcgggcgcggcggcgatcctgatcctggccttcagcgtgttcggcagcgtcctgctcggtgacccggaggtccagcgcgccctggccatcctcgccgtcgtgccgctggtcggcgcgctggaattccgcccggccgccatgatcgagcggcacggcaatttccgcggcgtggccctcgtcaacatgctgcgcggtctcgtcgccagcggcgcgatgctggcgctggcgctcctcggcttcagctacatgagccaggcctacgggcaggccgcgggtgccgtcgcggcggcgctggccgcgaacggcctcgggctgcgctacgtgtcgctgcgcctgggcctcgcgggctggcgcgagatcctgacctacggcggtcgactcttcgccatcgcgggggtcgcggggatcgccggccggatgggcgacctcgtcctcgggcggatgctcgggctcagcgccctcggcctgtactcccgcgcggcgagcctcaacaccctgatgtgggaccacctgcacgtggtgatcacgcgcatcaccttcgtggacctcgcgaaccagcagcggaacgggcagtccctgcgcacctgctacctccacacgctgcggatgatcaccgtgctgctctggccggccttcgcgggcgcggccgtcctggccgggccgatcgtgcgcgtcctgctcgggccgggctgggagggcgcggcgctgcccttctgcctgctgtccctggccgcgatcgtcctcacctcgctcagcatgacctgggaggtgttcctgatccgggaccagaccgccctgcaggcgcggttcgagttcctgcgccacggcgccggcctcgtgatgttcagcatcggctgcctgttcggcctcgggggcgccggcgcggcccggatcggcgaggcgttcctggccgtcggcctctatcggccgcatctcgagcgcatgaccgacacgttcaggcgcgactacgcccccatctacctccacgccgccaccctgacggcggtcgccgtcgcgcccgccatcctggtgatgtcggcctggggctggtcggccgagacgccgctcccgagcctcgcggccgcgatcgccgcgggcatcgcgggctgggtctgcggcctctggtacctggaccatcccctcgtcgcggaagcgcgcctgctgctcgcgcacatgcgcccggcccgtccggccacgaccgtgtcggatctctag

SEQ ID NO: 5449 - DNA, 789 bp, Methylobacterium sp.
atggccatggtgacgatcagtcgacgccgcgcgctcggggcggtcgccgccggcgccgccgcgggcctcggccccgccgcggccgccgaggcgcagccggccccgctcttcccgctgccgcaggccaccgtcccgatcctgggcgaggcgcaggtcttcccggtccgccggatctactgcatcggccggaactacgcggcccacgcccgcgagatgggctccgacccgtcgcgcgagccgcccttcttcttccagaagccggcggatgccgtgcaggtcgtcgcgggcggcgtcgccgaccatccctacccgtcgctgacccagaactaccaccacgagatcgagctcgtcgccgtgctgaagtcgggcgggcgcgacatcccggccgcgcaggcgctcgaccacgtctacggctacgccaccggcctcgacgtgacccgccgggacctccagcgcggcatgggcaaccagaagaagccctgggagatcggcaagagcttcgaccagtccgcgccgatcacgccgatcctgcccgtcgcccgggtcgggcatccggcgcgcggccgcatccggctcgccgtgaacggcaccgtgcggcaggacgccgacctgtcggacatgatctggtcggtcgccgagcagatcgccgagctgtcgcgggccttcgagctgaaggcgggcgacatcgtcttctcgggaacgcccgagaatgtcgggccggtcgtccgcggggacgtgctcgccggctccatcgagggcctgccggacctgtcgatccgcatcgtgtga

SEQ ID NO: 5450 - DNA, 354 bp, Methylobacterium sp.
gtgcggcgattctggatctcgaccatcctgggactcgaactgctcctcggcgggaccctggcagcctccgcccggacggcgggggttccggacttcaacatccgggcgatctgcgcgccggagcaccgggcgggatcgaccgccatcgaccaggcgagctaccgcggttgcctgtccgacgaggccgccgcgcggcgcaccctgatcaagcgctgggcgacgttcgacgtggcggagcgccggacctgcgcgacggagagccagatcggcggcgccccgtcctacgtggcgatgctgacctgcgtgcagctcggaagcgacgccctgccgatcaacccgccgggtcagccctga

SEQ ID NO: 5451 - DNA, 2184 bp, Methylobacterium sp.
gtgcgggccagctcttctcggaaacgcaagatcctcgtcgccgaccttctatgcggtgccggcggatcgtcgaccggctgccagcgcgcgctcgccggcctcggcctggagatggaactggtggcggtgaaccactggcccaccgcgatcgccacccacaccctcaaccacccggccgcccgccactacgtccaggacatcgcgacggtgcgcccgcacctcctggtgccggagggctacctggacctgctcatggcctcgccgacctgcacccaccactcggtggcgcgcggcggcaagccgacctcggaccagcagcgctcggatccctggcacatcatcacctggctcaccgagctgcgggtaaagcggctcatcatcgagaatgtctgggagttcacgtcctggggcccggtcgaccaccgcaccggcaagcccgtggcctcgcgcaaaggcgagtatttcaacgcctggatcgacacgctgaagcgcctcggcttcaagccggagtggcgcaagctcaacgcggccgattacggcgacgccaccacccgctcccggttcatcctcatggcgcggtcggacggcaagcgtctggcctggccgacgccaacgcaccgccgccgcgacgagatggccggcgacctgttctccggctcgaagccatggcgcccggcccgggagatcatcgactggtcgatcaagggccgttcaatcctcggccggaagaagccgctggcgccgaagaccctggtccggatcctggccggtgccctcaagttcaagtggcccgcccccttcctcggcctgctgcgcgccgagctggagcggtcgctggcctatcacctgcgctggacgctgtcggtccgcaacgcgccgcgctcgcgcgtcgatcggcacaagcgccgcctgctcgcccgccgcctggtctcgcagctccggcaggctcgcgccgacgctcgcgcccccgcccagtcctcgcccgtcgccgacccgatggtggtcaccctgcgccgcaacggcgccggctccgacgtcggccggccgatcccgaccgtggcggcctgcggcacgcatatcggcctcgcccagcccgtcatcgtcaacatgaaggggcggtcgaccgcctcggacgcgaaccagccactgccgacccagaccgcgcacgcgccgcacctcttcgccgccgagccgatcgtcgtctcgaccgcgcatggcgtcgatgctggcgaggccgatccgcacagccgacgctcccgcagcgtcgacgagccgctgggcaccgtccacgcgggcggcggcaacttcggggtggccgagcccttcgtggtctcgccgcgccacagccgcgagggggccgggcccggaccgcgcgccgtcggcgagccgctgccgaccgtgaccgccggcggaagccaggtggctgtggtcgagccgctcgtgctgtcccgccacgcgggcggcgcggcccgctccgtcgaggagccgaccccgacccaggtcgccaagcactcccacgtgctgatctcgccctattacgggcacggctggcaggagagggccggcggcgcgccggcctgcctgaacggcgacgagccgcttccgaccgtgacctcgaagggccggttcgggatggtcgtcccggtgtgccagtccggcggcggcgcggccgcccgcgacgtcgaagacccagtgccgaccatgacgaccgccaagggcggcgagttcggcttcgtcatgccggtcacgcaccacgacggcagcgaccgggcacgcgatccggcttccgagccgcttccgaccgtcacgggcgccaaccgcggcgagctggcgttcatcgccgcccagttcggcgagcgcgagggccaggcgccgcgcgtccacgacatcgaccagccctcgccgacgctgtgcgcgaccggccgggtcaacctggtccagggcaccgagggctacgacattctgttccggatgctggagccgcacgagctggccgccgccatgggcttcaacgacgaggagcggcggtacgagttcaccggcaccaagaccgagcagatcaagcagatcggcaacgccgtctcggtcgcgaagatgaaggcatgcgtcggcgccatcatggccgacaccgtgccggccgcgcgggacttcccgctctctatgcccctgatcgccgcggagtga

SEQ ID NO: 5452 - DNA, 285 bp, Methylobacterium sp.
atgctctacatggtccacatgcaggtcaacattccggcgtccctcccggacgaggaggtggctcgcctgaaggccgaggagaaagcctacgctcagaagctccagcaagagggcagatggcggcatctctggcgcatcgccgggcagtacgcgaattacagtgtcttcgacgtggcgggaaacgacgaacttcacgaactcctgagttcgctaccgctctacccgtatatggcgatcagcgtgacgccgctggcgcagcatccctccgcgatcgcggcaaactga

SEQ ID NO: 5453 - DNA, 810 bp, Methylobacterium sp.
atgagcagcgcggtcaccgcgaccgggatcaccgggcggacccgggtctacgggatcctggcggacccgatctaccacgtgaaggcgcccgaggtgatgggggcgctcttcgcccggcacggcgtggacggcgtcctcgtcccgctgcacgtggcggcggacggcctcgccgccgtgatggacgggctccggcagctgcgcaatttcggcggtttcatcgccacggtcccgcacaagaccgcgatgaccggcctgtgcgacgcgctgacccgcgaagccgagcagatcggggcggtcaactgcgtccggcgggaggcggacgggcgcatggtcggcacgatgctcgacgggatcggcttcgtcgaggcgctgcgcggctcgggcctggagccgcgcggccggagcgcggcgctggcaggggccggcggtgcggcgagcgccatcgccttcgcgctcgccgaggccggtgtcgcccgcctgacgatcctgaaccgcaccgcggaccgcgcccgagcgctggcggaacgcctgcgcgctgcctatcccggactggcggtcgcggccgaaggcgtccaggcggagcacgatctcctcgtcaacggcacgtcgctcgggatgcgcccgcaggacgccgctccgttcgacctgggcgccctccacgccggccagttcgtcgccgaggcgatcatggatccggagaccacgccgctgctcgccgccgcgctgacggcgggctgccgcgtccagaagggcctgccgatgctggaatgtcagatcgcgctgatggcccgccacatgggcgccctctga

SEQ ID NO: 5454 - DNA, 1050 bp, Methylobacterium sp.
ttgcgcaaggcgaccgccgccttcggggcggacctcgtccacgtcgatgcgcccgctgccccgggcgcgggacgcgtcaccgtcgcggtcgccgcggccggcatctgcggaagcgacatccacgccttcgagtggaccccgggctacgggttcatgaccgccttcatgccggtcactctcggtcacgagttttccggtacggtccgggcggtgggcgacggcgtgaccgcgctcgcggtcggcgaccgggtcacctgctggccgacggtgccgtgcggcgcctgcgcggcctgcggagccgcgcggccgcaggattgtcagggccgacgcgtcgtcggcctgcacgccgacggggccttcgccgagcagatcgtcgtcccggccgacaattgccgccgcctgccggacgggctgccgctgaccgtcgcggccttggccgagccgctggcggtcgcggtcaacgcggtggacgtggcggaggtcggtcccggccaccgcgtggctgtgctcggtccgggcccgatcggtctctgcatcgccttcgtggcacagcagcggggcgcggacgtgctgctcgccgggctcgacgacgctgcgcgcctcgacctcgcccggcggatcggcatccgcgacacggtcgatctcgccggcatcggcctggacgacgccgtccggcgcgccttcgacggggaggccgatcgggtgatcgaggcgaccggttccgcccggtcggtcagtgacgggatggccgtcctgcgctcgggcggcgtgatggtggtggccggcatccattccggctccctcgacctcgacctgacgggtttcgtgcgcagcaagaagcagctgcgcgcggcccacgacacgacggcgcgcgccttcgacgccgcgctcgcgctcctcgcggcgcatgccgggacgctggaggcgctgatcacccaccgccgccccctcgcggatgccggggcggcgttcgagctggcgcgcagccggcaggccatgaaggtgctgcttctcccggaagcggcggcgagccgggaggcggagcaatga

SEQ ID NO: 5455 - DNA, 594 bp, Methylobacterium sp.
ttgctcgacctccgggaacgggccgcgcgcttcgcgcgagcgcgcgggggcgcgacggccgtggagttcgctctggtggccctgccgttcttcgcgctggtcggggcctgcctcgagaacgggatcgtgttctgggagcaggagatcctccagcaggcggtgtccgacgccagccggcagatctacacgggcacgttccagacgacgaacgccggcacaaccgaccccgcgacgctgatgagccgcttccggacggcgatctgcacgcagccgaacggcacgccccgggtcacgatcttcacctgcgccaacgtccgggtcagcgtgatgaaggtggccgattacgggtccgccaccccagtctcgccggtcgcgaccaacgccagcggtgcgagcgactggaatccgaacttcgccagctacgcctgcgccggaaactcggccatcgtgatcgttcaggccgcagtcgacatcccggtcttcttcccgctgctcggtgccgccgtgcccaacctgccgaacaagcggcgggtgctgcaggccgcgacggtgttcaaggtggaaccctacaccgcgccgtcggggtgctcgtga

SEQ ID NO: 5456 - DNA, 204 bp, Methylobacterium sp.
atgaaaacagtcgtcgccaccgtcgtggtcgtcttattctgcgccggcgcccgggccgacgaactgaacgacatgccggacatcgcgtgtgcccaagcttcgtccgccgtggagcgcgatcacatcgggtgcccgggcaccgacaaggcggccgcggggtcccgggcggccacctcgcccctcgaccacgcggaagacgactga

SEQ ID NO: 5457 - DNA, 417 bp, Methylobacterium sp.
atgccggcggccggcggctcgccggcaggcctgcgcctcacctgcaccgacgcggccggcctcttggcgcggatcgccccgcggatcggccgctacgccaccctgcgcctcgcgctggcgggcggcgaggccgtcctgttcgcccccgacacgggcccgggccggccggcgcttccctggtgcgcgacgccgctcgggtggctggcggccgacgggccgctgctcctgcccttcgggtgccgcctcgccgtgccggcgccctggcgcgccgaggtcgcccgccgcctgctcgaccggcacgggatgagcggtccggccctgctcgttcccgagggcgaaaccctgcgcctgctcgacctcgccggttcgcgcgccttgccggacatcgacaccggtcgcctgggagaggcggcgtga

SEQ ID NO: 5458 - DNA, 516 bp, Methylobacterium sp.
atgctcgccgtccgcctctcgaaggtcgccctcgtcggggccctggcgatgacctgcacgctggtcgtgtacggcaacgtcacggagccggcggtgaacctcgccttcgtgcagcacgtcctgtcgatggacacgatcctgccggattcgggcatcgccgaccgcgcgatcacggatccggcactgcagcgcggcgccttcgcgatgatcgtcgccgcggaggctgtgacggcgctcctgctctggatcggcgtcgcgctgatgctggcgcggcttcgggccccgcgcggcgacttcgaccgggccaagacctgggcgatcgccggcctgagcgtcggcttcctggtctggcaggcgggcttcctgggcatcggcgccgagtggttcggcatgtggatgtcgaaggtctggaacggccagcaatcggccttccgcttcgccatgacggtcctcggcgtgatgatctacgtcgccctgcccgaggccgaggatccggaggcgagcggcagaggctga

SEQ ID NO: 5459 - DNA, 1218 bp, Methylobacterium sp.
atgtcccgcacgtccccctcggccatcgaccgcgcgcccgtcgccgaccggtcgggcaccggcaatgtggtcaggctggccgtcgcgcaggccctcgccggcgcgaactcgaccgtcgtgttcgcgacgggcgccgtcgtcggcaacatgctcgcgcccagcaaggtcctggccacattgccgatctcgatcttcgtggtcgggatggccgcctgcgcccttccgaccggcagcatcgccaggcgccacgggcgccgcaccgccttcatggtcggcaccgggtgcggcgtgctcgtcggcctgctctcggcctgggcgatcgtcgcggccagtttctggctgttctgcgcggcgatgttcctcggcggcgcctacgcggccgtggtcttctcgttccgcttcgccgccgcggattgcgttccggccgaccgccgcccgcgggcgctgtcggccgtcatggccggcggcgtcttcggcggggtgatcgggccgcagctcgtcacccacaccatgaacctgtggcctccctacctgttcgccgcgaccttcctggcccaggccgccgtcgccgccgcggccgccctgatcctggcgggcgttcgcctgccgcggccggctgccgggtccgtctcgggcggacgaccgctggccgtcatcctcgcgcagccgcgcttcgtgatcgcggtgatctgcggggccgtgtcctacctcctgatgaacttcgtcatgacggccgccccgctggccatgcgcctgtgcggccacgcgcaggaggatgccaatctgggcctgcagtggcacgtcatcgccatgtacggcccgagcttcttcaccgggcggctgatcacgcgcttcggcgcgtcccgcgtggtggcgaccggcctaaccttgacgggggcggccgcgctcgtcggactcgcgggcgcgcacgtcgggcatttctggctgtccctcatcctcctcggcgtcggatggaacttcggcttcgtcggcgcctccgcgatggtgctggactgtcatcgcccggaggagcggacgcgggtgcagtcgatcaacgacttcatcgtgttcgggatggtggcggtcggttcgttctcgtccgggggcctgctcacgagctacggctgggacacggttctctgggtgtccttcgcgcccttggcgctggccgcgacggcgctcgcgctcacgacagggcgcagcgcgaaggcgtggtag

SEQ ID NO: 5460 - DNA, 678 bp, Methylobacterium sp.
atgaagaaccggaccatcgcgggttcgatcgggaccgagatccggcggcgcatcctcgacggccgctatccggccggctcgcagctccgccaggacggcctcgcggcggagttcggcgccagccggatcccggtgcgggaggcgctgttccagctcgaggccgagggcctcgtgcggatcctgccccatcgcggggccatggtggcgccgctctcgccggcggacgcggccgaggccctcgagctccgggccgccctcgagccgcgcctcctggccctctcggcgccccgcctgaccgacgacgactacgcccgggccgacgccctgctggaggagtacgccgcggccctgcgggcgggcgcgacggcgcgctggggcgccctcaacacggagctgcacctcctcctctacggccgggcggagcggccccgcgccctcgggctggtcggctccctgctggccgagtgcgaccgctacacccgcctccagctctccaccgacagcgcggagctggagcgggccgaccgcgagcaccgcgagatcgtccggctctgcaggaacggccacgcctcggccgcctgcgccctcctgacggaccatatcgaccacgtcgccgcggcgctgatggcgttcctcggcgccgcgccgggcccggcccgcgcgacagatattgtataa

SEQ ID NO: 5461 - DNA, 2862 bp, Methylobacterium sp.
gtgacgggcaccgtcttctcgcgttccctgcgcgcgcgcctcgtcggcgccacgctctcgacggccgcgatcgcgctggcggcgttggttttcctggtggttctgcgctccggccagacgctccgcgagcaggcgcaggaggtctcgacctggtccgaggcccagctctccgaccgcctgctgagcgacgccaagctcgccgcggcgcggctgcaaatgcagcgcgaggacgtcgagcggcgcttcgccacgatgtccaagcgctgggacgtcgcgaaggcggtcttctccggcaacacggtggcggcctcggagcttctgcggccggcgctcgccctcgccgatctcgacggcgccatcgccttcgacctcaatctccgggccttgaccgccgaccgcgtcgaggcggacctcctcgccgccaacgcggctttccggacgtcgcccgtcgcggcgtccctgcgcgccgtgctcgcccgcaacgatcgggagcacgcggacggcttcgtgatgtcgctgcgctgggacgacgcgctcgcccgggcgctcgcagccaccgagagcggcacagtcgccgacgtcttcggcgagccgctgttcgacgatttcggcgaggtgatcggcggcctcgtcgggtatcgggtcctgcgcgcgcacgagccgaccctcacggccttcgcgtccctcagcaaccgcgacgtcctgatcctcgccgaccagagcctactctcctcggcgggctcggaggtctccaacgcccagctcggacccccgtcgggcgctgagctgcacgacgtgctcggcgccgagaaggtcgcgcgctgcatcccgcagccgcccgacatccgcctctgcgtcgcggcgccgctgcgggagctgcagcaactcaccggcaaggtcgtgggcatcggcgaggagagctcgcgctcgctgctgcggacgctcagcgtcgtcgccggcctcacactgtgcctcgtcgccgtcgtcatgctctttctgtcgagccggatcacccgtcccctggtgcgcatcacccagacggtctccgaggtcgcacgcggcaactggcacgtcagcgtgcccgatatcgaccgcgccgacgaggtcggcgatatcgcgcgggccgtcgtcgtgctcgagcattccctctcggagcgcgatcagctgcgcgacgacgtgttccggcagaacacggtcctgacggagcgcgagcggcagctgcaggagcagaacgagcgcttcgacgccgccctgaacaacatgtcccagggcctctgcatgttcggcgtccacggccggctcaaggtctacaattcccagttctgccgaatctacgggatcgccccgggcgtgctggatctcgaaccgacacaggatgaggttcaccggctcgccggtctcacggactggtcggccgcggagagcgggccgatccgccgaaccctcacccggacgctcgccgacggccgctgcatcgagatcacggtcgagccgatggccgatggcggctgggtggagacccacgaggacgtcaccgcgagcgtcaccgcgcaggcgcggatcgcgcatctcgcgacccacgacgcgctgaccggcctctcgaatcgagcgctcctggccgaccgcctggccgccgccttcgcggaccatgcggtcggcggccgggcggtgaccgtcatctgtctcgacctcgacgacttcaagggcatcaacgacaccctcggacatccggccggcgacgaactcctccgacaggtcggccgccgcctcaccggactgtgcccgtccggcggcacggtggcgcgcctcggcggcgacgagttcgcgatggtcctcttcgaggcagacctgccggacggcgtcctcgccctggcggagcagatcctgatccagctcaggcggccgttcttcctcgccggccagttcgtggccgtcgacgggagtctcggtatcgccgtctccggcacggaggatgccgacggcgacgatctcctgcgccgcgccgacgtcgccctctacgccgcgaaggccgacggcggtcggcgcgtccgcgtcttcgagcaggagatggaggagcgtcagaaccagcggcgctggctggaacgcgagctgcggctggcgatcggcaccgcgcagatcgagctgcactatcagccgctgttcgacctggcgacgaacgcggtgacgagcttcgaggccctcgcgcggtggcaccacccggaacgcgggatgatctcgcccggcgagttcatcccggtcgccgaggcgacggggctgatcgacgccctcggcgcttacgtgctcgaacgggcctgcgccgatgccatgacatggcccggctccctgcgggtcgccgtcaacatctcgccgatccagttccgcgagggcaatctcgaccggtttgtcgaggaggtcctgctgaagaccgcgctgccgagccaccgtctcgagctggagatcaccgagtcggtcatcctgagccaggatcaggcgagcctcgagatgctgagccgcctgcgccgcctcggcgtgcgattctcgatggacgatttcgggaccggctactcgtccctctcctcgctgaacacgttccgcttcgacaagatcaagctggaccagtccttcgtccggaaccttctggagaaggacgaggcagcggcgatcgtccacgtcgtcgccgaactcggccgcagcctgaagatcacgacgacggccgagggcgtcgagaccccggagcagctggcccggctgcgggcgagcgggttctcggaggtccaaggctacctgctgagcaagccgattccggccgccggcgtggcggccttcatcaacgcgcaggagcatatccacgtcgcggcctga

SEQ ID NO: 5462 - DNA, 810 bp, Methylobacterium sp.
atggcactgttattcacgtctcttcggcgcgtcatcgcgggtggaatcatcctccttgccctgccggccgccgcgcgcgcggacgacctcgcggtcgtcggcacgggcgacgggatcgagatgctccaggccgtggcggccgcctacaatgccgagagcggcgacgcacgcgtgtcggtgccgccgagcatcggttccggcggcgccgtcgcggccgtgggcggcgagcgccagaggctcgggcgggtcgcgcgcccgctcaccgaggccgagaaggcccagggactcgtggaggtgccgctcgcccgcatcccctcggcgatcttcgtccatcagggcgtcggcgtcacgaacctgaccagcgcgcagaccgccgcgatcttcgccggcacggtcgacaattggagcgccctcggcggccccgatctcaagatccgcgtcgtccggcgcgaggagacggacagcacgctcacggtcctgcgagccaccatgccgggctggcgcgacctcgccctgaccagccgctcgaagaccgcgaccacgacccaggacgcgatcgccacggtgcgggagacgcccggcgcgatcggcttcggaccgtactcgccggcgctcgcgggcgatctcgcggtcctgacgatcgacggccgggccccgcgcgatccggcctatccgagcgccgtgaccctcgcgctgatctacaaggccgccacgcgcgacgccgcggcgtcggcgttcctcgccttcgcgacctccgatcgcgcgggacaaatcatggcggagcggggcggcaccccgctcaggccgtga

SEQ ID NO: 5463 - DNA, 1038 bp, Methylobacterium sp.
atggccgatcgcgtcaccctcgtcatcaacggaaggcgggtcagcgccagcgccggccagaccctgctcgacgcgggtctggcggccggccaggcgatcccgcacgactgcgccaccgggcagtgcgacacctgccgcgtccggatccatgcgggcgcggtcgacgatgcggggacgcgcatcggcgagaccgtgcaggcctgccgggcccgcctcaccaccgacgcggtcatcgagttcgacgaggttccggaaaccgtccggcggaccggcaccgtggaccgcgtcgtcgatctcaccgccgagatcgtcgaggtgacggtcgcgctgcgcaagcggctgacctacctgccgggccagtatgtccgggtctccttcgccgggctgcccgcgcgggactacagcccgaccctgcgcgcggacggatcgggcgaactgaacgaattgatcttccagatccgccgccagcccgacggcgcggtctcgccgctgctcggtggcaggatcggaccgggaaccgcggtgaaggtcgagggcccgttcgggaccgccttccaccggctcgggcgcggccgtctcgtgatcgtctcatcgggcgtcggctgggcgcccgcctgggcggtcgcccgcgcgagccggatgcgcgagccggagcgcgacctgctcgtcgtggccggcgctcggcacccgcagaacctctacatgcgcccggcgctcgactggctgcgcgagcggggggcgacgacggtcctgacctgcagcggcggcaacccgcctccggatgcccggcccgggcggccgacgctccacatgccgatgctcacgcgcgacgacaccgtcctcgcggccggcgcccccgagatggtcgcggctgtccagttcctcgccgcggcaaccggggcgacctgctacgccgatcccttctacgcggccgcgcgcggcgcggacgggaagccgccgtccgacacgaacttccttcagcgcttccttcagcgcgtcgcgggtcatcggaccgctaaaacggagcctgtcgcctag

SEQ ID NO: 5464 - DNA, 1773 bp, Methylobacterium sp.
atgtcggaaccgctgaccctcgcgccgcatccgcccggcggagccgagaccgcccccagctggcgcagcgcgcccgccgtgcaggtcgaccggcatccccgctccgatgtcgggacgatcgtgatccactgggtggtcgccatcgccatggtggcgagcctgctcacgggcctgcgcatctcggccgacgcgcccgtggcacggaccgcgaagttcctggcgcccctgcttccgcaaggggaagtctggaccgtccacttcgtggcgggcctgaccctgttcttcggcatcaccgcctatctggtctacctcgtgcgcgggcgtctcacggatcgcaacggcctgtcgcggctccgcgccctccgtgtcagcgggcgaagcagggccgcccggaaggcccggtggggcggcatcaacgtcgcgctgcactggctgatctacgccgtcacgctcgtcctgacgggtaccggggtcgcgctctacctcggctacggcggctgggtggtctggctgcacgccacctgcgccctggtcgccctggcctacattgcggtccataccctcgcgcacttcatgtacggcggcctgtggcagctcctgcggctgttccgtccggcggccctggcggacggtgcggcgcggcggcgacgcccgctcctggcggcggccgtcatcggcctccccgtcgtcggcggcctcgccttcgcggacgtgaagggccgttccacgctggtgatcgacaaggtgacggccgggcccgacctgtcgaagctcctcgacgacccggtctggcgcaccgcgcgccccgtctcggtccggacgatacagggagccaatttcggcgggaccggtgagacgaccgtcgagatccgcgccgtgcgcgacgcgacgaacgtgtatttcgccttccgctggtgggatccgtcgcgctcgctcaagcgcgtcccgatgatcaagaaggccgacggctggcacctcctcgacgcggacgcggcgcgcgcggacgtgaccgcctactacgaggacaagctggcggtgatcttctcgcggtccgacgcgttcggcagcggcgggtcgacccatctcggcgcccggcccctgcccgacgcgcccgccccgctcaacggccgcggctaccactacaccaccgacggcagctacatcgacatgtggcagtggaaggcggcccgcggcggcatgctgggcgtcgtcgaggacatgcatatcggcccgcccaccgaccccaccgccgccgagcgggccgtgaagggccgctaccaggccggttactggggcgatcccggcaccagcgcgtaccgctacaacttcaagttcgagggccccggcggctacgcgggcgcggtcgagccgctgcggcttcccaaggattggcaggcgacggtggccaagctcggcaccgtggatctggacttcgatgccagcacgtcgccgggctcggcgtggtggatggtcgagaagaccgagacggtgccgtactcggcggccgccgacgcggagatcccggtcgggaccgtgatgccgggcgtgctcatgaccgacggctatacgggggaccgcgccgggatctcggctgccgccgactgggccgacgaccactggaccctggtcgccgcgcgcaagatcgcgaccggcagcaagtacgacgtcgatttcctgcccggaaacaccttctacctgtacgtctcggccttcgatcacacgcagacgcgccacacgcgtcacatgcggccggtcgaagtccttctgcgctga

SEQ ID NO: 5465 - DNA, 2253 bp, Methylobacterium sp.
atgtccggcctggagatcgacttcgagacgcgctcgcccgtcaacctcaaggtcgagggcgtctaccgctacatggagcacccggagacggcgcccctgatggcgagctacacgatcgacgggggcccggtccgccgctggcgcccgccggagccgtgcccggccgacatcgtcgcccacgtcgagaagggcgggacgatcgtcgcgcacaacgccggcttcgagcggctcctgtggcagatgatcctgtcgaagcgctacggctggccggcggttcgcctccggcagttccgctgcacggccgccaccgccgccgccctgtcgctcccgcgcgacctggatgggcttggagtggtgctcaacctgtcggtccagaaggacaagatgggcaagacgctgatcgaccgcttctcgaagcccaggaaggtcacgaaggctgacgtggagcgctaccagggcaggcccatgccggcgctctttcacgagccgggcgacttcccggaggagttcgagcgcttccacgactactgcgacgtggacgtgctgacggagcaggcggccgatcggcgcatgatgccgctccggaccgaatgccaggaggcctactggcggtccgagcagatcaatgaccgcggcctgcggatcgacgtggagagcgccaaggccgcgctgctcctggtcgaccgggcgaagcttcggctcgatcgcgagatgcggcacctcacggaaggggaggtcgaggcctgctcccaggtcgccaagctcaaggattggtgcgcggtccggctcggccagggcccagcgatgcaggcggccctggagttcttcgacggcgtgctgccggaaggggagggcgaggagatcgccagcctgggcaaggccgacatggacgacctgctggagcgcgaggatctcccgccggccgtccggaaggcgctggagctgcgccgcgactacgccaaggcctctacggccaagatcaaggcgttcctgtcccgcgccggccaggacggccgcatccggggcgcgttcctgttccgggccgccggcaccggccgctacagctcgacgggcgcccaggtccacaacctgccgcggccccgcaaggtgttcgacgacgcgcacctcgacccgcgcgacctgttcgaggcgatccggaaggcgaacgtcgagtggctggagatgctctacggcgaggagctgggcaagccgctcccgctgctctcggacagcattcgcggtttcatctgggccgacccgggcaaggagctgctcgctgcggactacagcggtatcgagggtgcaatccaggcgtggtttgccggcgaggaatggaaggtcaaggcgctattcgacctgatcgccgacccgagcctgcccgatatgtaccggcgggccgcggccggcatcttcaacacgaccacggatctgctgacgaagaaggacaagcgccggcaggtcggcaaggtgtccgagctgagcctgggctaccagggcggcgtcggcgccttccggagcatggcccggaactacgccatgaagctcgggcccatcttcggccctgcctgggaagccgcggacccggagcgccgcgagcgcgccgccaagcgctacgaggagtgctgcgaacgcggcgagctgctgacgaagcagctcacccgggaggagtggatgggcgccgagctggtcaagatcggctggcgcgccacgcacccggcgatcgtcgcggcctggaaggccctggaggaaggcacccgcgaggcggtctcgagccccgggacgcaggtccaggtgctcaaggtgtcgttgctggtcgcccggggcttcctctggtgcaagctcccgtccggccggtgcctcgcctacggggcgccctcgatccgcgaggtggaggtgccgtgggccgacaaggccctgacgccggagctgcgcgagaagcgcccggtcgtgacctgcctgggcgtcgacagccagacccgcaagctggtgcgctacgcgctctacggcgggctcaccttcgagaacatcgtccaggccatcgcgctcgatctcctggacaacgggatcgagatcgccgagcgcgccggctaccccgtggtcgggcacgtccacgacgagatcatcacggaggtgccccggggctggggcgatctcgcgtggttcgagaaggcgatctgtgaattgccgggatgggcgtgcggtctgccgctgactgctggcggatggcgcggcaaacgctacagaaaagactag

SEQ ID NO: 5466 - DNA, 243 bp, Methylobacterium sp.
atgcccggcctcgccgaggatgactggctgatctactacgaccagcgtgtccgcggtttgcccgatgagtggatcggacagctctgcgttgtgtggatctcggaggacgaggtctatgtgaagaaggtgtttcgcggacgcgacagtggcccgtatctcctcgtctcgacaggcggattgccgcctatcgaggtcgaggaaatcaactggtccgctaaggtcgcgtggatcaagccgcgctag

SEQ ID NO: 5467 - DNA, 786 bp, Methylobacterium sp.
gtgtcgtccatgaacttcgtgaccgggaagacgacgtccgtccgcgccgccgagccgggccgcaagcgggcgcggaaggccgtgaaaggggcgtcccagggggcttcccaggaggcctcccacgccgcgggcggcgacgacgatctgcccgacctgacgctgaccgaccgggcctaccagcagctggaagagatgatcacgaccctggtgctcccgcccggcctcgtgctcggcgagcagaacctggtccaacggctcgggatcggacggaccccgattcgggaagccctccagcgcctcgcgcgcgacgggctcgtcgtggtcatgccgcggcgcggcatcctggtgtcggacatcaacgtgcgctcgcagctgcggctcctggagacgcggcgcgtcctggagcgcctgatcgcccgcctcgcggcggagcgttccacccgggaggagcgtgaggtcttcgcggggctcgcgcaggacatgcgcgacgcggccgcggcgtcggacgatctggcgttcatgcgcctcgaccggcagttcaacgagctgatcgcgacggcctcgcgcaacgagttcgccgtgcgctcgctggagagcatggcgggcctgtcgcggcggttctggtaccagcactacaagcaggcggccgatctgccgctgaccgccaacctccacgcggacgtctgcgaggcggtcgcgcgacgcgacgtcgaggctgccggcgccgcgtcggacaagctcgtcgactacatcgagagcttcgcccgcaagacgttggatctctga

SEQ ID NO: 5468 - DNA, 558 bp, Methylobacterium sp.
gccgagccggtggcggcgcttcttcgggattggaccgcggccaacggcctctgccgcggcggctccggcgacgatccgcgcacgcaggcggcctgcgagcggcgcgacggcctcgatcgccggctcgccgccgcgggctggtgctacggacgcccggccgacaccggcgcccagagaacctggcagccctgcggcgtcggcacgcgacagcctgcacaggccgggacggagaccccgcagggcgcggcgcggcgcgccctgctcgatgtcgcccgcggccccgcggaggccgggcggggacagccggtgcagttcgtcgtgcacgccctgaaccgagtcggcccctgggccttcctcttcgcgcggatgcagcggcccgacggtcgacccctccctcgcgccgcggacgatctggactcgaacgactacgccgcgctgctgcgccaggacggaaacggctggcgggtcgtcgacttcgtcgtgggaccgaccgacgtcgcgtgggaaggctgggaccggcgctacggggcgccggcctccgtcttcgcggtccgctga

SEQ ID NO: 5469 - DNA, 1293 bp, Methylobacterium sp.
atgaagcgactggacgtggccgtcatcggcggctcgatcgccggactgaccacggcgtgcctgctcgcgcggagcggccacgccgtcacggtgttcgagcggtcggcggccgcgctcacgggccgcggggcggggatcgtcacgcatcccggcctccgggcggtgctggcgcgctgcggtgctccggccggggcgggcgatctcggcgtcaccgtcgagggccgccgggtcctcgaccgggacgggaccgtgatcgcgcagcggagcctgccgcaggtgctggcgagctggggacggctctacggcctgctcctggacgccgcgcccccggacagcgtccgctacggcgcggcgctcgccgcggtcgagcccgacgacgcgcgcgtcgtcgccttcttcgaggacggtcgccggatctccgcggatctcctcgtcggcgccgacgggcagttctcgacggtgcggtcacggttcctgagcggtgtcgcgccgcgctacgccggctacgtggcgtggcgcgccgtcgtcgacgcggcggccctcgcgccggcgacccgggaggcgatcggcggccatttcgcgttctgcctgcctccgggcgagcagatcctcggctatcccgtgcccgggcgcgcggacggggccgccgccgggcggtgcttcaacgcggtctggtacaggccgaccgaggaggccgcgctcgccgcgctgctgaccgataccggcggcgtccgccacgccctctccatcccgccgggccgcatcaaggccgcggtgctggactcgatgcgcaccgacgcggcgcggatcctcgcgccgcccttcgccgaggtcatgctgcgcgccgagcagccgttcctgcaggcgatcctggacatcgagacgccgaccatgatcccggcgcgcggcgtcgccctgatcggcgacgccgccttcgtggcccggccccatgtcgggatgggcgcgaccaaggccatggaggacgccgccgccctcgcggacgccctggacgcggccggcggcgacgtggacgcggcgctcacggccttcgaggcgcgccgacgcgcctacggcgcggccgtcgtggcgcggggacgcgatctcggcgcgtacctgcaggcgcagcagcgcggcgcggccgagcggacggcggcggagcggttccgcagccccgaggcggtgatggccgggacggcggtcccgcttaggccgcgcggcgggtcgcctccgcgcgcacggcggccgggagcgcgaggggcgggttcgcgctgtccaggaactcgacggtggtga

SEQ ID NO: 5470 - DNA, 324 bp, Methylobacterium sp.
atgccgaagcgcctcaccatcaccgtcccgcacaaccttggagctgccgaggtccggcgccggatcgaccggcatatggactgggcatttcggcgcctggagaaggagaagatccaggttgaggccgaggactggttcggcaatcggcgcgcgttctccgggacgggctacggccagaaggcgagcgtcgcgatccaggtggccgaggacgcgctagaagtcgaagcgctggtgccttggatggtcggcatgttcgccccggtcatcgaagcgatcggacggcactacgcggggcggctgctctccgacgaaggcgcatcctga

SEQ ID NO: 5471 - DNA, 321 bp, Methylobacterium sp.
atgccgaagcgcctggccatcaccgtcccgcacgacctcgggacagccgaggttcgccgccgcatcgacctgcacatggactgggctttccgccgcctggaggcggagaagatccgcgtcgaggccgaggactggctgggtaatcgccgctccttctcgggcagcggctacgggcagtcggcgcgcgtcgccatccaggtggcggatgacgccctggaggtcgaggcgctggtgccctggatggccagcctgttcgcgcccgtcatcgaggcgatcgggcgccactacgtcgggcgcctcctgtccgacgaggccgcctga

SEQ ID NO: 5472 - DNA, 1347 bp, Methylobacterium sp.
gtggacgggtcgatcgcggccgtcacgcggcggctcgattccctgccgatgacgcggcttcacgcggcggcgctcgccgtctgcacgctgggcctgttcaccgacatcgccgaggtcgccctgagcaacgccctggcggccatcttcctcgcgccgccccacaacatgccgcggggcagcctctcgctgctgctcgcctccgtgttcgccggcggggccgtgggcgcgcccgtcttcgggatgctgggggatcgcctcggccgcaggcgcgcgctccaggcctccctcgcgctgatggccgccggatcgctggcggcggcggcgagccaggggctcacggcgctgacgatcgcccgcacggtctcggggttcgcgatcggcggggtcccgcccctggtcgccacctacctcgccgaggtgacgcccgcgcgccgacgcggcgcgacgctgctggtctgtgccggaatcgggctcctcggcggcctggccgccatcggcctggtccagatgatggccccggccgcaccgctcgggatcgagccgtggcgctgggcgctgatcctcgggggcgccctggcggcgctcggcggcctcctgttcgcgcggttgccggaatcgccgcggtggctcgcctcggtcgggcgctccgccgaggccgacgccgcctgccgccggttcgagcgcgcggccggccggatgcgggtcgccgcccccggcggcccgcatccggcgccggccacgaccgggcccgcggggttccggggcctgttcgccgagacgcgccagctgcgccggacggccctgttcgtcggcctctacaccctcgcccccctggcgacgatcgccttcccgctgctcagcgccgtcgtgatggtggagaagggcttcaaggtcgaacaatccctcgtcttcgccgcgctgtcgatgctcggcccgcccctgggcaccctgctgaccgcgctggtgatcgaccggctggagcggcgcgctttcctgacggccctggcggcggcgatggcggccctcggcacggccttcgccgcgagcggcacgttcctgaccctggtcctggtcggcatcgccttcaacacggcggcggcgacctacggcagcatcctcgccgtctacgcgacggagctgctcccgacgccgctgcgggcctcggccatgacctgcgcctgggccggcggccgggtcgcggccgcgctggcgccgatcatcctcctgccgatcctctcggcctacgggccgcacgcgatgttcgcggtgatcacgctcgtcctcgcggcgagcgcggccctgctcctcgccggaccgcgcggcctgtccggtcgggccgttgcttag

SEQ ID NO: 5473 - DNA, 408 bp, Methylobacterium sp.
atggtggctgcccccggaccgatcctggccggcgccctcgtggtcgccggtctcgggttcgcctccgccgccgaggcgcagatgccgacgcgggtcggcacgtgcgcggcgaccaccatcgcgctgatcgggacccggttcagcgacacgctcgtgaagccgaagggcgacgggatcggcgacgggacgagcgtcgatctcaagaacggcgtctacggcgtctcctacgcgtatgtcgaagcggtcgcgcggtcacgggtcggcgaccgggtcatgacatgcctcgttctcctgccgacgggctgccccaagggcgacgatcgcggcaagatgtacacgacgaccaacctgcgcacgctggattcctggactttgcccgactcccagcacatgtgcggcggggcctga

SEQ ID NO: 5474 - DNA, 1281 bp, Methylobacterium sp.
atgcacgacctctccgatcccgtcaccctcccggccggcaccgtcctgttcgaggagggggcgatcgggcactgcgcctacctgatcctgagcgggcgcatcgcgatcttccggcggcgcgacggcggcgaggccgtgctcgcccggcgcggcgccggcgagatcttcggcgagatggccatcctggacgccctcccgcgctccgccggcgcgcgcgccgaggcggatagcgtgctcgtcccggtggacgcggcgcagatccgccggcggctcgccggcgccgatccgatcctgcgcctctgcctcgaggggctcatcgcccggttccgcgagaccctgccccgcctcgggccggcggtcgccgaggggcttccggcaccgccgtcgcccgccgcccgcgccgatttcgacgcgacggtcgcgtcgctcgcgcaggagcgcgccctgcggcgggccctggcccgggacgagttcgcgctgttcctgcagccgatcgtgcggctcgccaccgggcgcctcgccggcttcgaggccctgatccgctggcacgatcccgagcgcgggctcgtgccccccgccgccttcattccggccgccgaggcgaacggcctgatcctggcgatcaccgcctgggtgatcgacgcgatcggccggatcgtgccccgcatcctgcaggccggcctgcgcgcgcccgcctccgtcgagccctccctgttcgtgagctttaacgtcacggcccaggatctcgcccgcgcggacataccgggcctcgtcgacgcgatgctgcgccggaccggcctcgcgcccggcgccctcaagatcgagatcaccgagagcgcgctgatgcaggatccggccggggccgcggccgccctcgcgcgctgtcgcgccgccggcctcggcatcgcggtggacgatttcggcaccggctactcctcgctcagccatctcagcaccctgccgatcaccacgctcaaggtggaccgggccttcgtccgggcgatgctggcggagccgcgcgatcgccggatcgtccagaccatcctgcggctcgccgaggagatcggggtggtggcggtcgcggagggcatcgagggccgcgccgaggcggaggccctcgcggcgatgggctgcgccctgggccagggctaccatttcggccgcccgatgccggaggccgacgccctcgcggcggcggcggcctggaacgccgaggcgtggcgcgtcgggctctccggggaggctgatccggggcggcacgggttccacgcccgggcctga

SEQ ID NO: 5475 - DNA, 192 bp, Methylobacterium sp.
atgtccgacgacgacggttttgaccgcatggtggaggcgacgatcctggcccatcaactcgtggccgcgcacggcacggcgacgatgcagctcctgtcccgattgctgctcatggagatcggtacggagatcgcggcgcggcgcgatcccgatccggccgccaacgacaatccggacgccctggaggattag

SEQ ID NO: 5476 - DNA, 1284 bp, Methylobacterium sp.
atgagcgtacgcgagaccctcgaggcccggctggcccggatcgccgcgggggacccggcggtcttcacccgcctctacccggagcaggcccgcgcggcggcggacgccgccgatgcgcgtcgccgggtcgggatctccctcggccccctcgacggcgcgatggtctcgatcaaggacctgttcgacgtggcgggcgagacgacgcgcgccggctcggtcctcttggccgacgcggcgcccgcgcggaccgacgccccggtggtcgcccgcctgcgccgcgccggcgcggtgatcctgggcaagaccaacatgtcggagttcgccttctcggggctcggcctcaacccgcattacggcacccccggcaacgccgccgatccggcgcgcatcccgggcggctcgtcctccggcgccggggtctcggtggggcaggggacgagcgacatcgcgatcgggtccgacacgggcggctccgtccggatcccggcctcgctgaacggcgtcgtcggcttcaagccgaccgcgagccgcgtgccgctggagggggcgttcccgctgtcctacgccctcgattccctggggccgctcgcccggacggtcgcggattgcgcggccgccgacgccgtgctggcgggcgaggagcccgcgccgatggaggcgctcgccgtcgccggcctgcgcatcggcgtgccgcggggcctgctgttcaccgagacggaggcgccggtcgccgaggccttcgagcgggcgctgtcccgcctgtcccgggccggcgcccggatcgccgatcacccgatcgacgaccacctcgccgccatggacgcggcgctcccggacggctccctcgcggcgatcgaggccgcggcgatccacgccgactggctggacagcgcggccgaccgctacgacccgcgggtgcatcgccgcatcgtggccggccggaatgcgacggccgcgggctacatccggacgatgcgtcggcgggccgcgctgatcgccgccttcgaccggcacctcgccccgctcgacgtgctggcgctcccggcgaccgccacgacggcgccgctcaccgccccgctggcggcggacgacgcggccttcctggcggccaaccgcctgatgctgcgcaacacggccttcggcaacttcttcgatctcaccggcctgtccctgccgatgccggacctgccccggccggcgggcctgatgctgctggcccggcacgggcaggaccgccggctcctggcgatcggggccgggatcgaggccgcgctggcggggtga

SEQ ID NO: 5477 - DNA, 291 bp, Methylobacterium sp.
atgtcgcgttcgagggttccggaggcgcagagccgccccgacgggacgggggtgatcccgtcccacgacacggcgatcctgggatcgggcgccgtcggcgcgggggcgatcggggcgtcggccctgggcgcgctggccctcggggccgcggccctcggcgtcgtggcggtcggcgccttcgcgatcggccgcctctcggtgggccgcgcccgggtcggcaccctggaggtcggttcgctggagatcgacacgctcacggtgcggtcggtgcggatgccggaccgcggctga

SEQ ID NO: 5478 - DNA, 450 bp, Methylobacterium sp.
ttgtccaagtggtatctctacggcatcgccctcgtggccggcgtcgcgaacgccatcgagccgggccagaacgccaccctggcgaaggtcacggggcagccgatgctggcgggcctgttctgcttcggcctcgcgatcgcctgcttcctcgccgcgatggtcgtcgcccagctgcgcggccggactcgggccgaagcggccacgcccgtcccctggtgggcgtggccgggcggcatcctcggggccgcggtcgtcctggcgcagctctacatctccgagaaggtcggcgcggcgccgttcctgggctgcgtgatcacggcgggcgtggtcggctccatcatcctcgaccatcacggcctcgtgggcttcgcgcgccaccgcgccgggcgctggcgcatcctcggcggcgcgctgatggtcgcgggcgtcgccctcgtggcggtgttctga

SEQ ID NO: 5479 - DNA, 231 bp, Methylobacterium sp.
atgacccgcactctgaccatcgcggcgctggccgcgctcctcgccgttccggcggtccaggcgcaggcccgcccgcggcacacccccgccaaggcgcagcccagcgccgcgatcaaggcgcgccagaccgtcctgaacgatttcaacgcgcggatgagccgcctggacgcgctcatgggcgccccgagcacgtcgtcggtccgcgcgcgctcggccgaggccggccgctag

SEQ ID NO: 5480 - DNA, 117 bp, Methylobacterium sp.
atggagacgacgatgacctggaccaaccgcatcgccctggccgcgaccctgatcgccggcgcggtcgccctcgtgacctacgcgcaggccctcagcctgccggcccatttcgcctga

SEQ ID NO: 5481 - DNA, 786 bp, Methylobacterium sp.
atgcaggcgatgttcgcggatggccaggtcgcggtgaccctgtccggcgagggcccgcccctcgtcctgctgcactcgctgctcgccgaccggacgagcttcgaccgggtcaccccggcgctcggccgcgacttccggctcctccttcccgacctgcccgggttcggcgcctccgcgcccgcgccgggcggccttgaggccgtcgccgaccgggtcggcgcggcattgcgcgcggcggccgggggccggccggcggccgggctgggcaacggctacggcggcttcgtgctgctgctctgcgccctgcgccaccccgacctcttcgaccggctcgtcttcgccgattgcggcgcctgcttcccggagcccggccgggccgcgttccgcggcatggccggcgcggcggccgagaaggggctcgcggcgctcgccgacacggccatgcgccgcctgttcgcgcccgcgttccaggccgcgcacccggacctgatggccgagcgccgggccgccttcctgcgcacggacgtcgacgtgttccgggccgcctgcgcggccctggccggcctcgacctgcgcgcgcggctctccgagatccgcgcgccggcgctggtgctcgtcggggaggaggacgaggcgaccccgccggccatggcgcgcgagctcgcggccgggctgccggacgcgcggttcgtgacgctgccggactgcgcccacgtcccgcagctccaggcccccgagctgttcgcccgcgaggtcctggcgtttctccggccaggttccgcctga

SEQ ID NO: 5482 - DNA, 318 bp, Methylobacterium sp.
gtgaggctccccgcgcgcctcgccgcggccctgcggccgcccgcgcgcgccggcgtgcagcacctgccccggcgggtctggcccggcgaggaggcggcttggcgcgacgagaacggcgtccgccacccgcgggcggtgcgccgtgccctcgcggcgctggccgccctcgaaccccgcggtcgctacggcgcccggatcgagggacggggcaaggtcgtgaccggcccggccagcgcgctcgtcctgcgcgacgcggaggcggagatcgggttcgtcctcggcctcacgcccgacgggtacggcgcggagccgttctga

SEQ ID NO: 5483 - DNA, 864 bp, Methylobacterium sp.
atgaaacccgcgcccttcgcctatctgcgcgccacgtccgtggacgacgccctcgaagccctgcgccagcacggccccgaggcccggatcatcgcgggcggccagtccctgatgccgatgctcaacatgcggctgacgaagcccgccgtgctcgtcgacgtgatgcgcatccccgctctcaaggagcctcgcctcgacaagggggccctcgttatcccggcgggcgtgcggcaggcgatcctgctcgaccggccggggctcgcccgggacttgccgctgctggccgccgccctgccgtgggtcgggcacatccagacccgggcacgggggacactgtgtggctccgtcgcccatgccgacccgagcgcagagattcccctctgcctcgtggcgctccagggcgaggtgcatctgcgcaaccggcgaaaggtccggcgcgtcgcggcggagaccttcttcgctggcatgatggccactgaccgggccgacgacgagatgatcgaggccatcgcctatccgctgcggcgggagggcaccggcacggccttcgctgagatcgggcggcgacacggcgactacgcgatcgtcgcctgcgccgccgtggtggacggcacccggatgcggctcgctgtcggcggcgtcgccgaccggcccacagcccgcgacttcccccacctcgacggctcggcgctcgacgatgccctcaacgccttcgcctgggacctcggcgcgggggacgacctccacgccaccgcccgctaccgccgcgacctcgtgcgcagcctcggccgccgggtgctggaacaagccgccaaggtcgcccgcggcgacacccatcaggaggccgtgccatgccacagctag

SEQ ID NO: 5484 - DNA, 666 bp, Methylobacterium sp.
gtgcagcatttcggcgtcacggtccagaacatggaccgggctttcgccttctacaccgaggtgctcggcgggaccgaggtcatgcgggacggcgacttcaagggcgagccggtccatttcacgctgatggccgatcaagagatcgtcgcccgcgagcgccgcgtcgatcctcgcaccatcggcgtcccggacctgaagggtggctcccagcggctcgatgtgcgcttcgttcagttcgagaacgtcgtcatcgaactcctgcagtatcgcgacgcaacgcagccgatgggcggcggcgacagctgggctgagccgcgcgaccacatgagcccggcctacccgcgctcgatgcacatctgcttctacgtccgcgatgacgtgaacttcgacaagttcatcgctgatctcgaggcagagtgcgcccgccgcggcatgacgcaggtcagggcgaaccgcaccgtacccgtgcactccgaagagcagcgccgcgcggcgccgagggataccaattcgatcaagatccacgaaggtccgtcgaacggctggtcgatcatctactgcaagggccccgagggcgagcagctcgaattcgtccaagtgctcggtcccgtcaaaaagacgttcgctgacgccgccgaggcgcgccgggcgacgaaccggggctga

SEQ ID NO: 5485 - DNA, 516 bp, Methylobacterium sp.
atggcctatcatcccgttccggtgacgcatgtcggcctgaccgtcaccgacatccgggcagcaaccgagtggtacaccaaggccttcagctgccgccacatcatcggccccctgcacatcaggcacgacggctcgcatatcggcgaggtattcaaggggatcttcggtgatcgcttcgaggagggatacgtgtcccacctcgccaccgcgaacggggtggggatcgaactcttcgagttcgtcacgccgaagtcggaagctgtggatgacaacttccgctactggaagaccggcgtcttccacttctgcctggtcgacccggacgtcgagggcctcgcgcggcggatcgccgagatgggcggcaaacagcgttcgaaggtctggacactgttcgagggcgagccgttcaaggccgtctactgcgaggatccctggggcaacctgatcgagatctactcgcactcgacggagctcatgtacgccaatcggagcacgacggccgcccgggcggagtga

SEQ ID NO: 5486 - DNA, 303 bp, Methylobacterium sp.
atgcgcggcacacagtcttcgacgggcgctccgaaggccccgctggccgatcctcgaaggggatgtgacctgccccgcttcttcctcaacgtccggcggcacggcacgctgatcgccgatcgggagggcgacgagctgcccgatcggacggcggccgagcacctcgcgcgcgacatcctgcgcgagatgcgccgcctgccgcacgtctacggcgcgccgcgcggctggcgcgccgacaccttcgtcatcaccgacgaggccggcgcggtggtggccgaagtcccctacgccagcgtgctctga

SEQ ID NO: 5487 - DNA, 789 bp, Methylobacterium sp.
atgagcggcaccttgctggagacggtcgacgagcgcggggtcgccaccctgacgctcaaccgtccggagcagcacaacgccttcgacgacggcctgatcgccgccctcaccgcgtccctgcaccggctgggcgccgctcccgggatccgggcggtcgtcctggcgggcgcgggccagagcttctcggcgggcgccgacctcgcctggatgcgccggatcgccggccagtccttcgacagcaacctcgccgacgccgccgggctcgcggggctgatgcacagtctcgaccggctgccgaagccgacgctcgccctcgtgcacggggcggcctacggcggcggcgtcgggctcgccgcctgctgcgatatcgccatcgcggccgagagcgcgcggttctgcctgagcgaggtgcggctcggcctgatcccggcgacgatcggcccctacgtggtcaacgcgatcggcccgcgttgggcccggcgcctgttccagaccgcggaggtcttctccgccgagcgcgcccgggcgatcggcctcgtgcacgaggtggtgcccgacgaccggctggaggcggccggcgcggaggtgctgcgcgacatcctccggggcgccccgggcgcgcaggccgaggccaaggacctcgtcttcctgtgcgaggggcggccggtggacgccgacctggggcgcgagacgggccggcgcatcgcccggcgccgggcctcggacgaggggcaggccggcatagccgccttcctcgacaagcgcttagccccgtggcggcgggactga

SEQ ID NO: 5488 - DNA, 360 bp, Methylobacterium sp.
atgcccgtgacggaggggctgacccacctgacgttctcgatcatccgcctagctatgttcgcgccccgttctatctgctcaccgtgcgggcggagcggcagaatggcgagacggggcgtcttcgtgcgggccgaggaggtcgccttcctggaggaggcgcggcgctggtggcagcgatgcgtcttggtcctcacgagggccaagccgcagggcccgctctacaacgcgacctcgaaggtgatcgacgcgatcgacgacgttgccgaggtggtgaccggcgaccggcggaccttctaccagagggatgcgaccacaccgggcgagaacctaccgcccatgaagtggcgcacggtggagtag

SEQ ID NO: 5489 - DNA, 237 bp, Methylobacterium sp.
gtgcgggccgaggaggccgcgttcttggaggagatccggcgctggcgtcagcagtgcgtcctggtcctcaccagggctaagccgcaggggccgctctacaacgcgacctcgaaggtgatcgaagcgatcgatgacgtcgccgaggtggtgaccggcgatcggcgggccttctaccagcgtgacgcgaccacgcccggcgcggccctgccgcccgtgaagtggcgcacggtggagtag

SEQ ID NO: 5490 - DNA, 216 bp, Methylobacterium sp.
atggtcagcgagccggttgggccagaagggtacaagcgccgggttcggtacgagaagccccacgcctcgatctatgcgcacccaaaggtgttcaaggcgctccgtgagatcgcggcggccaccgactgcaagccgcacgacctctacatcgaggggctccggatggtgctgcgccagcacgggcgtgacttcgatgccctaaatcggggcgagtaa

SEQ ID NO: 5491 - DNA, 1359 bp, Methylobacterium sp.
atgacccggcttctcgccagccccgtgcgccggctcgcggctctcggcctcgcgctgctcgtcgtgaatgtcggcgcgctcgcgatccacgtgccgggcgccgacacggtgggctcggtcacccgcgccaacgtcttcgtcggtgtcgtggtggtcggcctcgggctctacctcctcgccgtgggcctcgtgctgcgggaacggttgccgcgcgccgccctgtggacgatcctcggcgtcgccgtgctgatgcgggccgcgctgctgccggcgccgccgttcctgtcgagcgacatctatcgctacgtctgggacgggcaggttcaggctgccgggatcaacccctaccgctacatcccagccgatccggccctcgaacagttgcgcgatccggcggtctacccgctgatcaaccggaaggattacgctcgtacgatctacccgcccgcggcgcagatggtcttcgccgccgtgggccaggtctcgcacggcgtcaccgcgatgaaactcgcgatgctgggcttcgaggccctgggcgtgctggcgatgctcgcgatcctgcgcggtgccggcctgccgtcggcccgcatcctgatctacgcctggaatccgctcgccctgtggtccttcgcctgtgacgggcacgtcgacgccgtagcgatcggcctcctcggcctcgcgctgctcgcccgcacccgccgtgggtacgggctcgcgggcgcgctgctcggcgcggcgacgctggtgaagctgctgcccgtcgcggtggcgcccgccttcgtgcgcggtggccggctgtggcggccgatgctcttcggggcggccgtgatcgcggtcctctacctgccctatctcggcgccggcacgaacgtgctcggcttcgccgggggctacggggccgaggaggggtacgagaccggcacgggctactggctgctcgccgggctcggccacctgggcctcagcactcagggcctgctgcggacctatctggtctgcgccggcctgacgctcgccgcgctcgcgctccggatcgccttcggccgggaccgggcgcccgcgcgcgacgcggtcgcgctgtgccgcgatgccgggctcctcgcagccctcatcacctgcgcggcgagcccgcactacgcttggtactacccctggctggcgctgcccgcggtggtcgcgccggccccggccctgatctggctcggcgcggcgccgatcctgttcctgatcgatccgttcaacgaccgcttcctctggccggcgctggtcttcgtcccggccctcgtcctggccgcccgcgcgctgtggcaggcccgcaccgcacccctcgccgctctcccggaaggaaccgcccgatga

SEQ ID NO: 5492 - DNA, 276 bp, Methylobacterium sp.
atgattggggccggatatgtcggcctggtctccggcgcctgcctggccgatttcggccacacggtcgtgtgcatcgaccgggatcccgacaagatcgccagcctcaacgccggccgcatgccgatctacgagccgggcctcgacgtcctggtcgccgagaacgtccgccagggccggctcgccttccgcgcgaccatgcgggacgccgtggccgaggcggatgcggtcttcatcgcggtgggcacgccctcccgccgcggcgacggcttcgccgac

SEQ ID NO: 5493 - DNA, 1182 bp, Methylobacterium sp.
atgacagccgcacagcccctctcgacggacccgttcctgcccgggccgcgcgtgcgcgtcgccggatccgcgacggggccgctcgccggcctcaccttcgccgtcaaggacctgatcgacgtcgcggacactcccacggggggcggaaacccggactggccgcgcatctacccgacgccggcccgccatgccggcgtggtgcagacgctgctcgatgcgggcgcctcggtcgtcggcaagacggtcaccgacgaagtctcaatgggaattctcggcgagaacgcccacgacggcacgccgctcaatcccgcagcgcccgatcgggtgcccggcggctcgtccagcggctcggcctccgcggtggccgcgggcacctgcgacttcgcccttggcacggataccggcgggtccgtgcgcgtgccggcgagcttctgcggcctctacggcatccggccgacgcacggccgcatcgacttttccgggatctgcgtccaggcgccgagctcggatacctgcggctggttcgcccgggatgcggcgaccttcgcgcgggtcggcgaggtcctgtttggccaagccatgccggaccgcccgccccacacgctgctcgtggccgcagacgcgctcggcttcgccgatgccgccgtgcaggaggcgctggctccgcagatcgaccgcttggccgccctgatcggcaaccggcgcgacgtgaccatggcgccgcagggcttgtccgtctggcagcgggcgcagcgcgtcctccagagcagcgaggcgtggcagaccttcgaaccctggctcgatgcctgcaatccacgaatggccttctcggtcgcccgatcgctgatccagggctcgatgatgatggacgccgagcgcagcgccgcgggcctgatgcggatcgaggctcgggcacgtctcgcccagcttctgctgcccggcaccatcctgtgcctcccgaccaccccgttcccggcacccctgcgcgggctgccgctcggcgcgctgcatcccctgcgcgagcgcatcgcctgcctgacgagccacggcggcctcaccggcgtcccgcaggtcaatctgccgggcgcacaagtcgacggcgctccgatcggcctgtcgatcctcggtgcgcgaggagccgacctcgacctgatccgcatcgcggtcgccctggaggcctga

SEQ ID NO: 5494 - DNA, 261 bp, Methylobacterium sp.
atgacacgtttgccgattatcgtcctcgccaccctcgctctcgggggaagcgccgtcgccgccgagcagggggcctcgtccaagactccgggccacgagatgcaggatcgcgggagccgggccgggagcccgggcgcgtcgggttacgcgccgggccacgagatgaagtccggcgggacggactcgtccggttcgacgtcgcgaagcggcggaagcacgacgggcaccaccggcaccagttcgaccggcacccgtcgctga

SEQ ID NO: 5495 - DNA, 954 bp, Methylobacterium sp.
atgctcgacaccgacgatctccgcttcttcgtcgcggtcgcggccagcccgtccctggccgccgcggcgcgcagcctgaacgtgtcgccacccgccgtgacgcagcggctgcgcagcctggagaagcggctgcgggtccatctggtggaccggtccggtcgcggcctcacgctgaccgacgagggggagctgctggccgagcgcggccgcgacctcctcggcgccttcgacgatctcgccgacgccctggccgagcgcgtcggcgcggtgaccggacatctgcgcgtcgtcgccccgctcggcttcgggcgccgctacgtggccccggtcgtgacggcgttccggctccggcatccgggcgtgcggatcgacctgctgctctcggatcgcctgggccgcatcccgtccgagacctgggacctcgcgatccacgtcggtgagatcagggaggcgaccccgagcctgaccgtgcgcgccctcgcgccgaacgaccggatcctctgcgcggcgcccgcctacctggcccggcagccggccccgcgcgtgccggccgacctgcgggatcacacctgcatcgcgctgcgcgagaacgacgaggacgtgacgctctggcgcttccgcgcggcggacggcgccgaggtccgcgtcagggtggacgcgggcttggtcagcaacgacggcgacgtggtgcggggctgggccctcgcgggcctcggcgtgatcgtgcgctcggaatgggatgtcgccgacgacctgcgcgcggggcggctggcgcgcctgctcgaaggctacgccctgccgtcggcgccggtcgtcgccctgctcggctcggaacggcggtcgcgcgcggcccggacggagcggttcctcgaggcgctccggcgctcgttcgatccgctcccgtggcgcccgcccgcggggccgggcgcggcaaccggcgatgctgcgccttga

SEQ ID NO: 5496 - DNA, 621 bp, Methylobacterium sp.
atgatcgatctctacgcctggaacacccccaacggccggaagatcagcgtggcgctggaggagatggcgctgccctaccgggtcatcccggtcgacatcacgcaaggggcgcagcacgcgccggacttcctggcgatcagcccgaacaaccgcatccccgccatcgtcgatccggacgggccggacgggtccccgatcccggtgttcgagtccggcgcgatcctgctctacctcgccgagaagaccggccgcttcctgcccgaggaccggcggcagcgcgtcgccgtcctggaatggctgatgtggcagatgggcggtttcgggccgatgcccggccaggtccaccacttcctgaccgtcgcggagcccgaccgcgcctacgggctcgcccgctacagcaaggagacgcaccggctctacggcgtgctggaccggcgcctcgcgcaggtcgcgtacgtcgcggggccgctctcggtggcggatttcgcgatcctcggctgggcgtggcgccacgagcgccaccaggtcgacctcgccgattacccgcaggtccggcgctggtacgaccggatgatggagcgccccgccgtgcagcggggcttcgccgtcccgctgagctga

SEQ ID NO: 5497 - DNA, 861 bp, Methylobacterium sp.
gtgggtcagtcgaaccttgccctgatctacgagaactattcggaccgcgcgactctgtccggcggctcgtggcagcccggatcgctgcggctcacgaacctgcagaccccctacatcgcggagaaggcgcgcacgacctcgaccgatccggcggccacgcagttcaccgtcgacttcgggcagccgtacatcatcggcggcgtgtgcttcggtccatctaacgtgcgcccggacgcgctctgtcggtaccggatgtatgacagcgtcggcctgctctacgacagctcgatcatcccgttccccggcacgaccgtcgactcggcctcgctggattgggaggataacggcttctgggagggtgtctccaccgagttcgacgacctctacaagggcgtctacttcatcgacttcccgaccctgccggtctcgtgcgagcggatcaccttcgagatcttcgatgccaacaacccggcagggtacatcgagatcgggcggctctactgcggcaaggtctggcagccgcagtacaattacgattacgaggggcacagcctcgacttccaagacaagaccgacatgcaggagagcgtgaacggcacgcgcttcttcaacccgcgtccgctgcggcggtcgttctccttctcgttcagctaccttcccgaggccgacaccttcagggacgtctatcggatcgcgacccgggccgggacctatcggcaggtggtggtggtcccgaaccccggcgacgtgtcgaccttcgtgcgggaggccttcctcggcacgctcggcgcgctgccgtccctccgccggccggccttcggctacgccgccaccgccttcaagatcgaggagaccctgtaa

SEQ ID NO: 5498 - DNA, 243 bp, Methylobacterium sp.
gtgcgtgaggcgatcgaggccgcaggagcgcggctgctctacctcccgtcatacagccctgatttcaacccgattgagcaggccttcgcaaagctgaaggcgctgttgcgcagcgtggccgctcgcacgatcccggatctctggccggcgatccgccaggccttcacgcgcttcactccacaggagtgccgcaactacctcgccgcagctggctacgaggacgacttggctgtcgctacctga

SEQ ID NO: 5499 - DNA, 372 bp, Methylobacterium sp.
atggacgacctgcttcgcgagtttctgaccgagagcggggagcatctcgacacggtcgatgcagaattggttcgattcgagcaggatccgaacaacgagactattctgcggaacattttccgactcgtgcacacgatcaagggaacctgcgggttcctcggcctccctcggctggaagctctggcgcacgccgccgagaccttgatgggtcgcttccgcgacgggctgcccgccacgtcggattccgtcaccctgatcctgctgacgctggaccggctgaaggcgatcctggccgatctggaggccaccggcacggagcccgcgggctcggacgacgacctcatctccgccctggagcgcatggccgagggc

SEQ ID NO: 5500 - DNA, 1143 bp, Methylobacterium sp.
gtgggcgaggtctatgcggagagcacgccggtgcctgataccggcgcaacctatatcaacacgacgatcacgatcctccgcggcttcaatctcatctatgacgccgatagcgggttcgcgggttaccagcgcattgcccccgaaagtgcagatctcattgcccagccgatgatcgcactgcagggaagcttgagcttggcctcgcaattcacgaccggccttcccgtcttcctgatgagtacgacggcgctgaacccgctcgatgttgcgagcctcggcggcgacgtctccgggcctggcggcctgattaaggttgggctcggcaccctcgaacttgccggcaccaacacctatgccggcggcaccaccatcctcggcggcaccctggccgtttcccgcgacgctaatctcggcgccgccggcaccggcctgaccctcggcggaggcaccctcgaggtcctcgcagacggcttcgccaccgcccgcccgatcacgctcgccggccccggcaccctgcagatcgacgtcggcaccgccaccttcgcggggccgattgccgacggcagccagccgggcgtgctgatcaagtccggctccgggaccgccgtgctgtcagccgccaacacatttaccggcggcgctgtcatcagcgccggcactctcgccctgactgccaccggcagcctcatcgcgccggtcctcgtcggtgcaggtgcgagctttctcaatgccggcctcgtcgccggcagcgtcggcaacttcggcgtgctcgccaacagcggtaccattaatggcgcggtcgccaatgccggtatggccgtcaacgccggtaccatcgccggcggcacgaccaacagcggcagcctggtcaacaccggcaccctcgcgggcggtctgaccaacaccggtaccgccctcaacaccggcaccatcggcggtggcgtcatcagcagcggcatcctgagcaacagcggcgccatcggcggcggcgtggccaacaccgggctcctcgccaccagcggcacgatcagcggtggcctgaccaatgccggcaccgtgctcgccagcgctggccgcatcgacgggcccatcgccaacaatgccggcctgctcgccgtctccggatccgtggccggcaccggc

SEQ ID NO: 5501 - DNA, 1302 bp, Methylobacterium sp.
atgaaggtcctcctctgctcgacgcccgccacgggccatctcaatcccctcctcgccatcgcccacatgctgatcgcggacggccacgaggtcatggtcctctcgggctcggccttccgcgaccgcatcgtggcggccggcgcccgcttcatggccctgccgggcgcggcggacttcgacggccgtgacctccgcgcggtcgtgccggaactggccgagatcgcgccgggaccggactggctgcgcgtcgccatggagcgcgtgttcgtcgaccgcatccccgaccaggcgcgcggcctgcgcgcggcgctccgggccttcccggcctcgctggtgatcggcgacgacatgttcttcggcgccctgccgctgctgctggggccgcgcgcggagcgccccgccatcgtcctgtgcggcacgtcgatcctgcactgcgcgcggcccgaccgggctccggccttcctgggcctcccgccggccgagacgcccgagcaggcggccgcgtacggccgcatcgccgaggcctacgaggcggcggtcgaccggccggtcgggctgagcctcgccgccaagctggcggaactcggccgggccgccccgccctggccgctgttcgacgcggtggtgcggctcgccgacacctacctgcagctgaccgtcccgagtttcgagtatccgttcccgctgccgccgacggtgcgcttcatcggggcgctgccgatcgtcccggggcaggcggcgctcccgccctgggcgggcgacctcgacggcgcgcgcaaggtcgtgctggtcacgcagggcacggtcgcgaaccacgatttcggcctgctcgtcggccccgccctccgggccctcgccgatgagcccgacatcctgaccgtggtgacgggcggcggccgggggctcgacgccatcccgggcccgatcccggccaacgcgcggctctcgccctacctgcccttcgagtggctactgccccggatcgacgccatggtgaccaacggcggctacgggagcgtgaaccaagccctgagctacggaatccccctcgtcgccgccggcctcaccgaggacaaggccgacgtgaacgcccgcatcgcctggtcgggggccgggatcgacctcgccgcgaacgacccgacgccggaggcgatccggaaggcggtgcggaccgtgctcgacgcgcccggccatcgccgggaggcgcggcgcctcgccgccgagttcgccgcctacgacgccaaggccgagatcctgcggctcctgtccagccacggcggccgcgcgcgcagcgccgcctga

SEQ ID NO: 5502 - DNA, 1140 bp, Methylobacterium sp.
atgcaggatctcgaggcgtattcggttctggtggggtcgatctacgaccgcgtcggccagccggaggagtggtcggcgctcctggaggatctgaccgatttcgtcggcggccgggtcggccagctcgccgtgttcagcctcgacgggaaccgcaagccgctctgggcggtgtccggtttcgagcggtcgcggtaccgcgagttcctctaccggcacgccaccgaggatccgcgcctcccctacatcctgtcgaaccagggcaaggtcatccgcgccgaggagggggtcgacgcggtgcagttccgcgagtcggccctgttcaaggaggtcgtccagcccttcgagatcgagcacagcctcgtcacctacttcgccaaggaagccgacgtcatggcgacgctcgcggcgatgcggggcgaggagggcggccccttccggtccgacgaggtccggcgcctggcgatgctcgtcccgcacctgcgccgggccttcgagctgtacgcgctgatgcggcaggcctccgagcgcacgtccgatctcgcctccgccctggacctgctcgacgccgccgtgatcctcacggattccgacctgcgcgtcgcgcacgccaaccgcgccgccgaggcgctggcgcggtcccggaccggcctgtccttcgtgaagggcagcctcgtcctcaaggacagccagaccgggcggcggatcgcccgcgcggccggcgaggcgctcgcggccgcgagcggcgacgtcgcgatcacgcaggccgaccacatcaccgtgacctgcggcgagagcggcatgccctaccgggtgtcgctgcacccgctgtcgaagcggccggccggcaccgggtcgaaggtgcgggccgagctggcgatcgtgatccggaccgggaccccgaaggtccaggggagcaacgccgcgcggctgcagaagctgttcgggctgaccgtcgccgagtcgatcctcgccaacgcggtcgcttcgggacggtccctcgacgaccacgcccaggaccgcggcatcgcgatctcgaccgcccgcacccagctgcgcgccctgttcgccaagaccgagacgcaccggcagggcgagctcgtggcgcgcctgcgcgaggggctggacgtctcgctcaactga

SEQ ID NO: 5503 - DNA, 1428 bp, Methylobacterium sp.
atgctgccggttctcgttgcgcggaagggcgctcgcatcgggatgctcctggcggtgctcgccgtcccggtcgcgggcgaggccggctggaaggggccggaggcgcaaccgctgttcgtcaacgaggccaatccggccggctacaactacgcgccgagcgtcatcaccgagaacgggaccaccgacatctggtggtgcggccagggcaagaccgacgtcatcttccatcgctcctacacgccgcagactggcttctcgccggcgcggatcgtgttccagccgacgcccaactcctggaaccggcagtacgtctgtgatcccagcgtgatccggggccgcttcgtcaacccggcggacgggcagacctacgcctacgcgatgtactattcgggcgccgacaacctgcccggaaacaacaaccagaccggcctcgccttctcgaacgacaaggtgacgtgggtcgactacccggaaccggtcatcaagccgatcaacccggtcgtcgcgcggggcaattacggcaccggccagccggcgatcttctcggacggccggtcaggcctgttcgtcttcaccacggatctcaccgggccgcagggcgtgccgggcttcggggacctctacgtccggcacacggccgacggcgtgcatttcggggcgccggcgcgggtccccaacgccacgaccgacggctcgaccatcaacccgaactcggatttcgcctacgatcccaagaccggcgaggtctacgtcatcaccgggctgccgggccgcgcgtgccagcaggtggcctgcaaggatccggggcgcaatcccgaccgggaaacctaccagatggggctgttcaggatgcccctgaaggctgtcctgagcgggtcgccggcggcgtggacatccctgggctacctgaattccgacgtcacgggcttctacctgaaccacagtcccggctttcagcgcgacggagcggggtacctgacgccgttcctgccggacatcacggtcttcttctcggggggtgacccctatcccggcacgtggcggatcgcagaggcgcggcggccgaagggcaccgaccgccttcccctgcggcgcgccttcgggcccggaggccactgggtgacgaccggctatatcgggccgggctacacgatcgagcgcagcctcggcaccgtgttgacgctcccggcgcccgggaccgcgatgctgatgagctgcgcggcgggacaggaccacttcctcagccgggacccgcgatgcgagggccagacgccgctcgggcagaccggctacgtctacgaggcgcacaggccggggagccacccgatctaccgttgcatcgccgggggccgcgatcatttcgtgtcgaccgccccggactgtgagggacacgcgtccgaagggatgctcggctacgcgctggactga

SEQ ID NO: 5504 - DNA, 297 bp, Methylobacterium sp.
atgaagttcggcgtcctgatcctggccggcgcctgcggcgtcctcgtcgggatcgtcatcggatacgtcgcgggggcgcgactcagccaggccttcgcgcagttgccggtgacggaccgctcccccgccgcgcaggcgctccggatcgtggaccgcatcgcgaccgagcacggcctcgcgcgggacacgctgctccgggcgatgctcgaccagcagggcggcggaacggggaccgcgcgtcccggcgaggagccgggcagggtgccgggcacggccccgggcgaaccggcccggtag

SEQ ID NO: 5505 - DNA, 216 bp, Methylobacterium sp.
atgacggcggcgctcgccgcgccggtcacgcaggtctgcgccttcatgctcggctgcgcgctgatccacgccgcccgcgcccacgccgatctgatcacgcggctcctcgccgtcacggcggtcggcgtggccgtgctggtgcttctcgtcgcgtccctcgactacgcgcccgagggcggaaccttcgacgaggtcacggtctacgcggcctcctga

SEQ ID NO: 5506 - DNA, 198 bp, Methylobacterium sp.
gtggaaagcatcacgccccggccggcgaactgggagatcgctggcggtggcattcgcctggtgttcccggtgcaagccggccagagccacgcgctcattcggttcaccgggtcgccggctttccgcggcggggtcaacctcaccgcccggctcgatgctggcgagatgctgtcctggtctcagtacgcggtgccgtag

SEQ ID NO: 5507 - DNA, 459 bp, Methylobacterium sp.
tcggacgacctcgacgagctgctgaccctggtctggaagaagcccgccttcttcgtggcccatccccgcgccatcgcggccttcggccgggaggcgacccgccgcggcgtgccgccggtcgtcgtccacctgttcggcgcgccgttcatcacgtggcgcggcatgccgctggtgccgagcgacaagctgccgatcgacctcgacccggtgaccggggccgagaccacctcgatcctgctgctgcgcgtcggcgagggcgagcagggcgtggtcggcctgcagaagtcgggcgtgaccggcgagatcgagcccggcctgtcggtgcgctacatgggcaccaacgaccactcgatcgcctcgcacctcgtgacccgctacttctcggccgccgtgctggtcgaggacgcgatcgcccgcctcgataacgtgctgctgggcaactaccatgactacgcctga

SEQ ID NO: 5508 - DNA, 429 bp, Methylobacterium sp.
atggctctgcgctcgacctccatccggatcgcctcgctcctcctcgccgcgtgctgggctgcgccctcgctcgcggagcccgccgcggtcgcccggccgaagatgctcgtttacggcaactattgcgggctcgggaacaacgcgccgctgccgccgatcgacgtcctcgacgccgcctgcgcccgccacgacgactgcaccccggacactgacctgccaacaaaggcgtgcaacctccggcttgagcgggaagcgatggtaatcgccaacgatccgcaccagccggacggcctgcgcacgatggccggcttcgtggcggccttcgccgaggcgaacccgtcgcaagtcatcccagacctcgtgccggtcgtcgtaacggtgaatgcccctgcccgcgcgcctcggaccgcctacacgcggctgcggtga

SEQ ID NO: 5509 - DNA, 384 bp, Methylobacterium sp.
atgttgactcgcaccgtcatcgggctcgtcgcccccgtctgcctcgccgccgcgtgggccacgccgtccctggcacagccggccgccaatggcgggccgaagttcctcatccacggcaactactgcggccccggcaacaacgcgcctctgccgcccatcgacgccctcgacgcagcgtgcgcccgccacgacgcctgcacgccggatatcggacttccgacaaaggcctgtaaccttcggctggaacgcgaggcagccgcggttgctcgggatccgcggcagccggacaatgtgcgctccctcgccggtttcgtcgcgtcgttcgcggcgtcgaacgcgtcgagcccggcgccgacggtgctcccagcgagactggcgcgctga

SEQ ID NO: 5510 - DNA, 1533 bp, Methylobacterium sp.
atgtcgacgtatcacctgtcgcaatcggagtttgagcagcagctccagagtgtcgatccatccatccaacagagagttgaagccgcactatccgctgccggtgtggatattgccaaggatggtgtgaccctggaaacgggcccccaggggaacgtttctgttggctcgagcgtgaacctgttcgaggccgtcgctgctggcaagtacacgatcacggcgggtgacaagtcgatcatcgcgaccggcaccaacaaggtcacggttgatctggctggatctgggcagaacaccgtcatcgtcggttctggcggcgctaacgtgacgaccaacggtggggacaccgtcattggtggcagtggcagcagcgagtttgtagctaagggcgggggcaacgtcctgtacggcggttcggcccaggacacgctggcagcggtggacgggaacaatactctgtatgccggctcgggccgcaacaatctgaacggcggcgcgggcaacgactcgctgtacggcggcggacagagcgctctgtacggcggccgcggtgaccagcagctcgtcggcggcgccaacggctccgcgcgcgacacgctcgtcggcggcaatggaagcgacgtcctgtttgttcagcacggcaacaatacgctgatcggcaatagcggtgacacgttgtacggcggcaccggcaacgactcgctcagtgcggtgggcggcaacaacacgctgtacgccggctccggcctgaacaccgtacagggcggcgctggcaccgactcgctgtatggcggcggccagagcagcctggtcggcggtaccggcaaccagcagctcgtcggcggtgccaacaactccgcgcacgacacgctcagcagcggcgctggcaacgacatcctgtacgttcagcacggtaccaaccagctcatcggcaacggcggtgacacgctgtacggcggcaccggcaacgacacgctcagcgcgaccggcgggaataacacgctgtatgctggctcgggtctgaatttggtgcagggtggctcgggtcgggattccctgtacggcggcggccagagcagcctggtcggtggcaccggcaaccagcagctcgtcggcggcgccaacagctccgcgcacgacacgcttgtcagcggcgccgggagagacgtcctgttcgttcagaacggcagcaaccagctcttcggcaatggcggcgacacgctgtacggcggcatcggtaacgatacgctggcgaccactggcggtgacaactacttgtatggtggtgggaagaccgcgtttgagctcagcaacacgggcggcaacgatacgatcgttggtagctccaccgattcgctgcggatcgacaacgctggtctcggaactgcgtcctataattacaaccaggtcgataattccaccacgattacattctctggcaactcggccatgtctgttactgtgagtggcctgactcaggttacgtacagtgatggaagctcgcatagcctgggccagcaagtcccaccacacccataa

SEQ ID NO: 5511 - DNA, 144 bp, Methylobacterium sp.
ttgtttaacaccatcctggcgcttctcgccgtcctcgccgttatgaccgcccatgccctctacaagctcgtgcggctgcccttccggctcgtgcgcggcctgtttcgacacaaagccccgcgggcccagctgacggcgcgctaa

SEQ ID NO: 5512 - DNA, 144 bp, Methylobacterium sp.
ttgttgaacacgatcctggcgcttgtcgccgtcctcgccgttatggccgcccatgccctctacaggctcgtgcggctgcccttccggctcgtccgcggcctgtttcgacacaaggccccgcgggcccagctgacggcgcgctaa

SEQ ID NO: 5513 - DNA, 1500 bp, Methylobacterium sp.
atgcgccttgccgtcctccagttcacgcacgagaccgtcacgttcctgccgaacgacacgacccgggacgacttcacttatcccggctcgccggcctccggggccgcgctcctcgccaccgatcccaagggctacatgggcgggttcgtgcaggtggcgcgggagtacgacggcgtcgagttggtcgggatcacctcgccgctctggccgcgcaccggcaccgcctcgggctggatcaccgccgacgcctacgcgcatttcctcgggcagatggtggcggagctgcgggcgctgggcccgttcgaaggggtctacctcgccctgcacggcgcgatggcggtgcgcggtgtccccaggccggaggccgacatcgcccggcaggttcgcgccgcggtgggtgagggggcgatcctggtcggaaccttcgacctgcacggcaacgaggacgccgccttcctcgaccacgccgacatggccttcgcggtgaagtacttcccgcactacgacggccacctgcaggggcagcgggccgcccgcatgctggtgcgcgccgtgcgcggcgacttccggccggcgcaccggaccctcaaggtgccgatcctctcgccgaccgtcgtgcagtggaccggcgccgcaccgtggtccgacctcgtgcagcgggcgcttgtctgggaggcgcgcgagccggacgtgtacgtcaacgtcttcttcggcttcccgtggggggacgccccggacggcgggatgaccgtgcaggcgatcaccaacgccgacccggccctcgccgagcgggtggcgcgggacgtcgcggatctcgcgtggcggcagcggcgcgcgctgctcgagacgacgcggatccacacgatcgccgacggtgtgcgccgcgcgcgggcggcggtggcggagggtgccgccccggtggtcctcgccgaccacagcgaccggtcgggccgggcgacctggctgctgggcgagatcctgcggcagcgcctcgcccgcaccctggtcgccacggtggcgtcgcccgacatcgcggcggggtccctcgcggacggcgacccgttcgacgcgccggtcggcggcggcggtgacccgtccgcgggcgagccggtgcggatcaccgggaccgtgctgcgcgtcgtcgccgcgccggagcccggcgtcgccggcagcggtggcggcggcacctggatctgcgtcgcgttcggggtcggcaacgtcctcgtgctgagcccgcagctcgcgcagatcgtcgagcccgacgagctgtggcggctcggcctggacccggcggatttcgacgtcgtggcgatcaagtcgcgggtgcatttccggcgcggcttcgacgacagcggctacgcccgcacgatcctgctggtggagccgccggagccgtttctcggaacggtgcggctcgatcacctcgcctacgcgcagatgcgggccgccgacttcttcccctacggcgacccgcccgggcccgtcccgtccgacccgtga

SEQ ID NO: 5514 - DNA, 291 bp, Methylobacterium sp.
gtgaccttcacctggcgccggacgttcccgggcactcaccacgacttcgtggccgaggaggccggccagcacgtcggccgcatcaagcggatggacggcggcccgcagaacggtacgtggacgtggagctgcaccggctgccagcgcggccacgaggccgagggcgtccggccgctgaacggcatggccgacacgcgggacgaggcgatcgaggcgcttgctgccgcctgggcgcgggcgaaggcttggagcgcgcgcagctggcagccgctggtgccgggtggctcatga

SEQ ID NO: 5515 - DNA, 156 bp, Methylobacterium sp.
atggaatgggtttatcgcggcttcgagacctcgatgctcggtctcgctctctgtctcggactcggcgcctgcctcacgctcggaaccgcgcgcgtgccggccggaacgctctccgtcaccctgccgatgctcacggtgaccgcccccgcgccctga

SEQ ID NO: 5516 - DNA, 2535 bp, Methylobacterium sp.
gtggccgatgaaatcctccgcatgcaggccgaggtgcaggaccgctacagcggccccctgaaggcccttcgggcccagctgcttgataccgcccgcaccggggccgaccacagcgcgacgttggcgaaggggttcaaggcggtcgaggggacgatgcagtcgacggcgcggactgcgtcgagcgtcctgaacccagcatttgcaggtctcggaataacaggtctaacggcaggcgccgccgtgactggcatctcgaatgcgcttaacaaattgaccggtagcatgctgagcgtgggccagctcagccgcgaaactggtgttgccgccaaaacgcttcaagaattctcgtctgttgctggtcgcttcggcgtcgagcaggacgcggtagcctccgccaccaagaacttcgccgcccagatgcggaccttctcgatcgggaccggggaggcgttccgatgggtgatgcagcaaggccgggacgcgtctggccggaaggcgttccaggatttcgccaccgacctgcagcgtacctccgacgagggcgagaagctgaagaaggccctcagcttcatggagaccatcaaaaacccggtggagcggggcattttcgcccagcagttcttcgggaatcaggacctgggccggatcgccgatgggcacctcgggcgggtcgtggacctgttcaagaaggcgcgagagaagctcggcgagttcaggccggaggacatcatcgatgcggagaagttcgaccggtcggtgagcagcctcaagggctcgatgcagcggctgggcacgacgatcgcccgtgaggtgctggggccggccaccgagctgacaacgtgggcggatgatctggtttccggcaagcgtgccgacgtgaccaagtcgctccgcgaaggcttgcaagagctgaagaaagagctcggcgagatcaactggaagcagttcggagacgacagcctaaccgttctgcgtgagtcgactgcgctggccggcaagacggcggcggccttccatgcaatcgccgaagctatccacgcgatccgtgagggcaactacgccggtgcggcccgcggtctcgacggcgcgtcaggtccgctcgctcgccggctggcgccgcgggtcggcgatgatgagatcgcggcgaaggagcaggttgagtcctggaagaaggcgcttgccgaggccgagtatgaccaggagaccggcggcccggcgatcgacttcaagtcgcgggagccgctcctgcgcaagcggttgaaggaatcggaggacgtgctttccggcctccagggccgcacgcccgagcagcgccagaaggactttgaggccacggagaagctgcgcaaggcgctcgacgcgaacacggaggagctcaaggccagccggaacggcgccacggtgcagaagcagtccatggacacgcagggcggcctgttcggcggcgccacggtgcagacggcgggcttcggcagcggcttccggcggttcggcggttacggcggcggctctgggccggggtatgcgggtgagcagggcccggcaggcggcggcgctggtcgaagtctcggaggtggaggccggttcaacggactgggtagtagccgacccagcgtcgcgccgatcgggcctcgccccacggtcccacagcttgggggtccagccgagactgacgagcaggtgaccgtccacgggcacaaatggaatcccggtgccagcacctcggcaggtaaggctcgggttcaatcctggctgcagttcttccaagcccccgtggatcagggtggcctgggtgcggatgccggcacagcccgcgccatggtcgcgatgatgcagggcgagagcggcgccaacctgaaaccggacgctgaaggcgactacaaggacccggtcaatcgtcgcaatccgaccgcgttcggcacggcgcaatggcggcttgagcgattccaagcgttgaaggacatggcaggccgcatgggtacccaatggaccgatgttggcgcgcagcagcagcactttcggaacgaggtactgaacggccgttaccgcggtgtctggcgggacatcctgaacgcgccaaccgaggagcagaagctacggctgggcatcggtgggttcgagcgcccaaagtatccaggactggcctacgatttccggcttccgaacctgcgtcggcttcagcgtggcgctgcggcgaccggaggggcgaccgccgagcgtgccgatggcagcagcgccgcgctaatgcgaccagagcgcgccgacggcgccggctgggcggcccgtgaggcagcccggaagacctttgaagcgcagcaggcggaggcagcaggtcttcgtgccagcggcgcacgtgtggcgtctgcggcggctcaggcgggcgtggtggccatgccgaaggtcgaggtgaacggtagcgtcacgaacgtcgtggagcggcccggcccggacacgcggatccggactaccgccagcggcaagctcttccaggatgtggtccagcggagcggtgctcagatgaggcgagctgactga

SEQ ID NO: 5517 - DNA, 2031 bp, Methylobacterium sp.
atgtctcaggacgaagctctccgcatggccgccgtcgtcaccgacggcttcacgggtcccctcggcaagttgcgtgacacgctccgaacgatcggacgcgagggtgggcagcacaacgacgcgctcgccaagggcttcaaaggcgtcgagaccgcgatgcacggcgtcggccggaccgcctcgacggtggtcagcccggcgctcagcaccatcggcgtcacgtcgctgtccgtcaccgcggccgtgctgggtgtcggcgcggccatgcgcagtttcgtgagtgccggcgcctcgctcgggcagatgagccgtgagaccggcgttgcggccaacgagatccgcatcctttcgagcgtggcgggcaagttcggcgtcgagagcagttccgtcgagggcgcggtcaagaacttcgccaaggcgatgcgcgagatgcacgcgggttcgcgcgagaccatgaactacctgatgacgcaggggcgcacggccgaaggtcggaagttctttcaggatctcgcgcgcgatatcgacagcacgtccgatcagggcgagaagatgaagaaggtgatcgaggcgatggaggccatccccgatcccgtcgagcggggcatgttcgcccagaagtttttcggcaacgaggatttcggccggctcggcgacaagcacctcggcaagatccaggagatctggaaaaagacggctcagaacctcgggccgctggatccgaaggcggtggagagcgcggagagctttgagcgctcgatgaaaagccttcagaccacgatgtcgaagatcgggaccacgatcgcgagcgagctggtcgggcctgcggagcagttctccacgttcctgtccgaggcggtgtcggagcagcgtggcggggccatcaaagcgatccgcgagggcatacagggcatcgggaccgaattgggccggacggactggcagaccgctggcaaggacgccaaggcgttcctgagcgagacgacggcgctcgcgaccacgctggccggcgccctcgcgcgcattgccgagacgatccactcactccgcgaaggcaagatcgccgacgccttccggtcagcggacggcggcagtggcccgttggctcgcaagctcgctccgcgcgtcggcgatgaccagatcgaggcgcaggaaagcgtcgatcgtctgcgcaagctcctcgacgtgtctaaagaagcgcagcagcacgtcattggtcgggctcagatcggcgcaggcctgctggatgcccctgagaaggtgcagcgcgatctggaggccgccgaggctcggctgaaggtgcttcagagccgcacacctgagcagcgtcagaaggacttcgaagcgtcggaacggttgcgccgctccgtcgacagtttgaccgaggagatgaaggcagcgcgcggaagcgggaacgctacggttcagcagcagtccttcgatggggccggcgccgggttcggcggggctcgcatccagacggcgagcctaggtggggctgccgccgcagcacgggttggaaacatccttggcggccgaggcggtggcatttacgcgccgggcggcggtgaaggtgccgtgtcgcctccgctcgatcccaacgaccccgttgtgcgccgtcgatttgatgcgttccgggaaaaccggggcggtggccgttcgttcggcgagcctgcgaccccggccgagagggttggcgaaaggcttcggggcgaaggcgctagcggtgccggcgaccccggcatgctggacctgatcgcccgcgctgagggcaccactcgccgcggctacgacgacagcttcgcccatcaggtgtctggatccctcacggacaagacccttggcgagattgagcagatccagcgtggcatgcgcgggtcctccgcgatcggcaggtatcagttcatgcgcaagaccctgtttggcgggcgccggggcgacaccggcctcgtgggtgagttggggctgagccgcgacgacaagttcacgccggagctgctgatcctccctcggcatcgcggacacctctga

SEQ ID NO: 5518 - DNA, 1728 bp, Methylobacterium sp.
atgtccgagatgtccgagcgcgccaacatgaccggcgcccacgccctcgcggtcgcgctccaccggcacggcgtccgcgacgtgttcggccagagcatcccctcggcgctgttcctggccgcgccgcaccacggcatccgccagatcggctaccgcaccgagaacgcgggcgccgccatggccgacgcctacgcgcggatctccggccgggtcgcggtggtcgcggcccagaacggtcccgccgcgaccctgctggtgccgggcctcgcggaagccctgaaggcctcgatcccggtcgtggcgatcgtccaggacgtccaccgccgcttcaccgaccggaacgccttccaggaactggaccacctcgccctgttcgcgggtgtcgccaagtgggtccgccgggtcgcggtcgccgagcgcatcgacgactacgtcgacatggccttcgcggccgcggcctccgggcggcccgggccggcggtgctgctggtgcccctggacctcctcgacgagcggccggacttcgaggccgccgcgccgcgccggtcggcgagcctgggcacctaccccctcgaccgcacggtcgccgacccggcccggatcgccgaggccgcggacctgatcgccgccgcgcggcgtcccctcgtgatcgcgggcggcggcgcccattcctccggggcctacccggaactcgccgccctgcagggcctcggactgccggtcgccacaacggtgatgggcaagggcgccgtcgccgagaccgacccgctctccgtcggcgtcgtcgggtacttcatggcgccgcgggcgcgctcgtcccacctgcgcagcctcgtcacggaggccgacgtcgtcctcctcgtcggcaaccgcaccaaccagaacggcacggacagctggtcgctctacccggcggacgcccgcttcatccatctcgacgtcgacgggggcgaggtcggccgcaactacgaggccctgcgcctcgtcggcgacgccaagctgaccctcgccgccctcgccgaggcgcttcggcagcgcgacctggcgggattggagggccgccgcgcgccgctcaccgacacggtcgcccgcgcccgcgaggcccaggccggcgacatggcccgcctcgtcgacatggaggccgcgccgatccgcccggagcggatcatggcggagatcgacgcggtcacgaccgccgagaccgtcgtcgtcgccgacgcgagctacgcctcgatctggatcgccaacttcctgacggcgcggaaggccggccagcgcttcctgacgccgcgcggcatcgcgggcctcggctggggcctgcccttcgccctcggcgccaaggccgcccgcccggacgcgcccgtgatctgcgtgaccggcgacggcggcttcggccacgtctggtccgagctggagacggcgcggcggatgcggctgccggtcatcgtcgtcgtcctgaacaaccagatcctcggctaccagaagcacgcggagctgagcctgttcggcgacttcaccgacgtctgcgacttcgaggcggtcgaccacgccgccatcgcgcgggcctgcggctgtgccgggacgcgggtcgagcgccccgaggatctcgcaccggcgctgcgcgacgcgctcgccggcggcgccgtcacggtgatcgacgtgatcaccgaccagcgcgcctacccgccgatcaccagcttcgagggcaaggacgccctcgcctactga

SEQ ID NO: 5519 - DNA, 669 bp, Methylobacterium sp.
gtgccggactgggtccgtccgatcgtcaaggagagcctgagcgagcgggcctaccgcgagctgcgcgtcgcgctgatgcgcgggcagttgcggcccgacacgcgcctgcggctccggccgatgtcggcccggttcggcatcagcgcgactcccatgcgcgaggccctgctccggctcgtcgccgagaaggccctcgcactcgacgcgcgcggcagcgtcgtcgtgccccgcctgaccctggatcagctcctcgagatcagggcgatccgcaccgacctcgaggggcgtgccgccgccgctggggcagccaggcgcgcggccgaggtcgacgacctcgaggcgatccacgcgcagatctcgcactgccacgcgagccgcgacttcgcgcgggctgtgaacctcaacaccgaatttcacctgacgctgtgcagactcgggcagatgccgatcctgtacgagatcgtggagttgctgtgggtgcgctgcggcccgatcctgtcgcacctctacgatgacggcgtccccgactgggaaccgcacccccatcgccgcatcattgacgccctgcgccgcggcgattcggaggcggcccgggatgccgtgcgcgaggacatcgagcgcggcgggagcggcctgttcgcgcatgtccgcgcggccgccacagggtga

SEQ ID NO: 5520 - DNA, 648 bp, Methylobacterium sp.
gtgctcgtgatgggtagcctgccgatcggcctgggccacttccgccgcgatgagcgcgggatcgccgccgtcgagttcgcgctcgtcctgcccctgctgatcgtcctgtatttcgggaccgccgagctgacgcgcgtcgtcgacgcgacccggaaactgaccctgttcgcgcgcacgctgggcgatctgtccggacgggtggacaacgctctggccacccagaacgggatggctctggcgacacaggacgggatgacgaagatcaccagtgcggcgaccgcgatcctgcgcccgctggacgcgtccggcctgcagatcgtggtcaacgcgatgggcgtggaaacggtcaacgggtcgctcaagggcttcgtctgttccagctggccgcagaacgccacgcagcggccggccaaccaggccaacgggagcaacggactccccgccacgccggccgcctatcagttcgacggggcccgctacatcctggcggaagtcacgatgccctacaccccgatcatcggaagtgccctgtaccgctggatcttcggcggccgcggattgaccttcacgcggcagatcccgtggtccgagcgcacccccagcgagatcgtcatgccgggcggcaccgcctgcccggtctacaactaa

SEQ ID NO: 5521 - DNA, 636 bp, Methylobacterium sp.
gtggggcaggcgatcctcgggaccgcggcgtgcgccgatccgacgctgacccggctggagacggaactcgacgccgcctacgaacgggcgcgggagcgtgtagccggggaaccggctctcgtagaagcgttgcgcggcgagcaggcgatgtttgccgagggccgcgcggccgtcgcggcgttgcccggtgcgagcttggccgactacctggcgtcgtggcgatcctggctcgacgcaatcggtccgccgaggccgggctgggacggcatctggctcaccggagccggcagcctagagatcgcgccgcggggagacggcgtctaccgcatcgtggcccacgcggacgagccgacgcgcggcgcgtacacttgcgcgttcatcgggatcggccggttaaggggcgacgcgatcgaggtcgagtgggacgcagcggacggcggcgacggagcggacggctggacgctgacgatccggcgtgccgaggatctgatgcatgtcgagcagcatcgcggcggcagcgaagcggtgacgccgccgttctgcggccaccacggcagtctagatggtcactatcttccggcgctggtgaagcccgggtccgtgaccgcctggggtcccgcacgggcgacgccctga

SEQ ID NO: 5522 - DNA, 2970 bp, Methylobacterium sp.
gtgcctgggcgcctgaggccgccgccggtccccgatgcccgggagccgctcgcggccctgcgcccgcgcggctgggtgcatgccggcacgatccccctcgacgggatcctgatggcgcgcggctccgtggggccagactggcgcgcccggctccttccctggctcgagcacgccgcggaggtgcgggcacgcggcgatcgcgtgctcgtgctgttcgccgcgcccgtcacgcgggactgctcggccctgggaccggtcctgccggtcgtgcgcagtgccgggatcctgaccgccgtgcccctcgccgagccggaggcgcccgtcgccgcggccctgcgggaccatgtcgtccacatgacggggggacgcctcgccgccgagccgctggcggccttcgccagtctcgacatcgccggctggtgggatctcgacgcgatcgcggtgcatccggccgaacgcctccccgtcctgcgaccggcgccgccggcgcgccgcctcgtcagcgcccccgccctcgtcgccgacgcggatcccctcgcgccggtccgcgacgccgtgagccggcggccgcggcgccggacgaagcacgtcctcggcgatctcgtcacgcgcggccggcgcctgatcgtcggcgcgttggggctcctctggaccgcctacgtcgtcctgctggccttcatcatggtcggcgccatggtgctcggcttcgccgagaacgtccggacgacggcggagcacggggccgccgcggcccactggggcagcctcgcgctgccggtgctggtcctgctcgtcctcgcgtggttcgcgttccggcgccgcggagcgcgggccgcgcgtgagggcgccgcgccctcggccatcccgcccgccggcaccgggcgcacgcccatctggcgccgggcagcggcgtggctcgcgtggcgctcaccctatgcggcccatcttcgccgcctctatgcccggcggctcaccgaggtcgagcggctgttcgcggcggggcgcgtcgacgaggccctgtaccgggcgatcggtctcggcggcgaggcgcggcgcgggagcgccttcgccgacctgcccctgaccgggcccgggctgcgcaggagcctcgacctcgatctcgggccgcagcgagcgagcggactgagcctcgcgcccgcggacgagatccggctcgcggcgctctaccgcgcgcaggccgtggcgatggccggacgcggcgacacggatcgcgcggccttcgtgctcgacagcctggtcgggaacccgcacgaggcggtgcgcctcctcgcggaatccgggcgcctggagaccgcagcccgtctggccgaggcgcgccgcctcttgcccgcgacgacagtcccgctctggttccgggcggggcagaccgagcgggccctggcactcgccgcccgccacgacgcccacgcggagctctggaaggaactcggggccgacgatccgttccgaccggtcctggccgaggcctgggccgcgcgcctcgtcgggatcggcgccctggatcgcgccgccgcggtcaccttcggcctgcccgctctggccgagcggcgactggactggatccggcaagccctcgacgccgaggcgccggtgcaggccgagcccctcgcccgagcgctgcgggccctgccctgggagggacgggacggcaaccggctgcacgccgccttcgcggatctggtgggcgcgaccggggccgaggcggcggggcgccggagcgcggtcgccgcgctcctgctcgacgcgcagttcgagggcggtccggagcggccgccgacgcccgccttcgcgctcctctgccgcggcctcgcgcgccgcctcgccaccgatgacggcatcctcggccacgatgcggagcgcgcccggctcgccgggcgcctcgcggaagccggcggacaggtcgccctgcgccagcatctccggcagctcaggacgcgctccgcaccgtccgcctcccggctgagcggcccgctcgtcgtcccggacggcccggcgctggccgagatcgccgatgccgcgctcctgtcgggcgggcggctgctcctgggctaccgttccggtctcgtgcgcctcctcggccgagccggccgcgagcgctggcggggacaggtggatggcctgacgggcttcgcgcgtctcggcgcgggcgaccgggccatcgttctgcgcgagacgctcgaaggccccgacgtccagctcttcgacgccggcaccggacggctcctgccgctcggtcctctgccgatcacgcactggcatggtcaggcggacgagaccggctggctggtcttcgacggagaggcgctcgtccggctggacaccgcctcgctcctcggtcgcgcgggcggcgcgcccggctccgacggcgccctggcgcaccattggcgcctgcccatgaccgaaccgggccggccgctgctgctcgccgccttcgcggacgcgagcgccctgatctatgcccggcacgacggcctgatcgagtggtggagcctgtcctcccgcaccctggcggtgacgtgccggttctggaccccgcccgatcgcggcagcggcgtgctcggcctgacggaggccgtcgcgtggtctctcgaggggaccggcgcgaatccgcacctgcgtgcgcatccccacgttttcacgacggccacccgggagcaggagcgcgcgttggtcgaggccgccgcgcgcgcggaggccgcggatccgccgcgcctcgtcgcggcggagaacgaccgcctctgggccgcgaccgccaccgaggaggggacgctctgggccggcgtgcccggcgcgaaccggatccgcggaccggccgtgctgtggcagggcagcgggagcctgcgcgcgcgcttcgctccggagggcgacgtcgcggccatcctcgacgagcgtggccgcctgatcgtgttcgagaccgtcaccggacaggtgaccctgcgcctgatctga

SEQ ID NO: 5523 - DNA, 1914 bp, Methylobacterium sp.
gtgagcgccgcgtcgtcgagtctgcggaagaccctgccgccggcgctggcacagtggacggcgctcttctccgacatggcggaaccggatctgcggatcctcgcggcgctggtcgaggcgctgcggcccctcgtcgagccggccgacggcgcgggcgggcaaccgcagggcgagatcgacgggctggggggcctcggaacacgcggcgggatcgagcgcctcgtcgcctcggaatggctctggcgcgacctcgatccggacgccttcctgcagcgcgcggccgagcgcgacctgctgaccctggagccggtctaccgtcaggcggcggatgcgggcgccgtgctggtcgtggtcgatgccgggccggaactcctcggcgccccccgcctcgtggccttcgcggcgctgctctgcctggccggcctcgcccggcggcgcggggcgcgccttctctgggcctcgaccgccacgccggagcggcgctggctcggcgcgttgaagcggtccgacgccgcgatccttctccgcgagagcgccgccacatccctcgacgcggtcgaactcgaacgggtcctggccgagccggtcgcgacccgcgcgggcgggcggcccggcgccagcctctggctcatcggcgggtccgacctgcccgaagcggcgcgaccgtgccggcggatcaccatcgcggagcggccgcgtctcggatcggacggcctcgccgtggccgccgacgtcgcggtcctggacgccagcggccctgtcgccggcgcgcgcctggacctcccgccggagcgcgaggccgtggggctgttgcgcgacccgttccggccccgtccggctcccggacgcccgccgccccggcggtccacgcccgaccggagcgcggcgcctccggactgggcgccccgcgggctggccttcgcgccctgcggcgagcacctcctggtggcgcggcccgacggcatcctcatcgtccccgtcaccggcacatccggcgcgctgcgcctgccggtcgcgccctacgagcgcctcgtggggctcgacgtcggccggtcgcggatccgcgccgcgtgcctcaacgtctacgccgacgacgcgcgcctgacgctccgcagctggaccttcgaccgctcgggcgccgctgcgacactcgaccggcggatcccgcgggaccatcccctggtgagccggcgcctgccgaaggcggttctgccgcccctcgggacgctaaaacgccgcaaccggtcctggctcctggcggccgacggcacggccttcctggtctccgagaagcggctgatcgagtacgcgccgctcgcgggcgaacttcccctcgcggtcacgcccgcgggtctgctgatgcgcgatcgcgcggacggggtgatcgcgcggcggccgtccgacgggaaggtcgtggcgcggttccccagccgggccgagtcgctgcggccgggcggcggcctcgccctctgcgcggtgcgcgggcagcccaccctggggatcgagcaggcgggcgggcactgggacgtggtgaacgccgcggacggaacggtcgggcacctccggccgcagggccggatcatcggcatcgtgccccagtacgacggcgtgcgcggccaggccgtcgagggcctcctcgccctccatctcgaccgcgaggaagcaggctcggcgcgcctgacgttccggaccccggacggcgtggcggcgggcgatcccctgacgcttccggacgcgaccctcgacgcggtgcgcgtcaccgtcgatgccgatgccgtcccgtgcatcgcggccgcgcggtgcgacgccgcgggcttcgttgacgcgctcgccttcagccagctccaccgcggatggtcccacctgacggatctcggcgcgttcgcggaaaccgtcccgtgcctgggcgcctga

SEQ ID NO: 5524 - DNA, 1077 bp, Methylobacterium sp.
atggtccacctcgcgctggtggcgcgcgagcatctcctgctgatcggaccgcccggcaccggcaagtcggccgcggtgcgggcctgcgccgccgggaccggggcgcgctgcttcgagtacctgatcgggcgcttcaccgaaccggccgaactgttcggcccgctggacctcgaggcgctacgcgcggggaagctgcggccggacatctccggcatgctgccggaggccgagttcgccttcctggatgaggtcttcctcggctcgaccgcgatcctgaacgcgcttctcggcgtgctgaacgagcgccgctaccgccgggggcatttcgacaccgccgtcccgctgcgctgctgcgtcggcgccagcaacgccctgccggaggatcccggtctcgcggccttcgccgatcgcttcctcgtcacggccttcgtcgatcccctggccgacaccgacctggaggccctgctcgccggcgacccggtcgcgtccgtcgaacccggcgacggggatgcgccgctgacgctcgcggagatcgacgccctcgccgaggccgccgcgcggatcgacctcgcgccggtccggcccgcctacgcgcaggtggtgcgcaagctccgcgcccgcggcgtgcggctgagcgaccggcgcgtggtccgggggcagtcgctcgtcgcggcggcggcgctcatcgcgggccggacggccgcggaggaggccgacctgtggccggtgatccacctcgttcaggaccggatcgcgcaggacgaggcccgcgacctgctgcgcgtcgagctcggcgccgcggcgagccccgtcctgcccgcggccgccaaggcggcgggctacggtccggccgcccgggccgcggacctcgccagggagggggaggctctggccgcctccgccccggacgaccgcaccgcccccaccttcgaggcctggctggtccgcgccgaatccttcctcgtgcagatcgacgccgccttcgggacggaggagcgcccgccggccctcgctgcggcgcgggacgcgctgctgacgcgctgccgggcaccggtcccgggcatgaccccggcgtga

SEQ ID NO: 5525 - DNA, 2346 bp, Methylobacterium sp.
atgatccgcgggttcgggaggtccgggatcgcgcgccgcgtcctcgtggtcggcgcgatcccgatcctcgtcgcggccgccatcgcgctgggcgcctggatcctgctctacgaggccgagcgggcccggaccggcgccgtggtggcgaccgagaccgcacagacgctgacgtcgatgaaccgggcgcgggcggacgctgtcagcggcggcaccgcgcggcgggacgaggccgagcgacgcttcgacgagcgggccgccacggcggccgggcagctcgaacgtctggacggtctcgcgcgcacgcgcggccagtcggctctcgtggcgaccgtcacgggcgatctgaactcgcaggcgacgcgcatgcgctcgctcctgctctccgagcggacggcgaacgcgacgatcgccgatatggcccggcgggcggacgccctggtggcgctgaccgacgtcgcgcgccggcgccagcagcaggacaacgcccaattgatcgccgtcctggccgtcaaggatgccgagctggagcggaaccagggcgtcgtcacggccctccgggagctccgggaggcgatcagcaccgcggagctgaaccgggcgcgcatcggccgcccggtcttcccgatcgagttcgatgagctcgccgccgacctacggcagctcgatgcggtgggcgaccggctgcgccgcgtcctgcgggtcgacggcgaggcgggggcggcggaccgggcgacggagctcctgaaggcgtaccgcgaccggagccggaccgaggacggcctgaaccgggtgctctccgagggcttcgagctgacccgcgcgacccaggccggccgcgtcctggtcgagtggtgcgaccagctcgtccaagtgaacgtcacccggcagaaccggctctacgaggaggtcgcgctcctgatccgtcactcggtcctctcgaacgaggccgagctctccgcccaggacatcgccctcacggccctacgcctggcccggcggacggatgcggccctggcgcgccgggatactgcggaagcgtcgcgggtactggaggcgggcgcggagctgtcgggcacgtcccggacgctgctcatcccggtgagcatccgggacgagatggcggaggcgatcgacgggtggcgcacgcagctcgccgcgacgatcgagaagatcggcgagcagaacgagacgatcgccgacatggacagccgcgccgccacgatgagcgccaacgcgcagaccctgagccgggccttcatcgacgatgccgaccagttcggcagcgtgatccggcagctgctggtcgtgggggcggtcggtgccctgtgcctggggatcggcgccgccgccgcggtggcgcgctcgatcacccggccgctgcacgcgctccagcacagcatcgtcaccgccgccgccgcgcccgccccagaggatatcggccgcgacagccacctgctcacccgacgcgacgaactcggcgacatcgccagggcgaccaacgcgttcctggagcagatccgccgccgcgaagcggaccggcgcaacgcgtcgcagcgggccgacgacgcgctcacgaacttgcggcaggcccaggaggacctgatccgcgcggagcggctcgcctcgctcgggcagctcgtggcgggcgtctcgcacgagatcagcaccccgctcggcatcgccctgaccacggcgacgcaggtccagtccgactcggccgcgttcgagcgcctcgtgggcgagaaccagctctcccggtcgcggctgacccagtatgccgggcggatgcgggagggcgcgcagctgctgaccagcaacctgatgcgcgcggccgatctcctctacagcttcaagcaggtggcggccgatcaggccatcgaggaccgccgcccgctgaacctcgcggactggatcgacgagctgctgaagagcctgcgcgccctggcgcggccgggccggcacgtcttccaggtcgagtgcccgcccgatctcgtcgtcgacaccctgccggggatcctggcgcaggtcgtctcgaacgccgtcaagaacgcgatcgagcacggcttccaggatcgggagggtggccgcatcaccatcacggggatccggtccggggacggcatcggcctctcgatcgccgatgacgggcgcggcatcgacggggccgacctcggccgcgtgttcgacccgttcttcacgacggcccgcgcccgcggcggcacgggcctgggcctgcacatcgtccacaacctcgtggtgaaccgcctccaggggcgggtcgaactgcagagcagcgcgggtgccggcacggtgctgcggctgtggcttccggagcggctggcatga

SEQ ID NO: 5526 - DNA, 888 bp, Methylobacterium sp.
atgcccgcgtctccaagcctcgcccgggaccgatcccgcatcgcggccctcgctctggcgacgctgatcggcgtcggcgatccccggccgggctggtccctcgacatgccggacagcccgcgtcccgcccggccgtcccggccggtgccgccggagctggccgcggccctcgcggcctacaggacctacgtcgtggcccaggccgacgccttcgtgcgcgagaccgcgcgcttcgtcgcggcgatccaggccgggcagctcgcggaggcgcgccggctctacgccccggcgcgcgcgccctacgagcgcatcgagccggtggcggccctgtttcccgagctgatcaagcgtctcgacgtgcgcagcgacgagttcgagctgcgcgagcgcgatcccgccttcgtcggcttccatcggctggagatggcgctgttcactctcggcaccacggaggggctcggcgaggtcgcggagcggctcgccgccgagaccgtgaccctgcgcgaccgcgtcgcggcgctcgccatcccgcccgcccgggcggtcggggcggcctcggcactgatcgaggggatcgccgccaccaagatcagcggcgaggaggagcgctacagccgcaccgacctgtgggacttccaggccaatatcgagggctcgaaggtggtgttcacgctcctgcggccgctgctgacggaccgggacttcgtggcccgggtcgagcgcagctacaagagggtcgaggacctgctcgcacgctaccgcagtccggatggcggcttccagagctacgacaacctcaccgcccgggaccgcaacgccctgaaggggcccatcacccttctggctgaagatctgtcgaccctgcgtggccggttgggtctagactga

SEQ ID NO: 5527 - DNA, 1245 bp, Methylobacterium sp.
atgatgcgtttcccgtcacaggtcaccacccgccgccagcttctcggcggactcggcgccgcggcgctcgtcggcccggcccgggcggaggacgccacgccgaccatcgccacggaagggacgctcgtcgcccagcccttctacggcccccaccaggccgggatcgtcaccccgcagccggccgccgccctgtacgtcgccttcgacgtgctggccgagcggcgcggcgagctgccccacctgtttcgaacgctcaccgagcgcctcgccttcctgacgcgcggcggtgccgtgcccgatctccacccgcagctcccgccgcgcaattccggcatcctcgggccgaccatcctcccggacaatctcaccgccaccgtctcggtcggtgcgagcctgttcgactaccggttcggcctgggtcgcgcccgcccgcgccatctcgggccgatggagcgcttccccaacgacgccctcgacccggcgcagtgccacggcgacctgctgatccagttctgctcgaacaccgccgagaccaacatccacgccctgcgcgacgtcatcaaggcgacgcccggcctcctcacgccccgctggaagatggagggcttcctcccgccccacgtggtgaagaccatgggggccgacaccgtgcgcaacatgctcggcttcaaggacggcaccgccaacctcgacgtgcgggacctccggatgatggaccgttacgtctgggtcggagcggggcaggacgagccggcctggacgacaggtggaagctaccaggtggtgcggatcatccgcaccctcgtcgagcgctgggaccgcacgccgctcggcgagcaggaggccatcatcgggcggcacaagggcagcggcgcgccgctccggcagggacacgagcgggacgtccccgactacgccgccgacccggacggcgaggcgatctcgctcgcggcccatatccgtctcgccaatccgcgcctgccgggcaccgagggcagtctgatcctgcgccgcagctacaactattcccgcgggctgaccgccgccggccagctcgacatgggcctgctgttcgtctgctaccaggccgacctcgccgccggattcatcaccgtgcagaaccgtctgtccggcgagggtctcgaagagtacatccgtccgatcggcggcggctatttcttcgccctgcccggcgtgtcggggcccggttccttcctcggggaaggcatgctggccgcgacctga

SEQ ID NO: 5528 - DNA, 1302 bp, Methylobacterium sp.
atgcagacggatcgcgtcgatccgacctaccgcaagctgcgctggcaaatcttcgcgggcatcttcctcggctatgcgggctattacctgctgcgcaagaacttctcgctggccatgccctacctcgtcgagcagggcttcagccgcggtgagctcggcaccgcgctctccgccgtcgccatcgcgtacggcctgtccaagttcctgatgggcatggtctcggaccgctcgaacccgcgctacttcctgccgatcggcctcgtgctctcggcgctggtgatgttcctgttcggcttcgtgccctgggcgacctccagcgtcggcatcatgttcgtgctgctgttcctcaacggctggttccagggcatgggctggccgccgagcggccgcacgatggtgcactggtggtcccagaaggagcgcggcggcgtcgtctcggtctggaacgtggcgcacaatgtcggcggtggcctgatcggtccgctcttcctgctcggcctggcctggttcaacgactggcacgcggcgttctacgtgcccgccgccgtggcgctcggcgtcgcggtcttcgccttcatcaccatgcgcgacacgccgcaatcctgcgggctgccctccgtggaggcctggaagaacgattatccggacggctacgacgcgaaccacgagcgcgagttctccacgcgcgagattttcgtcgagcacgtgctgaagaaccggatgctctggtacatcgccttcgctaacgtcttcgtctacctgctccgctacggcgtgctggattgggcgccgacctacctgaaggaggccaagcacttctcggtcgacaagacctcctgggcctacttcctctacgagtgggccggcattcccggcacccttctctgcggctggctgtccgacaagctgttccgcggcaaccggggcgcaacgggcgtggtgttcatgttcggcgtcatggcggcgacgctggtctactggctcaatcccgagggcaatccgggcgtcgacctcgcggccctgatctgcatcggcttcctgatctacggaccggtgatgctgatcggcctccaggccctcgagctcgtgccgaagaaggcggcggggacggcggcgggcttcacgggcctgttcgggtatctcggcggctccgtcgcggcgagcgcgctggtcggctacacgaccgaccattacggctggaacggctgcttcatcctcctgctggcggcctgcgtcctcgcgatcgtctgcctgtcgctgaccctgcggcacagcagcaccgcggtcgcgcagcctgcctga

SEQ ID NO: 5529 - DNA, 1125 bp, Methylobacterium sp.
atgagccggacggacaacgccgatgccggcgatgaggtcgccgggatcgtcctcgatcaggtcgagcggttgctcgcccagcacctcacgccggcgctgctggcggccagcgacggggccgcgggcgcggccgcgtggccgacggatctctgggcggcgctcgccgagagcggcctgccgctggcgctggtgcccgaggcggagggcgggatcggcctcgccgccacggtcgccgcccggctgatccggcgctgcggacgggccgccctccccttgccgctgccggagaccgtcgccggcgcggcgctctgggcagccgcagggggacaggtgggcgacgacgccctgtcgctggtcccgggcggcggtcccgtgcggatcgcgccgcacgcggagggtttcgttctggacggacgggtcgcgcaggtgccctggggcggttcggtcgccgccctgctcctcgacaccgtcgatgcgtccggcgtcccgcacctcgtgcggatcgccgcgcccggcgcgatccgcgacacgcaccacaaccttgccggcgagccgcgcgacacgctcgatctgaccggctgcaccgtcccggccgaggatgtccgcgccgcgccgggctgggcgaccggtacgggcgtgccgtccgtcgaggcagccggcgcctgggtccgggcgcagcagatggtgggcgccctggagacctgcctcgcctccgccctcgatcacgcccaggagcggcagcaattcggccggccgctcgccaagttccaggcgatccagcacatgctggccgaggccgcgggccacgtcgcggcggcgaccgcggccgccgatctcgcggccgcctgctggggcgacccgcgcttcgtcctcgcgaccgccatcgcgaaggcgcgctgcggcgaggcggcgggccacgtcgcggcgatcggccaccagattcacggggccatgggcttcacccaggagcacccgctccaccgcgccacgcggcggctgtggtcctggcgcgacgagttcggatccgacgccctctggcaggagcggatcgggcgcgcggtctgcgcgggcggcggcgcggccctctggccgatgctggtcaggctccgcggcggtgccggctga

SEQ ID NO: 5530 - DNA, 1152 bp, Methylobacterium sp.
atgcacagtttccgcttcagcgccgagccgctcccgcccgaggccgagtccgcccgcgcctccgtccgcgccttcctcgacgcggaacgggcggccgggcatttcgtgccgcaccggacctcgtggacgaccttcgacgccgccttcagccggcgcgcgggggccgcgggcctcatcggcctgacgatgccggaggcctatggcggccacggccgctccggcctcgtccgcttcgtcgtcaccgaggagatgctggcggcgggcgcgccctgcggcgcgcactggatcgccgaccgccagtcgggcccgcagatcctccggcacggcaccgaggcggccaagcgggcgatcctgccgcggatctgccggggcgagtgcgccttcggcatcggcatgagcgagccgaattccggctcggacctcgccgccgtccggacccgcgcggtgcgcgacggcgacgattgggtgatcaacggctccaagatctggacgaccaacgcccatcaggtcgactacctgctggccctggtccggaccggggagcccgggccggaccggcacggcgggctgacccagttcatcgtcgacatggcggcccccggggtgacggtgcggccgatcctcgacctgtcgggccatcacgagttcaacgaggtgttcttcaccgattaccgcgtccccgacgcgatgcgggtcggcgccgagggcgcgggctggggtctcgtcacggaggaactcgccttcgagcgctcggggcccgaccggttcctgtcggattaccggctgctcgtcgaactcgtcgaccggatcgggccggagccggaccggttccaggcggtcgagaccgggcggatggtggcgcagctcaccgcgctgctgggcatgtcggcctcggtggcccgcctcctcgaccagggcatcgtgccgggcgtcgaggcggcactggtcaaggatgtcggcaacggcttcgagcgcgcggtgccggagatcgcccggcgcctcgtgccggtcgagccgagcctcaccgcgcagggcgacgccttccgcgaggcgctgggcggcgtgatcctgcgggcgccgtccttcacgttgcgcggcgggacccgcgaggtcctgcgcggcgtcatcgcccgggggctggggctgcgatga

SEQ ID NO: 5531 - DNA, 912 bp, Methylobacterium sp.
atggatccgcgcgtgggcgaccagggccgtttcgagccgtgcggcttccggaaccgtcgtttcgcgcgtcgcgtcatggttgagcgcatcgctccgcggggtgccgcgtccaccgacctgacggtgggggccgaccctgccggctcggatatgaccctggtgaagtccgccgggcgggtgctccagatcctggagctgttcgacgagatccagcgggaggcccgggtctccgagatcgccgagcggctgaacgtcccgcaatcctcgacgtcggtgctcctgaagagcctcgtccggctcggctatctcgactatgaccgggggagccgcagcttcctgccgtcgccccgggtggcgctcctcggcgcgtggctcgacaaggggccggtgcgcgacggcagcctcgtgcgcatgctcgagcacctctcggagcgcacgggcgggaccgtgatcctcgccgcgcgcaacgcgatcttctcgcagtacgtccacgtcctgcaggcccgcaccgccatgcgcttccacgtcccgcccgggacgcgccgcctcgtcgtctggtcggcgaccgggaccgcgctcctcgccgacagcccggaggccgagatcggtccgctggtccgccgcacgaacgcggaggcgccggccgagcagccgccgatcgcgctcgcggccgtcctggccaatctggcgcggctgcgtcgggacgggcacttcttctcccgcgggctcgtcacgcccggcgccggctcgatcgcggtcccgctgcccaggcgcatcgacagcaagggccgtccgctggcggtcgccgtctccggcctgctcgacgagttcgagcgtcgggaagcggagatcgccgcgacgatccacgacgcggtggcgcggttcctgccggaggatccctcgcggccctga

SEQ ID NO: 5532 - DNA, 1437 bp, Methylobacterium sp.
atggcgcttccggacctgagccgcttctacatcgacggcgcctgggtcgagccggtttcggcccggccgttcccgctgatcgaccccgccaccgagacagcgttcggcaccctcgcgctcggcgatgccgaggatgtcgaccgggctgtccgcgcggcccgcgccgccttcccggccttctcggagacagcgcccgccgaacgcgtcgcgctcctgcgccggatcctcgcgctcttcgaggagcggttcgagatcttcgcggagacgatccggcaggagatgggctcgcccatcggcttcgcccgcaaggggcaggcggcgcgcgggccggcgcacctcaacgcgctcatcgcggtgatggagcgcttcgccttcgaggaggatcgcggcaccacccggatccggcgcgagccgatcggcgtctgcggcctgatcactccctggaactggccgatcaaccagatcgtcgtgaagatcgccccggcgctcgcggccggctgcacgatggtgctgaagcccagcgagtactcggccgtcagcgcgatgctgttcgcgcaggtcctccacgacgcgggtgtgccgccgggcgtgttcaacctcgtgaacggggacggccccggcgtcggcgccgcgatcgccgcgcatccggggatcgacatggtctcgttcaccggatcgacccgcgccggaatcgagatcgcccgggcggcggccccgaccatcaagcgcgtcgcgcaggaactcggcggcaagtccgccaacatcctgctcgaggacgtcgacttcgaccaggcggtccggcgcggcgtcgcggcctgctgcacgaactcgggccagtcctgctcgatcccgacgcggatgctcgtgccccgggcccggatggacgaggcggccgccatcgcggccgaggcggcggcgggcctccggctcggcccgaccgccgatcccgagacggatctcggcccggtggtcaaccgcacccagtacgagcgcgtcgtcgggctgatccgcaccggcatcgcggagggcgcgcggctcgtcgccggcggcccggaacggccggaccacctcgaccgcggcttctacgtcagcccgacggtgttcgccgacgtgactcccgacatgaccatcgcgcgggaggagatcttcggcccggtcctgtcgatcctcgcctacgacagcgaggacgaggcgatcgcgatcgccaacggttcgcgctacgggctcgccgcctacgtgcaggggcgggaccgcgaccgggcgcgcgccgtggcgcggcggctcatcggcgggcaggtccacatcaactacccgccgccggacgtccacgcgcccttcggtggctaccgccagtccggcaacggccgggaatggggtgaggccggtctccaggaatacctcgagaccaaggcgatgatcggcttcggcctcgactga

SEQ ID NO: 5533 - DNA, 954 bp, Methylobacterium sp.
atggccttcgatcgacacatcttctccggcacgatcccggccctgatgacgccctgccggccggaccggacgcccgacctcgacgccctcgcgcgcaaggggcgggagctcgtcgatgccggcatgtcggcggtcgtctattgcggctcgatgggcgactggccgctgctcaccgacgaggagcggatggcgggcgtcgagcgactgctcgcggccggcgtgccggtgatcgtcgggaccggcgcccagaacccgaagcgggccgcggcgctcgcggcccacgccaaggcggccggcgcccacggcctgatgatcatcccgcgggtcctgtcgcgcggcagctcggccgcggcccaggaggcgcatttcggcggcatcctggaggcggccgtcgacctgccgtcggtgatctacaacagcccctattacgggttcgagacccgggcggacctgttcttccgcctgcgcgcccgctacccgcacctcgtcggcttcaaggagttcggcggcgcggcctcgctcacctacgcggccgagcacatcaccggtcagtcgcccgacatcaccctgatggtcggggtggatacccaggtggtgcacggctacgtcaattgcggcgcccggggcgccatcacgggcatcggcaacgtcctgccgcgggaggtgctccacctcgtcggcctgtgcgagaaggccgccgcgggcgacgtccgggcccggcgccgggccgaggaactcgacgccgcgctggcgatcctgtcgagcttcgacgaggggacggacctcgtcctctactacaagcacctgatggtgctggaggggaacccggaatacgcgctgcacttcaacgccaccgacgcgctgagcgccggtcagcgccactacgcggagacgcagctacgcctgttcaaggcgtggtacgcgcactggtcggaggcgggcgccggggcctga

SEQ ID NO: 5534 - DNA, 942 bp, Methylobacterium sp.
atgttggacgatcatttccggacgcggatcgctctgcttcgagccgagcgcgatttccgccttgcggtcggcggttactgccagggcatgatcgaaccggcgcagattgtctggccgagccacaagctgctcaatcagatcgggcgctacgtggtctcgttcatgctgatccacaacgactacgcgtggcgccaccatggcggaccgcgccccaccctgacggtcctccaggcgatggtgggatcgagcccgaggcagacggccggcttcgtatcggccctcaaggccgggcgattcgtcacggcagtggcggatcggggcgacggtcgggtgaaatgcctgcaggcggcgccggccctggtgaccgagatcgcgcgaagcgggcgcctgttcgtcgccgccatggatgcggtgacccgtcgcgacccgggtcgggccgggatgctcgacggacccgaccggctcggggagctggtgcgcctctcggccgcccacgtgctgcggcacggcacgctcatcgcgccgttcccgcgggtgctccatttcgccggacgggactgcggctacccgctgctcacggccctggtcggggcccactatgccgccacggtgcccggcgcaccggcggcggtgtcgctcagcctgcgcagcctcgccgagcggctggacgtgtcgcgggcgcatgtcggcaacctgctcggcgaggccgagaccgcgggatggatccggatcgccggcggccacctgaccgccttcgacccggcgctgctggcggagttcgaggtctgggccgcagggcagatgctgttctacgacgatctcgcggcggcgatcctcgcggaggcgccgaccgcgcccgtcccggccggcgcctccggacacgccggtctcgcttgtgttccggtcgatccggggatacctacgggcggcaccgcgccgtga

SEQ ID NO: 5535 - DNA, 957 bp, Methylobacterium sp.
atgcccgtgaggctcgacgcgcgcctggccggcgacctgttcttcttccgcgccctggtcgaggcgggcggcttcgcccgtgccggcgatcgcctcgccgtcacgcagagcgcggtcacgcagcggatccagcggctggagcggcgcctcggttacccgctgctcgagcggggcgcccgcgagatccggctgaccgccgcgggtcacgacctgttcgccgcggcgcggagcggcttcgacgggatcggcgaggccctgctccgggcggaacggcgcgagcgccgggagacgctgcggatcagttgcatcccctccctggcctcggaatggctcgccccccgcttgagggccttcagcgacacgcatcccgacatcgacgtcgccgtcttcggggagacccacgacctggatcccggacgcatggcgcagtccggcatcgacgtcgcgatccgctacggcccgacgccccctcccggtgcgacggtcgtcttcgaccatcccgagcccgtctacccggtctgcgccccggcctaccgggatgcggcctcgcagcccggcggggccgtcgtcctgctccacgacgcgacgccgtgggaggcggccgcgagcgtctcggaggagtgggatcgctggataagcgtccacggggcgccctgggacggcgggatccagaatctctacttcaacctcgcgcaactggcgctgcgcgcctcgctcggcggctcgggcatcgccctggggcgatcgctgatcgtcgcgccctatcgcgccgacgggcgcctcgtgcccgcctgcggcgaggccgtcatgaacggtctccggtacttcgttatcgtccgtgctctgccacccgcggggcccgcggcggccttcgtggactggctcggccggacgatggcgggtccgccgggctcgcccgaggcgccgcgtcggggcggtgcggcggatcgcggatag

SEQ ID NO: 5536 - DNA, 444 bp, Methylobacterium sp.
atgacgcatcaggagaccgcctttgtagaggcgatggtgcggacaggtgatgcgctctactcggcgaccgtcgcagggtacgcacagcccgcgtcggccgcgtccaaggcgttgaagcgcccggacattgtcgccgcgatcaactcggctgtgcggctgcgcgtgcagagcgagggcgcggcggtggcggcgtcggtgctggtagagatcgccctcgacaagacggcgccgaaggctccgcgcgtcgccgcggcccgcgcgcttggggagatgacgcacctgggcgggctggagggcgcgggcctcgataagccgctgtccgagatgtcccgcgcggagcttgtcgaggcccgacagcgcgcggtcgcctacctcgcggagcttgacgcacccgtgatcgaggcggaggcggtcgaggcgcccgcgggcgggcttttcgactga

SEQ ID NO: 5537 - DNA, 1794 bp, Methylobacterium sp.
atgaactaccagcgcaagtacagcttctccggctatcaggccaacaacccacagcggcccctgccggcgacgcagatcgacgccgagctggacgctatcagcgccgccttcgagcagacgctggacgcctacggcgtggcgaaggccaacggcttccaggggaacgtgatcgagtggctcgccagcctcaagggcgagaagggcgacaagggcgacaagggcgaccgcggcccggccggccagaagggcgataagggcgacacgggcagccaagggccgcagggcgatcccggccaccagggcgtccagggcgtgcaggggccgaagggcgatcagggtgagcaggggagcgccgggcctgccggcgaccgcggcccccagggcctacagggtccgaagggcgaccagggcgtccagggcctccaggggccgaagggcgacaagggcgacaccggcagccagggcgcacccgggacgaacgggaaggacggcagtcagggcccgaagggcgaccagggcgcccaggggctccagggcccgaagggcgacaagggcgaccagggcgtgcatggcccgaagggcgaccagggcgagcagggtgcgaagggcgaccagggtgccggcgtcgttatcaaggggagcgtgcccacgccggccgacctgcccgcctccgggaacaccccgggcgacacctacatcatgacgaccgccggctccggctacgcggccggcgacggctacgcctacacgggctcgggcttcaccaatgtgggccagatccgcggcccgcagggcgtgcagggcccgaagggcgacaagggcgatcaggggctccagggtgtacagggcgagcccggtgcccagggtgcgaagggcgatgccggcgcgcagggcgtccagggcccgaagggcgaccagggcgagcagggcattcagggtcccaagggcgaccaggggatccagggcgtccagggcgacccgggcgcggccggcccgaagggtgacacgggatcccaggggccgaagggcgacacgggctccaagggcgaccagggcattcagggcccgaagggcgaccagggcattcagggtgtccaggggccgaagggagacaagggcgatcagggtccgcaggggccggccggcagcctcggctttcagccggtgcagcagggcaccgggccgggccagggcaccaacaccgtgtcggtcggctggggcacgatcaagaacgccgccgggatcgacacggccgcgctgctcttgtcgatcgacggccaagcgcagggtgcgatctggacggatcagctcctggggcagtcgttcggccggaagcggatcgagaacctcgcgacgggcgcgcacttctgcgcagcggtcgggctcggcagctcgggcttgaccgcgtctgccggcaacggcttccagcggatcatgctcaacgcggtcgaggcggatgtcgaggggctgttcaagacgggctcggggcagagctactacctcgtgcccatgtccggcgtctataacatcacgggcgcgctgcgcttcccggacaatacaggctcgttcttctacggcttcggcgtccacaccgcagaggaagatgggtcacacatgagctggtcattccgaccgaccaataacggccggtacgtcagccaatattctcgcatggcccacttcaacaaaggcgatcaggtccggatgatcttctactccgacgctgtcgtcgccaacctgccggtggaccgggccgcgttccagatcgcccttctgtcaggcgatattgtataa

SEQ ID NO: 5538 - DNA, 786 bp, Methylobacterium sp.
atgtgtgatccgctcaccatcgcaggcgcggcgctctcggccggcggcatcgcagccaactcgatcggcgcctcccaggccgccgccgcgtcgagccgagcctacgcggccgagcaggcccggcaggcccagctccggcaggaggccgcgcaggtccagcagcactcgaacagcctctacgaggggttcgccggcaagcagcaggaccgggcggccgatctcgcctcgacgctccgcagtgcccagctcccggcccagggctcggcctcgacgaccgtcgaggcgccggccagcagctcgaacatcacgacgcagggggaggcctcccagcgggcgaacgccgacgcctacgccggccagcaggccacggcgctgggcgacctgcggtccttcggcgacctgctcgggacgaacgccctggcccaggcccgggacgcctcccagatcggccagatcggcaacttcatgcggggctcggcctccgtgctgccgcaggagctgaacgcggccagccacgcgggcgacaccgccaagctgttcggcggcctcgcgggcgggctcggcaaggtcgggatcgcggccggcatcaacgggagcaccctgggtggcctgttcggtggcggcgccagctccggcgggaacgtctctacctcgctcccgacgatggccgcctccgggatgggctcgatcgccaacgcctacggcaacctgccggccgcgcccatgtcgatcgcccagccgttcggcgcggccccgtccttcgccagcagcccctaccgcgtctga

SEQ ID NO: 5539 - DNA, 621 bp, Methylobacterium sp.
atgtcgaagaaggatggcggcgccggcaagcaggcgaacatcgcgcgtatggaggaggcccagcggcaggcgactatccgccagggcaccgatcagatcaactcgacgttcgacagccaattcacgccggacttcttcaacaagcagcgcgacaacttcctcgcgttccagcttccgcagctcgacgggcagtacggtgacgcccagcggcagctcacctacaacctcgcgcggaacgggaacctggacagctcgacccgtggcttccagcagggccagctccagaagacctacaacacccagcggacgaccgtcgccgacaacgcgaacagctacgccaactcggctcggagcaacgtcgagcaggcccgcaacaacctgatctcgacgctcaacgccacgggcgacgcgacccaggccgccagctcggcgaccaatcaggccgcgatcttggcgcagccgcaggcctacagcccgcttgtcgacgccttcgccaccacgaccggcgcgctcgcctcccaggcccaggccgaccgggcggcggctatcgcgaacggcacctacacgggcggctcgggcctgtttggcacgtccggcggctccgtccgcgtcacgaggtaa

SEQ ID NO: 5540 - DNA, 225 bp, Methylobacterium sp.
atgtatgatggccccatcccccgctcgcgctacccggctaccatgatcgatgacaccgacccggtcttggaagcggtgacggcgctacgggccgccggggtcgcggtggacccgatcggcgacgagctcgaacgctggcagatcggcgacctgatcttctcggacgctgacctgtggcgcctggccgcgagcaggggactcgtagaggacagcgactcgctgtag

SEQ ID NO: 5541 - DNA, 381 bp, Methylobacterium sp.
gtgccggcaacagcacagcagcttgatggatggccgggcatcgtcattgccctgctgggtgcgctcgcggtggtcctggtccctctgaccgggttcatgaaggagtggtggggatacaggaaggaggtgctcgccgcagagaagatgaagcccgaaattgcgcgtgacatcggcaccgcatccggcggcgccgtattcgacagcatcgcgctggcggatctcgccaaagccatcaacggcctgacggcggccatcgtcgcagacacggcttccgaggaggcgcagcacaccagtcagatgacggccgcgctcagccgcttcaccgaggtcatggaccgctgggaggatgatcacgggcgtcagccacgaggaaggcgctga

SEQ ID NO: 5542 - DNA, 519 bp, Methylobacterium sp.
gtgcagacttcggttcaggcggccgtgcgcgcgctcctgaccacgaccgaccgttcggagatcacggtgcccctggtggccgccgcggccggcgtgacgccgtcgacgatctaccggcggtggggcacgctcgccgagctcttggccgatgtcgcggtcgagcggctgcgtcccgacggcgagccggccgataccgggagcggccggaccgatctcgaggcgtgggcggagcagtacgcggacgagatgtcgtccgcgccggggcgggagatgatccgggacgttctggcggccgcggacgcgaactgtgcccagcgatgctgcagcttcacccgcgatcagatcgcgatcatcgcggatcgggccgtggcccgcggcgaggccttcccggaccccgaggcagtgctggacggggtcgtctcgccgatcctctaccggatcctgttcgggaccgcgctgaaccgggagcggatcctcgagctggtcgaccgcactttgacggcgcgcgaagcgacctga

SEQ ID NO: 5543 - DNA, 429 bp, Methylobacterium sp.
atgacccagggaacggaaccggcggcgctgccgccccacttggcacaggaatacgcggcggcgcgggacaacggctgcgtcggcacccggctgctctcggaggatgaccgctcccgggtctggaccatcgtcctggcgcccggcgcgcggatcggcttccacacgcacgtgctcgactatttctggaccgcggtgacggcggggcgcgcccgctcgcattacggcgacgggcgggtcgcggaggtcgattaccgcgcgggcgacatccagcacctgtcgttcgggccgggcgagtcgatgacccacgacctcgccaatatcggcgacacggagctgatcttcaccaccgtcgagttcctggacagcgcgaacccgcccctcgcgctcccggccgccgtgcgcgcggaggcgacccgccgcgcggcctaa

SEQ ID NO: 5544 - DNA, 396 bp, Methylobacterium sp.
atgatcctccagcgcctcgcgctgcgggcaggtatcgcctgcgcgctgctgctcgtgcccggtcacgcccgggcctgggagggcatcgcctcgacctacggccgcgagatcttccgcatcaacccgaaggggctgacggccaacggcgagcggttccagccgatgggccggacagccgcgatctgggacgtcccgttcaacacccggctccgggtcacgcacctcgccactggccggagcatcgtcgtccgcgtgaacgatcgcgggccgcatcgtcggctcggccggctgatcgacctgtcgaccggcgcctgccgggcgctcggcgcctgcggcctcgcccgggtgcgggtcgaggtcgtgccgtccgggcggcgcgtggcggacgcgcgctga

SEQ ID NO: 5545 - DNA, 414 bp, Methylobacterium sp.
atgaaacgtctcgcgatcgccctcacggcgctgtcgagcctcgtcctgttcgccccgtcgagcgaggcgcgaccccacggccgcggcttccatcatgggccccaccatctgggtcacggcgtctggagggggcggcgccacggtctccaccggtaccgccatcaccgtctccaccggcactaccggcggcatcggggctaccgcggatatcgcggcgtccacttccgccccgccggctacggctaccggccccacgcgtatcgctccggtggcttgggcggctatcgcggggtcggcttcgcgaccggcgccggcctgggcctcgccaccgcccggccaggtctctacggcgcggcctacgggcgaccctacggatacggctacgcgccggtcggctacggctgcgcctactag

SEQ ID NO: 5546 - DNA, 300 bp, Methylobacterium sp.
gtgatcctgtcgcggtggcgcggctatagcgccgccatggcgaagcgccccatgactctcgacctgttcacgaccctggatatcgtcgatgacgacgtctcggccgtcgtcgacgcctatctggccgatcccacgcccggttcggtggcgttcggggacggcttccgcatcgaccccgcggccgcggtggcctcgcatcccttcgcccggacgctgatcgatcagccctgggccgatgccgggctgcgccgggcggccatccgcgccgccatcctgctggcggagccggagcgggtctga

SEQ ID NO: 5547 - DNA, 1152 bp, Methylobacterium sp.
ttgatacatctgatcaacatgacggactggctggaccgcgccgaagctctcgacgccctcgggatccgggcccaaacgctctacgcctacgtcagccgcgggctgatcgaggcgcggcgggcgccgggccggcgccacagccagtaccgggccaccgacgtcgcggcgctcgccgaccggcgcggccgaagccgcgccagcgcggcgatcgccgcgggggccatggcctggggcgagccgtcggtcgtcaccgcgatcagcaccgtccaccggggcagcctgatctatcgcggccgcgacgccgtggcgttcgcccgcgacgcgagcctggaggcggccgccgacctcctgtgggacagcccggagccgacgctgttcgacgttccggccaacgcggccgcgacgccgttcctggcgctggccgggctcctgcaggacgccgaggccgcgctgggccgcgggcatcaccgcctgtgccgcgacgcgcgccgcgccgtcgctcacctcgccgcgtcctgcggcatccccgaaggccgggcgcccctgcatcagggcctcgcgcggctctggtccctcgacgccgcgaccgccgaccgggtccgtcaggcgctggtgctgctggccgaccacgagctgaacgcctcgaccttcgcgacccgggtcgccgcctccaccggcgcgccgatcgcggcctgcctcatggccgggctgagcgccctgtcgggaccgcgccacggcggcgccgcggcggcggtgctgcggctcgtcgacgaggctgacgcgacgaacccccgggaggccgtgcgcgcctgcctggatcgggccggggcgctgccgggcttcggccacccgctctacccggacggcgacgtccgcgccgcggccctgggcgcggtcctgcccgccgatcccctgctggatgccgtccgggactgcgccgtggcggcgacgggggcgcggccgaacatcgacttcgcgctgacggcgctcgtccggacggcgggcctgccgcggagcgcgccgttcacgatcttcctgctcggccggagcctgggctgggcggcgcacgccatggagcagggccgccagggtacgctgatccggccgcgggcccggtacgaggggccgcggcgctcggcggaccgcccgtag

SEQ ID NO: 5548 - DNA, 840 bp, Methylobacterium sp.
atgcttcggactgcgatcgccctgacgcttctgctggccggagccccggcctgggccggaccgcgctggcaggacctgccgccgacccccgcgccggtcgccggcacggtttccgggcgcgcctctgtcaacggcatccggctgtattacgccacgatcggcaacggtccgccggtcgtcctgctgcacggcggcctgtcgaactccgattactggggtcaccaggtcgcggcgctcgccgcccgtcgcacggtcatcctcgtggacagccgcgggcacggccgcagcacccgggacgatcggccattcggctacgacctgatgaccgacgacgtggtcgggctgctcgatgtgctgaagatcccgcgcgccgacatcgtcgggtggagcgacggcgcgatcctcggtctcgacatggcgatgcgccaccccgaccgcgtcggcaaggtgttcgcgttcggcgccaacgccgatccgtcgggcctgatcgagggcgtggagaagaacccgaccttcgccgccttcatcgaccgggccggcaaggagtacgaggccctctcgccgaccccgaaggactacgccgccttcgtcgacgcggtcggccggatgtggggcgggcagccgcgctggaccgaagccgatctgaagcggatccgcgcgccggtcctcatcgcggacggcgaccacgacgagggcatcaagcgcgcgcacaccgagtacctcgccgccacgatccccggggcggggctgctgatcctgcccaatgccagccacttcgcgttcctccaggatccggcgctcttcaacgcggcgctcctcggcttcctggacggaccttga

SEQ ID NO: 5549 - DNA, 378 bp, Methylobacterium sp.
gtgcatttcatgcggatgatggggttcgtggcccttgtgttgagcggcctgggcctggcgggccccgcgtcggcggccccgctctcaccggcgccgctggccggcgacgcgagcgggctgacccgggtcggctactggtgcgggcccggattccacctcaacccgtggggccggtgcgtcccgaacgcccgccggttctacggcccgggcccggccttctacggagcccgctactacggaggccggcgcttctaccggacctacaactatcgctggcaccgcaattaccgctggcaccgcaactatcattggcaccgcaactatcgctggcaccgcaactatcattggcatcgcagctaccactggcgtcgccgctga

SEQ ID NO: 5550 - DNA, 90 bp, Methylobacterium sp.
atgacgctcgccctcatcatcaccggcttcctgatcgtgaacttcgtgatggccggcttcttctccctcgtggccctctgggccgactga

SEQ ID NO: 5551 - DNA, 1212 bp, Methylobacterium sp.
atggctgaggatgggattgccgattcgggccgcgcctggcgtcggctcgccgcggcgacggcgctcggcacggtcgggggcgtcggcatgtggtcggtcgtcgtcgtgctgcccgcggttcaggccgagttcggggtcgatcgggcggcggccgccctgccctataccctcacgatgctcggcttcgcggtcggcggcctcctgatggggcggctcgcggaccgcatcggcatcgtgcccccgctggtcctcggcaccgtctgcctggccctcggctacgggctcagcgccctcgcgacgaacctctggcagttcgccctcgtgcacggcgtgctcgtcggggcactcggcagctcggtcgccttcggaccgctgatggccgacgtgtcgcgctggttctggcgccggcgagggctcgccgtcgcgctgtgcgcgtccggcaattacctcgcgggcacgctctggccaccggtggtggagcgcgcggtccacgcgttcggctggcgcgcgacgcaggccggcatcggcctgttctgcctcgtcgccatgctgcccctcgcgctggcgatgcggggccggccgccacgggcttcggcgacgcgcgcggccggtccgcaggccgtgacgacgctgtcgcccgcggcgctgcagggcctcctcgtcgtggccggcaccgcgtgctgcgtggcgatggcgatgccgcaggtccacatcgtggcgtactgcggcgatctcgggtacggcgtcgaccgcggcgcgcagatgctgtcgctgatgctcggcttcggcatcgtcagccgggtcgcatcgggcttcgtcgccgatcggatcggcggtctcgcgacgcttctggccggtgcgctgctgcaggcggcggcgctcgcgctctacctcgcgttcgacgacctgacctcgctctacgtgatctcggccctgttcggcctgttccagggcggcatcgtgccggcctacgcgatcatcgtgcgcgagtacctcccggccgaggaggccggggcgcggatcggtgcggtgctgatggcgacgctggccggcatggcgctcggcggctggctcacgggggcgatcttcgacgcgaccggctcctaccgtgcggcgttcgtcaacgggctggcctggaacgccgtcaacgtggcgatcgtgctgtggctgatccactgccgtcgggcgcgcacgagtccggccgcgctctga

SEQ ID NO: 5552 - DNA, 696 bp, Methylobacterium sp.
atggcgaaatttcatttcgtcgaggattacgaggcgtacgtccgtcagctgatgcgcgacctgcccctggacgaggcgatgagcgtggcggtaggcggcgactacgaccgcatcggcgcgatcgagtgcgagatcctccagcatttcgggctccgggacggccagtcggtggtcgatttcgggtgcggctccgggcgcctggcggtgcatctcgcccgcaccgcgagcgtcgcgtatctgggcctcgacgtcgtccaggacctgctggactacgcgaagcgccgctgtcccagggactaccgcttcgcccggaacaccgcgctgtcgctgccggtcgccgacggcagcgtcgacctcgtctcggccttcagcgtgttcacgcatctcctgcacacggagtgctacatctacctggaggagatgcaccgcgccctcaggcccgggggccgcgtcgtggcctcgttcctcgagttcagcatggcctcgcactggggcgtcttcaccaagacggtcggcgagcagcgcaccagcacggtgccgcacctcaacacgttcatcgagcgcagcgtctggcagacctgggcggaccatatcggcttcgacagcgtgacgttcctcgacgggacggcggcgccgtggccgtcgggggtctatctgggccagtccctcgcggtgctcggcaaggcgccggcctga

SEQ ID NO: 5553 - DNA, 1407 bp, Methylobacterium sp.
atgtccgaagccgtgagcccggcggtcaacgccggaggccgcctcgaccgcctgccgatcggcccgttccaccgccgcatcatgtggctgatcgggatcggcatgttcttcgacgggttcgacatctacatcgccgccaccgtgctcggcgcgaccctgaagagcggcttctcgaccctgccgcagaacgcgtggttcgtctcggccaccttcgtggggatgatggcgggctcgttcctgacgggcttcttcggcgaccgctacgggcggcgcttcacctaccaggcgaacctgctggtcttcgggctggccgccatcggggcggccttcgcgcccaacatgacggtgctgatcgtgctgcgcttcatcatgggcgtggggctcggggccgagaacgtcgtgggctactcgaccatgaccgagttcgtgccggcgcgctcgcgcgggcgcttcctcggcctgatggcggtgttcgtcgtcacgggcctgccggccgcctccctggtcggctacctgatcatcccgaccttcggctggcgggcgatgttcgcgctgggcggcctcggggcgctcgccgtctggtacgcccgcaagagcctgccggaatcgccgcgctggctcgaggccgtggggcgcaacgccgaggccgaggcgctgatgcgcgcgatcgaggccgaggcggcccgcggcgcgccgctgccgcccgccgccgccgcggcgcccgtcacgcagctcgggctcgccgccctgttccggccgccgctgctgtcgcgtctgctgctgggctgcctgtgcctcgtggtgatcaacaccctgctgtacggcttcgtgacctggctgccgaccttcttcatccggcagggcctctcggtggcgacctccttcggctacgcgctgctgatggggctcggggcgccggtgggcagcgccatcggcgccctgaccgccgaccgctggggccgcaagccgacgatcatcggcgcctcggcgacggccatcctgttcgggatcctctacccgatgaccctggacccggtcctgctgccgctggtcgggtttgggctgacggtgccgatctacgtgctggtggccctgctgttcgggatctacatccccgagctgttcccgaccgaggtgcgcctgcgggcctcgggcctgtgcaacacggtcgggcgcggggcgaccatcgtgacgcccttcctggtcgtgaccctgttcgaggcctacggcatcgcgggcgtgaccggcctgatgatcgggctgctcgccctgcagatcgtggcggtcgcggcgttcggcgtcgagccgcgcagccagagcctggagagcctggaggccggcgtcgcgccggccgagggcggcccggccgcccgggcgcggggcacggttccgcgcccgatccactga

SEQ ID NO: 5554 - DNA, 1524 bp, Methylobacterium sp.
atgaccctgcacgcgccggaaccgaccgtcgagacacggggcaacttcatcgacgggcgcgaggtcgaggccggcgacggcgcgctgatcgacgtgcgcaaccccgccaccggcgcggtgatcgcccggatccccaattcggggccggccgacgtcgaccgggcgatgcgcgcggcccgggcggccttcgagggccgggaatggggcgggatggacatccgggcgcgcgcccggctggtgaacaggctcgccgacgcgttcgaggccaacctcgacacgctctaccggctggagaccaccaacaacggccggccggtcaacgagacccgggcgcagctctcgcggctgccggacttcttccgctacttcgcgggcgtggcgctggcgcggcgcgacgacgtcatcccggtcgagggcaactacctcaactacacccgccgcaccccgatcggcgtggtggcgaactgtacgccgttcaaccacccgctgatgatcctgtgcaagtcgctggcggtggtgctcgccaccggctgcaccacggtggtcaagccctccgagtacacgccgctcacgaccctgaagctcgcgcagatcttcaccgaggccggcctgccgccgggcgtgttcaacatcgtgctggggcttggcgcctcgaccggcaaggcgctggccgagcacggcgacatcaacaagctcgtgctcaccggcggcaccgaggccggccggatcgccggctcggccgccgcgaaggtcttcgcccaccagaccatggagctcggcggcaagacccccgtgatggtgttcgacgacttcgacgtcgagcgggcggtgaactacgcggccttcggcgccttcatcggcgccggccagacctgcgtgtgcggcagccgccacctcgtccaggcctcgatctacgacgagttcgtcgagcggctcgccgccaagaccgccgcgatccgcctcggcgatcccttcgacccggcgacccagctcgggccagtcatctccgagcgccagcgcgagcgggtgctggcctatgccggctacggccgcgaccagggcgcccgcgcggtggcgggcgggcgggcggcccgggtgccgggcttcgagggcggctacttcgtggagcccaccgtgttcgcggacgtcaccgccgacatgcgcatcttccaggaggaggtgttcgggcccttcaccagcgtcacccgcttcgaggacgaggccgacgcgctccggctggccaacgactcgcccttcggcctcgctgcggccgtgcgcacccgcgacgtcgcccgggcccaccgggtggcgcacgcggtcaaggccggcatcgtctggatcaacgaccaccaccgcctcgacccggcctcgccctggggcggggtcggcgacagcgggctcggccgcgagtgcgggatcgagagcttcaacgaccatttcgacgtgaagagcgtgatggtcgccaccggcgacgggcccttcgactggtaccgcgacacggccggccagcgccgcctgaactga

SEQ ID NO: 5555 - DNA, 633 bp, Methylobacterium sp.
gtgctgctccgagacaacatctacgcggcgatccgcgccgacatcctggcctgcatcctgcgccccggcgcggaggtgcgcgagcaggaactggcccggcgctacgccgtgagccggcagccggtccgggaggcgctgctgcgcctggagcgcgagcggctcgtcacggttcacgcgcgtcagggatatcagatcaacgcgatttcggtggcggacgcgcgcgatctgctgcgcatgcgcctcgccctggagccggcctgcgcggccgaggccgcggccggcgcgcccgcttccgtcctggcgtccctcgacgcgttccgcgccgtcgcggacggcgccgacttcatcgcggagaaccgcgccttccacatcgccctcgccgaggcgtcggggaaccgccgcatggctgcgaccgtgcgcgacctcgtcgagcaggcggaccggctggtccgggtcagcctcgacggtatccgcgggcgcgacccggcgcagctggtggacgagcacgccgccatcatcgacgccgtgcagcggcgcgacgggcgcggggcgcgccgcctcgtgcgcgcgcatgtcgcccaggccgagcgccgcatcctgaccgccctggaacgcagcgcgatcgtcctctga

SEQ ID NO: 5556 - DNA, 414 bp, Methylobacterium sp.
atgcaggacatcccgttgggggcgaaggggagcttcgccatgctggtcgggccgtcacatctggccagccagttcaaggacaacatcctgccgccggtcttcgccacgccgatgatggtcctgatcatggagaacgcggcgctgaacgccgtccgccagtacctcgatcccggcgagagcgccgtcgggaccaaggtggacgtgacccacatggcggcgacgccggtcgggcaccgcgtctgggcggaggccgaggtggtcggcgtcgccggacgccagatccagttccgcgtcgcggcctgggacgagtcggagcagatcggggccgggacgcacgagcggatgatcgtcgacatcgagcggctcggcaaacgtctcgccgccaagcagcccgccccgtcgaagcgcgcgtag

SEQ ID NO: 5557 - DNA, 465 bp, Methylobacterium sp.
atgtcgttcatgagggtcacgatctgcgccgtcgcgctctgccttgtcgcgggcctgggccacgctcaggaggccgggcagacggtcgccggcgagggggactgggtgctcaggaaatcggcggccccgtcgagcggcgacgtcgcctgcgttctggcgccgaaggcgcggtcgcgcatccagatcgtcggcgaccgcatcgagatcaccggcctgccaaagaattccatcttcaattatcagtatcggatcgacgacggacctgtttcaaccgcgatgtttcccacaacgcagatgcaggacgccggagtgatcacgctgaatggggacgtattgaaagatattctggccggtcgacgcttcagcatccgcctgctggaccgatggcacgaggccatgacggaggagatcagcctctccgggctgcgcggcctgatcgacaagcgggccgaggcctgcaggtag

SEQ ID NO: 5558 - DNA, 243 bp, Methylobacterium sp.
atggccttccccgatgcgaacgaacccagcgccacgtcgatcagcgccctcgagctggtcaataccctgatcgagcgcaaggagaacggcgagccggtcgacgccgacatcctgtccttcctgaccgacatggaacggctcgggctcaccgacaccgatgcttacgccacgctcgacgcgtatcggcctgggcccgcactgggtgcgaccggcggcgatgacgcgagcgaggcggacgcctag

SEQ ID NO: 5559 - DNA, 654 bp, Methylobacterium sp.
atgggcgggacagtggcgacctggaacagcgacgccggtccctccggccacgggatcgccgcgggccggcccggccgccctccgcccggcggatcatggaacctcgcggcgttcgagcgccatcgcgccgcctatctggcgcgggcgcgccgcatcctcggctgcccggcccaggcggaggacgtggtccaggacgtgctgctccggctgatcgccgatccgcccccggcccagaccgcgatccaggccgcctatgtcgggcggatggtgcgcaacctcgccctggaccgggcgcggcggcagggcctcgagcggcgcctgttcaccggcctcgacgccgcgccggacccggccgatcccggcatcgggacccccgaggcggccgcggcgtcgcgggaatccctgcggcaggtggaggccgcggtggccgagctgccggagccggtgcgcacggtcttccagctccaccgggtcgagggcgtgccgcagatcgagatcgcggcccggctcggggtctcgcgcgcgctggtgtgcggcctcgtgcgccgcggccacctgcactgcctcgcggccctcgaccggcgctgcgccgcctgcccggcgcgcgccgaggccccaggccggcagcggcgccggaccgcgcccgtcaactag

SEQ ID NO: 5560 - DNA, 801 bp, Methylobacterium sp.
atggctcgtctgcaatcctccggcttcttcgatctcggcgatggtcgactggaatatcatttcgtcggtcgacagccggaggtggcccccacgcttgtgttgctccacgaaggcctcggttcggcgatgcaatggggcgccctgcccgagaccctcgcccaaacgacagagtgcggtgtcctggccgtctcccgccagggatatggcgcgtcgagcccggtgcccttgcctcgcccggccgattatctcgagcacgaggcccgcacagtcctcccgcggttactcgacgccgcaaatttcaggagcggcgtgatgatcggccactccgacggcgcctcgatcgccgctctcgccttggcggaaggcgatgcccgcctgcggggcggtgtgctgatggcaccgcatttcttcgtggaggaggtcacgctgtccgcgatccggcgaacccgagccgcctacgagcgggggctcttgaggacccgcctcggccgctggcacaccgatgtcgaaggggccttccgtggctggaacgacgcatggctggatccggcccggcgcggatggacgatcgaggctgcgctgacacgcctgaccgtccccgtgacacttatacagggaaccgaggacgcctacgggacgcaagcccagatcgctgcagcccgcagatcatgtccacccagcctgctcacagtccgtgagatgccgggtgtcggtcatgaaccacatcgcgaagctttcgcggacacggtcgctctcatctcggctttcgtcgagtatgtcctgaaagacgaaccaggctaa

SEQ ID NO: 5561 - DNA, 1350 bp, Methylobacterium sp.
atgcagaccgccgccaccttcgcatccgatccccccgccctcgccaggcccaccggtcggcagacggcgacggccgccatggcctcgctgttcggctgggggctcgatctcttcgacctgttcattctgctctacgtggcgccggtcgtcggcaccttgttcttcccggcggacaagccgatgctgtcgctggccggagcctatgcctccttcgcggtcacgctgctgatccggcccctcggctccgccctgttcggctcctatgcggaccgcttcggccgccgccgcgccctcatggtggcggtgatcggcgtcggcctgtcgacggcggtcttcggcctcctgccgacggtcggccagatcggatggctcgccaccgcgatcttcctattcttccgcctcgtccagggcgtcttcgtcggcggtgtcgttgcggcatcccacacgatcggtacggaatctgtgccggagcggtggcgggggctgatgtccggggcggtcggcagcgggggctcggccatcggcggcctcctggcctccctggtcttctatctcgtctcgctcatggcgccgggcgaggccttcgccgactggggctggcgggtgatgttcttctcgggcctactgacctcggtgatcggcctgatcctcttccgcaacctcgaggaatccccgatcttcaaggaactgcaggcccgcaaggccgcgctccgggagggtgctccgacgaaggcctcgccgatccgctcgctgttctcgccgtccaaccggggaagcttcgcggtcgcgacgctcatctccttcggcggcggcgcggcctactacctcacgtccggctacctgccgaccctcctcaagctcgtgaacggcgtaccgaacgccaccgcctcgatgatcctgatcggcgccaacgtggcggcggcgatcggcgcctgcggcatgggcgaactgagccagcatatcgggcgcaagcggtcgttcttgctgatgggagtcatccgcctgttcgcctttcccgttctcttcctgaccatggcgaacacgacgagcctcatgggggtcgcggcctgtgccttccttctctcgctcatcgccaacgccagctacgcgccgctgttgatcttcctcaatgaaaaattcccgacggcggtacgggccacggggacgggcctgacctggaatatcggcttcgcgctgggcggcatgctgccgacgttcgtctccctcatcgccgatgggccgacgcagatcccgatggtgctgacggtcgtgatgacatgcgtcacgctagtctatctcgttggcgccgttatcactccggagacgcagggcaacctcgaccgggcgtga

SEQ ID NO: 5562 - DNA, 807 bp, Methylobacterium sp.
atgacgagcgacacccacaccatcgacccgcgcctgacgaacctcgacgggttccgcgtcgagatcgactcggagcgcgagcgcgccgacgtgatcctggcgcggccgcccatgaacgtcattgcgatgccccagcgcgacgagatccgtaaggtgttcgaggcgctggacgaggatccccgcgtgcgggtcatcgtcctgcgggcggagggcgaacacttctcgtcggggggctacatcaagggcttcctcgacgcctcgcccgagcacgtctcgaagctcgcctggaacatggcggcgccggcccgctgctcgaagcccgtcatcgccgccaaccggggctatacgttcggcgtcggcttcgagatctcgctggcctgcgacttccgcatcgtctccgagacctgccgttacgccctgcccgagcagaagctcgggcagattcccggctccggcggctcggcccgtctccagaagatcgttggcatcacccggaccaaggacatcgtgatgcgctccaagcgcatccccggacggcaggccctcgactggggcatcgccaccgaatgcgtggccgacgcggacctggagaaggccaccgacgcgctggtcgacgaattgcgcgccttctcccccatcgcccagcgcaccgccaagaagctcctcaacgacaccgaggatgcgagcctctccatcgccatcgagctcgaagggcattgctacagccgcctgcggcaggccgatgacttccgcgagggcgtcgaagcgttccacgccaagcgcgcgccgcgcttcaccggctcatag

SEQ ID NO: 5563 - DNA, 1560 bp, Methylobacterium sp.
atgcttgatctcggcaccagcttcctcgcgagcgtctcccgcgatccctgggccctggccctcgtcgacggggagacccggctgacctacgcggagtggttcggggtcatttccgcgaccgtggccgggctcgaccggctcgggctgaagcccggcgaccacctcgtcacggtccttcagaaccggcacgaggcggcgaccctgcactgggcctgccaattctcgggagtcgtgatcacgccaatcaactggcgggccaaggccgaggagatcgatttcgcgatcgagaacgcggaagcccgcgccatcgcctacgaaccggtctcggccgcgagcctgcgtgagagcgcggcatcgcagctgatcccgcgcatcgccgtcggcacgccacccggccccggcgagacggccttcgccgacctcgccgccaccgaggagccgtcggcgacgccccgggccgacgcggaggcgatctcgctgatgctctacacctccggcaccaccgccaagcccaagggggtcccacggcgacaccgggcggagcgcgcggcggccgtggcccatgtagcgcaaaacctctacgggcgcggcgagcgcacgctcggcgtgatgccactctaccacacgatgggggtgcgctcgctcctcgccatgtcgctgatcggcgggaccttcgtctgccttccccggttcgatgtggcgggggcgctgcggctgatcgcggccgagcggatcaccaacctctacctcgtgccgaccctctaccacgacctcgtgcaccaccgggatttccaggcgacgaacacgacctccgtgcgcaagctcggcttcgccggggcaccgatgacggacggcctgctcgcccgcctgaccgaggcgttccggccggacctcttcgtcaatcattacggctcgtcggaggtctacaccttcacgatcaaccacgaggcggcggttaagcccggctcggccgggcgggcgggcctcaacaccatggtacgtgtcgtgtccctggggggcgatcctagccggaccgccgcgccgggcgaggagggcgagatcgccgtcatcgccaagggcgacgaagccttcgagggctactggcatcgccccgaggccgacgccaaggccttccgcgacggctggtacttcaccggcgacaccggcttcgccgacgccgacggcgacctctacgtcaccgggcgggtggacgacatgatcatcaccggaggcgagaacgtctcgcccgtcgagatcgagagccgcctgtccctgcatccggcggtgtccgaagtcgccgtcgtcggcctgcccgacgagcgctggggccggatcgtcgcggccttcatcaagcggagcggcagcaccgacgcggcggcgctcgacgcccattgccgggccggcggcctgccgagtcacaagctgccgcgccgctacgtcttcgtggacgagatcccgaaatcgccggtcggcaagctgctgcgccgccaactcgtggccggcgagtacgtcctggaaggcggggccgagccccatgccgaaggtcacgaggctgcctga

SEQ ID NO: 5564 - DNA, 534 bp, Methylobacterium sp.
atgccacagctagacgcgcaggaccgtcacacggtcgccttcaccctcaacgggcgcgagaccgcggtcgaagtcgagacccgcaccctgctgaccgacgccctgcgccacgggcttggggccacgggcacgcatgtcggctgcgagcacggcgtctgcggcgcctgtacggtgtccatcgacggggttcccgcccgggcctgcctgaccctcgcggtgggggtcgagggctgtgccgtgcggaccgtcgagggtctggccccggagcctggccgcctcggggtgctgcaggtggccttccggcggcggcacgccctgcaatgcggcttctgcaccgccggcatcctgatgtcactcgacgcctatctcgcgctccggccgaacccgtcacgacgagagatcacggaagtgatcgggggccatctctgccgctgtaccggctacgcgccgatcatcgaggccgccctggaggcggctgcggaactcaggggcgacatcccggccccgtcatccccggaggccgcccatgcttga

SEQ ID NO: 5565 - DNA, 858 bp, Methylobacterium sp.
atgtctgaggctctcgagattgctcatggcacctttggtcgcgtggcgctcctcgacatggaccggagccttgttcggcacgcgcatccgcactgccacgttcttctgaaggtcgaaggggacgacaccgagttcctcgtcggggaccgtgtcgttgcgctgaccgacgaacaagccgtgctcgtcaatgcctgggaaacgcacgcttatctccatgatccgcgccgcgccaaggcgatgatcctggccctctatatcgagccggactggctgggggccttccggcgcaattgggcggcgagcggggcgcctggcttctttggaaagcccttgggcggcgtgaccccgacgatccgccgcttcgcgcacgacctcgctgcggagatggtctacgcgccgcactcctcgcacattcaggatcagttgctgtcgggcctgatgatcgcggtaatcgagcggttcaccgcgtggcgtgaggaggccgagtcgctccgcgccgccgccaggcgcaacgccagcgattggcgcatccggcggactatcgcgcgagtgcgcgccgagcccggtgccacgttggggatcgaggccctggcccgtgaggcgggcctttcccgagcgcaattctatcgcctgttcgagcaatccaccggagctccgccccacgtcttcctcaacgcgatccgcatcgagcaggccgtcgagtcgatcgtgggcagcgaggaatccttggcggcgatcggcacgcgcctcggcttcgccgcgcctgcccatttctcgcgcttcttccgggatcatgtcagcgtgcccccaagcgtattccgcagcattgtccggcgaagcggccaacccgccgtgtga

SEQ ID NO: 5566 - DNA, 705 bp, Methylobacterium sp.
atggctttcaacaccgaactcgacagcgctctcgaagcggccttcgcggaggcgcgcgctctgtacaaggagcgcggtttccagcgccgcgtcgggttcggacggcgtcccgccctaatcaatgtcgacctcgccaacgcctggacgcggccgggcaatcccttcacctgcgagaacatcgacgagcagatcatccccggagttcaggcgctcttggccgcctgccgccgcaacaaccacccggtcgtgcacgtcaccacctgctaccaggtcaccgacgtcgacagccccaagaccgacatgggcctgtggcaccgcaagatcccggtcgaggtcgtggatcagaacaagcccgagctctgggcgatcgacagccgcatcgagccggtgccgggcgagcaggtcctggtgaagaagcgggcgagcgcctttcacgggacctaccttgccgggttcctgcgcgccaacaacgtcgacacgatcctggtcacgggcgtgaccgcctcggcttgcgtgcgcaccacgctctgcgacggtctcgccgagggcttccggaccatcgcggtgcgcgagtgcatcggcgaccgcgtgccgggcgccgtcgcctggaacctcttcgatatcgacgcgaagttcgccgacgtcgagccgctggagcgctgcgtcgcctacctcgacgaggtcgggctgcgcaacgccgcctga

SEQ ID NO: 5567 - DNA, 1053 bp, Methylobacterium sp.
ttgtctctcgatcgattctcgccgacgcgccggcaggcgctcctcggcggcgcggcggccatcctcacggcgggggcgggacgcgaggcgcgcgcggcggccggaacggtcgtcgtctccaactggggcggcgactggaaccagcgcacggtgcgcttcgtcgagacgcccctggtggaggcgcagggactgaccgtcgtgcgcgatctcggcatggaaccggagcgcaaggccaagctcctcgccgagcgccgcctgcgccggggcagcatcgacgtgattcatctgaacgactcggacgggttcgagatgatgaagcaggacgtgctggccgacctcgaccggtcgcgcatcccgaactacggcgacgtggtaccggccctgcgcaaggattatttcgtcccgtggctctacagtggcgtggtgcttatctataacaaggacaagatcaaggatccgccgaaatcttacgcggaactctgggacaagaggtgggccggccgcctcggtctgaccaatcagctctacttcaactacatgatgatgtccggcctgatccagggcggcaacctgacgagcgtcgagaccggccgcgagcggctcgtcgcgctgaaggaattggtccagccccggctctacgccgcgcatcagcagctcggcgcggcgctggccaccggcgaggtcgacatcgccctgaactacaaggcccgcggcctgcaatggattggcgagggctcgccgctggccatccagtatccgaaggagggcgcgatcgcgatcaccttcggcgccgggatgccgaagcgcgcgccgaacccagacggagcctacgtctacctgaacgcgatgctcgaccggaaggcgatggccgagctcgccgcggcgagcttctacgcgccggccaacggcgcggccgagctgagccccgagctgcgcgcccggatcgacttctcccccgaggagcgcgagcacctcaacttcccggattatgcctacgtctcgaagaacaccgccgagtggctcgagtggtggaacaagacgatggcgcgctga

SEQ ID NO: 5568 - DNA, 1158 bp, Methylobacterium sp.
atgtcagcgaacacctacgacgtcatcgtgctcggcgtcggcggcatgggatcggccgcctgctggcacctcgcccgccggggcgtccgggttctgggcctcgagcgcttcgacatcccgcacgccatggggtcctcacacggcttcaacaggatcatccgcctcgcctacttcgaggacccctcctacgtgccgctgctgcgccgcgcctacgagaactggcgggaactggagggacgcttcggcgagcaactcctcttcatcaccgggtcgatcgatgcggggccggagggcagcgccatggtcgagggctcgctcgcggcctgccggatgcacgacctcccgcaccgtctgctcgacggcgccgagctgcggcgcgtggcgccgggctacaacctgcccgacacgcaccgggccgttctccagccggacggcggcttcgtctcggccgagcgcgcgatcgtcgcgcacgtcacgcaggcgcaggcggccggcgccgagatccgggcgcgggagccggcgctgagctgggagccgacggcctcgggtgtacgcgtccggacggagcggggcacctacgaggcggggcacctgatcctgtcggcgggctcgtggatgggcgaattcgtaccgcagctcaaaaccgtcgctgtgcccgagcggcaggtgctcggctggttccagccacgggagccggccctgttcgcgccggaccgcttcccggtgttcaacatggaggtcgaagagggcaagttctacggcttcccggtctggcacgtgccgggcttcaagatcggccgttggcaccatctcggcgagacgggcggtgccgataccttgtcgcgggagtgcgaagccgaggacgaggcggtgctacgcccctgcgtcagccgctacttcccccaagcaaacggtccgaccatggcgatgcgggcctgcttcttcaccaatacgccggacgagcacttcgtgatcgatacgctgccggacctgccgcaggtcgtcgtcgcttccccctgctcaggccacggttacaagttctgcagcgtcgtgggtgaagttctcgccgacctcgccttgggcagaaagccgggatttgacctcagcctgcatgcgctcaaccgcttcgcaccacgttcgtatgcgagcactgattaa

SEQ ID NO: 5569 - DNA, 951 bp, Methylobacterium sp.
atgcggcccttcagctacgagcgcgccgcgagcgccgaagcggccgtggcggccgtcgccgcccggccaggcgcccggttcatcgcgggcggtacgaacctgctcgacctgatgaagttccagatcgaggcgccggcccatctcgtcgacatccggcatctgccgctgaaggccatcgaggatctgccggacggcggtctgcgcatcggggcgctcgccaccaacaccgaggttgccgcccacccgcgcgtgaagcgcgattacggcgtcctcgcgcgggcaatcgtggccggcgccacggggcagctgcgcaacaaggcgacgaccgccggcaacctgctgcagcgcaatcgctgcccgtacttctacgagacgtccctgccgtgcaacaagcgccaaccgggctcgggctgctcggccctcggaggcgtcacccgctcgctcgccgtcgtgggcacgagcgcgcattgcatcgctcagaacccgggcgacatggcggtggcgctgcgtatcctcgatgccaccgtcgagaccgtcaggcccgacgggtcgcagcgccggatcgcgatcggcgattttcacctgctgccggacgaccggccggagatcgagcacccgctcgaaccgggcgagctcgtcaccgccgtgacgctcccgcgaccgccgggcggggcgcaccactatcacaaggtccgcgaccgggcctcctacgcgttcgcgatcgtgtcagtcgccgtcatcctgcacaaggacgggacggggcgagtcgcattcgggggcgtcgcaccgcgaccctggcggctggagaacgcggaggcgctcctgccaagtggaccggcagccgtcatcacggcggccttccagagcgcgacgcccacggccgggaacgccttcaagatcccgctcgccgagcgcgcgcttgcgctggtgctgagcgaagggagggtgtga

SEQ ID NO: 5570 - DNA, 2748 bp, Methylobacterium sp.
atggaaattctgaccgcgctcgtcgaacgcgcaggacaggtcgtaagcaaggcggacctccacaagcgcgcatggccgcggacgacggttgatgagtccaatttgaaggtcaacatcgcggcgatccggcgcgcgttcgaaggggcggcaccggggaagcgcttcatcgcgacggtgagcggacaagggtaccgcttcgtcgcgcccgtcgacgtcatgtcctggccgatttcggcagcagcgcggcgccataaccttccgagagcgacagacctgcttggccgatccgaggatctcgcggcgatcgcgacgaaggtgctgcagcgaccgctggtcacgatcacgggtcccggcggcgtcggcaagaccagcttggccgtgacggtggggcacgccctcgtcgagcagttcccggacggggtctggatggtcgatctgtgcgtcatcgacagcgaccgctatctcgcgagcgcgttcgctcaggaaatgcgcatcgcaatccatgcggacgatcctcaggctgcactggccactgcgctggcggatcggcagtgcctgctcgtcctcgattgttgtgagaacgccctcgatcaggcggcccggctggccaccatgctcgctaccgccgcgcccggaactcacgtattggccacgagccgggagccgctccggatggcgcacgagaccgtgcatcgcctccgacccctgccggctccgacagcgctcgggatacccaacgcgaaggatgttctgactttcccggccgtggcgctgttcgtcgcgcgcgcctcggccgctgctccagacttcagattcgaggacgacgacgcgtgggccgtcgtcgagatctgtcgccgcctcgacgggttgccgctggcgctggaacttgccgcgacgcgggtcggggcgtttggacttcgcggcctccttcgcctgctgaacgaacgcctggaccttctggacgacggccgacgggcaggtcatccccggcagcgcggcctgaccgcgacgttggactggagctatgggctgctgtcgcaggtagagcaggccctgtttcgacggctgtccgtctttcacggcgtcttcccgctcgacgccgcgctcgcggtcggcctttctgctggggaggccgagcgtgcgtgcatcggccacttggccgatctcgtcgccaagtcgctggtcgtcgctactcctgggtggttggcccggtaccagcttctcgacacgacgcgggcctacggattgcagcgcctcgccgagagtggcgaggatgatgcggttcgtcggcggcacgcggagttttgcgtcgcgcaatgtcgcgacgtctcggcgcgcaggagcgcgcgggcggcatccgacccgcgcgaggagttggtcgcgctcgtccacaacgtccgcgccgcactcgactggtgcctaaccgaccggcgcgatcccgtcctcggtcgaacgctggcagccgaggcgctcgtggtgtgggacacgctcgcgctgcttcaggaacggatcgaggcgagcgagtgggcgctcgcgtcggccgcccccgccgacggtccggaagaccggtacgagatcacgctgcgggcgtcgctcgctgcggccctgttgcaggtcgagggtccgacggcgcggatcgcggagttgtggagcggggcgctcgcccgcgccgaacggctgtccgacggcgatggccagttgcgggcgctttggggcttgtgcgacttccagacctgggtcggagaccacagcgcctcattcgccctgacggagcgcatcaggacgctggcggccgccagcggcgatcgcgcggccggcgcggccgtcgaccggcccgccgccaccgcgctccgctatctcggccgtctcgacgaggctcgcgaggcagcggagcgcctgctggcccgtgcggcccgccgtgacagtcccggccggcggctggaggatcacggcttggtcgcggcgcgcggcaccctcgcgaacgtcctgtggctccagggacgggcgaatcacgccgtcgcgtcggcgcggcgtgcgctcgtcgaggccgaagccagcggccaggccttcgccctcacgaatgccctggcgcacacggtgatcccgatcgcgctccatggcggcgatctcgacgaggccgagcgcggtctcgaccgcctcggggaccacgtcgctcgtcacgccatgcggatctggcaggtcatcgccgattgcctcgaagcgatcgtgagcctccgccggggcgacgcgggcgggctgcaccgcctcgaggatgccctcgtcgagatgggggagatcggcttccgcatgcggcgtccggcctatctcggctcgctggcgtccggccttgcggcgcatggccgccttcccgacgcgctcgctcgcatcgacgacgcgctcgccgcctccgagtgcggcggcgaactctggtgccagccggaactgctgcgcatcaagggagtaatactcctcgcctccaccggcatcgccggcgagccggacgcggcgcggcacttcctgcaagcgatcgatctggccggaagccagggagcggcgatgtggcgcctacgggccgcgacgagcctcgctgcgctggatgaccggtttggtggccaggaagccctcgccgccacgcttggcgacttcgacgaagggctcgacacgcccgatctcagggctgcgagggcgcgccgtgctggtcgggggggacttggcagagatgcgggccggccggtctccctggcttga

SEQ ID NO: 5571 - DNA, 1083 bp, Methylobacterium sp.
atggcacagaccgtctcgtggggcgtcctcggcaccggggtcatcgcccagcgcttcgtcagcgaccttctggggcggccggacgcgcgcctcgccgccgtcggggcgcggagccacgggagcgcccaggccttcgccgcggccttctcccaggcgtccggcgcgccggccgccgtcgccggcgtcgaggccctggccgcgcggccggatatcgacatcgtctacatcgccacgcccaacagcgaccacatggacagcgcgctggcctgcatcgaggccggcaagtcggtcctgatcgagaagccgatcgcgctctcgggcgggcaggcgcgacgcatcgcggaggcggcgcggcgcgagggcgtcttctgcatggaggcgatgtggatgcgcttcacgcccggcgtcgtgcgggccaaggcgatgctggaggcgggcgagatcggcgatcccctgcatctcgacgcccgcctgttcttcccccgcgcgccgaacgcgcccggacggacggacgatccggccgaaggcggggtgatcctcgatctcggggtctaccccgtgtcgctggcgctccacctgttcggcgcgcccacccaggtctcgggcgtcggcctcgatcggggcggtgcggcggcgcggcaggccgcgctcgcgctcggctggaacgccaggaccgcgaccctgagctgcggctcgaccggagaggccgacaacgccgccgtgatcgtcggcacgcgcggccgcatccacctgcaccggcagttcctgtgcccgcccttcctgacgcgcgtgcgcaccgcggccgcgccggcgcccgccgaccgtgccccgccgcgccgccaggccgtcggccggctggccttcgcgaaacgcctcctgcagccgctggacttccgccgcgtcgcgctgatcccgacgccgtacctcgggttcgggctgcggcatcagatcgacgaggtgcatcgctgcctgctcgccggcgcccgcgagagcccgatcatgccgctcgcggacagcatccgcaccctcgacatcctcgatcgggtccgcgcccggccgcagccgctggaggccgtcgcctag

SEQ ID NO: 5572 - DNA, 1230 bp, Methylobacterium sp.
ttgccgatcgggacgagtgcgccggccgcgtccctcctcgcggaccgcgtcgccgtgttcctgctcggcgccgctctgaacttcaacgtcctgacctcgaccttcgggctgccgttccagcgcctgtccgacctgctgccgttcctgctcatcccctggctcgggttgcgccgcgccgtcgtcgcggaggcggtgcggcaggccgcaccgctcgccggcatcctggcgctgatcgcggcctcgctggtgctgaaggcacacaagcaggcgggcgacgtctacctgaccctcgtcctgctgctctacgtggtccaggcgttcatcctgctggtgatgttccgcgaccggcgcttcgaggacgcgttctgcgtcggtctgctcgccggcatgctcgcctccctggcggtgctgctgctcgccgcctccggcacgccgctcgaccggttcgggctcgcggtccccacggacgggctcgacgaggagttgaagctgttcgtgcaggacaagcagggcggcctctgggcctccggcaacgagaccggccacgtcttcgcgctggccggggccgcggccctgctgctcagcctgcgctaccgcatcaagatcatctatctcgcctacttcgcggccctgctggcgagcttcccgttcaccaacaaccgcgccggcctgttcatgccggtcctgttcctcggcctgctgatgcgccggaacctcaaggcaccggcggtgctggccgcgctcggcgtcctgggcgtcctgctcgtggcctgggcggtgacgggggagatcccgctgccggggaccctgtcccaggcgatcgagcggcgcttcgccgaggaccacaacgtcacgggcaatttcgacgagcggttcctgtccggcgtgaccgcgctccagctcgtcgtcgagtacccgttcggcgtcggcgaggtcgcccgccgggaggagctgcaggcgctgaccggactcgtgacgccccataacggcttcgtctcgctggcgctccagagcggcatcgccacggcgctgctgctcatcgccggcctcgggcgggtcctgctggcgcccgccgcgttcgggccgttcctgacctacagcgcggtgttcctgatcccgtcgctgatgttcgaggagctgtcggtcaaccagtacttcctcttcttcatgggcttcatcctggcgtccctcgcgctgccgccggaccgggcgcagtccgagacccgatag

SEQ ID NO: 5573 - DNA, 1338 bp, Methylobacterium sp.
atgatgacccccaccctgtcgtcgaactatgcccgggtcctcgccgaggagccgcgcgcccaaggtcaggaccggccgagggagcaggcggccgcgcgcgcggtgaccggccccctgcggatcctgcatctcagtgccctctacccgccctacatcgtgggcggcgccgagcgctcggtggagcacctcgccgaggaactcgtcacggccggccacacggtcgcggcggcctgcatcgcccgggagcccgagcccaagagcgtgcgcggcggcgtcactgtctaccgcatggcccaccacaacgatttctggctggaggactggccccaggcgagccgcttcggccgcgcctgggccaaggtcaagcagcagtggaatttcgcggtcgcggccgagttcggccgcgtcctagacgatttccggcccgacatcgtcaacacgcactcgctgctcgacgtctcgaccctcgtctggcgcgaggcggccaagcgcgggatcccgatcgtccacacggtctgcgagtacgacctgatctgcggcaacgccgcgatgttcagggacggcaagccgtgcgaccgctggcacctgggctgcaaggtggtcaacgccgccaagcagatcacgaaccggtcggtcgacgcggtcgtcagcgtcggcaccgagatcctcaagacccatgtcgaccacgggctgttcgcgcatctcgcgccggagcggcgccgggtgatcttctactcctgcaccgtccccgagggcgacccggaggcacggcgccggatcgaccggaccggccagccgatgaccttcggctacctcggccggatcaacaccgagaagggagtcggcacgatgatcgacgccttccggcggctcggtcccggcgactggcgctgcctcgtcgccggtcacgcgatggacgactcgatcgagcgcttcaaggcccaggccgagggcctgccgatcgacttcgtcggctgggcgaagcccgccgagttcctcagcgccatcgacgtgctcatcgtcccgtcgttctgggccgagccgtcgccgcggacgatctacgaggcctacacgatgggcgttccggtgatcggagcggcctcgggcgggatccccgagctgatcggcgaggacaacgccgactggctgttcacgccgggtgacgacgccgacctcgccgcgcggctgcggagcgtgatcgaccgcggtcgcggcgacctgccggacgagcgcgccttccagcacgtcatccgcgagtcgacctcggagcgcgtcgccgagaagtatctcgatctctacgccgaactcgtcgccgagcgtcgggcatctcgtccgtga

SEQ ID NO: 5574 - DNA, 1257 bp, Methylobacterium sp.
atgcgcatcctgcaccttagctcgctctacgcgcccgagcaggtcggcggcgccgaactgatggtcgagacgctcgcccggacccaggcggatctcggccacagcgtcgctgtcgcctgcgccgcgcggaccgagggcggaccggtcctgcaggacggcgtcaccgtttaccggaccggctacgggacgccgttccacatcctcgactggccgcagcgcgggcgggccgaccgcctccgctacaagctcgcggcgcagtggaaccgccacgccctcgaccggatggcgggggcggtccgcgacttcggccccgacctcgtgaacacgcactccctctccgagctgccgccggcgctctggccgatgctccggcggatcggagtgccgatcgtgcacacgctgcacgacttcaccagcctctgcaccaatggcgcgatggtgcgccacgggcatccctgcgcccagcagcatctgaagtgccgcctctacgccgcgccgcaccggcgctgccagcgcgccgtgacggccgtcaccgccgtgggcacggacatcctcgaccgccacctcgctgccggactcttcacccaggtcccgccgtcgctgcgccgggtgatctggaacccgatcccctccggatcgcccgtggcgcggggaaagcgggcgcccggcgcgccgatccggttcggctacctgggccggatcgagggcgcgaagggcttcgacgtcctcctcgacgcctgccgacgcctgccgggatcgggctggagcctcgccgtcgcgggccgcgccgtggacgggctggacagctaccgcggcctggccgagggcctgcccgtgaccttcctgggctacgcggagcgcgacgccttcctcgatgatctcgactgtctcgtcgtcccaccgacctggcctgagcccttcggccggacggtggcggaggcctacgggcgcggcgtcccggtgatcggcaccgccaccggcggcatcagcgagcaggtcgggcccggcccctggctggtgccgccgggcgacgcgccggcgctcgccgccgcgatggcgcggatcgtcgcggagccggcccgcctcgccgaagggctcgcccgctcggcccggatccgcgccggcaccgatccgctcgccgtcgcgaccgcctacttggacctctacgccgcgacccgcgacgcggcccgcaccgaaccgcttcccgagctttccgcccgcgcggagcgcccgcacctcagcgagtgccgttcatga

SEQ ID NO: 5575 - DNA, 2196 bp, Methylobacterium sp.
atgtccttcctgactgtcgatctggccgaccggacgccggttcgcgccctcgcccaagagccggcgcgcggcggtccgctggccgcggccctcgcccggatctggcatcgccgctacctgttcgcggcggtgttcgccaccgtcctcggcctcgccgtgaccgccctgctgatgatccagcggcaatacgtggcgagcggctccgtgatcgtggccgaggcggagccgggcgccaacaacgcctcgatggcctggatccagaagatcggcgacccggctgacatcgagagccagatcctggtgatccgctcaccgcggctcctgcgcctcgcgatcgacgacaacctcgtcgccgcggtgctggccgagtgccgctacgcggccacaggggggcatcccgaccggatcagcgagaagaaggaggccgcctgcacgaagctcacgaccgaccgcaacgcgctcgtcgagtacctgcagaagcgctacacggtcctgagctccggccgctcgcgcatcatcaccatcggctacaagtcgccgctgcccgagacggcgcagacgatggccaacggcctgatcaacgccttcctggacgaccagcgcgaggcgcaggcctcgagccgcaaggccgcggccgactggctccacaccgagatcagccagctggacgcctcgatccgggccgacgagacccgcatccagaccttccggcgccgcaaggggctgctgaagggctcgctcgccccgatcagtgcggagcggctcaccagcatcagccagcagctcgccgcggccgagaccgccaaggcggacgcggccgcgcggctctccgagatcgaggccaagggtgcccgcggcgccgacagcgccccggccgtcctggcaagcccgaccatcgtctcgctgaagcagcagctcagcggcgtcagcgcgcagctcgccaatcagagcaccctgctgggcgcgaaccacccggtgatccgggcgcttgagaccgagcaggcgagcctgcgcgcgcggatcgagcaggagatcggcaacgtcgccaggggcctacgcaagtcctacgaggcctcgaacgccctcgccaagtcgctgcgcgcccagctcgagaccgcgaagacagacgccgccgccgccatggacgacgaggcgtcgatcgagggcatggtgcgcaacgccgagatcaagcgcacccgctacgccgacctggtcaagcgggcgggcgagttggagaccgagcggcgtatcctcaccggcagcacgcggctcgtcagcctcgccgagctgccgcaggagccgttctcccccaaggccgtgccgctcctggcgggcggcatcgtgctcgcgggcgtgctcgccgccgccgccgcgctgctgcgggacttcaccgaccgccgcgtgcgcacctcggcgcagctgatcgccggcaccggcgcgccggtcttcgcgcagctgccgagcctggagcccgccggcctcgtcggccgcttctccgagcggcagcgcgagctcgacctcgcggaggccctggcgcgggcgcgggtcgatccggtgatgcagaacgtcctgcgcaacctgcacgcccatctcgtgctggcgggcgccggcaagtcccgcgttatcctggtgacctcggcgaagccgcgggagggaaagtcattcacggccttcgcgctcgccggcatcggcgcggcgagcggccgccgggtgctcgtggtcgagtgcgatctgcggcgaccgaacttcgaggcctccctcgggctcggccgcggccccggcctcggcggtgtgctccgcggcgagatcgacccggcagaggccgtcgtccaggccgggcgcttcgacgtcatcccggctggaacgccgacggccgactcgaccgagctcctgatgggcgaccggatggccgattttctcaagtggagccgccgctacgacctcgtcctcctcgacaccccgcccacaagcctcctgatggacgcggcgatgctcgcccgccacgtcgacggcgtgctctgctgcgcccgctacggccgctcgcagctctccgacaccgtcgagaccgtggcgaacctgcgccgcgccggcggacacgtcctcggaatcgccatgacgatggtccgcccgggcatccagtcgacctacgacgtgatgccgctgcccgatccccgcacggccgcgagcgcgcgatga

SEQ ID NO: 5576 - DNA, 723 bp, Methylobacterium sp.
gtgacccgtctcacgcgccggtcggccctagccctggcggctggcgccctcgcggccggtcgggccgccgcggccgagccgctgcaccgttgcgaggcgctgatcgactcgatcggcgtcaacgtgcatctcggccatcgcggcaccccctacgtcgaccgcttcgccgcctgcgcccgggcgctcgacgaactcgggatccggcacctgcgcgacgacatcgtgctggtcggcgacgagccggccgggcagttcgagcgcatcgccgatctggccgaccggggctaccgcttcagcctgatcttctacgacgggctcacgccggggccgcgcgtgccgccggagcgcttcgccgagatcgcccgctgggccggcgacgggctcatcgtggcggagggcggcaacgagccgccggtcgcggcgcggccgggcctcgcgcggctctcggccgatcatcaggcggccctgttccgcgcggtgcgggcggatgcgcgggccgaggccgtccgcgtggccggaccgagctacatccagggcaacgtcgcggcggcgcaggacctcgcggcggtcgtcgacctcgccaacatccacgcctatcccggggccgagcacccggaaaccgacggcggcggcagcctcgcgcgcttcgtcacggccgcgcgcccggtcttcggcgacgcgccggtgatcgcgaccgagaacggctaccacacggcgctcgcc

SEQ ID NO: 5577 - DNA, 987 bp, Methylobacterium sp.
atgtcctgcgatacgctctcaaatctgttctcgaccttgtcggtgcaggttcacgctttcgctttctgcgagattcaggcgggctggcagctggcgaagaacggcatgccggacgcgatcctcgttcactacgttctgtcagggtgcgggacgattgccgtggaaggtcaagaacctctgcgtttcgggccgaattgcatcattattcccccgcgcggcatgcagcacgcgatcggtttcgccggagccacccgggcggttacagctgacgatgcgcgcagagtacttccagacggtctcatcgcactgacggccggcgatggaagtcgcgacattctcttggcctgcgggtccatctcggcgcgctatgccggcgcgctcggtctcttcgatcgcctgcatgacgcgctggtcgaggatctgtcgggcagcgatcggttgcgccacgccttcgctttcatggtcgaggaactggttcaaccgagtttcggcacgcaggaggtgacgagcgccctgatgaagcagtgtcttgcgatcctgcttcgcgttcacctgaaggagaagggcgcgcaatcgccgatcttcgaggcattgcgcgatccgaggctggtcccggcgatcgccgcgatcctcgatgcacccggggcgccgcatacagtcgatagcttggctgcgctctgcgcgatgagccgctccggattcgccgagcgtttctccgccatcttcgacgagggaccgatcgaatatctgcagcgggcgcgccttcaacgggcagccaggctgctgacggcctcgcccatgcccgtgaaggtcattgccgagagtgtcggctacgccagccgcagctacttctcgcacgcttttaaagccgcctacggttgcgacccgagcgcctaccgcacgcgggcgacgcgcatggttcaggcgctggaacccctgccgacgcgcggagccggcgtcgcgggcccggatcccggagaggcttga

SEQ ID NO: 5578 - DNA, 393 bp, Methylobacterium sp.
atggcgggccgcgccgccgaccggtttcctcaaccggtgcgcgtcggcgatctccccggccgcttcctgctccagccggaggagtcccagcccgtgctcggccgcgtgaccgggctcgtccgccgcgccgacggtggcaccgccgtgatcgttcgcctcgacggtgccctcgggctgacctggctcggccttcggccggtggcctggagcgggatcggcccccggctcgtggccgtgccggtcgaggcggtggcgctcctcggcgagcacgtcgccctgatgggcctgacgccggagcgcctgcacgcgctgccgaccttcgcgaccggctcggccaccgcgatcccgccggacgagacgctccgcgtcgggatcgtccggcccttccactga

SEQ ID NO: 5579 - DNA, 1116 bp, Methylobacterium sp.
ttggcggcgtatctcgaccgctggtcgggctgtgcgcaccacgccctcgccgcctcggattcggaaccgctgacgctcaccgcgttgctgcacttcgccggcccggaggatcgtcgacgctggcgggaggccgatctcggctacgccgatccgcgcggcgccgactggctgcgcgccaccgtcgccgcccgctaccgccggctcgaggcggacgacgtgctgatcagtgccggcgcgcaggaagcggtgacttccgtgctgagcgcactcctcggtccggccgaccacgcggtggtggtggtgccgatctaccagccctcggaactcgtcgtgacccgcctgtgcgcggccgatggcgttgcgctccgcccggaccggaactggcccctcgatctcgaccgcctcgcggcggccatccggccgaacacgcggctggtgctgatcaacttccccaacagcccgaccggtgcggcgctggatcgagcgaccctggacggtctgatcgacctctgccgccgacacgggctgtggctcgtcagcgacgaggtctaccgccagacggaccgcgacccggagcgcgccgttccgcccgtcgtcgacctgtacgagcgcgggatctccatcaacgggctgtcgaaggggttcggactccccggcctgcgcgtcggctgggccgcctgtcgcgaccgcgggacgctcgaccgcatcctcgcggccaagaatctgctgtcgagctgcctcgcgcggccgagcgagatcctggcgcaggtcgcgctgcaggccgagccgcacctgacccgccgcgcccgcgggatcgggcaacgcaaccttcaccgcctgcgggcgctcctcgaccgccatccggacctgttcgatccggacgagccgaggaacctcgccttcgcttgtccccgcttccgcgggcgggagggggcgaccgccttcgcgcggaccctggcgtctgaggacggcgtcctcgtgctgccctccgtcctgtggcactctgggctggcgtcgatccccacggaccgcctgcgcctcggcctcggccgagtcggcagcggtgcggcgctcgggatcctcgcggttcacctgctgcggcgcgccggccgatga

SEQ ID NO: 5580 - DNA, 1593 bp, Methylobacterium sp.
atggcggatgtactgatcgtgggagccggcccggtcggcctgacgctcgcctgcgaactggcccggcacggggcgcgctgccggatcatcgacggggcggcgcggccgtcgccctattgccgcgcgatcggggttaccccgcgcacgctggaagtctgggaggacatgggccttgcccgtgatatgatcgacgcgggtctctggctcacgggcctgcgcacgatcctgcacggtcagccgccggtcgacgcggtcagtgcgccgctggatctgccctacgcgtcgctcggtctgccccagttcgagaccgagcgcgtcctgaaccgccacctggagcgcttcggcgtccgggtcgagcgcggcctgcgcctgacggtcctggagcaggacgctgccggaatccgcgcgcacctgcaggaggcaaacggtgcggtcgcggaggcacacttccgctacgtcgtcggctgcgacggtgcccacagcacggtccggcgcctgctcggcatcgcgttcgagggcgaggcctatccctggcccttcatgctcggcgacgtgcacatcgcctgggacgtaccctacggcctcgcggttcgggccctgcgactgaacgaggacgccccgcccgacatgttcatcgccatcccgctccccgagccgggccgctaccgcgtctcgatgctcgcgccgcaacatctggtgccagcgggcgggtcggatcacgggatccaggtcgagctccagggaccgtcgctggccgaccttcaggccgtcgccgacgatctcctgccggacggctcgcgcctgtcggacctgcgctggtcgtcggtgtaccgcatcagcatgcgcctcgccgccgcctatcggcgcggccgctgcttcctggcgggcgacgccgcccacatccacccgccgaccggcgggcaggggatgaataccgggatccaggacgcctacaatctggcctggaagctcgccctggttcttcgaggtaccagccccgaggctctcctcgacagctacgagggggagcgacgcccggtgggcgcggacgtgatcgcgcggacccgaacagcgagcgagggatacggtcgggagcgcggcggcgcgccggaccgcctcgccgacacgcaggtcctggtcagctaccggaacacggcctggatcgccgacgacgcgacggagccgacggaggccggcccgagggccggcgaccgggcgcccgacgtcaacgggctggtccgcgacgggctgggcttcccgacgcggctcttcgacgccctccgcggcaccgagcacgtcctcctcatccatgctgccgggatgtcggacgccgtggccggccccgatctgccgatctgggcccgccagcaccgtccccgcgttcgggtcgtcgtcatcggcggcgacgcggccatccccggcgtgacgacgctcgcagatccgacgggggccttcgatcgggcttacggcgcggggaccatggcgtggctgatccggccggacgggcacctcgcctggcgcggccggacgtggcgcgagcccggcctgcacgcgcatctccggcgccaattcccgtcggccttcccgcaatga

SEQ ID NO: 5581 - DNA, 1695 bp, Methylobacterium sp.
atgagcgaccgggcggtgagctatgtccacggggcgatcggcgagcccctgctcggcctgaccatcggccaggccctggatcgcgccgccgcggcgtggccggatcacctggcgctgatcgcgcacgcccagggcgtccgatggacctggcgcgagctgaaggaccaagccgacgccttcgcggccggcctgctcgccctcggcctccggcccggcgaccgtatcgggatctggtcgctcaaccgcgccgagtgggtgctgacccagttcgccgccgcccgtgcggggctgatcctggtgacgatcaacccggcctaccggctgtcggagctggaattcgcgctcaacaatgtcggctgcaccgccctggtcacggcgacggcgttcaagaccagcgactatctcgggatgctcaacaccctggcccccgaactcgccgcctccgggccgggccggctgtccgccgctcgcctgccgcacctccgcacggtgatccagatcggcggaccgccggccccggggacggtcccgttcgacgcggtcgcggcccggggcgacgcggccggcaccggcgccctgcgcgacctcgccgacgcgatgcagttcgacgacgcggccaacatccagttcaccagcggcacgacgggcgccccgaagggcgtcacgctgacccaccacaacatcctcaacaacggccacttcgtcggtcgcgcgatgcggctgaccgccgaggatcggatctgcatcccggtgccgctctaccattgcttcggcatggtgatgggcaatctcgcggccctgacccacggttgcgccatggtgtttccgggcgagggcttcgacccgcgcgcgacgctggagaccgtgcaggccgagcgctgcaccgcgctctacggcgtgccgaccatgttcatcgccgagctcgaccatcccgagttcgcgcagttcgatctccgctccctgcggaccgggatcatggcgggcgcgccgtgcccgatcgcggtgatgcgccgggtcgtggagcagatgaacatgcgggatgtcaccatcgcgtacggcatgaccgagaccagcccggtgagcttccagagctcgagcgacgacccgctggagcggcgcgtcacgaccgtcggccggatccacccgcatctcgaggtcaagatcgtggatcccgagggacgcgtgacgccgcggggcgcccgcggcgagctgtgcacgcgcggctactcggtcatgctgggctactggggcgatgccgcgcggaccgcggaggtcctcgacgacgccggatggatgcacaccggcgacctcgcgacgctggacgcggaggggtactgcaacatcgtcgggcggatcaaagacatggtcatacgcggcggcgagaacatctatccgcgcgagatcgaggagttcctcttccggcacccgcagatccaggatgtgcaggtcttcggggtttccgacccgaaatacggggaggagctgtgcgcctggatcaggctgcgcgacggcgagaccctgtcggagccggcggtgcgcgcgttctgcgcggggcagatcgcgcatcagaagatcccgaaatacatccagttcgtcgatgccttcccgatgacggtctccggaaagatccagaaattcgtgatgcgtcggtgcgtggaggagcagctgggcctcgcgcgatccgagacggcctga

SEQ ID NO: 5582 - DNA, 3879 bp, Methylobacterium sp.
atgctggacatggaccggatcggatcgcgaaagggcgggctctccgtattcgggaaggcgacgccttgcccggcgccgtgcgtcgcggcgctggcagtcgcggtgatcggcctcctcgccgccctcggggcggcccagtggacccgtgcttggaacggacgcgtcacggcggagcggttccaggtcgccgcgggccggctggcctctgtcatcgatgggcggatggcccgctacgagtacggcctccgcggcgcccgcggctccgtgctgtcggccggcgaggccgggatcacacgtgaaggtttccggcgctacgccgacagccgcgacctgggacgggaatttccgggggcgcgcggcttcggcttcatccggcgcgttccggcggcgggcgaggccgcattcctggcaggcgcccggcgcgacggcgccccagacatgcgcatccggcagttgcagccgcacgatggcgagcgctgggtgatccagtacgtcgagccgatggcgcgcaaccgcgaggcggtcggacttgacgtcgcctcggaggaccaccgccgcggcgccgcgctccgggccatggagaccggggccgcgacgctgaccgcgccggtcaccctggtgcaggccaccggtatgaaggagcgcggcttcctcctgttcctgccggtcctgcgcgacggtgcgccggcggccacgcctgacgaacggcgggccgcgaccttcggctggacctacgcgccccttatcatcgacgaggtgctcgcgggcgtcgacctcgacgccgacgagctcgacgtcgccatacgcgacgtcgaaccggaagggacgacgcgtttctacgccggacgcgacgcgaccgaggtgccgccgggcggcctcgccatgacccgacgcctgtccatcttcggccggacctgggacgtcgacgtcaccgcgcgcgccgccttcctcgcgggcctgaacctcgtccggcccgcgaccgtggccgcggtggtcgtcacgggcgcgctgctgctggccgggctggtctacctccgcctcaccggacgccggcgcgaggtcctggccgccgtcgagaaggcgcggctggccgccatcgtcgagaacgcggatgacgccattgtcggaaagaccgtcgagggcgtcgtgaccgactggaacccgggcgcggagcgccttttcggtttctccccgggagaggtgatcggccggccggccgaggacctggttgtacccgcgcacctccgtgcgcaggaacgtgacgtcctcctgcgcataagccatggagacgccgtggcgcctttcgcgacgctgaggacccgtaaggacggaacggtcttcccggtcctcgtgaccgcctcgccgatccgtgggccgaacggtgcggtcgccggcgtcgccacggtcatccgggacatcacggagcaggcggctgccgaggaacatatccgcacggtcaacgcctccctcgaacggcaagtggccgaacgcaccgcggcgctccaggccggctcggcgttgcagagggccgtcctcgaccacgccggctatgccgtcatagccaccgacatgtgcggcaccatcaccctgttcaacccggccgccgagcggatgctgggctacgccgccgaagagctggtgggcaaggcgacgccgggcgtgttccacgaccccgcggaggtcgaacgacgggcgggggtcctgtcgcgggaactcggccggccggtcgagccgggcttcgaggtcttcgtcgcgaaggcgcgccgcggccagcccgatcccggcgagtggacctacgtcaccaagggcggcgagcggctgccggtgctgctcaacgtcaccctgctacgggcgggtgacgggaccgacctgggcttcctcggcatcgccatcgacctgagcgaacgctaccggcacgaggccgagatgaaggccgcgcaggccggcacctggaactacgaggtcgcgaccgggcgggtgcggttctcggcggagtgcgcccggcagcacggcctgccggaacgcgagaccgagatcgacgtcgaggccgagtggaagcggctggcgcatcccgacgacgtcccgcatgtcctcgccgacctcgcgcaggccatcgaggccgggggcagctacacgacggagttccgagtgccgctggcggacggcggcatgcgctggatcaccgccgtcggccgggtcgaggcggacgcgtcaggaatgacgtccagggtcatcgggctgacgctggacacgacggccaggaaggccgccgagatcgccctgtccgaggccaaggcagtggccgaggcggcgcgcgcggaggccgagcgggcgaaccgcgccaagaccgacttcctcgcctcgatgagccacgagatccgcacgccgcttaacgcggtcatcggcttcaccgacctgatgctggcctcgggccggctggacccgggcaaccgtcggcaggctgagctcgtacgctcgtccggcaacgcgctgctgaccgtcgtcaacgacatcctcgacttctccaaggtcgaggccggggccatcgagctcgtcgaggccccattcccgctgctggccatggtcgacaactgcgtgtccatcgtccgcggcccggccgacgccaagggcctggagttcaggctgcgcatggacccggacctcccgcgctggctgaagggggacgagcaccgcctcaggcaggtgctgttcaacctgctcaacaacgcggtgaagttcacggcgtccgggtccatcaccctcgacgtcgcgccgcaggggcgcatctcgggcggcgagcgcgtgcgcttccgggtcgtcgacaccggcatcggcatcccgaaggacaagcagaaccgccttttccaacgcttcagccaagtcgacggctcgatccagcgggacttcgggggcaccgggctcgggctggccatctgccggcacctcgtcgagctcatgggcggcgagatcggggtctcgtccgtggaaggcggaggctcgaccttctggttcatcgtcagcatgccccgggcgtccgcgccggccgaggctccgtcacccgcgcttccggccgccccgcgccgaacgggccggcttttgctggtcgacgattcccttatcaaccaggagctcgcacgggcggtactgattggcgccgggcacgtggtcgagacggtcggtgacgggcaggcggcggtcgacgcggtcagggaccgagccttcgacctggtgctgatggacgtgcagatgcctggcatggacgggatgaccgccacgcggctgatccgggagttgccggggcccgtgtcgcgattgccggtggtggcgatgacggcgaacgtgctgccggagcaggtctccgctttccgcgacgccggcatggacgaccacgtcggcaagccgttcgaccgggatcacctctacgcgaccgtcgaccggtggttggcgcggagcgggacggatgacgtgatacccctcccggagtctgcgagcccggaattcgacgaggatgcctggagcgccgtgcgccgctacctgtcaccgggccgcccccgcgaggtgctggctctcctcgtcggggaactggataccagtttcgagggcgacgccgccgaccaggccgtgcgcgtccgcctccgtcttcgcgcccactcgctgtcctcggcgtcgggtatgatcggcttcaccgagatggcgacggcctgccacgcgctcgaaaggttcgacgaggcgcgggtggcctcggagggggtcgccgcgttcgccaaggccctggaccgggtgcgcggcctggcggaccgctgcgcgcggaaggcggagcgcatgctggaagacatggagggctcgccgggcctcaggacggtctgcgggcgtggttga

SEQ ID NO: 5583 - DNA, 1239 bp, Methylobacterium sp.
atgccgctccagccccacgagaccgccttcacgcaggcccccgcgccgccgcgcccggtgccggtccttccggacgccgccgcggcgctcgccgtcgccgaccggctggcggaggccttcgccgaggccgccgccgagcgcgacctggagcgccgcctgccggtcgccgagatcgcgcgcttcaccgaatccggcctctgggcgatcacggtgccgagggagtacggcggccccggcctcgacagcgccacggtcgcccaggtgatcgcccggatcgccgcggcggacggctccctcggccagatcccgcagaaccatttctacgccctggaggtgctccgcaacggcggcaccgaggcccagaagcgcgccctctacggccgcgtcctggcgggcgagcgcttcggcaacgcgctcgccgagaccggcgcgcgcgaccacacccgccgcacccgcctcgtgcgcgacccggccggctggactgtcgagggccgcaaggactactgcaccggctcgctctacgcccaccgcatccccaccctggccaacgccgaggaggacggccgggcggtcgcctacctcgtcttcgtcccccgggacgcgccgggcgtgaccctggtcgacgactgggacgggttcgggcagcggctcaccggctcgggctcggtcctgttcgagcgcgtcgccgtggagcccgactgggtggtgccgttccaggcctcgctggagcggcccaccgccatcggccccttcgcgcagatcctgcacgccgggatcgatctcggcatcggcgcgggcgccttcgcggcgaccttgcccttcgtgcgggaccgcgcccggccgtggatcgattccggggtcgcgcgggcgagcgaggatcccctgaccctccacgcgctgggcgacgtccaggtgcgcctcgcggcggccgacgccctgctggcgcgggccggccgctacgtggacgccgcgcaggaagcccccgacgccgacagcgtcgcggccgcctccgtggcggtggcggaggcccgggcggcgagccaccgggccggcctgctcgcggccaacaagctcgtcgagctcggcggcacctcggccaccgaccgggccgaggcgctggaccgctactggcgcgacgtccgcacccacaccctgcacgatccggtgcgctggaagtaccactggatcggcgcctaccacctcgacggccggcagccgccccggcacggagcgctctga

SEQ ID NO: 5584 - DNA, 588 bp, Methylobacterium sp.
ttgcaggacgcgtcggccacccccgagatccaggccgtggacgccccgatcgcggcggatgaacccgctcaagcacctgaccattcgcctgaccactccgccgaggccgccccgaccggcgccgagacggtggacgcggccatgaccggcgcggcgcccggtggggcgtccgaaatcgcggccgagaccgcgcccgacggcgcggtggacgtcccgtccgaccagggggccgcagccgccgcgacgacgtccgaagccgagttcgaagccgaatccggacccgacacggtgatcgacatcgcccctccgccggtgccgggcgcgggtccgggactcgccgcgaccgccaaccgaatcagcttcacccccgaccgcctcgacgtcgtcgagatcggctcgatcatcgcccgctacgtgcgcggcgagggcgaggcggccgtcgcgcatctgcgggcgctctcgggcgcccgctcgccggccgacgtcattcgcctgcaggtcggcgaggtccagcgggccgccgacgcgtccctgacctgctgggtcacggtggtcgggcaggcgagccgggtcgtcgcgtaccgctga

SEQ ID NO: 5585 - DNA, 603 bp, Methylobacterium sp.
atgagcgcgcagcattacctcccgaaacttcgcgcgcttcgcatccccgccgacgccagaaatagcgagggcacggtcgcttggtgcgattggtgcgagactgtgcacagccacagcgccggaggcggcccccgcgtcgcacactgccacaggaaggaatcccctttcaccgcgttcggctatgacctcgcacccgtcggctgggcgcccgatgcaggcgcggcagttcctgcgggccttcttgtcggccggcgccgcctctcggacaccctcgatgctgccatcccggggcttcgtaccgccttcgagcggtgcgtcgtcgggcggaagcggatcggcctagctcgcatcagcgtgttcggccgtcagtggtcgatcgaggcggacgtgaccaagggcgagccggcctcgggctggactaccggcgtcggtctcctcggcctgctctcggcactctacggcgtccgccgcggcgtggccggcgtccgactcttggaagcgatcaccggcgaggaatttgacgcgtcggcacggctcacgatcgccaaggcgatcgacgcctctgcagcgcgcgccgcaggatccccgggggcccgcgcatga

SEQ ID NO: 5586 - DNA, 576 bp, Methylobacterium sp.
ttggccttctgctgggcgcacgtgcgccgccggttctacgaactggccaaggctggcccggcgccgatcgcgaccgaggtgctcgcccgcatcgccgaactctatcggatcgagggcgagatccgcgggcgctcccccgacgagcggagggccgtgcgtcaggaccgcagccggccggtcgtggcggcgctggagccgtggctcaccaccaagctcgggctgatcagccagaagagcaagctcgccgaggcgatccgctacgcgctgagtcgctgggccggcctgtctctcttcctcgacgacggccgcgtcgagatcgacaacaacacggtcgagcgggcgatccggccgctggccctgacgcggaagaacgcgctgtttgccggctcggacggtgggaccgggcattgggctgtcgtcgcctcgctggtcgagacctgcaagctgaacggggtcgagccgcaggcctacctgaccgacgtcatcacccgcatcgtcgccggacatccgcagagcaatatcgacgacctgctgccctgggcctacgccccgcagcccctcagggtcgtggcctga

SEQ ID NO: 5587 - DNA, 1971 bp, Methylobacterium sp.
atggcccgccccgacctccgcgccctcacggatgacggcctgatccagctcgccaatgccgggctggtgaagcgggcgctgcgcgaggttgccgccggccagggaccagaactcgcggaggccggggacggcaccgtcgaggcgcgcttcgccgacggcacgatcacgaggctcggccccggccggcctcccggcgaggccagctgcacctgtccggcgagcgggatgtgccggcaccgggtcgccctcgtcgtcgcctaccgggccgccccggtcgcggacgggctggccgatggggccgccgagggtgcggcggtgccggccgcggcgccggtcgcctgggatcccggcaccctcgacggcgccgccctcgaggcggggctcggcggcgccgcggcggcggagctgcggcgcctcctggcgggcgggatcacggtcgggctggagcggggcgccgtcccggccgcgcggctcccgaccgcgaccgtgcgcttcctcgtgcccgacgccgtcggctacgcccgctgcgactgcgcggccgggggcggctgcgcccacgtcgccctggcgatccgcgccttccgggagtccgcgggcgccgccgagatccgcctgggcggcgcggccccggccggagcggaggcgaagccggtagggacggcagagacggacctcgcggaggccgccgaccgggtggtcgccggcctgctggaggccggggtcgtgtccgggccggaggcccacgacgcggccctcgtccggctccggcgggcggccgagaggcggggcgccacgcagctcctgctggcggaggcggatctcgacgggcaggtcgcggcctatgccgggcgccacgccgcctacgacgcggccgtcgtcctggcgctcgccaccgaacttctcggccgcgtccggggcggggaggccgccctcggcctcggccagccctacgagaccgccatgggcaagacgcgcctcgtctccctgggcgcccggctcctcgcccgcgggcgcggcgccaccgcccgagtggccctggccgacaccgataccggcgcgctcctggcgctggagcgcgcgttcgcgccgggcgaggccgaggcggatatcgcggccggcctgcccgggcgcctcctgagcccgggcctgtccgtctcgggcaccggccagggccagatcctgaccagcgtcgcgcggcgccgggccgacgggctcctcgccctcggccagggcacacggggccgcacggcgctgctgccgcgggacgccctggtggccctgccggcccccctggcggcgcgggacgtcccgtcgatcctgcgccgcctcgccgaccggccgcccgtgttcctgcgcccgcgcgaccggctggaggccttccacgtcttccccgtcgaggcggttctgggacaggcctgggcgcccggcgcccagacgtggcaggccgccgtcgcgctgccgggggcgggcggcacgctgcatctcgcccgcgcctacgaccccgccgcgccgcacgccctggacgccctcgcgggcgcctgcgcggggcgctggggacccgtgcggcaggtcgccggcccggtgcggatcgaggacggcaccctggtctgcgatccctggtcggtgtcggtcgaccggctcgtcgtgcccgacctcgccgccccggacgatgccggccacccgatccagccggcgccagacctggggccggccacgctcctcgacgaggcggccgcgctgctggcgaacgccctccatgcggggcggcgggccttcgcggccagcgcccgcgccggcggcgccgacctggtcgcacgcctcgccgcgaccggctatccggccaccgcggcgcggctctccgccttcctctccgccaccctggcggctccgggcgcgcagtccgagcccttcgcccgggccgccctctgggtcgccgccatgcgcgacgatcccggaccggaagaggcctga

SEQ ID NO: 5588 - DNA, 357 bp, Methylobacterium sp.
atggccgtgaggcggatcgtcaccaacatccgggcgacggaggtcgaggcggcgcggtccttctacgcggacgtgctcggcctggaggtggtcatggatcacggctggatcctgaccttcgcggcccccggcatatcggcgacgccgcagatcagcgtggccagcgcgggcggctcgggcacgccggttcccgacatctcggtcgaggtcgacgacttggcggacgtcctcgcccgcgtgaggcgggccggcctgcccgtgctgtacggcccggcccgggagccctggggcgtggagcggttctacgtccgcgacccgttcgaccggctggtcaacatcgtcgcccatctcgcgtga

SEQ ID NO: 5589 - DNA, 1035 bp, Methylobacterium sp.
gtgcccggcaccaccctgctggcgctgctgatccacctcgacgggtcgggcgcggtgaccttcctgatcaccatcccggcgatgctgccgctctacgaccgcgtcggcatcgaccggcgcgtcctggcctgcgccgcctcgatggcggcgggcgtgaacttcctaccctggaccgggccgatgatccgcgcctccgccgccctgaagctgccgatccccgagatcttctcgcccctcgtgccggtacaggcggtcgggctcgtcttcatcttcgccgcctcgtactggctcggcctgcgggaggagcgccgtctggccctcgtccccggggcggcggggtccgcggggtccgcgcccggcccggccacgaccgcccggaccctgagcgacgcggagcgggccctgcgccgccccgaccgcttctggatcaacatcgtcctcacggccgcggtcctcgggacgatggtgttcctggccgagaaggtgccgccggcgctgatgttcatgctcggcacggcgctcgcgctggtcatcaactacccgcaggtcgacgcccagcggcagcgcgtcgacgcgcatgccagggccgcgatcctgatggcctcgatcctcctcgccgccggcgtgttcaccgggatcatgcagggcaccgggatgctcagggccatggcccagacggccgtcaccttcgtgcctcccgagatggggcgccacatcccgttcgggctcggcctcgtgtcgatgcccctgtcgatgctgttcgacccggactcgttctacttcggcgtcctgccggttgtggcggaggtggcccaccagctcggcgtcccgccggtgcaggtcgcccagggggcgctgctcggccagatgacgacgggcttccccgtcagcccgctgacgcccgcgaccttcctggtctgcggcctgaccgggatcgacctcgccgaccaccagagattcaccttcccgttcctgctggcggcctcggtggtgatgaccctcgcctgcgtcgtcctcggcgtcttccccatctga

SEQ ID NO: 5590 - DNA, 1338 bp, Methylobacterium sp.
atgagaaccgtccgcctcggcgccggcgccggctatgccggggaccgcatcgagcccgccgtcgaactcgccgagcgcggcgacctcgactacctcgtgttcgagtgcctcgccgagcgcaccatcgcgctggcgcagcaggcgaagctgcgcgaccccgagggcggctacgatccgctgctggaggcgcgcctgcgggccgtgctcgggccgtgccgggcccgcggcatccgcatcgtcaccaacatgggcgcggccaacccggtcgccgccgcccggaaggccggggcgctcgcgcgggagctgggcctcgccggcctgcggatcgccgcggtgaccggcgacgacctgctcgacgcggtgcgggcgggcgacttcgtcctggaggagagcggcgagccggtcgccagcctcggcaaccgcgtcgtctcggcgaacgcctatctcggcgcggcgccgatcgtggccgccctcgcggacggagccgacgtggtcatcaccggccgcgtcggcgatccggccctgttcctggcccccctggtgcacgctttcggctgggcgatggacgactgggagcgcctgggccgcggcaccctcgcgggccacctcctcgaatgcgccggccagatcaccggcggctacttcgccgatccgggctgcaaggacgtaccggacctcgcgcgcctcggcttccccatcgggatcgtggccgaggacggcacggtcgagatcacgaaggtcgcgggctcgggcggccggatcagcctcgccacctgcaaggagcagctgctctacgaggtgcacgacccggcgcgctacatccagccggacgtggtcggcgacttctccgatgtcgagatggagcaggtcggccccgaccgcgtccggctgcgcggcgcgacgggcgcgccggcgacgggcctcctcaaggtctcggtcgggtacgtggactcctatatcggcgaggggcagatctcctacgccgggcccggcgccctggcccgcggccggctcgccctgtcggtggtgcgcgagcgcctcgccctcaccggcgtggcgacgaccgagctgcgctgcgacctgatcggcgtcgacgcgctccacggcgcggcgctgtcgggcgggcgggagccctacgaggtccgcctgcgggtcgccgggcggaccgagacccacgccgaggccgtgcggatcggcaacgaggtcgagacgctctacaccaacggcccggccggcggcggcggcgcctggaaatcggcccgcgaggtggtggcggtgcagtcggtcctcgtcccggccgccctcgcccggccgcgcgtgcacgtcgtcgaagcctga

SEQ ID NO: 5591 - DNA, 345 bp, Methylobacterium sp.
atgaagctgcgcgcgctcgcccatgcccgcacgggcgacaagggcaacacgtcgaacatcgcgctgatcgcctacgacgcggccgattacgagcacctcgcggcgcacgtcacggccgagcgggtgcgggcgcatttccgcgggatcgtgaccggcgacgtgacccgctacgcgctgcccaagctcggggcgctgaacttcgtgctcacgggcgcgctcggcggcggcgtcacccgctccctggccctcgacgcgcacggcaagggcctcggcgccgcgctcctcgatctggacatcccggaccgcagcgccggccgagccgcgcggggaagcccgagacggtga

SEQ ID NO: 5592 - DNA, 420 bp, Methylobacterium sp.
atgctgttccacatggtctccggcgggccgcagccggtcgcccccttcagccacgcggtcgaggtcgacggcttcgtcttcgtcacgggtcagatgcccgacacgccggacaggcccggcgtcctgcccgacgggatcgaggcgcagacccgcaacgtgatggccaatctcgcgacggtcctggccggcctcggcctgggcctcgagaacgtcgtcgtcgcgcgcgcgttcctgaccgagttcaagcgcgactacgccgccttcaacgccacctacaaatcctacttcccgtccgaccggctgccggcccggacctgcgtgggcacgacggggctcgcctacgacgccctggtcgagatcgacctgatcgcccaccgcggcggcgcgacctcgccgtcgtcggccgcgcgatcgggctga

SEQ ID NO: 5593 - DNA, 261 bp, Methylobacterium sp.
ggcgcggcgaccggcacggtgggcggcatcctgggtgtcgacgaccgcccgcggttccgcagctacgtccgcgaccgcggcgtgcgctcctacagctggggcggcccggtccgggtcggcaccgtgctgccggaggacagcgtcacctactacgacgtgcccaccgagtaccgggtgcgtccgggctaccgctacaccatcgtgaacgaccagcccgtcctggtcgatcgcggccaccgcatcgtcgaggtcatcgactga

SEQ ID NO: 5594 - DNA, 159 bp, Methylobacterium sp.
atgaggatcattggcgcgcgcgtcatggccgtcgccgtcatgttgctggtcatggcggtatggcgcgggcttgagcaactcggagtcgcctcggtcgtcgagggctgcctcgtcgccgccattgccgcgaccgccgccacggccctcgctcgttggtga

SEQ ID NO: 5595 - DNA, 906 bp, Methylobacterium sp.
gtgacgcgactccaggcggccaccctcgccacagccttcgcctcagccctcgccgcaaccctcctggcgccgtcatcggcccgcgcgatcgactgccgcaaggcggccagcccgctcgagcgcatgatctgcgccgacccggcgctccggaaggcggacgccgcgctgggtgcggcctattccggcctcctgcacagcacggacgacgccgagatccgcgcgatgctggtcgccagccagaagcgctgggtggcggcccgggacacgtggctcggcgacctggacgcggccgacgcgcgcgccgtcgtgctgaaggcgatccgggcacggaccgaggacctgtccggccgctcgaagagcgatccggcccgaccgcactggatcgcggcggcgctgcggcagcgggccttcgcggcgcggttcaccggcggccccttcgcggggttcgacacggcttgctatttcctgcccgtcgggcaggaccgggtctacgggtgcttcggcagccggcgctaccagaacggcgaccgggtctgcacgctgtccgacgactgggcgagcggccacacctccgagacgcgcacggtcgcgcgggtcgtcgacggcgccgcgcgcacggtcgcgacctgcacgatcggcggtagcgacgacgcggaatgcccgggtcccgacaacgccgacggccgctgggcgcggcctgccgccccggccgccgccggcgcggcggcacccgcgggccctcggcccgtcctcgacgtcgagctggccccggacgccgatgccgagacctggctctcgacctgcctgaccgaccccgcctatccgccgcccgacccggttccggcggcccggacggccccgggatcgagcccgcccgcgcctgcgggcgccccgagcagccggtga

SEQ ID NO: 5596 - DNA, 1227 bp, Methylobacterium sp.
atgcgcgccgccgctcccgagacgccctgcctcgccttcctggaggccctgccggtggcggagcgctggcagcgcgcccgggactggatcgcccgcgcgccccagcccttcttcgcgcagctgcgcgcgcggcggaccgccctggattgcggcgcggccatcctcgtcgccggccgcgccgaggtcgaggagatcctgtccctgccgcaggtcttctccgtcgcgctctacaagcccaagatgggcgagttcatgctggcgctcgacggcacggaggtgaattaccgcgacaaggcggtcatgcgcgccgtgctgtcctggcgcgacctcccggcgatccgcgatctggcgggcgccgagaccgacgcggccctcgacgcgggtctcgaccagggcggcggatccatcgacgtcgtggcgtcggtctcgcgccgcgtcccgctgcggatcgtgcagcgcttcttcgggttcgcggcgcccgatgccgacctgctgcgctggtcgtacgcgaaccagttcgaccagttcaacaacctccccttcgacgagcgcccggacgccgacgcgatccacgcggcggcggatctggcgcgccaggagatgcgggcggccttcgccaggatcatcccggcgcgcgtcgcggcgatcgaggccggcgccgacctgcccgacgacgtcctcacccggctgctccggctgcacctgccggcggcgaccggcttcggcatggaccgcgtcgtcatcaacgtcggcggcctgctgatcggggccatcgagaccacgtcggaggccgtggtgcacgccctcgcggagctcctcggccggccgcagatcctcgcggcggcccgcgcggccgcccggaccggacccgccgccttcgacggctacgtgtgggaggcgctgcgcttcgcgccgatcgtcgccttcatgttccgccaggcggagaccgaccacgtgctcggccggggcagcccggccgagagcgggatcgccaagggccgggtcgtcctgcccctcagcctgtcggcgatgttcgacgcgaccggcgtgcccgacccggaccgcttcgacccggcccgcccggagcagacctatctccatttcggccggggccatcacgagtgcctcggccgctacgtggcgggcgcgatggtcccggagatcgttcgccgcatcctcctgcgcgacgccgtgcgggccgagggcgcggtcgaggacggcgtgccc

SEQ ID NO: 5597 - DNA, 267 bp, Methylobacterium sp.
atggcgaaggaacgcccgacgttgaccagcctgtcggaccggctggcccgaaaggtctcgactcctgccgtggagccggttgggccggtgctcgaggcccagccgaagaccagcaaggccgatgagcgagtccaaatcatcgtgcgaatgacgccggccgaacggaaggcgctcaggcggattgcgctggaccaggacaccacagcccaggcgcttgccgaagaagccattcgcgacgtgctgcgccgacatggagctttcgagtaa

SEQ ID NO: 5598 - DNA, 375 bp, Methylobacterium sp.
atgaagctcgcgatgctggcctgcctcgccgccctgtgcctcaccgggccgatcgcgcatgccgcaccgggcgagacgaccaggccggcgccggcggcgaacggcacccacccgcccgagacggcggccccgcatccggccactgcgcccgcacccggcgcggcgcccgcgcaggccgccccgcgcgcggccaacagtgcccgcgcggagcgccggcggcgctcctacgcggcctgcaaccgcgcctcgcaccagcgcggattgcgcggcggcaagcgccggcgcttcctgatccggtgccggctcggctacgagcggacccgggtccccggcgggcagcccgccgcggcggcgccggcacagccgggccggaag

SEQ ID NO: 5599 - DNA, 159 bp, Methylobacterium sp.
atgcaggacgagagaaagaccgccgccttccaggtgcgcatgcgaccatcggtgaaggctgctgctgagaaggcggccgcggaggaaagccggtctctggcctccctcatggagtaccttctgatcgagcacctgaaggcgaagggctatctgaaatga

SEQ ID NO: 5600 - DNA, 216 bp, Methylobacterium sp.
gtgacgttcctcatggcctacatcgcccagacaggaggaacgctcatgcgaattcgctatctgctgccgctcgtcggcttgctcgcgctcacggcctgcaaggacgagaagaaggccgaggctcccccgccgccaccgcctcccgccagcacggcgccggcgaaccctgcgcctccggccacgacgacgaatccggctcccgccaacaagccgtag

SEQ ID NO: 5601 - DNA, 171 bp, Methylobacterium sp.
atgcgaattcgctatctgctgccgctcgtcggcttgctcgcgctcacggcctgcaaggacgagaagaaggccgaggctcccccgccgccaccgcctcccgccagcacggcgccggcgaaccctgcgcctccggccacgacgacgaatccggctcccgccaacaagccgtag

SEQ ID NO: 5602 - DNA, 1371 bp, Methylobacterium sp.
atggcatccttccaggattttcaggacggctacgagcggacctgggcgtcgctccagatccggccggagaagctcgcgaccgtgcgcaagctcgcgcagcagctcgccgccggcaagccgcgctaccaggagatcgaggcgcgcaccggcgtgccctggtggttcatcgggctctgccactaccgggaatcgacgttcgatttcgacacgtatctcggcaacggacagaagctcggacggcgcaccacgatcgtcccgaaggggcgcgggccgttcacggggccgcaggccttcgtcgaaggagcggtcgacgcgctgcgcctccagggcctggtcgggctcggcgactggagcgtcgcgcgggccctctaccggctcgagggcttcaacggctacggctaccacggccggggcgtgaactcgccgtatctctggggcggatcgacggcctacgggccgccgggcgcgcgcggcggcaagttcgtgcgcgaccacgtgttcgacccgaacgtggtcgacacgcagatcggcaccgcagtgatcctgcggagcctcatcgacctcgacgcgacggtcgcgctcgcggcgccgcgcgccgtcgaggcggccgtgtcccgcgagcccgatgacgaactcgccgacagcacgctctgggtccagcaatcgctcaatcgcctcggcgcgacgccgcccctcgtcgaggacggccggaacgggccgcagaccatgacggccgtcgcgacgttccaggcgcagtgcggtctggacgataccggcctcgcggacgcgcgcacgatcgccgccatccaggaggcgctgcggccggcggcgccggaccacgcggtgctgacgcggatccaggacctggagcgacagctcgccgcgagggcggtcaccacgatgcagcccgccccgatgcaacctgcctcgatgcccccggtggtgatcgcgccggccacgcccgcaccggccgcgccgctcgctgacgtcgcggcgcggctcgacgagctcctccaggccctgcgccgacagatcgacggtgcgcgcctcccgaccgcgccgatcttgcccagcccgcccacggcacgtcccgacggcgcggtcctcggaccggtcaacggcgcgctcgggcagacgatcggacagctgctctccggcaggaagtcggcgatcggcatcatcggcgccgtcgccacgcagatcctgtcccaggtgccgctcaacaccggtctcgggcaggtgctcgcacagctcacgcccgccttcgggctgagcccctacacgatgccgatcttcatcgggctgacggcgtggggggcgctcgggaagttcgagaagtggaacgcacgcgcggggcaggcgaccccgtag

SEQ ID NO: 5603 - DNA, 1371 bp, Methylobacterium sp.; identical to SEQ ID NO: 5602

SEQ ID NO: 5604 - DNA, 246 bp, Methylobacterium sp.
atgttcgagcagatggtcgaggcgccgcggaccgttcggcggcttgaggtcatcaccaccgcgagcggccggcgacgctggtcgcaggctgagcgcagacggatccttgctgaggccatggcaccgggtgccgtcgtgttggttgtcgcgcgccggtacgggatgagcccgcagcacctgtttacctggctgcgcgaggcgcgtcagtggaagggcagctgccttcgtaccggttctcctcgatga

SEQ ID NO: 5605 - DNA, 150 bp, Methylobacterium sp.
gtgcgtgccgaggccgcggcggccaacgagaccgagacgccgcgcgagaagctcggccagatggaggacaaggcgcggtccggtaccgatctcggcgaggcgatcgaccgcgccaccgccgccgtcggccaggacgacgggaagcgctga

SEQ ID NO: 5606 - DNA, 1104 bp, Methylobacterium sp.
ttgttcggcgtcagcgtcgacgaaagcgtgcgctccgccctgctcggcggcgcgcgcgtggtcttcaacctgtcgggcgggaaagacagtggcggcctgagccacgcggccaacgcctacctcgacgagatcgggcacccgcgcgatcggcgcctcgccatccatgccgatctcggccgggcggagtggcagtccaccccggcgaccgtcgaggccacggcggcgcacctgggcctgccgctggtcgtcgtgcgccggaacgccggtgacctggtcgcccgctgggagaagcggttctcgaacgccttagagcgctacgagggcctggagacctacaacctgatcggcccgtggtcgcaggccaacaagcggttctgcacttccgagctgaaggcccaggtcatcggcccgcacctcgcccgcctgttccacggcgagaccatcgtgcaggtgatcggcatccgccgcgacgagtcccgcgatcgggccaagacggcgatctccagcctcgacacccggttcgccaagccgggcaaccggcacggcaccaccatgatgatgtggaacccgggcgtgctgtggtcgcgcgacgaggtgctggactgccacgcgcggcacgcgatcccgctgcacgaagcctataccgtctatggctcgacgcgtctgagctgcgcgttctgcgtcctggcctcgatccgggaccttgaggcggccgcgagcgcggcgggcaatcgcgacctctacctgcacctggtcaagatggaagcgacctcgaccttcagcttccagcccgaccgctggctggccgacgtcgcaccctcgctcctgccggcctcgctccgtgctgcagtgcagcaatcgaagctcgacgcggccgcgcgccgggacatcgaggaagccatgccggcgggcctgcggtacgtgaaccagtggcccccgcgggtgcccacgcccgaggaggcacgcgccatccaggcggcccgcacagccatcctggcgcggcacggcctgcgcaacctgtacgatacaggcgagaaggtgcgggaccgcttcgccgaactgatcgccaagcgcgatgccaaggccgcggccgccgcgcaatag

SEQ ID NO: 5607 - DNA, 753 bp, Methylobacterium sp.
atgacgttcacggcacacaacatccgcctcgcggacgggtctgagaccttgcccgaggcgggctggctgatcgccgacagtccctggacccaggcggctctgcgctcgctccggctgttctacggacacaggctggccggccggtcgatcgtcgatctgggctgcctcgagggcggttacacgctcgaattcgcccgcgccgggatgcgcgccaccggtgtcgaggtgcgccgctccaatttcgagaactgcctgcgggtcaaggatggggcaggcgtccccgacctcgccttcgtcaatgacgacgtgtggaacctggcggcccacggccccttcgatgccgccttctgctgcggactgctgtaccacctcgacaggccggccgccttcatccgcctcatggccgaatgcgtccgcgacgtggtcatcctgcacacacatttcgcgaccgaaaccaacgaggccctgttccagctctcgccgcccgctgagaatgaaggtctgccaggtcgctggatgcacgagcacgatctcgacgacacgagccagctcgaggcgcacaaatggacctcgtggagcaacaagcgctccttctggcccaccaagccggccctgatccagcttctcaaggagtgcggcttcgacatggtctacgagcagtacgacatgctgggacacgacatccgcggctcgatggagagcggctactaccaccagcagggccgcagtatgttcgtggcgatgcggacctga

SEQ ID NO: 5608 - DNA, 711 bp, Methylobacterium sp.
atgttcgcgacgagcctcgccctgtgggtgatagccatcctgcttctactcgcttggctgcatctgcaggagcgggtcaccgagcagtgtcgccgcgcgatccgaccgcagatcgaacgcctgatcatcgagaaccggtggatggagcaccacgcgcgcggagcggccgcgttcgaggcgctctgggaccgggaactcgtcaggctgcaccgcgcccatatctcgcgcccgctcagcgccgtcgtccgattccgcggcttcaggcgtctggtcagagcggaattcgcatcgatcctgccggccgaggtcgcgtcctggaccttcgtcgaccgcgcgagcccctcgcaggcgcactacgaggcgttgatgctgcggtgcctgaagtcggccggctggcgcctggattaccaggatcaggaccacttcgtgctcctccgggcccgaacgcgcgtcgtcgtctgcctgcactggacggaacgtgacgtcgcgtgtctcccgatctcggacgtcgcggcggcggcggagcgcgccgggtcgaccacggcgtgcgtgatgaccaatggccggttcagcggcgcggcgcgcgccatggcggaggagcagaacgtcctggcgctgcactgctcgcagatcgacctgctgctgccccgggacaagtcgactgtcgcgccccgcacggtccgcgaaaccggttttcggctcgccgcctga

SEQ ID NO: 5609 - DNA, 1200 bp, Methylobacterium sp.
atggcggccgccgtgttcggcgccgctgccctcaccgccctgcccgcctccgcgcagtacgcggacggcggcatcaagatcggcatcctgaccgacatgtccggcggctactcggatctggccggccgcggctcggtcacggccgcgcagctcgcggtcgaggatttcgggcgcccgatcaacggtcggaaggtcgagctcgtcttcgccgatcaccagaacaaggcggacatcgcctcgtcgatcgcgcgccggtggttcgataccgagggcgtcgacgcgatcttcgacaccaactcctcggtcgccgggctggcggtgcgcgaggtcgcgcgcagcaagggcaagatcgacatcaactccggcgccggctccatggcgctgaccaacgccgcgtgctcgccgaccggtgcccactggtcgtgggatacccactcgctcgcggccggcaccgccgcggcgctggcggatgatccgaagaacacgtggttcttcatcacggccgactacaccttcgggcacgatctggaggcgcaggtcacccgcgtcgtgaaggccaagggcggcacggtgctcgggtcggtcaagcacccgttccccaatccggatttctcatcctacctgctgcaggcacaggcgtcgggcgcgaagatcatcggcatggccaacgccggtgccgacacgatcaacaccatcaagcaggcgagcgagttcggcatcctgcagggtggccagaggctgggcgggctcaacatcttcctgaccgacatctactccgtcggattgccggcggcgcagggcatgatcctgacgacgggcttctactgggacatggacgaccagacgcgcgccttcgcgcggcgcttcggcgagcggatgggcgggcggatgccaaccatggtccaggccggcgactactcggcggtgctccacttcctgaaggcggccgaagccgccggcacggatgacggcctgaaggtgatggccaagatgcgcgagctgccgatccaggatttcttcgcccgcaacgccacgctgcgcccggacggccgaatggtccacgacatgtacctcgcccaggtgaagtccccggcggaatcgacggggccctgggacttctacaagatcctgaagacgatcccgggggaccaggcattccagccgctctccgagagcacgtgcaagctggtgaagggctga

SEQ ID NO: 5610 - DNA, 297 bp, Methylobacterium sp.
atgccctacatgatcgagaccttcgataaggccgggagcctggacgtccgcagggcgaaccgcgcggagcatctcgtctacctcgacaagatcaaggaccggcttctggcctgcggcgcgaagctgaacgacgacgggagcgacgccggcggcggcctctacgtcgtcgacgtcgagacccgcgcggaggccgaggcgctcatccacgcggacccgttctacaaggtcgggctcttcgagcgcgtcgagatccggcgctggcgcaaggcctacctggacggccgcagctatctctga

SEQ ID NO: 5611 - DNA, 807 bp, Methylobacterium sp.
atgaccgagcggcagacgaaccccgaggcgatcgtccggcgcgcgagccacgccggacggcgcgtcctcgtcacgggggccggccgcgggatcggccgggcgatcgcggaggggttcggcgcgcggggcgccctggtgggcgtggccgacgtgaacgcggacgacgtcgcggcgaccgtcgcggcgatcgagggcggaggcggtcgcgcgctgccgctgcggctcgacgtcgccgactacgcggcggtcgaggcggccctgtcggaggccgccgccacgatgggcggcgcgttcgacacggtggtcaacaacgccggcatctcgcccaagcacgacggggcggcccaccgggtctgggagatggacccggcggagtggaaccgcgtcgtcgcggtcaacctgacggggtcgttcaacaccgtccgcgcgctggcgcccgcgatgtgcgcggccggacgcggctggatcgtcaacatgtcgtcggtggcgggcaagacccactcgccgatcgtcgcctgccactacgcggcctcgaaggccgggctgatcgggctcaccaagcacctcgcagccgagctcggtccgttcggcatccgcgtcaacgcgatcgcgccggggcggatcgagaccccgatggtccgggcggtgggccgcgccgtcaacgacgagcaggtgcgcctgacccccatgggtcggctcggcgcccccgaggaagtcgccgatctcgccctctacctgacctccgccgaggccagcttcgtcaccggccagaccgtcgacgtcgccggcggcctctacatgacgtga

SEQ ID NO: 5612 - DNA, 1830 bp, Methylobacterium sp.
atgaccgatattccgctcgcttcagcaccgtccgcggccccgacagccgcaccgtccgccgcatcgtccgccttcccgcgccggggcgcggcggcgctggcgctcgtcctcgcggcgctgttggcggtgccggtcgcggtcggcaacccgttcatctaccacgtcttcatcacgatctgcgtcttcgccgcgctctcgaccgcctggaacatcgtcggcggctacgccggccagctctccctgggccacggcatcttctacggcctcggcgcctattgcgggatgctgctcgtcggcgccgggatcagcccgtggatcggcatggtggccggcgccgccctcgccgtgctggtggcgctggcgatcagctacccgtgcttccggctgcacgggccgttcttctcgctggcgaccatcgccttcctcgaagtcttccgcgtcctggcactgcatttccgggacctgaccggcggcgccaccggtctgatgatcccgctgaagttcggctggacgtggatggtgttccgggatcgctggccgccgctggccatcgccttcgggctcctcctgctgaccctggcggtcgcgtggtggatgcgcagccaccggatcggcttctacctcgtcgccacccgcgagcgggaatcggccgcgcgcgccgcgggcgtgcgcaccgtgcgggtgcggctcgtcgccgtggcggtgtcgggggcgctcaccgcgatggtcggcaccttccacgccatgtacctgaccttcatcgagccggcggcgatgttctcgctgaccctgtcgatccagatcgcgatgttcgcgctgatcggcggactcggcacggtgttcgggccgctcttcggcgcgctgctcctcgtgccgatcaccgagctggcccgcggctggctcggcgccaaggccctggggctccacggcctcgtctacggcctcgttctggtgctcgtcgtcctgttcctgcccaacgggctgatgggcctcgtgtcccgcttcgcgcgggccggcgcgggcggccgcggcgcgcaggcggcgtcggttccggccgttccgcgggccccggagcggccggcggtcggcgcggacctggtccgggtcgaggggctgcagaagcgcttcggcggccttcacgtcaccaacgatgtcggcttcacgctccgggagggcgagatcctcggcctgatcggcccgaacggggcgggcaagaccaccgtcttcaacatgatctcgggcttcctcaagcccgatgccggcacggtgagcgtccgcgcgccggacgggacgtggcaccggccgggccggccggcggatttcgcgacgctcggcgtcggccgcaccttccagatcgtgcagcccttcgcggccatgaccgtcgaggagaacatcatggtcggcgcgttccaccggcacagcgacgtccgcgaagcccgggcggtcgcgcgcgagaccgccgagcggatgggcctcgcgccctggctcgggagcgaggcgcgcgggctcaccatcgggggcctcaagcgtctcgaggtcgcccgcgtgatggcgatgcgcccgcgcgtgctgctgctcgacgaggtcatggccggcatcaaccagaccgacgtgcgccgcgccatcgacctgatgctgtcgatccgcgacaccggcgtcagcatcatcgcgatcgagcacgtcatgcaggcggtgatggcgctctccgaccgggtgatcgtcttgagttccgggcagatcatcgcccagggcagcccgcaggacgtggtgcgcgaccccgccgtgatcgaggcgtatctcggcaaggagttcgcccatgctcacgcttga

SEQ ID NO: 5613 - DNA, 1011 bp, Methylobacterium sp.
atgggcatgcgagccgtgatcgccgacggacagggcggtcccgaggtcctccggatcgtcgagcgtccacggccggagccgggccggggccaagtgctcgtgcgcgtcgaggccgcgggcatcaaccggccggacgtgatgcagcgggagggccgctacccgccgccgcccggcgcctcggacgtgctcgggctcgaacttgccgggatcgtcgaggcgctcgggccgggcgcggggcgcttccggaccggggaccgggtgatggcgctggttcatagcggcgcctacgccgagcgggccgtcgtcgacgaggcggtcgcgttgcccgtgccggagggcctcccggcggtcgaggcgggggcgatccccgagacctacttcaccgtctggagcaacgtcttcgagcgcgcccggctgcaggcgggcgagagcctcctgatccacggcggctcctcgggcatcggcaccacggcgatcctgctggcgaaggcccggggcgcccgggtgatcgtcaccgcgggctcgcccgagaaatgcgcggcctgcctggcgctcggcgcggacaccgccatcgattaccggcgggaggatttcgtcgccgcggccaaggccgccaccggcgggagcgggcccgacgtgatcctcgacatggtcggcggcccctacatcgcccgcaacctcgacgccgtggcggtcgacgggcgcatcgcgcagatcgccttccagcagggctcgcgggtggcggagatcgacttccagccgctgctgatgaagcgggtgacgctcacgggctcgacgctgcgcgcccggccggtggccctgaaggcgcgcctcgccgaggccctcgccgagcacgtcctgccgctgctcgcggcgggccgggcgcggccgccgatcgattccgtgttcccgttcgagcgggtcgcggaggcccatgcccgcatggatgcgggccagcatatcgggaagatcgtcctgtcgatgggcgacgccgcgcaggggagccgctga

SEQ ID NO: 5614 - DNA, 363 bp, Methylobacterium sp.
atgacttacgtgagcgggttcgtcacgccggttcccgacgcgaaccgggaggcctatgtcgcgtcggccggggcggcctgggcgcttttccgggaatacggcgcgctccaccagatggaggcctggggcgacaacgttccggagggcgagcggaccgatttccggcggtccgtcgcccttcgcgacggcgagagcgtcgtcctcgggtggatcctctggcccgaccgggaaacggcagaccggtgcgaggccgcgatgcgcaccgatccgcgcttccgcgatctgaccatgcccttcgacgggtcgcggatgatcttcggaggtttcgccgcggtcttcgaagcatcgcgcggggcggcgtag

SEQ ID NO: 5615 - DNA, 315 bp, Methylobacterium sp.
atgccagatctcgccgaggtggagctctactgcgcggaagcccgggatatcctcgctcacgcggagaacatcgttgccgacctggaccggagaggtgcctgcgaggggcactgcctgatggcgaaccagggcctcgcggcgctgcggaacctcgaccgcatcatcgagcggcaccgcaggcgcctgacgttcctggccctgcccaacgcggtcggcccgtccccgcctccgtctcctccgcagaagcggaactggctgctcttcctccggcggcgcggcgggtacgcgggccatggcatcgaggcgcattcctag

SEQ ID NO: 5616 - DNA, 1155 bp, Methylobacterium sp.
atgggcctcagccatcaccgcatcggcatcctgttctccgcgcacggaccctacggtctcgtcgggcgggcgatgctgaacggcgcgctcctggcggtcgacgaggtgaacgcgcggggcgactgcgtcctcgagccggtgatccgcgatccgcacggcgccctcgcgggctacgtcgccggcgccgagcaactcctcgatacggggatccgccacgtcgtcggctgctacacctcgtcgagccgcaaggagatcatcccgatcttcgagaagcgggatgccctgctctggtacccgtcgcactacgagggcttcgagacctcggcgaacgtggtctacaccggggcggcgccgaatcagcacatcgtcccgctggtgcggcacctgctcgccgggggtggccgcacggccttctgcgtcggctccaactacatctgggcctgggagaacaaccggatcctgcgggagacgctggcgatcgccggcggcgacgtcgcgggcgagcgctacctcgcggtgggcgagaccgccttcgatcaggtgatcgcggcgatcctggccgcgaagccggacttcgtcttcaacacgctgatcgggatctcggcgtaccggttcttccgcgacttccggagtgcgtgcgcggcgcgcggcatcgaccaggcgcggaccatgccggtggcgagctgcagcctcgccgagccggaactggaggcgatcgggccggaggcggtcgacggccacctgtcctccagcgtctacttcacgtcgatcgatacgccccgcaaccgcgccttcatggcggcctacgcggcgcgcttccccgaaggcccgaccccctcggcggatgcggaatcctcgtacatcgcggtgcatctcctggcgcgggcgctggcgcggtccgggaccgaggatgccgcgacggtgcgccgggcggcctgcgccgacgcgttcgaggcgccccagggaccggtgcgcctcgacgagacgaccctccacgcctgcctgaccccccggatcggcctctcgacggcggcggcccgcttcaccatcgtggcgcaggccgaggagccggtcgcgccggacccctacctggttcgcagcgatccgcgcgtcgtgccggtgagccggcgcccgcgcctgaaggtggtgccatga

SEQ ID NO: 5617 - DNA, 642 bp, Methylobacterium sp.
atgacgacaccccggctgatccagaatttcagcggcgcgcaggccctgctgatcgcgccgccgagcaccgccacggacgtcctggcgagcaccctgatgaaactcgggctcaccgtggcctcggtcgtcccggccggcgaggcgccgtggctcgatttcgagatcctcgaccccgagcaccacatcgtcatcgtggacggcgacctgccgctgccgggcctcgcggcgagcgccgtccccgacctgccgccggtcccggtcgtcgggctcgtgggcgtcgaggcgccgagccgcctcaaggggctgctccagctcggcgcgaccggcctgctgcgcaagccgatccacggcgcctcggtctacgccgccctgttcctggcggtgaacgagcacaaccggcgccgtctcctcgaagaacgccttgcccgcctcgaggagcggaggcgcggccggcgccacgtcgtcaaggcgatcctccggctgatgcaggagcacggcctcgacgacgacgcggcctacgagacgctgcggcgcgacgccatgcgcgcccggcagcccctggaagcttactgcgaggcgctggtccgcgcccgtccgtcggtcacggcgcctgccgccgcgccgcggcatgcccgatcctga

SEQ ID NO: 5618 - DNA, 762 bp, Methylobacterium sp.
atggatctcgggctcagaggccgccgggcgctggtgaccggcggcaccaagggcatcggcggggcgatcgtcgacctgctggccgacgagggggcggcggtcgccctctgcgcccgcaacgccgcggaggtcgccgccaaggtggcggccctgcgcgcccggggcgtggcggcgaccgggcgcgtcgtcgacgtcgccgattccgccgccctgcgcggctgggtcgccgaggccgcggagcagctcggcggcctcgacatcgtggtgccgaacgtgagtgccctcgcggtcggcagcgacgaggcggcgtggcggagcggcttcgccgtcgacatgatgggcaccgtctcggcggtcgaggcggcgatgccgttcctcgagcgctccgaggccggcgcgatcgtcgtcatctccagcgtctccgggcgcgaaatcgacttcgcggccggtccctacggcgccttcaaggcggcgctgatccactatgcgcaggggctggccttccagctcgcgccgcggaacatccgcgccaactcggtctcgcccggcaacacctacttcgcgggcggcgtctggcaccagatcgagaccggcaacccggcgctgttcgccgaggcgctccggctgaacccgaccggccggatggcgcggccggaggaggtggcccgcgccgccgtgttcctggcgagcccggccgcgagcttcatcaccggcaccaacctcgtggtcgacggcagcctgacccgcggcgtgcagttctga

SEQ ID NO: 5619 - DNA, 147 bp, Methylobacterium sp.
atgatcgccagcttcctcgccatctttgtcgccttcgccgcctgccaggcgctgctcaccgtcaagttcgccgacttcctctccgccgaccgtacccggaacactgtcgagccgcccgccgacgtcgccaacgccaagctcgcctga

SEQ ID NO: 5620 - DNA, 99 bp, Methylobacterium sp.
atgaagctcaaggctctctcctacgtcatgatcggcgccttcgtgaccggcctgctcatgacgttcgtcggttcggccaccgcgctgctggggcagtaa

SEQ ID NO: 5621 - DNA, 699 bp, Methylobacterium sp.
atgatcgggccggccgtcaccgcgctggccgccgccgggcccgcggcgccgggggcgggtccccccggacggggaccgccctgcgggccggttccgggctgcgcggtcttcggatcgaacttcgccccggacgtcccggacgcggcggtggaggctgtcgacgacgaggcggacgctccggttcggccgtcggaagccgacgacgcggcgcccgccgtcacgggatcgggcttcgcactggccgactgggcggccgggccggtcgacggcttcaggccgtcggtcccggaggccggcgggccggcgtcggacttcggatcggtcgtgccgggcttggcggccacgaccgggtcggtcgccggcttgggcggcgttccgggcacgggcccctgcgggcccttcgcgccgccggcggcggtggaggaggtggaggccgacatggacgcggacgtcgaggcggtggacgccgacgtcgtggccggccgcgacgcgcccccggacggggtgggctgcccgggcctgccgggcgcggcgtccggcttccggccgccggggccgggcttgtcggcgtcgctgggtggtggcgtcacgggcaagtcctccaactcttcggcgtcgccgcgcccccctagcaccgcggcggcgccgggcgcgagggcgagatacggcggcccggcctccctgtcaccgcgcggttag

SEQ ID NO: 5622 - DNA, 750 bp, Methylobacterium sp.
atgctcgaactctcgctcgacgctgatacaatcgacgcgcaggccccccggctccccgacagcgtgcagtatcacctcggccatctgctcgctgcgacctacgcgcaggacaacgtcgagccgaccatcgcggatcgcttcgccgaactgctgaggctgctcgacggcgccttcggccgggcgcagtacgggcgcgagaaggcgttccaggcctcgctcctcgccctggtgccgaacctgcagcgcttcgcccgctcgctcctgcgcagccatgtcggtgccgacgacctcctgcagaacacgcttctccgggcctggcgctcgcgcgccagcttcgcgccgggcacgaacctggaagcgtggctgttcaccatcatgcgcaaccagttctacaacgagcaccgcaagcgcgggcgcgaggtgcaggacgaggacggcgcgcaggcggagcggatggtctcgctgcccgagcagggcggccatctcgacctgagcgacgtccaggccgccctcgaccgcctggcgccgccgatgcggcaggcgctggtgctcgtggcgatcgagaacctcacctacgaggagaccgccgccgtcatgcagtgccgcatcggcacggtgaagagccgggtctggcgggcccggacgcagctcgccgagatgctgggctacaccggcctcgaggtcggcagcgacgacgtcatgctggccgccgcggggccgaagggccggaaatccaccgctgtctcgtga

SEQ ID NO: 5623 - DNA, 1311 bp, Methylobacterium sp.
atgccgcgtctgcgctggctcatgatcggcctctgcatggccgccaacgccatcaactacatcgaccgcgccaacctggcggtcgccgcgccctccatgtccaaggaactcgggctcgacgccaccgacatgggcctgatcctgtcgggcttcttctggacctacgcgatcatgcagctgcccttcggctacgtggccgaccgggtcggcgcgcggctctccctcgtcgtcgcggtggtctggtggtcggcctgcacggcgctgaccgcggtcggacggggcttcctgtccctgctcggcctgcgcatgctgctcggcatcggcgaggccggggcctacccgtccttcgccaaggtcgcggcctcgtggttcccgcgcagcgagcgcagcttcgccagcagcatcttcgacagcggctcccgggtgggctcggctttggcgatcccgctggtctcctgggtcatcgcgacgctgggctggcgggaatccttcgtcgtaaccggcgtgctgggcttcgtctgggcggtgttctggatgtggctctaccgcgagcccgagaaccacccgaaggtgtcgccggaggagctcgcccgactgcgggccgcgcaggagcggcccaagaccgtcgacgcggcggacgcccagaaccaggtgccgtggctgtcgctgttcagctaccgcacggtctggggcatgatggccgggttcttctgcctcaacttcgtgatctacttcttcatcacgtggttcccgacctacctggtcaaggcgcggggcttctccctggcggagctcggcacgctcggcagcctgccggccctggcgtcgatccccgcgggctggctcggcggcttcgcgtcggacgcgctctaccgccgcggctggagcctcaccgcggcccgcaagacctgcctcgtcggcggcatgctgatgtcgtcggtgatcaccctgtcgatcatcgccccgaacatctacgtggcgctgctgtgcttcgcggtcgcctacggcagcctcgccttcacggcggcctcgatctgggcgctgcccggcgacgtggcgccgaccccggcccacgtggcctcgatcggcggcatccagaacttcgcgtcgaacgtcgccgggatcgtgacgacgaccttcacgggcgtcatgctgacggtcacccaggggtcgttcgtgatccccctgatcgtggccggcgggttctgcctgctgggcgccttcatctacctgttcgtggtcggcgagatcgcgccgctgccggtccgcgacgcccgcgccccggccctgcgccccgaagcggcgcggtga

SEQ ID NO: 5624 - DNA, 648 bp, Methylobacterium sp.
atggccgcgatcacggcggccgcacagaaggcgccgcccggcgaggcgaccgcgctcaccccggcgcgcgacgtgaagcccgtcacggcgccagatccgcggtcgatctacacgctcacgccggaagcggccggggccgtcttcgcgctggtcgagaaccgcatccaggtgatcgacgccgcgctcgacgtgaccgaccggcggggcacgcaggccgtggccgccgcgatggccacggccacggcgacgacgccggtcgtgtcgccggagacgacgaagacgatcggcgccgccaatcgcaactggagcgaggatgtccggttggatcacggcccgtcccggctcgtcggcgccgacacggccgtggcgtacgacagcccgcgggtcacggcggcctggagcctggccttcccggacgtggccggccggcggttccgggccgtgcaattgccgggtccgagcctccgctccgtcctacacgaggcggaggccggattggacgacaccgggagcgacatctacctgctctgcaacagcgcgcatttcgagacgatccggcaagcccacccgcggacccacatcaactggatcaacgtcgacaacgacgagatcgtcgtcgtctggcggaagccgtccgaggaaggctag

SEQ ID NO: 5625 - DNA, 177 bp, Methylobacterium sp.
gtgggccgctgccgcgtctgcggccttgcctacggcggcatcctcggccgcgaggcgggagtgatccggctcgaccgcgcccggtggcgccgtctctgcccgggcgcggcgtggctgaccgtgccggccgcctgcgcgggtctccgggccagcttcggcgggggcgccggatcctaa

SEQ ID NO: 5626 - DNA, 306 bp, Methylobacterium sp.
atgattgaacagggcccacggatagcgcgcgaattccatgtcggcgtcggcggcgaccgctgggccctgatgcgcgacctccagaccgggcagccctacgtctctcactccccgggcgatgacgcgccggaggtccaactggatctcggttcgttcctcgtgctgttcaccggggaggagcgggagaagctgctccgcctgatcgggtcgctgctgccggacgaggacgcgcgtgcggatgccgacggccgggccggcacgtcgcgtccgctgacctttgtctcccggtggcttcccaaccggtag

SEQ ID NO: 5627 - DNA, 252 bp, Methylobacterium sp.
atggacaaccagcgcaacgcccgacgcgtctccgtcaacctgagcggatgcatctccgtggccggccatcccgccatcccctgcgtggtgcacgacatgtcgcggtggggtgttcgcctccggctcgtcgggaccgagcgggtgccccccgcgttcacgctgacgatcgacgccaccgacacggtgatcggctgcgagacggtctggaagaacgccgacgagatcggggccctgaccgacctgatggagtga

SEQ ID NO: 5628 - DNA, 1161 bp, Methylobacterium sp.
atggacatcaactccttcgccgtgtccccgctcgactacggcgcgagcgtcaacgccgacccggagaccaaccgcgtcgccttccagaacgcgatcaatgcgctccaggccaagggtggcggccggttcgtcgtcccgcagggcatcttcgtggtgaacgcaccgctgaccgccagcctcggtcagaacggctcgatcttcatggagggcgccgacaccaactcgaccatcaccttcacgggcggggcccagaacggcctcgtggtcgacgccggtttcatcaagctctcgggcttccggatcgtcgtctcggccatgccgaacatcggccagggctcggcctgctacttacggaacgcctcggcgctgggcggctcgttccagaacatcgtcgtggaggatatgcggttcgagggtcgtgtcgacgctcggccgagctacttcctggcggtcaacggcccggccacctcgcgcatccgcggcgtcaccgtcgtgggcttctacaaccagtccttcccggtcgacagcacgggcatctacatcttcggtgaggtatcgccgagtggtggcgcctcgggcgactggtcgtgcgagggctgcacggtcatcggcgtgggcacggcgttcctggtcaacgagggcgccggtcccgggcaggcgaccgtcgagggctcgtcgttcacggactgcgtcgccgtgggcgtccaggtgggcctgcacatggtcggcaacggctatcaggtgccgggccactcctggaagggcgggcacatcaacgccgcggcggtgtgcgcgcagttcgacagcatctcgcagttcgagatcgccgactgcctgctctacctggacgctggcggggcgaacaagcaggggttcatcttgttcaacggctgcacgcagatgcgggcgcgggacaaccagatgatccacatcgcgcagaccggcgacaccgggggcggcgtctacggcgtggccttcgccaacggcacgaccgcctcgcgggcccagaacaacgacggcatcgggttccccggtggctcggcggtcatctacaaccagtccggcggcaacaaccgggctggcggtaacggccgcggcggccagggcgccctgctcgtcggcggcaacctgatcgacctgggcgggaaccacgtcttctag

SEQ ID NO: 5629 - DNA, 1299 bp, Methylobacterium sp.
atgcaaccggtcccgctcccgcaccagatcgtcggcgcccagttcctcgcgaacggaggcctgctgctggccgacgagcctcgcgtcggcaagacgggcgcctcgatcctggcgctcgacttcctgatggcccggcgcgtcctggtcgtcacgacggcgtcggggcggttcaacttcagccgcgaggtgcgcgagtggcaggccttcccgcgggaggtccaggtcatgatgggcacggccggccgcgtgcagccgcagaccgacgtggcggtcgtgggctggtcgacggtcgggaacgagcagcagcaggcccatctgctcgactggcgccccgagctggtcgtgctcgacgagagccactacgccaagagcttcgaggcgaagcggaccgtcgcggccatggcgctcgcggacgcggccgaccggacattctgtctgtccggcacgcccatgccgaacagccccctcgatctctggcccatgctccggacgctggcgccggagcgggtgagcgatctgagcttcgacgacttcatgggccgctactgcgtcgtccgccacaagttcgtggccggcgagtggaagccgatcgtcaagcgcgggaagaacgaggtcgagctgcgccagcgcctcgacgggctgctcctgcgccggacccagcaggacgtggggatccgcgagcccatcttctccaccctggcgctcgacggcggtgcggtcggcacggccgcgatccgggccgcgctggccgagctgcccgaggccgacgagatcctcgacgccgcggagaccggcgacacgaaggcgctggagcaccacctgggcacgctccggcgcgtgacgggcatcgccaaggcccatgcggtcgccgagctggtgaaggaggagatcgagaccgggaagatgcagcgcgtcgtcctgatgtgctggcacacgggggcgatcgaggcgctccgtggcctgctcaaggcctacaacccggtcgtcctggatggctcgaccccggcggcgaagcgggccggcgtgatcgaggccttccagaacaatcgctcccaggtgttcatcggtcagatcatcgccgcgggcgaggcgatcgacctgtcagtttcgcgcgacctgatcttcgttgagcaaagctttgctccgaaggacatgaagcaggccgcgctccggatcactaaccacggccagaaggctcagtgtttggtgagagtagccgcgctcgcgggctctatagacgaggccttgactgcggtgttagtgcgcaaagtcgcttcaatcaaagaggttctccagtga

SEQ ID NO: 5630 - DNA, 381 bp, Methylobacterium sp.
atgcgcgtgctcatctgtggaggtcgcgacctcgacccggcgctggtgtggaactggctcgaggcgcacgcgaccgaggaatgcgccgacgcgctcgggcgcgcccagcacgtgctgatctcacacgtgatccagggcggcgcgaccggtgccgattccggagcggccgcctgggcacgctccagcgagatcccgcagtcgtgctttccggccgactgggaccgctacggccggcaggcgggaccactgcggaacacgcagatgctggcggaaggtcgacccgacgtcgtgatcgccctgtacccagccggcgcgggcacggccgacatggtgcggaaggcgcgcgccgccgggctgccggtggtggaggcgcggatatga

SEQ ID NO: 5631 - DNA, 213 bp, Methylobacterium sp.
atgaccgacgagcagaagggctacctgcaggcgctgtccgacatgcgctcctggcatcgatgggagatcggacaggcgcttggcgacgtgcgccgcatggagccccacgagaaggccatcgcttggctcgatgagctgattgccacgaagaagcggcacgcggccgaggatgaagccgagctgcggcgcggcgagcctgcacctaagtcctag

SEQ ID NO: 5632 - DNA, 567 bp, Methylobacterium sp.
atgtccgacgcgatcagcagcgcgctgtcggccggcacgatcggcagcaccgacgcgacggccctcgcgggcgccctgagcagcatcgatgggagcctgtcgtcgaccagcgctgcctcgaccagcgcgaccagccggtccgggctcgacccgtcctcgatgaaggaccggatcgacggcctgatcgccgatcaggtcagcagcggcagcctcaccgccgaccaggccacggagctgaagaacctgttcgccagccccggccggagcacccagagcgcggacgccaccggcgacgggactggcgccgtcgccggcccggacggctcgccgcccgggcctccgcccggcccggcgccgacggacgctgcgggcagcgccgggagcggggcgtcggtctccgcgtcggcctcgacctcgaccaccgacgcggcgcgcacgaccaacgacctgctgtccaccttcatccagcagctccagagcggccaggcgggcagcgtcggctacggggcgagcggcaccgccaacagcggcgccgtctcggcgctcctcctcgacttccgcagctga

SEQ ID NO: 5633 - DNA, 447 bp, Methylobacterium sp.
atgaagagcacgacacagcaggatcagctcgagatcgtgagcgccctcgcggcctcgctcgccgaccggatgctgatggagcgcctgacacaggggaagctgcccctcgcgaacgcgagccgcctctggacagcctcgctgctcctggaagagcacgcgcggcccatcccgcgcatcgtgacggacgtcctcgagcaggtccggcacgtcgagccggacgacgacgcggccgacggggatgacgccgacgggatcggggcggggccgcaaccggacttggccgcggcgcggcgtccggcccggccggcgcgccggcgcgggctcacccgcctcctccgaccgttccggcaggcggccgaagcctgccccgcatcgacggacgcgcccggtgacggcgcgggaccatctggtggatccggagttccccgcgcgcgcccgggacgctaa

SEQ ID NO: 5634 - DNA, 321 bp, Methylobacterium sp.
atggacaaggtctatgccggggaccggacgatcgacgggatcgtcgtcacggtgaacggggcgccgctgccggatcgggccgaggccaagtgctactcccggaacggcttcgagtggagctacgaaggtcccgagccctcgcagctcgcctacgcgatcctggtggatcatctcggcgacgcggcggaggcggagcgcctgcagccgcgcttcatgcgcggcgtcgtggccaacttccagaacgagtgggagatgacgacggccgacgtcgcccgcgtcctggagcacctggaatcgggcggcgcggcgcggtccggctga

SEQ ID NO: 5635 - DNA, 216 bp, Methylobacterium sp.
atgccgtttccgatcaagttcggcctgtcggtcgccgtcgcgctcgcggcgctcgccggctggttctacatgggccatctcggccagaccgggccgcgctgggccgtggccttcctcggcccgttcatggtggtcagcctctggatcttccccgaggtgatgcgcaaccgctccgacggccgcaccccgcgccaccggatccgggaggcgcggtga

SEQ ID NO: 5636 - DNA, 390 bp, Methylobacterium sp.
atggacatgatcgaaccgaacgtcgccgcgctcgcgtggttcgccctcttcgcgggggtcgcctgcaccggcttctacgtgctggccgggatgttcccgctggagacccggcccgacctgagggcgcgccccctcggcctcgcgctgatcgcggccaacgtcctcctgctcgcggcgctgaccggcgggatgctcgcctacggggtcaccgagctccgctggtcgagcctcgtgatcgtgggcggcttcgccatcctgttcgcgcccggcctgttcaacgtctggccccagcgctggcgcgacggcgtcgcgggcctggcgatcgtgctcgccgccctctgcggcgccctcggcctgctgcagcaggtcggcgccgtcttcgtcctctga

SEQ ID NO: 5637 - DNA, 792 bp, Methylobacterium sp.
atggaactcgccaacacccgcatgagcgagcggcagcggaactaccgcgccaattaccgccagcgcgtggccggctggtacaacggcttcctgcacatcgcgatcatctacacgatcggcctcacggccctgtatatctacgtctcgaacatccacgcgccgagctggatcgaactcgcgacggtcccggtcgtgttcctgttctgcaatttcttcgaatggtggctccaccgctacgtgatgcaccggccgcagagcaatccgatcgggcgggccgtctacaatcggcacacgctgcagcatcaccagttctttaccgaccacgagatgcgcttcgccgaccaccgggactaccgggtgacgttcttcccgccctacgcgctcgcgacgttcacgctgatgtcgatccccggcgccatcgtgctcggcaacgtattcacgcccaatgtcgggtggctgttcatcaccaccacgaccagcatctacatgatctacgagttcatgcacttctgctgccatgtcgaggagaactggttcgtccgcaacatgccgttcatcaacacgaaccggcggcaccacaccgcccatcacgaccagtcgatcatgatggagcggaacatgaacctgaccttcccgatcatggactggctgttcggcacctcggacctgaaccgcggtctcatcggaacgctcttcaacggctacgacacgcgccacgtgaagaccgacatgcgcaagaccgcgcgcacgcccggtgcccccgagccccgcgccatgcaggcggccgagtaa

SEQ ID NO: 5638 - DNA, 666 bp, Methylobacterium sp.
atgcgcgttctggtcgtcgaggacgatgccgccctggcgcgcggcctcgtcgccgccctccggcacggcggatacgccgtcgaccacgaggcggacggagcggacgcggtgcagctcgcgctgagcgaaccctacagcctcatcgtcctggacctcggtctgccgggtctgccgggcttcgacgtcctcaaggccgtccgggcggccggctcgaccgttccggtcatgatcctgaccgcgcgcgacgccatcagcgaccgcgtccgcgggctcgatctcggggcggacgattacctgctcaagccgttcgacctcgccgagttcgaggcgcgggtgcgggcgctcgtccgccgcgggcaggcggtgccgaatccggtcctgcgctgcggcacgctggagctcgaccgggccgcgggcaccgtgaccctcggcggggcgcccgtcgcgctgcgccgccgggaactcgccgtcctgaccatcctgatgacgcgcgccgggaaacccgtcccgaaggaacggctcagcgcggagatcttcggcttcgacgaggcggtcgccccgaacgccctcgaactctacgtcgcccgcctgcggaagaagttgcagccggacggtcccgagatccgcacgatccgcggcctcggctacctgctgatgccggtgtga

SEQ ID NO: 5639 - DNA, 318 bp, Methylobacterium sp.
gtgcgcgcggagatccgcgaggagatccgcgtcgccgcgcgcgggcgcgacccgtgtttcatccgttcagcctggagacgatcgatgccgttcgccaatttcaagatcccgcagggcatgatgaccggtccgcagaaggcggatctgatccaccgcacgacggatctgctggtcgcctacttcggggaggccgcgcgcccgcacaccatggtcctggtcgacgaggtcgtggatggcggctacgggcgcgcggacgaggtgttcgatctcgaggccctgcgacgcctgcgggcgcaccacgagacggggtcgcgctga

SEQ ID NO: 5640 - DNA, 1095 bp, Methylobacterium sp.
gtgtccttctcagcactgatgatcgcgccggcggcccaggcggccagcactctggaggcggctctccgcgcggtgcccgattccgtcctggcgacgcctgacccgatgccgatcgtcttcatggacgtccaggcgctgtccagggcgaccggcggcgcgctgagcgacgccggcctgcggcgcatggccttcccgcagagcatccgcccgctgaacgccctcggctacggcggcgcgcagacatggaccgagaaggccggcatcccgttcgaggacatctcctatttcgcggccttcggccagcctccggcgcgcgtgacttactggggtctggcgacgaaggcggcagccgacaccctggtcgccaaactgaaggacaggaacttccggccggtctcgaccgcgccgcgcattctcgccaacggtgagccccgcgccctgaatctcaaggcccggcagccgaccgatccctggtccggcccgatgggcgagaccagcgcgatcctggcgatcgatcgcgtcatcgcgcaggcgtccgcggccgcggatctggagacacgcgtcggggttggccggagcgcggcggatcacgaggccgtcgccacatcgctgacgggtctggccgccgcggatgagcgcgacccgggcgcgatccttcaagcggccgtcgtgacgccgctgatgggtatcacccccgacgatcctgccgccctcctgtcggcgacgaccgatctggtcgcgcagaagaaggcgatcgaggatcaacgcgagcgcggacgggacggcgtcccggcttatgccggcggtatcgtggcggactatcaagggaagaacggaccggccctgctcgtgtccctcgcctatcccgattgccggacggccgacagggccgtctccgcgctgaaggcgcgttggcaagccggcatgacccctgcggcctccgtggacggccgctcggtcgagagcccgcagcgcggctgtgccgccgtcctccgcgtcgatcgtgccccgggtgcgaacagcccgttcggggagttcctcgggacgtacatgcagcgcggcttcaatgtcctgcagatcggatcgcagcgatga

SEQ ID NO: 5641 - DNA, 276 bp, Methylobacterium sp.
atggctggagaagcgaagagggccgcgccgaagcgccgaggggacgacccggatgcggcgcgcgccgagggcgagaaggtcggcgcgcgcatcgatgccgccttcgagaagctcgccgggaagctgcgcgcccgcgccgacagggcccgcgccaagctcgacgcggcgaccaaggccgagaagcgggcggtgctgctgcgccgctacgaactctacgcggacgcggcggcctatctcgaggagcggctcgtcgatcgcggggggcgatccgcgtga

SEQ ID NO: 5642 - DNA, 228 bp, Methylobacterium sp.
atgctgccgaccgatctcgaccgacctgccgaactgaccctctggccgggctacgcgccggcccgggtggccgtgtcgcacagtttcccgacgctgcgggccgctctcgccgccgcggtcgcggcgatcgacgccgaggatgccaatccctggatcatcaccgagggcggcgacatcctcgctccgggatggatccgcgcgaacaccgcgggcgccgtcctgcagtag

SEQ ID NO: 5643 - DNA, 960 bp, Methylobacterium sp.
ttgttctcgacggcggatttcaagccgaaagacagtttccgcctctggcgtgagacgatcttcgagcggatcgtgccggtcgaacttacgcctgccgcggcgcacgctttcaccggcacgctggaggctgcggaggtcgggccgctgctgatcacgcgcgtgacgcagagcgccatcaccaccgtcgcgaccccggacacgatccgccgacacggcaagtacgagaccctgaacgtcgcgatcacgctcaagggccgcgtgttcagcgcgcaggacgaccgcaccgcgatccagaatcccggcgacatcgtcgtgatggaccgtcggccggcgacgatggcctccgacgtcgacacgcagacgctgttcgtcgagctgccgcgcgaatccctggagcgcgccctcggctcgacgcgccggttcacgtgcctcacgatcggcgcggatcaagtcggcacgtcgatggtcacgacctttttccaggagctggtccgcaacgcggagcgcctgacgccggacatgtcgaaccgcatggcgtcggtcggcgtcgatctcatcgtcgcgagtatcgcggaacgcctcgcgcacgagacccccaagaacatccagggcgtcctgatcttccagcgtgcgctggcccacatcgaggcccatctcggcgacctgaacctcgatccggccgggctcgcggcggccgtcggcgtgtcgctgcgccacctccaggccctgttccgcgagcaggaccgcaacatcgccgactggatctggcggcggcggctggagaccgccgcgcagcgtctcgccgatcccggcttcgcccatctggccgtcggagagctggcctacagctgcggcttctgcacccagagccatttcagccgacgcttcaaggacagctacgggatctcgccgagcgagtaccggtggcgcaaccgcggcgcggaccagctcgccggctga

SEQ ID NO: 5644 - DNA, 405 bp, Methylobacterium sp.
gtgctgacggcagggctcgtcgctgcctatgtatcgaacaatcgggttcccaccgccgacctcccgaccctcatcgcgcagtgtcacgacgcgatcaccgcgctggccgccaacggggcggcgtcgatcgaggcggcgggggatacggacgcgctgcgcgaccggcctaccgccgcgcagatccgcagctcgatccggcccgacggcatcgtgagcttcatcgacgggcgccgctacaagacgctcaagcgccatctcacggcccacggcctgcacccgcagagctaccgcgagcgctacggtctgccggccgactatccgatggtcgcgcaggaatatgccgagcgccggtccgcgctggcgcgctccatcggcctcggcgtgccgggcgagcgcgccgcctga

SEQ ID NO: 5645 - DNA, 225 bp, Methylobacterium sp.
gtgatcggcgtggtcggattgcgggcggtcgacgtgctcgggctcttcgtcgagcccgcggtgatctgcctgctcgccgccctggtgatcacctgggccctgcgctggatcctggactggatcggcatcaaccaccttgtctggaaccgcgccctgttcgacttcagcctcctgaccgccgtgacggcgctgctgatcctgtccctgcgcgtccagggcccgtga

SEQ ID NO: 5646 - DNA, 1857 bp, Methylobacterium sp.
atggccggtgaggtcgcgctctccgaggacgcgccgggcctcctgcagcgcctcgcggcgtggtggccgcgcgaggcggccgaggccgtgcgcatcgcgctcaccgccatcgcggcgatctggctcgccatgtggctcgagctggcgctgccgcactgggccggctggacggtcatctcggtgacgctcgccacccgcgcggcctccctgcgcaagagcctgtggcgggccggcagcacgctggtgggcgtcaccgtcgcgatggtgctggtggccaatttcgcccaggcgaccctagccttcgacctcgcgctggccctgtggatgggcctgctcaccgcggcctccagcgtcgagagcggccagcgcgcctacggcttcgcctcgatgggcttcaccgtgccgatcatcgcgctggccgacgtgcagaatccggaggccgtgttccagatcggcgtcgatcgctgctcgacgatcctgctcgggatcggctgcgcctacgcgtcgaacgtgttcgtggcgccgggcgtccccgccgtcagccgcgccctggcagggcggctcgaggcggccgcggaggcctgtgacgcctggatggccgccctgcggcggggcgagcggcccggcccgatgccgatcgccgcggtcatgaccctgggcgaggaggtcaccgacacgttcaccgagcagccctccctgcgctccggcggccgcggcatccgcaacgccgccccccggttgcggcgggtgctcgccgcgggcctgctgcgggcgctgctgccggaccggccgggatcgcgctcaaccgacctgatcggggccggcggggcgatcgccgtccggcaggtcgggcgcgtccgggtctcggcgcggctgctgcgggccggcggccgcgtgggccggcggcgcgtcccgttccgcccgcacctgctcctgtggaacgacctggactgggacggctggcacgccttcgacaacgccctgcgcaccgccgccgccgtcctgctcgtcaacggcttctggtacgtcaccggctggtcgcacggggccggcgccgcgacctgggcgagcctcgtctgcgtcctgctcgccgcccatgccgacccgcgggcggaatcccgcgccttcctggtcggcgcgctgctcgccggcgtggtcgggctcaccgtccgctacaccctgctgacggccaccgggagcttcgcgctgctggccgcggtgctgctgccggtggcgatgctggcggtggtcggccgcgccgacaagcgcgcgatctacgggatcggcttcgggttcttcgtcttcggcgtgctcgatcccaagaacccgatgacctacgacctcgccgattcgctcaacaccgtgctggccgagctgctcggcatggcggtggcggcgatcgccttcgccgccctaccgccgccggtcagcgccgcgaccctgcgcctgcgggcccgccggcggctggtccggtcggtgcgcggcgcggccctcgacccggggctcctgctgccgcccctcgaccgctacctcgcccggggcttcggccgcctcgccctcatcggcgcggatgaagaggcggcccggagcggcgagcgcctgctcgtcatcgggctcctgctgctcgccctgcgtgagacggacgaccgggagggccgccgcgtcggccgggcggtctgggcgcggctcgccgcgtcccgtccggcggggccggagacggcgccggatcccttgcgcgcgctcgccgaccgggcgaccctgcccctccaggcggagcgcatcggggcgctggccgccctcgtgtcggatctcgaccgcgcgggctggccgaacctcgatccgggagggcgggcgtga

SEQ ID NO: 5647 - DNA, 399 bp, Methylobacterium sp.
atgatccgctgcgtacgcatctggaccggtgacgacgacaattcctacttcgaggaaggcgtcatcgacctgccccacggcgagcgcggcgacatcctcagcggcacgaccgacgtggtctcgatctccttccgcgagacccaggccggcgggacctacgcgtggcacgcggcgccgacccggcagttcgtcatcaccctgcgcggcaccctcgacttccagacgagggccggcgcgcacttcacgatccgccccggcgacatcctcatcgccgaggacacggccggctccggccattcctggcgcctggtcgacgacgagccctggtgccgggcctacgtgatcctcgcccccggcgccgaggcgcggctccccttcgtcccgaacaagaccgcctga

SEQ ID NO: 5648 - DNA, 231 bp, Methylobacterium sp.
atgcaggacagcatcgataccgtccgcgagctgagcgccgccgagctggaccaggtcggcggtggcctcggggtcggcctcactgtcggcctcggggtcgacgcgagccaggagctcggtgcggtctcgggggtcgtgggccaggtcggcggtctggtgagcggcctggtgggcagcgtgctcggcgcggtcggcggtgtcgtcggcggcgtgaccggctccctgcgctga

SEQ ID NO: 5649 - DNA, 414 bp, Methylobacterium sp.
ttgcgcaagaaccaggaccagcttgaaccgaccatcagcgacgtggccctgcgcgtcgtgaccgcctatctgtcgaacaacgcgctgccgcacaccagcataccgccgctcctgatcaccgtgcacggcgcgctctccgcgctcaccgaccggccggcggtcgtcgaggcgccgcccgagcagcccgacgccgctcagatccgcggctcggtccgccaggacggcatcgtcagcttcatcgacggccggtcgtacaagaccatgaagcggcacctcacggcgcacgggctgacgccggatctctaccgcgcgcgctacgggctgccggacgattacccgatgaccgcgccgggctacgccgagcgccggtcaaagatcgccaaggcgatccggctcggccgcaaggccgcctga

SEQ ID NO: 5650 - DNA, 351 bp, Methylobacterium sp.
gtgctggcggcgctcctcggaggcctgctcgcggcgccgttcgcccacgggcagggcactgacgatctggaggccgagatgcgggcgcgggtcgccgcggccttcccggatgcgggcctcgtgacgttccgcaagatccggcctatccccgccgaggcggagtccggcgtggcgttctgcggccaggtcagcagcggccccgtcgggcaggggcggtcggattttcaggtgttcctgtacgaccgcaccgcgtcggccgagaccgtccgcatcctcggatcggaatccctcaacggctaccgcgtcggccggaagctgatcggcgccctgcggcgggtcggctgcctttga

SEQ ID NO: 5651 - DNA, 273 bp, Methylobacterium sp.
atggaggttcggatgtgcgcgcggaagaccttctacattttcgtctcggcctcggacggggagcagttctgcgccgtccgacaggaccagcccatcccgtcgctcatcgacggtgtccgctggatgtatgttggctgcatcgatacgacccgggacaggccgtacggattcgacgtggacgcggcgcacgcggcgatgcggcaccgcagcgtgtacttctaccggcgcgaactgatgttccgccgggccaacttcctcctcgaagccgcctga

SEQ ID NO: 5652 - DNA, 672 bp, Methylobacterium sp.
gtgctctggttcctggtcgcccttgggcttgtgcgggtggtcgacgccgcggcgcgcgcggcgaccttcccgggcggctactggatcgtcctgggcggcgccctggccctgtcgtggacctgcagcgcgcgggtgttcccgtactggcaggtccacgcgctcgtgggcgccctgccgttctacgtcgcgggcctgaggctcgggcgacgggcgttcgacgtgtcggcgctgctcggcgcctgcggcctcgcggtgctcctgctctgcgcgccgcggaacttcgtccacgtcgcgaccgggcagtacggcgacccggcgctgttcgccgtgacggccgtggcgggctcggcgttcgcgctggcggtcgccggccggctgcgcggcccgccgcgcgccgcggccggcctgctggggcgggcgagcttcgagctctacatcgtcagcggctacttcctcctcctggcgccgcactggcccgcctgggaccggtgggaccgcttggtgctgctcgccgccatcggcctgcccctgcacctgatcgcggcccgcgggctgcgcgggccgatccgggccgtccgcgcggccgccgacagtgtcgtcgacggtttggtcggcgggctctccggccgccggcgtcgcgcgcggccgggcttgtccggggcggatccttaa

SEQ ID NO: 5653 - DNA, 219 bp, Methylobacterium sp.
atgaccgctccgcaagtcatcgcaacgatcttcttcctggtctcggtcggttcggcgacgacgctggccctcatggcggcggcctcggccgtgctggacgcggtcgcggagacctgcgaccgcgcgcggccggacgcgggacgggaccgctcgcgccgtgtcacggaggccgcctgtcggctgcgccgcgcggccctcgcccgcgccgcgatcccgtag

SEQ ID NO: 5654 - DNA, 222 bp, Methylobacterium sp.
gtgcagcacctgttccaggccgtcgcgatcttcgcgttcggctgcctgctgatccatgccggtcgcgcctatgcccgggcgaccacgctcctgctctccgcgaccgcgctgatgctgagcgtcaccctcggcaccgtgctctgccagcggatcggcctcacggggcgttccgtcgcggccggcccgtcctacacggtggcgctcggccggcccgctccgtag

SEQ ID NO: 5655 - DNA, 144 bp, Methylobacterium sp.
atgaccgcgcctctcctcatcagcgtcgccttcgcggccgtgaccgcgggcgccgccacgctctgggccttgctggtcgcgaacggcatgaacggcgtgacggagtcgcgcccgaccgagcggcacgacatccggacctggtga

SEQ ID NO: 5656 - DNA, 813 bp, Methylobacterium sp.
atggcgcgccgcccgacctatcataacgacggccgcggaccggaacatctgatcatgcgtggtactctggtcgtcgcgacccttctcgccttctcggcggtgccggccgccatcgcggccaatccggtgcgggacgtgctctgggtggcgctgcagggctgcgtgctcgccaagaaggccgcgggccggagctttccctgcctcgcggtcgatctcggcgacgccgcgcgcccgggaacggcggtgctgcgggcgccgggccagcccacccacacggtggtgatgcccaccgacagcgtctcgggcatcgaggcccccgtgctccagggaccgcgaggggcggcctactggcgggcggcgctcgcggcccggcactacgtgtcggacgcgctgcagggccgtctgcccccctccgcggtcggcctggaggtgaactccgtgggcggccgcagccaggatcagctgcacatccacctcgactgcatgcgccggagcgtcacggcggccctgaaggcccacggcgacgccgtcggcgacagctgggccccgttcccggtgccgctggcggaggtgtcctacctcgccatgcgggtcccggccgacgcggtcgaggcgttcaacccgttcgccgctctggcccgcgtgcccggctggcagggccacctgcacgacgcgagcttcgcggcggtagaggccgatcccggggatccgcggggcgggatgatcctgctcgcctatcgggagccggaggccagcgccgaatacctgatggatcacggctgccgggtggccaggcacggccgggccggctga

SEQ ID NO: 5657 - DNA, 306 bp, Methylobacterium sp.
atgccgctgaccggacgtttctggttccgccggacctggaccggcaagctggtcctgctcgtcgaggaggagcgcgggcgctggttccggcgccgcctcggccgcaccctgcgctggcgcgacgcgcggctcctcgatctggccgaggggcccctgcgggggctcatgacgctggagcggacctaccgcgccgagttcggccccggcgagccgcgccgccccgccggcctcacggcggtcccgggcgggctggccctgccgcgcggcgggccggagccaggaacaaggccgtccctgtcgggttga

SEQ ID NO: 5658 - DNA, 225 bp, Methylobacterium sp.
atgaccgaacgagacccgtaccggcacgaggatccgatctggtacgatcggatcgaggcggatgagccgccaggcttgatcctcgatctgctggcgcacgtgttcgtgccgatcatggcggctctcggtgcggtgagagcgctgtactggctaccgactcgactgtggggccgggcctcgcgctcgctcctgcgccatcggaccaccgctgcgaagcgtccctga

SEQ ID NO: 5659 - DNA, 201 bp, Methylobacterium sp.
atgagcgacgcgcccgatccgaagcggaagacgatcgccgacagcgtgttggttcgtctcagcacgttcgcgctgggcatcggcctgtacgagggcatcgcccagagcatcgtcgagaaggcggttgccgacatgccggaggccaccgtcgagcagatcgcggcggcggcgcagatgatgatgctgttcgtgtcgggctga

SEQ ID NO: 5660 - DNA, 123 bp, Methylobacterium sp.
atggatcgcttcctcacgatgatcatggtcgcaggcggcgtggcgacggtggtgtggatcgccgcgatgctggtggtcggctggcaaatggccgtcgtgctgatgggactgagcgcagtctga

SEQ ID NO: 5661 - DNA, 117 bp, Methylobacterium sp.
atgaccaagccgatcaccctgacgaaccgtctcgtcgacgccgtcgtgacggccgccattgcgttcagtctcgtcgtgcacgcgcaggtcatgatcctgccgccgcacttcgtgtga

SEQ ID NO: 5662 - DNA, 111 bp, Methylobacterium sp.
gtgaccctggactcgcaccgccccggcgacgtgccgcgggcgcgcggctggcgcgtgatggttccagggggcggcatcgtcgtgacggtctgcgaggcggagcccggctga

SEQ ID NO: 5663 - DNA, 447 bp, Methylobacterium sp.
atgtcgaagctcagcctgtccctgaacgcggttcggcccggagccgacgatcacccccggccgcacgtcgccctgcgggacgaggccagcgcgatcgccgcggccgtgcgggtcttcgaggacgggctgacggatctgcgcgcgggcgtgccggtcgcggacgacgccgcttccgccgcggcggcggccgacgcggcgaccggcctcctggccggcatcgccggtcagaccagtctgatggcgctccgggccgcgatcgaggcggcccgcgacggcggagagggccggggcttcgcggccgcggccgcggaggtcagggacctggccgggcagatggtgcgggcgaccgacacgatcgtggcccaggtcggccagatccaggccgcggcggagcgggcgcaggataccgcgacccgggggcagcgccaggctgcgtccgcgcactga

SEQ ID NO: 5664 - DNA, 288 bp, Methylobacterium sp.
atgagcgcgcgcgacgccgcggatgccggacggcggcactggttctacgacagccggatcctggtctgcaccttctgcctgctcgcggtcatggtcatcttctggcaggtgagccggttcgagggtttccagccgatcttcacctgcgcccggaatcaggacgtcgatcgcgacctgctctccgtcgggatgcgcgcctgcatgggcgacgcgccctcgcaggccgcccaggcgcgctgcatgcacgtcgtctacctgctggcctgcacagacgagcggtggcgctga

SEQ ID NO: 5665 - DNA, 273 bp, Methylobacterium sp.
atgacgtccaccgctctcgccgtgatgatggccggcgtcctgggggccttctgcacgatcgtgttcgcggtcgactgggtacccggctccgtggtcggattgccgaacctgccgagccggcgcgtgatcggcctgtgggtctacaacggcgttctgtgcctcgccctggccgcttggttggtgtgcacctatttctgcaccgtcgacggctacgaggacattcccgcggtgcgcgacagctactgcaggccgcacgcgaccgtaggcgcgtga

SEQ ID NO: 5666 - DNA, 246 bp, Methylobacterium sp.
gtgatcccgatgtcgggcggcatgctcggttccctggccctggcggccgtcttcacgctggggtgcttcggcatccacagcgcgcgccggcatccggacgcggtgaccataggcctgttcctcctgctcggcttgctcgcgtccctgtatgtcggccggcacgtcggaccggacgtgcaccaacccacgtggcagcacgaggccctgtatcgcgagagcgcgccgacgtcgcatccgacaatgtga

SEQ ID NO: 5667 - DNA, 192 bp, Methylobacterium sp.
gtggacccccagccattcaccatcgacaccgaggcccaggctcagacgtacctgaccgatctcctcaacaatccgaagaaccggtcgatgagcgagatcgcgagacactgcgccctgcgggtccgcaacccgaagatcaaggcgttctttctgaccgagggcgcgaagatgctcgccgagatgaaggcctag

SEQ ID NO: 5668 - DNA, 153 bp, Methylobacterium sp.
atgctcgctcgcccgttccgcctgttcgccccggcgctcgcagccctcggactcgtggccctgcgcctcgcgagcccgttcatcgggccggtgtcgcccccgcaagcgggcgcgaccgacgacgcgggcgtcgtcttccggcactatctctga

SEQ ID NO: 5669 - DNA, 666 bp, Methylobacterium sp.
atgtcggtcaatacggtttcgggcagttcactccagcgggatctcgtcagcgccctcaggcaggcgcgggcggcgaacgctgcccgcctcgacgtcggcaccgccgcgacggcgaaccaggagaccggcaagcaggcggccgcggacgacaccgccccgtcgaccgggacggcctcgacgccgacgctgtcgaacgacctgatggcgtcgctcctccagctgcaatcggacttcagccagatggggctgcagaacggcgtcacggcgcccgcggaagccgcggccaacgccgacgactcgtcgacgaccggcaccgccaccggtgcggcgcccggtcaggccgcgggcggcgcgcccgccgtccatcaccatcgcggccatcacggccaccggccggtgtcggatgccgagcagagcgagggtgcggcccaggccggcgccgcggccgacgcgtccgcggcctcatccgcgatctcgtccgcgagcacgtccaccagcacgtccgcgagcacgtccgccaccgcgagcaccgatcccgcgacggcgacgggcagcggcagcgacctgcaatccttcctgcagcaggtgaccaaggcggtgaccgcctacgcggccggcggaccgctcggcatcgcggccgcgctgaccagcaccaccaaggcctga

SEQ ID NO: 5670 - DNA, 222 bp, Methylobacterium sp.
gtgcccagtcgcttctatttcgacatcgagaacggcgaggagacgatccgcgacgcgcagggcgtggaggccgcggacctggccgaggcgctcgcggaggcccgcagcgtgatcgacgaaatggcgggtgaactggaggccgcgggaccggccggcgcgtggacgctcgtcgtacgcgacgccaccggcgcggaggtcggccgggtgccgatcaagggctga

SEQ ID NO: 5671 - DNA, 228 bp, Methylobacterium sp.
atgcccctctcccagaacgtcccgcacgccgcccgccaagcggacgcgatggctgcccagatggcgctggccgcccacgcgctgcggatgcgcggcgatgtcggggccgccgagtcgctcctcgcgatggcgcgacacaaccggatcctcgcgctcaagctgcggatcgcgcaggagctggcgccgggccaaggccgcgccgagcgccgggccaccgccggccgttag

SEQ ID NO: 5672 - DNA, 216 bp, Methylobacterium sp.
atgaaatcctgcaacgtggatgctgggacgcaacggctgtcgggcgccgcccgcaagagcttcatggcagattgcctcgcgggaaagagcgccgcgccggccaaggagctgacgccgcagcagatgaagatgaagagctgcaatgcggatgcctcggccaagagcctcaagggcgccgagcgcaaggcgttcatgagcacgtgcctcagaggttag

SEQ ID NO: 5673 - DNA, 189 bp, Methylobacterium sp.
gtgctcgtcgtgctcctcgtcagtgtggggctgatgatcgccgccctggccggcctgatgatctggcagagcgagaccgcgccgcccgattacgccagccagagccaggccgccgcccgcaaggccgtcaccggctccgagagcgggtcggtcggggcccctccggccgggacgcgatccgcgccctga

SEQ ID NO: 5674 - DNA, 198 bp, Methylobacterium sp.
atgcgcgggaaagacggcccggataagccaccgaccgagcccgcaccggcagcccgcccgcgcggcttctttcggcgcgtgctcgacggtctcgaagccgtcgagctgctggtccaggcgggccggctggtctggtggctcctgagaggcctgtggctggccgccggcgcgatcgtgcgcctcttcggggatcgctga

SEQ ID NO: 5675 - DNA, 1212 bp, Methylobacterium sp.
atgcaagcgcactttgcggggatcgacaacccgaacccgatgatcggcccggcccgcctgatccgggcggccttcgagggcgccgacatggccgccctggccgccgagatcctcgccgagggcggcgactctgccctcgacgccgggacggcgctggacatggcgacgatcctgctgctgaagcaccgcttcaccgaggggctcgcgctccagagcgaggtgctggacggacagcgggtgttctcgctgcgctcgaacccggatcaggcgcggatccgcgtcctcgtcctggtcacggccggcgacctcatggccaatacgccgatcgacttcctgctgaacgacggcgatttcggcctcacctacctctatctccgccccggcgagccggtgccgcacgacctgccggcgcacgacgtcatcgtcacgggtatcgcctacgcgcggaccgccgagccgctcctggaagccctcgcggcggcggcggaccagtggacgcggccgatcgtcaatcacccgcgccacgtcctcaagacgtcccgccacgggatcgcggacgcgctccgcggggcgaaggggatcctggcgccggacgtcgtccgcgtgagccggtccatcctgagcgccgcggcgtcccgcatagccgagggcccgacgtacccgctcctcgtgcggcccctggacacgcacgccggcaacgacctccagaagatcgaccgggcggaggacctgcatctctacctcgcgcagacggatgccgaggcgttctacgtcacgcaattctgcgattatcgcggtcccgacggcctctaccggaagctgcgcgtcgtgctgatcgacggtgtgccctacctctgccacatggccatccgcgatcactggatgatccactacctcaacgccggcatgctggaggatccggtgaagcggcaggtcgaggccgccgccatggccacgttcgacaccgacttcgccgagcgccaccgcgccgcgttcgccgagatccaccgcaggatcggcctggattacctgatcatcgactgcgccgagagcgcggacggccggctgctgatcttcgaggccgataccgggatggtcgtccacgacatggattcggaggagctgtttccctacaaggctccgcagatgcgccgggtcttcgccgcgttccaggacgcgctgcgggggcgggtccgcgggcggaccgcctag

SEQ ID NO: 5676 - DNA, 498 bp, Methylobacterium sp.
ttggccatcctcttcgcgggaatcgcactgatctcaacggcgcaaggcggtctgtccctccgtcagctggccgggatcggagaggctgcgacggcgctggccagggactgggtgccctccctcgagaaggtcggcgcgatcgaagtggcggcctccgaggtgcgcatcaagcagttccggctcgtcctgctgtcggatacgtcggagcaccgggacgccaatgaagccgccctcgcgaagacgcacgcgcagctgcgcgacgcgcgccgggcctacgaaccgctgatcaccaccgccgacgagcggcggcactacgacgcgttccacgcgtcctgggcccgatacgcggaggtggatcgggaggtgcggcggcacgtggaggcggggcggcggacggaggcgaccgcgctgctggtccggcccgacgtcgtggcgctggacgacggcgcccgcgcggccctggcccgtctggtggaccacgacgagacgtcggcgtag

SEQ ID NO: 5677 - DNA, 120 bp, Methylobacterium sp.
atgaccgaggcagaggtcgggccggaggtcggggcggaggccgaggcggtcgagcggcacaaggccgagacggagaccgccgcgggcgatgtggccgacgacctcgccgatttcgcgtaa

SEQ ID NO: 5678 - DNA, 702 bp, Methylobacterium sp.
atgggtaagcggttcaccgcgacgctggccgtgctcctgtccctcgccctgcccgtcaccgccgcgacgctccacagcacctacatcgacccggcggcgatggcgctgcagcgcgtcctgccgcccccgcctgaggccggttcggaagcggccaaggtggacatgcaggccgtggaaactgccgtccgcgcccgctcgcccgacgacgagcgccgcatcatcgcgaacctgccgtgcaccctcgaccgcttcaccggggttctcggaccgaccttcaccgcggagacgatgccggtcaccgcagcgctgatcgagcatgtgttccaagacggcgaactcgccgtgctggcggccaaggccgccatcgcccggccgcgcccctacacggtgaagccggacctcgccacgttcgggcatcgctccgacagcacgtcctacccgagcggccacgccacgttcgggtatctcgcggccacggtgctgtcgcgcctcgtgcccgggaaacgtcaggcgctgttcgcgttcgcggcctcctacggggagaaccggatgatcgccggcacccatttcccgtccgacctcgaagccgggaagatcgctgcggccgtcatcgcggaggtgctgttccgcgaccctcgcttcgaacgggatctcgaccgggcgaccgcggaaatcgcggcccagggagcctccggtcgttga

SEQ ID NO: 5679 - DNA, 798 bp, Methylobacterium sp.
atgattctctccccgctgaacgccctgttcgtcggccccctcgagggctaccgggatcggatcgtgtccgcggaggatccgcgcccctccgtgaggggcgccgacctgctcgatccgcgcgtcctgaccgaccagctcgaccggttcgcccgcaccttcgcggcgccggagccccgcgccgtcgcgtcgatctgggcgaagcagcacttctcgatgctggtggtgcccgcgctcgcggccaacatcgtgctcgacctcgtcctgcccgtggccctcgacgccgtcgagatcgtcccggacgacggcgggctgacgcgggcgctcaagctgcgcggccccgccgcggggagcgacaggtccggcgggcagaccggggagagggcgccggcggatcgcttcggcgcgctgatcgacgcgcacctggcgcccctggtcggtgccctggcggcggtctcgggcgtggcgccgcgcgtgctgtggagcaatgccggcaacatcttcgagttcgtggtgcgccgcaccgaggggctcccgcaggcgggccggaccgggcacgcggccgccgcgagcgtcctgacgagccgtcgccggtccggcgcgcccaacccgctgttcgcgccgatccgctacgtcccggaggcgggggacgcaccggcgggcgcgccgccgcggcgggtgcggaaggtctgctgcctgcgctacctcatccccgaccagagcctctgcggcgcctgccccctgccggcacgccccgaagcgggtccggcgggaacgcacggcccgaggaggcccgcatga

SEQ ID NO: 5680 - DNA, 294 bp, Methylobacterium sp.
atgcgcaagctcgctctcatctccgccgtcaccctgtccctcggcgcgctcggcgccaccggcgcccaggcgcagggttatggctacggctacggcggccaccacggctacggctacggctacggccgcggctatgatcgcggctacggccaccggcgcgatttcggctaccgccgtcaccgcggcctgtcgaccggggccgccatcggtctcggcatcgcgggcgcggccgccggcgccgccgcggcgggcgccttcgaccggggcccgggctattacggccgcggttactga

SEQ ID NO: 5681 - DNA, 180 bp, Methylobacterium sp.
atgtccgcgcttgtcacgttcgtcggctgcggcctggtcctggcggggttcgcggccgagaagttcgccgagcatcgctggctcgcggcgagccggcccgcaccgctcgacaccctcgcggtcctggcgctggcgctgccggccgtcgggctcacgctgatggcgacgctcgcggtctga

SEQ ID NO: 5682 - DNA, 165 bp, Methylobacterium sp.
atgctcgatgtcgccttctggtggtgcgtggccgtggccttgaccggatcggtcggcctcgtcggcttggccgtcgtcgccggccggagcggccgctcgcagccgcgcggcctcaagctttcccggaccgagcccctcgtgctccgtcacttcgggcgcgcgtag

SEQ ID NO: 5683 - DNA, 198 bp, Methylobacterium sp.
atgcatttcgagatccgcgcgaccgacacccgtctgtggacctgggtcctcctcgatgcgacgcagatgccggtcctgacatcggaccgcaccttcccctcggaagcccaggcctcggcggcggcgctggccttcgccaagctcgtcacgcgggccggcaggaccctcaccgccgcaccgccgggcggcctgatctga

SEQ ID NO: 5684 - DNA, 528 bp, Methylobacterium sp.
ttgcgcgcggccggctatgtcggcgcctggacagcggacgtgtcggcgggacaatccctcctcgacgaggggacggcggcgctgctcgccggggatgcgaccctggccgggcgcccgctgcccatcgagatcgcccttcgatgcacccatccggacgatcgcgactgggtcttcgcgcgcatcgcccgggtgcgccagaccggcggccccgtctcggccgagtaccgcgtcctcacggacggcggcgaggttcgatgggttctcgaccgtggcagcctcacgcccgatccggcgggacggatgcgcggtcgcggcatcatcatcgacaccacggacagccaccgcggccccttccttccgagcgcggcgggcgatctgccggcggacgacccgatggtcctcgcgatcgatcacctcctgcaggcgcgcgcggcgatcgtcgcgatgggccaccagcggctgcaacaggtgtcggatctggcgctgttcgaggtcgggcgagcgctggcgcggcgcgctcgggcgtag

SEQ ID NO: 5685 - DNA, 483 bp, Methylobacterium sp.
gtgctcgcggcggcgctcgtgacggcgctcgcggcggcatcgaccgccagagccgagcccgccaatcaggtgctggggacgtggcgcatggtgtccgcgcggctcgatccggaggggcgcaacgcgccggcctacggcgcgcgcccgagcgggctgctggtgttcacgcgcgacatgcacttcgtcgaggtgcttacggacgccgacattccccggttcgcctcgagcgcgcgcggtcaggggaccgcggaggagaaccgggcggccatggctggcagcatcgggttcttcggcacctacacggtggacgccgacggcgcgttcagcggcaaccgcgtcgagggctcgaccttcccgaactgggtcggcgacgtgcgtacgaccgagcagcttcgcctgaccgtcgaggggggccggctgagcgagagcttccggcgcccggacggtacgcggatcgccatcacgtgggagcgcgtccgctga

SEQ ID NO: 5686 - DNA, 303 bp, Methylobacterium sp.
gtgatccgaacggatcccgatttcgaacacgccgtgatcggcggattcaagctggtcgaagacgcctacgcgcgcgggatcatctcttggatgcgccggtgcgcgttgcgggacctgttggcgagcggcgagtccgagctgtacgagaggcgcacctatgtgacgccgcattcggacccggatgcgatccagatcggcgtctacttggaaccgacttcggccttcctgatcgaactcggtctgctgacgccggagatgaccgcgcccgaacaggccgattccggggccgaccgcgagcgctag

SEQ ID NO: 5687 - DNA, 1635 bp, Methylobacterium sp.
atgcgacgcgacgagggtgacgggcgcacggtctccgatggcatccagcacgagcgctcgccgatgaggcgccgcgaggtcctcgccgccctggccgccgccgcggtcgcgcggcccgccgtcgcgcagcccgccaaggttctgcgcttcatcccggaaagcgacgtcgcggtgatcgacccgatctggacgacggcgaccgtgacgcgcaaccacggctacctcgttttcgacaccctctacggccagaccgcgggctacgagttccagccgcagatggtcgagggccacgccgtcgaggcggatggccgcctctggcgcctgaccctgcgcgagggcctgcgcttccacgacggcgcgccggtgctggcgcgcgacgcggtggcgagcgtgcgccgcttcgccgcccgcgacgccttcggccgggcgctgatcgacgccaccgacgaactcgcggcgacctccgaccgcgtcgtgcagttccgcctcaagcggccgttcccgctgctgcccgcggctctgggcaagaccggcacctcgatgccctgcatcatgccggagcgcctggcgaagaccgacccgaacacgcaggtcaccgagatggtcggctcgggcccgttccgcttcaaggcggacgagcgcgtcccgggggcgctcaccgtctacgagcgcttcgacggctacgtgccccgcccggacggcgcggcgagcttcaccgccggaccgaagcgggcccatttcgagcggatcgagtggcggatcgtgcccgacgcctccaccgccgcgagcgcgctggcggccggcgaggtcgactggtggcagaacccgacgccggatctgcaggcgctgctcaggagcagatcggggatccggctggaggtgctcgatccggccggcggcatcggctgcctgcgcttcaaccacctgcatccgcccttcgacaatcccgcgatcctgcgggcgctgctcggcgccatcgaccagaccgagttcatgagcgcggtcgcgggcgacgagcgcgccctgtggaaggaccatgtcggcgtcttcagccccgaggcgccgatggcgacgcgcgcgggcaccgacgggctggtcggcccccgcgactacgccgcggtcaggcgcgccctggcggaggccggctaccggggcgagcgcgtcgtcatgctcgacccgaccgattacccggccacccatcccctggccctcctcgcggccgaagccttccagaaatgcgggctcgccgtggacctcgtcgcgatggactgggggaccctggtgcagcgccgggcgagccgccagcccccggacaagggcggctggagcaccttcgtcacctacctgaacggcaccaacaacttcgatcccgccggccagctcggcatccgcggcaacggcgaccaggcctggttcggatggccccgcgcgccccgtctcgaggagctgcgcgccgcgtggttcaccgcgcccgattctgcggcgcagaaggcgatctgcgccgagatccagcgacagttcttcatcgacgtgccgtacctgccgctcggcgcctattacgaggcgacagcctatcggggcctgacgggcgtgcgcaacggcttcccgcaattctacgatgtcaggccggcctag

SEQ ID NO: 5688 - DNA, 1182 bp, Methylobacterium sp.
atgcggactgcgccagccttctcctcccgccacctcgaccgcctcggcgaccgcctgacggccgatgtcgacagcggcgcgatcgccggggccgacatgctcgtcggcggcgcggacggggcgatctggcgacgcaccgtcggctaccgcgaccgcgtcgcgcacgcgcccctcgggcccgacgcgctctggcgcatctactccatgaccaaggttgtcgtctccgccgctaccatggtgctcgccgagcgcggcgcactgcgcctcgatcagcccgtggcggcattcattcccgccttcgagcacctgtcggtgcttgatccggacggcggcctcaggcccgccagggccaggccgaccgttcaggatctcctgcgccacaccgccgggatcgcctacggctatctcggcgacgggccggcgcggcgcgcctacgcggccgacggcctgctcgccgaggatctcgacaacgcggcgttcgccgaccggatcgcccgcctgccgctggagcacgagcccggcacggtgtggcactactcgcacgccaccgacgtgctcggccgcgtcctggagatctcgggcggcgcggatcttcagcgggtcctcgacgcgaccgtgctcgagccgctcggcatggccgacaccctgttccagatctcggccgcgatgggatcacgcgtcgcgcagccgctgccgcaagcaccggggcagcgccctgtctttcacgatcccgcgcagccgcggcgcggccagaggggcaatggcggcctcgtatcgagcacggcggactgcgcccgcttcctgcgcatgcttctcgccggcggcagtctcgacggcgcgcgcgtcctggcgccggccagcgtgcggctcatgacctcggatcatctcgggccggcgatcgcgaaggccgcctactatccgccggggccgggctacggcttcgggctcggtgtggcggtccgcctcgcggcgggagaggcgccgttccccggcaatgtcggcgactggttctggagcggcgtcggaggcacatacttctgggttgaccctgtagaggggttcttcgcgctcctgatgatgcagacctcctcggccgaccagcggcagcactaccgcacgctgacccgcaccatggtctacgccgccctggaggaccgtcgactgtccgagacggccccctga

SEQ ID NO: 5689 - DNA, 255 bp, Methylobacterium sp.
atgcctcagaatgtcgaatactggatcacggaccgaccggacggccgcttcgacgttgtggtcaggctcgagtccggaaaaatctttcgccgccgcgggtgtgtctcgcggaccgaggccgatacgtggatcgagggattgcgaatgctgatggcggcgatcggcgcgcccgtatcggctgccgacgtgacgtctgacgacccatcgcccctcggatctcagccggtggacggtgcggatcactccacctcctga

SEQ ID NO: 5690 - DNA, 390 bp, Methylobacterium sp.
atgtcgcaccccgtggactggaacgcgttcgccgacgcgtggtgcgccgcctggaacgcgcacgatgtcgagcgggtgctggcccatttccacgacgacgccgtgttcacctcgccgggtgccgcgcggatcgtccccgcttcgggcggaacggtgcggggcaaggatgcgctgcgcgcctactggacggaggccctgcggcggatcccggacctccacttcgcggtggagcaggtcttcgcgggcatcgacacgctggtgatccagtatcgcaaccagaagggtgtgagcgtcagcgaggtgctcgtcttcgaggacggccgcgtgcgggcggggcacggcacctacccgatcggcgtcgacaaccccgtcggtgccgcggcgggctag

SEQ ID NO: 5691 - DNA, 693 bp, Methylobacterium sp.
atgaagtcagaaaaaataacctggcgggcatccgggtcccgcgagcgcctgtacgacgacgcttgcggcacggccctcgcgctggagttcatcggcgagcgctggtcgctgctgatcatgcgcgagctggtctacggcccccggcggttcggcgagatccgggcgaacctcccggggatcagcgcgaacgtgctgacgcagcggctggagagcctgggagcggcgggtatcgtcctgcgttaccggctgccgtcgccggccaacgtgcaggtctacgatctcaccgactggggccgcgaggccgcgcccctgatgcgcgacctgggccgctgggccgcccgctcaccgcggcacgacccgagcctgttcatgtcggcggcgtcggccatgatgtcgcttcaggccctggtcgaccgcgggcgggcggcggcgctgtcggcgacggtcgcgttccacttccccggcgaggatttcgtcgcgacggtggccggcggcgagatccgcgtccgccggggcgtcgcggaggcacccgacctcgctttcacaggcgacacgatggcgctgcgccgcacgatctacggcaaggcgcccctggaccgggacggcgccggcggcacgctcgccgtcgcggggtcggtcgacttggcgcgatctttcatcgacctcttcaccctgccggtcaaagcgggctga

SEQ ID NO: 5692 - DNA, 213 bp, Methylobacterium sp.
atggacgggagcgacagcgcggggccgaccatgtacgacctcatccacaccctccgcctctggctgtggcgccgccaagtgcgggccatggcgcgggagtgccggatgtccgggaccagcgacggcgactggatcgccgccaccgtcgcggcctccgcgacgagctcgggtccaggcgcgccggtctcgtacgtgagcggcaccggcctgtag

SEQ ID NO: 5693 - DNA, 276 bp, Methylobacterium sp.
atgcccacactcggcctcaagctcccgctccggatctgcgtcctcgagaacgccgcctgcgtcgaggatgccggcggccggcgcaccggctacgtctactgggacgagggccgttcgggaggcggtgacaggcccttcacccgcgccgaggccatcgagcaggtccggatcatcgcgggcgcctgggccggcgccctggtccacagcggcaccctcgacaccggcccggcgcccgagccgggtgccgctgccgccgagccgtctccggaaggctga

SEQ ID NO: 5694 - DNA, 255 bp, Methylobacterium sp.
atgaggatcctgacccgtacgacgctgctcgccgccgtcctcgccggcgcggcggggaccgctcacgccgccgagggccagggcaaggccggcgggcgccaggatgccggcgcgcccacgaccagcatgggcgcgggcggcctcagcggcaccggctccacccaggagggcgcccgcacgggcccggtcgagagcaaggggcagccgggcggcgcgaagccgccctccgccccgaaggccgggacgggccgctga

SEQ ID NO: 5695 - DNA, 1104 bp, Methylobacterium sp.
atgacccgcctgcgcctcatcgccgacgatctcaccggcaccctcgacacggccgcgggcttcaccggcctgtgcgggtcgatcccggtggcgtggccggagatcctggcgggggacggatccggctgcttggcgatcgattccggcacccgggaaggctcggccgcggaggccgcccggatcgtcggcgccctcgcgcccaggctggacggggccgacatcgccttcaagaaggtcgacagcctgctgcgcggcccctgggcggccgaactcgcggccgtgctgcgcgccggggcctggaagcgctgcgtggtggcgccggccttcccgtatcagggacgccgcacggagggcgggcggcagctcgcccggcacggcgcgggcttcgagccggtctccggcgacatcgccgaggccctgcgggcggtcgggctgccggcgcgccgggccgacgtctccgacggccccgtggcgggcgtcgccgtctacgacgcggcgagcgacgccgacctcgcccgggtcgcggatctcggcggcgacggaccggtgctctggtgcggcagcggcggcctcgcggcggccctggcgcgcggcgtggcggcgccgggcgacgaccggctcgccggcccggtcctcgggctgttcggctcggaccggcccgagaccgcggcgcagctcgcggccggcggcccccaccacctcgtcctgtcggcgcgccatccggaccatgccggcgcggtggccgcgcgcctcgaccgggacggcgtcgtcctggcgagcctcgcgctgcccgagggcaccgcccgggaggaggccgcggcgcggatcgccgcgaccttcgcgggggtgatcgaccgcgtcccgcggcccggcacgctgctggtggccggcggcgagaccctgaaggcgctgtgcctcgccctctccgtctcgcgcctcgacgtcaccgggcagatcaccccgggcctgccccgctcgacactgcggggcggacgctgggacgggctcgcggtcgtgtccaaatccggcgccttcggaactgagggcgtctggcgcgatctacttcacggcaacggctttccgcgcagcaggagcgacgcgtga

SEQ ID NO: 5696 - DNA, 246 bp, Methylobacterium sp.
atgccggcctatcacctccgacgcaccctcgagcacgcggacggccgctgcggcctcgccttcgccagcgaccgcctggaggcggacgacgcggaggcggcgatccgctgcgcccgcgacctgtgccggaccgccgccaacatgctcctgaccggggcggtgctgaccgattccctcggccggatcctgtggtcgttcaccctggcgctggcccgggagccgctctgcgtccggccgacgagctga

SEQ ID NO: 5697 - DNA, 768 bp, Methylobacterium sp.
atgaccttccgcctgacgcgcctgttcgacctgaccgggcggacggctctggtgacggggggcaactccgggctcgggctggcgctggcccgcgcgctgggcctcgccggggccgggctgatcttgacggcccgccgcgaggccgacctcgcggcggcggccgaggacttgcgggcggaggcggtcgccagcgaggttctgcccgccgatctcgcggagcccgccgcggtcgccgacctcgtcgcgcggctcgacggccggccggtcgacatcctcgtgaacgccgcggggatgaacctgcgccaacccttcgcggccgtgacggccgaggccttcgaccggcacatggccctgcacgtgcgcgcgcccttcctcctgacccaggccctcgcgccggggatggctgaccgcggatacgggcggatcatcaacgtcgcctccctgcaatcctaccgggccttcccggactccgcgccctacggcgccgccaagggcgcggtggtgcagctcacccgcgccgtcgcggaagcgtggtcgacccgcggcgtcacctgcaacgcgatcgcgcccggcttcttcccgacgccgctgacgcaggcggtgttcgccgatgccgagcgcgccgcgcgcaacgccgcccagacggcctgcggccgcaacggcgaactcaccgacctctacggcgcggcggtgttcctcgcctccgaggcctccgcctacgtcaccgggcagacgctgccggtcgacgggggattcaccgccaaatga

SEQ ID NO: 5698 - DNA, 195 bp, Methylobacterium sp.
gtgttcgccggtcggggccagtggcgtgggccggacggacggatcgtccgcgaggccgcccgcatcgtcctcatcgtcaccgaaccgacgcccgaggcggtcgcggccttgcgtgagatccaggaggcctaccggcgccgcttcgcgcagggcgcggtcgggctggtgctgcagcggagctgcgcgctgttctga

SEQ ID NO: 5699 - DNA, 1089 bp, Methylobacterium sp.
atgaacgcggcagagacccgccagttgagcctgtgggagcagagcctgcggcgccccgaggccggagccgaccggccgacgaccaggctcggccccgcgctcgacggccgcatggatgtgtcgttcctccacaagggcttctgcatcgccggcctgccgctgcgccggcccaagaacacgatggagccgtggaaccggcgcgacggtcgcttctcgctgaccgtcgagccggcccggttcgtcctgcccaacgggcgccagatcgaggtgggcgtcccgttcggacccaaggcgcgcctcctctccatgtggctggccacggaggcccgcgatccgcgccggagcgccggcgaccgctggatggagatggggcggatcaccgagtggttgaaggccgtcggtttgccggtcacgggcggcgagcggggctcgatcgggccgaccaaggaccagctcgtccggctgagcttccccatcttcacgatggtcctgaacggcgacgagggcggccacgtgttcaagcgcgagagcctgatcgaggggggcgcgttcaaggatgacgacctcgaggtctgggccgccgggggacacagcgccatgcgctggccggaagcgctgatgctcagccagaacgcctacgaccgcttcacacggcactcgatcccggtgccgaccgccaggctgcgccaggtcgcccacaacgccatggcgatcgatatcctcgtgtacctctgctaccggctgccgctgctctcgcgcggggagagcgaattgctgacctggcgcgatctgatggcgcagttcggatcctcggaattcgcctcccgcttcaagcaggccttctcggaatcgatcaagcgcaccctcgacgcgtacccggaagccaacgtcgcgatgacggccgagggtctggtgctgcggcactcggacccggcggagctgcggcgcgccttcgtcgccgtcgcgggggggccgacccgtcgcgcccgtgccgcgccgcgggcgcgcaaggctgcgcgggtcccggatcagatgggcccctgcgagagcgcggacctgctgacgccggccggtgccgcgcgcggctga

SEQ ID NO: 5700 - DNA, 189 bp, Methylobacterium sp.
atgactcgaatcctgacatccgtcctcgacggcgccgcgtgggtcgccgacgcgctcgacgatatcctcgtcgaggcggctctcggcttcggcgccgccgtaccgctgatcgccgatccgtccggcgatccgccaaccggcgcaaccaccggcacatccgagaccggcgccccgccgatccggacttga

SEQ ID NO: 5701 - DNA, 300 bp, Methylobacterium sp.
atgggcgaggccgtctccgggacctacaccgccgccgatcccggcttcgcgcagacgcatcgaagccgcatcctggtcggcacggccgagggcgacatcatcggcttcgtgaccagcacgtcgtcgccccaggagatcacggcctggaccgggcgcctcgtccggaccgacgagaagacggccgaggcgatccacgcggtcttccacgccgtcgaacggtcctcgcagccgaaggccgtgaccggccacgtcgcgctcgagacgaccatcttctcgaaggtcgagaacgcctgttcgtga

SEQ ID NO: 5702 - DNA, 345 bp, Methylobacterium sp.
atgaagatgatctcgacgaagatgttgatggtggcgggtctcgcggccgcgacgttggcctgtggtgccgccagtgccgacgcccgcgggtttggccgtggcggtttcggacacggcggcttcggccatcacggaggcttcggccatcgcgggttcgggcacggaggcttcaggcacggcgggttcggtcaccatcgccatttctaccaccgtggattccgtcggcgcttcggcgggttcagctggggctatcccgcgaacagcctcttcctcggcccgcaattcggcgactgccgcgcgatctacaatcctgtcttcttcggccatgagcgcgtgtgcggctag

SEQ ID NO: 5703 - DNA, 303 bp, Methylobacterium sp.
atgaggggcgtgtgccccctcctacggagccgtgagcccgcgatggccgacctcatcgatttccccgggaaacgccgaggcgccggctctgcctaccggctgcaccggttcggcgcggacggcagcgaccgcggcacggtcctcatccgagcccgcgacgacgcggaggccaggcatcaggccgacaggctggccgaaggattgttggccgagctgtggtccggggaccggctcctggatcacttcgcgccggccgaccacccggttgcgggctgcatcggtcccctgcgcgacgggccctga

SEQ ID NO: 5704 - DNA, 843 bp, Methylobacterium sp.
atgaccctcaagccaaagctcaaggcgacgacgtcgcacaccccggttcgatcaccctccgtcatcatcgtggccaataggcgtggcggctgcggcaagaccacgacgacgatcacgatcgtcgatcttctcgccctgaacggcatcgaggcggtcgtcttccaagtcgacgatcagccccagctcgccaagctcctcgggcggcgtgtcgtcagcctcatgccgcggctcggcgatgccagcctggctcgggcgctgagttcgccgttctccccactgtacgccgcctgccaagccgccaccgagagcggcggcgtggtggtggtcgacgtcggcgccaacatggtccagctgttcgtgcgctggctgcgcgatgtcgccctgcaggaggatctcgacgcctggaagatgccggccgtgctgatggtcccggcggtgcgcgagagcgccgccgtcgagggtgcgatcgagaccctggccgacctgcgcaaggtcctgcccggggccgtgcccgtcttcatcgagaaccagcgcgacgagcccttcgcctccgtcaagccggcctccgatctcggcgcgctcctgcgcgagcgcctccagcccgcgctcgccggctgcgtgcggctgaccatgccggtgatcgagggtgaggcctggcaagtgttcgaggccgtgggcctgcgcttcctcaaggtgctggcgctgagcccgcccgaggtcgccgcgcgcatcgaggaggacgtcgccgacgccaagatcatgcgcagctacgtcgcgcgctacctgcgggcgatgcacgccgagtgcgcgaaggtgctccacctgccggagggcggggcatga

SEQ ID NO: 5705 - DNA, 1728 bp, Methylobacterium sp.
atgtcgatccgcaaccaagccctgctcagcgcgaatccgatccgtgcctggatctgggcgcttctcgtctggctcttcaccggtctcgccctggccgtcgtcctgttcgatgtcgtgccgatggcggcgggatccgcggggcatgggctcgggctcggcggcgccgtgcatgccctgccggatctgttgatgatcctgctcgggcgcgcgacggcaccggccgctaccggctccactcgaccggacgtcgatctcacgactctgctgatggccgcccgttacctcatcgtgctctgcctaccgctcggcctcggcttggccacgtaccggcacgccgtgtcgcggcagccgcggcgactgaacgcgacattcatcggcggcgcgacctacgcggagaagagggacgcgccgcggctggccgccagcctcctcgccgaagacatgcgcgtggccggacccggcatcgcgctctgcccagacctgcgcctgccgcgcaatcgcgagatccagagcatcctggtggtcggccgcccgcgctacggcaagagcaccgccctccagttcatgctcgacggcatccttgcacgccccggtgacaagctcgtcgtcttcgacagcaagggcgatgtcgcggccggatggccgagcgccgacgtcatcttcctcgccccgcacgacacacgctcgtgggcctgggcggtgggccgggacgtcctcggcgagaccggcgcgcgtgagctcgccgccgccctgatcgcggtctcggaccgcgagccgaattggacactcggcggccaggagatccttgtcgccgcgatccgcaagcttcaggccgagcacgacaccggctggtcctgggcggacctcgacgagatcctcgacctgcccgacaaggcactgaggaaggtcgccctcgaccaccatcgtccggccctgcgctacctgacgctcgatccggacacggagtgtttcgaccgcaccgcggcgagctacatctcgactgcgatggcgccgatcaatcgcctggtgcggccgctcgcccaagcctggtcggagatccaaccgcagtatcagatctccctgcgagcgtggctgctggatgacacgccgcagcgtcggacactcatcctccaggccgcgtcgcacctcccatcgatctcgtcgacctggatcaccgcggccctggagatgatggctcggttctgcgtcggccccgccctggccgacagcaccgagcgcaggctgtggtacatcctcgacgagttctcgaccgtcccgaagatttcggctcttccagccctgctggcacagggtccctccaagggcgtctgcgtcatcctcgcatgtcaaaatctcgaacttgtcgaggacaattatggatcgatactgacacaagcgatcatccagaacatggatatccaggtcctgttccgcctcaacgcaggtccgaccgcgcagtacctgacgcagaccggcatccagaagacggagctgcagcgctacggtcagccggcggcaaaggacgcggctgacgaggacgcaaacaagccggagaaagtcagcctcgtcacgccccacgatctggcgacgctgccgcgtggagaggcttacgtcacggtcgagggcagcatcctgcgtctgcgctggccgaagtcgacctggatcgagcaccgcgccgggatgatccaggcgccgtgggtcaccgcgctgggcacgagcacgccctga

SEQ ID NO: 5706 - DNA, 1191 bp, Methylobacterium sp.
gtgccgcgccggtcggccggccggcggcgtgccggcgcgcccgcggggatcctgtccctcgtcctgttcctctccctgtgttccgcggccgccgcgccgctcgccgcggagcccgtccgggccgagacccgggaggcggcgcccgcgctccgcacgaccgagcccgagacgtggcgggtcgcgacgcatccggtgccgcccctggtcatggacgaggacggccggctgcgcgggttcagcatcgatctctggaacgccatcgcgcgggagctcggcgtccggacggcgtacctgcgcgtcgacgacctgccggcgctgttcgcggcggtctcggacgggcgcgcggacctcgccatcgcggcggtgtcgatcaccgcggagcgcgagcggcggttcgacttctccgtcacgatgctggagaccggcctgcgcatcgccgtccggtcggagccggacgcgaccggctccgccaccgcgcgggccctccgggccctcctgagcgacgccgccttcctgcaggtcctgctggggctcgccgccctgatcctggcggtggcggccctggtctggtggctcgagcggcgccaccccggcggcatggcggcgcgctcgggaccggcgcgcggcttcgcccacgtcgtctggtgggccctgagcagcctcgccgcccaggcggaggagatgccgcgcagcccgctggcgcgggccgtcaccgtgctctggctgttcacctgcatcgccctggtggcgtggttcaccgcgggcctgaccagcacggcgaccgtggagcgcctgcgcggcgcgatcaacggccagcaggacctgccgggcaagcgggtgggcacggtcgccaacaccacctcggtcgcctacctggcggaccatttcgccacgccggtgggtttcgcgaccctggaggaggcctgcgcggcgctccaggccggcacggtcgcggcggtggtctacgatgcccccgcgctcagctactacgcgacccggcccggccacgaggccctgcgcctggtcgggacggccttcaaccggcaatcctacggcatcctgttcccggccagcgatccccggcgcaagcgcgtgaaccaggccctgctgggcctgcgggaggacggccgctacgacgagatctacggccgctggttcggctccgagagcggcgagtcccagggtcgctga

SEQ ID NO: 5707 - DNA, 243 bp, Methylobacterium sp.
atgcgcgcgaagatcctcgtcctgtccttcggcctgatctgcgccggcgcgggacccgtctgggccgcccggccggtcctcggccggctgcccagcgccgtcgcgcaggccacgcccgggaccggaagcgcgccgatcctgagcgccgggatcgcgggggcgcccgccctgaccgtgctcgcccgccgcaagccggcccggcgcccgcgcggcgcgcgcctcggcagcctccggccgctctga

SEQ ID NO: 5708 - DNA, 177 bp, Methylobacterium sp.
atgcggccctcctcacgcgcgttcctcggttgcctggtgctggcgctgctgatcggcggcctcggactcggcctgcgccgcgccgtggccgtcaccccggtcgatcccgcgttccgggcggtgctgcgcgcttatgcggcaccggacgcgtccggcgggccccagcaacacgagtga

SEQ ID NO: 5709 - DNA, 1014 bp, Methylobacterium sp.
atgaccatcagggacgccctgctcgccggcccgctcggcttcggcgccgcaccgctcggcaacatgttccgcgacatccccgaccacgaggcggaagccacggtcgacgcggcgtggcaggccggcacgcgctacttcgacaccgcgcccttctacgggagcggcctgtctgagatcaggctcggcaaggccctgtcgaagtatccgcgcgatgcgtaccgcctcagcaccaaggtgggccgcctcatcctcgacgaggtcgagaccggcgctcgcgaccagggcgagaagggcgagatcttcaggtacgggcgcccgaacaaggtcgtctacgactacacggccgacggcgccaagcgctccatcgaggacagcctgaggcgcatgggcgtcgaccggctcgacttcgtgtgggtccacgacatcgccagggattttcacggcgacaagtggatcgggctgttcgagcaggcgcacaccggggcctttcccgccctcgaccgtctgcgcgacgagggcgtgatcgaggcctggggcctcggggtgaacaacgtcgagccggtggagcttctgctctcgctcgacgaggtgcgcccgaacggcaccctgctcgcgggccgctacacgctcctcgaccatggaagggcgcttgagcgcctgatgccggccgcggtcgagaggaaggtcgagatcgtcatcggcggtccgtacagctcgggcgtgctcgcgggcggtgcgcacttcgagtacggctcggtgccgcccgagatcgccgccaaggtcgagaccatcaaggcgctgtgcggcaagcacggcgtgccgatcaaggcggcggcgctccacttctcgctcgcccatcccgcctcggccgcggtcatccccggggcgagccgcccggagcggatcgcggaggaccacgccgccatcggcttcgaggtgtccggggatttctggcgcgacctgcgccggagcggggtcgtggcgcccgacgcgcccctcccgtccggtcagtag

SEQ ID NO: 5710 - DNA, 150 bp, Methylobacterium sp.
gtgcccgagtacgacatcaagatcgtcgctccgcgagatcggaaagctccggacgcaaagcgcgagactccgcccaagcgcaagctcgactgggatcgcgccatgcgcgaggccgcggaagcggaactctcgatccagtcgcacgactga

SEQ ID NO: 5711 - DNA, 294 bp, Methylobacterium sp.
ttgaacgagcccgaacagggcagcgcggaggccgtctacatctcggccatggtcggcgagatgatgcggcgcgtcctggaggacgctctcgccgaactcgcgagaacccgcggtgcggccttcctggagatcttcgtggcgcgcgagctggctcgctgcgccgagctgttccgcgagcggcccggcgacacgccggagacgacggacatgttgcgggcctggttcgccatggagggcggcgaggcgctgcgcgccgtggtcgatcgcgccagcgtcgaggcggcgcgcgattga

SEQ ID NO: 5712 - DNA, 222 bp, Methylobacterium sp.
ttgcaggcgttcgacgagcaattggcgcatgaactcgtccgcggcctcgtacagtcggccgtcgcgcgcggtctcgatccagccatccggctcgatcagtttcggacgttgcagcaagcggccgtcgctctatcgcgagacgctgccgtagttcgaaccagcgagcagatcgtccgggcgatcgactgcgctctcgaggaactgaccgcggtgagatcgtaa

SEQ ID NO: 5713 - DNA, 2073 bp, Methylobacterium sp.
atggaggcgtactatggtgcggaccgggcgctgctcggcttccagtgccgcttcgaccgggcggacggcagcaagacattccagccccttaccctgttccgcgagacggccactggcgcgctcaagtggaggtggaagggttggccgggtcctcggcccctctacggcctcgaccgtctcgccgcgaggcccgaggcgcccgtgctgttgtgcgagggcgagaaggcggccgacgcggccggcgagctggcgcccgacttcgtcgcgatcacgagcccgaatgggagcaagtcggcgggtaaggccgattggagcccgctcaagggacggcgagtcgttatttggcgcgatgctgacctggccggcttggaatacgctgaggccgcggcggccctgatcctcgcagccggcgcggcatcggtctcgctcatcgatccgcccggtgaggcgccgcagggatgggatgcggccgacgccatcgccgagggctggcccaccgttcgcgtcctgagcctcgtggcgagcgcgcggccggtcgggaggctcgcggagcgtcccgcgtccggcgggcgtctggcgccaactcccgcgccagtagaggcgcctccggccgaggacgtgggcaggcggggtccggggcgcccaccctggcacgacacccttctcgggctgacggaggattacatcctctggcacacgccgaaaaagcacgcctatgcctcgatccctcgacctgaaggccaccgagagaactggcggctcaacggcgaggcgttcgctcgggagctgagcctcaaggcattcgaggagacgaaccggatcccgtccaaggcggcgatcgaggagaccgtgcgcatccttgaggcgaaagccatcgcctacggcccgtgtcggaaggaatggctccgcgtcggcgagcgcgacggcaagctgtacgtcgacctcgggtgccctcagtggcgcgcggtggaaatcagcccgcgtgggcctgagatcctgcaaagccacgatctcccgttcgtgcggcccgaggggatgcaggcgctcccggagcccgtgtttggcgaggagaacgccattggcgacctgcgggccttcgtgaatgcgaacagcgacgaggactttcagctgatcgtcgcgtgggtcctgggcgcactgcgcgcggctaaggagtacccgctcctcatcctcaacggcgaacagggaaccggcaagtcgaccttgagccgcctcctgcggtctatcgtcgacccgaacgcggctggcatgctgtcggctccgaaagaggatcgggacctcttcgtcttggcgcagcatgcgcacctggtcgccctcgacaacctgtcgaaggtcgagaactggatgtcggatagcctctgcatcctggcgacgggcggagccctggcgtcccgctcgatgtacacggacgccggcctgacgatccttgaggcgacccggcccgtcattctcaacgggatcccgaccctcgccgatcgccccgaccttgcccaacgctccatcaccgtgcggttgaagccggttccggccgaggagcggcggacgtcgaccgacattgagcgcgagtgggaggccgccgcgccgcgcatcctcgggacgttcctcgaagctctcgcccgtgggctacaggacgtcgataaggtcgccctcgataagctgccgcgcatggccgggttcgcccgcttcatggttgcggcggcccccggcctcggtcccgacttcgacggccaagggctgttcaatgcctacctcgccaaccaatccgagctggcaagctctgcattcgagaacgatccggtagccactgccatcgtggcgctgatgcaggccgcctattccggtgagtggcaggggacgccgacagagctgttgcaggccctctcggatccggccgtgacgcccgaacgggtcacaaacagttgggcatggccgaagaaggcgcagaccctcggcaacgcggtcgagcgcattgcccctgccctgcgcgaccgtgggatcgacgtgcgcaagcggcattcgggcaagacgttctacgagatccggtcccggtcctga

SEQ ID NO: 5714 - DNA, 228 bp, Methylobacterium sp.
atgttggacggcgacgcctttgcccacgagatcgcggcgctcctgatcgccgacatcaagacctccggcgcgcgcacgcgcggcgagatcgaggaggcctgccggatctccctcgagagcctgctcggcggcaccgcggtgccgccgcagatcgccgtgctgatgccgatcggcctggagcggtggccgcgggtggtcgtgaagggacggcccctgcccgacgtgtag

SEQ ID NO: 5715 - DNA, 99 bp, Methylobacterium sp.
atgctgcgcaagctcctgacggccttcatcgtgccgaagctcatcgcctatctcgggcgccgctatgaccggcgccggggcaccggccgcccctactga

SEQ ID NO: 5716 - DNA, 693 bp, Methylobacterium sp.
ttgcccgcgcccccgtcgcgcttcgacgccgtcctcctcgacctcgacggcaccctcgtcgacagcctggccgatctccggacggccctgaacgccaccctggcgcgggagggtctgccgccggtcgggaccgccgcgatgcgggccatggtgggcgacggcgcggtggcgctgctgcggcgcgccctgcgggcctcgggcggcgatccggagcgggcgccggacctgctcccggccttcctggccgtgtacgagccgctcgcggccgccggcaccgccctgttccccaacgccgccgcggcggtccgcgacctccgggcggcgggctacgcgctggcgatcgtcaccaacaagccggcccgcgccaccggcctgatcctcgacgcggtggggctggcgccgctgatcgacacggtcgtgggcggcgacacgctgcccgagcgcaagcccgatcccgcgccgctgcgggaggccttgcgtcgcctgcgggtcgagcccgggcgggccgtcatggtcggcgacatgcaccacgacatcgcggccgcccgcgccgccggcaccgccgccatcctggcccgctacggctacgggcgcccggacgacgcgcggaccgccgacgccgtcctcgacgacatcggcggcctgcgggcgatgatcggggcgctgcccgcgggcggcgccccggcctcctag

SEQ ID NO: 5717 - DNA, 1572 bp, Methylobacterium sp.
atgaggcgacgcaccttcctggccgcgggggccgcggccctggcggccccctccgtcgggcgggcgcagggcgcccgggtcctgcgcatggtcccccaggcgaacgtcacctccatcgacccgatctggacgacggcgatcgtcacccgcaaccacgcctacgtgatctacgacacgctgttcggcctcgacgccgacctgcggccgcagccgcagatggcggccggcctcaaggtcgagcaggacgggcgccgggtgacgatccccctgcgcgcgggcctgcgcttccacgacggcacgccggtcctggcgcgcgactgcgtcgccagcatccggcgctgggcggcgcgcaacggcttcggccagaccctgatggccgccaccgacgaactcgcccacgacggcgacaccgacatcgtgttccgcctgaaggcgccgttcccgctcctgccgcaggcgctggcgagcgtcagccagccggccttcgtcatgcccgagcgggtctcccagaccgacccgtacaagcagatcaccgacgccaccggctccgggccgttccgctggaaggccgacgagttcaactcgggcagcctgatggtctacgagcgccaccccggctacgtgccggcgcccggcacgccgagcctgacggccggcggcaaggtcgcccatttcgaccggatcgagtggcggatcatcgccgacggcgccaccgcggcggcggccctgcagaacggcgagatcgactggtacgagcagccgccgcccgagctccagcagctgctcgcccgcaaccgcgacatcgtggtggagggcctcgaccggctcaccaacccggcgatcctgcggatgaaccacctgcagccgcccttcgacgacgtcgcggtgcgccgggcggtgctgccggcgatcgtccagagcgacttcatggcggcgatcgtcggcgacgatcccgcggcctacgacgaccgctgcgggatcttcacgccgggcacgccgatggcgagccaggccggcctggaggcgctcaccgggccgcgcagcctggaggcggcccgggcggcgctcagggcctcgggctacgacggcgcgaagatccggctgatcggccccacggacctgctggcgcccgcggcgctgacccaggtcgcggccgacctgctcccccggatcggcttcaacgtcgatctggccctgagcgactggggcacggtgatccagcggcgcgtctcccgcgagcccgtcgagaagggcggctggtcggtgctgctcaccaccttctcgtccttcgacaacgccgaccccgccgccctgcagccgctccgggccagcgggccgaacgcgtggttcggctggccgtcggtgccgcggctggaggcgctgcggaccgcgtggttcgcggcctccgacgcggaggcgcgccgggcgatctgcgccgacatgcagcggatcgccctcgaggaggtcgtgttcgtgccggtcggctcctaccgctcgatgacgtcctaccggcgcgacctcacgggccgcctcccgggcttcccgatcctctggaacctccggcgcgcctga

SEQ ID NO: 5718 - DNA, 2484 bp, Methylobacterium sp.
atgaccggcgcggcgatgaccggggcgccggacacccccgcggcggcggcgacccgggcgctgacccccgagcagcgcgcctgcctcgacgcggccggcgccgtgccgaacctcgtcgccgagatcgacctgcccgggccggtcgacgcggaccgcctccgccgcggcctcgccgcggtcgccgcccgccacgacgccctgcgcaccgccttcgtgcgcgaacagggcttccgcggcctgcgccaggccgaggccgctgcgcccgcgatcccgctcgataccggcgcgcggcagggagacgtcgggaccgtcggcctcgtgccagagcgcggccagaccctcgcggccgtcctcctgccgggcgcgacgccgcggctccgcctcgtcgccagcgctctggcggtcgatgccggcagcctcgaccgcgtcctgtcggaagtcgcggccgtctgcgcggccgacgcggcgcccggcgccgatcccgaggccgcgacctacgcccagtacgcggcgtggcgcgaggcggtcgccgccgacgacgcggacggcgagggccaagcctactggcgggaccatctcggcgcgggcgcggcgcccctccggctgccctatcgccgcggggtggccgccgacgcggtggaggagccggccgccgcgacccggctgagtcgggccgtcgacgccgccgtcacggacgccttcgcgcgggcgctggcccggccggacctcgccgcggccggcgccgaggccgtgctccaggccgcgtggtggctgctcgtggcgcgcctcgccgagcggacggagatcctcggcggctgggcgcacgattgccggcgcgactacgcggttttcgccggcacggtcggtgtcttcaccaagacgctgcccctgcgcctcgccctcccggcggagaccagcgtctcggaggccgccgccggtctcgccgcgcggctcgacgagcaccgcgccttccaggaactctgccccctcgacgcggccggcgacgaccgccgccccgcggtcggcttcgcgctcgcggcccagggggccgcgcaggaccggctcctgccaggacccgccgggttcgagctctgcctggagccggccctcgacgcggaggggcgcctcgccgcgctgaccttgcacgccgacccgcaccgctacgcggtggaggccctggagaccctgctcgatcaggtcgagacgctcctcgcccgcctgcccgcgaaggccgcgacgcccttcgcgacctaccccctcgtcggcgcgcgcgaggaggcgcgcctgcgcgcgttcgggcgcccggccccctgcgccctgccggcggagacccttccggtcctcgtcgcccgccacgcggcggcggcgccggacgcccccgccctcgtcggcgccggccgcaccctgtcgtacgccgcgctggaggatcgcgtcgcgcgcctcggcgcctggttcgccgcgcacggcgtcggtcccgagcgcgtcgtcgccctggacctgccgcgctccgtcgacctagtggtggcgatcctcgcggtctggcgcgcggggggcgcctacctgcccctcgacccggcctggccgcaggcccgccgcgaccgcctgatcgcgctcgcccggcccgcgctgaccgtggcgctctcggccgacaccgcggccggccggcacgccctcggggcgatcctcgacggcctcggtgaggcccggcgccccgccgaggcccgggacccctccgacatggcctgcctactcttcacctccggctcgtccgggacgccgaagggcgtggtgatcgagcatgcccagatccgcgcctacgtggaggccgtcatcgacgccctcgacctgtccggccacgggcgcttcgcgctgacctccacggtggcggccgacctcggcaacaccatgctgttcgcggcgctgcgcctcggcgcctgcctcgtggtcgccgacgaggccgagatggccgacggcccggccttcgcgcgcttcctgcgcgccaacgccgtcgcctgcgcgaaactggtcccgtcccacctcgccgccctcctcgacggcgtcgaggaccccgcgctgcccgccctgctggtgctcggcggcgagccgacgccggccgccctggtccggcggatccgggcggcggcgccggcgacgcggatcgccaaccattacggtcccaccgaggcctgtgtcggcgtgctggtgcatccggacgcggccaccgcgccgccggacgagagcctgccgctgagccgcgtgctcgccggcagcgaggcctacatcctcgacgcggcgggcgcgctcgcgccgaccggcgcggtcggcgtgctccacctcgggggcgcccagatctgccgcggctacctcccgggcacggaggccggcggcacgggcgcgttctcgcccaaccccttcggagcggggcggctctaccgcaccggcgaccgggcccgcctgctgcccggcggccgcctcgtgctcgcc

SEQ ID NO: 5719 - DNA, 1269 bp, Methylobacterium sp.
atggtctcgagaatcgtcgtgatcggcggcggcttcgccggtctgtgggccgccgccgccgccgcgcgcgcccggaccgagttcggcctcgacgaccgcgtcgcggtcacggtgatcgcgccggacccgttccacgtcatccgggtccgctgctacgagaccgatctcagcgccctgcgcgtgcccctcgacgacgttctcggtccgatcggcgtggaacgccgcgaggcgcgcgcgatcgatatcgatcccgcggcgcgcacggtcacggtcgagtccgccgcgtcgtccgccgcgtcgtccggcgtcgtcgagacgctggcgtacgaccgcctcatcctcgccgccggaagtctgctgtggcgccccgagatcccgggaatcgcgagcgccttcgatgtcgacaccttcgcgggggcccaggccctcgcggcgcatctcgatcgcctcggtgacgcgggcgggccggatgaggccggccgctggaccgccgtcgtcatcggcggcggcctggtgggactggagctcgcctgcgagctgcccgcccggctcgccgctgccagggaccgggccggggccacgggtccggtgcggaccattctgatcgaccacgcgcgcgaggtcgggagcgccatgggcgcggcggccctgccggggatccgcgaggccttgcgcgatgccggcgtgacctgcatcggcggtgcgcgggtcggtgccgtcgatcgcgccggggtgacgctggcggacgggacgcacgtcccggcgcggacgagtgtctgcgccaccggcatgcgggcgagcccgctgggcggcacgctcggcctcccccgcgacccgctcgggcgcctgccggtcgacgccttcctggcggtccaggggatcgctggcgtctacgcggccggcgacatcgcctcggctgcggcggacgatgccggtcatcgcacggtgatgtcgtgccagcatgcccggccgatggggcggttcgcgggcttcaacgccgtctgcgatctcgccggccggccggagcggcggctgcgcttcgccgcgcccgactacgtcaccgtgctggatctgggcgcctggggggcggtctacaccgccggctgggatcgcggcacgctggtctcgtcgggcgccgccgcgaaggcgacgaagcggatcatcaacggcacgcgcatctatccgcccctcgaccgcgacgccgcgtccatcctggccgcggccgcgccgatcatccaggccgcgcccgcgacgcaggccgcgcgatga

SEQ ID NO: 5720 - DNA, 1113 bp, Methylobacterium sp.
atgctccggtcggtgtcccgggcgagcccgcgcccggcggccggcctgctgatcctggcctgcggggtcggtctggccggccccgcccgcgccgagcctgcgcccgctccggccacggccgcggccacgccggggacgggggcggccgacgggacgcccgtcccggccgcggtccgcgcgcggcgccaggaggccggcgtcgccgtcgcggccgccaccgtgatggcggcgccgccgccgtccttcttcaacttctccgacactgtggtgagctaccgcttccaggggccctcggcggagcccggcctccgggtccagcgtcccgacggccagttcgtggggcgcgaggtccccaagaccgtcatcaacctgttccacgccaacgcgtgggcctacggcaccaacctgctctccctcgacatcctccggtccggatcccaggacccggccggcaatcaggtccgccggttcgagggcgtcggcgccaccgagttctacctggtctaccggggcgtcctgagcctcaacaaggtcttcgacacgcaggccctggccatccccggcttcgtgaaggatgtcggcctgtcgttcggggccgacgtcaacaccaaggacacgaccttcgactccgagaagcgcgccggaaccttcgggctgagcttcgccttcgacgtgccggccgggttcgtgaacctgaaggtccagggctacaaggagttctcccgcaacggcttcgccggatacgggccggttccgggcttcgactacgcgcacttccgcagcgtcgagttcaagatgacgccggaattcgagatcacctacacgatcccgctgccgttcaccgggctgccgctgtcgctggccggcttcaacacgatcgtgctgcccaaggggcgctacggtcgattcaacgagaacgacacccagctggaattcgtctcccagaccaacctcgtgctcgatgtcgggcagctcgtcgccggcacgcccaaccgggtcgaggtcttcgccgggttccagtactggcacaacaagttcggggccgacccgcggcgcacgctcaacaccgaggagaaggcgctgatcgccggggtggcctaccacctgaaatga

SEQ ID NO: 5721 - DNA, 1032 bp, Methylobacterium sp.
atgggcaaccgacgcgaattcctgaccgccacggccgcgggcctcgccgccgccgccgcggcgccggcccgggccgccgaggagcgcacggcggctccgaagtccacgccggcgggggcgccgcccttcggcatgccccgcgacatggtcctcctcaacatgcgccgcggcgacggctacgccctgggcgtgaagaccaaggacggcgtgctcgacgtcgaggccgccggccgggcgctcgggatgccggtccccgccgacatggacgacctcctgcagaacgggcgcggcccggccctgcgcgccctgatcgacgcggtcgaggccgcccccgacgggcgcttcgtgctggcggaagccggcgtcgcctacgcgccggtggtcacgcggcccgagaagatcatcatgatgggcttcaactaccgccaccacgcggaggagaccggcacgccgatccccaaggacccgccgctgttcaacaagtacaacaacgccctgaaccaccacggcggcacgatcgcgctgccgacccaggcggcgcgggaattcgactacgagaccgagctggtgatggtgttcggccgcgagtgccggaacgtgtccgaggcggacgccctcgattatctcgccggctactgcacgggcaacgatttcagcgcccgggacctccagacgctgacctcgcagttcatgatcggcaagacctcggacgggttcgcgccgctcggcccctacctggtgaccgccgaccgggtgaaggacccgaacaacctcaagctcaagacgctggtcaacggccgggtgcgccaggactggagcaccaacgacatgatcttcaactgccgccagctcatcagcttcgcgtccaaagtgatgacgatcaagccgggagacatcttctacaccggcaccccgcagggggtgatcttcggcgagaagatcccgcgcaaggaccgcgcgtggctgaagcccggcgacgaggtcgtgtccgagctggaagggctcggtgagctgcgcttcaggctggtctga

SEQ ID NO: 5722 - DNA, 324 bp, Methylobacterium sp.
atgcggtccatcctcgccgccaccctgctgctggcgatcgctgtcccggccggggcccagagcctgtcggcatcgctggagccgatcacccccatcgccaatccgggccagctgagcctcggcggcagttccaccaccgggccgttcccgaccgtctcggcgcagaccggcggcctcgtgaatgctggccagctgagcttcggcggtggcggtggcggtggaggtggtggccgcatcggcgcgtcgggcggcctctcggccgggacgacgctcggcaccacgaccgccggttcgggcggggcgggccagctcggcggcctggga

SEQ ID NO: 5723 - DNA, 702 bp, Methylobacterium sp.
accgcgactggcggttccggcgtcaccggcacgaccctcgggaccggcgggacgatcggcgccaccggtgcccgcagcggcctcagcggcgcgtcccgcacgggcctgggctcgacagcggggagcctcctgacatcgaccctcggaacgggcggtctcgggggcgggccgggcctgtcccccggcctgggcaccggcctgggcaccggactctcgggagccggcctcggcgcaggtgtcggcgcaggcgtcggcgcaggtgttggcgcaggcgtcggcgcaggtgtcggcgcgggcctcaacgctgccggaagcctcggctcctcgctcgcgaccggctcgtccggcgtcgcgtcgcccggtctcggcagcggcgtggccgcgtcgggcatcggcgcggcgggcgccaccctgtcctccggcggtctgttcgggctgttcgggctcgggaccggaacggccgcgagcgggacctcggccgtgacggttttcggggcggccggtgccggcacgggcgtcgccgggatcgccgggacgcccgggctgcccgcggacgatcccgcccaggcggcccgcaccctgccgaccggcggcggagcgatcggcggtgccggaatcggcggcgcggcggccgcgccggtccggaccggcgacctctgcggcgggcccttcgccgaagcctgcctcggccaggggttctga

SEQ ID NO: 5724 - DNA, 792 bp, Methylobacterium sp.
atggaaggcatgaaagccctggatcttcgtcagccgcatgagcgggtcacgatcctcctcgtgatctgcctgccaacggaaggcctcattacgggcttcgaggctggaaggtggacgatcgtcggacgcttcgagcagatcgagcacgccaagcggcgccttcgtcgcctaatgcattttttggagcatctcgaggcgcgggcattcatcatccaggagacggttccgcggcagtccagcaaacgcgccccctggcttaccctcgtccgcttcagagagcccgagctctatctggatcagtccgacgccgtggaggcttccgaggaggctctggagagctgggctgcgattgcggactctttcgttgcgccttcggccatgaaagcgaagcccgcgccctcgaaacggaatcccatcgccatcgccgcattgatggcaacagccgtggtggcgctgatcggcataatcgcggctctccaagcgctgagcattaagctgagcaacgccatcccttcggcgttcacccgtgcgggcggcatcacgatgtcaatccccgacgagcaccgtgccggctggtatgtgcgcgtgaagatctatccggacaagtcggtcgagatcatcgatcgcttcccggcctacgcaaggggtaagcattggaaggagggcgacatgacgccggaggaactggcggcggatgtcaagcgcccgttgaccgccgacggcaacctcatggacactccggacccgatccctgcgcggacaggggtcgccgccgccttgcggcagaattga

SEQ ID NO: 5725 - DNA, 222 bp, Methylobacterium sp.
atggcacagtgcatggcacagtcgtcgggccacgaggtcccgacccagacccgcgccgtcgccgagaccggtctcgagcaggcccggacggccttcggaagtgtcgtcggagcggcgcgccgcgcctccgacacggtccgaacgaccccggtgcgagggcaggatgcggcccgggaagcggcggccgcggctcgcgacgccgccgggacggcgtcgccctga

SEQ ID NO: 5726 - DNA, 186 bp, Methylobacterium sp.
atgacgcgcgcgcgcgagaccgcagacccgacgagccgcggaccggacgcgcgcgaggcggacgagcccccggcggagcgcgtcaaggcggagccggccacgatcccgaccgaggatcccgaggtcggcctatcgcagaagggcagcggggaagaggcgatcgtccggcgcgagacggagatctga

SEQ ID NO: 5727 - DNA, 255 bp, Methylobacterium sp.
atggccctgaagaccacctacctcgtgcaaccgttcgagctgcaccggaaccgcctgcggccggcccgtcaggagcccgcgcagagcgagttcggcgcgctcaagaaggcggaggcgctggccgcccgcatgccgggcgcggcggccctcagggtcgtggccgacgacgagaccggggaactcgagggcgtcaccatcctcggccagttcgggaccgttccggacgatttcgccgagagcctgctggggggctga

SEQ ID NO: 5728 - DNA, 144 bp, Methylobacterium sp.
atggattggttcgacctgcccgaagacccccagccgccgtcggccgccgacgagagccggatgcggctctacatcgccgcggggctgatcggcatcggcgccctcggcatggtcggcgggatgctgcacatcctccccgcctga

SEQ ID NO: 5729 - DNA, 261 bp, Methylobacterium sp.
atggccacgcccgagacccaggcgccctaccggctgcagtgcatgatccaccgggaaagcgccggcggcatcatcattcacgacgagcagattcccgggcccctcgtggaggcggcggtcgccgccgccaaggcccgcttcgcggagctgcgcgccggccgcgcgggctcggcggccctgcgggattccgccgggcgggtggtctggtcggcccggcaggacgccgcgacgcccggcaccgggggatcggcaacccggtag

SEQ ID NO: 5730 - DNA, 96 bp, Methylobacterium sp.
atgaccgacacgccggccccgtatctcgcggtggcgttcctctcggcgctgtgcctgctcgtggccgggctgcaggcggagggcctcctgtggtga

SEQ ID NO: 5731 - DNA, 93 bp, Methylobacterium sp.
atggggctggtcgccttcatcgtcttcgtctgtccctggatgggcatcgccggcctgctgtggatgcgggcacagcaggccaagccactctga

SEQ ID NO: 5732 - DNA, 1515 bp, Methylobacterium sp.
atgaagcagcggacgcaggagctccgtgcggtggaacggcccgcgcgcgcagtatcgtccgaggacggccctcgggaggacatcgaccggacaaccgaggcgcacgaggccttcctcaagtcctggaacacctatgtgccgaccatcaggacggcggacgagctgaagcgcgctcgaggtctgtgggacgcgtggcagcatttcctcgccgtgggggcggaggccggcgccctcgacagggccggggaacgcgatctcgccgaccgggtgcggacgacggcgcttcaggccgacgcggaagccgtcgcacgggatatcgacacgctgctgaccgaccacgacgccgcggttgccgagcaactcggagctgtcgacgccgccggctcgacctttcgcccgagcctcgtggccggcttgtccactgctgcgctggctgccctggtcttggtgcaggccaccctgcgcggcgtcgcgcagccgatgacagcgctggcctccgccatgcagcgactggccgtccacgatctcaccgtcgccatcccgccggtaacgggctgcaccgagctcgcagtcatggcggccgcgacgagagctcttcaggaaacgctgcggcaggccgtgcggcgggatgcggaggctgaccagttgcgcgctcagagcgagcggcgccgcaccgtgatcgaacaggcgaccgagcgggtcgagaccaagatcggcggcatggtcgaggctgtgtcttcgtccgccgcggcgctgcgcgtcaccgccgacgacatgggccgggcgatccgcgatcgggcggttcgatcgaccacgatgggcgccgcgctcgcacagacgcgatcgaaggtccggcggtgcgccgtgtccgccgagacgttcggcgcggcggtcgaagaggtcggggcgcaggccgagtccaccgcgaccctggccggaagcgccgccgcggacgcggcccggacgaccgcccgcgttcaggcgctgagcagcgccgtcgaccgcatcggcgacgcggtccgcatcatcgccaagatcgccgcacagacgaacctgctggccctcaatgccgcgatcgaggccgcccgggccggcgacgcgggccgcggcttcgcggtggtcgcttccgaagtgaaggccctggccgcgcagaccagggaggccaccgatctcatcggccagcacgtctccgagatccgtggctcgaccgacgcggcggtgtcggcgatcgcgggcatcacggcgcgggtcgaagacatgagccgcgcggcgaacgccatcgtcgattccgtggagcggcagggtgcgaccgcgcgggagatcgtgacggccttcgcggaggcgaccgacggcaccgagcggttcgacgcggagggtgcgggcgtcgccgagatgcccgaggcggccgagccggcgacgaccgccgtgctgaccgcggccgacgacctgacccaggacgccgcccgtctcggcgaggcgctcgcaggcctcctggagagcctccgtgcggcgtga

SEQ ID NO: 5733 - DNA, 825 bp, Methylobacterium sp.
atgctgagctacctgggtgacaagatcgtcggcctgaccctcgcggtcctgaacgcgctcgcgccgctcgaagtccacgtggacaagggcgtcccctatgccgacgggagcgcgcaccgggccgacatctaccggccggccggcgggaagccgcgtccggtcgccgtgttcctgtacggcggcgggtggcggaccggatcgaaggacgaggttgcctacgtgggcgcggccttcgcgcggcggggcgtcgtcgcagtcatccccgagtaccgccacgtcccggcggcgagcctccagaacatcctcgcggacaacgccgccgccgtcgcctggaccatcgcgcacgcggccgagtacggcggcgatcccgcccgcgtcaccgtcgtggggcattcctcgggggcctgggccgccgcgatgctgggcctcgacgcgacctggctccagcgggccggctcgagtcccgccaagctcgccgggatcgtcgggctggccgggccctacgcgacttcggcgctgaccgatccgctggaccgccgggtgttcgcgggcagcgatccggccctgcagccgatcaaccacgccgcggatccccatccggcgatgctgctggccaccggcgcggcggatctcgacgtcaaccccgccggaaccctggcgctcgaccgggagctgcgcggcttcgacggcagagagacgatgaagatctaccccggtatcgggcacgggcagatcgttcacgcgatgagcttcccgttcagcctccggtactcggtcgcggacgacgtcgcgcgtttcgtcaagggcgcccgtgccggcccgtga

SEQ ID NO: 5734 - DNA, 246 bp, Methylobacterium sp.
atgcgcatcacagtcagggatcaggtgaaggccgccatcatcggcaccatggccgaagcgcagaaggaagggcgctgtccgttggcagcggccgaggctgcctttcccggcacgccgaccgtcgtcttgggcggctgctacggcgagatgctgtcggacgatgaggacgcttggtggaagaggatcgagcacaccatcgatgccgaggtcatccgcaacgctgtcgcctctgcctccgcccagtga

SEQ ID NO: 5735 - DNA, 408 bp, Methylobacterium sp.
atggaccacctgaccgaccaccgttcaaccttcatgctggagaaggtcggcgcgatcgtcgcggcctacgtctcgcgcaacgcgatcgaggtcacggcgctgccggccctgatcgaccaagtgcacacggcgatcgcggtgctccgctgcgcgccgtcggagttcggtggggtcgggctgagccagtcgcaggtcgatgcctcgatccagcaggacggcctgatcagcttcatcgacggccggtcctaccagaccctgaagcgccacctcacggcgcacggcctcacccccgagcggtaccgggccaagtacggcctgccggccgactacccgatggtggccccgggctacgccgcgcggcgctcggagatcgcccgggcgatccagctcggccacaaggcggcctga

SEQ ID NO: 5736 - DNA, 114 bp, Methylobacterium sp.
atgttcgcccagccccacgccctcatcctccgccatcgcgagcgcgtcgccgtgctcatctcctccgcgctgttcctggcgggcgccctgccgctcttctgggcgatcggctga

SEQ ID NO: 5737 - DNA, 273 bp, Methylobacterium sp.
atgacccgaaccctcttccgctccgcgggcctggccctgctgagcctggccgtcccggccaccctcgcggcccaaggcctggcgcccgaccagaccggcacgggcggcggcccggccacgacgatcacggcgccgaacaccaacagcctcggcgtgaccaagccccccggcacgtccctcggcccgggcgaggtgccgccgcgcgccgtgcaggagcacgagcgcgcccggctcaacaagatcgagcgcagcatctgcgacggctgcaactga

SEQ ID NO: 5738 - DNA, 972 bp, Methylobacterium sp.
atgccggcagacatcctcgacgaactcgggccgctgttcctgggcagccgcctcaagcgcctcgccgaccgcttccaggccgacgccgcccggatcctgcgggacgaggggctcggcatccagccggcccagttcccgctcctcgccgccatcgaccgctacggcccgctgaccatcggcgacgccgccgccgccctcggcgtcagccagccggcggccacgcgcacggcggcgagcctcgtcgcgctcggcttgctcgaagaggcgcggtcggacgcggaccttcgccagaaggcgctgtcgctcagcgatgcgggcgaggccctgatggcgcgcgccaaggacgcgctctggccgcgcgtcgacagggccgtcgcgagcctgtgtgccggcctgtcgggccccctgctggaccaggtcgccgcgctggagcgcaggctcgacgccgtcccgttcgcggcccgcatccgccaggacggcgcggccggcgacgccgcgacgggcctgacgatccgggactacaccgacgcgctggcggaccgcttccgcgacatcaacgccgagtggatcgaggcgatgttcgcgctggaggagaacgaccgccggatgctgtccgatccccgcggcgagatcctggaccgcggcgggctcatcctgttcgtcgagtcggcggatctcgggatcgtcggcacctgcgcgctgatgcggacggaggcgggctgctacgagttgaccaagatggccgtgtccgcgcgggcccgaggccgcaaggccggcgagcacctgctgcgggcggtgctggcccgggccgaggccatgacggtcgagacgctctacctgctgaccaacaccaagtgcgcggccgccgtgcacctgtacgagaaggtcgggttccggcacgacccggagatcatggaccggttcggccggcgctatgcccgctgcaacgtggccatgcgctatcccctgtga

SEQ ID NO: 5739 - DNA, 1245 bp, Methylobacterium sp.
atggacatgcaggtcgagaaagcccagggccggcctctgaaaggcatcgaccggaacaaggtgatcgcgcagtcgctgcggcagttcgcgcgcctcccgggcctgcccgacaccaagaagggcgtgcgctcgtaccagagccacgtcaaaagcgacccctggctgccgctcctgttcgtcgtctgcttcgtcctgccgaccctggccgccgggatctactacgggctgatcgcctccgaccgctacgtcaccgaggcgcggttcgcgatccggccgaccatcggcaccgccgacaaggcgacgcccgacacggtcggcacgaatgccggtgtgatcaaggcgaccgtcgcccaggaaacgctcatcgcgcaggagtacatccacagccggcccatggtcgaagcggtcgcggcggaactcccgatccgcgcgtggttcggtcgggacgacatcgacatgttctcccgcttcaacccggagaagccggtcgagaagttcctgcggtactggcgccgccgggtcgacgtcgacgtcgaatcggcctccggcatcatgtcgctgaccgtcgaggccttcgatcccgacgagtcgctcgccatcaccaaggcggtcatggcggatacggagcggatgctgaacgacctcagcctgccgtcccggaaggacgccctcgacgtgagcacgcgcgtcctgaagctcgccgaggagcgggaggccaaggccaacgccgccctgaacgagctgcgcaaccgcgagggcgtgctcgacgtgatcaagtcgaacaccgccaccatcaagtcggtgtcggaactgcgggagacgcgcaccaagctcgccgtccagctggcggtgctccagcgggacctcggcccgcaatcccgcagcatcgtcgacctgaagcagcagatcggcgatctcgacgcgaacatcgcgcgggtccagcagcagctggccggcaccgcgccgaccgagaagcggcgcctctccgacgcgctcacgcggttcgaggatctcgagcacgagcgcgagaacgccgagaagtatcaccgcgacgtgcagctggcctatgaccgggctcgcatcgttgcccagcagcaggtcgtggccctggtgccgatcgtcgagcccatcaaggccgggtcctcgaccgagccgcgccgcatcctgatgacgagcatcatcaccgccggcgccgccgtgctgttcgcggccgcgatgttcacccgccgcatgctcatcacctga

SEQ ID NO: 5740 - DNA, 240 bp, Methylobacterium sp.
atgtacaagctcccgcccggcagcctctaccggctccgcaccctcgcgcagaccggcgcccgcttctatcaggtcagcggctacatgcggcgcatggaggtcctgggactggttctcgcgacgggtcggacggatccggacgcgaagaccgtcgagtaccgcatcaccgaagccggccgagccgaactcgaggagcgtcacggtccggcctggcccggctcggccgaggacgaggcctga

SEQ ID NO: 5741 - DNA, 378 bp, Methylobacterium sp.
atggattcgggcgaggccctttcggatcgacgtgtcgggccggccctgcgggccgtcgtcgccctgctggcgctctacgccctgctgctccaggcctttctcggcggcctgatgccgttgccggcagcgaccgacggcctctgcgcgcagcatgccgacgcgtccgctccatcgggcacgcccgtcccccacgaccacggcgattgctgcacggcggcccaggccaccggcccggcgctcccgccgcgccccgcgtccgtcggcttccgatgggccgcgaccgcggacctgcggccggcctggcccctcaccgggagcgtcggcgcccgcgcgccgcccggcaccatcgcgtccccgagggggccgccgaccgcctga

SEQ ID NO: 5742 - DNA, 1551 bp, Methylobacterium sp.
atgctcctgcgcgcgaccgctacagcgatcagagctcacctggacgatcgcgcctcgcgcctgatcgcggcggccggcacatgcctgctgctctgcctcgcgctgctcggcgtctatctctgcctggacctgcgggacgtcgcttggcacaacgcccgccgcaacgccgggaatctcctggcggtgatcgaggagggcgtcggccacagcctgcgggtctacgacctctcgctgcagaactccgcacggctggcgagccgcgccgacatcacggccctggacccggatattcggcgcctggcgctgttcgacacggcggtggcgggctccggcctcggtccgatcgccgtcacggacgcggccggcgacgtccggctgacgagcgatcccggcgtgcggacccggcccaacatgagcgcgctgccggaattcgagttccatcggtcgaatcccgaaggcggcctgatcctgtccgggccgaccgtatccctcatcacgggtgagcccatcatccgcatgacccggcggatccggacgcccgacggctcattcgccgggatcgtctcgggatcgatcaggctcgcgcatttccaggcgctgttcgagcgcctgcacttcgacgacggcatcgctctgaacgtctttcatcgggacggcacgctgctgatccgggcgccggcccggccggcggcgctcggccagaacatcagcgcgagccccggctacaagatgtaccgggccaagccgcgcggcgagttccaggggcgctcgttcctcgacggggtcgagcgggtctacagcttcgccgacctcgacgacctgccgctgatcgtgaccgtggcgacggacgtcgacagcatccgcggcgtctggatctacaaggcggcgatcgtcgccgtcctgatcctgtgcctctgcgtcctcgccttcggcctgacgatcctgctgcaccgggaggtcgggcgccacgtggccgcggaggcctccagccgcgaggccaacgccgcgctcgccgtgctcgcgcgaaccgatggcctgacgggcctgccgaaccggcgcagctacgacgagcacttcgccgtggagtggaagcgggccgcacagctgcggacgcccctggcgctgttgatcgtcgatgccgaccacttcaagcagttcaacgaccgcttcggtcaccagcgcggcgacgaggtgctgaaggcggtggcggagtgcctgcaacgcaccctcgataccgccgggctgagcttccggatcggcggcgaggagttcgtcgccctgttgccgggtgtcgacgcgacggccgccagcgtcgcggcggagcgcgtccgccgggccgttgtgaacctccgcatccctcacgccccggaggtcgggggcatcgccacggtgagcatcggcgtcgcctgtgccgacccggccggcggcgatccgcccgaagggctgttcacggcggccgatgcggccctctacgcggccaagaaggccgggcgcaaccgcgtccgcgccgccgcgccggcggatcccgtggccctggcgctgcgggcctga

SEQ ID NO: 5743 - DNA, 399 bp, Methylobacterium sp.
atggacctcacccacgttcgcgccttcgcggccgccctggcggcgaaggaccgggacgccgtgctggcacagatggccgagggggtcgtgctcaacaccccgctcgccgccgagcccgtgcgcgggaaggcggcgatccggccggtggtcgacgccctgctggcggcggtcgacgccttcgagatccgcgagatcctggaaggccccgcgcacgtcgccgccttcttcggcgcgacggccggcccgcaccggctcgacgggatggatgactggcgcctcgacgcggccgggcgcatcgccgagatgaccgtcctgtggcggccgctgccggaggcgatcgccgtccgggaccgcctggcccgcgccgcggaaacgccgacttccgcggcgaccgggtga

SEQ ID NO: 5744 - DNA, 363 bp, Methylobacterium sp.
ttggagttcagctggttcaccaagtgccagatgatggcgtcaaactatgcccagcactgggagatggttctcgagcctgatctcggaagtctgattcaggccgtcgccactgatgcgcggaccagcttcaccgggccgcaatcgatgcggcgcgtcgccgaacgactgacgctcgttgcagactcgcttgtcgcggcgagcgacgatcgggctcgcgctgccgatgtgcgccgcgaggacggtcgttgcacggaagcgctgcaatacttggcgtcgcaactggcgagcacggcagccagtgtcgaggcatggaagcatgcgtccgcctccgcgactgaaacaagtcaggcgccgtcggcgtga

SEQ ID NO: 5745 - DNA, 219 bp, Methylobacterium sp.
atggagatcaagcgcgatctgatggacatggcgcatgcggacacgatcgtgaagtccttgaagagtcgtggcctgaccagggacgaattcgaggacgtggtttcgggcctggtcgatgacggtctgctttcgctggagcgagctcaggtattgaccctcagattcgagcgcacagaaccccaaagcccaagtctcgtggatgatcgtgacgtgcgatga

SEQ ID NO: 5746 - DNA, 222 bp, Methylobacterium sp.
atgccgacaccgcccgacgcctacctccgggacatccttgcacaggcggaacaggacctcgccgcggccgagctgcgccgggcccagcaggcacggatcgtcgccggcccgctcaatagcccggagacccgtgccgccgcggaactgcttctgcgcgagattgaccggaccatcacgtccatccgcgcgaaccgccatctgatcgcggacatcctggcctga

SEQ ID NO: 5747 - DNA, 741 bp, Methylobacterium sp.
ctgctctgcggcgtcctcgcggatcggctcctgcgcgcctgcgccgtcggcagcggcgactggcccgcctggatgcgcgcggcgctgcccgatcactgccccgcaccgtcggtggccctggatcccgacggcggcgcgatcctcgcggcgatccggaccacggacgacgccgtgcgggccgccgaactcgccctcacgcgccgggcgctcacctgcgacgcgagctgcccggtgccgccgcgtcgggccgcgcgcgagaccccgcaggtgatcccccccgacctcgcgcggcgtctcaccggcatcgagcgcgggcagggtctcgaactgacgctcgcgtgggagggcgcgtccgatctcgacctccaggtcgtctgtccggaccgcacgcgcatcagcttcgagcaccgggcctcctgcggcgctcgcctcgtggccgaccagaacgagaagggcgggagcagcgccagccggccggtggagcacgtgatctgggacgacgcccccgcccccgagggccgctacggcgtcgaggtcgggctgttcgcgcgtcacggtgaggcgaggccggagatcccgttccaggtcatcctctcgcgccacggcgaggtcgtcgagcagcgcgccggccggatctcggcggagcgggtcgcgcaggccgttctgtccttcgacctgccgatcgcggcaccgccgcagagcggcccccaggccccgaccgggagcgcggccgtgccctga

SEQ ID NO: 5748 - DNA, 390 bp, Methylobacterium sp.
atgtccgcgaccacgaagctcaccgagacgccccgtctcggcctcgacccggtcaatccgaagctcgcgcagcagtacgagcagctcgtcgacctgctggcgcgccgtctgagcccggcgcacgcccacctgttcgccgaacccgcccccgtcgcggtcgccggcaccggacgtcccggcttcgcgtggttcgccgcattcgacggcgacgcgcggcccgtgaccgcgctcgatcccgccgccgccgcgaccctgcgcgcgaccgcggcccgtctggtcgccgagatcagcgccttcgcggacggcctggagcgcgagggcgaggcctcgcgcgacctcgcccgtctgctgcgggacgcgctcgttgtcccggacgccgaccacctgtgg

SEQ ID NO: 5749 - DNA, 219 bp, Methylobacterium sp.
atgggttccagcgatcccgagacgcgcaggcggcagctcgaccggctgcgcgcggcctacgaggcccgtgcgggccggccggacctctcggccatcggcagcggcgcgcggcactcgcgggcgctcctgggacggatcctcgtggtgctcggcggcctgccggacggggccggactgccggcgatcgggccgggcgggaacggacgcgcccagacgtag

SEQ ID NO: 5750 - DNA, 420 bp, Methylobacterium sp.
atgggatcgatgcggaacgcgttcatctacgcggccatcctgtcgacgctcccgctcccggcggccgcggcggagacgtgccgcgaccattaccggagcgaggggacgccgatgctccaggccatcacctacaagacgtggatgatcttcccctcggtgagccccagggccgcgttcgaccgggtgacgcgggcggtcctggccgaggggttcgtgggcgtgcacgtggagaaggcgctcgggaccctgacggcccagcaggagacatccggctcggggcgaccgcagacgctgcgggtcgtcgtgcgcaaggccggggcgggcagccgggtcgacgccctgttcatggtgcaggccggccagatcggtcaggacgtcgaccagaacctgtgccgcatcgtcgatgccgcggcgcagtag

SEQ ID NO: 5751 - DNA, 498 bp, Methylobacterium sp.
atgccgctggttgtcatcttagccgccctgtgcggcggactccctgtgcttgccttcggctggcagacgttcggcttctacacggtaatactcgcttcctgtgtcgccagtgcggccgccgtactggtgggtggcggactcgcgctcctgagggccggaaggtcccggaccgcgcaggatccggcgaagatcttcgacatcgacaggctcacgagcggcggccgcagcgactttcggctcgttccgcggcgcctctacttcgacatcgagcacggtcgcgagatcatcaaggatgagatcggcatcgaggccacgagcatcgaccaggcgctcgacgacgcccggagcgtgatccgggacatggttcaggaactcgccgacgagggctacgcggaggattgggtgctggtggtgcgcgatgccaggggggcttcggtcgcgcgcctgcccatcgagcggacgcccgcgcaggcgcggcccgaccgccgctccgcctga

SEQ ID NO: 5752 - DNA, 159 bp, Methylobacterium sp.
atgccgtccgcctcgctcatggatcagatcgcccccgttcgtaccagccgcacccgcaggaggcctcatccggcccttgtcgtggcgtctgtcgccctcgccatcggcctctggttcgtcatctacgcggtggccggacgcgccatctggttctggtga

SEQ ID NO: 5753 - DNA, 1857 bp, Methylobacterium sp.
gtgacccgctcccaggccgcccgccagactgcccgccaggccgcccgccagaccgcccgcgtcgtcgcgctcaccgcggcgatcctgctcccggtgcaggccggatcgcgcgccgccgaccgaggaccggcagacgggccgggcgacaggccggacggcaccccgcactttctcgagcaatcctggacgccgcaggagcgcgcgtggttctaccgggcgagccagggctcgcagatcatgccgtatgcctggttcatgtccctggagcgcccggacgacgacacgctcttcgtcgcggacgggctcgcgcgcttcggctacctgccgaacccgtacgacgggacgcgcggatcggaccgcagcgggctccccatcgggttcgtgaaggacgtcgacgatcgcggcgagtggatcggcatgacctgcgccgcctgccacgtgaaccgggtcgacctgcgcggtcggtcgatcctgatcgacggcggcccggccgatgccgacatgttcgccttcatcgaggaactgggccgcgccctcgcgcggacgcgcgacgacccggcgcgcttcgagcgcttcgcccgccgcgtcatcccggcggaactgtcggcgccggggaccggcccgtccgagcccgaccgccgccgcctgcgggccagcctgacgcggctggccgaggacttctcccaatacgtcgcgtcgagccggaccgcggtaccctgggggccggcgcgcctggacgcgttcggcatgatcttcaaccgggcgacgggcatcgatctgcgcgacccgcacaacatcgccccgcccgacgcgcccgtcagctacccgttcctgtgggatacgtcgtggcacgaccgggtgcagtggaacggctcggccgcgaacgggctcgccgtcgagcgcctgggccggaacgtcggcgaggtgctgggggtcttcgcccgcaccgacatccgggagccgaccctgccgccgctctggttcgagacctcggcggaccgggtcaacctcctgcggatcgagaaccagctgggcgccctcacggcgccggcctggcccgaccggatcgcgccgcgcaccgaggcgcaggcccgggacgccgcggccggcaaggcccactacgaccggtactgcctgtcctgccacgcgatcgccccgaccggcgcgaaccgcacgctgacggtgaccctgacgccgctggcggagatcgggaccgacccgaagatggcgacgaacgccgtgtcccggcgcgcgcggaccgggatcctcgaagggatccggatgccgttcctggcgacgacgccgccgctggccgccgagacgagcagcctcgagctcgtggccacgctcgtcgccggcgcgatcctggcgcccctcgaccgcggacccgacccggcgggcgtcggggcggaccagagcgtcatcctcgaccggctgctcaagcgcggcgccgccgccctcgaggcccgcaacgcgatgctcgacgacgtctcgaccgccggcggcaagggcctcgtcgccgcgttcgtcggggcgcggagagaccgcgacctcatggtctacaaggcgcggcccctcaacggcatctgggcgacgggcccgtacctgcacaacggctcggtgccgaacctgtacgaacttctgctgccgtccagccggcgatccaggacgttccgggtcggcagccgcgagctggacgaggaccggatcgggttccggtccgacgtcgggccgttcctgttcgacaccgcgctgccgggcaatgccaataccggccacgaggggccggcctacgggaccgagcagctcgacgacgcgcagcgccggcagctcctggaatatctgcgaaccctgtag

SEQ ID NO: 5754 - DNA, 921 bp, Methylobacterium sp.
gtgagactgcctgtcaccggcgacggccggttctgggcccttgccttcctgggcctcggcctcccggcctgcctcgcgctgggctggatcggtctcaccggcgagaccccgtccacctccgccctcgccgtgggcggccggctcgccgccatcgcggcgttcctgagcctgggcctcgccgccctggccctggcgacccggggccgggccgcgctgttcgcgctgctgtgcttcccgacctcgctcgcggccgcctccggaccggacgggcccgtcctcgcgctggcggcgctcgcggccgcgctgctcagcccccggccgatgacgggccggcacggatcggcgcgccgcgccggcgcggcgctggcgatcgccctggtggtgctggcgcggccggcctgcgcgcccctcgtggggatgctgctcgtgccgttcccgcctccggggcgacgcgtccgcgcctggcgggagcggctgccgctcgccgcgttcgccctgctgccggctctcctgccggccgcgagccccggtcttccgccccccggcgcggcgggggacggattcgtgtccctgcccgtcccgctgcccgggttcctctccggggtctgggccgccgcgctgctggcgccgcccgtcgcgctgcggcgcggccccctgcccccgcccgcggagcggctgtggctctcgggctgcgcgctcctcggcctctggctggcggtgctgtcgcaggccctcgccccggcgggcggcctcggggggatgcaggcccgggacctgctgccgctggcgccgatgctgatcctggccttcgcccgggggcggatcggcaccgcggcggccctgcgctggccggccctgctcccggtgctggccgccgccctcgacgcggtggtgctgccgatgatcgcgctgcgggcgtag

SEQ ID NO: 5755 - DNA, 219 bp, Methylobacterium sp.
atgaccgtccgcctgttcgctgccgccgcgctcgccgcgaccctcgccgccgccctcgcgacgcccgcctccgcgcagggatccgccgcacggcacggcctgtccaacgtcacagcggtgatgctgcccgagatctccgtgacctaccaccggcccgtgccggccgaccgctccgccggcccgcacggggccggcccggccggccgccagccccgctga

SEQ ID NO: 5756 - DNA, 207 bp, Methylobacterium sp.
atgacgaacgcgaccgatcgaagggccggccgccgcggcgtccgcggcggccgtgctcaggtccggacggtgccgccgggcctgctgctggccggcggcgtgggggcgaacgccccgctgacggccgtcgacctgatcgcccaggcccgcgcggcccggcgggaggccgaggcccgcgacggcgcggaccgcgcggagcagggctga

SEQ ID NO: 5757 - DNA, 600 bp, Methylobacterium sp.
atggatctctacgccggatcggcgcagatccggctgcacgaacaccagatcgcgcaggatctcggcatcagccgcacgccggtccgggaagccctgacgctcctggagcgggagggcttcgtctccacggtgccgcgacgcggcctcttcgtgacgcgcaagaacaagcgcgagatcgtcgagatgatcaccgtctgggccgcgctcgaaggcatggcggcccatgccgccgcgcggaacgccgaggatgccgatctccgcgcgctcggcagggccttcgaggcgttcgacatcgcgactctacccgaccatctgaaagcctacgacgaggcaaacctcgacttccatcggacgatcatccgtctcggcggctgcgggttgatggtcgagatgacgaccaacctgttcatccacatgcgggcgatccggtcggccttcctccatcgggccgggaggctcgaagactcgatgcgcgagcatgctgccatcatcgccgccttgcaggcacgcgacgcggatcgggccgcgatcctcgtccgcgatcacgcgctcgggctgatcgcgcatgtcgaggcgcactgggtttggccagaggggtga

SEQ ID NO: 5758 - DNA, 600 bp, Methylobacterium sp.; identical to SEQ ID NO: 5757

SEQ ID NO: 5759 - DNA, 288 bp, Methylobacterium sp.
atgatcgtcttgatagccgcagccatcgtcagcggcctcgcgacagccgcgatcctggcgccggtgagcgccctcgccgcgctgatcatcgcacccctggcagccagcgcgtcggccatcctcgcctgcatcttcatcgcttggcgcaacacgcgcgacgatgtcgggccgcccaacctcgagacgcaggccgacgcgatggtggcggtcctctgcgaggttgcccagaagggcaagatcgtcccggtcgccgcgccggtccgggtccgcggccaccggtcggcctga

SEQ ID NO: 5760 - DNA, 114 bp, Methylobacterium sp.
atgtacgctttggccaagaccagagagagaaccgactgggagctggtcgtcgtcttcggcagctggatcgtcttcgagatcgcgatcctgatgctgtgcttggtgtcgatgtag

SEQ ID NO: 5761 - DNA, 267 bp, Methylobacterium sp.
atgaagacgctgatcagcctgaccgtcgccggcctcctggcgacaggcgcggccgccacggccgcggagaataccgggacccgcatgcagggttcgcccaacgcggccggctacacgggccagggcgcgacgggcaaaggcgagacgacgggcacgacgaccggatctccgggctcggagatgccgaagcaggacagccggatgaaggggccgccgaatgcggccggattccagcccggcggcggcggcggcggctcggcaaggagg

SEQ ID NO: 5762 - DNA, 675 bp, Methylobacterium sp.
atgcggcgcccgatacggaaggagaagcccatcatgacagcccatcggttcgacgccgtcctgttcgacctcctgacggccctgctcgacagctggtccctgtgggactcggtcgccggcagcaccgaggccggccgccggtggcgggccgagtacctgcggatcacctaccggacgggggcgtaccggccctacgaggaactcgtcgccgaggccgccgaggcggtgggcctgccgcgccgcctcgcggcggatctcgaggaccgctacggcgagctccggccctggcccggcgtgacggagaccctgcgggcgctcgcggcgcgctccgtgcggctcggcgtcgtgaccaactgctccgaacgtctcggtcgcatcgacgcccattgcgtgggggtcgagctcgacgcggtcgtcacggcggagcgcgccggcttctacaagccggatccgcgtccctaccggctgggactgcaggccctcggggtcgagccggcgcgctgtctgttcgtcgcgggctcggccttcgacctcgtggggacggcgcaggtggggctggcgacgtactggcacgaccgcgtgggcatggcggctccggacggcgcgtcgcccccgctggcgcacgagaccaccctcgatccgctgcgcgcctggttcgatccgggcgcgcgctga

SEQ ID NO: 5763 - DNA, 177 bp, Methylobacterium sp.
gccgggcgcgcatccggggacgcgtcgccagattgcgacgcgctgccgacgctggagctgctccgtctgtgggaatcgctgcgggagccggtgagccggcagcgggtgctggccgccgcccggcaggaggcccgaaccctgcgggcgagccgcgcggaggacgcggcggccggctga

SEQ ID NO: 5764 - DNA, 147 bp, Methylobacterium sp.
atggcggcgccgatcaagacggtcaggccggggcaggtcccgggcgcgggggtgaccgccgcggcggaccagacgatccgtcctctgagccttgccgagttcatcggtcagcgcgcggcgcgggcgaacatgcaggtgttcatcgag

SEQ ID NO: 5765 - DNA, 273 bp, Methylobacterium sp.
atgcgccgcgactccgacgggaccggccggatctcggctctgacgcggatgcgacgccgcctcggccggctgcgcgacccgctggccacgccggcggcgctgcaccgacgctgggcgggcgcggcgaccggcgcggatctcgaggcgcgcctgatcgccgtcctggccccgcacgtcgacacggcgttctacgcgagctggtacgggatcacggccgatccggtgcgcgactacctcgtccacggctggcgcgcgggccgcgacccgcgcccc

SEQ ID NO: 5766 - DNA, 129 bp, Methylobacterium sp.
atgatgaactctgttctcgcgcttctcaccgtcgtggcggtgctggtggtcacggcgctgatcaagctgccgctcctgccgttccgcttggtcggccgccttctgcggagccgcccggcggcggcctga

SEQ ID NO: 5767 - DNA, 741 bp, Methylobacterium sp.
atgagcccggcccggagcctcccggccgggcacctccggaccagcctcgccgcgctcgtcgccctggccccggtcctctcgctcggacagggggcgtcccgggccgacgaggcgcccgccgcacccgtcttcaacaaggccgaggccgcggagatcgcggtgccgctgcggcaggacccggccttgctgcgcagcttcggcacctgcccggccgacaccttcgcgcgggagcgcccgttctggcggtgggcgttcgcgccccgccggcccaccgagcgccgctgcgcgcgcgagcccgcttcctgctacgcgctctgcacccggtggtcgaacgcgccggcctgcttcgacctcgccctcgccctggaacaccactccctcgacgtcgccgacatcctcgacaaggagcggctctacgccctcgcctgcgcgggcgggttcccggcgggctgcaccaaccgggcggccgggatccggaacggcggctacgcggaggatcccttccgcgacgcgccgcgcgccgacacggatgcctgcctcgcccggagcttccgtctcgattgcgaccggcgcggcgcctggggctgcgccatgctcggccaggcctatcgcctcggcgagggcgtcgccgccgaggcgtcccgggcccgggcggcgttcgacatggcctgtgcgatcaacccggacttcgcggcctgcaccttcgccaaacggcagctggccgagatgggcgcgccgtga

SEQ ID NO: 5768 - DNA, 399 bp, Methylobacterium sp.
gtgagcgccggcgacgccggaccggcttccgacgccctgcgggccctctacgggcgggtcgacccaatgcccgaggggccgccggccccgggccacgcccgcgcctccctgtgcgtggacgtgggcgacggggacgacgtcgccgccgccgagcgctggatgctggcccatgccagccggctcacccgcgtgcgcagcaccggctgcggctgctgcgtgatcggctgggacatcgaggggccggcggcgctcgtcgccaccctgccggcggcgctcggggcaacctccgactgggccggcccggccgcgaccccgcggcgcgcggcgagcgcgcggggccggcgcttctgggcgcacgggtgggagcgctggtgggagcgctgggtccgccgccgctga

SEQ ID NO: 5769 - DNA, 93 bp, Methylobacterium sp.
atgtcacgagggatcgagaccgacgccctgcccgagacgcccgaggccgaagagccccggattccgagcgcgcctgcccaccccgtcacggga

SEQ ID NO: 5770 - DNA, 570 bp, Methylobacterium sp.
gtggcgatcgcgatcccctgcgggaccatggtccacgcggacttcgccgtgagcctcggatcgatgatgcactcgctcggcgagatgccgatgtcgatcgtcgtcgggaagtcgtcgatcgtcgccgatgcccgcaacctcggcctcgaatacgcgcagaagtacggggcggagtacgtcctgttcatcgacagcgacatgaccttcccgaaggacgcgctcctcaagctcctcgtccggcaggtcgacatcatcggcgcgacctattcccgccgcaccgcgccgttccacttcctgggcgacatcctgccggagcagccggccgacgcgccgaagggcctgctggagatgtcccggatcccgaccggcttcctgctgatcaagtccacggtcttcgagaagctgaagaagccctatttccgcttccgcgtcgacgaggaagccggcgtgaacatcggcgaggacttcgatttcagcgatcgggcacgcgccgccggcttccggatctggtgcgatccgtatctcagcaaggagctcggccatatcggcgagcaatccttcaagctctga

SEQ ID NO: 5771 - DNA, 714 bp, Methylobacterium sp.
acgctggcggcgctgctgcgggtctgcgggctgcggccggcgcgggcgccggtggaggacacgggctggctcggggcgatcgggcaggagaccctcgagcgggacgcgttcctggacctgcaggcgcggctggtggcggggcatttcgaccacggcttctaccgggcgcgctacgggctgtcagaggcggaggacgcggtgcgcgactactgcgacaccggctggaagaagggccgcaaccccaggcccgacttcaaaggctgggcctaccgcgcgcaccatccctccgcggaagcgacgggcctcgcgcccctcgtgcaccacctcgcccgggccctgctacgcggcgacgacctcgcgggcgaagccttcgatccgcgctacggcacgttgccggccgaagaggacgctgacctgttcgagcaggcccggctgatcgagccgttcttcgacgcgccttggtacctcaagcgctacccggacacccgcggctttgagaacggtccggcgatccacttcctatcccacggacaggaggaggatcgcgacccgagcaagaccttctcaacgcgcttctaccgccgggcctacgggcacctgctgggtcccggggagtcgccgttcctgcactatgtgcgcaccggccgggccgccgggctgatgggctgccccgaggatctcggcacctacccgcccatggaggccccggcggcc

SEQ ID NO: 5772 - DNA, 162 bp, Methylobacterium sp.
atgcccaggaccgtcgaccgtccccatcccgcgcgacgccgcgccgtccacctgccgcgcccccgcgccggcgccgccgccaccggcctgttcctggccggcctgatcctctcggccgcgacggtgccgctggtcgagcccgccgacgccgccaccggcacc

SEQ ID NO: 5773 - DNA, 531 bp, Methylobacterium sp.
atgctgacgcttgaacgccctgactcgatcgcgccggctgccacggacgttccgcttggcaccctgctcgccgcctgtaacgctcagcgggccatgccgctggtgttcacctacgacgggcggaccatccagcgcggctaccacgtcaccgaggtgaaagccgggcagttcgccgccctcgattgcggggccaacccggagtcgtggtcggagatcttcatccagctctgggacgtgatcgacggcgaccgcacccacatgacggccggcaagttcgcggcgatcatccgcaaggtgtcagagcacgtcggccttgatcccgccgcgcggctcaccttcgaggtcagcgacggcgtggtgccgatgcagctccactccgccgatacccccgagctgatcgacggcgtgctccgggtcgcgctgtcacctcgcgctgcgagctgcaagccgcgggaccgctggcttgaggagcagaacaaggccagcgcctgctgcgatccttcgactaccgagcagccctgctgcgggtga

SEQ ID NO: 5774 - DNA, 540 bp, Methylobacterium sp.
atgctggaccttgccaagatcgatgtggcggtgccgcctcgcaggaccgccgacgacattcagatcggcgccctgctcgccacctgcgacgagcacccggcgatccccctcgtgttcgtctacgacggtcacgccgtgcgtcccggctaccacgtcaccgaggtgaaggccggccagttcgccgccctcgactgcggcggcaaccccgagtcctggacggagatcttcatccagctctgggacgtgatcgacggcgaccgtacccacatgacggccggcaagttcgcggcgatcatccgcaaggtgtcggagcacgtcggcctcgatcccgccgcgcggctcacgttcgaggtcagcgacggcgtggtgccgatgcagctccactgcgccgatacccccgagctgatcgacggcgtccttcaggtcgcgctcgcgcctcgcgctgcgagctgcaagccgcgggatcgctggcttgaggagcagaacaaggccagcgcctgctgcgctccctcgaccacgaagcagccctgctgtgggtga

SEQ ID NO: 5775 - DNA, 510 bp, Methylobacterium sp.
atgctggacgttgccaagatcgctgtggcggtgccgcctcgcaggaccgccgacgacatccagatcggcgccctgctcgccgcgtgcgacgagcacccgtcgatccccctcgtgttcgtctacgacggtcacgccgtgcgtcccggttaccatgtcacggaggtgaaggccggccagttcgccgccctcgactgcggcggcaacccggagtcctggtcggagatcttcatccagctctgggacgtgatcgacggcgaccgcacccacatgacgaccggcaagttcgcggcgatcatccgcaaggtgtcggaccacgtcgggctcgatcctgccgcgcggctcaccttcgaggtcagcgacggcgtggcgccgatgcagctccgctgcgccgatacccccgagctgatcgacggcgtcgctcaagtcgcgcttgcccctcgcgctgcgagttgcaagccgcgggatcgctggcttgaggcaaagggaacggcgaaggcatgctgcagctga

SEQ ID NO: 5776 - DNA, 861 bp, Methylobacterium sp.
gtggtccgcgcgatcgaggccgcggcggaagctgaggccgagatcatcgtcgtcgataacgggtccgaggacggaacggacgcggcgctgaagcgctggtccgcgtccgtctcgatcgatcgacgcgacgttctgctcctcgcgcagtcgcgcccaggtgtcgccgggtctcggaacgccgcgatcgcgcgcgcgtccggagacatcatcgcgttcatcgacgacgattgcgtcgtgtcggaccagtatctgcgagatctgatcgcgcactatgccggcgacacggaaagcgtcattcgcggtggccgtgtcgaactgggatcgaccgaggacatcgacttcaccacgaagaccgaggccctggccagccggctgacctatccggcccatcccgggggcttcgtccacggctgcaacatgacctgcagccgggccgtcatcgagcggatcggcgggttcgacgcggcgttcggccccggcgcgacgttccgcgcggccgaggacacggacttcatctaccgcggctgggcggccggcgtggcggtcgagtacgtgcccgacatgagcgtcaagcacttccacgggcgccgggacccgcgcacgatcgaccggctgcactggaactaccagttcggcaacggcgcgctctacgccaagcacatcggccgcagcccgtggctgatcaagcacctgtactggtccgcccgcaacgccgcccgcgagctggtcgggggcccgtgcttcgacgcgcaactcggcctgacgtggcgcgccatcgtgaccgccaatctgagcggcgtcctggccttcgcctggcacagcgcgcggacgctgctgacgcgcgcgcccgcccgggcctag

SEQ ID NO: 5777 - DNA, 552 bp, Methylobacterium sp.
atgacgggcgccccgctccagggccacgcggagttctccggcgacgcccagcaccggtaccgcctcgaccgctggtggtcggacgcgccgcgcgcgctcgtctgcggctgcaacccgagcatggccggcgccgaggtcaacgatccgacggtgtggcgcctggtcgagctgctgcgccccatcccgacgatcggcgggttcacgatcgtcaactgggaggaccgcgtcgcgaccgacccggcggcgatgcgggcgtggcgcatgcacgcgctccacaccgacgaggccggctacaaccgggcccgcgacgccaacctcgcgcggatccgcgcgctgtccgcggcggcgccgatccggatcgtggcctggggcgacctcgtcccgatggagcgccagaccacgctcgtcctgcgcgccatgagcctggactggacgcaccccctctacgcgttcggcacaaccgcctcgggcgccccgctgcacccgatggcccgcggccggtcccgcatcccggccggcacccttcccaccctctggcgagagcacgaatag

SEQ ID NO: 5778 - DNA, 309 bp, Methylobacterium sp.
atgagcatcaagacgccgccccccggcgcccttcatcatgaggaggactgcggggtctcgacgcttcggcaacagagaacggaacggctcctgagccgtatcgcgggggcggtgcagatgccgccctcgacgttctacaggccaccgaacgccgtcgacacgggagcgtccgccgcggccatttcggtggcctcggtcgccagcgacgctgagtgcgcggagctgctggcagctttcaacctggtccgtgatcctgaggatcgacgcaggctcctggagctggtgcagaagacggcccagcgcgcctga

SEQ ID NO: 5779 - DNA, 291 bp, Methylobacterium sp.
atgacgatcacctcgacgaagaccgcgatcctgtcctgtctcgccctcgccgccctggcgaccgtgcccggacgagccgaagcgcgcgggttcgggcacggaagcttcgggcaccatggcggcttccatcacggcttccaccacggtggtttccatcacggcttccatcaccgcttcggcggccatggctggtggagcccggcgggcggctacgccgcgagcagctactacggcgactgtcacctgttcttcagcccggtgtggggccgctacgagcgggtctgccgctga

SEQ ID NO: 5780 - DNA, 729 bp, Methylobacterium sp.
atgcatcaccacggcctgcgcatcctgctcgtcgacgatgacgcggaggttcagcgtgtcgtctcgggatacctcgacgcgcacggggtcgacgtcgtcccggcgtcgacgcgggccgaggcgcgcggagagctcgcggatccgtcgcagttcaacctcgtggtgctcaatcttcgcccgggcgcggagaacggtctcgacctgctgcgggacctgcgcgcggtgagcgatgttcccgtcatcctgacgacggcccatcgctgcgaggagttcgaccgcgtgctcggcctcgaactcggcgccgacgactacatcgtcaaaccctacggcctgcgcgaattcctggcgcgcgtgcgcgtcgtcctccgccgcgtcgcggcgcaggcctcgtcccgaccggcggaggcgccgtgccggcgcttcgacggctgggtcctcaaccgtcgacgccggcgtctgatcaatcccgacggggaagaggtcgtcctgggcaagcgcgactacgcgctcctggcggcgttcctcgacgcacctcagcgtccgctcagccgcgagtacctgctgcaggtcacccgcgtccacgacgacgtcttcgatcgctgcatcgacgtgcagatcctgcggctgcgccggaagatcgagcgcaggcccagcgacccgaagctcatcgtgaccgagcgcggggtcggctacgtcttcgccgccgcggtcgagagcacgtcccactag

SEQ ID NO: 5781 - DNA, 177 bp, Methylobacterium sp.
atgaaccgagatccgagagccaggagcaagcaggccgacggcaaggcccggacggcggagtccgaccgcgagaccgatgcccgcgcacgtcaagcggtggtggatgcctggcggcgggcactgctccggatgcgcgagcggcgcgccaccgaggaccgcgccgatccgggccactga

SEQ ID NO: 5782 - DNA, 237 bp, Methylobacterium sp.
atgccccgcttcttcatcgacctgcacgacggaaccgagctcgtccgcgacaaggacggctacgaactgcccggtctcgacgccgcccggtcgcaggccgtgaagatcatgacgcggatcgcgcaggggctctccgaccggcccgggcgccaggattacatcgcggcggtccgcgacgacacgggcgtggtgcggatgcgcttccgcgtgtcgctcgatgccggcccggtcggctga

SEQ ID NO: 5783 - DNA, 423 bp, Methylobacterium sp.
atgcccatcatgccctggatccacgatgccctctatgtcggcagcttcgccgccctcgtcctcgtcgcacggcaggcgctcgtccggcgcgatctcgggctctccggccttccgggcctcgaacgcctgcgccggtccctcgggcccggcaccgtgtcccctgagtggccccggttcacgtcgccccggaccagcggcaacaccgccttcgacgcctggcgcgacggcgagatcggccgcatcgagggggagcgccgcgcgctcgaaacgcgtctccgggatttcgagggtttcgtagacgcgctgaagcgcgcccaggatcgcgcgaccttcgagcgcttcgtggcggaacatcccgcgggatcgggggcggcggtcgacatcgtcggcaccgccgatcacgccgaacttcgaagaggctag

SEQ ID NO: 5784 - DNA, 279 bp, Methylobacterium sp.
atgacgcccgatgagatggacgacagggaggagcatcctcggatcgaagatccgcgatccaggcccacgctgttccttcgccggctgcctccccagttccggggtgagcgggacggtctgacgaccgacgccgcgtggctgttcgatgccttctccggctccccggaccggcgtgacatcaagctcgggcgcggcacgcatcggatgcatctcgaagccgggcgcagggccctctggcgagcctccgccgcatgtctgagtgggccggtcccggcttga

SEQ ID NO: 5785 - DNA, 279 bp, Methylobacterium sp.
atgaacacgctgaagatcgcctccgtcgccgcaggcctctgcctggtgccggctatgagcatggcccaacaatcggtgagccaggacaatctcaagcgctactgcacgggagactacctggagcattgcggccagttcgcgccgggtggcccggaagttcaggcctgcttccgcgagaaggccaagctcctgtcgcccaactgctcgatcgcgatcacggcgtaccagaaggagcaaaacgaggccggcgccattcggaaggtcagcgtgacgcgctga

SEQ ID NO: 5786 - DNA, 294 bp, Methylobacterium sp.
atgacctttctcaagaccctgctggccagcctggccctgtgcgcggctctcctcgtctgggccggcctcgcgatcggcccggaacagccgatggaccggaccagtccgggtctgaccaccgccgcggtgctggccagcgacggcatggcgccggacggtcgaccgggcgagccgtccgcggcctccggcggcccggatcggcgcgatctggatcgagcggctctggaccgcctcgcgaagcgggtctccggccaggtccgcgacgcgtccgccgcggggacgccggccggctga

SEQ ID NO: 5787 - DNA, 285 bp, Methylobacterium sp.
atgcttagacagatcggcgcgggaccggcgcgcgcggtcgcgacgcccgacgccgccaccgcgcgggagatccgcgcgtccatccaggccgaaggcctgatcagcttcatcgacggcaggtcctacaagacgctcaagcgtcacctgacggcttacgggctgacaccggaggaatatcgcgccaagtacgggctgccgcgagactatccgatggtggctccgggttacgccgccaagcgctcggagatcgcgcgatcgctgcagctgcgtcacagggcgggatag

SEQ ID NO: 5788 - DNA, 270 bp, Methylobacterium sp.
atgcgacacgtgatcggtacctcgtcggccgcggctttcggcacgctctgcgtcctggcgctcgtcggctggacccaagcggccgacacggtgccgatgcaggccagcgggggcgcgaaagcctccgcggtggcccgtgacggcggcgcctgtggcgggggggcctggccgtacccgcccggcgcctgcgcgggagccggcccggtcggcgatccggcggcccgtcgcgtccggctcatcgcggtcgacgccgcgcccggccgtcggtga

SEQ ID NO: 5789 - DNA, 216 bp, Methylobacterium sp.
atgccgcacttcagcgacgaccccggtgccgacgaagatcccgacctgctcctcgcgctgcgccgcatgctgcgcggcggagaacgcgctccgcggcgcctgccgacctgcgccgagcgtttcggcgtgccggcgccgcgcgattgcgcgcgtgacgcgcaggatgcggtgctggccggcccggacccgcagccgccccgatcccgacatcgctga

SEQ ID NO: 5790 - DNA, 186 bp, Methylobacterium sp.
atgctcgacgtcatcgcccgcctcctgctctcggccggcatcatggtcggtacgacctacctgccggcgctctcgcaggccgtcaccgggcagccggccggcacccggatctacgccgcggacgcgcccgcctgcccggcgaagcccacgatggccgggatccgcgccctggcctgcctgggctga

SEQ ID NO: 5791 - DNA, 1017 bp, Methylobacterium sp.
atgccgatgtcgctccgccacgcggccgtcgccgcgcgcctcctcgtcgccgcgctgctgctcccggccctcggcggcgcggcgcgggccgagacgacctccgtccgcatcggcctccagtacggcctcgtctacctgccggtgatgatcgcgcagagcgaggggctgttcgacaagcgcgccaaggcggcggggctcgacggattgtcggtcacgctgacccgcttcagcggctcgacggcgatgaacgacgcgctgctctccgacagcgtcgaactcggcaccctcgggtcggccggcgccctgatcgcctgggacaagacccgcgggagtcagcagatcaagagcctcacggccctgagctcggtcgtctacacgctgttcaccggcaagcccggcgtgaccgccctgaaggacttcaccttcggcgacaagatcgcggtcccggccttcaactcgccccaggcgatcctcctgcgggtcgcggcggcgcagcaactcggggacgccgccaaggccgacgcgctgatggtgagcctgccccatccggacgccaccgcggcgatgcgcgccggacagggcattgccggctacttcgcgacgccgcccttcacgcaggtgctgaaggcggatcccaagatccggacggtcatgacctcgaccggcctgatcggcggcggcgacatcaccgccgcgaccctgaacgccaagcagggcttcgtcgacgcgaacccgaaggtggcgcaggcgatccgcgccggtatggaggacgcggtggcgctgatccgcagcgaccccaagcgcgcggcgtcgatctatctcgcctccgagcaggttcagatcgaccgcgcgcaagtggaggcgatcctgaccgacggatccatcgtctacgacgtggcgccgaagggcatggtcgccctcgccaaggcgatggcggcgcagggcttcctgcggaaggtgccgcgggactggcaggagatcttcttccccggcctcgagggccgcgacgggagctga

SEQ ID NO: 5792 - DNA, 1377 bp, Methylobacterium sp.
atgtcggtcacgtcggcagccttggcaacggacacggcgggcgcgcgcccggccgcgtcccagtcgatcgaggagaagcggaagagcgctatccgcggcgcgttcttctccgaatacatcgacatgttcgacatctacctgccggtggtcgcgctggcgccggtgatgttcatgttccagccgaagaacctgtctcctcagatggagacggtgctggcctcgctggtgttcatcacaaccctgctcggccgcccgatcggcgccctcatcttcggcctgatcgccgacaaggtcggccgccgggccgcctcgatctactcggtggcgggcttcggggtgatcacgctgctgatcggcctgctgcccggctacgagacgctcggcctcgcctcgtacatcctgctggtgctgctgcgcttcctcgacgggatcttcctcgggggcggctacacgggcgcgatgccgctcgccatcgagtattccaagaaggacaagcgcggcttcgtcggcggcctgatcatcgcgggcttcccggccgcctatgtcagcatcaacctcatcacgatgctgatgttctacctgttcccgctcgacgggcccgggtcgccctacacggtctggggctggcggatccccttcatcgtcggcgcggcgctcgccggcctgctcgcgctctactacgtccacaaggtctcggaatcggaggtctggaagaaggaggccgccgccggggccgaacaggccgaggcatcgcccatggcgggcctgttctccgggaagggcgggcgcgacctcctgcaggtcctgctactgatgaccggcttctggacgacgcagaacatcatcacgatctacatgccgaccggtctgctggtgaagaccctgcacctcaacggcttcgcgctgaccgcgacgctgatgatctgctacacgatcctgttcttcagctacatcggctccggcctgctagggcagctcatcggccgccggcggttcttcgtgatcgtcggaccgctgatcgcgaccgtcggcgcgtacatcctctacacgctgaccgtcacgcccgacatggcgttcggcacccgcgtgctgctggtcagcctcctggcggtgatcgtgacctcgccctggggcgtcatcgtcacctacatcaacgagcgcttcgccacggatgtccgcgccaccggcttcggcatcggcttcagcctctcggtggtcatcccgtctttctacgccttctacatggactggctgagcgcgctgatgccgctcgcgctgacgcccgtggccctgctgatcgtcggtggcctgatcggcaccgtgggcgcgctcatcgggccggagaccagggacgtcgatttcggcaccggccactga

SEQ ID NO: 5793 - DNA, 906 bp, Methylobacterium sp.
atgaacgggaaccggatcggcttcatcgggctcggcaacatgggcggccgcatgacccgccgcctgaccggggcggggatcgatgtggtcggctacgacaccgaccgggaagccgcttcgcgctggggcgcgacggacgcggcctcgatcgccgcggtcgtcggtgaagcggacgtggtcctgatgtccctgcccgacagcaaggtggtcgagcgcgtcgtgctcggcgagggcggggtcctcgcgggctgccgggacgggcagatcgtcgtcgacctcagcacggcctccgccagctcgacgcgccgcatcgccgcggcgctggccgagcgcggcgtcgcctacgtggacgcgggcatctccgggggcgccgccgcggccgagaaaggcacgctgaccttgatggtcggcggcgatcccgccatcatcgaccggctgggctgggtgttcgcgccgatcgcccgaaaggtcgtcgtgatgggcggctccggcgccggccacaccaccaagctgctcaacaacttcctgaacgcggtcagcctcgccgccaccgcggaggtcatggtcgcgggccggaaggccggactcgacatacaccggctgctggaggtgctgaacgcctccagcggcgtcaacttcgcgacgctgaaccgtttccccaagatcgtggacggcgactacctggaaggcggcctgaccggcaagctgatgaccaaggacgtcgtcctctacaccgatctcctgcacgagctcggcgtcgcctccctcaacgcttcgggcccgatggcgagcttcggcctcgccacggcgctcggctacggcgacgtcatctccaaccgcgtcgtcgacgccatcggcgacgtctccggcggtgtccggctccacggcaaccgacacgagaactga

SEQ ID NO: 5794 - DNA, 765 bp, Methylobacterium sp.
atgaccgggcccgcgccgagcccggagagcctccggcacaccgtccagggcgagctcggctactgggacgcggagcaggcggccctggccgagctggccccgggctttctcgacgcctgggcgcggctggcgatggtccccgtgcgcaagaaccatctcggcgccaaggaccgcgccctgatcgcgctctcggccgcgacggccgcgacgcatctctacgcgcccggcacccgccgccagatccgcaacgccctcgacgcgggcgcgacggccgaggagatcacggaggtgctggcgctcacggcgaccctcggcatccacgcgtgcaacatcggcgtgccgctgctgctggaggtgctggaggaggccgggcagcggagcggccccgcgccgctgacgccgcggcaggagcagctgaaatccgacttcacccgcgaccggggctactggcacgcattctgggacggtcttctcgagctcgatcccgacctgttcgagggctacctcgacttctcggcctggccctggcgccacggcgtgctcacgccgaagatgaaggagttcgtctactgcgccttcgacgcggcggcgacgcacctctacgtgccgggcctgaagatgcacatgaagaacgccctcggttacggagcgaccaaggaggagctgatggaagtcctcgagatcgtcagcctgatcggcatgcacggcgcggaactggccgcgccgatcctgcgcgatgaactggccgcgcggggccggggctga

SEQ ID NO: 5795 - DNA, 111 bp, Methylobacterium sp.
atgcgcatgcgagggttcccctggaaaagctcggcctttcgaatgcgcgaaccggcgcagcttttcgagaggcggatctacgataccgcgatggatgcggccggaatgtaa

SEQ ID NO: 5796 - DNA, 168 bp, Methylobacterium sp.
atggccagctcgatgctggtcaccctcgcgtggctggccctctcgatcttcgtctgggcccagctcgacgccgagaaggtgctgctgctcttcgcctacctcaccgctctccaagccggctatctcgtcggggcctatatcagcgccgatgccggcccgagccgctga

SEQ ID NO: 5797 - DNA, 249 bp, Methylobacterium sp.
atgcccgccgacgacgtcccaacccacgatggccgcgcgcccccggctggggagagccgcctccgctcgatcgccaaggccgtgagctggcgcgtcgtcgggagcctcgacacgctgctgctgtcctatctgttcaccggcagcgtgctggtcgccggatcgatcgcctcgaccgagaccgtgaccaagaccgtgctgtactacctccacgagcgcggctggggcctgattcccctcggtcgcgcctga

SEQ ID NO: 5798 - DNA, 135 bp, Methylobacterium sp.
gtgccgatcattcccagcccgagacacgcggcgcggcgatcgctgttccagagcgggatcggcctgcggctggcgctcgccgcgctgctctcggcgctggtctggctgaccatcgcctgggcgctggcgacatga

SEQ ID NO: 5799 - DNA, 360 bp, Methylobacterium sp.
atgaccttccagaccaaagcccgccccttattagccgccctgctcccgccgaccctgctcacaaccgtgacggctccggccgtcgcggccgaacccgtttccaccttcatggcctacacggcgccgctcgccgctccccttggcgagacagcccctcatatcccgctgatcgccgcaagcgcgctgatcgccgcttcggccctcgcgatgttcctccccttccgtaagcccgctgcgccggcccgcgtcgaggcgcctgccgcgcccgtcgagaccgcagcggtcgggcccatctactgcccccgcacccgccgttggcgtgacgcctcgacgggccgccttgtgaaggctccccgctaa

SEQ ID NO: 5800 - DNA, 267 bp, Methylobacterium sp.
atggccgaataccacgtcaccacctatccgccgcacgtcggacccgccgagatggcgcttgtcgcgcgccgcgtcgataccgcgggcgatcgcttcgtcggcgccgtcgtcgccgtgctcgacagcctgtcgctgcgcgacacggagggcggctggcgggcctaccgcgcggccctcgccgcggccggatcgctgcgccggggcgccgtcgcggcgcgcctcacggtcgcgggcggctacgtcgttctggtggagcgcgtcgcgtga

SEQ ID NO: 5801 - DNA, 345 bp, Methylobacterium sp.
atgcagccccgatccctcgacgagctgcgccggctgctgccgggcgtcggcatctcgatctacgcgatggagcccggtgggcccgtcaccctggagcttctggaggagggcgacccgggcgagacgccgcaggcgatcgtctggaccgcaccgagcgagcgcgaggcttgggagaaggccttcccgccgacgccggccgagcccgtgccccagggcagcttcatgccgcccgagggctcgccggctcgcgccgagctggccgcggccgtagaggacccgaccgccggcttagccgccgagctggccgcggaactgcccgccgacgctggcgggctgttcgactga

SEQ ID NO: 5802 - DNA, 168 bp, Methylobacterium sp.
atgaaccgacagcccaaggggcagaatttggtccgcgccacggtccacctggacgcagctttattggccgagctggacgacgccggccgcgcgcgcagcctgtcccgcagcgccatgctcgcccagctcctgcgccagatgctcccgaagacacggaggacatcctga

SEQ ID NO: 5803 - DNA, 351 bp, Methylobacterium sp.
atgttcgatgcagacgacacccccggctacctccacgacgcctaccgcgccgccctcgataacgggctgctgagcctcaacctgacccgcgtgggcacggacaaccgcatgtggcaggcctctagccgcttcgcgaagtccagcggcttccatgtcgagatcgaggccaacgccctggaggcggtcatgaaggcgctcggggcctacaccaagatcggggccccggcgcccgctggcctgttcgacgacgagcccgcccccgagggtaagcccctggacgacggcttcgacgcgatccaggacgcggtctacggcgccgacgagcccgaggacgaaggcctgttcgactga

SEQ ID NO: 5804 - DNA, 438 bp, Methylobacterium sp.
atgaagtccctcgccgtcgccgccctgggagctgggctcggaatggccgcgaccgcggccagcgcgctcaccaacgcagtcgccgccggcacggagctgatctcgggcgagccccgggccgcgcgccgccggcaggcccgcaagggccatcggttcgtcatcggccgccgcggcagccggagccgctaccagccccaccagggctcccgggagatcgcccggcgcgtccggcagatcatggacggccagctcgtcgcctggacgcccccgggcaccgaggcgccggccgcggacgccgccctgcgcgcggagaaggcgatccccgcccaggtgctgatcgacgccggcctggaggccgagcgccgggccaagcgcagcgaggcggcccgcaaggcggccgcgacccgcgcccgcaagcgggaggcggccaatggctaa

SEQ ID NO: 5805 - DNA, 570 bp, Methylobacterium sp.
gtgaacctctacaagccccgggcgaacaagaagaacccggacaagctcaagtacgaggtgaacctgctctatccgaagtcggccgacctgtcggcgatcaaggcggccgtgatccaggccgccaaggccgagtggggcgagaaggcggtcgacctgctcaagaacggcgtcatcaagcagccgatcctggacggtgacggcccgcagggcgtgaacaagacgaccggcgagcgctacaaggagctggaggggatgttcttcatccgctgcgcctcgaatctcaagccggcgctgctgagcccgaaggtgacggccgcggtcgagggcgagcacctctactcgggctgctacggctacgcggcgatccacgcctacacctgggagagcgacgagcagggcaggggcgtctcgatcgggatcagcatggtccagcacgcgaaggacggcgagcgcctgggcggcggccagcaggatccctcgaagttcttcgagacgatcccggacgacgacagcggcacgggcggcgctgcggccgacacgggcgacggcgcgggcgcgctgttctcctga

SEQ ID NO: 5806 - DNA, 1293 bp, Methylobacterium sp.
atgtccgccggccacgtccagcgggatcatgcgcaatggtccgccagcgcaagcgcccggctctgggcgtgcgccggcagccttgccctgtccggtcgcaccggacgggctgacagcgagagcgaggcggctgcctggggcaccgcctgccacgaggtgtccgaggactgcctgcggaccgggaaggacgccgtcgagtggatcggccgcttcgtgcagacgaagcggcaccggatcgaggtcgacgaggagatggccgagacggcccaggtctacatcgatcacgtccgggaagaagtcgcggccgcccgcgccgacgacccgggggacgatcagatcctgtggctggagcagcggttcaagctcgacgcgatcaacccgcccttcgaggccggcggcacggccgacgccgtcatctacagccgcccgacccgtaccgtgaaggtgaaggatctcaagggcggccgggggattgtcgtcgaggcgctcggcaacaagcaggcccgcacctacgccctgggcgcggtcctggcgatgcctgggctcgacattcagcacgtcgaggtgacgatcgttcagccccgggcgccgcaccgggacgggcccatccggtccgagaccttccacatcgtcgacctgctcgactggacgaccgagctgctggaggcgatgcggctcgcgaagctggccgacgacacctacggctcgaacgggtccgaggacgggtccttcgacgagtgggccgagcggttcctgcaccccggcgatcactgcacgttctgcccgtgcgccgggtcctgcccggccctggcggtcgccgcgaagtcgaaggcgctcctgttcttcaaggatgagagcggcgtcgagcaggagaacacggtcggcaagctcacgccggccgaggtcgccgagatcctcgaccgggccgacatgatccagaactggctcaacgccgtgcgggcccacgcccacgcggaagcggaggccggcgtcgagatcccgaactaccagctcgtcgccaaggtcgggcgcgagcgctggaacgacggcgccgaggccgacgtgatcgccgcgtgcgagtgggccgagctgccccttagcgaataccagaatgctccgaagctgagaacgcccaagcaagtacgcaaggcgctcggcccggatctcgccaagctcgtcgagagacactcgacggtgcccactgccggaacatccctggtccggcaggataagacggtgcgcactccggtccaaccgaaggctcacctgttattcgacgtgattgacgactga

SEQ ID NO: 5807 - DNA, 540 bp, Methylobacterium sp.
gtgagcatttcgatcaccatcaacggcgacaacgcttccgaggcgatccgtgagatcttaacgctggcgggcagcatggggatgtcgcgggggaccgacacgtcggccgccgcgctcgcgaccggcatgtctgatgcgtcatccgacagtcgccagacggccgagcccgcgaaggagccggccaagtcgacccggaagaaggccgacaagccggccccggccgccccgccggagcccgcccccgaggtgaaggccgccgacgccgccgacgaagcggccgagagcgagaaggtcgtcgaggccaaggccgaggaagccaaggtcgacccggccgaggtgttcgaccggaacgtcatgcgcaacgcgggcggcgagtacgccaagctgtacggcatggccgcggcccaggaggacggcccgaagatcatcggctaccctgccttctcgaaggtgccggacgaggagatcgagaaggccactcgggcgctccgcgcggccatcgccgagaatccctacggccgcacgaaggccgccgcctga

SEQ ID NO: 5808 - DNA, 255 bp, Methylobacterium sp.
atgggcacgctgagtccccgcgagcgcgaggcgcttctgctgcgcctggaggccttcgcggacgccccgcgcgagcccagccgctacgccgccaacaccgtccaggccgatctggtctccgcgttccgcgacggcgaccgccactacctgctggtcgtgccggccggcggacaacctgtccgggtcgacgtgaccggccggctcggcgccctgttcgcctacctgggcgaagtgatcgagaaggccggcatctga

SEQ ID NO: 5809 - DNA, 216 bp, Methylobacterium sp.
atgggcctgcgcatcagacacacgcgggtgccgccgcaggtctggaagaaggccctcaagatcaagggcgggaaggacgacgcccgcatggaggcgatgcgccgctggccggcgctcgcgaaggagttccgcgtccgccggcccgacttcgccgaggccgcgctgatcgctgagtacggacggctccaggagggcgccaatgacctgtttgcctga

SEQ ID NO: 5810 - DNA, 264 bp, Methylobacterium sp.
atgtccgttatctgtctgatccaacggacgggggaggcaatggcggggttcaatagcacgaagttcctcaaggcccacttccccgactgcgcgaccatgcgcagcctgctcacggcctacggcttcgagccgccggccgcggacaccgccgagaaatggtggcgtcgcggatcggtgccgggcgcgtggcttcctgtcctactcggcatgctggagctggagcacggaaagcctgtcagtctcctgccgtacctggaccgctaa

SEQ ID NO: 5811 - DNA, 417 bp, Methylobacterium sp.
gtgcgcgagcccagcttccagccgcaggacgacaacgtccggaagcacaagctccacatgatcgcaggccgcatcgcggagctgcgccgggatcgaggctggacgcaggccgaactggcgcgccgggctgggctcaaccggaacgtcgtcaacaccacggagaacgagacgagcttcccgacccgggagaacctcgcccgcatggcgagcgcgctcgggatcgagctgaacgagctgacggacgtgttcgtcatagaggcgcaccaccgggcgccggctgcgctcagcctcacggaagccaagggtcggccgggctacatggccgtccagatcaaccggatgctcaagacggccacggcgctcaagatattccagctcatcgccgaagatgacgcagacgctgctgacagaggctga

SEQ ID NO: 5812 - DNA, 999 bp, Methylobacterium sp.
atggctgcggctcagatctacttcggcgagtggctcatcaatgagcaaagggccgcgcgcgacccgaaagggtcgggcctagacttcgcggacgtgtgggccttctatgcgaaggaggccttgccgaagctcgtctccggcgagaacaccgcgcgcagcggccggcacctcctggaggccttcggcgacctgccggtcgcagacattgggcaagcccatctcgacgactacgtgcgcgatcggcgcgccggccgcatcggccggccggccaagctcagcacgatctggctggaggtggcgaagctcaaggcggccgtgaacttcgcgatcaagcgccggaagctgccggcgactgcacgcctggagctggacagcctggagccgccggaggttcgggaccgctggctccggccggaggaagtcgacaggatcatcgcggaggctgagacccgccgcgagggcggccgcctgtcccgggccgaacgcttcctgcacctcgcgatcgagacggccgcgcgacgggccgtgatcgagaacctccagtgggatcaggtcgacctggaggccggcgtcatccactaccaccggcacggcgacctgcgctcgaagaagaagcgcccgagcgtgcccatctcgtcgcgcctgcgaccgatcctagagcgcgcctttgaggagcgaatcacgtcctatgtgttggatacgtcatccgacatctaccaccacatcgaacggatcgcacgagcggcagacgtgaagggctttcatcctcacctcctccggcacaccgcggcgacatggatggcgcgccggggcgtcccgctctggaagatcgccggcatcctcgggaacacgatgcagatggtcgagcaggtctacgcgaagcactcgccggacgggctcgccgatgccgtggagcacatttcggcggcccggaagccggcccaggcggtgcgcccaaatgtgagcgcaaacgacgatttgggcgcactttccgtctga

SEQ ID NO: 5813 - DNA, 453 bp, Methylobacterium sp.
atgctcgttcgcctcgccattgaagccgaccgccccgccctggtcgagctgtgcgtccaggcagtcgaggagagcgtgcggggtatcccgccggaccgggagatcatcaacgagacgatcgacagctccttcgcgaccgcggagccgaccttcttcgtagtcgagcgccagcgagagctgatcggcttcatgatggcctcgatcggaagctacgccttcgcctctggcatcttcacgacccagcaggtaatgttcgtccgtcccgatatgcgcggcactcgggcggccgcactcctgatccggcatctgatcgcctggagcactaggctcggcgcgaaagagatcacaggcggcaacaacaacgggctctacaccgaacagaccgctcgcctgctggagaagcatggtttcgagcgcgtcggggtgtttatgcgccgtccgggagtgcagtaa

SEQ ID NO: 5814 - DNA, 492 bp, Methylobacterium sp.
atgatcctggagcctgtcacctacgccacggccctccaggtcggccagggcatgcgcgagcgcgacgtgatggagttcgccgcggtcgcgccggtgggcgccgaggatctggcgtcctggcttgcccagcgcttcggccggcggtccgagctactctgcgcccggaccaacgacggcgagcccgtctgcatcggcggcgcggtcgaggtgcggccgggctcggccacgctgctgttctacggcaccgaccgcttccccgagatcgccctggggatgacccgcttcatccgccggcactacttcccgagcctcgccgcggcgggctcgcaccggatcgagtgcgtcaccctcgacagctaccgggagatgcagcgctggctggagacgctcggcctggagcgcgagagcaccctgcgcgcctacgggcgcgaccgcgaagacttcgccatgtacgcctggatcgacgccgatgctcgttcgcctcgccattga

SEQ ID NO: 5815 - DNA, 1611 bp, Methylobacterium sp.
atgggcacgatctggatccgtgagttcacgggcggcctcgacacccgcaagctggccgaaacctcgaagggcggcacgctcgttcaggcggtcgacggccacatcaaccggggcggcgagttcgagcagcgcgccgccttcgtgccggtctacaccctgccgaagggcaccgtggggctcgccttcaccaaggccgggccgaccgtcttcggctcgatccccgacccgggcgtgcccaacggggtgaactaccagcgcctccagcacccggacggcgcgaccgagctggtcgcggtccggagcttcgacctgttctccgggaagatctttgcggtcggcaccttcgcggacggcgacatctaccagttctacgacggcaagcgcatcacgaactacggcaccaacaccgccgtggtcccaggctcgccggtccggaccttcggtcgcaagctgtactacctgacaggcccgaacctgatctactcgaacctcgcggacccgaccaatttcgacgcggacagcggcacgaagctgccggacgggacgacgaccgacgtgagcgcgccagacgcggacgggaagaccacgaagacggagacgacccgcaagacgaacgcggacggtacggtcacaatcaccgtcgtcgtcaccaagccggacggctccgtcacgaccacgaccagcaccgagcccgccccgacgacgggcgtgggcgccggcttcaacgacctgtccgaagaggactacgggtccgaggatctgacggcgatcggccgctaccagaactacctcgcgatcttctcggaccggacggtccaggtccgctacatggacccggacccggcgctctcgaagggcatccagtcgctgcacaacacgggcacgatcagcccgcgcagtgtgacggagttcggcgacaccgacctgttctacctcgacgcctccgggctccgctcgctcaaggcgcgcgacgcctcgaacgcggccgtgagcaccgacatcggctcggcgatcgacgtgctgctgacggacttcgtcgcccagcagagcgccgaggacgtgcagaacgccatcggcgtgatcgagccccgcgatggccgcttctggctggcgatcggcgatacgattttcgtgttctcctacttccccgcggcgaaggtgagcgcatggacaatctacaagcccggctttaaggtcgaggagatcatcgtctacaagcggcgggtctacttacgatctggcgaccagatctatgtgtatggcggcctaggcgcggagctgctgtacgacgacaccgaagccgtggcttggctaccctacctcgacggcgaccggccgaccgagacgaagacgctccaggggatcgacgccgcggtccgcggctcctggcgcgtcgacatcggcatggacccagcgcaggtcgaggccagcgacaagatcggcgtcgtcacggagacgaccttcatggcgaaccggatcccggcgagccatcaggcgacccacttctccctgcgcttccgctcggacggccgctacctgccgaacaagccggcggtgctgggctcggccgcgatcacctactcggccgaaagcgacaaggcccggtcatga

SEQ ID NO: 5816 - DNA, 720 bp, Methylobacterium sp.
atggcccgcgggcagacgctgctcaagctgctggacgacctgcgggccgaatgccggctgtcgccgaacccctcccacaacgcccagcagcgcgagacgcaggtccgcctgctccagcgcatgcaggagtggctctacgacgactacgactggccgcacctccggatcgagcgcacctttccgagccagcgcggccagcgctactacggcctcccgaaggacatcgcgctcgaacggatcctgcacctggaggtccgcttcgggacgcgctggctcccggtcggcacggggatcgacacggagtgctacgccgggatcgacagtgacggcgggcagcagggctggccggtccggcggtggcggatctgggaggacgaccggatcgagctgtggccggtgcccgaccaggacgccgggaccgggatcggcgatgacggctcgatcaaggtcgtcgggatccgcaacctgcggcccttccgcgacgacaccgatgtctgcgatctggatgaccgcctgatcgtcctgtacgcggcggccgagctgctcgcggcggccggcgcgaaggacgcccagctcaagctccagcaggccgcggcgcgctacgcgaagctcaaaggcgacctgacgccccggcggcgcgtgcagatgttcgctgagcgccccgagcgcgccccgctgcgcggcatgccgatggtcgactaccgcccggcgagcaagtga

SEQ ID NO: 5817 - DNA, 660 bp, Methylobacterium sp.
gtgcccaagacggtcacgcccgccgagatccagatcctccagcgcatgcacggcgacgacgcggtgcatgacatcctgcccggcgagcccgtgcagcgctcgaagcagcaggagctgggccggctggccggcatgtactcggcccgggatgaggacgggaagccgcacctccaggtcatgttcccgagccacaccctgctcccgatgacgatcgacgagctggggctgcccgacgagttcttccgcgccacctcgcgcgcccggccgacgacccgcaccgtcgaggtgccggtcgagcagacccacggcgccccgagcaccccgccgacgcaggtcgggtgggacaacacggagttcgagccgaccgaggtcccggccgatccggagacgcagcccgagctggcgggcacgatggtcgacccgcgctcccagcaccagaacgacgagccgcccggcgtcgcactcgcggcgaccaacgacggcgacgccgacaagctccgcgcccgcgccgaggcgcagggcaccgggccgggctccgtcccgacccagaccggcgcccggacggacggcggcccggtcgagacggccggcgccaagacggccgagcagaagtcggccgaggtcgccccggcggcggacgccaacgccctgttctcgtaa

SEQ ID NO: 5818 - DNA, 1083 bp, Methylobacterium sp.
atgccgtttactgcgaacgaactggcgaacatcgccaactccgctctcgactactacctcaacaagggcaaggtcgagaagcagaacatccaggagaagcccatgtcgaaggccttcgaggcctccgctgggcagttcccgggtggtaagggtctggtctcgatcggtgtgaagggcggccagggcggcggctccttccagggctacacccacgacgatcaggtcacgtactacaacccggcgtccaacctgcgggtcggctacgcctggaaggagcaccacatcggcctgggcctgacccacaccgagctgaaaatcgacggcatcaccgtcgtcgaggacggcgcggaccagaccacgaccgagaaggacggccgcgagcagttcgccctggcgaacctgctcgaaggcaagatggaggacttcgacgaggacaagaaggcgtcctgggacaagctgctccacggcgacggcaccgccgacgcgaaggctctggccggcatccagtcgatcatcctcgacaacccggcggtgggctcgaccggcggcctgtcccgcgtcacctacccctggtggcgcaaccgggcggccaccgccgccgcggcggccgcgggcaccggccaggacgctatcgccagctcggcggctggcggcggcgtgctgatgcagttcctccagaaggaggatcggcagctcaagcgcttctcccagggcggcgtgaagctgcgccggttcgccggctcggacttcatcgacgccatggagcgcgagatccgtgcaaacggcaactactcgctcagcggcttccgggccgcgggcaccgtggatgggaagatggccgacccgacctgggacggcaacgagatcatctacgacccgaccctggacgacatgggcctcgccaagcggatgtacgcgatcgatatgcgtcgcatccgtctgatgtacatgatcggcgagaagaacaagaaggcctcgccgccgcgtccctacgaccgctacgtgatgtaccgcggtctcacctcgaccgcggtcatgatcgcgtcgcagctcaacacgagcggcgtctacgacatcaagtaa

SEQ ID NO: 5819 - DNA, 1029 bp, Methylobacterium sp.
atgcctttcgaccgtgaagatctccccgaggaactggacgaggctctcgaagtccaggccggttccgaggggacggacgggcaggccggcgccgatggcgccaagcctgctgatggcgagggctcgtccgcctcgcaggcgaaaaccgaagacgaaggccttctgggcgtggtccgcgacgcggccccggccaagaagcccgacgccgcggcggcctcgccagccgaaggtgccgaggcgggtgacaagcccggcgaaggcgctcccaagcagccggacaacgagaactactcggatgtcccgttcaataagcatccgcggttccgccagctcctgagcgagcggaacgccaacaagggcgacgccgagaagtatcggcaggtcgacacgttcatccgtgacaacgggatgaccgcccaggaggcggcagacctgctcacggtgggcgccatggcgaagacgaacccggcgaaagcctgggaactggcgcgcccgtgggtcgagaacctcttgaaggcatgcggggaggtgttgtccccggatctgcaacaggccgtccaggaaggacggatgacgcaggaggccgcctacgaggtgagccgctcgcgcgcgtccgtcgccgccatggaggcctcgcgcgggttcgaggagcgtcgtcggcaggagcagtcccagaccgagcacgcgcgctcgatcacgactgctgccgaggattgggagaccgatcgccgggcgagggacccgaactacgacacgaaactcgaactgatccatcgcgagatcgcgtggcgccaccacaacggcgatgtcccgaagacgccgcaggaggtcaaggcccagctcgacgacgcctacaaggccgtcaacgctgcgctcaagcccccggcgacgcctccggcggcagccccgggccggcaggcgcccccgcgcaccgcgaccaagcccgtcacgggtggatcagtggctggtggcaacgcgaagcccgcgccgcggtcaatgctggaagtcgtccagcaggccgcaggttaa

SEQ ID NO: 5820 - DNA, 2226 bp, Methylobacterium sp.
atgttcgacgccccccagaccgcactcgcggacgaagcgcctccgaccgctgccgaggtgacgcccgagcaggtcggtccggcgaaggagcaggccccgaccgagcaggagctggcgctccagcggcggatctcgaagacgatccgcgaggacaagcgccacttcaagaaggccttcgagcagatgcgcagtgatatgcgcgtcgcgatgcgcggtcacgacaaggattggtcggacgacaagtacaaggccaatatcacgggccgtcacgtcaaggccaagaccgccgcgctctatgcgaagaacccgaaggcggtagcccggcgggccgacaagattgacttcaagatctggaacgaggatcagcagtcgctgctgatggccttccagacgatgcaggctgcccagcaggccgcgcagatgtcgcaggcccaggcggccggcgacccgaacgcgctggcggccggcgccacggcgcccgagccgcagctcccgccgggcttcgccgaggcccaggccctgatccaggacttccaggagggtatggccgcgcgcatgcaggcccagcggatcgcgaagacgctggagaagctgttcgctcacgcgatcaaggagcagcagccgctgggcttcaaggagagcatgaagcagaccgtccggcgcgcctgcacgaccggcgtcggctacgtgaagctctgctaccagcggcagatgggcccgtccccgagcgtcgagtatcggctgaacgacagccgcgtgcgcctggagcacctcaaggccctgatcgaggcccagcagggcgacgaaggctccgtggctgacctggaggccgaggccgccgagatcgaggccatggtcgagagcctgtcggccgagcccgagatcgtcacgtccgaaggcctggttttcgacttcccgcagtcgaccagggtcatcccggaccgcctgtgccggtcgctcgaaggcttcgtcggcgcccggcatctgacgctggagtacctttacaccccggaggaggtgaaggagatcttcggcgtcgatctcggcaagaagttcaagccctacctcgccagcgggaagctcgctgacgacacatccgagagctaccagcaccagagcgacattctcgacagtgaggagccggccggcgagcagccgaagggcgatctgtgccttgtctgggagtatttcgacaaggcggcggggctcgtctactacgtctgcgacggtcacgagggcttcctcaagcctccggccgctccggatgtctacgtcgaccagttctggccggtgtgggcactcacgttcaacgcggtagagagcgaggacgagcttttcccgccgtccgacgtggcgctgctgcgcgacatccagaaggagtacaatcgctcccgggacggcaagcgcgagcaccgccgggccgcgcgcccgcgctgggtgttctcgaagggctcgttcacggatgaggacctgtcgtggctcgggaccgccccggcgttctcggccacgggcctcaacatcgatccgacgaaggacatcaagacccagctccaggccgtgcccgtgccgggcgtggacccgaacctgtacgatgtcggggagatcatggccgatctccagtacgtcgtcggcaactcgacggccgggctcggcgcgccgcagaagggcaccgcgaccgccaactcgatcgcggccggcgccaacgccacggccgaccagtcggcggtggacgatctcgacaacttcctcaccgcgatcgtccggggcgccgggcagatcctgatgcgggagatgtccgaggagaccgtcgtcaaggtcgtcgggccgggcgccgtctggcccgagatgacgctccaggagatcgcggacgaattgtccctggagatcgaggccggctcgacgggcaagcccaatcaggcggtcgagatcgcgaattgggagaagatgctgcccttcatcatgcagatgcaggggatcagcccgcagtggctggctcgcgagacgctccggcgccttgacgaccgcatggatctcaccgacgccctggtggacagtcttccgtccatcgtcgcgcagaaccggcaggcccaggccgctccgggagatcccaacgctcagccggacgcccaagggcacaacggcgcagcaaacggcccggcggcccctggtgggcccgccggacgtggcgcaccgatgggtgcgcagtctaaggctccaccagtctga

SEQ ID NO: 5821 - DNA, 408 bp, Methylobacterium sp.
atgcagcttgatctgacgacggcctttgcgttcatcgcatgtatcctgagtgttggcgcgctcgtcttcaagtctggcggtcaagctcaggctcagaagtcattcgagacctactcgaccaaggtcgacgccgaccgccagaaatggcgcgaggacttcgagaagtcggttgagcagcggttcggcgccgtgaacggcgcggtgacgctttgccgcgagcaggttcatgacgttcgcgaagatctcgcgaggaactacttaactaaatccgaggtcaaagagatcgagcttcgtgtctcgaacagccaagacaggatcctcgaccatctcgataagatcgacactcggcttaacgagatgcagacccgcgtactcgaagcgatcaacaaggcaacgtcccgtggctag

SEQ ID NO: 5822 - DNA, 1158 bp, Methylobacterium sp.
atgcagtcacgcctgccgacgatctgcgccaattacggcgtccgagcccagaacgacttaggctacactcgcaacaaggtcgccggactgttcggcaacggcgatgtcgagagccagggcttcaacaccctccaggagatctcgccggtcgttgcgggctcggccggcggctacggctggatgcagtggaccgggccgcggcgccgcgcctacctcgcctgggcctccgcgctcggcctcgatccggccgccgatgagacgaactaccgctacatggtccacgagctgctgacgatcgagacggcggcgcaccgtgcgatcctagcgtgcgccgacacgcccgaggcggccgcggccgtggtctgcacgaagtacctgcgccccgggatcccgcacctcgaccgccgcatcgccagcgccaaggccgcggtgagctacatcggaccggcgaagggcgccagctcgcccgacgtgggcccggtcggcgtgcccatcagcccggcggcgccgcccgtgcgcctccagcgcggccagtggcccgaggacgccctgacgcgcttcgaggtccaggcgatccagcagcggctgctcgatctcggctaccatgtcgtaggcttcgtggacgggaagtggggcgagcggaccgccgcggcgatcaccgccctccaggagaacgcccacaccgcgctccagcggaccgacgtggcgatcgacggacactacgggccccagacccgcgcgctgctcgccgacgacgccagccgtgccaagccgtcgcctcagcgtgccggcgtgacggccaagacgctcgccaaggccggcaaccccgttgtgaaggccggcaccaagatctcctgggcgtcgctcgggtcggtcctggccggcgcgggcgctctggccggcacgctgtcgtcgacctggacgacggagctgccgtggccgttctccatgctggcgggcttcctgccgccgtgggcgatgctctgccttgtcgtggccttcaacctctacacgggcctcaaggcctccggtctgatcggcacggccgtcgagcgggtgcgccaggggatcgacaacacgggcgccgcccaggatgggcccgccaagctcacgctgcccaacctacccttcggtctcgacaagctgctgccccgatga

SEQ ID NO: 5823 - DNA, 1305 bp, Methylobacterium sp.
ttgttctccttcaccgcctttcagcaggcgcaaggcgacgacagcttccccggcaccgagctggatgttgagctggacacgacgaacaacgccctcgacgcgctgctcgacgccttcaagacagtcctgcgggcggacgggaagctcgccaacggcatcgtcacccgcaacagcctcgccgccgacctgatcctggggatcggcgcagcccggccgtggagccccacgcagccctacctcgccgacgagaccgtcacccgcggctaccggatctaccgggccctggtgccgagcctgggcgtcgacccggcggccggcggcacgagctgggagttggccgccgacctgtcacaggcggtcgtgatcgccgatgggggagtgggcacggccgcgctccaggacgggagcgtcacgaacgccaagctcgccgccgggatcgacggcgccaagctcctggacggctccgtgccggcctcgaagatcggcgccgggctcggcaccgtgccgatcggcgcccgcatggcctacgccggcttccgggcgccggccggctggctgttcgaggccgggcagccgatctcgcgaaccgattacgccgacctgttcgccgcgctcaccgagacgctccaggtggacatcggcgccgggcagaagaccctgctcaacgcctcgaagtcgatcgcggggatcggcctccgctcggcgatcgtcgagggtgtcgggatcccggccggcgcgcggctggtgagtgacgccaacggccagctctcgatcaacgccgcggcgacggcgagcgccgtccaggcgacgatccgcatcttcccgtacgggaacggcgacggcgcgacgaccttcaacgtgcccgacagccgcggccggaccgacttcggccgcgacgacatgctgtcgagctattggggcacgggcgccgggcgccttgtcgcgaccgtcgacggcggcagcctccaggccggcgctttcgacgccggggcgggcaaagagcagaccctgctcaagatcacaaacctgccgaacaatctgccggcgggcaaagtcacggtaaactttccgaagcagaacctcgcgacatacggcgctttggcgactgcatcggtgacgactgccagtggagcccttcccgttcagaacgtctggacgggcacggtgaacggcgaaagcaatccgcagcaggcaagcgcggatttccaagtcgacgggacaaacgcgaacccgaccgggtcgcagccattcagcatcgtcccgcccgctcacgtcacgaacaagatcatcttcgccggagtatag

SEQ ID NO: 5824 - DNA, 321 bp, Methylobacterium sp.
atggcacgctttccactcaccgctgccgcgcttgagcacgaggccgaggagctgatctcgggcctgctggctcagccggcgttcaaatccgcaatccaggagcttctgatggcctccgtgaaggaactacgtgacgcgctcgacggcgcgaaggcgagcgtcgacagcctgaccgccaaggtcggacaggtctccggctccgggatcgacccggccgatctggatccggtgctcgcggaggtcaacacccttcgctcgaccgtcgaggccctcgcggcgtcgctgcccgagcccaagccggccgccgcgcccgccgcctga

SEQ ID NO: 5825 - DNA, 1353 bp, Methylobacterium sp.
atgagcatcaaggctctccgccagaagcgcgccgacctggtgaaggaggcgcaggccaccttcgaccttgcggcgaaggaaaaccgcggcctcaccgaggccgaggcgcagcgtgacgacgcgatctccgccgagctgacgcagctcgacgccgatatcggccgcctggagcggcagatggagcgtcagcgccagctcggcgccaccgtcgacgacaacgccgagagcgagcgccgcgcccacgccgagccgcgcggcaacgacaagcccttccgcagccttggcgagcagctgcgcgccgtcatgtcggcctcccgaccgggcgggcaggtcgacccgcgcctgagcatggacggcgccggcttctcggccgggccgaccggcatgtccgagggcatcgcggccgatggcggcttcttggtgcagaccgacttcgccgccgatctgctggccaacacctacaacgcgggcgagatcgccagccggatccgcaggatcccgatcgggccgaatagcaacggtctgcgcgccaacggcgtcgacgagaccaaccgggcgaatgggtcgcgttggggcggcatccaggcgttctggaccggcgaggcggccctgaagcgccagagccagcccaagttcaagcgcatcgccatggagctcgagaagctcaccggcctctgctacgcgaccgacgagctgctgcaggacaccacggcgctcggctcctggatggagcaggcgtttaaggacgagatgctgttcaaggtcgaggacggcatcgtgaacggcaccggcgccggcatgccgctcggctacctcaactccggttgcaccatcgcggtggcgaaggagatcaaccaggccgctggcacgatcgtcgccaacaacatcctgaagatctggacccgcatggctccggcgaaccgcaagaacgcggtgtggctggtcaaccaggaggtcgagccgcagctcttcgcgctgatgctgctggtgaagaacgtggccggcaccgagaacgtcggcgcgatcgccttcccgcaggtcacctacacgccgcccggcgccaacgggaacgaatacggcatgctgatgggccgaccggtgatcccggtagagtacgccgcgccgctcggcacggccggcgacatcaccctcgccgacctgtcgcagtacctcggcatcgacaagggcgagatgaagacggattcctcgatccacgtccgcttcatctacgacgagacctgcttccggttcgtctaccggttcaacggccagccgatctggcagcagccgctcatcccctaccgcggcacggcgaccctctcgcccttcgtcaccctcgccacgcgcgcctga

SEQ ID NO: 5826 - DNA, 237 bp, Methylobacterium sp.
atgcggtgggcgatcatccgacagcagcaggtgctctaccgcgggacccgcgaggaggtcctggccgcggccgagcgctacgacctgatctgccacaccgtgccggggatcccgcagccgctcgacggccgcggcttctacccggacggcgccgagattccgccgcggctccgccagggcgcggtgatgttgccggaggacatgcttccggtccggcttcggaggcgcgctgcatga

SEQ ID NO: 5827 - DNA, 372 bp, Methylobacterium sp.
atggttgagcaccgccgcaagccgcccatcgtggcgacgccgcgccggaagcactggcgcgagcacgtgcggctcagcagcggcgagctgcggccgacggtctggaccgccatccgcctgccgaacggcgatcagcgcggcaagacgttcacccgcgccacccgcgtgcagctccgtctgagagaccaagccgagagccggcagttcctgttcctgcccggcaccaagatcccgcgaccggccgccctctactggcaggacatggtcagcctgccgctggtcttcgccgaggtcgaaggccgcctctggcgctcgcggcggccggtccgccgcttcccgcaacgtccgctccgtgaggcgagccatggctga

SEQ ID NO: 5828 - DNA, 153 bp, Methylobacterium sp.
gtgctccttgacgcctcgcatctgccggtgatggaatcggaccggacctttccgtccgaggcgcaggcgtcggccgccgcgctggcgttctcgaagctcgtgacccgcgccggcaagacgctgaccgcgccgacgtcgggcggcctgctctag

SEQ ID NO: 5829 - DNA, 657 bp, Methylobacterium sp.
atggatcgcaaaagccggcacttcagaacgttcgccgacgacatgaagcagttcgccgatttctcggacgtcgctgaccgcgacctggacggccagacaccgttcctgccgaacggctatttcagctacggcgacgcattggccctgacaactgtcctcgccacgcgcaagccggcccggtatgtcgagatcggaagcggaaacagtacaaaattcgctcgccgcgcaataggcaagtacaagctcgacaccaagatcgagtgtatcgaccccaatccgcgctcaagcgtccgcgacattgcggataactggatttctgacggccttctcgatgttgacccgtcctactttgaatccctgaacgatggcgatgtgttgatgctcgatggcagccatctcctgttccatggtagcgacacgacgcatttcttccttcgaatctacccgcttctccggccaggggtgatcgtgcatgtgcacgacatccatctgccgtatgagtatcctgaggtttgcgacaggctattttggaacgagcaatacatccttgccatgatgttttactacaagcctgcatccgatattatcgccccaatcaagtacatgcatcgtgagggcatgtgcgacgagggtgccagcttctggttcgaggtctag

SEQ ID NO: 5830 - DNA, 330 bp, Methylobacterium sp.
atgcgaccctggccgatcctggtcctcctcgccgcgctgctcggcgggctggcgagtgcgcccgcgcgcgcggcgcccctgccggtccccgcgagcgccgaggccgccgcgcccgcccccgcggtgcagcaggcccactggcgccaccgccgccactggcaccgccgccaccactggcggcgccactggcaccaccgccgccaccactggcaccgtcgccatcactggcaccggcaccaccatttccgccgccactggcaccgccaccacgtctggcacggccggccgtacggccgcccgtacggccaccggcacgtcacgttctactga

SEQ ID NO: 5831 - DNA, 366 bp, Methylobacterium sp.
atgcgttcactcgttttcggcgccgtccttgccgtcgtcatgcctctcgccgcgcaggcccaggacgccggcgacgccgcggccggcgagaaggcgttcgccccctgcaaggcgtgccacaacttccagaagaacggcgtgggccccgacctgaagggcgtcgtcggccgcaaggcgggcacctacgagggctacaactactccgccgccctgaagaactccggcatcacctgggacgaggccaacctgcacgagtggctgaagaacccgaaggcgaaggtgcccggcaccaagatgatcttccagggttaccccgacgacaagaagatcaacgacgtcatcgcctacctcaagacgcagtcctga

SEQ ID NO: 5832 - DNA, 165 bp, Methylobacterium sp.
atgtcgatgatcgccaccggcgggtgcctcggaagcaccctgctctgtctcctgaccgcgtcgtcgggaccgctcctcgccctggcgggcttcttcggcggcggcacggccgggggtctgctgggcgccctggcggtcgcggccctcggccggggtcgcgcctga

SEQ ID NO: 5833 - DNA, 303 bp, Methylobacterium sp.
atgcgcgtcacatccgccattggcctcgccaccgtgttgctctcagcggggtccgccgtcgccttcgcccccgcgctgttcgcggcgggaccggccgccgtagcccagctgtgtacggagagtgcagggaccgtctcttgtgcgaacggttatgcgggcttccgaggcccctcggggaagctctggattggcaaagatcgccgggggaccgtgatcgtcagcatcgatgatcgtcggaacgatcaggagtcactccggcgcgagcaggatcacggacgcttcgtccttgagcaggcgtggtga

SEQ ID NO: 5834 - DNA, 99 bp, Methylobacterium sp.
atggccgcgtggtcgatcgtggatctcctgtcggtcatcggatctcgccccgcggacgaggcgcgcatcaccgcgcaggcagatcggatcggagattga

SEQ ID NO: 5835 - DNA, 267 bp, Methylobacterium sp.
atgaccacagtggtcacggagggcaccatgcaggagatccagcttcgggacgccaaggcgacgctgtcggccgtcatcgaccaagcgaagcagggcgcgccctcgatcatcacccgccacggccgccccgaggccgtgctgctcagcttcgaggactggcagcggctgtcccgcgtcccgtcgttcggccgcctgctcatggccgcgcccctcgcggcggacgacctcccctccccgtccggcgggctcagaagcgccgagctgtga

SEQ ID NO: 5836 - DNA, 1347 bp, Methylobacterium sp.
atgcaatccacccctccgtacggtgagccgccgctcccgatcagttccgacgcgatcgccgacggcccgaaggtccccggcgcggcgcggcgtcgctccgtggtcgcgggcgccatcggcaacacgctcgaatggtacgatttcgccacctacggatatttcagtgccgtcatcggccggaacttcttcccgtccgacagcccgacgacgtcgctgctctcggccttcgcggtgttcgccgccgccttcttcatgcgcccgatcggcggcatcgtgttcggccacatcggcgaccgctacggccggaagacggcactcctgctgtcggcgggcctcatggcggtctcgaccttcctgatgggctgcctgcccacctacgcgtcggccgggctcctcgcgcccgtcctgctcgtggtgctgcggctcggccagggtctctccgtcggcggcgagtacacctcctcggccatcttcctgtccgagaccgcagcaccggcgcgccgcggcctgaccggcagcctcgcctgcatcggggccgcaggggggatcctgctcggctccattgccgggacgctcgtcaccggcctgctcacaccggaagacgtgcaccagtggggctggcgcctgccattcctcttcgggatcgtgctcggcgtcttcatcttcgccctgcgtcgacatatcgacgacgatcacgtcgagaccgtgtttcgcgaagatcgggcgcctgcggaccagcgctcaccgctgcgcacggcggtcgagatcgacggctccgccatgctgcgcgccttcgcgatgaatctcggcctggcgtgcggcttctacgtggtgttcgtctacctcgtgacgttcatgcacactgtgtcgggcctcccgcaacacacggcgtttctcatcaactcgctcgccatggtggttcaagccgtgtgcatcccgatcgccggagccctgtccgaccgtttcgggcgcaagcgtgttctggtcctgaccggggcgggcctgacaatcctgtcatggccgctcttcatgctgctgaccaccggcgacacgcttctgatcgtcctgagccaggtcgcgttcgcgatcctgatcgccggcaacgccgccgtcgttccgacggcgttcgtcgagatgttccagcaccgctcgcgctgcacggccctggcgatcagcttcaacgcctcgatggcgctcgtcgggggaaccgccccgatggccgcgacgtggatcgtccaccacctggcctggcccacggggccgggcctctacgtcgccgtgctgtcggccatctcgctcgccgcagtcctcacgatgcgcgatcggaccggagaatcgctcgcgtga

SEQ ID NO: 5837 - DNA, 672 bp, Methylobacterium sp.
atggagaccccgaccggggatcacagcggcgccttcgaggcgtccccgctcgccgcgattgccgtggcggtcgcccgcggtgacgtcgcacgcatcgccgcgctggcgcccggcctggatctctccgtccgcggcggccggaacctcacccttctcgaatgggcgatctggaacgcgcggccgcgcgcggtgtcggccctgctcgacgcgggggcggacccgtccgtgccggggctcgatcaggagaccgcgctgcacatggcggcgatggtcgaggacccgacctacctggagatcctgctgcgtcacggcgcgccggtcgacccggtgagcccgcgcggtcagtggacgccgctgttccgcgctgtccagaaccggcgcgaggcgcagatcgcgctgctgctgagggccggtgcggacttgaaccgggtcgacgccaccggcaactcgctgctgcacgtggccgcgcaggtcggagcggccaatccctgggtgctgaggctgctcgaggccgggatcgacccgaccctgcgcaacgcgcagcagaagaccttccagccgtacttcttcaccacccccgagcgcctgctgaacgattccgggcgcgagacccgcgcggcggtccgggcgtggcttgcccgcagaggcgtcccggcggatccggaccgctga

SEQ ID NO: 5838 - DNA, 87 bp, Methylobacterium sp.
gtgaggagcgacaccatgctgaccgccctctcgccgctccacctcgccgccctcagcctgatcgtcgcgtatctcggctggggctga

SEQ ID NO: 5839 - DNA, 225 bp, Methylobacterium sp.
gtgcagagggcgcgatcctggtaccggcgctacgggcgcctgggcgcgccgcagacgccgcgaccggccacgcagggcccgcaggccgttcgcggacgctcgctggaggactgggcgcggctcggcggcggtctgctcggcccggaatccgcagatgccccgcgtcctgagatccgcgccgaccgagcggtcgccctcggcatcccgatcagtccgccggactga

SEQ ID NO: 5840 - DNA, 522 bp, Methylobacterium sp.
atgcgcctcacgacacgcacgccctcccggccgcgatccctgatcgtcggctgcgccgccgcggcctgcgcgttcctggccgtgccctcggaggctcccggtcaggccggaccgggatcggaggaggcgctcgtgaacggaatccagaccatccggcgcggcgacaccgtcacgaaggtcgaccggaccggcaagggtgcggtgctgtgcatgcgcggcatcctgcgggcgatgcgcgccgtcggacaggcgtgccacgacggcgccgacccggacttccagcaggaactgcgcgccgcgctcgcgcgcatcgatcggttcatcgccgacaacgccccggacagggccgtcccgtcgcgcgacgggacgacggaaccccagcatcggcctggcgcggtctgcggccgcgacgcggaggccatgtacgaggcgctgcggaccggcggcgccgcgggcctgcgcgcccaggtcgacgacctgctctcgatcccgcgcgagccggtcatgaatccgtgcctgtga

SEQ ID NO: 5841 - DNA, 525 bp, Methylobacterium sp.
ttgctgatcgtcgcgcatgaggacatcctgccccgcgtatgcgggacggatggtcagagcacgatgttcgagatcgcgcaggatgatctgtccgatacgcagacacgggcgttgctggcgctccatctcgccggcatgcacgcatcctcgccgccgggtagcgtgttcgctctcgacctttcaggccttcaggcaccgggcgtgaccgtctggacggcgcggcgcggcggtcgggtggcgagcgtcggagcgctcaggatggcgacggacggcaccgcggaagtgaagtccatgcggacgcacccggacttcctccgcctgggagccggcgcggcgatcctcgacactatcatcgcggccgccaccgcccgcggcgcgcggcgtctgagcctcgagaccggatgcgggcccgcattcgcacccgcgctcgaactctaccggcgtcgcggcttcgtgagcggccccgccttcgggacctacgtgccgagcgacttcaaccagttcctccatctcgcgatcgcctga

SEQ ID NO: 5842 - DNA, 666 bp, Methylobacterium sp.
atgaagcggctcatgtcaacgcctcccgaccgccggtcccgcaagcgcctcgccacccggcaggccatctccgacgccgccacgcagctgttcctggagcgcggcttcgacgccgtgacggtggatgagatcgcggcggcggcggatgtcggccggatgaccgtgttcaaccatttcccccgcaaggaggacatgttctacgaccgcgacgaggaggggcgcgcactcctgcgcgagaccctgcggcagcgcgatccccgggtcgcgccggtcgagacgctccgccagctggcgcaccggctggtgacgggccggaacccggtcgtggaattctcggcgcgcagcggcgccttcgtcgcgacggcggccgggagcgagacgctcaaggcccgggcccgggcgatccgggacgaactcgcgggcgtggtgcgggtcgcgctcgccgaatccgtcggccgcgggccggaggatcccgacgccgacctggcggccggcctgctgctggcgacctggagcgtggccttcctccgggcgcaccggaccttccgggcgacgcggcggacggaggcggcgaatgccgccttcctggcggtcgtcgaccgggggacggccggcctcgtggcggcgctggccggcacgccgtacgcggaggccgccgcgccctga

SEQ ID NO: 5843 - DNA, 114 bp, Methylobacterium sp.
atgaccgacgccccagacccgccggaaggaccgcccgggaaaacggcgctcctggtggtcctcaccctcacggccgttgccgccgccgcctacgtcctgatccacatggactag

SEQ ID NO: 5844 - DNA, 1527 bp, Methylobacterium sp.
gtgaacacgatctccgccgcggtccagaaacccgcccccaaacccgatcgggatctcgcaccgtccccacatccggcgggcgaccgtcagacgctgccggatccggcggagcggggcgccttcgacctggtcctgcgcgcggtctcggggggaactcccgcggcccgacccgagaccgacgagggtgagatgggcgaaccggagagcgagaccggggaggacccgcgacccgaggctggcgcatctcccgcgccgccgtcaccggtcgatcccggcaacgccgccgcggcgctcgccgagatcctgagcgccgccgtcctggctgcccgtccggagatgcccgcgggacacggggccggtgctccgggaccggccccatccgccgcatccccggcgggccccgacgcggccccggaaaccagcctcgcggggaatctcgaggcggcccgcgcggacgcgtcgccgcgcgccgggtcgagcccgggccccctgctgcagggcagccccccgaagatcgaggtcctcgaccgggcggttcacttcaagcccgtcctgcccggggcggcccggcacgtcctcccggccgccgcagcggcaacgtccccgttgccggccggcccgaacgcggcggacgctcagcctcgggccgatcgccccggaccggtggttccggccgtcgccgggcccgatccagctccgatcgcgacggccgcccaagtcgccgcccagattgccgggacggtcgccgggaaggtggccgccgcgccgccgaaggcgacggtcgccctcgcgaccgatcccgagccgcgagccggcgatgcgtcggcccgcgccgccgcgacggggatcgacgggccgggggagctcacggcacgcgaggacaaccgttcccgctccggcatcgccggactccgcctcgcccccaccggccggcaggggccgccgggcggccccatccccggtcccggcaacggatccgggaccgagccggcccggctcgccgccgtcctgccggcgatcgcggcggccatcacggaggagatcgagcgcgcgaccgcggccggaccggagcgtcgcgtcggcgccgatccggcgatccccgcggctcaggacgggccgctccgggtgctcaagatccagctccggccggaaagcctcgggatcgtcacggtggagttgcggctcgtcgacggtcagctcgagacccatctgcgcgcggcgcgtcccgagacggcggcgatgctgcagcgggattcggcgatcctcaccgaactgctcaagcaggcccattaccggcccgagatcattgtcgagccggttcgccccggcgacgccgggttctccgcgggcggatcaccgtcacagggccaatccggcctcaccgacggcggcgcccggccgggtcacggcggggacggacagcggcaggaagaccagcgcgcggcgaagcggccgacgatcggcaggcgcgacggggagcggacagatgagacggtacgtcctcgcgacggcggcgtttatctgtag

SEQ ID NO: 5845 - DNA, 135 bp, Methylobacterium sp.
atggccgaaatctgcatcacggaagaccagaacggacggtggaccgtctacaccgccggactggtggcgaccgatctgacgcgcgaggccgccgaagccttcgcggcgagctaccgccgcgtcgcggccggctga

SEQ ID NO: 5846 - DNA, 267 bp, Methylobacterium sp.
ttgacccgatcgatccccgcccccgccctcgtcctcgccgccgccacgctggccgcccttccggccgcggcccgggcgcaggatcggcccggccccggggcggcgcctccggccgagaccgcgccgaagccggcggccgacacgaaggatccgggcaagaccgcgacggaggccgtcacccacccgtccgccgtgccgccgacggagggcgcggtcggcaccggcaagcccccggccaccggcgacgccccgacgaccggccggtaa

SEQ ID NO: 5847 - DNA, 201 bp, Methylobacterium sp.
atgcaccgcatccgcctcggccttcggcggagggcccctgtgccgccggcgccggcgctgcccgagagcctgacccgctacgtgtcgccgccggctcccgaggccggcttgatcaccgcaccgctccgggacatcggcatggcgctgctggtcggtgtcgtcgtcgcgctcgtcggcggccggattctcgaagcctggtag

SEQ ID NO: 5848 - DNA, 513 bp, Methylobacterium sp.
atgcgcggcttggtttcgactgcgacgctctccggagtgctggcgcttgtcttcagcatgccggcatcggcggcctccgatatcacggtcgctgccatcgccaccggtcgcctctatgttgtcgggacgaccgatcgcccgcacacggccgtgattttggacaaccggttcaaaacggaatccgacgagaacaggaagtttcagtacgagttggtgtatcatcctgccaattgtgtggtttccgccgcaatcgatggaacgatacacgaagcggttgtcagcaattgtgggcagcaggtggtgcccggaacttggctggacccgaagcccgcgatgaggaggccgactcctctggaacgggtgctctccccgacggtcgaggtgccctccaccgtcttctgcccctcagttcagacagagcgctcgcaggatccggcacgcatcgagcttgctgaccgcacgccgccggtcttcaccgtcgtgacgggaatgaatttctcgccgcgctactga

SEQ ID NO: 5849 - DNA, 96 bp, Methylobacterium sp.
atgatcctgagggccgagcaggtatcgaccggcttcgtcggcggccgcattcgcgtgcgggctgccgaacagcaggacgcacgtcgccgcaactag

SEQ ID NO: 5850 - DNA, 945 bp, Methylobacterium sp.
atgatgagacctcgctgggtacgccgcgatctgctgaaatcgtgcttccgggatctaccgatctgcgcggccgcgtccctgctgccgaccagccgctcgagcgcggcgatcgacgcctccgtggacccgacgcagggccgcacactcgtcttcgatgagcccttcgcggagatcaacggacggatctggaatggcggaccgaaggccacgaccgggccgtccggcttctacggccgttccgccttcgctccccttgccggagcggaaggcttcaaaccctacgagatcgtcgcggatgcggaggccacgggcggcacggccctccagatttccgcgaagtatatcggacgcaagatgagcgtcgtgaactactatgggaacaacatacccgactatcagtggatttccggaaatctgcagaccggaagccggagcggtgtcgtatcggtcggctggcgccacggttatctcgaagcgcggatgaagtttccgcggcatccgctcacgtggccagccttctggcttctcaaccgagaaggcatcaccaatgccaagcggagcattgaggtcgatatcgtcgagcacaagggtttcgagccgaagctctacggcgcgtacctgcacgaatgggggcagcccggtgagcacaacgaaggcaccggcgttcccacacccgtcgacatgaccgaacagtactgccggtacggcgtactgatccatgacggccaatgcattccttactttgaacgaaaaccgatcatcaatcctaaaacgaatcagctcaatgtctggacactcacccgcgcatcggagatggaacaggccggcgacgtcttctggccgctcctcacattggcgttgcggacggatgtcccggcccctcaactgaccgaagcgcagaagctcacccatatgcgcgtcgattacttccgcgtgtacgcgtaa

SEQ ID NO: 5851 - DNA, 885 bp, Methylobacterium sp.
gtgcgtgacgccgtccgcggacggccgggcaccgcgtcaccgcgcggttcgacggggcgcgcgaggaccgggctgtcgcggcgatcgctgggcctcctggtcgtcctcgcggcgacggcggtctggctcgccgtcgccctcgtgcccaacctcctcgggaagggcggagccctgtgggcgatcgtgcacggcgcgtgcgtcccccacgcgttgcgcggacagggccccgcaccgtgcagcctggtcgacctggagggcggggtcgagaagggatacgccatcctcaaggacctccgcgggccggcgcagttcctcctgatcccgacggcgcgcatcaccggcatcgagagccccgtactcctccagcccggcacgacgaactacttcgccaaggcgtggcgcgcccgaaccttcgtggaagggcgtctcggccatccgctcgaccggcgcgacgtcagtctcgcggtgaactcgcggctgcggcggactcagggacaactgcacatccacatcgactgcgtccgccgggatgtccgcgacacccttcgccgcctcgcacccacgatcggggatcgctgggcgcctctcgcggagccgctggtcggtcgcccgtacagggcgatgcgcgtgctcggggaggatctcggcaccgcggacccgttcgacctgctggcgcgcgacgacggcgcgcgctcggccatgggcgagcacgccctggccgtcgtgggcgccgagtttccgggtgcgaagccgggcttcgtgctcctggacggtctggtgaccagccgcttcggcaaggcctccaacggcgaggtcgtgcaggaccacacctgcgccgtggcggcggagcccgcgtcgagcgggtttcggccgctggaagactga

SEQ ID NO: 5852 - DNA, 300 bp, Methylobacterium sp.
gtgcggaacgcgggcgccgccgtggggcccggcaccggacgcggtgacgccgccgcgcttttcgcgctccgaatcccgcgcggccccttctcggacacctatccgatgggccatgcctcgagaggcctcgtcatcggcgccggactgggacatgcctgtccgcaccccgatgccgtcggcggccgcaaccgatccggcggcgctctgccgggatcgcggcgcgaacgacaggggtgggacgacgcgcgcgaggacctgctcgacgcgcgctccgggagccgggaggccggcgaccgctga

SEQ ID NO: 5853 - DNA, 165 bp, Methylobacterium sp.
ttgctgttcagccgtcaagctgaaccgaccattcggacgtcggatctggtcggagccacggccggggtcgcactcctgggcggcctgtgcttgctgctcgtggccctgctcacgagcgaggcccaggggttcacggatctcacgtcgatcctcacggacaggtag

SEQ ID NO: 5854 - DNA, 282 bp, Methylobacterium sp.
atgctgacgaccctgctcgccgcgatgatccgggaggtgcccgtcgtctggtcgacctcggtcgatgacggaccggtcgatcgcgtgaagcccgacatcgtcctgaccgagatggccgagcggttgctccatcagaccgtcgaggacgacttcgctgtcgcggcgcgggtcgccgggcatgccgcggccgttacagcggggtggcgccggtcgcgcgaagcttcgccgcatgggcaaggcgcggggctaacgcggcccgctgccttcgaccgtcgtggttga

SEQ ID NO: 5855 - DNA, 174 bp, Methylobacterium sp.
atggctgtggagagcgcgaccgcgacggctgagtccttcacgatcccgacaggccaccacgtggacgtggccgaggccatcgaaatgcgctctccggcgaccagcctccgcgccggcgctccgccgcacgtggccgagagcgcgatcaacatgagtttcccgaggacgacatga

SEQ ID NO: 5856 - DNA, 114 bp, Methylobacterium sp.
atgttcaagaacaggccgaacctccatgcgacagccgtgatgaccctcgtgtgcctcggcgcagccaatgtcgtgatcgctccggcgagcgtgctctacctcctgtatgcctga

SEQ ID NO: 5857 - DNA, 225 bp, Methylobacterium sp.
atgcaggcatccgaatgctgcatcatccgggtatctatcgccgcgagcctcggctggctcatcgcgattaccctgatgtggaagcatggcgtgctggccgcgctgatcgtcagccccttgttcgggaccgcggcggcgatcgccgccatgacactgttctggttcgtgagcctgttcgtctcctgcgaacccatcgggccgcgagcgtctgacaccaaccggtag

SEQ ID NO: 5858 - DNA, 285 bp, Methylobacterium sp.
gtggcgaagccggcggcgccgccgcagcaggccgagggcgcgccgggctccggccagccgccggactctccgggccagggcgtcgacctcaacacggcgtccgtcgaggagctgaacgccctcggggccggcatgatcgggcgccggatcgtcgcgttccggccctacggctccccggaggatctcgtgacccggcgtgtcctgaagaaggccgattacgaggcgatcagggctgccgtcgcggtgcggcagaccgagtccgctggcgcgggccgcccggattga

SEQ ID NO: 5859 - DNA, 255 bp, Methylobacterium sp.
atggaagcgatcggcgtcgaggaccggagtggcggccggcgcgacgccagcgcccgcctgcgtcggatcgcggccgcgaccggcgtcccgctcgcggccttcttcggggcgccggcgccgcgcccgctggccgagctcagcgagctgatcggcctgtggcagtcgatcgccgaccaggagggccgcaacgcgatcctggcggtggcccgggcgcgggcggccgggacgaaggacggggcgggcgggccggcctga

SEQ ID NO: 5860 - DNA, 294 bp, Methylobacterium sp.
atgggcctcaccgcgttcgccgtgttcgtcattccgtgggtcctgctcgcggtgttcctcacgcggtccccttcaacgcttcgcctggggaccgcttccgcgccgtggcggtctatcccgacccataaggagatggcccgcgccgaccgtcgcgcgctgcacccgcatgagcggcgggcgggcgagacggacggagtctcgggccgggaccagcgcgttcggaccgatccgcccgcgggcggtgcgctgggcacgagcgtggagcccacggaacccgacgacaagctcagctag

SEQ ID NO: 5861 - DNA, 180 bp, Methylobacterium sp.
atgttgaccatgaccctcgcgctgttggccgttctgattgccggggcgctgtgtctcggaatgatctccgcgttcctgccgtttcagcgtccgcgcgaggagatcgagttggcagagttcgccgacgacgaattcttcgacatcggcggcccgatcatcgatttgcaggctacacgctag

SEQ ID NO: 5862 - DNA, 696 bp, Methylobacterium sp.
atgaacacgacagtcacagcgatcgcgtcggcaatccttgccggcgctctccttggggcgccgaccggagccaaggcgcaggcgggcagcttcgccaaccacggcttcggcaaccacaatttcggagctgcggccgtcggcggcggcttcgccaaccggggcttcagcaatcccggcatcggggccggcgccgcgggcggcttcgccaaccggggcttcggcaataacgccttcgggccggctgccggtgccggagggggtagcttcgccaataacggcttcggcaaccacaatttcggccgaccggccgtcggcggcggcttcgccaatcccgggttcgggcacgggttcggcgcccatcggggctacggtcatcatcgccactacggctacaaccgcggctactacgggcgcccctacggctatggctacggctacggacggggcggatacgcgctcggcgggctcggcctcggcgtcgccgtgggcggtctgtacggcggctacggttatccgggatacggctacgacaccgggtactacggcggttatgcgcccgtcacgtacggctacgccgacaccgaaaccgaccgtgtcgcggacgatgaccgctactgcgcgcgccggttccgatcctacgatccgcagagcggaacctatctcggccgggatggacgtcgccaccgctgccggtga

SEQ ID NO: 5863 - DNA, 132 bp, Methylobacterium sp.
gtgaccggcatcgatggtccgacgacgcgcgggcgactgcagcagatcgacacccacgccctcctgaccatcggcccccaccggcgccgctccgccgtcgggtccgcgcgcgagccggagcctgtgccgtga

SEQ ID NO: 5864 - DNA, 213 bp, Methylobacterium sp.
atgttgtgtaccgaaggagaagggcagcgcggcgttccgggcggtacccgcgccggtcccggcgcggcgcagccggttccgcgttccgatgcggcgggcgagatcggctctgcgcgtctgctgcaggggcgccgcgagatcgtcatccgccacggtgaccacgcctatcgcctgcgggtgaccgccagcgacaagctgatcctgaccaaatga

SEQ ID NO: 5865 - DNA, 153 bp, Methylobacterium sp.
ttgctggtcgtgctggtgttcgctgcactgattggaggagcgatcggcttcgcggttgttctaccgaagggtttcctgctcgcgctgctggccgcccaggccggggcggccgtcgccgtcggcctcgtcgtcctgctcacccgccgccgctga

SEQ ID NO: 5866 - DNA, 273 bp, Methylobacterium sp.
atgagtagtgaatcgacaggtcccgtcacggtccgcggcagcgtcggggtcggcgcgggggtcgcccccgcgacggtgcagggcggcccgctcccggcgacctcgggcggccgcgacggcgcggtcgggccgctggcgatcgagcggttcccgcgcccggtcggccaccgggaccgtcccgacgcgcggctgcggccgcccctgagtccggacaatccccggcaccgggtgcgccggattgacggcgcgcgcgccccgcaacccggccgctga

SEQ ID NO: 5867 - DNA, 162 bp, Methylobacterium sp.
atggacaggcacggccaggaggcgggcgcggacacggctgcggaggcaggtctgggcacggccggggacacggccggggacgcagccagggacactgccagggacactgccgaggcccgggcgccgtcccccgcgcgagcctccgctcggacggccacctga

SEQ ID NO: 5868 - DNA, 141 bp, Methylobacterium sp.
gtggcggcggtctgcatggggttcctccgggggatgcggtcgttgccgcggtggggccggttcgggctctgggtctggatgggagccattcgggcgcgcgccgtcgtttcccgcctgggcgggatcgaagcgatgcggtga

SEQ ID NO: 5869 - DNA, 924 bp, Methylobacterium sp.
atgcggtttgacgtcaggcacatctcgagctgccttgtgctggcgcaggagcttcatttcgggcgggctgcgcagcgcctcgcgacgacgcagccgggtctcagccggctcgttgcggaactggaggccgaggtcggcgtgaagctgttccgccgtacgactcgaacggtcgaggtgacggaggccgggcgtgccttcttggccgagtgtaggatcggtatcgaccatctggagcgggccgtgacgctggcgcggcgcacggcgaccggcatggccggcgtcctgcgcgtcggctacatggatttcgcgatcaacggccggttgccggagctggtccgagcgttcagcgaatttcgaccggcgatccggctggagctgtcgcacgtgccctcgcaatcccagcgcgaggccctgcttaacgaccgcatcgacgtcggcttcacgctcagcgcggtcgagaacgagcacttcgagagcctgctgttcgaccgcgactcctatgtggccctgctgccggtaacccatccactctcgaacgcgcgcagcctgaccctcaaggatctcgccagcgagccgttcgtgctggggtctggcgggagctggagcgcctatcgcgaagccttcttcgcgatttgccatcggcgcggctttcacccgaccatcagccaggaggcctcgtcgagcgagggtatcttcggcctcgtcgcggcgggaactggtgtgagcacctatgcgagctgtgtgcgcaacgtgcagcggcgcgggatcgtaatccgctccctcgacgacgtgcctgataccatcgcaacctacgccacttggatgaagccggcccgatccaccagccttgaagccttcaccaccttcctggcgacggtgtggggctcggcgccggcgcgttccaatacgcggtcgaagttttga

SEQ ID NO: 5870 - DNA, 822 bp, Methylobacterium sp.
atgaagctgtttgacgccgacctcgtcttccctcgggtcccggcgaccatgccaagtccgtggatgcccctcgaggttgggcgggccatgggggcaatctgcaagccccacgacgcgggcggagggacctcgttcctcgggcttcatttcgacgatcactgcttcggcccggctcctgagcatgtggcacacgctgtcttggccctccctgtccgagcgttcgacctcgaacctgacacgcgccgtgaggatctccgcaaggccttttatctggcggctcccggcttcgggcgccgtcctgacttcacgctgggggccggcgcgttcatggtccgcagcttcgagggcgcggacccccgagacaccgtgtacctgatctggccggtgcggtgcgacccgggtgaggcggggttggattgccacaacggcatgggtcggaaggcttttcggttcgctgccgacggcgccttgcgggatgtcagtgcggacgtgctgccggcggatccgctcctgagctccgacgaccgcgtgcgtcagacgaagtacggcggcagcgttctgtttctgctcgacgacaagctgccttatgcgcccaccatgcgctggatcatggaattcgatcctgactcgccaccgctcgagaaggacgatccgaaggccgcgggcccttgggcccacttcggcttcgtccactggaccggttctcgcttcgagctcgtagatcgaattacccgatcgcaatggccgtgtcggaaattccatgacgccccggcctgctcgacgtatcccgacgacttcgaggatccctttgtcatcccttga

SEQ ID NO: 5871 - DNA, 354 bp, Methylobacterium sp.
atggcggtcgagtcgtacggggattaccgtgactatttcgattcgaagcccgtgaccgcgaagcgcgcgccgcgcagcgcttcccagaagatgactcccatcgacatcactacagacctgagcgccgtgcgacgccgcgccgatggcgaccgccgtgagatgtaccgctacgacactgggtcgaggctgatcgctgacatgaggcctcgcaactgggacggcgggcatgttcccgtgcaaccgcacagttggtcgccggatggcttctggagcccgatggtacagtcacgcgaggggcgcgagcggcccgaccagtcattcgaggggcggggacggcccgagcgcttcaggtga

SEQ ID NO: 5872 - DNA, 450 bp, Methylobacterium sp.
atgcgctttgccgtcgccgcccttctctccgccgtgccgctcgccgcagcggcggacgatctcccgccgccggtggccgcggccatcgccgaggtcgaggccgcctgcggatccgcgccggcgacgctcgatccgttcgtcatcgaccggcaggacgtgaacggtgacggggtgccggacttcatcctcaacgtcggcggcctccgatgcggcgacgaagaagtctcccagtgcggcctcatgggatgcccgaagatcgtcctcgcatcctcgaagaacgggttcgtcgtggtgctggacatctacgcgcacgacctccggtttcgcccgctgaatggccggccggcggcttcggcggacgacgagggatggaattgcggctcggtccggagggggccgggccgcacgaccttcctgtgggacggaacgcgcttcgcctgcgccgagtag

SEQ ID NO: 5873 - DNA, 90 bp, Methylobacterium sp.
atggcttggtccgcccccgtcgtctccgagatctgtgtcggcatggaagtcaccagctacgagtccgctgagatcgacaccttccactaa

SEQ ID NO: 5874 - DNA, 96 bp, Methylobacterium sp.
atgaagcccaacacgatcgcgccgatctccagcgaccgacgcgggaacgggccggaccggcagagcctgccggtcgcccagggagaggaggagtga

SEQ ID NO: 5875 - DNA, 81 bp, Methylobacterium sp.
atgatggagttcatgaacttcgtcagcaccacgtccccgtacttcgggtccgggatgatctcacgcttctcggcagagtga

SEQ ID NO: 5876 - DNA, 144 bp, Methylobacterium sp.
atgaccgatcttctcgtcaccctccaggagccagccgaacccgccgggcaggccgggccggaatccgagacgtcggccctgcgcgcgcatatcgcgcggattctgcgcaggctgcctcccgccaaggcgacgaagacgacctga

SEQ ID NO: 5877 - DNA, 219 bp, Methylobacterium sp.
atggtagagcggtaccatttccgcctgagggggccggacgaggtcatcgaggacgaggagggcgtgctggcaaactcgatcgagatcgcggtggccgaggcgacgcagctgatcgccgagatgcacgcacggggcgagttgcccgatcccgacgagcgctggtgcgtggagatccacaccaccgacggtgtcgtgcttcgttcccttcagctgtactga

SEQ ID NO: 5878 - DNA, 369 bp, Methylobacterium sp.
atgtcaggacctcgccccatcgccgtcctcgccgaggacgaagagttcagccgcctcgtcgcggcggacatgctgacggcgttggggttcgaggtgctggaggcggaacacgcccagggcgcgctccagcatctggaggcatgtgacggggccgtcctgctctacaccgacatcaacatgcccggcacgatggacggccgcgcgctcgcgcacgccgtccgggcacgctggccggagacccggatcatcgtctgctcgggctgcgatccgcgcgaggcgaccgcgctgcccgaggaggcccatttcatcgccaagccctgtggggagaaactggtgcgcaaggcgctcaaggccctgcacctgcactag

SEQ ID NO: 5879 - DNA, 1875 bp, Methylobacterium sp.
atgatcatccgccacacccgcaggctgcagcgatcgggcgaggcggtcgcgagccgcgatggtcggctcgtcgcgcctgccccgacggagcccgactgggatatcctgggtctgatcgatctcggcgggcgcgccacggtggtcgcgctcctgggtccgaacgacgcgcgcgcgttccgattcctgaacccggacggcacagcgctggcgtcctgcgctgcggactttctcgccgcgccgtgggacggcgccggcccgctcgactggcaggccgaggcgctccacaccgacgacggcgacgcgtcgaacacgcgggccatgatcgaggatcttcacctcctgatcgaagccctcgcgcgcgcggctgccgcgagcccggagcacgctgtccgggtcgtcacgggcggcggttccgatccgcgggcgcaggcgatgcacgcggcgctggcacgcctcaacgccgcaccggcgggggctccgccccacctgcccgaactggtgacgaaggcgatcgtcgcgcgcggcggccaggagacggcccatccggacggcggcgatctgcgcttctcgatctacctgcccatgccgggcttccgctttgtcggctacgcggcggaccggaacgagacgctgtgcacgctgatcggcaagaactcgcgcctcgcatcggccctgctggacgttcgcgcgaacacggcctacgcccggccgaacctgggaagcgtcgggttcgacgccgcgaccctggtgcaggtccggttgtggcggcagtacctcctgccggcgctgatcgacggcgcggcgcggtcgacgcgcgtcggggtggtcttcgagcacgcgcacatcagtcacgccatctggaacgagctggccgcggtcgacgacgtgctgtcgctcggtcgcgcgccggcggtgttcctgttcgcgagctgcaacgagccgatctctcccgtcgacgccgtcttcccggagctcgccgggcacgtgtatcgcgggatcgaaggcccgctgcccctgctgcaggccgccgtcgccggcgcggcgatcttcctgcccttccggtcctaccgcgtgagccagcgattggccgatcgtctcgcggccctggcgcggagcgcggaacccgcgctcgatgctcgcctgacggacgcggcgcgccgggccacgatcgtcctgatcgggctgcgcttggagaaccgccagtgggtccggcagctcgacggctacgtggcgctgatccgacgcctcggccggcggcgcggggagaggttcctcgtcatcgtcgacgggcacaacacgctcgcgggcgcggagggcggttacgtcgagagctactgcgagagcctcgtgcccgcggaagggagcgtgccatccatcgtccggaaggagctcgagctgatcggggcgctgcgcgcacgggtcgccgacgtctccaacgtggagttgatgccgctcgtgccctgctcgatgggggcgagcctcgtggccgcgctccacaccgacctgttcgtgacgcatttcggggccgggctcgccaagtataagtgggtcgccaacgcgcccggatgcgtcatatcgagccgatccgtgctcagcgggaaggacgatctgcgcatctacgacaccgagatctttcgcgagaacgtgtcggcctgtcactactttcccgccgagcgggtgacggacctcgacacctcgaccaacgccctgcatgtccccggcagccgggagcgcgaggatttcgatctcgacctcgaagagttcgccagcttcgtcgagcagaacctgccgaagcggcgcgccgcgcgcccgcactggctgagacggctcaccctcttcaggacccgcgccgccaccgacgcggccaggctctga

SEQ ID NO: 5880 - DNA, 99 bp, Methylobacterium sp.
ttggtcatccaccagggcgagcaggagatgctccagcgtcgcgtattcgtgccggcgctccccggcgagcgccagggcgcggtggagggcttgttctag

SEQ ID NO: 5881 - DNA, 138 bp, Methylobacterium sp.
atgctcgaaccactgctcttcatcggcctcatcatcgcggctgtggctgccgcgacccggctcgggatcgccgctgcggcaccgatggcaccgtcgcgcctcgacgcctgggacggacgcgccgacgcggacgcctga

SEQ ID NO: 5882 - DNA, 132 bp, Methylobacterium sp.
atggccacgaagatgatgaccaggggcatgaccgtgaccgaccacatcgtggcttggtcgatgctgactggcttggcgctcgccgtcctccagctcgccctgaccgcggccctgccgacgcacttcgtgtga

SEQ ID NO: 5883 - DNA, 633 bp, Methylobacterium sp.
gtggtcgacgagggcatccgcggcgaagaccatggccgagaacacgatcagcccgacctgcttacggtggctgtcgcgctcatcggtatcgcccgtgtcgcgcgcttcggacggcccgtgctgttgcgcgtggcccgcgtgagggggctgcgacgcgctctcggtcgatcgctccccgtcatccgcgcgggcgtcgtcgggcgacaggctcagggccgcggccgcgacgagagccgcgagcagcgcggccgggtgaacagagagcttcgtcccgcgggcgccctgcgggatcgggagaagctcgggatagcgtcgggcgatctcgttgatgagagcgcggaaatcgctgcctcgcatcgggctgtccaagacctcggacgcgatgacgtagctgccgtcgatcctggcgaaatgcatgacggcgtcgccatccggccggcagaagacgaaccaggggtccgcctcgtcgctcaggccctgctcgctgccgatctgcaggccggcccggatcagcgcggcctcgacgcggtagaattccgcgagctcctgctgcgaccagccgccctggcacgtcgttgcgggtcggaagaacgagatgaccgcgcccatcgggacctcacgtccgcacagtga

SEQ ID NO: 5884 - DNA, 420 bp, Methylobacterium sp.
atggcccggcgcagcggcactccggccgggaccttcgccggcccgcgtcgggcctggatcggaagtgcttgtctgagccagcacgagacccggcggttgatccggacgcgcgcccccggccgcgtccggtggaacggccgccgcctctctgagatggcccggcgcatcggcgctcccgccccgcccgtcgccatcttgaccgcggccttgatcggtggcctcccccgggagctgcgtgaggtccgctgttggacgcaggcccggatcggacgccgcgctgggaccgccggcgacgctgtgcttcacccgttcggatgcacctgcgccgacgccggagggatccgcatccgcgaccgcgtcgtgccctccccttgcctgcggcgagacgtccattcgcagaccgttgtccgggctacctga

SEQ ID NO: 5885 - DNA, 141 bp, Methylobacterium sp.
atggccggcatcccgggcgtgcggtgccgtgtcttggtcatgttccggcgccaccgcgctccgaaccggtccctcgccagcctgcctgtgatccgcttcggcggctctggcctcgatctgcaggttggctgccggtgctga

SEQ ID NO: 5886 - DNA, 117 bp, Methylobacterium sp.
gtgaacggcgggaccctgtgcgtgcggtccattgtcttggaggtgcccgggcggctcgccgcttcgatcgtcctgcccggggcctggatcggcagcgcgcacctgcgcgccggctga

SEQ ID NO: 5887 - DNA, 666 bp, Methylobacterium sp.
atgcgtgagatcaccggctccctcttccagtccctcgacggcgtgatccaggcaccgggcggtccggaggaggatcagaccggcttcgcgcacggcggctggaccttcccgtacttcgacgcgtcgctcgccgggccgatgggcaagctgctcggcggcgatgacgagctgctgctcggccggcgcacctacgagatcttcgccgcctactggccgcacaacgccgagcagccgatcggcgcgaccttcaacgcgatccgcaagcatgtcgtcaccggaagcgacgccgcgctcgactggaacaacagccgccgcctcgccggcgaccccgtcgcggcggtcacccgcctcaaggagagcgagggccccgacctcctcatccagggcagcagcaggctctatccggcgctgcttccggcgggcctcatcgaccggctcgtcctgatcacattcccggtcatgctcggccgcggcaagcgctggtacgcggacgacccggcggcggcccgcacctggacgctggtcgagcagagccactcgccgaagggcgtccacgtcgcggtgttggcgcgggacggggcggtccagaccggcagtttcgccagcaaaccacccagcgcggacgagatcgcgctccgcgagcgccaggcggcgggtcgctggtag

SEQ ID NO: 5888 - DNA, 345 bp, Methylobacterium sp.
atggcggtcgcctgccctgttctgacgcccgaagagcgcaaggcgtccgagatcctggacgccgcgcagcgcgcgatgatggagacggtgcacgcggcggtggcggaggccgccgcgcgggtgcgccagcagagtctcgacgccggcctcgatctcgccccgccgccccgggcctatttcgagtccgtggtgcaccagcggatgtacctgacgctctgcggggcggcggtcggcacgttcgcgggcggcgacgccaggacggcgatcggcctcatccggaatcagcagctgatcgccaaccgctactgggcggccgggatcgcggtgacgccgagggcgccgtga

SEQ ID NO: 5889 - DNA, 279 bp, Methylobacterium sp.
atgccatcgacgccgcctcgcctcgccttctcgcacgccgggcaggatttcatcgtcaaggcgcggcctgtgtcggatggcatcgaggtgcgcggcttctggcatgctcgctctaggggccggacccggttctttgtcgttgtgccagccgacgcccttgagaaggccaagcgccccgattgggctgatccggtgcaagccgcgctgaagctcgtccggaagcagattgtttcggcgatcgacgagggcgagcccctggccgaggaccctcagccttga

SEQ ID NO: 5890 - DNA, 99 bp, Methylobacterium sp.
atggccttgaagatcttttcttacgcaatgatcggcgccttcgtgggcggccttgccatgacagtaatgggctctgcgggggtgctgatgggcctttga

SEQ ID NO: 5891 - DNA, 216 bp, Methylobacterium sp.
atgcgccgcacggccgagatcctgaccaccctcatcctgttcaccgtcgttatgtcggcgctgggatgggtagcgagcattacagcgcccggcatcggcgactggctgtcggccaggatcggcgaaggcgggatctgggctggcttcgcggtgctctgggtcacggccggcgtgctcctctaccgcgagaaggctggcagggcggccggtaagtag

SEQ ID NO: 5892 - DNA, 2526 bp, Methylobacterium sp.
gtgggcgacgcgcgtcccaggcagacgacggcgcgggtcctcctcgcgagcctgatcggcacgacggtcgagttctacgacttctacatctacgccacggcggcgagcctgatcttcgggccgctgttcttcccggcggcgctgcaatcggcggagctgatcagcgcctacgcgagcttcggcctcgccttcgtggcccggccgatcggcggcgcggtcttcgggcatttcggcgaccggatcgggcgcaaggcgacgctggtcgcctcgctcctgctgatggggctcaccacctcggccatcgggctgctgcccaccttcgcgctggccggctggctcgcgcccgtcctgctctgcctcctccggttcgggcaggggctggcactcggcggcgagtggagcggggccgcgctgctggcgctggagaacgccccgccgggctggcgtgcccgctacgcgatgttcgcgccgctcggggcgcccctcggcttcttcgtggccaacggcctgttcctcgtcctgaccctgaccctcagcgcggagcagttcgcggactggggctggcgggtgcccttcctgctcagcgtgcccctggtctggctcgggctctgggtccgcaccaatctcggcgagaccgaggagttcgccgccgccgtgaaggacgcgcagcccccgcgcgtccccctcgtcgccctgatgcgcgaccatgccgggcaggtcgtcgccgggatgttcggggtcgtcgcgtgcttctccctgttctggaccgccaccgccttcgcgctcggctacggcacgacgacgctcggctactcccgggcctcgttcctgacggtcgagctcggcgcgatcctgttcatggccgccgccatcgtcgtcgcgagttggctgtccgaccggctcgacccggcccgggtcttgatcgtcggctgcgccgggaccatcgtgtcggggatcctgctggcgccgatgcttggcagcggctccctcgcgaccatcttcgccttcctggccttcgccctgtgggtgatgggcttcgtcaacgggccgctcggcgcgtggctgccgagcctgttcccgccgcaggtgcgctacacggggacctccgtggcgttcaacgtcggcggcatcatcggcggcgccttctcgccgatgatcgcccaggcgctggccgcgcagagcggcctgaccgcggtcggcttctacctcgcgctgaccggtgggatcagcctcatcgccttcgacacgagcgcccggcggcgggcgctggacgcgctcgcccggagcgagcgccgctaccgcgcgctgttcgagcagagccacgtcgcgctgtgtgaggtcgatctctccgaggcgcaggcccacctcgccgaggcgcgggccaccggcgccctcgggcccgacctccgcgggcaggccgacgccgcgctcgtcgccgcgctcgtcgccgaatgcgcccggcggatcgcgctggtcgacgtcaacgacgcgacggtgcggctcctcggctgcggctcccgcgaggcggtgctcggctcgatgagccgcttcctgccgccgggcaacgacctcgtcctgccgctcctgcagcggatcgaccgggcgggcggccgcttcgaggcccagggccgcctgatccgcgccgacggacgggaggtgaccgcgatcctcgtcgtggcgctgccggacgacgaggcggccctcgaccgggtcgcctgcgcgatgatcgacgtgaccgagcgggagcgcgccaaggaggccctgctcgcggcccaggccgagctcgcccgcgcgggccgggtctcgaccgtcggggcgatctccgcctccatcgcccacgaggtcaaccagccgatcggcgccatggtgatgagcgccgaggcctgcctgcgctggctgcggcgcgagacgccggacctcgaggcggccgcgcgggcggccgagcgcgccgtccgcgacggcatgcgggcgagccggatcgtgcagcggacgcgcgagcagctccgccgcgaccgcagccagcccgagatcctcgacctgggctccctcctggcggaggtcgcgaccctcctcgaccgggagatcctggcggccggggcgacggtgcggacggtgatcgccgcgaccgaggcgcgcgtcctggccgaccgcgtcgagctgcagcaggtcgtggtcaacctcgtgacgaacggcctgcacgccgtgcgcgacctgcccgagccccgccgcgcgctgcggatcgcgctgaccgcccccgcgccgggccggctgcggatcgcggtcgtcgacagcggcaccggcatcgatccggagcagctgcccaggctgttcagcccgttcttcaccaccaagcgcgacgggatgggcatcggcctcgcgatctgccggaccatcgtcgagtcccatggcggcacgctgaccggcgggaacaacgacgggccgggcgcgaccttcgcggtcgagctgccggcggccgagccgggcgcggcgggcggcgccgcggccgagcccgccgccgccggctga

SEQ ID NO: 5893 - DNA, 231 bp, Methylobacterium sp.
ttggcggatcctgaattcgagattggaaaattcgggccgaacgacaagagatcggtgctccggcagatcgcgcacgccctcggagtgcccgaagacgctttcctcgacgagtccgaggcgctcgccacgatcgacatgacgggggatttgctgcgcgtctggcacgcgctcaccctgtcggaccgccgcttgctgctgcagatggcgcgcgggatgatctcccgcggctag

SEQ ID NO: 5894 - DNA, 210 bp, Methylobacterium sp.
atgagcgatgacgtggcggccctgctcctcgcgctcgcgaccgagaacgccgagctgcgccagcagctcgccaccgcgcaggacatgctgatggagaccgccatcgatgccggccatctccacgcccgcatcgaggcgcttcaggccgagcgcgacgcgtggcaggcggaggccgagcgcttggcgcgccggcccccgcgttccctgtga

SEQ ID NO: 5895 - DNA, 195 bp, Methylobacterium sp.
atggccatcgatagatccggtgagcgtgccgcgctcgataccgaggtagaggacacccaggacaccatcgcgaagcttcgcgaggctgccgacggaacgccgcccggacacagttcgcgcgtggcgctgaagaaggccgaggaaaagctggccgagctggtcaagcacatcacccggcgcgaccggacgggttag

SEQ ID NO: 5896 - DNA, 129 bp, Methylobacterium sp.
ttgatcgccctgtccggtatcgagcgcgcacgaaccgcgccgacctgcggtggggcggccattctcgatctcgctctctgcctgatcctgtccgtgactgtcgtcgggctgctcctcctggccctctga

SEQ ID NO: 5897 - DNA, 225 bp, Methylobacterium sp.
atgccgaagcacgcccgcctggccctggccgccgcgcttctgtcggccctcgcggcgggcgccgtccgcgcggacggcacatccgctttcggggctgccaacgcggcccagctccggggctacaccgcgagcccggcccagatctacgttccggcaggcggcccgagcgccaagcccgcggcccctgcaacgcagcggccgaaggcgccggcgcgcagccgctga

SEQ ID NO: 5898 - DNA, 198 bp, Methylobacterium sp.
gtgacgatctgcgcgcgcaccggcggcgagccgccgctctgccgcatcgcggcccgctgcacctcggaggcgctgctccgcgaggacctgttccgagaggatggacgccccttcagcgggacggagcgcctgcgggcgcaggcgatctcgcagggctgctacgccaccctggaggccgccgcgcgatccgcgcgctga

SEQ ID NO: 5899 - DNA, 339 bp, Methylobacterium sp.
atgcgcaagatcggtatcatcgccactgccgccgccatggctctcggcagtgttgccgtcaccacgagcgccgaggcgcggccttacggctaccacggcggctacggcggctacggccacggctactaccgcggccgtcgcggcatcggcaccggcgccgccatcggcctcggcatcgccggcctcgcggccggtgcgatcgccgcgggcgcggcccgcgacagctactacggcggtggctacggctacgccccgtcctacggctacggctacgccccggtctacggcggctacggctacgccgctccgggctacggctactacggctacggctactga

SEQ ID NO: 5900 - DNA, 102 bp, Methylobacterium sp.
atgaagggattcacgaaaattgtgtcgtacgcggcggccgcggcggcggtctgcatgctcgcggttgtggtggtccaatcggcggggctcctcgccgggtga

SEQ ID NO: 5901 - DNA, 1530 bp, Methylobacterium sp.
atggccgcggcgctgcttgcgccggcttccggccgcgcggaaacgacggtgaaggcggtgctggaggccgagatcgtcaccctcgatccctacttcaccacggcctacatcacgcggaccttcggctacatgatctacgacacgctgttcgcgccggacgcgacgggcgtgttccggccgcagatggtcgacacgtggtcggtgtcggacgaccggctgacctggcgcttcaccctgcgcgaagggctgcgcttccacgatggcgcgccggtccgggccgccgattgcgtcgcctcgctgcggcgttgggcggcgcgcagtgcgctgggcggccggctcatggatgtgacctcctccctggagcctgtggacgaccggaccttcgtgctgacgctgcgggagccctacggtctcgtcctcgacacgctcggcaccacgtcgagccccacaccgttcatcatgccggcccgcctcgccgccaccccacccacgacgcagctcacggaggtcgtgggatccggtccgttcgtctacgaccgcaccgcccacatccccggcgaccacatgctgctgcgccggaatcccgattaccggccgcgtcccgagccggccgacttcctggccggcggcaaggtcgtgaaggtcgacgccctcgacatccgcgttatccccgacggtgcgacggcgacgggcgccctcggcacgggcgagatcgactacatgcagtacgcgcccttcgacctgatcggtcagatcgaggccaacacgagcttggcggtgatgaacttcaccggctcgcacaggttcacgggccactatcgcattaacacggcgtccaagcccttcgacgacccggcgatccggcgcgtgctgctgcgcctcgtcgatcagcgcgaggttctggacgggttcggcctcgatccgcgcttctcgcagacctgcgacgccttcttcatctgcggctcgccctacgagacgcatgtcgggacggacctcctgcacgacccctcggtggcggcggcccgggctgctctgaaggcgaccgcctacaagggcgaaccggtgaccgtgatggtggctaacgatctcgaggcggcgcgcgtgtcctcgaccatcctggccgaccggctgaagcaggccggcttcaccgtcgacctgcaggtcatggattgggcagccctgctcgcccggcgcaccaagaaggccggctggagcctcttcggcatccacgcacttggtctcgatctcagctcgccgctgacgaattccgcaatcaacttcaactgcaaggacgcggcgagttccggcttcatgtgcgacccgcgcatggtcgccctgttcgaccgcttcgcccgtgagccggatccggacaaacggcgcgtcatcgccggcgagatccagaccatcgtctacggcgaagggctggtcgtcccgttcggccagttcgcgcagcccgcggcctatcggaggtcgctcaccggtctgatcccctccgccatcccgctgttctggaacgtcgcgaagccatga

SEQ ID NO: 5902 - DNA, 264 bp, Methylobacterium sp.
atgctcaagtccctcgccgccgcggcactgctcgccgtcggcatcgccgcgccggcctcggcgctgcccgtcgcgggttctccgcttcccgccgcgcaggacgggctgatccagcacgtctacggcggctgcgggccctacggccatcgcgggccttacggtgggtgccgccccggcggccagtggggcgggtatgtcggtcgggcctgcccgcgcggcttccacctcggtcgcggcgggcggcgctgctggccgaaccggtac

SEQ ID NO: 5903 - DNA, 138 bp, Methylobacterium sp.
atgaccctcctcactgccctgtccctcctccccttcgccgccatcgccaatttcgctctcgtggtggcgctggccaatcacttcgacgccgacaagccggccacgggcttcaccggcccggttccgaacctggcctga

SEQ ID NO: 5904 - DNA, 192 bp, Methylobacterium sp.
atgtcagtctccgcaggccaggaggatcagatgacggctccgttctccctcatcaggcgatggctcgactgccgtcgcgcgcggagcgaactcgcgtcgttcagcgagcgcgacctcgcggatctcgatctcgtcggctgtgacgtgaagcgcatcgcctcggcgcggtccgggcggagaggcgcggcctga

SEQ ID NO: 5905 - DNA, 147 bp, Methylobacterium sp.
atgcgctaccgggccgtaagtgtcttggatgtgtcggcgatggcttcggaagagaacccgacggacgagaccctcatgctccgcgagcacatccgccgtatcctgcgcaagctctcccgcgcgcgggccgagcttcagtacggctga

SEQ ID NO: 5906 - DNA, 306 bp, Methylobacterium sp.
ttgctctcctcccccttcgaccgagccctatctacgataccggcctccatcggccggggggccgagtcgatcggtgacgacgtggcgaacgcgaccttcgagatcctgaagggcatccgggcgcgcgtggcgatgccggctatggcgggcggcttcgacgcgcgtgtcagcgcgatcgcggcggccgtcgttgccctggagaaccggtccggatgccgatcatccgccgaaagaatgccctgcgccgcgtgggagattgaccgaaagcaaggcactcggcagagcgacacgatacagctcagctga

SEQ ID NO: 5907 - DNA, 675 bp, Methylobacterium sp.
atggaccatgcggccgacccagatcccgtcctgatccgcctgcgcgagggcttcgagcgcgtcgccctcgtgctgcgggccgatctgtgggcggccgcgggcgatgcgggtctgaatccgacacaggcgcaagtgctggccctgctcgcggggcgtccgggcggcctgagggcgaaggagatcgccgcgcagctcgccgtctcggcaccgagcatggccgacacgctctccgcgctcgcgcgcaaggccctgctgacgcgcgcgcccgattccacggatgcccgcgcggtgatcgtgcgcctgacggatgaaggccgtgcgctcgggcgcgccctcgccgcggccacgtcacaggtgatgtcggccctcgcgcggctgactccgcctgagcaggcggatctcctcctgacccagatcaagctcatccggaccttgcagcaggcgggtgccattcccgtgcagcggatgtgcgtcagctgccgccatttcaggccgaacgcccatccgggcgaggcccagccccaccattgcgccttcgtgaacgccgcgatcgggacccgggatctccggctcgattgcggcgagcatgaagcggccgatcccgacgtccaggctgccacctggacgtccttcgcgaatggatcgccgcccctccgagcaccacgagagacctga

SEQ ID NO: 5908 - DNA, 720 bp, Methylobacterium sp.
atgacgaggatcaaggcacggggcgtcggcctcgtggcggcggctctgtgcgcgctctccaccggcgcctcggccgagcccatccgggcgcagccgaatcccgctgtcctggcgtcgttcgacatcgtcgagacgacgatcgcgaccaggggcgacaccgccgtcttcaccacccgtgtccggggcgaggcgggcaaggacaagccggatgccaccggcaagttcgagggctcgagcgtttacgcctacgtctggccgacgaccctcgacagcgacgcgatcggcttcgacaaggctcagggtatcgtggcgctcgccgtcaccttccaccccgatttcgacgacgcggcctacggtgccaggaaccgccacgtctggcacccgcactgggtggtgctcgccagggacgcggcctgcgggggcggcctcaaggtcgtcgatatcccggacggcgcgaagccgaaggttccgccgacctggccgaaggtcccgctcctgatcgacagcccggactacccgaccaccttccggggcgacacggttcaggtcgagatcccggtctcgctcatcaccggcatcaagggtgcctcgttcgacggggtgacgtccggcctcaaggtcaacggcaacctgcacgcgccgctgctctgcgtgagcgacgtcttcaaggtcgcctcgggcaacctgtcgctgccgggcaaggtgacccctcagaagtag

SEQ ID NO: 5909 - DNA, 549 bp, Methylobacterium sp.
atgaccatcctggcccccgaactggtgaccggtcgctggttcaacacgcccgcgccactctccctcgccgcgctgcgcggcacggtcgtcgtgctgcacgcgttccagatgctgtgccccggctgcgtggcgcacggcacgccgcaggtcgagaagttgcaccggatgtttgccgggaacggcgcggtcgcggtgatcggcctgcacgcggtgttcgagcatcatgccgccatgaccgaggtcgccctcgaagccttcatacacgagtaccgtctgcccctgccgatcgccgtcgaccgccgcggggatgacggtccgatcccgcagacgatgcggcgctacggcatgcgcggaacgccgaccacgatcgtcgtcgaccgcgacgggcgggtccgggaacacgccttcgggcaggtcgacgacctcgcgctcggaatcctggtgggctcgctgatcgcggtaccgggcacgggatcggtgcgcggggcattggcgcctgacgggtgcgacgaagccggctgccggctcccggaggaaacgcggccatga

SEQ ID NO: 5910 - DNA, 1623 bp, Methylobacterium sp.
atgtcgagtttcgacgagtcggtcgcgcgccagcagcggttcatgggaccgctcctggtggcggcgatcctgttcggcctggccgggctgccggtcgcggtctggctcgacctgcgcggcctgtccgagcgcatgctcgccacgcaggcgatcgagaccggccggatcatcgaccagatgcgcagcttctacgccagcgacgtcgtccaggcggtcaacgccgcgaccggtcgggtcgagacgcggcacgattacaagggggtgccgaacgcgatcccgatccccgcgacgctctccctggaactcggcgagcggatcagcggcggggacggcgcggtgaagtaccgcttcgtctccgatctcccgttcaaggaccgcaagccgcacgatctcgacagcttcgagacccaggccctggcggacctccgggcgcaccccatgaccggcttcgtcagcgagacgacggggtcgatcttcgaccggcaggtgcgcatcgcggcgccgatccgcatggaatccgcctgcgtgcgctgccacaacgcccatcccctgagcccgaagaccgactggaaggtcggcgacgtccgcggcatccaggagatcgtcctgcaccagccgatcgccgccaacgtcttcgcgttcaagtacctgctcggctacttcatcctggcggcgctcgccggcaccaccttccttctgctgcaggcgcgccagtcccgcctcatcgaccggatgaacagggagctgaccgagtcgaacggcttcctggcgtcggtctcggtgcagatcgccaagtacatctcgccccaggtctacaagagcatcttcagcggcgagcgggacgtgtcggtggcgaccgagcgcaagaagctgacgatcttcttctccgacatcaaggacttcactgcgaccaccgagcgcctgcagcccgaggagctgaccgccctgctgaacgagtacctgaccgagatgaccgccatcgcggtcaggcacggcggcacggtggacaagtatatcggcgacgcgatgctggtcttcttcggcgacccggagagccggggcgtccgcgaggacgcgcaggcctgcgtccgaatggcgatcgagatgcagaagcgcctgggccagctgaacgcccgctggcggcgatccggtatcgagcgcccgttccaggcccggatcggcatcaacacgggctactgcaacgtcggcaatttcggcagcgacgagcggatggactacacgatcatcggcgcggaggcgaacctcgccgctcgcctgcaggcggccgctgtcccgggcggcatcaccctgagttacgagacctacgcgctggtgagcgacatcgtccaggcgagcccgcaggagccgatccgcatgaagggcatcagccgcgagatcgtaccctacgccatcgagggcgaccttaccgccgaggccccggagacgatcttctccgagcatgcccgggggatcgacttctacgtcgacgtcgatgccctggagatggagggcgcggcgcggctccggaagcgcctgctcgacacgctcgccgccgtcgaccgccggatgaccggggcgggcaccccctcggacgacggcacgcggccctccgcggccggctga

SEQ ID NO: 5911 - DNA, 1890 bp, Methylobacterium sp.
gtgacgacgccgctcgaccggcgacggctgaacctgcgctggctctgcgccagctgcctgatcgccacctgcggcgcggccctcatgggggcggcgctgcgcatgtccgtcgacaccgatctcgcgccggcaaagccggcgttccgccagggacccgcccaggtcgcggaggggcagggggtggtcgggcagcgcggcgaccgcctcgtgcggcgccaactcgtcgcctcggaccgggaggaattctccgcgccggtgacccaccaggtcggcgcgcgcgagatcatccggacccagcccttcgtgcgactggtcacgagcctgtcctccggcgacgcggtcgatgggcagatcccacccttcgatccgacgcgccagctcgccgaggacggggaggtcgctccggtcgccgacgagccgggggacgatccgtccgggaccacggtcacgatcacgcgctccgcgctcgcgggcacgccggtccccgacgacgcgcccggactgagcgacgaggacgtcacggccctcgtggagaggcagtcggatgaggcgcgacagacggggccgcggatcgccgtgccgctcgcgccgcagcggctgctctcgcagattctggtcgccgcgccggccgacgccgccgcgacggccgccggcgccgatacgggccgcgacccgttccacgcgatcgaggtgcgggtcgttccggagaacatcacggacctcgccgagacccagcccgcctccggcctgagcctgaccgagacacgcgacgtcgtgctcaagcgcggcgagactctggccgacgcgctggcggcgaacggcgccgagccggcgcgcgtgaccgccatcctggccgccttcagcgagcatgcccgcaccgggctggccgaggggcagcacgttgacctgctcctcgtccggtcgcacgccggcgaggcagcgcgccggatcgcccgggtgacgctctacggcgcgggcggcgtcgaggagatcgtcgcggaacgggattccggcggcttcgtcacggtggcgccgccgtcggcccaggtcgcggcgtcgcattccggcgacgacggcgacggagagggttcgggcgccagcctctacaggagcatctacgaggcggtcctgcgcaacggcctgcccggcatcctggccgagcgcatcgtcggcatcttcgcgttcggcctggacatgcagcgccgggtcgccccgtccgaccggctggaggtgctgttcagcccgagcgagaaggcgggcggtgcgccggaggtgcgctacgtcgccctgacgctcgacggggtgaagcaccgcgcctaccgtttcgaggcgcccgaggccgggacggcgagctacttcagcgagacgggcaactcgctccgcaagttcctgatgcgcatgccgatcgccgacgggcggatcacctcgccgttcggcacgcgcgttcacccgatcctccactacgcccgcttccacaacggcgtcgattgggccaacaaggccggcacgccgatcatggcgacgggcgacgggacggtggcgtatgccggcccgcgcggcggctacggcaaccgcgtcgagatccaccacgccaacggctacgtgacggcctacaatcacctgcagcggctcgcgcacggcgttcaggtcggcgcgaccgtccatcaggggcaggtcatcgcctacatgggctcgaccgggctctcgacgggcccccacgtccactacgaggtgagcgtcaacgggcgcttcctcgacccgatgacgatccgcctgcccgacagccagggcgtttcgcccaggctgatgacggctttcgagcggcaggtggcggccacgaacgcgctccgccaccacggcgccctggcgatgtccgccctgccgctctga

SEQ ID NO: 5912 - DNA, 1212 bp, Methylobacterium sp.
atgaacggtgtcgccccctcgatccgccctgccgcgcgagccggagatccggacgcggcgtttctcgcgaccgtcgcgacgcttcggcccctcatcgcggagcaccggtcggccctggctgtcggcccggacctgccggagccggtcgcggaggcgctcatcgacgccggtctcgcgcagctctggcttccgcggggcctgggcggtcccgaagcgcatccgctgagcgtcctggcggcgatcgaagctctggcggaactcgacggttcggtcgcctggtgcgccgcgatctcgtccgggggcgcgtcacgcttcgccgacctgatcgacgcggacgtgatgcgttcgctcatccctgccggcaggaagttcgcgggcagcgggagcggccagccgacggggacagcggttcgccatggatccggctggcggatcaacggacgctggtcctgggcgagcttctgccgctacagttccgtgtccgcattgatgtgtgtggagatcgagggcgagcggccgaagctcgacgagaacgggcggccgtcgctgcgcggcgtcttcatcgcctcgaaggatgtcgaggtcgtcggcaactggaatgccggggggctccgggccagcgggagtcacgacgtcgcgtgcaccgatatctgggtgccgaacgagcagaccatcgacggcgcgagccttatgatgcctcgcgacagaaagcccctctacatgctgcccatggcatcggcggccgcgatcgccgccatcggtgttccgctcgggatcgcccgggcctcgatcgacgcgttcatcgacctcgcgcagacgaagacgccgcatggcggcaaggtgcccctgagacttcgcgaggatgtccaggtcgcgatcgcgcgtgccgagacgagcctcggtgccgcgtgcgccttcgcccgggacacggtctccgaattctggtgggaagccgagaacggccgtccgataacgctcgcgtggcaggccaagcttcggcgggcctgctggtacgcgggccatgtcgggaagcaggtggtcacgagcatgtacgaggcggccggcagttccgccgtcctcgaagacctgccgttcgcgcgccagctccgcgatgtctacgcggcctgccagcacatgcattatcaggaccggctgctcgtgccgaccggccgcatccttctgggcctcgaatccgacgcaccgttaatctag

SEQ ID NO: 5913 - DNA, 165 bp, Methylobacterium sp.
atgccaggcgggatcgggatcggacgcggggatcccctgcgtcccgcggtgacgcggaccgcgcgcttctcggggcccgagggcttccatccgggcgccctctggctcgccgcggcggcgccgctcctggcgaccctcctcctcctcgtccggctcgcggcctga

SEQ ID NO: 5914 - DNA, 99 bp, Methylobacterium sp.
atgatgctgaaggccttctcctacgcgatgatcggcgccttcctgggcggcctcatgatgaccgtcgtcggctcggccggcgtgctgatgggcctgtga

SEQ ID NO: 5915 - DNA, 219 bp, Methylobacterium sp.
atgcgcctgctctgggacagggttctcgaccgggcgtggctcggcctggcggccgccgcggcggtgacggtcgccgtccacgagggtgcggcggtcggccggcttgcctggacgctggggtccggcggcgccgcgctggccgcgccggcggggggcggccgggccgtcccgccggcccgcgccgcggcctgcggtcccgccccggcgccgtcaccgtga

SEQ ID NO: 5916 - DNA, 2331 bp, Methylobacterium sp.
ttgggactgtattccaagctgcgggccgcactcgctgaagatgccctcctcgcgcgcggcgtgaagcgctcgctcgtcgacggcctgtatcagcccttcgcgtcgctcgcggtcggcgccgcgtccgggacgatcgtcgccacggccgcggcgttctggtccgacgatcgcgcgatcacggtgaccgcgttcgcggtcggcctgatcggcctcacccgcatcgtactggctcggatctacctgacgaaggggccgcagaagcacgatcgttacgagctctgggagacgtacttctccctcggcgcgttcgcctacgccgcgtcgctcggcatcctgtcgttcctcatcacgacgcggtcgtccaacctcgcgctccaggtcatcacccccaccttcacgatcggttacgccgcgggcatctcgggccgcaatgcgggccgccccctgctggccatcgcgcaggtgctcctgtcggcgatgccgctgtcggcgggtctgctcgtgtcgggcgacggcgagcgggcctcgctcggcatcctctcgctcctgttcgcctacggcatgatcgatatcacgctcagcacgcgcgagatcatcgtgtcggccctggtgacgacgcgcgagaaggaggcgctcgccgagaaattccaggcccaggccaatctcttcgacatcgcgttgcgcaacatgtcgcacgggctgtgcatgttcgacgcgcgcggccgactccaggtctggaacgaccagttcctctcgatatcgggcattccctcgaaccgcatccacaccaattcgacggccaagtcgctgtacgcatcgagccgcgccatcatcgacgagcgagccgcggggcgcggcgcgacactctcgacattctctgcggcgtcgaacgcgctgaggtcgggaaacctggtcctgatcctccccgacgatcgcgtggtctccctgatgcagcggcggaccgccgagaagggctacgtgatcatcttcgaggacatcaccgagcggcgtcggagcgaagcccgcatccagcagatggcgcgttacgacgatctgaccggcctgctcaatcgcagcagcttcaaggccaaggtctcccaggcgctgaaagccagcgccagcagcaagggcgctttcgcggtccacctgctcgatctcgaccacttcaaggtcatcaacgacacgctggggcatccggccggagacagattgttgcagatggtggcggaccggctgcgcgggatcggggcgctgtccggatcggtcgcccgcctcggcggcgacgagttcgtcatcgtccagcaatccgtcacgtcgccggccgtcgcggaggatctcgcgcagcgcgtcctgcaagagctggagcgacctttcgatatcgacggcactcacgtcacggtcggcgcctcgatcggcatcgcgatcgccccgttccatgccaacgacgaggacaggctgctgaaatgcgccgatatcgccctctacgccatcaagggggccggcaggagcgggttcaagatcttccagcacgagatggaagcggccacgcgcgcgcggcacgccctcgagtcggatctccgggccgccctgaccaacggcgaactggagctgcactatcagccggtcgtcgacgcgagcaccggggcggtcgtgagctgcgaggccctgcttcggtggcagcaccccgtctcgggctacatcccgccgtcggacttcatcccggtggccgaggacacggggctcatcgtccagctgggcgactgggttctgaacgaagcgtgccgcgaggcccggaactggccgtcgaccgtgagcgtcgcggtcaacatgtcgccgcgtcagttcggtgatccgcagctggccttccacgtcatcggcgcgctgaaccgctccggcctcccggcgcatcgcctggagctcgagatcacggagagcgtgacgctgggcgcgacgcacaagatcgtcgacaccatccacacgctccgtcagctcgggatccgcctgtcgatcgacgatttcggaaccggttactcgtccctgagctccctgagaaacttcgccttcgacaagctgaagatcgaccggtcgttcgtgtgggacctggacaggaaggccgagtcgaccgcgatcatccgggcgatcgtcgggatgggcaggagcatcgggatggccatcgtcgtcgagggcgtcgagacggagacccagctctccatcctccgggcggagggctgcgatctgatccagggctacgtgttcagtcgtccggtcgccgcaccccagatccgggccatgctcgcgaccgcgcagcccgtgacgaagctagcgagttga

SEQ ID NO: 5917 - DNA, 261 bp, Methylobacterium sp.
atggagcagaccatgaccccgcgaaccgcacaccccgtcgccccctacctgctactcgccgagctcggggccgccctgttcggcggtaccgccgcctccgccgaggagcgcatcaccctggagatcatcggtgccgtccgcatgaccggcccggggatgatccgccccgcggacgcgacgcccgtcagggccgaggacacccaggcgcgcgaagcgggcgtcgagcgtccctccgagaggatcgcggctcggcacaactga

SEQ ID NO: 5918 - DNA, 90 bp, Methylobacterium sp.
ttgcgcggcatcgcccgccggcggccggacggagcggaagaggagagctggccgttcgtcgacaacgcggacccctacagcgtggtttaa

SEQ ID NO: 5919 - DNA, 132 bp, Methylobacterium sp.
atgatcgggatcttccagccgttcggcgtactccatgtgtggacgtcgatcggccgcccggacaccgctgccatgctctgcctgctcctggacccgatcgtcggcggcgcggtggtcctccgccgtttctga

SEQ ID NO: 5920 - DNA, 816 bp, Methylobacterium sp.
atgggtgtcgcgcgcacacgcgtcgaccgacggacttggtccgttcacggagcggccaaacgcaacacggccatcatccaggccggcctcgcccggatcgtcgaggacgagatcctgccgcgtctggcgctcgcgcatcaggcggatccgccgtcgcccgcgtcgaccacgcgatcaccgacacctgagcgcgtcgcctctctcgctcaagcgctgatggagggcgagccgcacgccgagtgggtgcgcgcgctcttggaagagggcttgtcgctggatgccctgctgctcgacctgttcgcacccgcggcgcggtatctgggcgagctctgggaagacgatgccgccgatttcctcgacgtggcgctcgcgctcggtcgcctccagaacctgacccgcgccctgtgtgcggatctggagggcgtggacgtgacggcgaacggtcgccgcgtcctgctgatgccctgtcccggtgagacccatctcttcagcctcgcgctcgtggcgagcttcttccgcgaggcggggtgggatgtggtcctgaccaacggagcggacgaggaccccgccagcttggtccgcgccgagcagttcgacctggtcggcatctcgctgtcctgcgacatcctcctgccggtgatggcggtgtccgtggcgaagctgcgcgccgcgtcgtgcaacccggacctgcgcgtcatcgtcggcgggccgctcttcgtgcgggagcctgccagcgcccgtgtcgtcggcgcggacgccgtcgccgcggacgcgcaatcggccgtcaggatcgcggaggccaccctggcgcgatga

SEQ ID NO: 5921 - DNA, 690 bp, Methylobacterium sp.
atgcccgaccgatccctccgcgccgtctggtccgacagcctcatggccgaggtcggcgcccgccttcccctcttcgacgacctgtccccggacacgatccagcgcctgtcggccgagggattcgggcgcggcctgctgacggcgtccctgcgcgcccgcctgcggaaggccggattcccggatctcggtcatctggcccagtcttcaccggtcgcgatcgccacgatcaggaagttcggtcccatccgcgtcgagcgcgtccggcacttcatcctcgacgtgctggcgcgctggctcccgggcgcgcgggagatgcacacacccgaggccacgcgggtgcggaggctcgaccggctgcgcgggctgccggccggatgcctgcccctcgcggcgggtcagatcgcggcgctccgcttcgcggacgcatcctgtgcggacgtcgccgcgtgttcgcgtctcgggctcctccggacaggcgccgtgacatccggtgacgtggaccacgtcgtcgccgcactcacccgcctcgctcgcgcgtccgatccggttcctccgcgtcccctggaggaggccggggcggcaccgtcgtgcgacgccgcgaccggggcggcccgtcgcgccgctctgctggcggagcaggatcgcgaatgggacgaggccgcaccgaccgcgcgccggcctcggcgctga

SEQ ID NO: 5922 - DNA, 210 bp, Methylobacterium sp.
atgcggaagctgaccaggttggtcgtccgcatggcgcagcgacccggcctcctcgagagcgggcgactgatcgatcagctcacggatctggaagccgagggcctggcccggaatatctcgtggcggtccatcgagacgatcagggccgctcgattgaagctgcgcgtcgagggcctgatgccgacgtcgtccctgccgctcgctccctga

SEQ ID NO: 5923 - DNA, 306 bp, Methylobacterium sp.
atgtccgacatgcccgagcggatccccgcgatgatccgggtccgggacgcggcgcgctccgcgcgtttctaccgggccaccttccgcctcgacaccgccgaccggcccggcttcgaaaccttcaccccgatcgatctcgcgcatgccgcgtccggtctcgcgtcggagctgacggtcaacacgggccacgacggcgcctgcggcctgggcgtgggggccgcccggggcacggcgcgctcctgcttcatcgacgacccggacgagcacaagatcgaggtgctcgcccgcggttggcgcttcgcctga

SEQ ID NO: 5924 - DNA, 786 bp, Methylobacterium sp.
atggatcttcagctcacgggacgaagcgccctggtcaccggctcgaccgccgggatcggtctcgccgtggccaaacggctggccgcggagggcgcggaggtcatcatcgcggggcgccagcaggccaagctcgacgcggccgcggccgcggtcgccgcggcgggccgcgcgcgcgcgatcctggccgatcccgccacggccgagggcgctgccgcgctcgtgcgcgcggcccccgcggtcgacatcctcgtcaacaatctcgggatctacgaggccaaggccttcccggacatcgccgacgacgactggcaccgcctgttcgcggtcaacgtcgtgtcgggggcccggctcgcgcaggcctatctcccggggatgcaggcgcgcggctgggggcgcgtcctgttcgtctcgagcgagtccgggatcgtgccgccgcccgacatgatccactacgccgtgaccaaatcggcccagctgacgatcgcccgcggactcgcccagctcaccaagggcagcggcgtcaccgtgaacacggtgctgcccgggcccacgcgctccgacgggatcggcgatttcctgaagagtgtcgcctccgatcccgacctgtcgcccgaggcgatggaggcggagttcttccggctccatcggccgctgtcgctgatccagcgcctgatcgagccggacgaggtcgccgccatgatcgcctacctggcgagtcccctcgccgccgcgaccaacggcgctgcgctccgggtcgagggcgggatcgtgccgaccgtcgcctga

SEQ ID NO: 5925 - DNA, 222 bp, Methylobacterium sp.
atgccccgctggcttcaattcgccctcggtctcgtcacgctgatcgcgctcgccgcgggcatcgtgcgtacgctcgtgcgtcacatgccagacgcggccgcatcgtggctcgggccgtgggcctacgaggcgttgatcctgctgctggccgtcagcttcgtggcgatcatcgtgcgggccgcccagggctatcgctctcctcgatccgataaggtgcggtaa

SEQ ID NO: 5926 - DNA, 387 bp, Methylobacterium sp.
atgctccgccggctcacgatcctcctccctttgctcgtctccacggtcgcgcacgctgcgggccccggagccagggcggtgggcaccttcgagcaccaggaggacggctacgagcagggcgtcgaggtgaaggcggcgggcgcagccggcttcacggcccagttctcaacggggaccaagggctgcggcggtgaggtgacgatgaaagggcggccgaccggacccgatacggtcgtcttcagcaaaaccgaaggtgggcaaacatgccggatcaccgcccgctacgcttcggatttccggtccgtcgtcctggaggagcagggctgcacgatgtggcacggcgcctcgtgtgagttccaagggacgttgaagcgaaagggacgctag

SEQ ID NO: 5927 - DNA, 231 bp, Methylobacterium sp.
gtgccctatagcgagcccatgtcggccagtaccggacacggtctccacgacgtcgcgcaaatgctccggcaggtggtggccatagacctgctccacgacctgctcgttggtgccgagcgctcgagcgaccttgccggacggcacgcccgccctcacgacccacgtcgcgaaggcgtgggtcagtgcgcgtggcagctcagcaagagcgcgttaacactcgacgatgactga

SEQ ID NO: 5928 - DNA, 963 bp, Methylobacterium sp.
atgccagtcacgattccggatcgcctggggctcggcgtcgccgatgccgggaacggcctctccgcccgcgcggccgaggcacggtcgcggctcgtccgctggatcgtgggtaaacgcgcggcggcgcgcgtcccgacgcggatcctgaccgacgacgagatcgccgccttccggcgcgacgggttcgtcaccgtcccggcgatcaccaccgccgaggagctcgacaccctgcgcggcgcctatgaccgcctgttcgaggaggcgcggggctggaaggacgggagcctgttcgacctcgtcgatgtcgaccgcggcgccagcgaggcgcgctcgccccagctcctcaacccgtcccgcttcgagccgctcctccgggacatcctgttccgggccaacgccctggccatgtcgcgccagctcctgggaaaccgcgcggccctcgtcttcgagcacgcgatccgcaagccgccgaagatcggcgccgccaccgcgtggcaccaggacgaggcgttctacgccgcctacacgaattaccgggcgatcacggtctggatgcccctgcaggacgtctcgcctgagaacggctgcatgctctacgtcccgggcagccaccgggagccgctccttacccatcgcagcatcggcggcgacccgcggatccacgggctcgaggccctcggggttccggtggagcgcgcggtcccgtgtccgctcccggcgggcggcgccacctttcacgactgccggaccctgcactgcgccgggccgaatctcagcgccggaccgcggcgcgcctacgccctcggcttcggggtccgcgcgccggagcacacgctccgccacgagcatccctggaacgccgagaagcgcacgctgcggcaggagcgcgagcggcaggcccgcggcgggctggcccggttgaaggcgggcgccaagcagcagatcaaggcgctcatccgctga

SEQ ID NO: 5929 - DNA, 267 bp, Methylobacterium sp.
gtgcacatgcagcacgtgtccgcagacaacgaccgggtcgcgcagtggtgcgcggcgcatcccgtccttctcgccttcggcctgtgcgcgttcggcctcgccgtcgtcgccgcggtctggggactcgggatcctcacgccggccacggccacggtcatcgccttcatctatgtggcctgcctcggcggcttcctcatggagtacttcgggatcaatgaactcatcagaggcgtgagatgcatctggtttgttctgacgagcgtctga

SEQ ID NO: 5930 - DNA, 231 bp, Methylobacterium sp.
gagtacgccctgcccaccgactcgttcctgaacttcttccgctcctcggccgtcaccctcaaggtcgaaggcctctacgtcagcctcgaccgccagaagaactccgccggcggcgtgttctacggcaacctcctgcccccgaacggcaccgcctacctcaacggcgccgccgccaagaccgagttcgccgtcgtccgcgccggcctcaactacaagttcggctcgtactga

SEQ ID NO: 5931 - DNA, 264 bp, Methylobacterium sp.
ttgatcgtgcggtggatcggtgccgcggcccgcaagcgcggccgggcggccaaccgggaagctccgcccgctccggcctcggacaacgtgacgaggctgtcctgggccgacaccttcggacgggcgatcagcgccgatcctcagcggtcgaagggacccgcgaccgtcctcgcgatgcgtccccgcgcgagcaggcgcgcgtgcggcccgatcgtccgcgcgagacaggcggtgagcgccgcgatcccgacctcgctgccgtag

SEQ ID NO: 5932 - DNA, 120 bp, Methylobacterium sp.
atgcggtatcggcacagcggcatcaacgagttgccgatcgcggagtcggaccgcaagtttcacgggcccctcgggcgccggccggacaaccagccgggcctgagccatttcggcttctga

SEQ ID NO: 5933 - DNA, 549 bp, Methylobacterium sp.
atgtcgcccgagtatgtccggccttacgtcaaggcacagaagaacgatgaccgggatgccgaggccatcgccgaggcggcgacccggccgaccatgcgattcgtcaccctcaagtcgcaggcccagctcgacatgcagaccttgcaccgggtgcgcgaccaactcgtcggcgagcgaacggcgctgatgaaccagatccgtgctgttctcctggagcgtggctacatcgtgccgcaaggtcgtgcgaagctcgcagcttgtcttgcctctctgatggatgaggccgccgtgcctgcgctttcagcacgcatgcgcgttctcgtcgccgaagtacgggagcgctggcaggatctcgacaagcgcatcgccgcgctggatgccgagtttgccgaaacggttcgatcggacgaacacgcgcgtcggctgactacgatcccgggatcggcgcgctcaacgccacggctctcgtggcggccatcggcgatgtcgctacctttgcacgggggcgtgaccttgcagcttggctcggcctcgtgccccggcagttga

SEQ ID NO: 5934 - DNA, 318 bp, Methylobacterium sp.
atgttcaccaagaccgcacggacccgcttggccgccgccctggccttcggcggcctcgccttcgcggcgccggccatggccgcacccctcggccgcgacgccggcctgcaggcggaagccggcgacgtccagaccgtccagtacggctacggctacgggcaccgccacggcggctggggtcaccgcggctacggcccgcgccatcaccaccacggttggggccggggccaccatcacggctggggacaccgcggcttcggcccgcgtcaccatcaccacggcggctggggccatcgccacggctacggccgctggtaa

SEQ ID NO: 5935 - DNA, 207 bp, Methylobacterium sp.
atgtcgacctccgccaacccgcccgacccgtgcgccgagacggccgcgctccgcaaggacaagctgcgcgcgcacatcaggagcgtgctgtcgacgatccggtcccatcatacgggccgcggggcgccgtcgatccgggccacgggctacgtccttggagggtggttctgcggctcggccgcggcaacgatcccgctttttacgtag

SEQ ID NO: 5936 - DNA, 213 bp, Methylobacterium sp.
atgaaacacggcgcgcgcaacgacatccccgccacggtgacggcgatcaagcgcggggacgtgatggcccaggtcgaggtggaactggtcggtaccgcctaccgcatggcctcggtcatgacggtcgactcgctggaggagctgggcctcaaggaaggcgacaccgtccacgtgctcgctaaggcggtgaacgtgctgctggtgaagccgtag

SEQ ID NO: 5937 - DNA, 177 bp, Methylobacterium sp.
gtgaaggtgttccggatcatgcaggcggcgacgggcgcgattctctggagcggcgcggcgctcgatccgatggccgccctcgacgcgatggcgcgcgccgccggcttccgcgaccgcacgcggatcccgaaccacctgcgggccggcggcctccacgtcgaggagctgcaggcctga

SEQ ID NO: 5938 - DNA, 324 bp, Methylobacterium sp.
atggatgagaacggactcgaattcctgcggacgattgctgagcggaaggtggaatcctccgcggcgcgcgcgctgaacaggattgcgcagtccctcgatttgccgatcgaggcgttctacgggtccgatcactgcggatctgtggaccggctgaccctcgagggcgagacggagcgagtgctgatgctcgtcggggtccacctgcgccgactggatccggcggcgcggaggcgattcggtgaggcggtcctcgctctggtcggccccgtatcggccgaggcctgcgcgcgcatcgcggagaacgcggagcgcggcgacccgtga

SEQ ID NO: 5939 - DNA, 318 bp, Methylobacterium sp.
atgctttggtcctgcctgatcctcatcaccgaacaggcgttcgtccccgtgcagtgggagcgcgcctccgtgcgaagggaggcggttctcgaagggctcgtgctcggtgtcgtgggtgccgtcgttggcaccggagcgctcgtgttctcgatgggagcgatcgagatcagcggcataacccactgcatggactggcagcgaaggcacgacctggtgcggccggacgatggaccgctaccgccgcttgcctctgagcgcctcggctctcagatgctcaagcaccatgctgccgctcctggtcgaaccgacaggatgtag

SEQ ID NO: 5940 - DNA, 87 bp, Methylobacterium sp.
atgacggccaagcgagcgctgatcacgggtgtgacgggccaggacggcgcgtatctggcgcagctgctcctgcagaagggctacgcc

SEQ ID NO: 5941 - DNA, 342 bp, Methylobacterium sp.
atggcaccggacatgtcccgatatcgccggctgccgggcgaggagccgcgctacgccctggcggaggcgcggacgctgatcgcggagcgcgcctacctgttcagcctctacgcggtcgacgtggtcgcctccgacgggctgaccggccgacacgttctcgccgtgccggtcgcgatcagcgcggtctcgatcacggtgggcctcgtcctgaccgaggcggattcccgcagggccgaggcgggcgatctcgctggcgtcgtgtccctcgcccaggccgtgcagggcggataccggcgcttccgcaccttcccggcgaacgggctcgggcgtttcgtgctctga

SEQ ID NO: 5942 - DNA, 270 bp, Methylobacterium sp.
gtgctgaggaaattcctgctcgcggccctgctggcgctgggcttcgcggccgcggcgccggagggcgcgtccgccgcgcccatcggcccggggctggctctgcccgccgaagccgcgccggcggtggccgagaaggcccagtactactaccgccgccgtttctacggcccgcggccctactggcgccgcccgtactacggccgccggttctactacggcccgcggccgtactaccgtcgtccttactggcgccgtcggttctattactga

SEQ ID NO: 5943 - DNA, 153 bp, Methylobacterium sp.
ttgctcggattcggacagcgcctcgaagacggcgcgggcatcccgggcccggctcccgacgaggccatccggccagaccgtgacgagatgctcgaatcgtacggcgaccggatcgagctggccgccggcggctggtcttccgccggtccgtga

SEQ ID NO: 5944 - DNA, 1005 bp, Methylobacterium sp.
atgacgggccccgaccgtcccggcgggcgggctccgccccgacgcgatcaggcctccggtcgggtcacgccgccggggcacggggacgggacggccgccttcgaggcccaccgtccccagctcctgcgcatcgcctaccgcatgctcggctcgcgcagcgaggccgaggacgtcgtgcaggacgcgtggctgcgctgggtcgcggccgaccggagcggggtcgcggcgcccgaccgcttcctcgcgcaagtcgtgacgcggctctgcctcgaccagatcaagtcggcgcgcgcgcgccgggagagctatgtcggcccctggctgccggagccgctggtcgagccgctggtcgagccgggagcggacggcgtggacgaggacgacctcaccctgacgctgatgctcgcgctcgagcggctgtccccgctggaacgcgcggccttcctgctccacgacgtgttcggccttccgctcggcgacgtcgcggagaccctcgggcgggcggcgccggccgtgcgccagctcgcggcgcgcgcgcgccggaacgtccgggccgcgcgcccgcgctttcccgtgacccgcgacgagggcgagcgcgtcgcccgggcgttcttcgaggcctccgcgagcggcgatgtcgcggggctgcggacgctgctcgccgaccgcgtcacgctctcctcggacgggggcggcaaggtgctcgccttcgtaaacccgatccgggggctcgagcgcctgctccggctctacgcgggcgcgcggcgcaagtggggcgacggccgggcggcgctggtcgggttcgtgtggatcgacgggcttccgggctatgtcacccgcgagcgcggcggcctcctgcagacgacggccctcgcgatcgagaacggccggatcgacgccatctacatcacgcgcaatcccgacaagctccgccacgtcgcgcgcgccgtcgcggccggcccgggacccggcgacgcgggcgggcctgtggcgcgccggtcttga

SEQ ID NO: 5945 - DNA, 768 bp, Methylobacterium sp.
atgcatcctgccgtggccgccgccaacgccttcaaggcggttcatgacgccggtcaggtcccggactacgagcgcatcctgcgacagggctacagccgcttcctcgctccgggggatgtcgtcgtcgacgtcggcgcccataccgggctccatctcgtcgcgttcgtcgacatcgtcggcccgaccggcaaggtccacgccttcgagccgatcccgttcctgatgaaggatctggcggggcgtttcggccgacgacccgaggtcgagctgcacgacgtcgccctctccgacacggcggggcgcaccgatttcacggtcgcgagcgtgcccggcgagagcgggctcctcgcccgctacttcagcagtcccgccatcacgtccaagaccatcaaggtcaggacggagaggctcgataccgtcctcggtcacgtccccgcggtggcctacatcaagatggacatcgagggcggggagttgaacgccctgagcggcgcggctcagctcctccggcgatgccgcccgatcgtcagcgtggagtacggctgggccggctactccgcctacgggcacgcgcaagactccctctaccggttcgccgagagccacggctacatctgcgcggacatcaccgggaacctgatcgacgatgcgagcacgtggctcgcggtcagcgactacgtgacgtgggatttcttcctcgtcccgcaggagcgtcgagccgactgggccgccctgttcgcgcgccgcccggagcccggacccgcgtga

SEQ ID NO: 5946 - DNA, 105 bp, Methylobacterium sp.
gtggcgctcctcgccctctacgccctggcgctgcagggcgtcctcggcggcttggcctccgccgccgcggggccggaccatgtcctctgcctcgccgacggcggc

SEQ ID NO: 5947 - DNA, 255 bp, Methylobacterium sp.
atggaggttccgatggacaggaagcaggccctcgaactcgcgatcttcgtcatcgcgctcgtccccttcctccgctgcctcatgccctccgcgacacgctcccgggggccacgccgctccggctccctcagctacgattcgggctccggcggcgacggcggcgcgatcttcggcgatggcggctgccacggcagcgacggcggcagctgcggcgacggcggcggcggcggtgatggcggtggcggcggcgattga

SEQ ID NO: 5948 - DNA, 1338 bp, Methylobacterium sp.
gtggagttccgcttcgaccgcaaggaaccgggtgtctggatctccgccggcacccacgtcgcgctcctcgcgctggcgctggtcagcgtcgcggccccggccctcccggaggctcaggagggcgtgcccgtcgaggtgatcaccgagaaccagttctccgagatcaccaagggcgagcgtcaggccgacaagccgatgccgaacgccacctcgcgggccgaccgcaaggccgagaagttcgaggaccgcgagcctgagaattccaagcaggacgcgccgaccgcgccgacccgcacggccgagatgaagctcgccaacgcggacgagatgccgctgcgcgccgagcccgacccgcaggaggcggcccaggccgccaaggcggcggagaaggccgcgcaggagaagcgcgacgccgagaaggccgccgccaaggcggccgagaaagcggccgagaaggccgccgcggagaaggctgccgccgccaaggccgaggcgaaggccaaggccgaggcggtcgcgaaggccgaggccgagaagcgcgagcagctcgagaagctgatcgagaagcaggaagccgaggccgctgcggccgcccagaaggccgccgcgaagaaggccgaagccgccaaggaggcggccaaggaagcggccaagaaggccgccgacgcgaaggccaaggccgaggccgaagccgagcgtcagaaggagatcgcggaggccaaggccgaagccgagcgcgagaaggcggaggccgccgccaaggcgaaagccgaggccgcgaaggccgaggcggccgccaaagccgaggccgccgccaaggcgaaggccaaggccatggcggacgcgaaggccaaggccgatgccgaggccaaggcgcgcaaacaggccgaactcgccgacaagttcaacgccggcgacatccgctcggtgctcgcctcgaaggcgccgtcgcagtcgaccggcgccaccggccacgcggtgcagaaggtggcggcgctcggcgcggcgaccggcaacgcgcagcgcctgtcgccgtcgctgcgcgacgccctggtcggcctgctccagcagcagatcgagcggtgctactcggcgccccccggcgcggcccagggcgtggtcctgccggtgctcgacatccgcctgaacccgaacggctcgctcagcaccgagccgcggatcatgcgcggtggggcgagcgcggtcgaccagtcgatcgcgcaggccgcgctccgggcggtccgccgttgcgcgccgtacaacattccggccacctacgcgccgtactacaacgactggaaggccatcaacgcggagttcgagttcacggcgacctga

SEQ ID NO: 5949 - DNA, 183 bp, Methylobacterium sp.
atgacaattctgatggccgtcgctctggcgattgcgttgctcggcatcgcgctgacgtctgcagcctaccggtttgcaccggtgtcgaagcacatagcgagtggggatatcgtcctcgtctgtgggatcagcactgcggccttggggagcctcggagccctcctgcagatcttcaccgcctga

SEQ ID NO: 5950 - DNA, 87 bp, Methylobacterium sp.
atggtcggtgccgaccacaacggcacccgtatccttggccacacggtcggggagcctgcggcgtatgtccaggcgttccggcgctaa

SEQ ID NO: 5951 - DNA, 300 bp, Methylobacterium sp.
atgaggacagggatgcgcgtgcgcggcgtcgataaccgggagcgtaggcactggttctacgacagccgactgttggtcttcggcttctgcttgacggcgttcgtcgcgatcttctggcaggtcagccggttcgagggctttcagccgatcttctcctgcgcccgcacgacagacgtggaccgtcaattgctgcgcctgggaatggatgcctgcatgggcaacgcgcgcacccagtcagatcgcgagggctgcatgcggaccgtccatctgctcgcttgcatgaaggagcgctggcgctga

SEQ ID NO: 5952 - DNA, 153 bp, Methylobacterium sp.
gtgctgctcgacgagaccgagatgacggtggccgaatccgaccggtcgtttccatcccggacgcaggcctcggcggcggctctggccttcgcgaagctggtcgcgcgcgccagccgctcgctgaacgggggcgcgtcgagcggcctcctgtag

SEQ ID NO: 5953 - DNA, 225 bp, Methylobacterium sp.
atgttggacgtcgtcgcgagacatcagttctcaatcaaaagatttcccattccaacgaacgtagcctccacctccgccatgggcatccatatggaccttcgggatgcgctcgcggcctaccttgacgttggcacccagcatatcgtgggccttctggagcaacgatccgcgacgcagatagaacagtacggagcaaacctgcatgccgcaatgactgctccgtga

SEQ ID NO: 5954 - DNA, 303 bp, Methylobacterium sp.
atgggatcgaaatcacctgtccggagcagatcctccagggctgcggcgcccgaggacgacctgttcgagcgctccgcgccgccgcacgggccgggtgccgggcggcggctgcagcggatcgccgacgcgctgcaggttccggccacctccctgtacggcccgccgggtgcggagcggggcgccggcgtcgcgggcgggcgtgccgacgaggccgacgccctgctgcacgcctaccgtcgcatcgacgatcccgagatccgccgccgcgtcctgaccctcgtgcaggatctggcggcacgctga

SEQ ID NO: 5955 - DNA, 609 bp, Methylobacterium sp.
atgcccaagaccaacgcgtccgtcggtcagacctgtctcgaagccttccagatcgcgctcgattccgccgacatgatcgggcactgggcgtgggatcccgcgacggaccgcgtgcgcgtcgacgccctggtggccctcctgttcaaggtcgatccgaccgcggcggaatccggcatcccgctggccgtctacgagaaggccatccacgtcgacgaccgcggccgggtcgacgccctgatccgccgcagcgtcgcggcggggagttcctacgtcgccgagtaccgggtgatctccgtcgacggtcggatgcgctgggtcctggcgcgcggccgcttcaccagcgaccgtggcggccggccgacgggcgggcgcgggatcctcgtggacatcacggcgctgcgcgcgcgcgaggcgatcggcggcgcgaccgcgcccgacctcggcgacacgcccctagaccgggcggtcgagcacgccctcgccgcgcaggacgccatcgcggcgctgggcgatgcggccctgaaggccgaggcggacgcgctgctgatggcgctgggtcgacggctggcccggcggcaggtcgcggagcggcggcggcggctgaactga

SEQ ID NO: 5956 - DNA, 240 bp, Methylobacterium sp.
gtgccggacctgcgccgccgcgcgctgacgctgacccgcgacgccatcgcgggcgatgtccagggggacgacctcgtccggctcaccctgctgaaggcctgggagcgccgggcggcgttccggcccggaaccgggatgcccgcatggctcgacacgttcctgcgcagccgccccgccggcggtcgcgccgggccgaccggcctgtcgcggaacggcgtgtctgccgagatggcccgctga

SEQ ID NO: 5957 - DNA, 168 bp, Methylobacterium sp.
atgctcatccccgccccgaccatccgccgcctcctcatgctggggctcgtgctcgtcgccctcgtcgcgctcgcggacggcgtggcccgacacgagttgcgcacggccgcgcgcgcgatgaccctcgccgacgcggccccgcagacggagcgcgcgtcggatgagtag

SEQ ID NO: 5958 - DNA, 84 bp, Methylobacterium sp.
atgctgcgcggtggattgctgtggctgctgggaatcccgctgccgatcatcctgttgctgtatttcctcggcgtgttccactag

SEQ ID NO: 5959 - DNA, 231 bp, Methylobacterium sp.
ttgcaaagcgataccggctgcccgcggccccatcacgccggcgacgcgacggccgacatgatggagcacgcggccgaggagcaggcgggtctgagggtcaggatcgtcgtccgcggcctcgtaggcctcgatgagagacgtcaccaaatgtttcgatggaccagggtcgtcgccggctgccgacggcccggtgacggcttgctcgcgggagcgccgcaccaaatcgcgtga

SEQ ID NO: 5960 - DNA, 81 bp, Methylobacterium sp.
atgacgatcctggatccgatcaccggcgagctggtcaccatcgccgttccacggccgcggccgcaggccggcccgcgctga

SEQ ID NO: 5961 - DNA, 114 bp, Methylobacterium sp.
atgacctcggggacgatgatgcggggcgaagccccggccaatgtgggcgtgatggtccaggggcacgacgccctggggcgcgaccggcccgacccgttccgccccctgccgtga

SEQ ID NO: 5962 - DNA, 300 bp, Methylobacterium sp.
gtgctggcgctgcgtcacgatcggcgccaccgcgggcagctcgatctgctcggcgacgctgatgacctctgccggacgagcggcgtgcaggctggcgccgcagcacgcacacgcctgggaacgacgcgggacgattgtatcgggatcatcgctcagcacccggctgtgaccctcgtgagggggcttgccccgctgggcttggagtgcgcgcgctgctccttgcgatccgtcacgggcggcttggatgaggtgcgcgaggtcttgtccggttgctgcagccacagcaccaccttatcctga

SEQ ID NO: 5963 - DNA, 975 bp, Methylobacterium sp.
atgcgccgggtcttctcgacggccgggacacatccccggacgcgcttcaagctctggcaggaggtcgtcgccgaacggatcgggccgatcgagcagcgccggcgcgccgacgggccgttcgcgggcgagatcgagatcggcgccgtcggcccgctgacattcagccggatcacccagagcgccctcacgaccacgatcaccgccgatacggtccggcgccggcctgacgggctgatccgcgtgaacttccgtctcgccggctcgtccaccttccagcagcacggccgcgaggcggtgcaggggacgggagacctcaccgtcatcgaccatcacccgggcgtgctggacgcgcgcacggatggccagaccctggtcatggccctgccgcgggagcgcctcgagggcatgctcggaccggcccggctgttcgcggccctgacgatgcccgccggatcggccacgacccgcctggtgacgaccttcttcggggatctgctccgggtgaaccggcagctctcccccgaggcggcggagcgcatggcgacgatcggcgtggatctgatcgcggccgcgctcgcggatcggatggcccgggaggtgccgcattccctgcacggcagcgtcgtggtccagcgcgccaaggcccatgtcgaggcgaatctcggcgaccagaccctcgatccgccccggctcgccgccgcgatgggcgtgtccctgcgccggctccaggagctgttccacgggcgcggccagcacatctccgactggatctgggagcgccgcctcgcggcggcggccaggcgcctctccgatccgatcagcctgcaccgttcgatcggcctcgtggcctacgagtgcggcttcgcgaaccaggcccatttcgcgcggcgcttcaaggaccgccacggcctgtcgccccgcgcctacagggaggcggccgccctgcggctgtccggcagccagccggatccgtga

SEQ ID NO: 5964 - DNA, 414 bp, Methylobacterium sp.
atggcgcaggagatgcgctggcagaagcgggaaggggacggtcgcgtccatcttgcctacgagattccggacagcggcgcgcagggcctcgcgctcacctgcgacacgcggggcggacagctgagtgtcgactactacgacgacagagaccgcgctcgggacggcacccgggccgaggtcgagttcgcctcagagggcggcacgctctcgctgccgatgcgggcgaaacagctggaactcgacgaccagatcgtgctccagaccacgacaacgttgacgcaagactgggtgcggatcctgtccggcaagacccttcgcgtgacgctctctggcgacacgcagcggatccctctggccggcgcccggagcggtctcgccgccctggtcgcgggctgcagccgtccttcgcgatga

SEQ ID NO: 5965 - DNA, 627 bp, Methylobacterium sp.
atggcacgacgcgttgcgacgacgggaggggccggcggcaccgggatcctcgtcggcctcctggggctctgcctcgcaggaccggcgctcgcgggatccacgagcgtgaccgcgcggcccggggagcgggtccgcctcgacggctacgccacccacgagacccggccgggttgcccgtccgttccggcggccgcgatcgagctggtcacgcccccgcgcggcggccgcatcgagcagcggcgcgagttcctggtcctcggccagaacatcgacggcaccccgtcgcgggacggctgccaggacgtcgagcgggacgcgcggacgctctactacacggcccggcccgacttcgccggccacgacacggtgtcggtgatcgtcaccttcgtcaccggcgaggaggccacctacacctacaggatcacggtgcccgagggcgagggccggcgggcgccggcggtgtcccaggcacccgcccccagcgacgcgggcctcgcgcggccggccccggcggcgcgcgccgctccggccgagcgggcgaccctggctgcgagtccggctgcgactccggctccggcgccccgggaggccagcaccggcgacttcctgcgcgacgcggcccggggc

SEQ ID NO: 5966 - DNA, 603 bp, Methylobacterium sp.
gtgtcggcggtgatccagctcggagaactcgtcatgatcctggacctgcaccgccagggcctgtccgtcacggccatcgctcgccagctcagcctcgaccgcaagacgatacgtcggtacatcgcccgcggcctcgaacccccggcctacacgccacgcccgccccgcgaacgtcgcctcgaccccttcaccgcctacctgcgcgagcgcgtcgccgcctatcccgcactgaccggctcgcgtctctggcgcgagctcaaggagcgcggctacgcgggctcaacccggacggccaatcatttgaaccccagcagcttgccacatcgaactatcaatgctctatacacgttggagttgcatatcgaagcgggggttgtaatgcaagcatcggaatgctgcatcatccgggtgtccatcgccgcgagcctcggttggctcattgcgctcaccctgatgtggaaacacagcgtgctggctgcgctgctcgtcagccctttgttcgggactgcggcggcgatcgcagccatgaccctgttctggttcgtgagcctgtttgtttcctgcgaacccatcgggcctcgagtgtctgacactaaccggtag

SEQ ID NO: 5967 - DNA, 120 bp, Methylobacterium sp.
atgaagcgacagcgggagaccggggccggcacggcgcgattcagggcggacgccgcgggggccgccccggcggagcgggtccccggtctcggtctcggcgtcgctgccgggcgggcctga

SEQ ID NO: 5968 - DNA, 549 bp, Methylobacterium sp.
atgacggcgatagcgatcatcaccgcccccgacaggatgtggatcgcctctgacggggcagcctacaccgaaccggacggcatccttcgccacatcgcgcccaaggtggtgctatgcccggactgggactgcgtgatcagcagccgtgggatgggtctcgctgccgaggccatgcggatgcgcgggttgcgccacaacgcccgggatttcgatgagctggtggagaacgcctcagagctcgcagaggtggctgaggcggatctgagcctgtcggcgcggggtgtaacgcatcatttcaccctgatcctcagtggctacagccggtcccgccggaccttcgagacccacaccgttcgtacccgtcccgggcccggctgggatgcggatgccggccgaatcgtggaactgccgcccttcggtgtctcccggcaaccggccctgctactcctgcccgagcctgcggaagagatcgccgcacacttcgggctggagctgccccgcggccaggcgaatttccaacttgatcctccctcggtgtcgcggacatag

SEQ ID NO: 5969 - DNA, 597 bp, Methylobacterium sp.
atggcccaggctgcgttgtccctcgccgcgttccagaccgcgtatccgagcgcggaaccccggcgaccggcgcccccgcgccccagctacgtcgagaccgcctacgatccggtcgtccgcacccgggcgccctacccgagcgccatgcggcgcgcccgtcgccgcgcccggctgacggcgctcatcgccctcaccggcgtcagcctcgccggctgggccgtgttcagccacccgcaggggccggtccgccccgaggcggagtccgtcgcggcggccggcccggtcccgcaggccgcggcggcgccgcggccgagcctcgcctggatgctcgaccggagcccggcgctgggcgccggcaccgccacggccttcgggggcgaggccccgccggtcgccggcttccaggtcgccgccgccgccccgtccccggcggtccgggagatcgcccggcaggtcgcgcaggcggagcgggcgcgggccgcccaggtccggatggcccaggccaaagctgcagagaaagtcgcggacaagatcggcgagaaggccggtgagaagggagcgggggcgccggtccggatggccgcggccgagcccacc

SEQ ID NO: 5970 - DNA, 135 bp, Methylobacterium sp.
atgaagaagcttctcctcgcatccaccgtcctcgccggcatgaccgccgcggcgtccgctgccgaccttccgcgccgcgctgcgccgccgccggtgttcacgccggtgccggtgttcacctggaccggcttctac

SEQ ID NO: 5971 - DNA, 2646 bp, Methylobacterium sp.
atgcagaccggcgctgtcgcctccgagaagatggctacggcggaagcgaaggttcaggaagccgtcgacaaggccgcgcgcaccttcactggcggcgtggtgctgatcgcggagcgaaacagggccttcgaccggctcagggccgccgcggatccggtcgtgaaggcgcaacaggcggtggaacgggcagcaacggctgcggatgccgccatccggcggggcaccaccaccaccgatgaggcggcccggatcgtcgggatctaccagcagcggctggcgagcgcgaaggtcgccgccgatcagcacgtgctggccaacgacaacatggccaaatcgaccggcatcgcctcgcaccagctccagaacctcggctaccagatcaatgacgttgtgacgtcgctggcgagcggcgcgccggccatgcaggttctggctcagcagggcgggcaggttgtccagatccttggcgagacgggcgtttcgggcgcggtgcgcggcgttgcgggtgcgatcgggcgcttcctgacgccggcgacggttggcgtgagcgccctctctggggctgtggtgctcggatacatggcctggagccggtacgacgacgacagccggaaggtcggggtcacgttgcaggggctcggccgagagaccggcctgacccgggacgccttcgagaagcttgccacctccgcggcagccgccggcaacatgaccgtgcgccaagcgaccgacatcggcaccgccctcgccgcgaccggccggatcgggccggataacatctcgaagctgatcggggtctcgaaggacctggcggcgacgttctcagtcagcctggacgacgtgaaggagaagctcgtcgccttcgggaccgccgagggcatcacgcggctgaacgatcagctccaattccttgacgcccgcacgctccgcgtcgtccagagcctgttccgcgccgggcaggagcaggacgccatccggatcgccgtcgagcgcctcccggtcgccttggcgaaatccgagaccgctcagggcgccgtcgcgaaggcgtgggacgccatcaaatcggcggccagcgacgccgacaacgcgatggggcggttcctcgaccggatcacgaagggcccgtcgccggcggaccggctgaaggagctccaggaccgcgtcgaggcgctgaaggcggccgaggctgagaacatcgtgcagccgggcggcacgcggcgcgcctacgtcccttcgacctcgcccacggtggccagcaccacgccgaccccgctcccgccctcgcggccctccgagcttgagtcggccaagtccgacctccagtcctacatggaaaagctggccgccacgaagcgcgcagagcttgaggtagccgagcgcaaggagctcgaggccagcctcaaccgcaagtccggggagctcaagaagctcaccgaggaagccggcctcgggtccgactcttggcggaaatacaaggacttacagatcgcggcggacgaagcgctgaagtcgggcaaccccgagctgatgaagcgcgtcgacaacgtgaaggacctgtccgaggcctcgtccatccttgagcacgtggtgacgaccaccaccaacgccgagggcgagaggatgacagccggcgagaaggccgcggaacagcgccggatcgatatcgcgagcactcgggccgtcaccgtcgaggaacgggcccgcgccgcgcagatgcagacagaggcccgccagcgcggccagctcatcaccgtggcacaggcccaggccgacgccgagcacgccgcgacgatggtgcgggagcaggctgcacagcagctccggatgatgctccgggatcaggacctcgaggcggacagcctcaagcttcgcatttcgctgatcggccagggcgccgaggcgcaggccgttgcgatggcgcgccagcggatggagcaggacctcacccgccagggcgtcgttgacctgaactccgaccttgcccggagcgtcatcgccggggccgaggcgaacgcccggcttggggtgtcctacgacaaggccgccgaggcgcagcagcggctgcgggacggtcagaaggagctggcctcggaattcgggtccttcgtcgagggcgtgacgatcggtgggcagcggatgtccgaggcgttcgcctcgctgtccaagagcctcggcagcaacgcgctgaaggcgatcatctccggcgacggtccgcttgctgggattctcggcacggccccgggggagaagggccagctcggcggcctgctcggtgggagcggcggcctgtccaagctcttcgacgtcgacaagatcaccgagtccctcggcattggggcggagagcggcatcgcgaaggcgctcggcgacgcgctgaggccgtccaagcccggcgggggcatcctatcgtctcccctcggtcggggccttgcagtcgccggcgctggcgcctcgatcggctacagcagccagagccccttgatgggcgcgctgggcggcgggctagccgggttggcgagcggaaacccctacctcgccgtcgcaggcggcatcgccggcatcgcgggcggcgtctgcggccataaaccctctcggaagaaggatcgcgaccatgagcgccgtcaacgtcatctgcggttcgcgtag

SEQ ID NO: 5972 - DNA, 2721 bp, Methylobacterium sp.
atgagcaccgtcgtcacacaactggtggtcgacgctcgtggcgccgaagacggcgtcaggcgttacacaaccgcgatgcaatctggagcctccgcttcggaggtgatggctgcggccgaggccaaagttcaggctgcgatcgagaagtcggagcgcgccttcacgggtggcgtggtgttgatcgcggagcgcagtagggccttcgacaggttcagggctgccgccgatccggtcgtgaaggcgcagcagacggtcgagagagccgccaacgccgcggatgccgcgatccggcggggtgctacgacaacagacgaggcggctcgcgttgttgggatctaccagcagcggctggagagcgcgaaggtcgccgcggagcggcacacggtggccaacgataacgtggccaagtcgaccggcatcgccagccaccagcttcagaacctcgggtatcagatcaacgatgtcgtgacctcgctcgcgagcggcgcgccggcgatgcaggttctggcgcagcaaggcggccaggtggtccagatccttggtgagaccggtgtcggggccgctgtccgtggcgtcggatcggtgatcgcccggttcatcaccccggcgacagtgacagtcggcgcgctcacgggcgcggccgtgctcggctacatggcttggtctcggtacgatgacgagtcacagcgcgtcagcaccaccctgcaagggctcggccgggagacgggtctcacccgggacgccttcgagaagctcgccaccgctgcggcggccgccggcaacatctccgtccggcaggcctccgacctcggcacggcgctggccgccacggggcaaatcggcccgcagaacatcggcaagctgatcgccgtttcgaaggatctggccgccacgttcggcacggacctggacgggatcaaggacaagctcgccagcttcggcacggtcgaaggcatcacgcggctgaacagccagcttcagttcctcgatcagcggacgctcagcctcgtccagagcctgttccggcagggcaaggaacaggaggccatcgcgcttgcggtcgaccgcctgccaccctccctggccaaggccgagaccgcacagggggccgtcgcgcgggcctgggaggcgatcaagaacgcggtgagcgatgcggacaccgctacgggccgtttccttgaccggctcacgaaggggccttctccgacgggccgcctgaaacagctccaggaccgcgttgaggcgctgaaggcgtcggccgccgagaaccttgtccagcccggcgggacgtcgcgcgcctacacggtgccgacctctccgaccgtgagcagcaccacggcagtaccggtcccaccctcgcgcccgaaggagcttgaggacgcgcaggccgagctgcggcggtacatggagtccctggccgaggcgaagcgtcaggaggaagccgttgcggcccagaaggagcttgaggcaagcctcaaccgcaaatcgcagcagcttcacaacatctctgaggaggtcgggctcggatccgacaactatcgcaagtacaaggatatggagattgccgtaaacgaggcgatcaattcgggcgatcccgcgctgatgaagcgcgtggatagcgtcaaagacctatcagagatgtcgtccatccttgagcacgtcgtgaagtccacggccaacgccgagggtgagcggatgacggccgcggaacgcgctgcccgccagaacgcggtggacctcgatggcgtgaaggcccggaccgtggcggagcgcgagagcgtcgcggcccgggcgcaggtggagcgagcccggggccagaccattactgcggcgcaggcagaggcgcaggcggagcacgccgccctcatggtgcgcgaggaagccaaccagcgcctgcgcgacatgctgcgggatcagtcccttgaggcggacgacatccgcgagcggatccgccttctaggccaggacaccgaggcgcgtgccgtgtccaccgcccggcgccgggccgaatacgatctgatccgcgacgggtacagcctgaacagcgacctcgctcagagcgtcattgcgggggcagaggccaacacccggctcggggtctcctacgatcgcgccgccgaggctcagcagcgcatgcgcgatggccagcgggagttggcgagcgagttcagcaccttcgtcacggacatcctggccggcgggcagaagatgtctcaggccttcgatacgctggccaagaccttcagcggcaacaccatcaaggcgctgatcagcggcgaagggcctctggcgggcatcttcgggacggccgcgggcgagaaggggcagctcggcggcctgctcggcggtcggctcaacctcggcggcttgttcgacgtcgacaagattaccgagtcccttggggtcggagcggagaccggcatcgggaaggcgatcagcgaggcgctgcggccgtccaagcccggcggaggcatcatgtcgtctccactcgcgggcgccgtggcgtcgatcggggccggggcggccatcggctacagcagccaatccccgctcatgggtgcgctcggcggcgggctggcaggcctcgccagcggcaacccttacctcgccgtcgcgggccctcgctgcggccgcggagccgttttcggcaagcccgccaagtccaaacctcagcaggagccatcgagcgatgaccgccatcaacgtgatcgtgcggcctga

SEQ ID NO: 5973 - DNA, 1425 bp, Methylobacterium sp.
atgccagaggcacaggccgccagctccatcacccgcatcggcatgtgtgacgaggccgacgcccgtctggacatcgcagccgtcgagcgcttcctgaaggaggggtacccggcggcgagcccggccagcgtgaccacgtcgcgatctgccgtgcgcatggcctcggaggcccgcggcatcgcgcggcagacgatggacaaccgcatcggctcgccgaaccgcgccggatcgcacaagcgccgcttcggcctggagccggactggagcctcgccgagacccacgccgcgcaggcggcccgggcccgccgcggcgaactcgggacggatcccgtgctgaccggcttcgagctgagccaggtcaagacgcgcttcgacagcgagggcgcattcgccggcgaaaccatcacccagatcccggcgagcggtccgaagttcgagctgccggccggacaggccatctccaaggtgacggccaccgtcaaggccaacggccagctcggaacgcagtggatccggtacaagcccgaagggacggacccggtcgccttcgccgagtcgctgcgcgaggcgatgcaggactgccgcgggctcgcgcgggtcccggtggcggtccccgcccaggacgacgagctgctgaccgtctacgtgatccccgacttgcatctcggcatgttggcgtgggcctgggagtcgggagagagctacgacctgaagatcgccgccgacatggcgcgcacccagctcgcgcgcctcctggcgatggcgccgccggcccggaacgccgtgctcctcttcctcggcgactacttccacatgaacgaccgccggaacgtcacgccgcggtccgggcacacgctcgacaccgacggccggtggcgcaaggtctacgacgtcggcgcccgcctggcggtcggcctcgccgaggcggtcgccgagcggcacgaccaggtcgagatcgccttcctgccgggcaaccacgacgaggacgccgcgcagacgctggcggtcgcgctggacctgttcttcgagcggcacgcgcggatcaaggtcgcaggctcgcccggcgatcactggttccggcgcttcggcaagtgcctgctgggggcgagtcatgggcacaccatgaaggcggaccgcatggcctggatgctcgcgaccgaccgggcccgggactggggcgagaccgagcaccggcacttcttcttcggccacatccaccacgagaccgccaaagagatcggccccgtgcgggtcgagtccttcacgtcgccggccgcgaaggactcgcacgcctcgcagggcggctaccgctccaaccgcgcgctcaacgcggtgacgttccacatcgaggacggcgagcactgccggcaccgggtgagcatccggacgccgcagcccgccgtcgagctgcaggtggcggcatga

SEQ ID NO: 5974 - DNA, 798 bp, Methylobacterium sp.
gtgagcgcgggcgccgtcgccgtcgtctgcggcagccgcggcaacccgcactggcactgggtggccgagcaactcgacgacctgcacgcccgccggccgatccggcgcctggtcgagggcgggcagcgcacgcgcgagcaacaggggagcgtctggcacgtcgtcggcggcgtcgactttcacgctctgtgctgggcccaggaccgccggatcgagcgccgcacggtcgaggccgactgggccggccaagggaagcgggccggcccgctgcgcaacggccggatgctcgaggaggagcgtcccgatttcgtggttggcttcccgggcggggccggcaccgccgactgcctcgcccaggcgcgcaccgccggcatcgaggtgatcgagatcgcgcgcgactgttgccggttcagctacgtgccgaccctgagcgtcgagctgtgccgggaatggccggacgcgctgttcgtcttcggggacaacctccagggctggggccggaagggacaggccgcgatccgcgacgagcccaacgccgtcggcatcccgaccaagcgcgcgccgagcgaggcgccgacggcctacctggtcgacgccgattatgcccgggttgccgagcgggtcgcgccgatcctggcgcacctgcgcgagcacatcgagcgcggcgggcgcgtgttctggccggagaacgggatcgggaccggcctcgccgagctgccgcaccgggcgccgcgcatccaccgcgccttcgagaacgcgcggatcaagctgcagcgcctcggccgcagcatgccctga

SEQ ID NO: 5975 - DNA, 726 bp, Methylobacterium sp.
atgccagtagccgccaccgagaccgccgaccccttcgacgtccccgcgctgatccgcgaggtggacgagctgtgggaccccgaaaccactctcatgacgcacaacgagcgggtcctgatcgaattctgccggcggctcgccgcgccgctgcgcgcgatcgtcgacacccgcgccggcatggcgctgtccaggaagctcctcgaacagtccggcggctccgggccggcttggaagcccttcatcaacgtggcgctgcaggggccggagtacctgatggtgttggccggtctgcgctcgctgtcggcgaccgcacgcggccctgcgccgttccaagaccgggtcctggagcagatgtgcgagatctgcgcggacgacccgaccgacctcgaggagcggcgcgatcggcacgccgaggaggatgccgagctgctccaatccctcgggctgtcgcgcgaggctcatcaccgcatcgtcgattacgtccacgaccggcccgtcggcgacccgggccaggagctgggcggcaccatgcacaccctggcgggcctcgccgctctcgcctgcctcgacatggtcgcgtgcggtgaggccgagttcgaccgcgtcggtcggccggagatcaccgccaagatccggcgcaagcgcgcgaaccgccacggtcgcggcccgctccccggcgacgacgcgggcctggtcacgtcgacggccagtcgccccggcgcgtaa

SEQ ID NO: 5976 - DNA, 156 bp, Methylobacterium sp.
atggtcgatggcccccgtcggccggcgcgcagcgacgcgatcccgcccggcgcgggatcgggggacgggccgcgcaggacgcgcttccgacgccgggcggactcggcccgcgccgcggcgaacatcgaggccgtgaccggcgttcccgacccgtga

SEQ ID NO: 5977 - DNA, 84 bp, Methylobacterium sp.
atgctcgacatcgtcttcctcgcagcggggctcgccttcttcgccgcggcggccggctacgcggccgcctgcgaccggctctga

SEQ ID NO: 5978 - DNA, 1038 bp, Methylobacterium sp.
atgccgaacgtcgtcgctaaccgccaagtcgctcacatctgggcccatcaggcacaggacagcgcccgctcgcacaacggcaatttctggttcgagggccgcaagctctacagctattccacgccgatcgcgaaccttgtcccgggtgttgacggcgaactgatcgcgctcgttactgcgcgaagctacagcatcaccacgaacggcaagcacatcggcccggctcactccgcgctcggctatggccgcgtgcgcaaaaccttcacggttcccttcatcggcgccttcggcggtcaaaaccgcggcgacctgaacctgtccgagaccaacgcggccgagatccacgcggcgaaccttgaagcctacctcgcggactacaccgcgaccgtcgagcggctcccccgcaagcgcgattacgaccgcgccgacgctctcgcctcgctgaaccgcatcgccaaccccgcgtgcgactacgccgaagcgttcggcctgtcgcgtccggcctatgacaccgacgcggacgaagcggccgcgttccgcctctggagcgcccgcaacacgcccgagcgcatcgccgcgcgcctcgctcgcgccgaagccgcggcggctgccaaggccgcacgcgacgctcgcgacgccgcggcccgcgtcgagcgggagcgcgccttgcgcgaggcctggctgtcgggtgagccgaccgcctactttcacggccgcgacgagcgtggcggcgcctacctgcgggtgcgcggcgacgtgctggagacctcgctaggtgccgaagtcccgctgtcccacgcgatcaaggctttccgcttcgtcaagctgtgccgcgagcgcggcgaggcttggcaccgcaacgggcgcaccgtccgcgtcggtcacttccaggtcgacagcatcgaggcatcgggcgacttcgtggccggctgccaccgcatcaactggagcgaggtggagcgcatcgccgcgagcctcgacctgctcgacgccgagccgtccgcggacgctgtcgagccgtcgcacgccgcggcgtag

SEQ ID NO: 5979 - DNA, 102 bp, Methylobacterium sp.
gtgaccgcccgcgccgtcctgctccccctcgccgaagcgtccgccgtgatgttcggcgccgtcgccttcctcgccgtcgctgtcgccttgggtgcgctctga

SEQ ID NO: 5980 - DNA, 114 bp, Methylobacterium sp.
atgttctacgtcctcgccctcgccgtcgtcggcgcgtcggtcgccctccccttcctcgggctcgccaagctcacggagtggacgcatcgccgctgtcacccatacgacctctag

SEQ ID NO: 5981 - DNA, 1155 bp, Methylobacterium sp.
atgtcggtcgtaagcccgttaatctacaatatcgtcgactacggcgccgtctcgaatggcggcgactgctccggagcattccaggcggccttcaacgccctcaacaacacgccggagggcggccagatctacatcccgcccggccggttcctcatccagaacccgatcggcggcaccaccgacaagagctgcgtcatcaagggtgcgggcgctgacgcttcggtgctcgtcttcaacggcccgaacctcaacaacggcctcgtcctccagcaggtcacgccgaacaacgcctgcgcattcaaggacttcggcgtcgtcgccaccggctgtccgaacctcggcaacgggtcggtcctgtcgatcatcggcgtcctccagggctgcaacggcatcaccgtggatggcctgcatgtccgtctgacggacgacgcgccgtgctcgaacgtgctgtacgtgcgcaacccgtcctcgggtgtcatccgcgacttcaacgtggacggctactcgggctggggcgagggcaacaccgcgaccggcatctacatcatctgcgacacgcagggcgccaacgcgatccagctctacaactgcaacatcttccgcgtctacaagggcatctggtgcgtcggcggccagatccagcagtacgtcatggaaggtttcgaggccaacgagtgtacgctcgtcggcgtccagtacggcctgcacatgcagggcggctggtacaggcctccgggcaacgcgtggaagggcgggcacatcaacgctcgccagatctgcatccttctggagacttggtacgagttcaagatctcggacactctgctgtatctcgacggctcggccgccgcgaacagccagggccacatccgggtcatcaactgcgacgagatccagatccacaacaactcgacccgctacgtggacgagatcacgggtggcccgacgcagcggggcatctggggcatcgcgatctcggacagcagcaacgtgctggtccagggcaacttcttcgacatcggacgggccgacagcgcggcgctctacagcgtctcgggcaacagcaacgtccggtcggccttcaacacgaagcgcggcgggggcgcctacggcgccggggcctacaccgagatcggccaggacatcgtcgtctga

SEQ ID NO: 5982 - DNA, 117 bp, Methylobacterium sp.
atgaccgcgcctactcgcaaggtccggggcggctgcggcttctgcgccgtggtgttcgccgccggcctgatgatcgccggctacgccctggccttcttcgtcaccctccacggctga

SEQ ID NO: 5983 - DNA, 324 bp, Methylobacterium sp.
gtgagcttacagtcggaatgcgctttctattggcgtttcgcgcccatccttgagatggcgaagacttcctggatagctggaccgatcctagaggaagctagggacgagatccagagcattgcgctgcacacccgtaatgctttgctccgcgaaatgtgcatcagcctcttggacgcgaccgccgaggatcggattgtcaacttttcgacggaacaagtggtgaacgaaatcctaagggccgtcgttcggggcagccgtgcccaatttccaggcgtctctgagggaaataaggtcgcacatctagacgtgcaggccttcgggtaa

SEQ ID NO: 5984 - DNA, 195 bp, Methylobacterium sp.
atgagcaagatcaccgaccaggatttgcttagtgccaccagtaacggcgatgggacgcacgacggcgtgaagctggcacagtggctttacgaggcctatactggcaagccgctgcctcgcgacaaggccgaggagctggtgcaggaaggcgtgcggcgggctcgcatccgcaaggaccaggaggcccgaggctga

SEQ ID NO: 5985 - DNA, 846 bp, Methylobacterium sp.
atgaccaaacagccgctcgccgtcgtcaccatggccttcaacgaggcgatgctgctgccgatctgggcgaggcactacggccggcaggtcggggctgagcactgctacgtcctggaccacggttcgaccgatgggtcgacgcgggacctgcccgtcaacgtcctccggctcccgcgctcgccccatgacgagcaccgccgggccgtggcggcgggcgatttctgcacgtcgctgctctacttctacgaccgggtcctgttcaccgacacggacgagatggtcgtcgcggatccggcccgggacgcgaatcttgtcgagttcgtccggcggctgcccggcgccccgtcgatcgtctcggccttcggcgtcgacctgctgcacgaccacacgcgggaaggccccctggattgggcacgcccgctgaccgaccagcgcagcgtgatccgaccgttcaactcgctgtgcaagcccacgctgatccgcgagcgcccggattgggccgccggcttccatttcagccaccgggtgccggcgacgacgatcgtgccgttcctctacctgttccacatcgccttcgtggacaacgacctgctcgtgcagcgccagatgcagcggaacaaggtggagaaggcccaggtcgatcaccaccagatcccgccccagccgctgctcgatcacgtcaagcgggacatggagacggtccggcgcgtcgggacgaagctggagcccggcgaccgggagttcgagcgggtgcgggcccggtggacgaaccttctcgacctgcgccagttcgtccagctcgacgagttctgggagctgccgcgccgattccgcggtttgatctga

SEQ ID NO: 5986 - DNA, 213 bp, Methylobacterium sp.
atgcccgcagatcgcgactttggtgctccggcccagccggcggcgcccccgatcactatcagcgtccagatcttccgcgagatcatgggcgcggccggagccgtgctggcgggttacggcgcctggctgcactacccgccggcaggcttcatggtcggcggcggcgtgctggtcgggctcgcgatcgtcgggaccctgcgcggtaacggctga

SEQ ID NO: 5987 - DNA, 126 bp, Methylobacterium sp.
gtggtctactggcctcggatcgttgatgccgcccaagcgcgcggcatcgagatcaacaacgacatcctcgtccgggcgcatctgcctcgcgaacgtctcgcacccgccgagaccgaggccgcctga

SEQ ID NO: 5988 - DNA, 189 bp, Methylobacterium sp.
atgagcgagggcgatgatccgattcgcgaagccgtctcggcactcagagcgaacggctacgaggtcgaatcaatggccggcgatcacatgctgtggctggtcaacggacaggcgctgaccgagggcgagctgatggccctggccgtgcgcctcggcctcatggactccacgacggacaagctgcaatag

SEQ ID NO: 5989 - DNA, 1155 bp, Methylobacterium sp.
atgaccattacctgcaagggcgccgtgctgcgccggatcggctgctcgcaaccctatgcggagtcgaagccgctctcgatcgagacgatcaccctcgcgccgcccacggcgagcgacgtcgtcgtgaaggtcgctggcgcggggctctgccactcggatctttcggtcatcaacggcgaccggggccgggacgtccccatggtgatggggcacgagggcgcgggcgagatcgtcgaactcggttcagccgtcacggacctccgggtcggcgatcacgtcgccttccagttctcggtctcctgcggccggtgccgggcctgtctcggggggcggccgaacatctgcgaggcggcgccggccgcccgcagccgcggcgaactcctgtcgggcggctcgcgcatcaccgatgccgggggcgccaccctgcgtcatcaggccggcgtctcgtgttttgccgagtacgccgtcgtcaatcgcggctccgtcgtggtcatcgatccggaactgccgctcacggaagccgcggtgttcggttgcgcggtgatgacgggggtcggtgcggtggtgaacaccgccaatctgcgggcgggcgaggccgtggccgtctacgggctcggcggcgtcgggttgagcgggatcatgggcgcgcgggtcgccggcgccgggacaatcgtcgccgtcgatatcgaggaggccaagctcgacaaggcccgcagccttggcgcgacccattgtttcaacgcccgggacccggacctcgacgccaaggttcgggaggctaccgccggcggggtcgactgcgccctcgacttcgcgggcgccatcccagcgctccgatcggcctacgcggtgacggtgcgcggcggccgtgtcgtcacggccggacttgcgcccttcggcgcgcagttcgccttcgagcagggcgacctcgtctcgaacgagaagcagatctgcggttgctacatgggctcctgcgtccccgtccgcgacttgccccgcttcgtgaagctctaccggagcggcgcactccccgtcgatgcgctgatcgattcgatcatcgggttcgacgagctgaacgccgggttcgatcgactcgcccagggctcggcgctgcgtcagatcctggcgccccacggtggcccccgccccacctga

SEQ ID NO: 5990 - DNA, 612 bp, Methylobacterium sp.
atgcagacctttgctcacatcgtcgacggcgccgtgcgcgaggtggtgaagctcgcggacgacaaggtcctcggaaaggacctctactccgccgccttcgccgcggagtgtgtgtcgtgtgccgcgaccgtcgtcgccggcatgctctacgacccggccaccaagaccttcgcgccggcgcccgtgccggtcgtcgacctcggcgcgctcaagggccggctgaaggcgcaggtcgacgcggatgccgaagccctgcggctcaccctgatcacgccgggctcgggtcaggcgatggagtaccaggaggcctacgccgaggcggtccaggtcgacgcggccgtgaaggcgaacgccagcgccaccttcgatccggccgccttcccgatgctgtcggcctcgctcggctacgacctcgatcctgagaccggcaaggccacgaccgacatccccggcgaggcccgggcggtgctcgccgcctacgacgcctaccagaaggcgggcgcggcgatccggggcgtgcgcctgcgcgccaaggccgcgatcgacgcagcggcggacgcggcgtcggcttcggccgcctatgcggcgatcgtctggccgacgctggcctga

SEQ ID NO: 5991 - DNA, 147 bp, Methylobacterium sp.
ttgcgccgaccgccccgatccgggcgcgatcggcgggcgttctacgggcaggtccaccggagacgtgctgacatgctgatcctcaacccgatgaccggccagatggtcgaggtgcgcgtgccccggccgaagccgaaggccgcctga

SEQ ID NO: 5992 - DNA, 255 bp, Methylobacterium sp.
ttgaagcagatccgtggcctgtaccatcaatgggcgcgctccgggctggtccgcgcgagcggcaacccgctgatccggctggcggcccgccgcggcctgccggcggcgaacgatgtcgtcaccgcggacgcgcagatcgccgccctggccccgcactttgacacggcgttctacgcgagctggtacgggatcgcggccgacccggtgcgcgactacctcgtccacggctggcgcgcgggccgcgacccgcgcccc

SEQ ID NO: 5993 - DNA, 405 bp, Methylobacterium sp.
atgactcagccacacctgatcgagtttcgccacatcctcgatcataggggtgcactgacccctatcgaggccgagaaggacgtgccgtttgcgatccggcgcgtctatttcatctacgacgtctcgcacggcgcggtgcgcgcgggacatagccacaaagaactgcagcaggtcctgatcgcgatctctggcagcttcaaagtccacttggatgacggccgcacgcgcaagacgtttctgctcaatcggcccaacatcggcctctatgtcccgcgcatggtgtggcgcgatattgacgatttctccggcggggcagtgtgtctctccctggcctcgcagcactacgaagagagcgattattacagggactacgacacgttcctgcgcgccgtggaaagccggtag

SEQ ID NO: 5994 - DNA, 102 bp, Methylobacterium sp.
atgccgaccatgatcagcgtggtcgccaccgggaaccggatgaacggcgccgagatgccgcccttcatggccgggccccgcgcggatgtgcgcccgccgtga

SEQ ID NO: 5995 - DNA, 333 bp, Methylobacterium sp.
atgtctcacaccgctttctcatccaagagcgccaccggccggaccactgcgtcacgactggtctccgccgccttagccggtctcgtgctcgtcggcacttcggtgatgcccgccgcagcagggcacttcatgtcggaagcccccgctgccgcgaagccagttcggctgccggcgctccacacaacgacgggcttccggcgcgtgagcgcggtcggccagaccaagccgcccggggcggccctggattggcgcgccggcacaacccccgggctcgacgctcagagccatcgcctggaccagctcatcaccaccacgatttgcagtcgctgctga

SEQ ID NO: 5996 - DNA, 426 bp, Methylobacterium sp.
atgcgccatacgggcggcgggcgcaccaccgagggcgagaccgagatggcgctggagcacgcgcagccgctcggatcggcgggcgtgagcgacagcgacgtcaccgacactctcggcgaaggtccgccgtggacaagctgggttcgcacagcggaagcgtcgcaaccggaggcgcaggcggacggaccggccctgccacggcaaatcggcaagggtgcgctcgcagtgaccgtgcttgcggcctgcggacgatcgacaggtgggacagcatgtcggacccggacggggtacgacgcgcacgatgagcgggtcggtcgccagctcgacgccgacgacggtcaggccatcgggcacgaggggcaggatacggcggggcatggcgtcctccggaaagccgatctccggagatggggcacatcacgctaa

SEQ ID NO: 5997 - DNA, 570 bp, Methylobacterium sp.
atgaagaagcccgccctcaccggctacacgttcaaccccaccgcgcggacgctggatttcagcgccacgtcggggttcacgatccagagcctgctcgtggtcattcacgagccgaccggcaagacgctctacgccaagggcaaggcgcaattcgcgccgaagaccctggccggcgcggtcatcaccctgaacgatttcgtggacaccaccggcatggcggccggggatgcgctgtacgtgctccgcgaggacgggcaggacgtcgcgaccgacggcaggctggaatcgctgcggcgcggctcgacggcgacctcggacgcctccggctcgctggccgcggccacgaacgtcgcaccggcggcgctggcggcgaacgcgaaccgctcgttcatcgagatcacgaacacgggcccgaatccgctggcctaccgatggggtgccgccgcgtccgccacgaacggccacatcctcgggccggggctgaccgcccgctatcacgccaaggtgccggtcggggcgctgaatatgttctcgaccgccggcaccacgtacttcgtctccgtcggctga

SEQ ID NO: 5998 - DNA, 306 bp, Methylobacterium sp.
ccctgcctgggcttcgccatccggtcggggccgcggcggatcgccgaggggcgccccggggtcgggcgggaggtgccccgctcggtcgagcagatgaccgagctggtcggccgggtctcgatgaagaccctggtgcgcgagacgaccgacctgatcgagaagctctgcatcgaggcggccctgcggatcacccgggacaaccgggcctcggcggccgagatgctcggcctgagccggcagggcctctacgccaagatgcgccgctacggcgtcggcgacctggacggcccggtcgaggacatctga

SEQ ID NO: 5999 - DNA, 408 bp, Methylobacterium sp.
atgcgcacagccctcgccgccctctgtctcatcgccgctgccgacgcggcgcaggcggccggcaaggcagcggtgagcgtcgatcagctgctcgccgaccccaaagcgcattggggcgagatggtcttggtccgcgggatccgttgcgtcgatcccggtcctggcgggttcatctgcgagaccacggtcaacggccggctaatacggctggacgcctccgggctcggcggccacgcctcggaggcgatagccgagaagctgattggcccgtgcaatgggctcgcggcgctcaccaagccggcctgcaccttcgacgtgaaattcgttccgactggctcgggctttgaggacggcgttacgatcgtccacacgcccgagatcgacatgagcgccacgcggcgccgatag

SEQ ID NO: 6000 - DNA, 165 bp, Methylobacterium sp.
ggtgcctacggcggcgggggcggctaccggaatgatggctacgacgaccggcgcgacgcctaccgcgaccgccgcgactacgaccgcccgccgccgcgccgcccctacgacgacgattacggaccggggccgcgccgctaccggggtgatccggacgagtactga

SEQ ID NO: 6001 - DNA, 198 bp, Methylobacterium sp.
atggccgaggcgttcgtgcgaaccttgaaacgcgattacgtgcctgtctcggtgctaccggacgccgacagcgtgctgcgccagcttcccgtttggctggcgcactacaacgatcttcacactcatcgcgtgctgggttaccgctcgccgcgcgagttcatcgaccgctcaactcaggagatcttgtccggtctttag

SEQ ID NO: 6002 - DNA, 1110 bp, Methylobacterium sp.
gtgttcgtcacgctggaactcagcaagccggcatggctcctggccgcccaggccgtcccgagcgggaagacctccgcacaccgggtgagcggcggcgacgtggagggcctgctcgccttgctgcgccgcctgcaggctcgcgagcagcgcagctccggccgagaggtcgcgatcatcctcggctacgaggccgggtacgacggcttctggctgcagcgccgcctcgcggccgaggcgatcacctgcttcgtcatggatcccggcagcctccaggtcgaccgccgcgcgcgacgggccaagaccgaccggctcgacgcggccatgctgctccgggctctgatggcgtggtgccgcggcgatcacgccgcctgccgcatggtgcaggtgccctcggtcgagcgcgaggatgcgcggcgcacgcatcgcgagcgccagcgcctgatcgcggagcgggtgcagcacgtcaaccggatcaagggcctgctcgccacccagggcgtctacacgttccagccgctgcgacgcgaccgttgggagcggttgaaggaggtgcgcaccggcgacgggcgcgacctgcctcagcgcctgcgcggcgagatcgagcgcgagttccggcggctggaactcgtgctcgaacaggtcgcggccgccgaggccgagcgcgatgccgccgtggcggatccggccgtcacggacgccgacgccgagaaggtggcgcgtctggcccggctcggtggcatcggcaccgagctggccacggtgctggtgcgcgaggcgctgtatcggcccttcgccaaccgcaagcaggtggccgcctatgccggtctcacgccgagcccgtacgccagcggcgaccggcagcgcgaccagggcatctccaaggctgggaacccactcctgcggaagtcgatggtcgaactggcgtggctgtggctgcgctatcagccgggcagcgggctcgcccgctggttcgtcgagcgggtcggcaccggacgcgggcgcatccgcaagatcaccgcggtggcgctggcgcgcaagctgctggtcgccctgtggcggtatctcgccaccggtctggttccggagggtgcgcgcctgaaggcggcctga

SEQ ID NO: 6003 - DNA, 204 bp, Methylobacterium sp.
gaggggggacgggcccgggcgggcgcggaggccctgcaggcggcccgcgccctgcgtgcggccgggctgccggccctcgtggtcgataccggcacgcggggcgacgaggcccgttcggtggcggacgcgatgggcgcccgctacctgaagctgccccgggccgaggccggccagctcagcgcggcggtgcgggcggcgctctga

SEQ ID NO: 6004 - DNA, 270 bp, Methylobacterium sp.
ttgcgtactctctcggccgctgcgccgctggcggccgtcctcgccgggacggcctacgcgcaggcgccggccaccgcgccgggcgcgccgccgacctcctcgggcgtcgtcacgcctcaatcgggcgcgaccggcgcgccgggcgcggtgacggggtcgccgaccgggcaagccgccgacacgcgttccaacagctcctcagccgcgggcaacgccaaccagccggagcgcccgtcgccgcagggcggcagcggtggcagcagccgatag

SEQ ID NO: 6005 - DNA, 327 bp, Methylobacterium sp.
ttgagcgtcctgggcaagtggcggatcgtcgagctgcccggctacgcggacgactatgccgacatggtcgagccagcctacatcctctttgaggccaccggcggcgagttcgccttcggatgcgtcaccggggccttcgccggtggtggtgaccacgctgccgtcaagttcgactggaacgggaacgacgagatggacgaggcctgcggctccggatgggccgcgcttcaggccgacaactcgcttcggggcgaaattggcttccacgccgacgacgacatccccttcatcgctcgccgctggccgagttcttcaacagcctgctag

SEQ ID NO: 6006 - DNA, 3111 bp, Methylobacterium sp.
atgttcgtcgatcccgtccccttcggccccacgatccggctggtcccgcacagcggcgtccagttcgtggaatacgacttccacatcgacacggtcgggcgcctgtcccgccgcttcgtcgagcgcgcggtcacgggcacgccccagggggacgggcggcggacctaccgcctgctcccgacctggaacgaggacgacccgggcgccgaggcggtcgagaccgcgcgcggcgacgaccgggaatacgcggtcggcgagcgcggcgccctcgaggtcttcctggagaaatggaccccggtgccgatgctgcgggtcaaggccggcgtcgagggcggcgaggaactcgacctcggaccgaccaactgggcgcgcgtgcggatcgtcgaggtcgccgaccgggcgccggacagcccgatcagccaccgggtgatcttcgccttcgacaccgagctgctcgagcggcgcccgaaccggccctacacggcgccgtgcctggaggacgccgccaacgagcacgagttccgcttcgcccatcgcttccgcgacatcggctggttcctgggcgcggccggggaggacgaggaagcccgccggctggcgggcttccaggaatgggtccccgcctggctgctggagcagttccgcgagttcaaggcggcgcagcggccggaccgccccctgcgcgatacggacttcccgaacgcgctcgagcactacgcccgctacctggtcttcctcgagtacctgcagacggcggtccggccccggaccctgcggctgaccgatacggtgacggccgagccggcgatccggccggtcacggtcgacctgatcctcgacatcggcaacagccgcacctgcgggatcctgatcgagtcccacccgaacgaggaccgggtcgacctcaacaactcgttcgtgctgcagctgcgcgacctgtccgagcccgagcaggtctacaccgagccgttcgagagtcatgtcgagctgtcgcacgcccggttcggccgcgatcacctctcgcgcctgtcggcacgcccgcgggcgttcttctggccgagccccgtccgggtcgggcccgaggccagccggttccgcgagctcgcccagggcaccgaggcggtgggcggcctgtcgagcccgaagcgctacctgtgcgacgtccgcccggtgaaccaggaatggcgcttcccggaccgcgactacggcgccgacgggacgagcccgctgatcgaccgcacgatccggcagttcgtcaacagccgcggcgacgtcatcgcgcagctcgacgccgaccggaagcgctacgggatccgggtcctgccggacgaccgcgtcggcgcctcgcgcctgaccttctcgcgctcgtcctacttcaccttcatggtcgccgaggtggtctgccacgccctgtcgaccatcaacaatgccggggtgcgcgagcgccggcgcaccaaggacgccccgcgcaagctgcgccggatcatcctgaccctgccgcccgccatgccggtccaggagcagcgcctgctccggtcccgcgccgagggcgcggtgaagctcatctggcagctcatgggctgggccgacaatccgccccccggcctgacccagcccgaggtccacgtcgcctgggacgaggcgagctgcgtccagttcgtctacctgtacggggagatcacccagaaactcggcggcgccgtggacggcttcctgcggctcgtcggccgcccccggcccttcgcggagcccgacaccgcgcccggcccggagatacgcccggagccgtcggtgcggatcgccagcatcgacgtcggcggcggcaccaccgacctgatgatcacgacctactacgcggagggcaaccgggcgatcaaaccggtgcagaacttccgcgaggggttccggatcgccggcgacgacatcctcaagcgggtgatcgagcgcctcgtcctgcccacgatcgaggcggccctgcgctcggccgggcatcccgacccgcacgccctgctgctggagcgcttcggcggcgaccgcgccaacatggccgagcaggagaagcacctgcggcggcagttcgtgtcgcgggtgctggagccgatcggcctgcgcatcctcggcgacgtcgaggcgggcgcggagatcaccgcccgccccttcgcggagttcttccccgaacgcggcggccggaatcttcgccgcgccctgccgcagcagcgcctgctcgacttcctcgagatcccggcccgcgccggcggcgcggcggatttcgccctgaccgactgcgtcttcgagagccgagccgacgtggtcagcgcctgcgtggtcgcgacgctcgacctcgtcctcgacaacctgtgcgaggccgtgcacgccctcgacgtcgacgtggtcctgctctcgggccgcccctcccggctccaggcgttcgtcgactgtctcgtcgacaagctcgcggtctcgccggaccggatcgtgccgctccaccagtatcaggccggcacatggtacccgttccgggagcgggacaaccgccgcatcggcgatcccaagaccaccacggcggtgggcggcatgctctgcgcgctcgctgagggccagctcaccaacttcaccctgttcacccgccgcctcgcgctgcgctccacggcccgctacatcggcgagctggagctgagcggccagctccgcgacgccggcctggtcttccgcgaggtcgatctcgacgccccggcctcggcccggcgccagggacccgcgatgagcgcgaagctccggtactacgcgccgatgcgccttgggtaccggcaattgccggtggagcgctggatcgcgacaccgctctaccgattgcggatgcgcgccggccaggaggcgacgcagctgcggctgcccctggagatcaccctggagcgtagcggcgacggccggcccgacgatgaggggccggatgccctactgcgctccgagtcgatgaaggaagaattcgagatcaccgacgcctacgacgcggatggtctcgacgtcagacgcaagatcgagctcgtgctcgataccctggcctcggagcagggatactggctcgacaccggcatccttgccctggattga

SEQ ID NO: 6007 - DNA, 2616 bp, Methylobacterium sp.
atgtcgaccgaacatctggcgcaggattgcaggaatacgggtcggctggccgaggacgccgagcagtggctcggcgacgaggccaatgccggcgcggtcggacgggagcgcgcggatctcatccgctacgtccggaaggcggccaaccgggccgagcggctggcccgcgcggcggcgcggccgatgtgcgcgggcgtgttcgggccgagccaggcgggcaaatcctatctggtcgaggtcctggcgcgtccggaggacggtgccctgcgggcgcgcttcgacgggcacgagccggtggacttcctggccgagatcaacccgatcggcgagaaggaggcgacggggctggtcacccgcttcacggccggtgcaggggccccggccgggcaaacgccgcccggtgcgccggtccgcctgagggtcctcagcgaggtcgatctcgtcaaggtcctgtgcaacaccttcttgcacgacggcgacgccaccaaggacacgcctctgggtcccgaggccatcgccgcgctgctggcgagcctgaaggcgcaagcccgccccggtacgtcgcgcttcggcgacgtcgcgatcgacgacctgcaggattacgtgcgcgaccaagcccgcggcacgcgacctctcgacgatctcgcccgctactgggacgaggcccgcagcttggccgggagcctcgatctcgacgggcgcgcccgcctgttcgcgccgctctggggcggccacgcggccttcacggccctctaccgtcagctcgcggaggcgctggagcgcctcgaccatccggaggagatcttcgcgccgctcgccgctttggtaccgcgcgagggcagcatcctcgatgtggcgaccctggcgggtctcggagcagcgcgttcggacgacaccctgacggtgcacgcggccggcggcagggccgtcacgctcgcccgcgccacggtggcagcgatcaccgcggagctgcgcatcgagatcgccgacacgccccgggcttttctccaggaggcggacctgctcgacttccctggcgcccgcagccggcagaaagtcgatctgacccacttcctgaccgcgcacccggacgcgctgaaggagaccttcctgcgcggcaaggtcgcctacctgttcgaccgctacgtcgccgagcaggagctgacagcgatgatgctgtgcgtccgcccctccaaccaggaggtcgtgacgctgcccgacctcgtggagcgctggatcacgctcacgcacggatcaagcccggaggcgcgggcgcagctgccgaacctgctgttcctcgtgctcacgtggttcgacagccacttcgtcgacaaggccggcgacgtcggccaggatgcgggcctgcgcttccgcaaccggatcgaggcctcgctgctcggattcttcgggaaggcgcacacgtggccgcggcaatggatcccgggcgcgccgttccgcaacacctactggttccggaacccaaactacccggcggaatcggtcatccgctacgacgggcggcgcgaggtggcgttcctgcccgaaaagcaagagcggatcgccgagctgcgcgccggcttcgccgccctgccggaggcaaccgcgcatttcgcggatccgggccgcgccttcgatgaggccctccgcctcaacgacggcggcgtgagctacctcgtcgagaacctgtcgcgggtctgccgaccggccctcaaggcgcagcagatcgcctcccggctggaggccctgcgcgccgaaatgcgggagcggctcgcccgcttccacgtcgccctcgacatcgagacgcggctggccgagcggcgcgaggcggccggccaggtcttcgacgcgctcgatggggtcgtggcggccggccagttcggctcgctcctgcgggcgctcatggtggaccccgcggcgctcgcgcacgccctgcacggggccgagggcgcgaccaccgaggccgcgctccccgtcgcggcgccgcgcatcgcccgccccggagcgatcccgcggccgggcgcggcgccgacgccccgggtcgaggcgtcgagcccgggcagcgatcgggagcgcgcgatggcgcgggccgtggtcgccgcctggatcggggccttgcgccgcacgatcgaggccgaggacttcgcgcgccgcttcgccgtcccactgaccgccctggagatcgtggtcagcgagctgatcgtcctggcccgacgggccgacatcgagggtggcatcgcgtccgacctgcgggacctggcgaccgtcgagcgctccgagcagtcgacggtcaagctcgcgctgatcgccgcgacacgcctcaaccggctgaccggcagcctcgggttcaccctcgtcccgccggccggcgagcgccccgcgatccaggacgaggcgggggatcgggtcgccttcgcccagcggccggtcagctacgatgcccgcagcatcgggcaggcccccgcgaccttcgcccacacctacgccaccgactggttccacggcttctaccgggtcgtcgaggacaacgccaagagcgcgtccggcgtcacggtcgacctcgcgcagaacgcccggatcggcgcgatcctcgccggtctccaggcgcgcgccgcctga

SEQ ID NO: 6008 - DNA, 684 bp, Methylobacterium sp.
atgacgatccgcatcaccgaggacgaggacgagtccggcggctacgccttcatcgatctcggtcgcccgctggcgtcgcccctgctctcgttccgtcgccaggataccgagccgcggcatctcggggcggagggctggcagccggaggtcgcgtggctcgcgccgctcgcggtgaccgagcgggacgggcgggccgtcgcgcgcttcggccccaacgtcgtcgaccgcatcgaggagctggtcccgatcgagattgtcgcgcaggacggcacctccttcggcgtggtcgcgtggccgaccatctcgcccgcgccgtccggcgggggcatcctcgccggccttccggcaccggctccgacgctgacccgggacgggaccggcggtccggccgtcccggtcgccgaggccgtgccgctcccggaaccggggccggctccgccgcaggatgccgcacccgcggctccgccggcgcccgagccgcccgcgcgcaagagccggctgctctggccgctggtcgcgctgatgctcctcgcgctggccgcgggcggcgcctacctgtaccgcgaccggctgcccgacctcgtgacccggcgcgaggcgcccccccaggagccgggcccgccgcccgcgcctcccgagtcggattcccgcctgacggccgccgagttgcggcaccgctacgcc

SEQ ID NO: 6009 - DNA, 204 bp, Methylobacterium sp.
atgacgtcgcccatgacgcccgccgacagggaccggttcgagaagtgcctcgcgctcgccgaccagggggccacggcgggcgagcgcgcggccgcccgggcggccgccgagcgcatcgcccggggtgccggcctgaccctcgcggcggcggccgaggcgctccggcggagcgggcaggcctccgccgatcgggcgacccgcccg

SEQ ID NO: 6010 - DNA, 87 bp, Methylobacterium sp.
gtggagcgcgatcggtacctgccgaacgtgagccccggccgcatggtcgacgaggaggccgacctggagagtgacacgatcggatga

SEQ ID NO: 6011 - DNA, 1779 bp, Methylobacterium sp.
atgaccggcgccacgcgcttcgtcgcaagccggacgctggccggactggatgccgtccgcaccgacgaccggctggtcatcgagtcctatgaccggctgcggcgggtcctgcgccagcacggcggcgacgccgctgccgaactcttcgccgagccggtcatctcgcgcagcaacggggcggccccggcgcgtgtggactggtacacgaagctcgacggtccgatccggccgctggccgacctcgatccggacagcgccgtccacctcaggcaccgcctcggtgccgcgctggcggcgctggagccggcgctgcgggaccgcgaggcgggcccgttcgcggccgcgtgcctcaatctcgcgggaccgtccgccgtgctagcggtcggggacgttccgctcctcgtcgactggggattgctccctcagggattggccgcggacgagcgcggacgcgtgcgccactacgcgtcgacgctgggcgcggtcgcccccggtcacctcccctatccgccggtcgaccgtgaggactgggccgcccgcttcgagccggcggccccggccggcccggatgcgtctcgcggaccgcggctcggagttcccgcccggccggcttggcgcggcagcatcgcgccggtcgtcgcggccgggatcgcggcggccctggtcgcgctctcctacgtgccgggcgttctggtcttcccgccgctgctccaagccgtctcggccgagtccagggccttccagacggcatggctcgacggtcttcgccggcgacgcgacgccctcgccgcggcggacggcttcgcctgcccccgcctccggacggaactgcccgggctcgttccgcagagccccgccggcgtgcgcctgcccacggatccggcggcgccgcccgcggcccgcgccgccgtcgagccgtcggcgccaccggcagaatccggccggcccggcgcaccggccaccgacgggctggtcgaccggctggagcgcagcacggtcctggtcctggccggcgacgccaccggctcggggttcttcgtcgcggacgatctcgtcgtcaccaatcgccacgtcgtcgagggcgcctcgacgctgatgatcgccgggcggcacgccggcgtcgctccggcgaccctggtgcaggtcggcgctccgggcaccctgaccgacttcgccctgctgcgggtcccgccgcgctcgggggggcggcccctcgccctcgcgaagccgggccgcccgctgacgccggtggtcgcggccgggttcccgggcctctatctcggcacagacccaaccttcgcgcgcctccgggacggcgacgccgcggcgagccgcgacctggtcccggtggtccagaccggcgtggtcaaccatctgcagcgctacgacgaggccgccgtgacgctggtgctgcacggggccgagatcgcgccgggcaacagcggcggcccgctcgtcgactattgcggccgcgtcgtcggcgtgaacgccttcggccgcacggacgaccgcatgccggtcaccgcgcgctacgccctcggcgcggacggtctcgcggcgttcctggcgggcgccggcgtgaccgcggctgtcgatgaccgtctctgcgatctccaggcgacgccccgcccggcggcgaccgccgcggcggagccggccgaggctgccgcgacgccgcccgccccggcaccggccgcgccgaccggccagacggccccgcggccggacgcgcggaccgccccacggcctgggcgcgacgcccggccgccggcacgctga

SEQ ID NO: 6012 - DNA, 825 bp, Methylobacterium sp.
atgatcgtctctgccatccgtgattccaaggatccgacgcccgtatacgcgcaagccccggcgcagatcgacaggaaggattgctatttctaccatacgctcgaattgagcaccggagaggtggtcgagggcggctgggatctgcgcgggcgctacgcagactatatcggtcatgtcgacctgcgtggacagcgcgttctcgatgtagggactgctggcggctttctaagcttttctgccgaggaggcgggagcgagcgaagtggtctccttcgatcaggacaccggcgctcggcagcacctgctgcccttcgctggctccccctatgtggtcgatcatgccggatgggtgcgcgcgcatgaccgcgcgatgcaggcttggaagaacgcctattggttcacccacgctgaccggggttcgaaggccaaggtcgcgtacggcgacgtatacgacctgccggccggcatcggattgttcgacgtggtgatcttgggcgccattctcgagcacctgggcgatcctgtccgggcgatcggatcgatcgccaaggtcgcctcgaatctgattgtgatcaataccgactacatccctggcgatgagccgatggctcgtttcaacggcaggcctgagaggccggaatatagctttgttttctggacctacacgattgagacgtatcgccggatcctcgcgatctgcggcttcgagatcgagaaggtctacaaggactcgtttctcggtacgcccgctgtacccggcggcgtgcggccgaacatgccccgcgccgcgatcgttgcccgtcggatcgcacgatcctcgaagtag

SEQ ID NO: 6013 - DNA, 2067 bp, Methylobacterium sp.
atgagcgctgagaagatcggcccgcagcaccgagcccgcaaagccgtgctctacgtccgccagtcctcggcccatcaggtccagcacaaccgcgagagccaggccctgcaatacgccatgcgcgagcgcctcgccgggctcggctttgcagaggtcgagatcatcgacgaggatctcggctgctcggccgccggcggcacgctgcgcgccggctttgaacgcatggtcgccgaggtctgcctgggcaaggtcggcgcggtcgccgcccgcgaggtctcccgcttcgcccgcaacagccgtgactggcagcagctcgtggagatgtgccgcgtcgtcgacaccctgctcgtcgaccaggaggcgatctacgcgccgcgcctgggcaacgaccgcctgctcctcgggctcaagggcagcctcaacgagtacgagctcgacctgctgcgccagcgctcgctgtccgcgcgctacgagaaggcgcgccgcggcgagctcgtggtcgcggcgcctgtcggcttcatcaaggtcggcgaccggcttgagatagatcccgatcggcgtgtgcaggccgcgatccggctggccatcgacaaggtggccgagctgggcagcgtgcgccaggccctgctctggttcctggagcacgggctcgatctgccgacacgcgtcaacgccggcccggtggtctggcgccgcccccgctactcgacgctgcgcgagttcatcgccaatcctgcctatggcggcgcctacgcctacggccgcagccgcgtcacggccagctacgacgcggccggcgccaaggcgcgggcccggcgcacgccgcgctcggagtggctggcgttgaagcccggcgcgcatgagggttacgtcacgtgggagcgggcggaggcgatccgggcgatggtgagcgagaacgtcccgacgagttcccgtggcgcgcccaagctcggctcggccctgctctccggtctgctgcgctgccggcgctgcggacgcaagctgagcgtccagtacaccggggccaaggggcagatcccgcgctacgcctgcgtccgcgggcggatcgactacggggagccgaactgcatcgccttcggcggcctgcgtgtcgatgacgtcgtcgaggcggccctcctgtcggtggtgcagcccggcgccatcgaggcggcacgggcagccgagtcgcaggcgagcatgcgccgcgacgaggcacgtgaggcgatggtgcgcgatctggaggcggcgcgctacgcggccgaccgcgcgttccgccagtacgacgccgccgaccccgagaaccgcctggtgaccggcgaactcgaagcgcgctggaaccgcgctctgtcccgggtcggcgcctgtgaagcgcgcattgccgagcacgacgcggtcgccccccgacccgcccttcctccaatcgcgttggagacgctcgccgcggacctgcaggacgtctggtcagcgcccacgacggatgcgcggctcaagaagcggatcgtgcgcaccctcatccacgaggcgatcgccgacctcgacgaggtacgggccgagatcgtgctcaccctgcattgggccggcggcgcccacaccgagcatcgcctgccgcgtcggcgacgcggtcagcgcaccagcacgcccgccgacgtgatcgaagcggtgcgcacactggcgctcatcacgcgcgacgacgtgatcgcgggcgtactcaaccgcaacggcgtgaggacggggcacggcaatcgcttcacgcgcgagcgcgtcaccgcattgcgctcgcagtaccgcattccggtgttccgtgaggccgcggcgggagaggagccttggctcaacctgacccaagctgccgcccgcgtcggcgttgccgcgcgaacccttcgtctggctgcggaacggggcgagatcgatgcagcgcatccgctcgtggacggaccttgggtcttcagccgcgcggctctcgacggcccggctgcccgcgtcctcgcacaggaggcactcaaccgcggcaaacaccctgcggtaccgcatccagcacagcaatccctcttcgcatcaacgacatag

SEQ ID NO: 6014 - DNA, 219 bp, Methylobacterium sp.
atggaacgctacgagctggtcgagggcagcgcggccaagttctgggaggtcggcgtctccggcccgacgctcaccgtccgcttcgggcgcctcggcacccagggccagagcaaggacaagacctgcgccgacgcggccgcggccgcgaaggagaaggacaagctcgtccgcgagaagaccgccaagggctacgtccgcgccgacggcgcggctcccgcc

SEQ ID NO: 6015 - DNA, 546 bp, Methylobacterium sp.
atgcgcgcacccttgctcgccttcattgcatgggtccacgccggcctgatcgcgtcgatggcgctcccgagttcccccgctctggctgatgccgcccaggattgtcggtccgggagcccggagatgcgcgtcggcggatgcagccgcctcttggccgaggctcggacgccgcggcagcgcgccatcgcgctcgatggacggtgctgggcgaacatcgaccggggtgcgtttgccgacgctctgacggattgcaacagcgccattcgggcggacgatcagtacccctacgccttccacaatcgcggggtcgcctatgccggcctgcagaacccgaccgcggcgatcgccgacttcaaccgtgcgctggcgatgcggccggccttctcgaatacgctcatcaacagggcgaaagcgaacatcaccctcgggaacacgcaggcggcaatccgagattacgaagaggttcttcgtctgaagcctgacaacgaagaagccaaaagttcccttaacttattgcgcggcgctgtggtaacatcgccatcgtaa

SEQ ID NO: 6016 - DNA, 1782 bp, Methylobacterium sp.
atggccccgcccgcccgaaccggccgtcgctggaggcgcctggccgccgcgaccgcgctcggtgtcgccgccgccaccggcgtgcacgcggcctcgcccggcctgacggtccaggccgccgccgcgcgcagcagcgccgtcaccgggcagcggatcgcgctgctgatcgtaccgcaagccgcggcctccggcggacgggcggcgacggccaacgccgacgaggaggcctatcgcaagcgcttgcgcgacatcggcttcgaggtgtggacggtcggcccggccgaccgtccgcagctggatcgcggactgcgcgaggccgtcggccgcctgccggaggacgcccaggtggcggtcttcgccctcgggccgaccatcggcggcgccgacgacgtctatctcctgccgcaggacaccccggccgacgccggacagcgcccgggtctgctcgacagcgagggcgtgcggctgagcgacgtgctgcgccgcgtcgcccgacgccggacccgcgaactcgtcgtcgtgatcgacgagtgtcagtccgcggcgggcgggcgttgcgacttcgatgccgcggcggggagttccggggctagcgtcatcggcgccgaacgcgccggccgccgcactgcctcgggcgcgccgctcgcgggccgcgcctcgctgcgcgatcccatgttcgccgcgatggcgcaggagggcgaaacctttctgcagtcgcacgaaactctgaagcggggcctcgccggcagcgatctggaaccccgggcgagcggcgcgctcaccacgtcgttcgccttcatcccgcaggggttcttcgcgggcctgcggacggagtgcaacaagatcgacccaaataccgagccggccgcgctgcgcggggtgaatctcgatgccgcgatccgcggctgcgaggcgatgacggggacctatccctatgcccgtcccttcgaggaccggctccaggcggggcgggagcagcgggcctatcagcgggccgtcgcctcctgcgacgatcccacggccaccgcgagctacagcgcgtcctacccggctgggcgcttccgcgcccttgtcgacaccttcgcggtcgagtgcggccgcacgcgggatcgccaggacgaggcccgccgccagcaggcggacgaggcccggcgtcaggaggaggacaggcggagacggcaggaggagatggatcggcaatgggccgacgcgcgacgccagcgggagcaggacgagcagcgccgcctggaggaggagcggcgccagcgtgagctgcagcagcgcaccacggtcggaagcgcctccggctggacgctgaactactcgaccaacctgctcgagatctcgccgctggccaacgaccagtacgatccgcagaagcagacctacacgacgatctggcactcgcggcagcacggcgagcaggtcgtgatgtacgtgcaggtcagcccgaacgagcggtgcggcagcgcgcaacagttcatcacggagcagatccggccgcgacggagccagatcagccgcgctcaggaggtcaatacctcgccggttcgcgccgggttcgtgctcgaaggtcgcgggaccgcggtcgcgcagaacagcttcgacgacagaggcttctacgacttcgcgacgatccggcgcgacgaccgcagcacgatcacgaatatcggcggccgtttccccgccgagttcagcgacctgtaccgggccgaactgctccgcatgatgaactcgatgcagctgcccggccgcgacgtcttcaacaatcgctgcggctga

SEQ ID NO: 6017 - DNA, 828 bp, Methylobacterium sp.
gtgagggaggctgtcatgtcgaaccagacaaccaaggccacctcggcgacgtcgctccgtgagcgcgccgcccaggcccgggacgcagctggccggttcatcaagcggagcccgccagttgcgccagctccgacccacgccgagcaggtcgcggaggccgcgctcacgggggacgtgctggccgcctgcggcatcgaccaccgcgacggtaccgtctcctacgccgatgctaccgggaaggtcgtgcggcatcccatggcgcgttggatcgccttcaacgctgtgcagatgtacagccacgtgcagagcgagatgggccgcaggcgggtcatcgaggccaacccgctgccgggtgccgagcatgcagcctgggaggcacggatccgacgcgagctgcgcgtcgacgcgatcgccgctctcacctttaccccggggcacgcttttcaggtcgagcaggaccggcggaccggtgcagagccgatggcggacggatcaatcctggcgctgatcgaggagcacagggccgcctacgccgagtgggaccgattgtcggaagtctggagcgagatgctgacgaccgacccaggctatgccgaggccgtggcggcatccgaggagccgggccggcgcgagatcgccgcctacgaggcattgttctcggcgcgtccgacgaccctgcccggagcgatcgccctgaccgaatacctgcgagaggccacggagcgcgtcagcaccaacatacagccctcggatgccgagcgcgccttatcgatcatcgccagcgcgctgcgcgggatcgtggcggcggctgagcccagaggacactga

SEQ ID NO: 6018 - DNA, 411 bp, Methylobacterium sp.
atggtgctcgaggcctgtcccgacgtcgtgctctacgcccgcgacggcatccggagctggtccgatctggccggcgcggcggaggtcgttcgtccggcgctgggaatcggcccggacgtctgggaggcggccctggccgcgatggggcgggaccacgcgctggcggcgctgtcggcgatcctccagcgcgccgagtcgatcggcgcgcccggcgcctatctccgcgacctgacgcggaaggcccgctccggccggttctcggcctggccgatgctcttcgccctgtggcgccagcgccgtcgagcgtcatccgacggctcaagcggtcccctccgcgtcgcggaagttgaccgcggtcaacacgctcgcccgctcggaggcggggcggcgcgagcgtcaacattctgttaa

SEQ ID NO: 6019 - DNA, 207 bp, Methylobacterium sp.
atgagcgacgagaccgagcttcgacatcatcaggccgccattcagcacatgatgcggcgccttgacggatttgcgcgcaggctcggcctggacgaggcggccacgcgccaggtcgttgagaggatcgcctccgacatgccggagtggacggacgaggagcggctggagacagcccgcaggtccctgttggctgtggcttcggcatag

SEQ ID NO: 6020 - DNA, 420 bp, Methylobacterium sp.
atgatcgccgcccgtcagcatgcgctgccgcccgacgtcgaggcccggcaacaggtcggtttccggctgcgcgctgcccgcgacgccgcgcgcctccagggccgcgcccagtcgcccgccctgcgccgcgagatcggcgccgccctccgggccgcgcgggacgccgccggcatgtcgcagagcacggtagcgcgccgcctcggcatatcgacaccaatggtctgcttcttcgaaacgggccagaagcgcgtgccgctgaatcggcgggacgacgtcgccgccgtctatggcgtgccgcccgagcatctggatcggccgccggtcgtcacacgcagcgaggacgaggccgcgctcgtcaccggctaccgccacctgtccgaggacgagcgcgccgcgctgctcgcgctggtgcagtcttga

SEQ ID NO: 6021 - DNA, 231 bp, Methylobacterium sp.
atggccaaggatagggacgtccccaaccggcaagtgcgcccattacccgaaagcctcaaccggctgctgcttagcgaccccacccagccgattgggtggatcgaggatccgctcatcggctaccatagaccctccgtgtacgaccgcgtgctttggtggttcagcgtcgcggctttcgcggcggccgcgttcatgaccagtgcaagcatgacggtcaggcttctgcggtga

SEQ ID NO: 6022 - DNA, 183 bp, Methylobacterium sp.
ttgcgcagcgccttcgagatcatctcggggccattgtcgcagcggatgtgctcgaggatgccgcgcaggctcgatctggcgcagcttcagcacgacctgctccgcgctcgtcttctgacctcgccgcatgtccgactcccttggtcccagttgatcctctcaatcagcccggtccaaagctag

SEQ ID NO: 6023 - DNA, 402 bp, Methylobacterium sp.
atgacgaaggtcgagaaccccaagcgcgcgcacggcctcaagaagctgccgctggagctgatcccgcgcgtggcgctggtgcaggaggccgcggtctacggcctcggcgccgactctcccgcgaaggcgtacggccggttcaactggcggaaatcgccgatcgacgacgcgatctacgtcggcgcgatcgagcgacacctgacgctatgggcggccggcgaggacgtggacccggagagcggcgtcagccacctcgcccacattcgcgcctgctgcggcatcctgctcgacgcgatggatgccgggagcttcgtcgacaaccggcaccgctcgccggagacgatccgggtgctgcgcggctacgacgcggcggcgctcccggtcgtggcgccggccggctga

SEQ ID NO: 6024 - DNA, 846 bp, Methylobacterium sp.
gtgttcctgcgcaagaactacctcgcgaagggctcgacctggtgcgccggagagctcaaccgaaccgtcggcgccgtgcgcgctatggcgaagaagctcaagctcggccggccggccgaggaggtccggttccggtggacccagcagcacgacgatcgccttcgccgcgtctacgagaacggcaagatcggcggcgtgaaggaactggcccactctctcgggatcacgccgggccaggcccggtaccgggcgggggagctggggctgtcgacgcgctggcaaaccggcccctggaccgagccggagatcgagttcgtcgaggcgcacacccacctgcggcgctcgacgatctcgctcctgatgaagaagaagggctggacgcggacgccggtggcggtgcagcagctcattcgcagccggggactcgccggcgcgaacgatcgcttcctcccggcctcgactgtcgcggcgtatctgggggtgaccccggtggtggtgttcaaatggctcaaggacggcctgctctcgtccgagtcgccaacgggcggcgagcaggatggacgcccagtctacttgatcgaaaaccgcgagcttgcccggttcatcgtgcagaacccgttgaagctcgacccgcgcaagttcgactggccgtgggtctcggatctgctcgcgcgatacggctcgttcgggctgatcgaggggcggaccatgatagagcgcgtcgccgccctcgatcgcgagaagcgcacgccccgcgagatcgccgaaattctggagtcgacgcccaacagcgtgtcggtgatgctctcgcgcatccgcgcccaagagcgacggcaggccgcatag

SEQ ID NO: 6025 - DNA, 4977 bp, Methylobacterium sp.
atgatgtctctattcgacgtgccgcaactgccgagcgcgccgccaccaccggcccagtccctgccggtcgacttctatctcgacggggtccgcgccctgtcccgcggatgggccgcccgagctcgcgacaacgtcgaggccatctcactctccgccgccatcctcgccgagggacgccctgcgacccccgaggagcaagcgcgtctcatgcgcttcgtgggcttcggcgcgaccgatctggcgcagggctgcttccccaccacgggctcgttccggtcgggctgggaggacatcgcccggttgctccaggcggccacccggcccgaggagctcaaggcgctggcccgcgccacccagttcgcccactacaccccggagccgatcgcccgcgccatgtgggccgcgctgctgcgcatcggcttccgcggcggcctcgccctggagcccggcgtcggcgccgcgctgttccccgccacgatgcccgccgagctgcgcgggcagacccggttcatcggcgtcgaggtcgagccggtgagcgcccgcatcgcggcgctgctgcgcccctccgacgagatccgctgcgaggacttcaccaaggcccggctgccgcgggacttcgatctcgccatcggcaacccgccgttctccgacctgaccgtccggatcgacccttaccgcggcttgcggctgcacgacttcttcctggtgaaggccgccgaccacctccagcccggcggcctcgccgccttcgccacctcccgcggcaccctcgacaaggccgacggcggcgcccgcgtggcgctccacgccgcgtgcgagttcgtcggcgcgatccggctacccgacggcgccttccgcgcgagcgcggggacggacgtcggggtcgacctggtgtttctgcgccgccgggcctcgggcgcggtcatcgacctgccggcatggctggagaccgcgtcggccggcttcccggatttccccgggatccggatcaaccgctacttcctcaacaaccccgacatggtgctgggccggcccgacctcgcccggtcgccgcggggcgagaccgtctatgcctgccgcgccccggagggcttcgacctcgaggccgcgctggcccgcgccgtcgcccgcctgccggaaggccgcgcgcagcccgtggcggcccccaggacgcccgtgatcgagacggagcgcccttcggccccgtcggcgatcgagcgccttcacgagggctcctatctcatcggagcggacgacgagctgcagcagatcgtcgacggccggcccgtcccggtgcgcatccgcgcgggcggcagcgggcccgggatcttccgcacgcacgcggccatgatccgcaagcttatcccgctccgcgacgcggtgcgcgagatcctgcggctgcagatggcccgggccgactccatggacgcccaggcccggctcggcgcgctctacgacgcgttcaccgccaagcacggcccgatcaaccggaccgaggtgagcgagagcaccgacgctcagggcggcaagagcgaggtgcaccggcaggtcaacctcatccccttccgggacgaccccgacacccacctgctcgcctcgatcgagaattacagcctggaggcggacaccgccacgaagggcccgatcttctcggaggtggtggtcgcccgtgagatcgcgccgacgatcgagaccgccggcgacgccctcgcccgctgcctgcatgagaccggccgcgtcgacgtcgaccgcatcgccgcgctgatcggccggccggtcgccgacgtgctgaccgacctcggcccggccgtctaccgcgacccggacaccgccgaatggcagacggccgacgcctacctgtccggcccggtccgcgcgaagctcgctgcggcgcaggaggccgcgaaggcggaccacagctaccggcgcaacgtcgaggccctggagacggtgcaacccgtcgacgtgccgccctcggacatcaccgcccgcctcggcgcgccgtggatcccggccgacgtggtgcaggacttcgtcaaggaggtcctgggcggcgacgtcgtggtgcgccacaccgccgacgtcgccacgtggtggatcgacctgcgctggttccgctgccggcccgaggccagccacgcctacgggacgccgcgctactcggccggccaggcgctgctcgacgcgctcaacgcccgcaccccccgcatcgtcgaccggatccggaccggggtgaaccagtggaccgaggtggtcaacgcggccgacaccgaggcggccaagaccaagcaggacgcgctcaagcgcgcgttcgagagctgggtctgggccggcgggccgctcgcccatttccgcgccgaccggctcgcgcgcctctacaacgaccggtacaacgacacggtcccgcgcagcttcgacggctcgcatctcacgctgccgggcgcgagtgccggcttccggttccggccgcaccagctccgcgccatctggcggatcctggcgtcggggacgtcgtacatcgcccacgccgtcggcgccggtaagtcggccgtgctcgccgccgccgtcatggagcagcgccggctcggcctcgcctccaagcccatgatggtcgtccccggccactgcctggcccaggtcgcccgcgagttcctgtcggtctacccgctcgcccggatcctggtggccgacgagaccgccttcgccaaggaccgccgccagcgcttcctcgcccgggccgcgacggcggactgggattgcatcctcatcacgcactccgcgttcaagctgatcgcgacgcccaaggcgttcgagcagcagatgatcgccgacgccatcgcggatttcgaggcggtgctggagcgcgtcgccgagagcgaccggctcacccggaagaagctggagcgcgccaagcagggcttcgaggccaagctggaggccctgagcgtccggcacgacacgttcctgaccctggaggagatcggcgtcgaccagatcctggtcgatgaggcgcacgagttccgcaagctcaccttcacgtcgaacatgaccgtgaagggcatcgacgccaacggctcgcagatggcctgggacctgtgggtcaaggcggccttcgtgcgggaccggcgcatcgcgcgcggcgatcgccgcgtagaccgcgcgctggtgatggcctcgggcacgccgatcacgaacacgctgggcgagctctacacggtcctgcgcttcatggacatggaggcgctgcgcgagcgcgggctgcacgagttcgacgcctgggcggcgagcttcggcgagagccggaccgagctagagctgcagccgtcgggcacctacaagccgatcacccggttctccgagttcgtgaacgtccccgagttgatcgcgctgttccgcgcccgcgcggacgtggtcaccgaggaggagctgcgcgacctggtcccgcggccgcgcatccgcagcggcaagcgccagatcatgacctcgccgccgagcgaggcgttccgggagttccagcgcgaactcggcgcccgcatcaaggcgatcgccgcgcgcagcgggccggccaagaagggcgacgacatcctgttgaccgtgatcggcgacggccggcacggcgcgatcgacctgcgcatggtcgaccccttcaacgacaacgagccggccaacaagctcaacaagctgatcgccaacgtcctgcggatccaccacgagaacgccggctgcgtctacctccaggaggacggcacaccctacgagcgcaccggctgcgcgcagatgatcttctccgacctcggcacggagaagtcgatcgccacgcgcgggttctcggcctacgtctggatccggcaggagctgatccggctcggcgtcccggtcggcgagatcgccttcgtccaggactacaagaacagccgcgctaaggcccggctcttcgccgcgatgcgcgccggcatcgtcaagatcgtcctcggctcgacccagaagatggggaccggggtcaacgcccagctccggctcaaggcactccaccacctggacgtgccgtggctgccgtcctcgatcatgcaacgcgagggccggatcgaccgccagggcaaccagaacgacgagatcgagctgtgggcctacgcgacggagggctcgaccgacgcgaccatgtggcagacgaacgagcgcaaggcccggttcatcgccgcagccatggccggcgaccggtcggtgcggcgcatcgacgacgtcggcgaggatgcggtcaacctgttcgccctcgccaaggcgctggcctccggtgacccgcgcctgatgcagaaggccggactggagagcgaggttgcccgcctccagcgcctgcgcagcgcccactacgacggccagcacgcctaccgcgcccggatccgcgcggccgagcggaccatcgtcgaggcgacggagtcggcccaggcgttcgaggccgtcgccgcccgggtctccggcccgttcgtcctgaccgtcggcaagaaggacttcaccgacccggccgagggcggcaaggcgctcaccgacgccatgaaggcggtcgaccgcatgctcgagggcggctggttcaagggctcgaaggccaaggtcgaggacgagctggtcgcgaccgtgcatggcctgcgcatcctctacacctccggcgtcgacgggggcggctcatggtcggccgcgaagctccaggtcggcagccagtgggtcgccctgcgctgcaagtcgatcacgccgggcgcggtcgccttccaccaggtcgccgaagaggtggcgtcgatcgccggcgccgccgaggccgcgcggttcgaggccgagcgggcgcggtccctgatcgccgacaccgagccgctggtagggcgcccgttcgacctcgaaggcgagctcaacttgaagctcgaagaactcgaccgtctgaacgcggagcttgacggggcgtcgatcgaagacctggcaccagccgcgtaa

SEQ ID NO: 6026 - DNA, 288 bp, Methylobacterium sp.
atgaaccagaccgaggctcgatacgacgcccacctgagagcgcgccacgcgaccggcgaagtcgaatggcacaagtttgaggggctcaagttccgcctcgcggacaatacgttctacacgcccgactttgccgtgatgatcgccggtggagcgctggaggcccacgaggtcaagggcttctggactgacgatgcacgggtgaagatcaaagtcgcggccgcgctcttccccgtgcagttcgtcgccgtgcagtggaagcgcggcgcttgggtcgaggagcggttctga

SEQ ID NO: 6027 - DNA, 1062 bp, Methylobacterium sp.
atgagccccaacgacaccgccgatcccctcccgccgaaacccgccagcctgcccgggcgcggctcagtctggcagcactacaagggcacgttctaccgcgtggcagaggtctcgcgtcacagcgaggatccccgccagtggctcgtcacctatgcccccgtcgagggcggcgacgcctggacccgcgcggtgcgggcgccgctggtcaacacctggccgggcttcctggacttccggcccaacgcgccgggccaccgcttccgacacgtctccggtccgcgcacctggcgcgacgaggcgccggagtcccagacggctgcggagcgcctgtccgcggctgcgcccctgatgctcgccgcgctcaaggcataccgcgcgcagtacgcggatcggccgagctggccggacgacgaggtcgcctgccttgagctggccgatgccgcgatcgcggcggccatgccggcgctcgaagagcgcgagacgatcgcggtgacctggcgagacgagaactacggcgacgtctcggacgtgctggccttccgcacgtacggcctgaccagccttccggagcaggtccggcggcaggtcgaccgcgtcatccgtgccgcgggcttcagcttcaacccgcgccgcgcctcctggatggcgctggccgaccccactcacgaccggaaagccggcctgaccgccgcactggaagccgcagggttccaggtcgaacacaggggcgcgatcccggacgtcacgccgcccggccccgccgtcccggccccgcccgggccaaggcctcggcttacgctcacctggcgcgacgagaactacggcgctgtctccgggaagatcgcattccgctgctacgacaagggcgacctgacggagggcatgtgggccccgatccggaaggcggtcgaggaggcgggcttcacccaacacctcggccgctcctgctggatggcggacgacactcccggccgcatggacagcctcgccgaagcgctggaggcgctcggatacttcgtcgtgcatgccggcgccgtcccggccgaccgggtgagggcatga

SEQ ID NO: 6028 - DNA, 543 bp, Methylobacterium sp.
atgcactactacgcgcacctccacgtggacggtacgaccgtccacgagatcctcgaactcgccgacgaccaggtcctggggctcgacctctactcgaaggagatcgccgaggcgtcggtaccgtgcgacgcgtcggtgcgggccgggttcacctacgacccggtccaccagaccttcacgccgccgccggccccgcccgtcgacctggaggcctacgccggagcggcccacgccgccctgcgcgacggcggcgtcacgatccagggcatgcgggtgaagaccgacgccgagagccgagggctcatcgacggcgcgttcgcgctgagcaagtcgcggccgggcggccagatcgacttcaaggcggcgtccggctgggtctcggtcgacgcctcgaccatggaggcgatcgccgtctccgtcgggctgtgggtgcaggcatgctactcggcctaccgccaggtcgacgagaaggtgaccagcggcgccttcaccaccaccgagcaggtcgacgccgccttcgcggccgtcgccctgccgagctga

SEQ ID NO: 6029 - DNA, 564 bp, Methylobacterium sp.
atgttcggaccgcgccggttcggggcgatccgaggggcgctcagcggcatcagcgcgaaggtgctgaccgagcggctgcagggtctgaagcaggcgggcatcgtcgcacagcggactctgccaccgccggcctcgacgccggtctacgagttgaccccatggggctacgaggccgagccgatcttctcggtgctcgggcgctgggcggcccgttcgccctcccacgaccccgctctgccgctctcggcggcctcgctcatgctgtcgtttcgcacgatgttcgaccccgcacaggcctccggcttcgaggcgacgatcggcttccggttcgacgaggacgccttccgcgtcacggtgagcgagggcgaactccacgccgcccgcgccgacctggtcggggcgcacgccgtcgtcggcgccgcaccgccggtcgttgcggccatcgtctatggcggcctgccgctcgccgacgcggaggcgtcggggcaggtgtcgctggagggggaccgggacgtcgtgcagcggttcgccggactgtttcccctgccggggaaggcgttctga

SEQ ID NO: 6030 - DNA, 261 bp, Methylobacterium sp.
atgcgcctgctccgcctgatcctcctcaccggcacggtgctgccgggcctcacgctcgtgcagctcgccgacgccgcgccgggccggatccaagtggcgcagggcgggccggacgagcgcggcccccgcggcggcgagcccccgcacggcggcccacgccccgaacggccgccccaggagcgtcccggcccgccgccgggcccaccggccgcgcgcgagcggcccgaaccccggccggagcgggcgccgccgcccccgcgc

SEQ ID NO: 6031 - DNA, 246 bp, Methylobacterium sp.
atgccgctgcacgtccccctcgcgaacggctggaccctaagcatctcggaggacacgcccccggccttctgcgcggtggccgcgtggccgtcgcactacagcgatgcacctcgcgatcagagcctgtggttcgttttcgaggggcgccaagtcgaatgccgctgctggcttctcgaagacctcttgcaagcgctggagctcatccttcgcgcaccgcgtccgagtgacctcggagagcagatctga

SEQ ID NO: 6032 - DNA, 717 bp, Methylobacterium sp.
atgtggatcaagcagctaatcggccgccttgctggccaagtcgtggaccttcccttcagcgcggccgagaacgtgctggcgaacggcacaggtgagctcgccaccgacgccgaggtgctcgccgccgggttcgagccgctcccggccgtcgcgccggtccggaccgacgtgttgccgctcggctaccgtgtcgagccgaccgaggtgggcggcttcgacctctacgacgccggcggcctgctcctgaacgtcgagccgctcgccaacatgatcgtggcggtcgaggcggcgcacgaccatcgcgaggcggtctatctgccggtccaggtcgttccggtcggccagctgccgccgcagctgccgatcccgccgcgcgtcctgaccgccgactatctcctcgaaccgatcgaaggcggcggcttcgacgtgctcgacccggccgggctcaagatcaacgacgcgccggtggcggacgaggaggccgcgcgcgccatggtgctgctgcacgttgccgaggcgaccgggcgcaccgtcgagcaggtcgaggccgatgagatggagcagccgccggtcaccgagatcgatgtgcccgaggactggaagagcctgcactggtcgcagcgcaaggccctcgcccatcggatcaacgggggcgcgccggtcgcgaacgcggccgaggccgatcacgtcatcgaggagtacctcacccggccctga

SEQ ID NO: 6033 - DNA, 486 bp, Methylobacterium sp.
atgccgaaggaaaatttcgccacccgcaccaagctcgtcgccgtcctcgcggtggcggcggacggcgcaggccgcagcggccgcgcagtcaatctgaagaacgccgccttcgcgaccgtcctggccaagatcacccagggcaacgcggcgccggtcaccctgaccttcctgcaggcgcaggacgtgtccggcaccggcgcgaagccgatcaccaaccccgcgccgatctgggccaacctcgacaccgacgcctcggacacgctcgtccgccaggccgacggcgtcagcttcaccaccgatgcggcggtgaagaacaagcacatcgtggcgcacatcgacccggcctatttcgacatcgcgaacggcttcaagacgctcatcgtggccaccagcgcctcgaacgcggccaacctcacctcggtggacgtgctcctcgaggccggtcgctatcagagcgagccgcttcccaccgccctgacgaactga

SEQ ID NO: 6034 - DNA, 372 bp, Methylobacterium sp.
atggcgcggctggaggccgacggctacgacctcgaggccgagatcctgccggctctgctcgacgccgccgcagcggcccgaacgccggtccggacgtggcggatctgggctgatcgcgtcgccgaacggatcaacgcccagcggctgacccgagcatcccagggcctgcccgccacgccggccgcgccggtggccgaggaggacaagatcgacctcggcgccccattcggccgctgggccgagccggtgctgcggacggccgtcgccaagcaccgcgagatgggcggatgggtcgaccacctctggggcccgccgcccggtcagcccgggtgcaagatcccgccccggctgctgatcgtggaggccgcgtga

SEQ ID NO: 6035 - DNA, 246 bp, Methylobacterium sp.
atgaggccggtccgcttccactatctgcgtctgcaggagtggctcgcccatctcgatgaggcccgggccaacgcgcgcatccgctcgattctggccttccgcaaccgccgagcggccgacgccaagcgctacggcgcggaggccgatgcgatctgcccgcctgaggcgcccgcccgcgagtggtctcctcgcctctgggatcgcgatcacgacgcccgcagcgacacgcgcgagcgccagccatga

SEQ ID NO: 6036 - DNA, 285 bp, Methylobacterium sp.
atggccggcgcgcccgctcacagcggcacgctcgaggatcgcgtccgcaccatcctcttcgacgtcctcgccaccgagccggagcggcaggtggatgcggcatacctcgtccaagacctcggggcggacagcctcgacgtcgtggagtttgggttcgagcttgaggaggctttcaagctcggcatggacgagctcgacctcacatctgcgatcactgtcggcgacgtcattgccgccgtgcgtcgtgtcgttgatgcgcgggcggtgcccgcggggggcgcctaa

SEQ ID NO: 6037 - DNA, 339 bp, Methylobacterium sp.
atggccgccggcgcgagggagaccctcgacctctcgacgatcgatccggcgcaactcgcccatgcggccgagaccgcggcccgggccaacctcgcggccgccgggatcctcggcgcctgctccgagcgctcgaccatgcgggccgccgtccggaagatcgagcacggccaggcgctggcgagcctcgcgctgctgatgagcttcgtcgccgagcactacgcgagcctgctgccggtgttcctggcgctccaggagggctcggtcgtcgccgtcgaagaggtgaccatctcccgcagccggaaggacgagcggtccaagctcgcgctggtggcgcgatga

SEQ ID NO: 6038 - DNA, 633 bp, Methylobacterium sp.
atggacaacgagggcacatcgccggccgacaagttcttcagctacggcatcgaatgcggcccgcacacgatcctcgacacgctgaacagcagcggcggcgtgctggagcaggagaaccacgaagacggctgcacggtctgggacgagcaggcgcggcgcgatctcacgtacatcgccgccctggtcaacgatcaccgcgccggccggctcgtcgaggtgtcggacgcgccgcccggtccgtggcgccctatgctcgccggcgccaacagcctcggccgcaaccggaagggcgacgtcacgatcaatgtcccgaccgcgctgtgctggctccagttcagcccggactcgttcaccggcaccgaggacgagacgcggccgggcgtcgggttcacgctggtggcctacccgggcagcgccggcgaatggccgaacggcgtcatcccgcgggacgaggcgttccggctctaccagatgctggcccggttcttcgccgcgcatccaccgcccggagaaccggccgcgcgggagctcgaggcagcagctgccgacgctgagccggtccgaggcgaccgcctccgccgcatcgccgccgcgctccgcggggccgccgtcggagggccgcgccatgggtga

SEQ ID NO: 6039 - DNA, 291 bp, Methylobacterium sp.
atgggtgagcagaagcgcaaggccgcggccgggcacgtcccgccggagggcatggcgaacgtctcgggtcggcacgtcaccgagttggcccgcgggatcatggacctgctggagaagcccttcgacgagggtatgcaggccgacgtcgccgcacacgtcatggtcgccaccgccgtggatctctggcgggcgaactacggcgacgcgcaggtggcggacgctctcaagcgcgcgatcgaccggcggctcgagaagccggccgaatactggggcgggaagcggggagcctga

SEQ ID NO: 6040 - DNA, 138 bp, Methylobacterium sp.
atgccgatcctggaagagctcggctacgtcgaggagcgcgcgacccgcggcagcactcgccggcgcgcgtggcacctgaccccgcgcggacgcgaactgctgatcgcgctcgggatccgcgagagcgctgagccgtga

SEQ ID NO: 6041 - DNA, 288 bp, Methylobacterium sp.
gtgctgctgaacgcgctgatcctggtcacgaccctggtgccgcacgccgagtccggcgcggacgccctcgcgcgcgcccttacgcccccggcgaccgtttccgctccggccgacagcccacccccgcacttcgaccccgcgacccgctccgtgtccaactggcacgcccagaccggcgcgcagctgaccccgcgggcgctggcggtcacggcgtcattggccgacgacccgccctacgtcgcccgctgcgtgcggctcaacaacggctggtgcatcaagtccccccgc

SEQ ID NO: 6042 - DNA, 114 bp, Methylobacterium sp.
gtgcaagcatggctgctctccgccgccgcggcctcgcccagcgcggtctgcatgatcgcgcggatcgtgcgggcgcagcgcccgcatttcgggctgcagccgaggcaggcgtag

SEQ ID NO: 6043 - DNA, 273 bp, Methylobacterium sp.
atgacgacacgacctcccagaagcggcgggccgacggggcgcaagcctcaggccggcaagttcagcaccagcaagttcaggggcggcaaggcccaggccgacggccgcgcccgcacgggcccgcgcaccagcgcccgcgacgccgccgagcgcgcagcccgcaaccgcggcgaggatgccggcacccgcgatccctggggcgcgcaggccgctgcggccccggcgccggcccggccgccgaagccgcgccgcgacgccgccacaccgcgcgat

SEQ ID NO: 6044 - DNA, 933 bp, Methylobacterium sp.
gtgggcggccggcctgcgcagttcgggcgaggcgcccgcggcatgacggctcccctccgggtcggtggtcttaccatcgacgttctcaccgagatcgcccatcgctacatgcccgtaagcttcctgttcaacgatctgccggagccggacatcgcccgcaacatgtcctggctcggaccgcgcttcatcgagccgcgggagcggacgctgggcctcgccttccaagcctacgtccttcgggccggcggcctcaccattctcgtcgattcctgcaacggcgaggccaagcaccgtccgaccgcaccctggcagcacgatctgcgggcgaccgagttcctcggtaatctcgcgcgcctcgggctttgctgcgaggacatcgacatcgtggtgtgcacgcacctccactgcgatcacgtcggctggcacacccgcctgcggggcggtcgctgggtgccgacctttccccgggcgcgccacctgttcggccggcgggagttcgaccattttcgcgcgcgctacgaccgggaaggcgcggccgccgtcaatcacggcgccttcgcggacagcgtgctcccggtggtggaggcgggcctcgctgagttcgtcgatgaggaccaccggcttctcgccgacgagacgggcgagatcgccctcgtacccgcccctggccattccctcggccattgctgtgtccggctgcgggcgggtggcacagaggcgatcgtggcgggtgacgcgctccaccacccgatccagctcgacctccccgaccttcccatgcgggccgaccatgatcctggcctcgctgtcgcgacgcgccgttccctcctcgcgcactgcgccgacaccggggcgtggctctgcgccggccacatccccgactggtccatcgcgcagatccgccgcttcgaggaccgattccggatgggatag

SEQ ID NO: 6045 - DNA, 621 bp, Methylobacterium sp.
atgaccgcacagctccagcagcagcagatgcagctccagccgcccagcgacgccgcgcggctgttcgcggtcgagaaggacgtggcgagcctgaaggaaggtctctccgtcctcggcaccagcatggacaagggcttccgcgacctcgcgaccgagatgaaggcgcgctccacgatcaactggcagccgatcgcgatcctgctcggcgtcctgggctcgctcggcaccatgggcttcacctggatcaacaccggccagggccggctggagatggcgatcgccaaggtggagacggcctccatgcgctacgtcccgcgcgaggacctcgacgcgcgcttcaccgtcctgtcgcagcgccgtgacgatctccagcgcctgaccgatgcccgggtcgagcggatcgagcgcgacctcgacgcggcgtccaagcagatcgtcccgcgcggggagcacgagcagatgtgggccgcccagcgcgcccgcgatgcggatttgcagcgccaggccgatcagaaccggcagggcctctacgacctgaacaccccgcgcgacaccatccagggcatgcagcgccggatcgacgagctggagcgggatgcccgggcgccagcgcggcgctga

SEQ ID NO: 6046 - DNA, 153 bp, Methylobacterium sp.
atggcggaagtctgcatcgccaaccacgaacaaatcgttcggtacggctcccccgagatgcaggcagcctcgcgagcgctgctctatgtcctcgccgcagagatccagcgtcgcgagcaggccatgtccgccgcgaacaacgatgaggcttag

SEQ ID NO: 6047 - DNA, 486 bp, Methylobacterium sp.
atgggccagcacaacccggcctcggtcgccgagctcctggccaagcgcggcagcctcgttgagatcgccacccgcgaccggatggcggccgaggaggtcggcaccaccaaccagccgatccacctgcgcgaactctaccggctcggcgtggtgatgacgccgaacatggagctgatcgacatctatcccgagggcaaccgtttcgtgggggtcctgcgcaacaccatgaccgacgccgaggaggagcgcctcgtcgaccgcatcgtggtggatcacgggacgctcccggtggacgggctctgtcacggcctcaaggccggctcggtaaatcgcggccagaatgaccagggagccctgctccgcggcgagccgcagcccttcgacctgtccggcggctacgccctccaccggatcggcgacgccctggccggccgcaacatccacgcggcgctctacgacgccctgcgtctgtgcaaggacatctga

SEQ ID NO: 6048 - DNA, 663 bp, Methylobacterium sp.
atgaacgtttcgaggatcagagacgcgatgcggtactgtgatctgccggatgtcctcgattattccatcgctgagcttcggctcggactggccttcatcgctctggacttgctggagctcaaggccggctttcggcaggaccagccgcgcggccgcgacggctgctggtgcggtgggagcggttcgctcgtcgtcgcgcggaaggacaagacgggggatccccggatcgacgggaaaaccgacgcgatcgtcgatgtcttgggcgaagtcgtccagacctgcgatcccggccagggccccctgtacggcatcgaggtacacacgaagttcgccgcacggatgcgggaactcgacctgcccggcatcgggcgacacggtatcgagcagagcttcagcgccggtgatctggtgcgctacggattggacggcagcatacgcacggacgtgatcctccgcgacggcaggaccagcgctgccccggttcgagcgatctgggatatcaagaccggcaaggcgcagttgacgccggctcgcgcgcgcgaactgcgcagaggtgtgggcgtggatgacagtgttcccgtcatagaggttcacttgagacgaggaaattcggtcaaaggcctttcaatatctgctattctattcggtgagaggttgccatga

SEQ ID NO: 6049 - DNA, 426 bp, Methylobacterium sp.
gtggccgggacgcccttcgacttccgcgagcccgcggtgatcggcgcgcggatccgcgacgggcgggacgcgcagatcgtgcgcgggcgcggctacgaccacaactgggtcgtgaccgacgcgcccacggccgagccgcaccccgtggcgcgggtcgaggatccggactcgggccgcgtcctcgatgtggcgagcaaccagcccggcctccagttctacgccggcaacttcctcaacgcgaccgcggtcggtaaatccggcctcgcctaccgccagtcggacgccctggcgctggagccggagctcttccccgacacgccgaaccagccggccttcggctcggcccggctcgatcccggcaagacctaccggaacgtgatcacctaccgcttctcgaccagccccgcccaccggacccagaaatga

SEQ ID NO: 6050 - DNA, 885 bp, Methylobacterium sp.
atgcagatcggattcatcggtctaggcagtatgggttcagccatggccatgaacttggtgaaggcaggccatgaggtgcgggcctggaaccgtagcaggatcgtccaggatcgcgttcacggaataacgttggtcccgctcgtggcggatgcattccaggccgacgcagtcttcacgatgctgtccgacgatcctgccattcgggaggtcatcctcgatgccggcgtgctcgcaagggcgcgaccggggctgactcatgtcatcacatcgacgatttccgtcgctttcgcgcgggaactggagttgctgcatgcaaaggcggccctcggctatgtgtcagcgccggtgctcgggcgaccgaacgtagcggcgcgcggccagctcaacatcctggcagctgggaaggccgatgcgattgacgcggttgagccgttgctcgcttcgatcagcaagaaggtttggaagttgggggaggatcctgcgcgcgcgaacgccgccaagatcgcctgcaacgcgatgattgccatggctatcgaggcgatggctgagggtgtcgtgttgaccgagagcgtcggcttggatcgcgcggtcttctttgaactcatcctgggcactcttttctcgggccgcgcctatgagagctacagcgcgcagatcacgaaccgatcattcgagcccggtttcaaatccaagctcgcgctcaaggacatgcgcttggcgatcgaggccggcaaccagatcgggcgcacgctcccgatgcttgaggctgtccacgagggactcaccagagctgtctcggcgggcctcggagagaaggactggtcgatcatggccgatatgacggttcgtaacatggcgatcgccgccgcttatagcgagcgctga

SEQ ID NO: 6051 - DNA, 1836 bp, Methylobacterium sp.
atgccctacgcggacatcgaggcgcacggcgtcatcggcaacctgcgcaccgccgcgctggtctgcagcgacggcaccatcgacttcttctgctttccccaattcgactcggcgagcgtgttcgcggccctgctcgacgacgccaagggcggccacttctccatcacgccggagccggacggagtgcgcacccggcagatgtacctgccggagaccaacgtgctcgtgacccgcttcatgagtgaggcgggcatggccgaggtcgtcgactacatgccgatctgcgcggacggaccgaagagtgccctcgtgcgccgcgtaaagggcatccggggcagcatgacgctgcgcgtggcctgcgagccccggttcgactatgcccgcgccgcctcgcgggctcgcctgcgcgacggcggcctgatcgagttcgcgccggaaggcgaagcggctccactgcgtctgcgcgcgaccgtgccgatgacggtgacgaagtcgggcgccgcgacgactgtgacgctcgcgcccagcgaggaggccggcttcgttttcgaatgcacccaggaacgcccgagcgatggcagcctcgacgccttcctggagagcaccttctcggagacgatggcgtactggcggtcctggagcgggcgctcacgctaccgcggccgctggcgcgagaccgtgcagcggtcagccctcgcgctcaaggtgctgacctccgccgaccacggcgcggtcctgggcgccgcgaccttcggcctacccgagtgggtcggcggcggccgcaactgggactaccgctactgctggatccgcgacgccgccttcacggtctacgcgctcatgcgcctgggctacaccgacgaagcgacggccttcattggttgggtcgagcagcgggcgcgcgagcagggcgagggcgaccggctccagatcctgtacgccctcgacggtggcagcgaggcgtcggaggaagagctcgaccacctcgcggggtatcgtggctctcggcccgtgcggatcggcaacgccgccgccgagcaactgcagctcgacatctacggcgagttggcggacgccatctacctcgcggacaaatacggcgtgccggccagcatcgacacctggcatggcgtggcgcgggccctcgactgggtctgcgagaactggaaccagccggacgagggcatctgggaggtgcgcggcggccgccaggcctttctgtccggacgcctaatgtgctgggttgcgctgaaccgggggctgcgcatggcgggacaactcgcccgcccggcgcccctccagcgctggcacgagacgcaggacgccatcgcccagagcatctacacggatttctggaaccccgagaagcgtgccttcgtgcagcatccgggcaccgacgccctcgacgcggcggcgctgctcatgccgttggtcaagttcatcagtcccgtcgacccccgatggctctcgacactcgacgccatcggccgggagttggtcagcgacgccctggtccttcgctatcagaccaaggagggcgccaatagcgacggcctggaaggacgggagggcgctttcacgccgtgctcgttttggtacgtcgaatgcctcgcccgggccgggcgtctggaggaggcacagctcaccttcgagaagatgctgggctacgccaaccacctcggcctctatgcagaggagcttggtcctcaaggcgagcatctcggcaacttcccgcaggccttcacccacttggcgctcatcagcgcggcctacgctctggaccgcgccctgtccgagaaggggcggccatcaatgggccaggacctccgcggctga

SEQ ID NO: 6052 - DNA, 621 bp, Methylobacterium sp.
atgatctcgttcgcgggatccgcgctcgggcgtgaccttcggaatttctacccagaagttgcattcgtcgatgaggcgtcgccgctgggccgcaccctccgccgcctttccgacgtcttggacgccgccgaaacgcgcgacgagcgccgcttcacgtcagacctggtcggggtggtgccggacctgcgccggtacgcgctgtccctgtcccgggatgcgaccgagagcgaggatctcgtgcagtacaccctgctcaaggcttgggagcatcgtaccagctaccggctcggcacgagcctgaaggcttggctcttcacgatccttcgcaacggccatctcaacggccggatgaagtaccgccgggaggtgcccgatcccgaaggctcctacgccgcgggactggcgagcctggccgatcaggaacaccggctcgacgtacaggacatgcaggaggcgctcgcccggctggaaccggcccagcgcgaggcgttgctcctcgtcgcggtcgaggatctgagctacgaggccgcggctgcgcggatcggctgcccgcccggcacggtgaagagccgtgtcagccgggcccgggacaggctcgctgccgagctcggggaagcctga

SEQ ID NO: 6053 - DNA, 1011 bp, Methylobacterium sp.
atgagagcgctgatctacaccggtccgaacgcgctcattgtcgacgacgtgccggttcccgtgccgggccccggcgaggtgctggtgcgggtcgaggcggtcggcatctgcggttcggacatgcacgcctttcacggtcacgatgcccggcgccccgccccgctgatcctcggccacgaggccgccggacgggtcgcggaggggccgcgggccggcgcccgcgtggcggtgaatccgctggtcacctgcggacgttgcccggcgtgcgaatccgggcgcacgcacttgtgcccgagccggcagatcctctcgatgcccccgcgccctggggccttcgcggactacgtctgcgtgcccgagaagagcctcgtaccgatcccggacgcgctgtcgaccacgcacgcggccctcgccgagccgctggccgtcgcctaccacgccgtcaaccagggggcgcggcttctcgggcgccctctcgcgggcgcgcggtgcgtggtgctgggcggcggcgcgatcggtttcgggtcgggtctggtcctggccatgcagggggcgggcgaggtcgtcatcatcgagccgaatcccgagcggcgctccgaagccgcgcgtggcctccccacggcccgctgccgggcgcccgacgatgccgagggtccaggtcccgacagcgctgacctgatcctcgatgccgtcggcagcgacgcgacacgggccaaagcgagccagctcgcccggccgggggcggtcatcgtgcacatcggactcctgcccggcgatcgggggctggacgttcgcaagatcacgctccaggaaatcgtggtctcgggcagctactgctacacgatgcaggagttccgcgacgtggtcggggccctcgcggatggccggctgggtcccctcgactgggtcgaggagcgctcgctcgccgcgggcgcggctgccttcgccgacatggatgcgagccgcgtcgctgcgccgaagctcatccttcgtccggacgctccggcttga

SEQ ID NO: 6054 - DNA, 1314 bp, Methylobacterium sp.
atgacgatcgactacgcgaagcgggcgacaaagacgcccgagaccgagaccgacgcggcgcggcaggtcgtgacggagatgctcgccgccatcgaggcgcggggcgaggaggcggtgcgggactatgcccgctcgctcgaccgctggaccggcgagatcgtcgtgacccccgaggagatcgcccggcgcacgaaggacatccccgagcgcgtcaaagaggacatcgccttcgcggcggggcaggtgcggcgcttcgccgaggcccagcgcgacagcgtccaagacttctcggtggagctggtgccgggcctcgtcaccggccagaagctcgtcccctgcaacgtcgcggggtgctacgtgcccaccgggcgctacgcccacattgcctcggcctacatgtcggtggccaccgccaaggcggcgggcgtcccgacggtcgtggcctgctcgacgcccttccgtggcgagggcattcacccctacgtgctctacgcgatgcaggtggccggcgccgacgtgatcatgacgctgggcggcgtccaggcgatcgccgcgatggccttcgggctgttcaccggcaagcccgccgacatcatcgtcgggccgggcaacaagttcgtggccgaggccaagcggatgctgttcggccgcgtcgggatcgacgtcttcgcgggtccctccgaggtcgggatcatcgccgacgagaccgccgacccggccctcgtggcctcggacctcgtcggccaggccgagcacgggcacgagagcccggcctggctgttcaccacctcgcgtgccctcgcggacgacgtgatcgcgcggatgccggcgctgatcgacgccctgccgcccacggcacgggacgccgccgccgccgcgtggcgcgactacggcgaggtggtggtgtgcgggagccgggaggagatcgtcgccgtctctgaccgctatgcgagcgagcatctggaggtccacgccgccgacctcgactggtggctcgcgcagctcagcaattacggctcgctgttcctcggcgaggagactacggtcgccttcggcgacaagacctccggtccgaaccacatcctcccgaccaagtacgccgcccggtattccgccgggctgtccgtgcacaagttcctgcggccgctgacgtggcagcgcatggaccgggaggcctgcaagaccatcgcccaggccacggcccggatctcgcgcctggagggcatggaggcccatgcccgcacggccgaccaccggctggcgaagtatttccccggccatggcctggatctcggcgaggcggtgaccgcatga

SEQ ID NO: 6055 - DNA, 1107 bp, Methylobacterium sp.
atgaccgagattcgaggcaacgggtgccggggcggccggcggcgggcatggctcctagccggcgccctggcgctggcgccggtggtcgcgccggccctcccggcgaaggccgcggagcccgagcggatcggcgtgtcctatcagccgtcgctctactgggcgctgcccttctacatcgccacgcagaagggctggtggaaggaggtcggcctggagccgaccttcgcggtcttcccggccggcgcgccccaggtcgccgccgcgcaggcggggtcctgggatgtcggcgggaccggttccgtgccggcgatcctcggcgcggcgcgcttcggcctgctgacgatcggcctcaccaacgacgagtcgaagaccaacgcactgatggtgcgcgccgcacggcacgacgcgatcctcaaggatcccaagcagctggccggacagaagctcctcgtcaccaccaactccaccgccgattacgccgcccgcgcctgcctccggaagtggggcctcggcccgcgcgagatgcgcttcgtcaacctcggacaggcgcagatcatctcggcgatgatcgccgacgcgggcgaggtggtcggcgtctgggccccgaacacctacacgctggaggagaaggccagcgcgcaggtcctgtgcagcggggccgacgccgacgccatggtgcccggctccctgatcacccgcgccgacttcgccaaggcgcatccggacgcggtcgccaagttcctcgccgtctatctccggggctggggctgggccaaggcgaatcccaaggacgcgcacgacatggccaagcgcttctacgccgagggcggcgtcgaggcgtccgaccacgccatcgaccaggaattcgcgctgcgcccgacctacgccctcgatgcgcagctcaaggcgatggcgcgcgcggacggcccctcgcaggtcgacggctggttctcgcggatcggcgcgttcatggccgaggtcggcacgatcgcgcaggcgcccgatgccaagggatacatcgacgacgccttcatgaagcgcgtcgcggccgatccgaagctccgggccttcgccacggagttcgacgcggccgccgccccgcgctga

SEQ ID NO: 6056 - DNA, 786 bp, Methylobacterium sp.
atgagcgcaatccggttcgagcgggtcgagaagagcttcggcagcaacgtcaaggcgctcgacggcgtcgacctcacggtggccgaccgcgagttcgtggccatcgtcggcgcctcgggttgcggcaagacgacctgcctgcgcctcgtggccgggttcgaggctccgaccggcggccggatcaccgtcggcggacagccggtcaccgagccggggcccgaccgcgctgtggtgttccagcagttcgcgctgttcccgtggaagaccgtcacgcagaacatcgcgttcgggctccgcaacaagggcatgcccgccgccgagcgccaggagcgggtcgccgcggcgatcgacatgatcggcctctcaagccacgccgacgcctacccgcaccagctctccggcggcatgcagcagcgcgtcgccatcgcccgcgcctacgtccttgagcccgaggtgctcctgatggacgagcccttcggcgccctcgacgcgcagacccgcgtggtgatgcaggaggagctggtccgcctcgcgcgcaggaacccgcgcaccgtcctgttcatcacccacggagtcgaggaggcggtctacctcgccgaccgggtcgcggtcatgaccaggcgcccggggcgcatcaaggagatgatcgacgtcaaggcggtccgcgaggccgaacgctgggaggagcacgcccgcatcgaggacgtgatggacctcgaatcgttcgtccacctgcggacgcacatctggaaatcgctgcgcgacgagaaggcggccggccggtga

SEQ ID NO: 6057 - DNA, 792 bp, Methylobacterium sp.
atgatcgcctcccgccagccgctcccgctgcgccgcagcctcgccctcggcgcgatcggcaccctggcctttctcggcttctgggccgccctgtcccgctccggcctcgtctcgccgctgttcctgccgggaccggtcgccgtggcggagcgcttcgcgaccctgaccgagcggcccttcgcggggggcacgctccccgcccatgtcgcctccagcctgcagcgattcctgatcggctacctgctcgccgccgcggtcggcgtgccgctcggcctgatgatggggtggtcgcgcctcctcgacgacatcgtcacgccgatcttcgacgggctgcgcttcatcgcgccgatcgcctgggtgcccttcgcggcgctctggttcggcaccgggatcggcggcccgatcctgatcatcttcgcgggcgcctttccgccctgcctgatcaacgcctatcgcggcgcccgctacgtcgacgcgcgcctgctggaggccgccgagatgctcggaacgccgggctatcggatgatcgccgaggtgctcctgcccgccgcgctgccctcgatcgtcgccggcctgcgcatcagcgcgggcctggggtggcaatccctggtcggtgccgagctgatcgtggcctcgacgggggtcggctacatgatggtgcaggcccagggcgccgtctcgaccgcgaccgtgatggtcggaatggtcgcgatcggcctcgtcggcgtggtcatcgacgtcgcgctgcgcgcgctcgagacccgcctccgccggcatcacggacaggcttga

SEQ ID NO: 6058 - DNA, 783 bp, Methylobacterium sp.
gtgaagttcagccgccgcatgtgcgtcggcatggcgacgctcgtcgtcatcgccgtcctctggtacgtcgcgaccaccggcctcggcctgatctcggcagggcggtttcccgcgcccggcgacgtggagacggcggctgtccaggccttcgtccggggctatcccgacacgacgctcctcacccacgtcctgcactcgctccggctcgtcgcgctgggcttcctcgtctcggtgacgctgggcgtcccgctcggcctgctgatgggctggaaccgtacggccgaggccctgatcaacccggtcttcctgctgctgcgcccgattccgcccctcgcctggatcccgctcgccatcctgtggctcggcctgggcgacggggccaaggtgatggtcatcgtcatcgcggcgctgcctccggcggtcatcagcacccaggccggcgtgcggggcgtgccgccgcagatcatcgaggcggcgcagatgcttggcaccccgcgactgcgcttcgtcacggacgtgctggcgccggcggcggcgccgatgatcttcacggggctgcggctggcgctccaggcgagctggaccaccctggtcgccgccgagctcgtcggctcgctcgcggggctcggctacgtcctgaacgtcgcccagcaggacctctacccgggcatgatcctcgtcggcatggcggctgtgggcatcctgggtgcgggaagcaccgcgcttctgggaatggccgagcgccgggcgatcggctgggcacagctgcggggagcggcatga

SEQ ID NO: 6059 - DNA, 405 bp, Methylobacterium sp.
atggatgtgactgtgaaccgccccgaggtcgtggccgagattaccgccctgttcgagcgctacgagcgggcgctcgtcgagaaggacgtcgccgtgctcgacgcgaccttctgggacagtcctcatacgatccgctacgccctccatgagaactgctacggctttgccgaagtccacgccgcacgcgttgcagccgatccgccgccgggcggggccaaggagacgcgaatccggctagagattctcacgcttgggaacgacttcgcaacggtcaatctggaattcaagccgcgcggcaaggccggcatcgggcgtcaaagtcagacttggatgcgcctacccgacagcggttggaaggtggtgtcagctcacgtgtcaatcatgccgcctgcggattgcatttag

SEQ ID NO: 6060 - DNA, 1617 bp, Methylobacterium sp.
atgagcgacgccgtcctcgagatcgagaagctcacgatcacgctgccgcccggcgcggatcggcccaatgccgtcgccgatctggatctcgtcctgcggcccggcgcggtcacatgcctgatcggcgagagcggatcgggcaagtcgatggtggcgcgcgcgatcctcgggctgctcccgggaccgcgcgtgcgcgtcgcgggcggacgcatccagttcgagggcgcggatctcgcggcgatcaccccgcgtcagatgcgcaaggtccggggtgcgcggatcgcgatgatcttccaggagccgatgacggccttgaacccgctccacacgatcgggcggcagatcgacgaggtcctgcgcatccacaccccgctcgggcgcgccgaccgccgggcgcgcatcctcgcgctcctcgcgagcgtccacctcccggatccgggccggctgctgcgctcctacccgcaccagctctcgggcggccagcgccagcgggcgatgatcgccatggcgctggcgctgaatccgcggctgctcatcgccgacgagccgaccacggcgctcgacgtcaccacgcaggcgcaaatcctccacctgatccgcgagctgcagcgcgagcacggcacgagcgtcctgttcatcacgcacgatttcggcgtcgtggccgatatcgccgacacggtcgcggtcttgcagaagggcgtcctggtcgagcaggggcccgcagcttcggtccttggggcgccgaagcacccctacacgcgcgccctcatcgccgccgtgccgaagctcgtgccgccgccgcggcgtgccgccagcaccgcccccctggtggtggaggcgagacaggtcgagaagacctacggtgcccgcggcctgttcggcggccgcatcacccgagccctcgacggcgtggacgttttgctgaggcggggcgagaccctgggcctcgtcggcgagagtggctcgggcaagagcacgctcgcacgggcgatcactcggttgatgcccgtcgatggcggcgagatcctgctggccggacacagcgtcgccgaactgacgcgccgtcagatgcgcccgcaccgccggcgcgtgcagatggtgttccaggatccctacggctccctcgatccgcgccagcgcgtggtcgacatcgtcgccgaggggccgatcatccacggcaccgaacccgggatcgcgcgggtccaggcctgcgagatgctggcgctggtcggcctcgatcccgcggcggcgcagcgctacccgcacgaattcagcggcggccagcgccagcggatcggcatcgcccgggctctcgccatgaagcccgagatcctggtggccgacgagccggtctcggccctggacgtctccgtgcaggcgcaggtcctggcgctgctcgccgacatcaaggcgcggctgcacctcagcatgctgttcgtgacccacgatctccgggtcgcgctgcaggtctgcgaccgcatcgccgtgatgcggtccgggcaggtggttgaggtcgcgccgacctccgagatcttcttcgcgccgaagcatccctacacgaaggcgctattcgccgccgtgcccggcgcccaatggcaggaaccgatccccgcatga

SEQ ID NO: 6061 - DNA, 411 bp, Methylobacterium sp.
atgcaggcaggatggagtgcgatcccgaacattatcatcgaaaagcaggcgactctcggcctcgatgcgctcgacatgaacattattttgcacctgacgcattactggtggcaccccgataacttgccacatccgtctgtcgagacgatcgccacggcgctcaacgtcaagccgcgcaccattcagaagcgtattaaggcccttgtcgagctcggactaatgacacgcgaggagcggcgccacaccaagaacggcagcacaaccaacctctatggcttccaagggctgatagaggcatgccgaccctacgcagaggagaagattgccgagatcgcgaaggcgaaggaggccaaacaggcgcgcctggtccgtaagaagccgcgcctcgtggtcgacaatgccgatgactga

SEQ ID NO: 6062 - DNA, 720 bp, Methylobacterium sp.
gcggccatcggcgtcgacctgacgagcggcgaggcgatcgcggccgacgtcgtggtgtccaacgccgattcggccgtgacgcacgcgcgcctgctgccggaggcgcagcgctggagcccgggacggttccagcgggcccgctcgtcgatgggactgttcgtctggtatttcggcaccaagcggcgctacccggcggtggatcaccacacgatcctgctcggcccccgataccgcggtctgctcaccgacatcttcgaccgcaaggtgctggccgaggacgcgagcctgtacctgcaccgtccgacagccaccgatccgagcctcgccccaccgggctgcgacgccttctacgtgctggccccggtgccgaacctcgccggcggccaggattggcagaccctcgccgaaccgtatcggcgccggatcgccgccctgctcgaggcgagcgtgatgcccggcctgtcggaggccatcgtgacctcgaaggtgacgacgccgctggatttccaggacgatttcctgagctaccggggctccgggttcggcctggagccggtgctgacgcaatcggcctggttccgtccgcacaaccggtcgagcgcagtccgcaacctctacctcgtgggggccggcacgcatccgggtgccggcctccccggggtgctgtcctccgcccgcatcctcgacagcgtggtccccgatgcccgcgttaccgcctga

SEQ ID NO: 6063 - DNA, 741 bp, Methylobacterium sp.
ttcttcaccaccaaggagatcggcaagggcaccggcctcgggctctcgacggtgttcggcatcgtcaagcagtccggcggcaccatcgacgtccagtcgaaggtcggggagggcaccgccttccgcatctacctgccgcgccacgtgccggtggcggagcccgaggaggtgccggccccggccgccgagccggcactgccgcgcgtggagccgctcgcgccggcttccaccgccgcccatcccgattccgggccggacgccaagccggtcaccgcgccggccgcgggcggcgacgccgttgtgccgaagggggagacgccgcccgccaaggtcgacaagccggcgccgcgcaagcccgccgccgaccatacggggcaggggaccatcctgctcgtcgaggacgaggacccggtgcgtgcagtcaacagccgggcgctctcggcccgcggctacacggtgctggaggcggcctcgggcctcgaggccctggcgatcgtccgcgagggcgcgcagaccatcgacctcgtcgtctccgacgtggtcatgcccgagatggacggcccgacgctcctgcgggaagtgcgcaagcatcagcccgacctgaaggtgatcttcgtgtccggctacgccgaggacgcgttccgcaagaacctgcccgagggcgagacgttcaacttcctgcccaagcccttcagcctgaagcagctcgtcgagaccgtgaagaagacgatggcggactga

SEQ ID NO: 6064 - DNA, 789 bp, Methylobacterium sp.
ttgacaaacggctcggtcgagggtccgcacgggcacctcaagcgggccatcgccgacgcgctcctgctgcgcaccagcaccgacttccccgacctgaccgcctaccgcaccttcgtcgacgagatcgtcggacgccgcaacgctcgccaggccaagcgcatcgacagcgagcgtgccgtcctggcgcgactgcccgagcggcgctcgtgcgactacgagcaggtcagcgtgcgcgtctcctcggccggcgggttccgcctgcgcaaggtgttctacaccgtaccctcgcgcctgatcggccacaccctgcgcgtgcgcctctacgatgaccgcctcgacgtcttcgtcggcggttctcacctcctcactttaccgcggggccgggctcatccggacggacggcacgatcaggtcgtcgactaccaccacgtcatccacgccctccggcgcaagccgatggcgctgctcaacctcgtctaccgcgaccggctcttcccgcgcgccccctaccggcacgccttcgaggccctgcgcgccgcgcttccggaacggcaggcctgccgcatcgccgtcgacttgctcgcgctggcccatgaccgcggctgcgaggccgagctcgccgaatgtctggccgtcgaactcgccgccaagctcctgcccgatctcgccaccctgcgcgcccgcttcgcacccgatccggctaccatccctcacgtcaccgtcgccctgggctcgctagcgagctacgagagccttctcgacagcgtcacgacgggaggggcggcatga

SEQ ID NO: 6065 - DNA, 309 bp, Methylobacterium sp.
ttgctcggcgcgatccaggcgctcatcgccgatctgccgacctacggctatcggcgcgtccatgcccttctgcgccggcaggccgagcgggacggtcggcctgcaccgaacgccaagcgggtctaccgggtcatgaaggtgcacggtctcctgctgcagcgacatgtgggcggagccgagacgcgccgtcacgagggcaaggtggcggtggccacgcgcaacacgcgctggtgctcggacgggctagagatcgcagcagagaacggtgagcgtgtgcgggtcgccttcgcgctcgattgctgcgatcgg

SEQ ID NO: 6066 - DNA, 312 bp, Methylobacterium sp.
atgacgggtacaattgtttcgctgcgctccggccgcagcacgacatcggctctcactcacttcgacatcacggcgatggaactgctgcgggagggtcgtgcaacgaccctgtcggaggcgcggctcgatgcgatccgggccgagcttctagccaagcgtgcggaactcgcagcggtgctcgccgatctacaggcgcggccgtcaagcggcgacgctcagatcgatgccgtcaacgcgaccttgcgcatcgaggcaggtatcggactttcccacatcgagctgttcatcaagcaggtcgaggtgtgcccataa

SEQ ID NO: 6067 - DNA, 174 bp, Methylobacterium sp.
atgcggttcgcggtttccatgatgcagggcctggtcaagggacccgcctcgcgtcggctctcccggagccgccgggcggccctggctgccctcgccgtcgcggggctcgccgctccggcccaggcgcagacgctggcgagcctgcccaccgaggccggcgcccgggtgcagggc

SEQ ID NO: 6068 - DNA, 174 bp, Methylobacterium sp.; identical to SEQ ID NO: 6067

SEQ ID NO: 6069 - DNA, 234 bp, Methylobacterium sp.
atgggcgacgacgatctccacgctccgtcgcgcgagaccggctacctctctgccttgcgcgacctcatgattgtccatcagcaatggattgaggatggctgcggcttcgagaatgtgcaggcccaccgacatgccatccgcttcctcggcggcctgatcgcaatgaagcaagcgcgcatggcaagccgggccaaggacccgaagtcggagcgaccgcggggctggtcatcctga

SEQ ID NO: 6070 - DNA, 1704 bp, Methylobacterium sp.
atggagatgttcgaggcattcggcttcagcgagcgcgtcctcaaggaggcgtactgggtcaacgaaacctgcttttggaaccccgatcccagccagtcgaacatgattacccgcactggccgcatcgtggatacggaggagggattgtccgagttcccgcacgtcatcatgaaccaggcgcgggtccacgacttcttcctcgcaacgatgcagaacgcgcccactcgcctggagccgagctacggacgcaacttcctcgatctggctctcaaggacgccgaaacgggcgacggcatcgagccatccagcgacttcgactatccggtcaacgtcaggcttgagcggatcgacgattcgcagacgtctgccgtcgagaccgtacgcgcgcgctacatcgtcgggtgcgatggggcccacagcgccgtgcgtggcgctgtgggccttacggtgcacggtgactccgccaatcaggcgtggggcgtcatggatgtacttgccgtgactgacttcccggacatccgtctgaagtccgccatccactccgccaaagagggcagcctcctaatcatcccgcgcgaaggtggttacctcgtgcgcatgtacatcgaactcgacaagctcgacgcgaatcggcgcctggcaagggacgcggtgactgtcgatcacctgatcgcggcggcgcggcgtatcctgcacccctacacgctggaggtgaaggaagtcccatggtggtcggtctacgagattgggcagaggctctgcgaagccttcgatgatggcggccttgcgcaccgtgaacatcgttcgccccggatcttcatcgctggcgatgcctgccacacgcacagcccgaaagcgggccagggcatgaatgtctcgatgcaggacgccttcaacctcggctggaaactcgccgccgtggtccgcgggcagtgtacaccgcagattctccagacctactcgatggagcgtcgcgccgtcgcccaggaactcatcgacttcgaccgtgcgttcgcccgcatgttcagcgccccgcccaggccatccgacgtgacgggcggcgacggcgtcgatccggccgagttcgagcggtacttcgtcaagcatggccgcttcaccgccggtaccgagacctgctatccgccgtccctcatcaccggccagtccacgcatcagaacctcgccgagggcttcaggatcgggacacgctttcattcggcgccggtgatccggctggccgatgctaagccacttcagctcggccacaccgtcaaggcagatggccgctggcgcttgttcctgttcgcggatccggagtcgcccgacgcgcgatcctcgcgattgcgcgccgtgtgcacgtacctggccgaagcggacgacgcgcccatccggcggttcacacccgcgggcgccgacatcgactccgtcatcgacgtgcgggcgatcctgcagcagggccaccggcagttcgttctaggagcgatgccaccgctgctgcgaccgccgaaggggcgttataacctcgtcgactgcgagaaggtcttctgcccggacccgaaggccggcgatatcttcgcactgcgcggcatttggcgggcggacggttgcatcgtcgtcgtgcggccggaccagcacgtcgcgcatgtgctgcccctggacgcccatgccgaactcgcggccttcttcgatcgattcatgctgtag

SEQ ID NO: 6071 - DNA, 486 bp, Methylobacterium sp.
gtggcggccttcgtcagccgccaagcggtggccgcggccgatctgcccggcctgatgcgcaccgtccgcgacggcctgctcgcgctgggcgatgcggccccgccgatcgtcgccgagccggagcccgaccgccccgccccgacgcccgcccagatccgcaagtccgtccacccggacaggctgatcagcttcatcaacggctgcgaatacaggacgctgaagcggcacctcacggcctacggtctgacaccggacagctaccgcgcacgcttcagcctgccccacgactatcccatggtcgtcgccggctatgctgcagagcactcggcgctcgcgaaggcgatcgggctaggcgtgcacggcgcccaggcggcgtggcaggcgagcagcagcatcgtcaacgacgccgagcacttataccggtcgagaaatgccgttttgggacgcgcaaagcttccggatcgacaaacgaggatgactccctaa

SEQ ID NO: 6072 - DNA, 288 bp, Methylobacterium sp.
atgaaattccgtccgctgcacgaccgcgtggtgctccgccgcatcgaaggcgaggagaagaccaagggcgggatcatcatccccgatacggtcaaggagaagccgcaggagggcgaggtcgtcgccgcgggaccgggcgtgcgcgatgaggccggcaagatcatcgcgcttgaggtgaaagccggcgatcgcgtcctgttcggcaagtggtccggcaccgaagtcaagatcgacggtctggacctcctgatcatgaaggaatccgacatcctgggcatcgtcgcctag

SEQ ID NO: 6073 - DNA, 942 bp, Methylobacterium sp.
atgagcgccgtcaacgtcatctgcggttcgcgtagggcctgcgtcctcaccgacgccagcctctacgactcggccgggacgatcgttgggttcgagctgaaggcctacgcggtcgagagttggaccggcgtcatcaccggccggggtaactggtggggcccgacctttgtccgagatctcgccgagagcttcggctcgttcgatgagttcatgtcgcggagcgcggctaccatcgagcgcgagcaccgcgaggcgatggagggcggccaactcgcaggccagacgcttatcgaggtgcacgccgtcggctggagcgagcgccgcgacgagcccgaggcctacgtgttgcggtcgccctcggccttcctcgacgcggacgagccgtcctacgtctggcgcagcctggaggacgaggacggcatcttccatcacgcgcacctcagcgcaggcgagctatggcagctgcaccggcagagcgccgaggagggcgtcgactggacggccgagaccttcgaccccgtgcgccacggtattccccttatggaggcgcagcgccggcaggccgccgacgcgatggcgggccccgatgttgccggcaagcacgtgatcggcggtgcgctgtggctcaccgtggtcgaccgcgagggcgtacggcaaggcatcatccggcaatggccggactcggcgggcgaagcgattctgcccgcatcgctcgatgagtcgagcttgccgaaggtgcccccgtccggcttcagcgcagcatggacgttcgaacggttcgaccgcgccgtgcgcgccggcgtgatcgatttcgccacgttcgacttcgatcccgccgccctggcgcgcctcgaggctgcagcgccaaccggggtcggcctgtcccgtcaacagcgccgcgccgcgaaggctcaagtccgtaagctggcaggtgcacgctga

SEQ ID NO: 6074 - DNA, 204 bp, Methylobacterium sp.
gtgcagggcatcatgcccgacgttgcggtgcacggccacccgatcgcgggccacgcatgtcgggacagcttgatcggcgaccgacgtcggtcgtcggtcgtcggatcgtcccggatcctggctgtcggtgccgagaacctcggccggggagcgatccgatcgaacgccgcctccaagcgcatctcgccgatcgtccggctgtag

SEQ ID NO: 6075 - DNA, 129 bp, Methylobacterium sp.
gtgacgagcggcgacgccttcataatgctgaccagcgtccggtactgcctgggccgccacagctacgcgccgagcgtaattacccaggcctgtgatggctgggttcaggcaccgatggttttgaggacg

SEQ ID NO: 6076 - DNA, 561 bp, Methylobacterium sp.
gtgtcctctgcgcacgacggcgatccgggtgtcggggctgttcagtcctgcgaccgtctcgcgagcgctccgtgggatccggatgcccccgacgcgcagcggaccgtcaacttccgggatctacgcgctggcgcggccgtagcggcgtgccgggcggcggttgccgaggccccgcggctgcggcggctccatttccagctcggccgcgcctacgaccggcagggcgcgaaccacgatgccttcgaggcctaccggcgcgcggccgaactgggcagcggtgcggccaaggtcaatatcggcatcctctaccagcagggtcgcaggttcgagaagagcgatgccaaggcgcgcgcttggttccgcaacgcggccgcgacgggcattccggaagggatgtactgctacgcggtcgccctcgacaacgggatcggcggttcccccgacgctgcggcggcccgggcctggtacgtgaaggccgccgagcgcggcaccgcgaaggcgcgggacgcgctcgtgcgtctcgaactcgacggcaccggcacgggtgtgcgctgtgattag

SEQ ID NO: 6077 - DNA, 189 bp, Methylobacterium sp.
gtgagcgcgccctctccccacgggtccggcggcccggccccgcggcgcatcctcgtcaccggggcggccggtttcgtgggcggccacgtcctgccgctcctggcgggggcgacggcggggtcgacggcggagtcggcggcgcgggcgggttggggtcggtcgggtcgaaggcggcgggctctcccgtga

SEQ ID NO: 6078 - DNA, 1074 bp, Methylobacterium sp.
atgccgttcgccctgccggacctgccgacggtccgccggaccaaccgggacaccttggcggccttcctggagggcgccgacgcgagcgtcccgaatagcgccctgcgcgtgctctcggacatgaacgccggcggcgcgttcctgaacctgaagtacctccagtggctcgccaagaacttcctgccggacctggcggagaagggctggctcgaccgctgggccagcatcctgttcggcggccggaaggccgcgaccttcgcctccggcaccgtcacggtcaccggcacgccgggggtgacgctcccggccggctcgatcctggcgacttcggacggcgtccagtaccagaccgccgtcgacgtcatcctatcggcggcgatcacacccgtcgcggtcacctgtctgaccgccggggcgatcggcaaccgggacaagggcgcgctgctctcgctcacggtcgcggtctccagcgtcaacgcgcaggcgaccgtcgtcctgatcgacggcggcgccgacaccgagagcgacgacgatctgcgcgtccggatcctgctgcggatccgcaacccgccgatgggcgggtgcgccaccgattacgagcagtggaccctgtccctgcccggcgtctcccgggtctgggtcgcgcctatggagatgggcatcggcaccgtcacggtgcgcttcgcctgcgacgtgctgcgggccggaaacgacggcctgccgacccccgacgactgcgcgctggcgaaagcctacctcgacacggtccggcccgtgacggtggcggacctgttcgtgctcgccgcgatcccgcaggggatcgtgccgcgcatcctcaacctgtcgaacgacacgccctcgacccggctcgcgatcgccgcggcgctccaggcgatgctcctggagaaggccgcgcccgggcagacgatcttcgcctgctggatctcggacgcgatcacggacgcggtcggtgatgccaccttcgacctcgtgaccggggacttcgtgatggccaacgccggctcgatcgcctcgctccggcagccgttcggcggcgggatcgccttcacatga

SEQ ID NO: 6079 - DNA, 711 bp, Methylobacterium sp.
atgagcgacgccttcatccggcgcgacggcgaggactacgcgcaagccttcgcgcgcctgctgccgaccggcgaggcgtggtcgcgcgatcccgccgcgacgctgatgcagctcgtgcgcggacaggccgagatctggggcgcggtcgtcgatccgcgcgcggccgacctcctggagatcgagaccgacccgcgcttcaccctggagctgctcacggattgggagcgggcctacggcctgccggatccgtgcgtgccggtggtgcagacgctgcccgagcgccgccagaggctcgcgcagaagatcgccatgcagggcggccagtcgagggcgttcttcaccggggtcgcggcctcgctcggctacgcgatcaccatcaccgagtacgtgcccttccagttcgggctgtcgtcgttcggcggcagccacgggcggctcaacccgccgggcttccggtactgctggtcggtcacggtcacgggcgcgcgcctcacgcgcttccagttcggcgtctcctcgttcgggcgcgatccgctcctgtcgatccgcagggccgaggacctggagtgcatcctcgggcggctcaagcctgcgcacacgctcctgcggttcaactacggcccgcccgccccgacggtgcgccagcagcgcttctccttcggcacctcgaccttcggcggcgatccgctcctgcgcctgatcgcgagctga

SEQ ID NO: 6080 - DNA, 297 bp, Methylobacterium sp.
atggcagaccggaagcagacctttacccctgagtttggtgctgaggcggtgcgattggcgcagacgagtgggcggtcgcgccgtgaggtcgccgccgatctcggcgtcgggctctcggcgctgcgcaactggattgacggtcgacgtgagcgggagatggacaacccaccgaccgaccggcaggaggacatggccgccgagctcaagcgtctgcgccgcgagaacgaggtgctgcgccaggagcgggaaatcctgaagcgggccacggcttttttcgccaaggagggaagtcgatga

SEQ ID NO: 6081 - DNA, 120 bp, Methylobacterium sp.
atgaggatcgcgatcatcacgccgtcgaggctcaaaccctcgaccctggccggaaaggccggccagtacttcctggagcacgcgatcgcgagcgccaacgcccaggagctcgaccggccg

SEQ ID NO: 6082 - DNA, 1932 bp, Methylobacterium sp.
atggcaaatacgatccggctcaagcggtcgaacaccgcgggcaacgcaccggcgtcgctcgccgacggcgaagtcgcaatccagcaggcggacggcgcgctcttctggcgcaatgcttcggccgccgtccagaagctcctgctcccgcgccgggctccggtcgcggatgccgcctaccccatcaagtccaccgatacttacatcggtatttcgtcgctgacggcggcgcgtgcgttcactctcccgctggcctcctcttaccccgccgggcatgtcctgaccgtcgtggacgagagccggctgtgcagctcgtccctgacgatcaccttcggcgtgaccggctcggacaagatcaacggcgcgacgaccttcgtcgtgagcgagccgggcttcttcctccggctcgtctcggacggcgcatcgaagtggtcgtccagcttcgtcggggccgcgtccaagaccgatctcgtcacgaagttggaccagaatttcggcaacgtcagcttccccggagcccgcaacacgctgggtctgcgcgagatcaacgcggccgatccgcagtacggcggcggcgtcgtcgcggactgcacgggcgtcggtgtcggcaccgacaacggcccgcgcctgcagctcgccatcaacgcctgggtcgcgtccggcgccggctccgtcctcaagatcccgcgcggacgctaccgcatcacgacgcccgtcatcgccaacctcggcggcctggccggtctggtgttcgatgccggcgatgcactcctgacgcccgaccccgtcgccatggtggcgatcagcatccgcaacgggttcgggctcaccatccgcgcccgcatcctcgagggcggccccttcggcggttggggggcgagcaatccctacggggtcgactattcctcgatcgccgatgccgtcgccggtggcggccaggaggcgatccgggtctcgggggtgagcggctacaccgtcgacctctgggcccagaactacgccggccggctcctgcgcatcacgaccgcggcgtccggcgacccgatgaccagtgccatcaagggccgcatcgtgacgacccgtggcaccgacctgagcaagccgcgcgtcgggcagtcgatcttcaccgacaatggcacgggcgaccccacgggagcttggggtcagctcgaggggctgcacaacgacttcgacgcgtacgggccggtctggcgggacgtgaacgatgtggcggtcacctatctcgacggtgcctacgcctacaccgggatcgccctgcacggggtcgggatcgtccacggggcgagctggtacatcggcgacatcgactcgaacgcgagcaacacccacctggactttgccccgtcgcccgccaccggccgcccgggctaccgcctctcgcttgcgcagctcacgatgctcaacgccggaaacggcctgaacatcagcggcacagacctgagccagcgcgcggccgacatcggcatcgcccgcatgatcggcgcaaccggcaccttcgggaacgcggtcaacatcgcgaacgccaagggtgtggccgcgcgcatcgaggcgagcggcgccggcggctccatcctggcgatcacgggcgcgggagctgacgatgtccgcctggacctgcatgcctccgggctgaacgggaacttcgcctacatcgcgtccgaggtggcggggcggatccagatcggcggcgccatgtcgaacccggtgccgggcaactcggtgctggtggtcggcggcaacacgccggtgcgcctgtccgatctcgatgtgtcgggtccgagcggcccatcgctcctgtacttcgtctcgcagacgaacaaggtccgctgggtgtccggatcaaagtctggcgccgcgacgacctacgcgggctatcagccggcctacgccgcgccggccgtcgacatccaataa

SEQ ID NO: 6083 - DNA, 1401 bp, Methylobacterium sp.
ttgcgcgagatcaacgccgcggatccgcagttcggcggtggcgtcgtcccggactgcacggacgtcggtgtcggcaccgacaacggcccgcgcctgcaactggccgtcaacgcttggatcgcggccggaccgggctctgtcctcaaggtgccgcgcgggcgctaccgcatcacgacgcccgtcatcgccaacctcggcggccgggtcggcatggtgctcgacgccggcgatgcgctgctgacgccggacccggtcgccatggtggcggtcagtatccacaacggcttcggcctcatcctccgcgcgcggctcctcgagggcggcccgttcgcgggctggggtgctagcagcccctatccggtcgattacggctcgatcgccgacgtcgtctccgggggcggccaggaggcgatccggatctctggggtgagcggctacaccgtcgacctcaccgcgcagaactacgccgggcggctcctgcgcatcacgaccgccgcggccggcgagccgatgaccagcggtatcaagggccgcatcgtcacgacgcgggccacggatctgagcaagccccgggtcgggcaatcaatcttcaccgacaacggcacgggcgtggcgaccggcgcttggggccagctcgacagcctgcacaacgacttcgacgcgttcggtccgatctggcgggacgtgaacgatgtcgcggtcacctatctcgatggcgcctacgcctacacgggggtcgggcttcatggggtcgggatcgtccacggggcgagctggtacatcggcgacgtcgactcgaacgcgagcaacacgcacctcgacttcgcgccgtcgcccgcgaccggccgcgccggctaccgcctcgcgctcggccagctcacgatgctcaacgccggcaacgggctgagcatcagcgacacggacccgagccagcgcgccgcggatatcgccctcgtccgcatggtgggggcgtcctccgcgttcgggaccgcgctcaaggtcgacaacgccaagggcgtgtccgcgcgcgtcgaggcgagcggcttgggtgacgcgatcgccgctgtggccggggcggacaccgacgatgttcgactcagcctgcacacccccggtctgggcgggaacttcgccaccatcgcgaccgaggtgacgggccgggtgcagatcggtggcgcgctggcaaacccggtgcccggccgctcggtgctgtacgtcggcggagacacgcccgtgcgcctgtccgatctcgatgtgtcgggcccgagcgggccgtcgctcctccacttcgcgagcgcgaccaacaaggtgcgctgggtgtcggggtcgaagtccggggctgccatgacctatgcggcttctcccccggcctacgtctcgccggccgtcgacctcccatag

SEQ ID NO: 6084 - DNA, 348 bp, Methylobacterium sp.
gtgcacggcgtgatcgccggcctccttaccggcgccccgaacttcgagaccggcgcggtcgagcaggcaaacgtcgagaagccgagcgcggcccagatccgcaagtcagttcgggatgagggcatcgtcagcttcatcgacggcaagacctacaagacgctgaagcgtcacctgactagccacggcttggatccgcgcagctatcgcgaccgttacggcctgccggctgactatcccatcgtggcaccgagttatgccgcgcagcgctctgagcttgccaaggcgatcggcttaggtcagctcggcgcgatggctgggcgcgggcggaagggcgataaggccgcctga

SEQ ID NO: 6085 - DNA, 372 bp, Methylobacterium sp.
gtgcacgccgtgatcgccggcctcgttgccggcgccccgaacaccgagaccggcgcggtcgagcaggcagacgtcgagaagccgagcgcggcccagatccgcaagtcggttcgggacgacggcatcgtcagcttcatcgacggcaagacctacaagacgctgaagcgccacctgaccagccacggcctggatccgcgcagctaccgcgaccgctacggtttgccggccgactatcctatcgtggcaccgaattatgccgcgcagcgctctgcgcttgccaaggcaatcggtctcggccgtcccggagcgatggctgcgcaggttgacgaaggggttcagcctgagcggaaaggccgacgcaaggccgcctga

SEQ ID NO: 6086 - DNA, 555 bp, Methylobacterium sp.
ctgaacttcaacgacaacggcttcgacgccgccgtgatcggcacgaacatgaacttcaaccgcaccaacaacaccggtgcgatcggagcagattggatcgctcatttcgtccagagcatcgggccgaagccgatcggcagcgcgctcacggccatcggcaagatgcgggtcggtatcgatctctcccacgccaacttcgacgccgacaagatggccctcgctctgccggccggggcgaggatctacggcaacgcctacaacaccgacacccactccatgccccggtacacgatgccgaacgtggactggatcgagcggagcccgagtgggttctggggtatttactacaacaacgcctcgaccatgcagttcaacgacgctcaggtcacgtcaatcccggtgttcttcgcctacggcggcatccgcgagcccagcaatccgccgccaaatagccagacgggatgcaccacgggcgatcgtgcttgggattcgaacttcgaatatcggtgcgtcgctgctaacacctggaggcgggctgagctgaagccgttctga

SEQ ID NO: 6087 - DNA, 555 bp, Methylobacterium sp.
ctgaacttcaacgacgacggatacgacgacgccgtgatcggcacgaacatgaacctcaatcgcaccaacaacaccggtgccatcggagcggattgggtcgcccacctggttcagagcatcgggcccaagccgatcggcagcgcattgtcggcagttggcggcatgcgggtcggtatcgacttcacccacgccaacttcgatgcggacaagatcgccctcgcgctgccggctggcgcgaggatctacggcaacgcctacaacaccgacacgcattcgatgccgcgcttcacggtgccggcgactgactggatcgagcggagcccgaatgggttctggggcgtcgcctacaacaacttgaccgcgcttcagataaacgacgtccaggtgactactctgccggtgatttatgcttccggcggcattcgtgagcccagcaatcccccgcctaatagccaaacgggatgcactccgggtgatcggacctgggatcagagctgggagtaccgttgcgttgcgtcgaatacctggaaacgagctgagctgaagccgttctag

SEQ ID NO: 6088 - DNA, 186 bp, Methylobacterium sp.
atgggcgacgagcgcgatccggtcctcgaggccgccgaagctctccgcgccgacggggtggaggtcgagccagcgggcgacgacttcacgctgtggatggtgaagggcaagctgctcaccaacttggacctgctcgccctggccgtgctcctcggccccatcgacgcgctgataggggtgcagtaa

SEQ ID NO: 6089 - DNA, 186 bp, Methylobacterium sp.
atggtcgagaagcgtgatccggtccttgaggccgtcgaagctctccgcgccgacggggtggaggtcgagccagcggacgacgactacacgctgtggacggtgagaggcaaggtgctcaccaacttggacctgctcgccctggccgtcctcctcggtcccatcgacacgctgataggggtgcaatag

SEQ ID NO: 6090 - DNA, 654 bp, Methylobacterium sp.
gtgcctactcccctggcggagggcaagggtctcattatcggatcggaggctctgatcaggtcgcacagcgtcttctatgagggctcgatgttcggcgataagctcgtgaccggccacaaggttattgtccgtgagcttacaagagccggtgccagctttcaaatcggcacgcttggtgacatccaagggcactgttgcgttggcgactacgtccggtttcaaagcaacgtttttatcggcaagggagccacgatcgaggattgcgtctggatctttcctcacgtcgttttgacgaacgatccacatccgcccagcgatatacaactgggcgttaccgtgcgtaagtacgcggcgctcagcaccatgagtgtaatcctgccgggcgtcaccgtcggtgtaggcgccttggtcggcgcgtcgagttgcgtcaccaaggacgtcgaggattaccgcatcgccgtgggaaacccggctcgggataaagggccggtctggcgtatcaagcttagggatggcagcgggcagcctgcttacccatggatatcacactttcagcgcggctaccccgagcacttggtgcgggagtggcaggacctcctcaatggctcttgggaaaggctccggcccaacgatatggaaggttcgcctacctaa

SEQ ID NO: 6091 - DNA, 633 bp, Methylobacterium sp.
ttggccgagggaaagggcctgacaatcggagcgaatgccctgatccggtcgcacagtgtcttctacgagggctcaacgttcggggataaactcgtcaccgggcacagggttacggttcgcgaactcaccaaggccggtgccaacctccaaatcggcacgctgtgtgacatccagggtcactgcacgattggcgactacgtccgttttcacagcaacgtgcatatctgccatggggcaaccgtcgaggattgcgtctggatttttccctacgtcgtcctgacgaacgatcctcatcctccgagcgaactcaccttggggcctacggttcggaagtacgctgcgattgccaccatgagcgtcgttctcccgggtgtgacggtcggcacaggggcgctcgtcggcgcgtcgagctgcgtgacgaaggacgtcgcggattaccgcatcgcttcaggcaatccggcgcaggacaagggaccggtctggcggatcaagcttcgggatggcagcggtcagccggcctacccttggatatcgcacttccggcgcggctatcccgagcacttggtcaaggagtgggaagacctgctggatggcccacagatggtgctggggccggatgagatgagagactag

SEQ ID NO: 6092 - DNA, 486 bp, Methylobacterium sp.
atgccgaatcgagtccagtcggccttccgcgcggccgccgaggtcggcgtcggcctggtggcggcctgcaaccggctgcggctgcccagggcggcgaatcccttcgtcgtcggtgtccacgcgccgatgcgcgcggagctgacgctggaggacctgcccgtcaccgggacgatcccgcccggcctcgacggcctctatctcaagatgggggcgaaccccgtccgcgcggcgacgcggggccacgactggttcctcggcgacggcatggtgcacggtctcgcgctcgagggcggcagggcgctgtggtatcgcaaccgctggatcggctcgcgcacggccgccgcggcgctcgggcggcccgcggcgcccgggccgcggcggggcggcaacgacaccgtcaacaccaacgtcgtcgcgatcggcggccggatcttcgcggtggtggaggcgggcagcttcccggtcgaactctcgcccaccctggag

SEQ ID NO: 6093 - DNA, 486 bp, Methylobacterium sp.; identical to SEQ ID NO: 6092

SEQ ID NO: 6094 - DNA, 333 bp, Methylobacterium sp.
atgcgccgcctcgcgctgctgaccacgctcgccctgctgccggccgcggccatggctcaggactacgatccgtccaaggcgaccaagtatgcctcgccgcccatgtaccggccgaaggtcaatcagttgatcctgaagggcacgggtggcgtggtctgcgacaacccggccggctgcgatgcctcgaccctcagcgtcactctgccgagcggggcgaagctgaccctgccggacgccttcgcggcgaagatgtcgtcgatcaacgtggccgccgcgccgtcctcggccggcaattggggcagcgtcgacacggcgttcaccggcgacacctcc

SEQ ID NO: 6095 - DNA, 231 bp, Methylobacterium sp.
atgtaccgcccgaatgtcgaccggctcatcgttcgcggcgctggcggcatcgtctgcgacaacccggacggctgcgatgcgtccacgctcagcgtcactctgccgagcgggtcgaagctcaccctgccgaacgccttcgcggcgaagctgtcctcgatcaacgtggccgccccgccatcctcggccggcaattggggcagcgtcgacacggcgttcaccggcgacacctcc

SEQ ID NO: 6096 - DNA, 174 bp, Methylobacterium sp.
atgacgatcttccaggtacggcaggcgcgcagtcgcgcgatcgtctggactggcgaggccgaatcggctgaccgggcgctggaagcggcggcgcagtcggccggctatcataccttcgctgagatgccggatgccctccggaccgacatggccgtggaggctgtgaccgtctga

SEQ ID NO: 6097 - DNA, 174 bp, Methylobacterium sp.
atgacgatcttccaggtgcggcagacgcacagtcgcgcgatcgtctggactggcgaagccgccacggctgatcgtgcgttggaagcggcggctcaggctgccggctaccacaccttcgccgagatgcccgacggtcttcggagcggcatggctgccgaggccgtgaaggtctga

SEQ ID NO: 6098 - DNA, 255 bp, Methylobacterium sp.
atgatggacgagcgtcaagcactgactgccttcgccgccctgtcccaggagacccggctgcagatcgtgcggctgctcgtccaggccggaccagaaggcatggcctccggagttctggggagcgagctgggcgtgtcagcctccaccgtctccttccacttgaaggagctggaccacgccggtctgatccaggcgcggcgcgagggccggtcgatcatctacagcgcggcctacccggcgctctcgggcctcatc

SEQ ID NO: 6099 - DNA, 255 bp, Methylobacterium sp.
atgatggacgagcgtcaagcactgactgccttcgccgctctggcccaggagacccggctgcagatcgtgcggctgctggtccaggccggaccagaaggcatggcctccggagttctggggagcgagctgggagtgtccgcctccaccgtgtccttccacctgaaggagctggaccacgccggtctgatccaggcgcggcgcgagggccggtcgatcatctacagcgcggcctacccggcgctctcgggcctcatc

SEQ ID NO: 6100 - DNA, 114 bp, Methylobacterium sp.
atcgaggtgccggtgatgctgaccgtggtctggatcgtgaaccggagccagggctggtacgagcgcggcgccactcggaatgcggcgctcaagaccatctcccgtgaggtctga

SEQ ID NO: 6101 - DNA, 114 bp, Methylobacterium sp.
atcgaggtgccggtgatgctgaccgtggtctggatcgtgaaccggagccagggttggtacgagcgcggcgccacccggaacgcggcgctcaagaccatctcccgtgaggtctga

SEQ ID NO: 6102 - DNA, 282 bp, Methylobacterium sp.
gtgaggtctgaggcggtcggtcggagccgcctgacgatcatcagcgccctgggcgtagtcgagatcctcacctggggctcgtcgttctacctgccggccgtgctcgccgggccggtcgcgcaggacactggctggccgctggcctgggtggtcggtggcttgaccctcggcctgctcgtcgccgcgctcgcctcgcctcacgtcggtacggtgattgagcgccacggcggacggccggtgctggccctggcggcgctcctcctctcggccggcctcgtggtg

SEQ ID NO: 6103 - DNA, 282 bp, Methylobacterium sp.
gtgaggtctgacccgggcggtcggagccgcctgacgatcatcagcgctctgggtgtcgtcgagatcctcgcctggggctcgtccttctacctgccggccgtgctcgccgggccggttgcgcaggacaccggctggccgctggcttgggtagtcggtggcctgaccctcggcctgctcgtcgccgcgctcgcctcacctcacgtcggcacggtgatcgagcgccatgggggacggccggtgctggccctggcggcgctcctcctcgcggctggcctcgtggtg

SEQ ID NO: 6104 - DNA, 138 bp, Methylobacterium sp.
atgtcgacgtttgaacgctacctcaccgtctgggtggccctctgcatcgtagccggcgtggcactcgggcacgtcatgccgggcatcttccaggcgatcggctcggccgaggtcgcccaggtgaacctgccggtggcg

SEQ ID NO: 6105 - DNA, 138 bp, Methylobacterium sp.
atgtcgacgtttgaacgctatctcaccgtctgggtggccctctgcatcgtggccggcgtggcgctcgggcacgtcctgccgggcgtcttccaggcgatcggctcggccgaggtcgcccaggtcaacctgccggtggcg

SEQ ID NO: 6106 - DNA, 558 bp, Methylobacterium sp.
atgccccaccccgagatccagcctgccagccgccgcgagtggtggccggagaccttcatcgacgaggtctcgcccgacggccgcgccacgccgagcgactggctcatccgcctggagggcggcgggtacgcctatggcgatccgacagacaggctcgcgcccccgaaggctgtacgggaaggtgacgtcgtcgaattcagtttccgcgactatctcggctcatcgctgatgaccctcgacgcggacggcgagccggtctggaccccgcctctgccccagggcgtcaacctgttctgggacgggcacgactcggacacgatctgcgacaccgagggggccttcgccgagttcgtgaaggaatacggcgagcatcaggactcgcaggtcacggtgctctgccactggtccgagcgcacgcttcgctgccagttcacggcggccggcggcgtcctgcgcttcctcccgatcgacgacccgcctcctccccctgtcatgcccgtcgaagctccggtgcagccgagccacgacgacctgttctctgccgccccaaccgcctga

SEQ ID NO: 6107 - DNA, 543 bp, Methylobacterium sp.
atggctgagaacctgatccccgccatcgatggtcggcaatggtggccgtccgactgcctcgacgagatcatgccggagggacgagcgactcccgactcgtggctgttccggctcgctgacggcacgcaccgctgcggcgaggagggcgagaccgagcacccggtgtgctccgtctccgagggtgacgttgtcgagttcatcgcgagcgacaacctcggtcgtgctcgcatgacggtcgaggatgatgggtccgtgcgttgggagccgcggccgccggacgactcgcacatcttcgacgccgacgacttcgagatgagcggcgacgggccggacgacttcgtgcggaatctgcgctcgttcaacgacctcgacccgggcgagagcgtcgaggtctacgtcaccaggtggagcgctgccgtccagtgccgcttcaccgctgaaggtgggccgccacgcttcgtaccgctgagcgaccctccgccggcgccagagaagccgctcgcgccgcccgcacctcccgagccgcacccgacccttctctga

SEQ ID NO: 6108 - DNA, 1593 bp, Methylobacterium sp.
atggatcgggtcatcgtctacccgaacgcgcttccgcgcgcgctcgacgtcctgcgcaccaaccagttcgccatggtgggtctcggcgggatcgcccaggccacgctcggcacctcgacgatcgtcgacggctttacgctcaccccgaccagcccggcctcgctgtcgtgcaacctcgggccgggccagatctaccagatcgacagccttgaggagaccgcgatctcgtccctgccgtcggacgggacgcgcatcgtcaagcagggcctcctgaaggcgaccacgctgattaccttcgcgccgcagctcggcgtcgggcagtcggcctgctacctggtccaggcccagtacgacgacgcggacaccggcgaccaggtcctcaacttctacaacgccgccaacccggccgtgccgctggcgggcgtcgacggcaacggccagtccagcaagacgatccggtccggcgccgtcgccctggcggtcaagcccggcatcccgacgaacggcgtcccgaccgcgccgacccccgatgcgggctacgtcggcctgttcgtggtcacgatcgcctacaaccagacccagatcctcgccggcaacatcgcgacgtacgcgtatgcgccgacgatcctggacaagctcccggcgatcccgtcggcgctccagtccaacaagtacgtctacgtgaaggacgtcggcgcggtgaacgcgctctcggtcaacccggtgccggcctacacggcctaccaggaaggccaggagctggtcgtcgtcccgaacttcaccaacacgtcgacgacggtgacgctgtcggtgagcggccttcccgccgcggcgatcggcctggcgaacggatcgaacccggcggtcggcgacatcatccagggccggccgctgcggctgcgccgaagcggtaccggcttctggaacttcaccgggcccgcaccgagcgaggccggaccggccgcagcccagcaggcggccgcagccgctacgcagggcctcaagaccccgccgtactacaacctcgtgcccggcacctactcggtggtcgtcccggccggcgtcacgagctgcgactcggagctctggggcggcggcggcggtggcggcggcgtcggcgcggtcaacaacggctccggctcggccggcggcggtggcggctactcgttcaagaccatcaccggcctgacccccgggcagaccatcacgctggtcatcggcggggccgggaccaagggcggcgcgggcggtgctggcggcaacggcgggacgacgaccctcggcgcgtatcacagcgcgagcggcggcgcgggcggctcgcccaacggcatcggaaacggcggcgtcggcggcctcgggtccggcggcgatatcaacatcggcggcggctacggctcggccggtgcctcgacgggcgtgagcctcggcggcgcgggcggctccgccccgttcggcggccagggcggcggcggcgcgccgggcatcgcgggcgacggcacgatgccgggcggtgccggcggcggctccggctcgaccacgatcaacccgggcggcgcaggcgcgccgggcggctgcatcatccactggaagtga

SEQ ID NO: 6109 - DNA, 456 bp, Methylobacterium sp.
ggctcggccggcggcggtggcggctactcgttcaagaccatcaccggcctgacccccgggcagaccatcacgctcgtgatcggcgtcgccggcacgaaaggcgccgcaggcggtgccggcagctctggcggcacgaccacgctcggcgccttccacagcgcgaccggcggcgcgggcggctcgcaaaacggcatcggcacgggcggcgtcggcggcaccgggtctggcggcgatatcaacatcggcggcggctacggctcggccggtgcctcgaccggtgtcagcctcggcggcgcgggcggcagcgccccgttcggcggccagggcggcggcggcgcgccgggcatcgcgggcgacggcaccgtccccggcggcgccggcggcgggtccggctcgaccaccgtcaaccccggcggcgcgggcgcgccgggtggctgcatcctccgttggaagtga

SEQ ID NO: 6110 - DNA, 633 bp, Methylobacterium sp.
atgaccgcaatcctctccttgccgctcctccaggtcgcgttcgagaccgcgaccaacgaggactggcgagacggtctcgccttcgcgacggccggggaggccgttggctacgccgcgcccggcaataccggcaccggcacgatcactgatctcgccgtttcagccggcgcctacatcggcgactacgtggtcacgatggcgagccccacggctttccgggtcacggacccggatggctacacgctcggcgcgggcgcgctgggcgtgccgttctcgcgatccggggtcagcttcaccgtcacggccggcgcgtcgggcttcgcggcccgcgacaccctgatcgtctcggtgttgccggcgccgatcgacatcaccggcatcgccttccggatgcaggtgcgcacggccgccggcaacgagtcggtcaagctggacgtgtcgacggaggcgagcaccatcgtcaacggcggtgccacgggcgttctcggcatcgcggttccgggtgagcggatggctcgcatgaagccggccgcgctcgtgttcgacatcgtcgcgatcgccgacgggctggagcgaagggtcgcgaccggcaccatcaaccacgtcccgggcgtgacccggctcatcgcctga

SEQ ID NO: 6111 - DNA, 675 bp, Methylobacterium sp.
gtgtcgaacctcgccctgatccagccgcagccggtcgacttcgacacaacgcaggcgaccgactggctcgatggcctgccgatgatcggcacgcccggcgtgatcggtacgctggcgagcccgtccaacatcggaagcgccggcctcgtcgtatcggccgcgcccggggccgccctcggcgtccacaaggtcaccgtcgcggcgctcgtgaacgggctgatcgacctgaccgtctccgatccgtcggcgacgatcaccgggtttgggattgccggcctgcccttctatgccggtggcctcaccatcaacctgtcccaggttaccgggggcgctgcgcttgcgatcggcgacagcttcgcgatcgcggtcgtgccggtcgcgatcgacctcacgggcctgcgcttcgatctcgatgcccgcgcctccataggagatccgtcgatcgcgctccaggccacgagcgatggcccgaaccccacgatcgccaacggcggcccgctcggcgtgatcgccatggcggtggcgcgggcgagcatggcccggctgccggtgaagcccgagggctacccctacggcatcaccgcgtccgaccctgtctccggcctaacggtcccggtcttctacggcctcatccaccacaccgcggtgcccgctcagatcggacagggagcctga

SEQ ID NO: 6112 - DNA, 207 bp, Methylobacterium sp.
atgatcgtcgcgttgttgctgaccgctgccggcgtgatcgtcggcatgccgatcgtcctatacgggttcatacgcctcgacgagcgacccggacgcgcgagttggctgatcctgctgctgggtctcgtcatcatcgtcgcccccgtgaccaccgccctggtcctgcatcaggaagagagcggggctgggcgctacgtcggccggtag

SEQ ID NO: 6113 - DNA, 207 bp, Methylobacterium sp.
atgatcgtcgcattgttgctgagcgctgcgggcgtgatcgtcggcatgccgatcgtcctctacaggttcatacgcctcgacgagcgacccggacgcgcgagttggctgatcctgctgctgggcctcgtcatcatcgtcgcccccgtgaccaccgctctggtcctgcatcaggaaaagagcggggctggccgctacgtcggccggtag

SEQ ID NO: 6114 - DNA, 963 bp, Methylobacterium sp.
atgcaggcgggcggtatgacgaacgggggcaagaccgtggacacgcagatcgcggacgcactgcgcgaggcgctgatgtgcagtgtcttcatcagcccgtcagaccctggcctcacctacgaggagttgcaggaagtcggccgtcgcgcgggctacagggacggcgaggtgaacgacgcgcttcgccaagtggcgaacaactacaccggccgcgaccgctacgtccccgaggagaacaccttcatccatggtctgacctggatgccggacaatccggagctgcgcgacttcgatgccttcgacttcgtcgtgaaagctttgaacgagcgcatccgggacatcgggatccgggaagcgcggatcgaccgtggggtagtggtcgagcaggcggtgagttctggcctggaccgcgtcgccgtcgaagcggccatcacgtacatggtgtttggaaatttgctcgccgagagcaacggcagcctccgcacgacccaggtcatggggaccatggtggtgcccggagaccgctggcgcgagtggaagcgcggtagggatgtcgcctggccacggccacaccgagcgcgaatgcgcccgatcgtgagcgacgtcatcgggcgacgaaccaatgggcgtccgagccacgcagagccgctggccgccttcccagatgctctggatcgcctcggtttccggaccttcaaggtgtggtggacgcagatcgccagggagatgctgacgagcgatccgagttcggccgcaacggcacggatcgtcctcgcggcagcgctcgttgaaggggtactgaccttcgtggtgcagcatgccaggtccaaggggttggcggtgtttcaatcgtccgacttccagaggaccccggagcactggaagattgtcgacctcatcaggagcgctgcgaccggcgggaaggacgcggtcctgacgcaggatgccaaggtgcgggcagaa

SEQ ID NO: 6115 - DNA, 963 bp, Methylobacterium sp.
atgcagccgggcggtatgacgaacgggagcgagatcgtggacacgcagatcgcggatgcactgcgcgaggcgctgatgtgcagcgtcttcatcagcccgtcagatcctggtctcacctacgacgagttacaggagatcggccgccgcgcgggctacagggacggggaggtgaacgacgcgctccgccaagtggcgaacaactacaccggccgcgaccgctacatccccgaggagaacaccttcatccacggtgcaacctggatgccggacaatcccgagctgcgcaatttcgatgctttcgacttcgtcgtgaaggctctgaacgagcgcatccgggacgttggaatccgggaagcgcgaatggaccatggagtagtggtcgagcaagcggtgagctctggccttgaccgtaccgctgtcgaagcggccatcacctacatggtgttcggaaatctcctcgctgagagcaatggcagccttcgcacgacgcaggtcatggggaccatggtggtgcccggggatcgctggcgagagtggaagcgcggtcgggatgtctcctggccacggccacaccgagcgcgaatgcacccgatcgtgagcgacgtcatcggtcgacggaccgatgggcgtccgagccacgcagaaccactggccgctttccctgatgctctggatcgcctcggcttccgaaccttcaaggtgtggtggacacagaccgccagggagatgctgacgagcgatccgagttcggccgcgacggcacggatcgtcctcgcggcagccctcgtcgaaggggcactgaccttcgtggtgcagcatgccaggtccagggggttggcggtgttccaatcatccgacttccagaggaccccagagcactggaagatcgtcgacctcatcaagagcgcggcgaccggcgggaaggacgcggtcctgacgcaggatgccaaggtgcgggcagaa

SEQ ID NO: 6116 - DNA, 336 bp, Methylobacterium sp.
atgaagaacctgaggcagcaccctgacggcagcggagggatgtatctcaactggacgaaggagcagctcgtcgaagcgctgcaggatcgcatccagcggaaggacaaggtgccaaatggcggcccctacgagcgctacttcctggtcatcatcacggacgagttcatgctgaccagcgacgtggtgagcgcctatctggaagcgaccgtgttccgagtggagctgatcaccgacgtcattctcggactgtcctacgagcccagtccgaccccgaacgaccgcgcggggaccaccccaacctttcgtctccctctcgcggctcgagagaggcgctga

SEQ ID NO: 6117 - DNA, 336 bp, Methylobacterium sp.
aaggcctccatgaagaacttgaggcagcaccctgacggcagcggagggatgtacctcaactggacgaaggagcagctcgtcgaagccctgcaggatcgcatccggcggaaggacaaagtgccgaacggtggcccctacaagcggtacttcctggtcatcgtcacggacgagttcgtgctgaccagcgacgtggtgcgcacctacttggaagcggctgtgttccgagcggagctgatcaccgacgtcgttctcgggttgtcctacgagcccagcccgaccccgagtgactgcccggggtccaacccgatctttcgtctccctctcgccgctcggtaa

SEQ ID NO: 6118 - DNA, 495 bp, Methylobacterium sp.
atgatccggtccgccctccgacctttctggtgggcgtactgggcgtgcgtggcgctgttcatgctcggcaccgtggccggcgccgtcggcccgagcgtgcaggcgagggtcgcgccgatccacgaggacatgcaggcggtgtcgatcgcccggacgcccgagcggatgtgctgggactacacaagccggaagctccgtgaggcggcgaccgacgatctcgacacgttcctgtacgtggccgggcacgaccgcatggtggtcgcgccagtcggcgaggtcgacggcatgccctggcgcgcgagccgggcgcccgggatcggcccgtaccgcaagcgctggtgcatcgacttgccgcccggcgtgccggtcggtgagccgatccgcttcgagctgacggcctactaccgcggcccctggggcctgtggcgcatgccgctcgcctggccgcctgtcggcgccaaggggctgcccgggacccggacaaccacaccctga

SEQ ID NO: 6119 - DNA, 1089 bp, Methylobacterium sp.
atgactgccgttgtcgcatccgccccggcgcccgcgcggcgccgcctggaggtcaacctgccggacgcccacattggcctctggcagaaggaccccaacgacccgacgctccggaccgagatctacgagggattgctgggccacctgaagcgccgcgggtttaagatcaccgcggttccgcgggtggcgaagcaccaccgctgcatcagcccgctctaccgcctcgcggcccggggcgacctccgcgccgagatccacgtcagcggatgcgtcgtgcagctcgactggtggtcggaggcggcgcccgagggaaacaagagcggccgccagtacgacttcggtcgccgccggcgcatgccctacctcgacggcctccggttcgagctggaggtgcgccatctgctggcctgggtggccgagcgggcggacatcgtcacgcgcccccagcaccgcggtgatcgccgggtcgggatcggccgaggtgaggtgtccgccgccgagtacatcgaggcggcgtacgcgacgagctggcacaccgacaaagacctgggccggccgaagtgctcggactcgaaccggaaatccgccgacggcgacctgatcgagcaggagtcgcgcgtgtggttccgcgactggcacgggcgcatgctcaccggcatcgcgtactacagcctcaacaaccgctggatgatcgtcacgagcgcccacagcatgtcgtgggcgagcgcatacgagatcttcacgcgctgcccgcccgacctgcggaggaagcgcaacgaacgccagcggcgcaagcgcctcgagggcgagctggcgaaggcgatccagcggatggacttccggcgggccgagacggtgcggaagatcctgttcggcaccgagttgacctatggcatctaccacgtggagcacgacgcgctctatgggccaggcttctccggctacacgaaggaccggctggaggccggccgcttcacctggaacgaggccgcacgcgaggtgcgcggccacccggatctgctgcgcctggtccttccggacggaaagcacctgcctgcatccgaactcggccaggcgaaggcggcgtga

SEQ ID NO: 6120 - DNA, 1440 bp, Methylobacterium sp.
atgaacgctcgccgaagcaacaagcttaccccgctggaggaagagctgctggacctgcgcgaccgcgtccaggaactgcaggacgcgctgcgcgagcgagacaaggcgttcgcccccgagatccgcatcccggccgaatggggcctgtcccgcgccgaggccgtgaccttctcggcgctgatgaacgcggtgggcaagacggtgcgccgcgccggcctccttctcgtctgcctgccgagctacaccgtcccgtccgacgaggtcctggacaagaccgtcgccagcttgcgcaagaaggtgacgccgcacggctacaccatcacgtcggtcatgggcgtcggctacagtatcacggccccggccgacccggctgaagtcccccagcccgcggcggccgccgtcgccgcgcccgcgccgcgcaagcgcccggccggaccgaacgcctactccgaggcggaggacgccatcatccgggccggcgtcgaggccgggaagctcctgcccgcgatccgactcgacctggtgtcggccggcttccgtcgctcctgcacgaagtcgatccggtcccgggccgagtggctcgggctgaaagtcccggtggagctcaagcggtggacgccggaggaggacgagatcgtcgccaccaacacgaacgcgccgatcaagcgggtgcgcacgctgctcgcgaccgcggggttccggcgcaccatcaaggcggtcgcctcgcgccggatcgacctcggcctgcagccgcgccccatgggactgacgccggaactcaagcagatcgtccgcgcctgcatcgcccagcagatgaccgacccgtcgaccctcgcccacttgcgcggactcggccacgacgtgacgctctcgcaggtcaagaacgtcgggcagcagatccgggccaggagccggccgggctggaccaaggaacgcgtcgacacgctgcgcgccatggcggaggagggaaagcggccgatcgacatcgctcacgcgctcgggctgaccaactcgaagacggtcaacgagaaggcccgccatctcggcatctcgttcgcgcgcctgtggctcgacgaggaggtgcgcacgctcctcgccatgatgggcgagcgcaagacttcgatcgagatcggcgaggcgctcaaccggccgccgtcccaggtcgtcaacaaggcccggcgcatggggatgtcgttcgagcgctggccggaggagtcggcgtggacggacgagaagatcgacgccctgcgcaaagccagcgaggacggcgtgcgcctcgccgacgccgcccgcgcgcttggccgggcgccggacgccgtgttccaggccgcgcgccgcttcggcatctcgttttcccgcgaccgcaagaacttgctgcccctcgccaggactgagcaaacaaagatcaacggcaatcattattcggttgcgcaacagtag

SEQ ID NO: 6121 - DNA, 558 bp, Methylobacterium sp.
atgctgtcgccagcccacttcgattacctggtcagctacgcggtcgcgcgggagatccgctactggtcccgcgccgacaagtgccaggagcgcgtcacctcgacgggcgcgaacgcggtcggccgcatgctcgccagcgccaacgcggacgcctacgccaaccgctactccagccacggcgacgagttcgaacgcggcgagaacttccgcgccgcccgcgagtaccgttggcgtccgttcccgggcccgttcgatcccgtccaggtcatcaaggccgtcgactgcctggagtatcaggcgtgcgaggcgtcgggctgggaggacagcgacgcgtcgatgctgtgccacgccatccgcgcttatgccgtgcgcgcgctggccggatatgacgacgccaagtggtgcatcgacgacgtggccgacctgcgcccggccaagcccgccgcggcgcccgcctccggcgtagcctcccgcgcgctgcgcctggccgccgccgtcccggcgttcacgcctcccgctccgcccgctccgttcttcggccagggcgcgctcttctag

SEQ ID NO: 6122 - DNA, 624 bp, Methylobacterium sp.
atgcctgacctgagccggcgagccctgctcgcctccatcaccgccgcggccgcgaccatcgcgctcccggccagcgcggcgccgctctcggggaccgtcatcatcgacgacccgtggcactcgataccgcctgcgccgcggccgctccccacgttgcccgagctgaaagccttgtccgagcgagccctggcggcgctggagcggcactggccgaggcacatctacggcgagacgttcctgtcggagggcgacagcccgcacggcctggtgatccgctgcgactgcctggaccgcccggacacgtcccacgggcggagcggctaccgctgctcgagcgtcctgcccggcacgcccatgatcggcgccatgtccggatatttcgagccggagtgggacgagcgcaccacctacggcatcctcctcgacgtgacgtggtggaacgagcggccggccgcgatcagcgacgcggactgggccgaggtcctggcgatcgtcgacatgacgccggagtcgcacgcggagcgcatggccgaccttgctcgccagaccggcgaggcggacgcggcctgggatcgcttcgccgaggagttcaaccgcacgaatggagagttgccccatgtctga

SEQ ID NO: 6123 - DNA, 477 bp, Methylobacterium sp.
atgaagcgcgagaccgccccaccacgcccgatgactgcccgcgaagcccacgccgccctggagcaactgcgctccgagatcgggccgaaggcttacgtctcgatcagcatcgcggcctctgacatcagcgacgcgataatccacgccagcatctacgctcacggcatcgcacagacgtcgcccaacttcgcctgcaagggcgaggacctgggcgaggcggttgccgcactgcgcgccggctgggccgggtttcaggaggagcacgcccggcgcatgtccgccgatatggcgctggagatcatccgcctcacggacgcgcacggctgctgcacagacgctgctctgcgcggctcgaagttctcggtcggcgacgtccggcgctggggcgaggccgcgtgcgcccgggcgaacgagatggccgggcggggcccgttcaccatcgtctcgatcgccggcgcgaacggggaggcagcctga

SEQ ID NO: 6124 - DNA, 456 bp, Methylobacterium sp.
atgaccgacatcatcaagacttccgcctggtcgcagaaggtgccctccgatcatatcaagatcggtatctcgcgcgggaccccgcgcggtcacgcggcgggctaccgcctgttcaagaccctcgcgcccggcgcctggttcaactcggtctcggcgaccgaataccgcgagcgctacttcgccgagatcctggcgccgctcgacccggccgcgatcgtcgccacgatccagaagctggccggcgacaaggtgccggtgctcgtctgctacgagagcccgaccaaggacgaggactggtgccaccgcggctacgtctcggcctggctgaaggacaagctcggcctcgacgtgcccgagctcggacacgaggagcgcgggtgcggctggtcgcatccgaagctgccgccgacccagcgcgtgaagccggccgtcgacggccccgcccgcctgctctga

SEQ ID NO: 6125 - DNA, 549 bp, Methylobacterium sp.
atgctgacgttcaagcgcacccgcggcagccgcctcgacccgctcccgacgttcgaggtcctggcgggcgcggcccggctcggcttcatcaccgacactggccctgaaggcgcgggcatgcgctggaagggcacggcggctgacggcacgcccctcgccgcgaccagcaaggcgaagatcgcccagaagctccagatccacgacgcggcgacgcggaacgcgccaggccccctcggcccggtctacgcggagcccgcccgtgtctcggacgcgcacggccggtacttcagccacatccatgccggcacgggccgcgaggaccgcggcaacgtcatcgcggccgtctaccagggcggcccaggcggtaccctgaacaccggccccgcggtcgacgcggccgcccgcctgctcgccgcggcccccaagctgctcgccgcgctcaagagcgtccaaggctgcccgcaggccgccccgtggctggccgcggccggcatccacgaagagatccaggccgcgctagccgcggccggccccgccccgcgcacctga

SEQ ID NO: 6126 - DNA, 393 bp, Methylobacterium sp.
atgcgcacagtcttcgctatactcattctcgccgctgtcggaccggccgctgctgcggatgtctacctgttcgatctgctgcgccggcccgactacaagcgcgcctacaacgcgatgctgaaaagtggttcttcagtgccgaagtgggtgacggcctatagccgcacgttgaacggcccgtcccaaccttccagtgaaataaaagcggacggcgaaacctacctgctcgctgacgtgtgcaaggtccacgactgcctcgaccataagcttcacgtgatattcgcgccgggcgggcggcgtgcgtggggccggctgtatgagaatggcagcaccagctggataggcagcccatcgccggcgctcaggaaggcggccgaacggatcgagttctga

SEQ ID NO: 6127 - DNA, 1023 bp, Methylobacterium sp.
atgtatgacggggaaggccggttcccgcggatcgaaggccgccgcgacatctcggaatacgcgaccgggcggatcagcaccgacgaggtgccgccgcacgaacgcatcgatcactggaccgaggcgtgccgaaccgcgttcggcgggttcgaattcgtggatgtggagcggaagggctttcacgccgcgttgagcacgctgacggtcgactgcctcacggtcggtcactacgtcggctcgccccacgcgatggcccggacgaaggcgcatatccgatcctcggacaacaatttctacctcgtcatcctgggttcggagcggaccttcaatctggaacacggccggtacctgaactcagcccccggcgggatctcgctcctcgacaacacgcagcccttcctgggggcgcatccggacgggctggacatcatcaatgtcttcatcccgcgggccgtgctggagcaggctgtcggcccggcccgatccatcgcgggattgtcgatcgacgccacgcagtcgacctatcccctgatcgcgtcctatctctccgcgctgatccggcacggcggcgccctcacgccggcacgccaggcgcgcatggccgcggtcgcggtcgaactcctcgcggccggcttcgcggagcggatcgagagcggatcgccgcggtctctgagcggcgcggcgatcctgtgccgggcgcaggccttcatcgccgagcatatcggtgtcgagggcctgtcgatcaacgacgtcgcggccgccctcaacatctcggtccgccgccttcaggaagtggcctgtgcggagaacgtcgcgctgatggactggatgtgggagcgccgtctgcaactggctcaggcgaagctcgccgatccggccaacggcgtcatgccggtcgggctcatcgcgtatcaatgcgggttcgccagccaggcccacttctcccgccgcttcaaggagcgattcgggcagacgccgaccgagttcaaggtgtgggccgggctccagcgcgctccggcgtga

SEQ ID NO: 6128 - DNA, 321 bp, Methylobacterium sp.
ttgctctacgccaggatcgaaccggagtcagagcatcgccagaacggcctgctgcatcctgagaaggtcatccaggcgggttccatacaactgacctcggtgagcttcgagaacggctcgctccccatcatatcggcctgtgcggagttccagctatcgttcgaccgggcgttcagggacacgggcggactatacgattggatggaacagaccgattggctggatcatgccctatgcttcggcttccgcttacaagatggtggtgagtgggatgcgacgtacgatcacgcgggcatagatttcgaaatcgtcacgccctga

SEQ ID NO: 6129 - DNA, 537 bp, Methylobacterium sp.
atgtccggatccggcgttgtccacgaggcggccgtggcggcgagcgagcctttcggcgcgttcgcggccggcctggcggacctgtcgcccctgcggtgggcggtggtcgcggcctgccggcggcccgaacgggactgcgtggtcccgctcctcgaagaagcgcgcctgccgcccgaggcggcgcggcgcgtcgccgaggacgcgcggcgcctcgtcgagaccctgcggcgccggggcacccgcggcggcgtcgaggggctgatccacgagtacgcgctgtccagccaggagggcgtggcgctgatgtgcctcgccgaggcgctgctgcgcatccccgacgcggcgacgcgggacgcgctgatccgcgacaagatcgccggcggcgactgggccgcccatctcgggcacagcccgtcgcccttcgtcaacgcggcgacctggggcctgctcgtgaccggcaggctcgcggcgacccgggacgaggccggcctgtccgccgcgctcacccggctgatcgcccgcggcggacaggccggc

SEQ ID NO: 6130 - DNA, 177 bp, Methylobacterium sp.
atggtctcccgggcggtgtgccgaaccgccggtccgaactgcctgacgggcggagtcctgctcgccgaaagcggcaaatctgagaaggacatgagcgccttgccgggccgcagcgcggtggtcgaacggcgcgcgtcggccgccgccttcgccgagaaggctccaccggtcgcttga

SEQ ID NO: 6131 - DNA, 168 bp, Methylobacterium sp.
atgcgccgcttcatcgtcctctggaccgtcccgggcctcggtttcgccttcgaggcggacgtggccgccacctccccgcgcgaggcccgcgccgcctttcgggccatgttcccctcggaccgcgtcaaggcggtcaagctcccccgcggcaatggccgtttcgtctga

SEQ ID NO: 6132 - DNA, 495 bp, Methylobacterium sp.
atgctctcgccgggcctggacttcgatccgcgcttctggccgtctgatccgtctcccgacgagacggtctgcctccagctctcggaccggatcgactgctactgcctgctcgaccggcaggactacctctgggcccggcgctggctctggtgccacacctacggatccgggtcgttcgacccggacacctggacgattgatcgcccggacgggatctacgcccgccggtccgtgcccatccccgggcgcatcacgccgagcggccggcccgcctacggcaacctgttcctccaccgggagatcctggagcgcgccgaggggccgccgccggatccgtcctgggtcggcgaccacatcaacggggacacgctcgacaaccggcgctgcaacctgcgctgggcctcgaagtccctcaacgcccagaacaccgtccggcaccgcgccgcgaccctcgcccgctacgccgcgcagcacgccgcggcctgttccgcatag

SEQ ID NO: 6133 - DNA, 225 bp, Methylobacterium sp.
atggcggacgatatgtccgaagacaagacagcgtcaagacagaaatcagacgccgcgatggagcgaacccggaagctagtcctcgatacgctcccaccgggccccgttcgggaccgtttcgcggccctcacgctcgacgagctgcggggcctcgaatttgacagtgacctctggcgtcaggtgcgcgttgcgctcagccacgtcgaaggccgccacctcaactaa

SEQ ID NO: 6134 - DNA, 147 bp, Methylobacterium sp.
atggtcgattgtaactgcaccggcctgaggttcggtaagctcgtcttcgtctggctcaggcgcgagcgcgccttccgcctcaacggcttcttcgccttcaccttcgctttcaggtcgatccgctgcctctgcctcaagcccgcttag

SEQ ID NO: 6135 - DNA, 870 bp, Methylobacterium sp.
atgtcgagcctgatctttcacgacctgccgcgcggcccattgcctctctacatcagcgagccggtgccggggttggaggaagcgaaggctacgctcctgctcgaccatcaccaccgcgaggtccgcttcgttgcggcggacccattcacgccgttcacgataccgccggccggcgtcgaccgctatagctggtgggatgtcgacccgatgctgccgcgctggcaggtccgcgagctgtacggcgaggcccggccgctcctggagcggattcagatgggcacgaccctgacgcaactgccgacacactggcaccggacccggaccccggaggcgctcgcggcggccgagatggtcgaggagctggcggcgcagcctgcccaggcggcggtcgagtgggtgccgggtctgcggccggtccgcgaggagacggcgctggagcgcgcgatccggattaccgaagcagccgtgcgctccgagttcatccatcagttccaccagaaggaactggccgggatgccgatcgaagcccacgagcgcaatttccggaacctgctcgctcacggcaaggacattttttactcgcacggcgaccgcacgctgggcatgagcggcagcccgatcctcaacctgagcccgggcaccggtaagtcgcagggcgtaatcgggcttttgaacgcgatggggccggtatcgaagtcgcttgcgaccgatgacggctcggctgtcggcagcccgtcgcaggagaccatgcgccgccgcaccaagggcgtgatcctgcctggcaaccacgatcgctacagccgcaagggcatcaacggaaagtggggcgctctgttcgaggagagcgacgtgcgccggatcgccggctga

SEQ ID NO: 6136 - DNA, 138 bp, Methylobacterium sp.
atgaccaagtccctccagatcatcgacaccaagctcaacaagatcatcctcaccaagatcagcgagcatgaggctcacaagcgggtcgacctgctcaactcctgcggcatcgtccggtacaaggcccgggcgatctga

SEQ ID NO: 6137 - DNA, 1461 bp, Methylobacterium sp.
atgagctgggacaatgagaaagtcgtggccttccggccgaccgacagccagttgctggagcggctaccgcactgcttcgacaccgagcgggcgttgctggcggcgctgctgctgaagccggatcaactcaccgaggtggcgcacgggctcaaggtcgacgacctgttcggcgccgagcaccgtgaggtgtacgggaccatgctggccctgagcgccggcggcttgccggtctcggccgtcacggtcgcgcagtacctcaagacccgcgagatcgccggccagccgccggcacgctacctcgccagcctcgcggccgatgcggcttcctgggacgcgcccggccatgccacgatcgtgcgcgagttcgcccgtcggcgagcgctggtcatgatcggcgaaggcttggctgagcaggcccgtcagggcggcgccgaggaccaggcgagcacgctgatcgacgagaccgacacggcgctcctcgaggtccgcggcacgggcagcgatggccggatgagcggccaggacgcggcgcaggccacggcctggatgcgggagcggattgaagggctgcggtccggactgctgcggtccacggcggtgccgaccggcatcgcggatctcgaccgggccacgaacgggggattccagcgcggtcagctctggctgctcgcgggccggcccggcatgggcaagacggtggcgatgacgtcgctgagccggttcgccgcccgcgaggccggcgtgctggtcttccagtgcgaagtgaccagggaccagcagatcgcccgctacctcgcggatctctcctacctccacaaccgcccgctgaccttcggcaagatcatggcggcggtcgagctcgacgatgacgagctgtggcgcattgacgaggcgatgaagcgctacgagcgcctgcacctcaagctcgaatgcgagccgtctgtcagcgtcgcccagatcgcggcggcggtgaaggccgagaagcggcgcctcgccaagatgggccaggatctgggcgtcgtcttcatcgactatctgaagttcatcaaggtctcggaccgctaccagggcaaccgcgtgctggagatcggcgagatctcaggttcgctcaagcagctcgcgaagtccgaggacatctgcgttgtgctgctgacgcagttgaaccgcggggtcgagtccaaggaccgggccgacaagcggcccagcctcgccgaccttcgggattccggcgagttggagcaggacgccgacgcggtgctgatgctctaccgcgaggcctactacctcgagaagaagctcaaggggtccagcgatgacgacgtcgcgacccgactgatcgagaagcagaacactctcgagatcatcctggccaagaaccgcagcgggccgtgcccgaccctcgacctgtggtgcgacgtggcctcgtccgcaatctcccagacgacacggggtccccgatga

SEQ ID NO: 6138 - DNA, 513 bp, Methylobacterium sp.
atggcgctgccgaagatcctcgctctcgacctcgcgacccgtctgggctgggcctatggctcgcccgacggggagccgcattacggctcgaagctcctgccctccaccggggccgagatcgggcgcttcggcgacgcctacgatcagtggctcctcgacatgatcacgctggagaacccggcgctggtcgtgttcgaggcgcccttcgtcagcggcaccggcaattcgaacaccgcccgcaagctgatgggcttgtgctggcagaccgagctcgcctgctaccgccggcagatccggtgcctggagcacaacaaccagagcatgaagaaggacttcgccggcagcggtcgcgcggagaagctcgacatgatggcggccgcgcggcggcacggctgggatccgaaagacgataacgcggccgacgccttggcgctgtgggcctgcgccgttcacgagaaggccccgaagtattctcgcctgaccctcggccggctcggcgggagggcggcgtga

SEQ ID NO: 6139 - DNA, 234 bp, Methylobacterium sp.
atgctcggcaagaccctcagagaccgcattaccggcttcaccggcatcgtgaccggccacgtcgaatacctgaccggctgcaaccagtgcctgctcaccccgcccatgcgcgacgggaagcggatggaagccgagtggttcgacgtgcagcgcctggaggacaccggcgccgcgatcatcgtcctcgacaacgggctcacgcccggctgcgaccgcgccgccccgaagcgctga

SEQ ID NO: 6140 - DNA, 402 bp, Methylobacterium sp.
atgcgcaacctccgcctcctcgatgtctaccgcgacgcctccccgcgcgtgatcgcgatgtacggcgacgccggcgatcacagctacggcgtctttcgcgtgccgtcgccgaccggcggccagccgctcgtcgtcatcgcttcgaccggtgagggctgggaccacgtcagcgtctcgctcccgaaccgctgcccgaactggccggagatggagcacgtgaagcggctgttcttccgcgaggacgagacggccatgcagctccacgtcccaccgtcggaccatatcagcgtgcatccgtactgcttgcacctgtggcgcccgctgagcggcgagatcccgcgcccgcccggctggatggtcgggccgagcagcaccgaggcagccgggaaggtggtcgcgtga

SEQ ID NO: 6141 - DNA, 330 bp, Methylobacterium sp.
atgcggatcatgctcagcgccaagatgggggagcaggttcgcaaggacccgcgcaccgtcatcgtcgaccgggtgccgtgggagctgttcgacgagcaaaccacgcgcgcccgatgcgagagcaaccacggtcagacgatcgagcggatctcggagcgcggcggcttcgacgcgaccgaggccgtgggcgtcctgaccggcctgaagtggggcgagcttcggcatctccgcgaggagcacgcgcaccgcatcctctaccagatggtgcacctgttccgccgcggcgtgctcacgggccggcggtcgatgcaggaggccagcaatggttga

SEQ ID NO: 6142 - DNA, 222 bp, Methylobacterium sp.
atgatcggccggacgtacctcgaagcgggctcgcccgtccgcgtcctgatccgatggggcaggacctccgccggcccatccgcgccgattggcccgctcagcgactgcagctggagccggcgccgcgcccctcacaacgtcctgatcgagcgccaggacggcagccgggtcgtccgcccgttccgcggactgcgcaagctgccggaggtggaccatgggtga

SEQ ID NO: 6143 - DNA, 402 bp, Methylobacterium sp.
atgggtgagccgatgaaggccctctcgatcatgcagccgtgggcctggctgatcgtcaacgggcacaaggacatcgagaaccgggattggcggtgccaccgccgcgggcatgtcctgatccacgccgggaagaagatcgaccgggacgcgatgcaggacctgcgctccggccggcatccggtcaccggcgagttgctgcgcctcgacctgcctgaggtgttcgagaccggcggcatcgtcggcgaggccaccatcgcgggctgtgtcgagcggtcggaaagcccgtggttcgtcggccgtttcgggatcctgatgcgggacgcccggccgctctcgttctggccctgcaagggcgcgctcggcttcttcgtgccggcgccggtcgccgaggtggcggcatga

SEQ ID NO: 6144 - DNA, 225 bp, Methylobacterium sp.
gtgatcgccccaactgaagccgacatcggccgccgcgtcatctaccacccggtccgcggccacaccgtcgaggagggcgtgatcacgtccttcaatcccgcctacgtcttcgttcgatacggcgctgacgcggggagcaaggccacaccacgcgagctgctggagtggttcggcccggcgtccgactccgggctgaaggatcagggaggggacagtgccgcgtag

SEQ ID NO: 6145 - DNA, 297 bp, Methylobacterium sp.
gtgggcgcctccgagatcccggtgggggcgcagttccgcctggagatcacgtggcgggtgctcgggccgggtccggcattcgccggcatgccggacgatggggcgatcaccgcgacctcgccggatggcggcctcgcggtcgatcagccgaacggcaccgtgacctggtcgtacacgaccgcgcagagcctcggcatcccgctcggcgcggtcgcccgctacacgctgcgctgcctctttggcagccatacgcaggtctgggcctacggtccgctgcgggtgcgaggcgcggcgtga

SEQ ID NO: 6146 - DNA, 183 bp, Methylobacterium sp.
gtgccgacgccggcgccgcgtcccgttccgaagcggggcgaggacgcccggctctacgcacgccgcgccctcgactacggcgatgccaacgcggccggcctcaccgacaccgcggaccggtaccgcgcgctcgccgaggcgatggagcaccccgcaccagcgccggaaacgaccgcgccgtag

SEQ ID NO: 6147 - DNA, 1527 bp, Methylobacterium sp.
atggggatcctggtcccagtcggcatcgtcgcggtctgctccgcgatgctcctccagttgcgccaggacgcctgggacaaggctgaagaaacctccagaaacctgatccaggtcatcgagcgcgacatcgaccgcaacgtcgagatcatagacgtcgcactgcagaacgtcgtcgaaaatctgaaactgtacgacctcgaggacattagcccgaagcaccgacagcgcatcctgttcgaccgggccatcaacgccaaggacctcaacgctctgctcgtgctcgatcagtacggcaactgtatctacgatgctgcaggctggcctccgcgccgctacaacaacgccgaccgggactacttccaagcgcacaaggccgatgcgagcctcggactcggtatcagcgggccgattatgtctcgatcagtgggaaagccggtcatcatcctgagccggcggacagggatgcgcggggacgacttcaacggcatcgtgctcggcagtctgtcgctgtcttacttcgaccgcctgttccaggacctcaagctcgggcaggccggtacgatcaacctcttcctcgacaacggcacgcgcatcctgcgctatcctcagaacgacacaggtaccccaccgaatttcgcagacgcgccgaacttccagcgattccagcgcgaggggcgcggaagcttcgtcgcaacgacccagaccgacgggatcgaacgcctgtataccttcacccgggtcggaaatctgccgctgatgctcaacgtcgcgctctccacccgggagatcgaggcggattggcaggccagagccctggtgatcgggcttctcgtattcgcgctgtgcgggattactgtcgggctctcgcttctcgttgcgtgggagctgaagcggcgcaacgcggcggaggccgagctggcagtactctcgcataccgacaccctcacggctttgccgaaccgccgtgccttcgaggcggcgtttgcgcgggcctgggccgcgggccgccgatgtggaggttccgtcgccctcctcatcatcgatgccgatcacttcaagcggtacaacgaccgccacggccatgacggcggcgaccgcgtgctgatggcgctcgcccaggccttcgcctcctgcacacgccggccgggggatttcgttggccggatcggcggcgaggagttcgtcgtgctccttccggacgccgatgcagagggcgctgcctcagctgcggacaccgtgcatgcggctgtcgcatccctctcggtcgaggcgggcggcgtccatgtcggtcgaatcacggtcagtatcggcctcgcctacggtgttccccgtcgaggcggctccccggaagacctcttacgcctggccgacgctgcactttacaaggccaaggccacgggccgcgaccgaacctgctacgtggtcatggatgagcaccgagctgtgggtgcaaaagcgccttcgaacccaagctccgatcccggcgccagacccacgcgacctgaaccagcatccctcgtagcctga

SEQ ID NO: 6148 - DNA, 423 bp, Methylobacterium sp.
atgtttcgtcgacctctctcgccgacgcggcttgtccgggcggcggtgctcggcgcggcccttctcggcacctcaactgccgcggaagcgcgacgcgccgcgcttcgggcagacgtcgagggttacgcgatggcggcctgtctgacccggcaggacgtgccgtacctgcgcgagcagggccatctgtggggcaatgcgatcttgcagcgcgggcacggatcagtggaggattggaccacactcgccgacgccgtcggcgcagcagccgcgcggcagaccatgtccatggctcgaggcgacggagcagttcatgacgcgctgaaaccgatgccgctgctgttctgtcacgaactcgtccgcagcccagcggtccgcgccgccaaggttcgggcgatgcggcacttggcaccggattaccgatag

SEQ ID NO: 6149 - DNA, 117 bp, Methylobacterium sp.
atgaggaacaagatcgagacgaggcggcggcactacaacgagagcggtcctcagaccgccctggagtggccaacggcccaggaattggacctggcaacggccttgcaagccgcctaa

SEQ ID NO: 6150 - DNA, 204 bp, Methylobacterium sp.
  modified_base (149)..(181): a, c, t, g, unknown or other
atgatcaacgaggcggtgcgcgagcgcctcggccgctggcgctcggccgacatcctgatgcgctcggtcgacttccaagcggtggttgacatgcagcgggcggtcctctgggacgagatcggccaccacctcggcacggcggccccgcnnnnnnnnnnnnnnnnnnnnnnnnnnnnnnnnnatgcacacggcaccggccgctga

SEQ ID NO: 6151 - DNA, 771 bp, Methylobacterium sp.
atgacgaagactgtagccatcgtgacgggagctagccagggcatcggtcgagccacggcgatgcgcctggcccaagacttctcggcgctcgtgctggtggcgcgcaaccgcaccaagctcgaagagacggcctcggctgttcgggaagccgggtccgaagccttcgtgatcgacctcgatctcgccgaacccacggcggccgcgacagtcgtccagcagaccctgtcggcgttcgggcgcatcgacgcgctggtcaacatcgccggtgcggttcccgggctggacgtcttccagatgacggacgagcagtggcatgcgggcctggaactcaagcttcacggagctcggcgcctcaccattcaggcgtgggatgtcctgaaggcgacccgaggcgcggtcgtgttcatgtcgggcaacgccgccgtgaccccgaaggcggccgcagcggctgtgggcgcgatcaacgcgtgcatagaggccttggccaaggcgttcgcggaacgcggcatcgtggatgacgtgcaggtcaacagcgtgtcgcccggcgctatcatgaccgaccgccgcacggcgatgcttcagagagccgccgaggccaagaaaatcgacatcgcggaggcgaaacagggcttcctgaaacaggccgggattacccgcttcgggacagcggaagagatcgcggatgtggtggcattcgccgtctccccggcggcgcattggatgaccggcactgtgctccggatggacggaggtgaggtcaggtcggtttga

SEQ ID NO: 6152 - DNA, 972 bp, Methylobacterium sp.
atgcgcgccatcgtcctggacggcttcggaggcctcgacgtcctgacctacagggacatccccgaacccgagccgctcgctggccacgttgtcatcgagatcaaggccttcggcatcaaccatgccgaagtgcacatgcgtcgaggcgaatgggccgaggcagcgccggtctcgggcatcgaatgcgtcggtatcgtcaaatcgtgtcccggcggcgagtttccggtgggcgccaaggtagcggcgctgatgggtggcctcgggcgcaccatcaacggcagctacgcccagctcaccagtgccccagtcggcaacgtcgcgctgatcgaggcggacctgccctgggccgagctcgcggccatcccggagacgtacgccaccgcctggacctgtctgttccgcaatctcgaaattcaaaaggggcagcttctgctgatccgcggcgcgacctcgtcgttcgggcaggccgccctcaagatggccgtgaacgccggtgcccgcgtcatcgccaccacgcgtaaccccgagcgcttcggcaagctgcaggcgctgggtgccgagcgttgcgagatcgagcggcctgacctgtcgaagcacatcgccgacgcgaagcagatcgatgcggtgctggatctcgtcggcaacagcgtcgtcctcgactcgctcgcgatgctccggcgtggcggccgttcgtgcctagccggctggctgggcgggctcgatccgatcccggatttcaacccgctgctgcagatggcgagcggcgtctacctgaccttcttcggcagcttcgtgttcgggacgccaggctttccgctagccgatgtcccgctgggccagatcgcccaggacgcggctgctgggcggctcgatgtgaagcccgtgcgaatcttcggcttcgacgaggtccgagaggcacaccgcctaatggaggcgaacgcggccggcggcaagatggtcgtcgtgcactga

SEQ ID NO: 6153 - DNA, 981 bp, Methylobacterium sp.
atggcaacacccgaggactggctgagccgcctgctcgcgctcgtccccgtccgcggacgcctcgacatctactgcacctatggggccccctggcgcatcgaccaagccggcgcggcggtcggcgagatggcctatcacgccgtcgtcgccggatcggccgtgcttgaggacccgacaggtggcccgccgctgcgcctctcggccggggacatcctgctgcttccgcagcgggtggaccacatccttcacgatggcagcggggcgcccgcggcgccagcgcatacacggacggccgccaacctgttgatcagcgagaacgagggcacgggcgagcggctcgacatgctctgcgggcacttcgtgctcgcgcgcgcccaggaacgcctgttgcgggactacctgccgccgcgcctcgtggtgcgaacggccgacccgggcgcgtccgcgacgttatcaggaacccaggacgtgctgactggcctcgtgtcgctcatgcgccacgaggcggtgtccgacggactgggcggccgggccatgctgaacgcgctgtctacggcactgttcacgctgacgctgcgactggccagcgaggcccgtgacaggccggtgggcttgctggccctggcgggccacagccgtctggctccagccttgtcggccctgttcaacgagccgggccgcccgtggacgctgcccaagctggcgcggctctgcaacatgtccagggcgaccatggcgcggcagtttcaggagagactgggccagtccgccaacgaactgctgacggacatccgcatgaccctggcggcgaacgaattacgcaacccgtccgcgagcacgggcgcggtggcggagacggtcgggtaccagtctgaagccgccttccagcgcgccttcaagcagcgcatgggggtcacgccggcgcagtggcgccgggacgcgcagtccgtggaaccgcccgtcccggccctcccgtcgtga

SEQ ID NO: 6154 - DNA, 522 bp, Methylobacterium sp.
atgccaggcctgctcagtagaatactcgcgtgccgtccgctcctccttcgctgggccccagtcccgctgcgcctggtcgtcggatacggcttcctggcgcatggtctggcaaaagccgcccgtggcttcgatgccttccccgccatcgtcgaggccatgggattgccgctgcctcatctgttcggatggctgaccatactcgtggagatcttgggcggattggcgatcctgctgggtgctctcgtcccgctcgccagccttcccatggcgatcatcctgttggtcgcagcgttcaccgtgcaccttccctacggcttcagctcgatcaagctccaggccgtgaccgcggctggggcgtcctttggaccgcccgggtacgagacagatctgctctacctcgcgtgcctcctcactctcgttatggccggggccggtccgctctcgatcgacgaactactgcgcaagcgtctcggcgcggtacctgcagatcagactctccggcacgtgggcagacgaggctga

SEQ ID NO: 6155 - DNA, 231 bp, Methylobacterium sp.
cccgtcacgctgcaggacgcgatccaggtccgcccgtggctcgccaacgtcctgcgcaacggcggccccaacgtgcagctcgtgcggcacggattcgtcctgccgctggtgtgccgcctcgtgcatccgggctccgggacctcggatgtcggctcgggaggcacctccaaggccgagagcaacgccgagtatcagcggctggtcgaccgcttcggccgcatcccctggtga

SEQ ID NO: 6156 - DNA, 267 bp, Methylobacterium sp.
atggtggcgaccagtctcgccatttcgttcacggtcggcgctatcgcgattgcgcaaatcggcccgttcgcggaacgagccacgccggtgctggcctcggtcgcaatcggcctcgggatgctggctttgatcggtgggctgtctcagctcaacgcagagggtgcagctgtctctcgggccgatccccgtcccgaatttgggatgagctggcgaccgcctgcgacggagccctacgatcgcacgggctccggtcgcaccgagcgttag

SEQ ID NO: 6157 - DNA, 243 bp, Methylobacterium sp.
atgagcaccgtaaatctcgagaattcaatcggcatcccagtcgagaatgccctcaggttcgcgcgcctgatggattcctggttcgcaggcgtcggccgggttgcagtgccgcccggcaatccgtttctgggcatcaatccggaggagcgggaaacgatcgcgttcggcttcgctgatctggttgagcgtctcgcggctatcgacgcgcaggtcagcggccccgacgggatctgccctcgatga

SEQ ID NO: 6158 - DNA, 330 bp, Methylobacterium sp.
atgacgatgcggagatcgtttcccccgctcgcggcgctccgggccttcgaggcggccgggcgccgcctgagcttccgcgctgccgccgacgagctgggcgtcacggcgaccgccatcagtcatcagatccggcttctcgagcagaccctggggctgcgtctcttctaccgcgagacgcgccgggtccggctcactgccgagggcaccgtgctgctgcccgtgctgcgcgacggtttcgacgcgttcgcccgagccatcgacgagatccgcggccggcacgcggccggcgttctcacgctctcggctccgactgccttcgtggcgaagtag

SEQ ID NO: 6159 - DNA, 450 bp, Methylobacterium sp.
atgcgcgaccgggcgggcaaccgcaccacgatgtcggcccgggcgctgcgcggctccggcggcgaggcgcaggcgccgttctacgtggcgatcgccgcgtcgctcgccagcgcctactacccgggcgaccggccgggcgacgagaatccggggctcggcctgtgcctgctcgacgaggcgttctcgaagctcgacgtgcgcaacagccaggcgctggtcgatctctaccgcgcctgggggctgcagctcctgatcgccgcccccgaggacaagcgcacgacgctgaccgaggtgatggacacgatcgtgacggtctacaagagcccggatctgacctcggtccggatcgaggccgagcaccccctcgaggcggcccggcgggcgctgcacgcgatcaaccccgaccaggtcgggatcgagggcttccgccagtcggacgccgcggagtga

SEQ ID NO: 6160 - DNA, 585 bp, Methylobacterium sp.
gtgagcgacgtcccggccccatcccgctcccgcccgccagaatacgtggccatcggcctgatccaggatgccgaggcataccgggtcgccgccatgcgcgtgcatcccagtagggagacgttcggggctcgagaagtggatctcctcgcccccgcttggcacctcctctgccactcgtccgagttggccttgaaggcctatctgctgagcaccggagtcgatcagggatcaaagaagggcggcctcatgcactcgtccatccggcacaacctgaatggcctctaccaatgggccatggagcgggggttcgagccgccggacgaggacttcggagacctgatcgagttcctcgacccgtaccacagcgctcacgtgttccggtatcgcgagccggaccgcatgccgttcgtcccgcctttcgtgatcgccgacatcctgaagccggtgatctcgggcgtcgcccgaacggttcgagcgaaatggaaggccactcgagaggcaggcagcgacgatgcggacctagcgagcgtcggcttggcgcaagcgcagccgcctgagagcaacacaaagccctcaaggggttag

SEQ ID NO: 6161 - DNA, 201 bp, Methylobacterium sp.
gtgtccacgaccctgaaggcccgcatgatgcggctggagaactgctaccccgacctgaagcctggtccggagcgcatgagcgacgaggagctggatggcgtgattggcgtgctgcggcagctcgaagccggcgagaccgttgatccaacccggctggattgggcgacggccatcatgcaaagggagcagatgctgtcatga

SEQ ID NO: 6162 - DNA, 279 bp, Methylobacterium sp.
atgaacctgaaagcgctcgaagctcgcctcgtccgccttgagacgaagcatggggccggtcagttcgaccacttgacctacgaggaggtcgaacgggccttgtttgatcgtctgcaccggatggccgacgcggccggcggcatcgacgagctgatggccgagtgggacgccgagaccgacccggagcactctgccctgatcgcgcagatccggtcccacgagtgcgacgtccgcgcgagctacctggagatggaggggcgcctgtgtccacgaccctga

SEQ ID NO: 6163 - DNA, 246 bp, Methylobacterium sp.
atgagcgccgtcctgcagttcccccggttccgggcctaccgccccgagccagacgccatgcggctcgcgttcgatttcggcgactggtgcgtcgagctgcgcaggagcggcaagctggcgcggcggatccgcttcgcctcgctcgaggaagcccgcgccgaggttgcacgccaggaggctgctggtctccggcggctccccgacgcgcccatgccggagccgatcggcggggaggacatcgcctga

SEQ ID NO: 6164 - DNA, 204 bp, Methylobacterium sp.
atgcgcccgctcgtctattccgacacgatcacggtccgcactgacgcggacctgcgccgcgcgatcgacgccgcggccgagcgcgaaggcgcatcggccagcgagtgggtgcgccgcgcgttgggctccatcgtcagaatagacggtccgcctcgttcgcccacgcccgctgctccggcgggtgccctgccggccgcggcgtaa

SEQ ID NO: 6165 - DNA, 207 bp, Methylobacterium sp.
atgcagacgctggcctgccggaccgaactggcgaccctgctccggggcatccagggcatcgctggcttggccgcctgcaacctcgaaacgggcggctcggtgcaggacctctgcggcctcttcagcgcccttggacagctcgacgcgaacgcgaccgatctcgcgggccgctacggcgtcctgatctccacggcgggttcggcctga

SEQ ID NO: 6166 - DNA, 288 bp, Methylobacterium sp.
gtgatctcgcgctccctccagctcgacgacttcctctgggcgctcgacaacagccggcgccggtaccgggtgcgcccgacgcggcttggggatctgaccttccggttcggggagacctaccccggcctcatcactgtcgtgagcgtgaacggcatccaccacgtcgtgatgacggcgcggtgtgagatctctcccggcccgtggctcgataccgacgcctacgccgacttccggctactggcgatcaatcgcaagcgcgctctgcggaattatggaggcgcgcgatga

SEQ ID NO: 6167 - DNA, 129 bp, Methylobacterium sp.
atggagacttcgatgaccctctttacccgcttcgccctcgccacggccgtcgccgccgccaccgtcgcggttctcgccgggacctacgtcgagatcctggaccgcgccctcccgatgcacttcgtctga

SEQ ID NO: 6168 - DNA, 270 bp, Methylobacterium sp.
atgaagaagcttatcaccaccctggtcgccggcaccgcgctgctgggtgcagcctctgccgttcaggcccatgagtggggtggcggctatggctatggctacggctacggtccgggtcacggccattcccgcgtgatcgtgcgcgaaggctacggcgacggctatcgcggcgtgcgcttcggccaccgtggctgggatcgtccggatgttcgcgtgatcgagcgtcgcgggtacgggcatcgttaccacgacgacgattgggacgattga

SEQ ID NO: 6169 - DNA, 264 bp, Methylobacterium sp.
gtgcgttcaacgatcattgccgccgccctgctggcggccctcggttccgccgtcgcgatcccggcctccgccgcgccgatcggccccgacacgggcgtgtcggcgcccgccggcatggtctcgacggtccagatggatcccgtcgagcgccacatgatgcgccgtcgcatggagcgccggatgatgcgccaccggatggagcgccacatgatgcatcgggagatgcgccgcgagatgcgtcgcgagatgatgcgccgcatgtga

SEQ ID NO: 6170 - DNA, 417 bp, Methylobacterium sp.
ccgggcggcaccgtcctggcggcgctcgccgaggacgccgagggcgagcggctgatgctggacggcgtctggcgccggctgcgcgcggtccgccgcggcgcggagctgacggtgatcgtcggcggccggaacgcgacgctggtccacgtcgatcccctcgccccgccccggaccgaggcgtccggcagcgaccgggtgacggcgcccgtgccgggccgcctgacccagctctgggtgcggcccggcgatgccgtggagaagggcgcgccgctcgcggtgatcgaggcgatgaagatggagatcaccctccgcgcgccgcaggccggcaccgtcgccgaagtccgccacgccgtcgacgacatggtcgaggagggcaccgagatcgtcaccttcgcggcggaggagcggcccgcatga

SEQ ID NO: 6171 - DNA, 357 bp, Methylobacterium sp.
atgggcgacataaacggcgacatcgaccagaccaccttccagcaggtcggacggctcctcggggccgagcgcgccgccgagatgctcggactgctccgcggcacgctgacggcgctcgccgacatgaccgacgatgacctgcgcggaccggccgggctggccggcgtccatcgcctcaagtccgaggccggcctgatgggcttcgggcgcgtgtcgcaggcctgcgaggccgtcgacgccgttggcacgaacggctccgtgcctcagggccgcctggacgacctgcgcgcggcgatgacctcggcactggcgacggtggcgacgctcggaccgaaccccggacgaccgacgctctga

SEQ ID NO: 6172 - DNA, 423 bp, Methylobacterium sp.
atggcgacggcatcggcaagcgtcgagatcccggctccggcctccgaggtgtggcggctcatcggcgggttcggctccctgccggactggctgccctacatccccaagtccgagttgcacgagggcggccgcgtccgacacctggcgaaccccgacggcggcgtcatcgtcgagcggctgatggccttcgacgaggccggacggagctacagctaccacatccttcaatcccccttcccgcaaagaggttacctctcgaccttgcgggtccgggagaccggcgacgggcagcggtcgcgcgtcgagtggtccggcgaattccagccggtcggggtcagcgacgcggaggtcacgaagctcttccagggcatctacgaggaaggtctcgccgccctgaggaagcactatgccgacgagggctga

SEQ ID NO: 6173 - DNA, 315 bp, Methylobacterium sp.
atgaagcgtcggcgcgggctcctctcgttcagccgcgtccggtcggccgccgcgaaccataccgaagctctcgtgacgcggtggcttcccgacggccaccgcgagggccgggagtgggtcgcccgaaacccaacccgcggcgacgcgcgggcgggcagcttcaaagtaaatctcagcaccggcgcgtggggtgacttcgcaactgatagtaagggcggcgatctcatctcgcttgccgcctaccttcgcaacatcagccaacttgaagcggcgcgcaacatcgccgagatgctgggtatcgacgcgtatgagtaa

SEQ ID NO: 6174 - DNA, 459 bp, Methylobacterium sp.
ctggcgctgaacgccacgatcgaggcggcccgcgccggcgatgcggggcgcggcttcgcggtggtcgccagcgaggtgaagcagctcgccgcccagaccgcccgggccaccgaggagatcgccggtcaggtcggccgcatccagggcgcgaccgggcagaccgtggacgcgatcgacgggatcacggcgcgcatccgcgagatcgacggggtggcgacctcgatcgcggccgccgtcgagcagcagggcgcggcgacccgggagatcgcccggaacgtggccgaggcggcgtccgggaccggcgcggtcaccgggacgatcgacgcggtggcgcgggcggccgacgacacgggcacggccgccacgcggatgctggcctcggcgtcgagcctctcggaggaggccgccgagctgcgccgggagatcgacgccttcctgcacaccgtgcgcgcggcctga

SEQ ID NO: 6175 - DNA, 318 bp, Methylobacterium sp.
atgaggggttcggatcagcgttcggggacgttgttctcctatgtgaattgggaggctcgggtccggcccgaccatcccttgcgcacgatccggcagctcacggacgtggcgctcgtagcgctgagcggggacttctccgcgctctatgcggctcggacgggtcgcccgtcgatcccgcctgagatgctgctgcgggcgcgcattgcctcgcctgaaatgctcccggacgttgggtcgttgccgcatctgatttgctccccacgcaggttcggcggtgggagtgacgatgaggcgagtgagcatggcgacgcgcgatga

SEQ ID NO: 6176 - DNA, 246 bp, Methylobacterium sp.
atgggcgagccgactgaagccgacgtgctggcgcgcgccaagcgcaccttcatcgcgaagaaccacgacgatcgcgcttgggatgcgggctttacagagcgggaggcccgcaacggccacaacgtcgcctgtctaacggaagtcgagcgccaggagtatctcgagcaggcgcgccacgagcttcgcaccagttcgccatccgaaagaaccgatcgcagcaaggcgaggcggaagggtatcgagtag

SEQ ID NO: 6177 - DNA, 177 bp, Methylobacterium sp.
atgctgagtccgattgatgccttgcaaaaactgcgcgaccagatggttataaaccgccgaaaaatcgtggatcaggaggagagcattcaaaatgtgcaagccgagatcgaagccatagaccgggccattaaggacgaggagattattagtaagagtactggctccaaagtcacttga

SEQ ID NO: 6178 - DNA, 414 bp, Methylobacterium sp.
atggccttgttgaccgatacacctgagtcctctgccgacgcagttccgaagcagaaccgggacgagtgggccgagacggtctcgagctacatcgagcgctcgttgctgatcgtggtgggcgcgtcagtgaccgtcgtcgcgggcttcctgagccaagtgtggtccagtgcgagcgtagcgttcaggacggacctagcgaccaacctgaaggcgctgggcaccctgttcgtggcgaccttcgtcctccctacgctgaggttcttcgtcgagctccacagggacgacgatccgaagaagtcgcgtaaggcgttcatcgtttgggtgatcgcggccgcactgatgttctccttctacacgcgcttgatcgaccagctcggcgacatcgtgttgaagtacgcgaaggttgtaggctga

SEQ ID NO: 6179 - DNA, 201 bp, Methylobacterium sp.
atgccgcagacactcacgggatgggtcttattcgccgcgttatggctcacggggccgatcgccggctacgccgcgatgaacttagctgccgcccgctgggaacgtgaggcgataatgaggcgcgacatcctcgccgtcactattctgggatctcttttgctagtttccgcgctgctgctgatgttcgtggatggactgtag

SEQ ID NO: 6180 - DNA, 111 bp, Methylobacterium sp.
atgttctggacccatcccaccgagaccatgatgtgggtcggcgtcagtctcgtcatcgggctattcgtcggcgattggggcgcggatcggcagcgactgccgcccggctga

SEQ ID NO: 6181 - DNA, 546 bp, Methylobacterium sp.
gcgctggtccgggacctgcgggagagcgcgacgcggatcggcgacgtggtcggcctcatctcgggcatcgccggccagaccaacctgctggccctcaacgccaccatcgaggcggcccgcgccggcgcggcgggtcgcggcttcgctgtggtcgcgagcgaggtcaaggaactggccgagcagacggcgagagccaccgaggaggttgcccggcaggtcggcgagattcagtcctggactggggacgcctccgacgcgatcacgcgggtcgtcagccgcatcaacgagatcagtgcggtgtcgagcgggattgccgcggcggtcgaggagcagggttcggcgacccaggagatcgtccggaacgtcgggcaggcggcactcgggaccggagccgtcaccaacaacatcacggacgtggcccgctcggcggagggggccgggagcgccgccgcacaggtgctcgaggcggcgtccgggctgttggggcaggctcaacggctcgacgcggaagtgggccgcttcctcgacacggtccggacgggttga

SEQ ID NO: 6182 - DNA, 177 bp, Methylobacterium sp.
atgtcgccgcggttggctgccgtcctgagcctcgagaccgcgctgtgctccgcgatcctggttgaggctgcacacgatcggcttgaagaggaagcgcccgcaactgggatcgcccgcgtgtcagcgtggctcctgctggccgccatcgacttcctgctctggtcgaaagccacctga

SEQ ID NO: 6183 - DNA, 201 bp, Methylobacterium sp.
atgatcgccttcacaccgaacccccacaagctgcgcgtaacgccctccgcgaaggagcctggccggttcgactggtcgatcacgcgcgacggcgtcatcgtgcgccagtcggttcgatccttcgggtcggaaggtgcgtcagaggcggacggcgatgtggccttccgggagatcactgctcggtggcagagcgctcgctga

SEQ ID NO: 6184 - DNA, 816 bp, Methylobacterium sp.
atgacagtgctcgcgccgacatccgcgcaggagacctcgcgcaatccgctggccgcgttcggtggcggcgcggcgatcggggcgctgggtgggctgatcgggctcggcggtgcggagttcaggctcccgctgctgatcgggttgttccgcttcgacgccttggaggcggtgatcctcaacaaggccatgagcctcgtggtcgtcgccacggccctgccatttcgggcgaggaccgtacccttcgacgagatcggggcgcactggccagtgatcctgaacctgctcgctgggagcctcctcggggcctggttcggggccgggtgggcgacacggctccggtccgagaccctctacaaggtcatcgccggccttctggtggtgatcgccgccgtcctgatgttcggacatgacgcggccgctggcgcggctcttgtgacgggctcggtgcagattgtggtgggcgtgatcgttgggttcatcatcggcgtggtggcgtcgctgctgggcgtggccggcggcgagctgctgatcccgaccctggtcttgctgttcggcgccgacatcaagctcgcgggcagcctgtcgctggcggtgagcctcccgaccatgctcgtggggttcacgcgctatagcagggatcagagcttctccgtgatcgggcgcaaccgggcgtttctcttggtcatggcggccgggtcgatcatcggcaccttcatcggcggccagctgcttgggatcgtgccaagcggcgtcctgctcccgctcttggccatgatcctcctcgtgtccgcggtaaaggtctggcggcacgcctga

SEQ ID NO: 6185 - DNA, 282 bp, Methylobacterium sp.
atggtgaccgacgcctcagccgacctcgccgtctacctgctcaaagaggtcgcgagccgcgcgcccagcatcgtcgccttcatggtcgcagaaggtcgccgcctgcctgaggaccccgacgaagcccgtcaggaggtccgccagcgctggcccgagatgtcggacgatgagcgggacatggcgtttaggatggccatcaacgtgttgcgccggatcgagcgcgactgcgctgagaacatcgccaggctcgacgcgctgaccaccgacgctggacgaggctga

SEQ ID NO: 6186 - DNA, 756 bp, Methylobacterium sp.
atggtcgggctcgcacgccggaagccgaagaacgatgccgttgccgccgtgcagccgctgtccgtgattgacgggctgcgcgccgctcgcgcccaggccgatgccgagcgtgccgatgccgttcgcgctcgcgtggatgccgagggccggcgacatgccgccgtgaaggccgaggacgagcgcgcgctcgcccgccttgatgatgagatcgcgaccgcgcgtcgccggatcgacatagccgaagctaagttcagccgcctcgacggcgagttggcgcaagccgagtacgatgccgagcagaggcgccgacacggtgtgcgttccgaggcggaagccgcgctcaatcaggcccgcgagatcatgcggaccgagtaccccgcagctgccctagccgtcgtggaagtgctgcgccgagttcgcgagttgcagggggctgcctaccgggccaacgccgatttgccggacgacgccgcgccgctgagcctcatcgtggaccccatgcacgttgcggcagcatcggcgccgcaagcgatgatgtgggcccatgtcctgttcaatcgcagaaccggcgaacgcgcgccgtcatccgtgcagagcggccccgagtacgagcttcgtcaagtcatggtgccgcgaccggccgctgataatcatgcgccgaccatgcaggccatcgccgacttcgtgaacctgccaggcgttgagccgggcaaatacttctatggggcggtccgttggggccagccgcgcaactga

SEQ ID NO: 6187 - DNA, 102 bp, Methylobacterium sp.
atgatccagcctccgttgcgccgaaagatccgtgttttgtccacgatcggccggatcagcgtcgcgttaatgcggactatgcgcatcctccgttcggattaa

SEQ ID NO: 6188 - DNA, 402 bp, Methylobacterium sp.
atggcctccgttcgcgtgccggtgaagccgataggcgttccgttcgcccgcgcgggtggcatgatgggcgctcaggccaacggcgccgagagcggccggacgatcatcccgccgatcctcgatcggatccgccgtgagccgcatctgctggccagtctgcccgggttggtggaagccgcgattgaggccggcgctgctgtgctggtccaagctgagatctctgctgccgacatcgccgcttggaaacgaggcttcatccatgccgccaacgccttggtacatccctttttcgaagagatgcaggccctcctagattcgagccctggcgtcggtgagccggcggggattccagcaggccgctcgctgcgaccggaagacctcggcgccctgccaccgcgctga

SEQ ID NO: 6189 - DNA, 240 bp, Methylobacterium sp.
atgcagcgcaataaggtgagcaccgtgttcacgccagccagagtcgccgccgacctcggacaggatgaagacgcactgttcgacatcattgtcgacatggaacccgaggacggcctgatctgggtccacggctccggcgacgaggcatacctagcgtttaccaacgatgggatccacgagctgaaggagcggatcaccgcccttagggcggaaagagatctgctcccgccgagaccgtag

SEQ ID NO: 6190 - DNA, 237 bp, Methylobacterium sp.
atgaacgcgaccgcttctgacgtcgagaccatgcgccggttcaataggctctacgtcggccaactcgatgccgacgagatcgcggccttcgacaatctgtgcagtcaggtcctgatgcagcgctcctacgagcgcctcgccggtctcatgggcctctcccaagcccgaatccccagcgctgggcacgcggcgatcgacgccgcttccaccacccccgtcaccaccgccgcggagtag

SEQ ID NO: 6191 - DNA, 1401 bp, Methylobacterium sp.
atggcccgcctgcggatcgccatggtctctgcttggtgtctcatcccagccggggccctcgtcctgctcgtgccagccctcgtgaacggctttcccttcatcttccaagatacgtcggattacctgatcttcacaccgcggctctaccgaagcccgttctacggcctcttcctgtttggctttcatctaaaccgcttcatttgggcgccggtaatcgcccaggccctgatcgggagcgctctcatctacatgctcataaagaccctgccgatccggaaccgaccgggcacattcgcgggccttatcgccttccttggcgccttcacatctcttccctggtttgtcggcttcctcatgccggatatcttcaccgcgtaccttttcatcgcggtctacctgatcggctttcacctcgagcgcttctctcggccgctgcgagtggtgctcgtcgggttcgccggtctgaccatggtggtgcacctctcgcacctcgtccttggttgcggtgcaatcgctgtcttcgtgctactcagctgttggctccggcagccttggcgtcagaccatcgttcgtgctgctgttctctgcatcccggttgcgctcaccgtcggtgcctacctcacctacaacctcgcggtcttcaaggccgttgcggtctcgccggcgggccaaaccttcttcttggcaaacctgatcgagtatgggccggcgcgtgactacctccgggacgcatgccccggggccggctacaagatctgcgaccaggtggagacgttgccgtctaccgccaacgccttcctgtgggaggccggccatctcgaccgactcggcggctttgccggcatgaacgccgagtccgcgactatcgtccgggccaccgtgatgtctcggcccggctacgtggccgccgtggtggccaataatttctggcgtgccctcggcgcccatgcgcccgacaccgacgtttcctcagcattcccaccctactcggcgatcttcgaggtcatcgcgtcgaagttcggttcgcaagcgctcgccgcattccaagccagcgcccaaatgcgcgatgtggtgccccacagcctaattaggacggtcgacaccgtcctgatcgcgctggcctgggtcctagcggctgcgacttgcctggtagctgtcgctcggagagagcgtgaactcacggcgctgccgctgttctttgcggcctgtgtcttgagcgatactttggtctgctcagctctgtcaggcgtgtttgaccgctaccaagcacgcgtcatttggctgctgcctatgacagcaattctctgcctcgtaagtctaaaagaccgcgcctggcaacagcttgaccgagcccgcgcgccctacagcagcaacacgcccggtctgaacgcagctagctga

SEQ ID NO: 6192 - DNA, 561 bp, Methylobacterium sp.
ttggtggaacgccgctaccgcgaagcgcagcggatgcagcgtcgtcagggtggggacttcatgagccacttccgtaccgcccttgcacgcgagtgggcgagcttccccggcgactacgggcagcagggcatcaacgggggtatgtaccccggccagcgcgccagcatctcgcgcgagcggctgacggcgtcagctcaagcatggctcgataggcgagagggtcgcgtcgcttcaagcgcatcgcgtcgcgctgaggttctggccgaccccaacgacgagcgtcgcaggccagattttgccagcacctatcgagccctgaaggccgaacaggatgccgtgcgcgatgatatgatgccgagggtgggtgagccctcgctgcttcagaagtcgctgagggcgaatggtgtcggggtcacgcccaacgtcgagggcgccgtcaacatccgcatcgacaagcccggccccgacacgaaagtgagggccggagccagcggcaccctcttccgcacgatcaggcagagccgtgggcgtcagatgcagccggcgggtgaggatgtctga

SEQ ID NO: 6193 - DNA, 693 bp, Methylobacterium sp.
gtgctcacatcgagcgatccggactacttggagaagctggcccacattcaagccatcctcgccgacctgcggcgagacgaggcattcttctcaatcgacgagttcgggccattcgcagttcggatgcgagcggggtgcaagcttgtggcgccaggtgaggttccgacggtgccgcaatggcagccatcgcgcggcagcctgatcctcacggccgcgctggagctgtcgagcaaccagatcagccacttctacagccaggccaagaacaccgccgagatgatcaggatgctcgacctgttggtggtgcgctaccgcgaccgacggcgcctcttcctgtcttgggatgctgcctcctggcacgtgtcgaagaagctgaacgcccgagtcgcagaactcaacgagatcgcagccaaaggcggaggtccgctcgtggagaccgcaccgctgccgagcggcgctcaattcctaaacgtgatcgaggcggtgttcagcggaatggcgagggccatcatccacaacagcgactacgctgacgtagaggccgcgaaggcggcaatcgatcgctacctcgccgaccgcaatgccgccttcctgcgtcacccccgtcgagccggacggaagatctggggtaaggagcctgcggcaaccacttactgcgaagcgggtctcttcaaggatccgctgttccgatag

SEQ ID NO: 6194 - DNA, 231 bp, Methylobacterium sp.
gtgtcgcgctacttcatcagcacagctaacggccacgtggtcgaggacgacgagggcgtagagctatcgagccgcggggcattgcgcgccctgctcgggaggacgctgacggcgatcctccacgacgaatgcgcgatcggcggggcgaccgagtgcagcgcccgagcttacgacgaagaaggcaagctcgtgatgcaggcgcgggccaccatcgacatcgcggatcagtag

SEQ ID NO: 6195 - DNA, 153 bp, Methylobacterium sp.
atgaccgaggatttcggcagtcgcgacggacagcgcgacgacaagaccggcccgtcacccttcgccgacatgatcgaggccacccgcctgaccggcctcggccggctcgaggaggcgaccgccctcattcagcgcagcctcggggggcagaag

SEQ ID NO: 6196 - DNA, 294 bp, Methylobacterium sp.
gtggcccgctcccacctcgccgagcgcctgagtcggcccgctcggccgcacggtccctaccgcaagcccgaggatgcgcagctgctgccgacgatccgcgcgatcgtcgatgcccgcccaagctacggctatcgccgcgtcaccgcactggtgaaccgggccctgcgctcgcgcggcgaggcgagcgtcaatgccaagcgggtgctgcgcatcctgcgggcgaacgggctcaccctcgcgccgcacaccgcccggcggcccggccgcacccacgacggcatcgtggtggcgtga

SEQ ID NO: 6197 - DNA, 387 bp, Methylobacterium sp.
gtgctggcgctgcacgtcacgcccgccaatgccgatgaccgcaccgccgtggccacgttggctgacgccgtgcaggaggcaaccggcgacagcgtagatctcgcctacgtcgatcagggctataccggcgagcgtgcggcgaaagcggcagccgatcacggcatctcccttgaggtcgtgaagctacccgaggccaagcgcggcttcgtgctgctgccacgccgatgggtcgtcgaacgcgcctttgcttggatggcccgcttccgccgattggctcgcgactacgagcgcttgcccgccactctggccggattgtatctcgtcgccttcagcgtcctactccttcgcagggccgccgacttcgctgcagtccgtaacagcctctag

SEQ ID NO: 6198 - DNA, 162 bp, Methylobacterium sp.
gacgaggcgcccgcccgcgtcccgccgccggacgcgtccggtcccacatccggtcccacatccggtcagggcccgtcgccccggtcgacggcagggcggcggacgaacgagctgcggctcggcgagcgctggaagcggcgcctgccgcacttcatgcgctga

SEQ ID NO: 6199 - DNA, 162 bp, Methylobacterium sp.
atggcgacgctgatcgtgacggccaagctcaacgcgatcgatccgcaggcttggctcgccgacgtactcacccgcatcgccgatcaccccgcccctcggctgcacgaacttctgccgtggcattggcggtcagcgaccgccccgcttgccgaggctgcctga

SEQ ID NO: 6200 - DNA, 168 bp, Methylobacterium sp.
atgacggcactccccttcgacaacagctacgcccgcctgccggagcgcttctacgcccgtcggccgccgacgcccgtggcggcgccgcgcctcgtccggctgaaccgcgcgctcgccgaggagctcggcctcgatccggactggctcgccggcccggacggcgtcgcg

SEQ ID NO: 6201 - DNA, 495 bp, Methylobacterium sp.
atggtgaccctgcggccgatgatcttcgagggcctgacgccacaggagcgctacgtctggacgaagaagcgggtcaacgcgatgcgccagctcttcgccgacaacgacgacttgcccgagtttgcggctctgtggtcacgggagtcgacccgggtcaggaccgagccgccctacggggcgaaaggcgagcacctgcacttgctcgtgcacactgccggcgcccgggagctgctacgcaaggccctgcacaagagcttcagtcgacgagaggcctttgtcgatccggccgacgacgtcgtgcgccgcctggacaacggccagcttggcgacgcctcgacctacctcctcaaggcggtccaccagaacgtctggcgcacctacccggcgacgccacaccgcccatccggcgagatctacgggccacgggtcggctggacgcgcaacatcctcgatgagcagccagtccgccggccggccagccgcgtcggcggctga

SEQ ID NO: 6202 - DNA, 519 bp, Methylobacterium sp.
atgacgaaccacctcttctccctggtgcgggacggcgccgccgatcccgccaagaccgtgatcgagacgccggacgggcgccgctacgcgtacgcggacctgatcgcccgctccggcgcctacgcggcggccctgcgggcggcgggcgtcgcgcccggcgaccgggtggccgtgcaggtcgagaagagccccgaggtgatcttcctgtatctcggcgcggtccgggccggcgccgtgttcctgccgctcaacaccgcctacaccccggcggagatcggctacttcctcggcgacgccgagccgaccgtgttcgtctgcgacccgggccggcgcgaggcactggccgaggccgccgccggcgtccgcacggtctggacgctggacgccgcgggcggcggcagcgccgcggaggccgcagaccgggccgcagatgcgggcgccgccttcgcggacgtgccccggggtccggaggatctcgcggcgatcctctacacctcgggcacgaccgggcgctcgaag

SEQ ID NO: 6203 - DNA, 264 bp, Methylobacterium sp.
ccggtgccgggccgcagcggcgtgccggtctccgggcgcccccgcctcggcgcgccggaaccggccgcccgcgcggaggccgcgccggacgcgggcgccgagcccgacgacgccccgatgaagccctggaaggtcgtcctggggatcttcgtcctgttccaggcggccgccctgctgcacccggcgctcgggctgctcgtcctcgcggtcgccctgctcctcggcctgcgacgcctgctgcgccgctggcgacggcgccgatga

SEQ ID NO: 6204 - DNA, 306 bp, Methylobacterium sp.
ttggggcgcgttcggcggctgagaccggtcgccgggcgcacccggaccgcccggacgctgacccggcggtccgcgatccggcgcggaccggtcgggggccgcgtcgcgctgcgcgggacggttcggctggtcatcggggccggggcgatcccggtcgggcgcctggcgctgctgcggcggggccggcggacgctccggcgcgggccgcccctggggcggcggaacctgatcgcgatccggcccctgctgacgctcgggccgcgccggggccggccgccctgcggcccgcgatccggacggtccggc

SEQ ID NO: 6205 - DNA, 546 bp, Methylobacterium sp.
atgcatgtgagagttcgcctcgacggcgcgaacccgcggcgctggcacgtcgcgctgctggagcggctgtccggcctgccgggcatcgcggcggtgagcgtcgacgcggcgcccggtccggacgggtggccggcacaggccgacctgctgttccggctggaggccctgatcttccggctggcgccgaacgggtcgcggctcgtgccgcccgcggatctcgcggcctggacccgtcccgcgaccccggacctcgtgctcgacctgtgcggcgacgcggtcgccccctgcccggtctggcgcgtggcctacgacggcggcctcggcgagaccggcctgctcgcgagcctgctcgccggccgggtcccgcagctcgacctcctcgaaggcggcaccgtcgtcgccgcgggtcgcctcggctcggactaccggggttccatcgccgtctcgttcgaggatgccctgtcgcgcacggcgacgctcgtcgccgccgccctgcgggccctgtcggacggccgcgccttcgcggcgacgcccgccgcgggcgcg

SEQ ID NO: 6206 - DNA, 231 bp, Methylobacterium sp.
cccgtcacgctgcagcacgcggccctggtccgcccgtggctcgccaacgtcctccagctcggcggccccaacgtgcagctcgcgcgccacggcttcgtcctgccgctggtgtgccgcctcgtgcatccgggctccggaagctcggatgtcggccagggcgggacgtcgagggccgagagcgaggccgagtaccggcggctggtcgaccgcttcggccgcatcccctggtga

SEQ ID NO: 6207 - DNA, 624 bp, Methylobacterium sp.
cccccccgccgctacagcgtcgcggaggcgctcctcgaccggcgcgtgctcgccgtcgccttcgtgtatttcggcaacgtggcgctgctctacgggctcagcttcttcctgccgcagatcgtcaagggcttcgacctcacgaacctccagacgggtctcgtcagcctcatccccttcgcgatcgggatcgtcggcatgctcgccctcgggcgctcctcggaccgcaggggcgagcgcaaggggcacgcggccttcgcgctgctgctcgcggccggcggcacggccgcggcggcgctggtctccgatccctacgccaagatggccctgttcagcgtctcggccttcggaatcttcggcggcctcccggtgatctggacgctgcccaccgcctacctgtccggcgccgcggcggccggcggcatcgccatcatcaacgccctcggcaacctctccggcttcgccgcgccctacgcggtcggcgcgatcaaggatgctaccggcagcttcacgggcggcctcctcctcatcgcggcggccggcctcgccgccatggtgacggtcctctgcctcacccacgaccggcacctggagcaggcggcgcgcggcgcgcgggcggcggagtag

SEQ ID NO: 6208 - DNA, 96 bp, Methylobacterium sp.
atgactacgcctgaggcacgcgccctcgggctgcccggggcgagcccgggcgagctggcccacgcggatctcgtcgggcgcctcgcccgggagatc

SEQ ID NO: 6209 - DNA, 237 bp, Methylobacterium sp.
ctcggccccaccgtcgacgcctatcgcgaccgcttctgcctccgctaccgcaaccacatcacgcccaaccagtacccgatcgagcgcgtgatcgccggcgagcgcttccacgacgtggtggtcgaggtgcggcgggccgacaagcccgacatggacttcgtgcactcgctgcgcagcctcgtggccacggaccgcgacggcaacccgagctgcctcgcgctgatcctgaaggacgtc

SEQ ID NO: 6210 - DNA, 195 bp, Methylobacterium sp.
gtgaccgaccgccctgccctcgacgtggtgatcgtcaactggaacggcggcggcctgctgcgcgcctgcctcgcgagcctcgcggccgcgcgggacgccgcggccgtgcaggtcaccgtggtggacaacgcctcgacggacggctccaccgagaccctgcccgccctgccccgccccctccggctgatccagaac

SEQ ID NO: 6211 - DNA, 213 bp, Methylobacterium sp.
atctcgttctggttcggccgcggtggggccggcgggaccgggggcgcgggcgggaccgcggagatcgtcaacgcgggtggccggatcgcgaccgagggcgactcggccttcggggcgttggtgcagagcatcggtggcagcggcggcagcggtggcggcgccttcccggccggggccttcttcgcggtcggcctgggcggcagcggcggccgg

SEQ ID NO: 6212 - DNA, 504 bp, Methylobacterium sp.
gtggcggatttcacatacatcgccacctggggcggcttcgtctacgcggccttcgtgatcgacgtcttcgcccgccggatcgtgggctggcgtgtgtcgcgctcggcccgggccgacttcgtgctcgatgccttggagcaggccctgcacgagcgccgccccttcgccggcagcggcctcgtctgtcactcggatcgcggatcgcaatatgtgagcatccgctacaccgagcgcttggccgaggcgggcgtcgaaccctccgtcggcagtgttggcgactcgtacgataacgctctcgccgagacggtgatcggcctgttcaaggcggaggtcatccatcgacgcgggccgtggcggtcctttgaggcggtcgagtacgccacgctggaatgggtggactggttcaaccaccgtcggctgctcgaaccaatcggccacatccctcccgccgaggcggaggcacgctattatgcccaggccgaggtccaagccttggccgcctga

SEQ ID NO: 6213 - DNA, 504 bp, Methylobacterium sp.
gtggcggattttacctacatcgccacctggggcggcttcgtctatgcggccttcgtgatcgacgtcttcgcccgccggatcgtgggctggcgtgtgtcgcgctcggcccgggccgacttcgtgctcgatgccttggagcaggccctgcacgagcgccgccccttcgccggcagcggcctcgtctgtcactcggatcgcggatcgcaatatgtgagcatccgctacaccgagcgcttggccgaggcgggcgtcgaaccctccgtcggcagtgttggcgactcgtacgataacgctctcgccgagacggtgatcggcctgttcaaggcggaggtcatccatcgacgcgggccgtggcggtcctttgaggcggtcgagtacgccacgctggaatgggtggactggttcaaccaccgtcggctgctcgaaccaatcggccacatccctcccgccgaggcggaggcacgctattatgcccaggccgaggtccaagccttggccgcctga

SEQ ID NO: 6214 - DNA, 279 bp, Methylobacterium sp.
atgacgaagcataccccacccttttcccctgaggttcgcgagcgggcagtccggctggcccgggagcatgagagcgagcacggttcgcaatgggccgcgatccagtcgatcgcggccaaaatcggttgctctggcgaaacgctgcgcaagtgggtccgtcaggccgagcgcgaccggggcgtgcgggccggaccgacgacggatgagcgcgagcggatcaaggcgctgtaccgcctgcggattgtgagacaccgatctgaagcctacgcggcaatggcc

SEQ ID NO: 6215 - DNA, 246 bp, Methylobacterium sp.
atgatcctgagcctgcaggccgtgcaggtcgcgaccggcagcgacgatgccgagagtcagctcgtcttcgccgacgggttcctggtcgcgatcctggttcgtctctcggcgcagcacggggccgatgccgggaaatggttccttgaagccgggttcggcccgatcgatcccctcgcgccgccgctgttcgcggacctgccggcggcccgggcctggatcatgcggcagctgatcgccgcggcctga

SEQ ID NO: 6216 - DNA, 258 bp, Methylobacterium sp.
atgaaggtcacgagtctcgccatcgccgccctcctcgcggccgcgattcccgccacggcagccgagaatgccggcagcgcgaccagccggtcgggcacggccaacagcaccggcccgagcgacgcggggtccggctcgacacccggcgccgccgggagtggcccgtcgaccggctcgatgagccgctccggtacgacgaacagcaccggcccgaacgatgccggatccggctccaagccgccggccggcggccgctga

SEQ ID NO: 6217 - DNA, 249 bp, Methylobacterium sp.
atgccccggaccctgatcacctggacgcaggacgagaccgccggcgtgccgctcccgcgcttcgtcggccgggtcgggacggtcgtcgtggggatctgcgcctacgacggatcgagccggttctggacctggtggagcccgctggccgaggacatctgggggcacggccaggacgccgaaggcgcccggcagggctgcgaggcctggctgcgcggatggctcgagaacttcaggccgttcttcacctga

SEQ ID NO: 6218 - DNA, 1755 bp, Methylobacterium sp.
atggacgatgacaccctcacgctgatccctgacgacctcgacgaggcgcagccgaccgcgggagcctgggtgatcgccgtgatcgacgacgatccggccgtgcatgacggcacgcgctacgcgctggcgagctacaccctcgacgggcgcggcctggagattctcaccgcccgttcggccgcggaggcgcgggtgctgctcgccgagcgccgcgacgtggcggtggtgctgctcgacgtggtgatggagaccgacaatgccgggctggagctggtggactacatccggcgcgagctccggcaggagaccgtgcgcatcatcctgaggaccggccagcccgggcaggcgccggagcggcggatcatcgtcgactacgacatcaacgactacaaggcgaagaccgagctgaccgccgacaagctgttcaccagcctcaccgcggccctgcgcgcccatcagcagctcaagcgcctcgacgagacccggcgcgggctcgagatcatcatcgacgccgcgccgatgctcctcgatcacaagtcgatgcagcgcttggcggagggtgtcctcacccaggtcgcctcgctcctgaacgtcgcctgcgccggcatcttggtcctgcgcgagaccgccgccccgcaggagcgcttctgcgttctggccggctccggctgttacggccactacgccggccgcgagccgtgctggccgctggaggagcgggtgcaacccctcgtcgaacgcgcctttgccgagcgccggcacagcttcggcgagcactggtcgaccctgtatctgcacacggcgagcggcagcgagatcgtcgcgctgatcgaggccgaccgccagttgtccgagaccgaccggtcgctcatcgccctgttcacgagccggctgtcgatcgccttcgacaacgtcatcctctacgagcggctacagctgaccaacgccgacctcgagcggcgggtcgtcgagcggaccgccgagctgatccgggcgaatcgccggctggacctgcagcgctcggacctgcggcgcgccaacagcctgaagaccgagatcctcggcacgatcgcgcacgatctgaagaacccgctggcggtcatcctcggccgcgccgagatgctgtccgacctgatcgacatgcagggcgaccgggagcagatgcgggcgcaggtgcagcacgtgcgcaccagcgccaaggggctgacgaccatgatcgacagcctcatggccgacgcgatgaacgacgccctcgacatcagcctgcgccgggaaccggtcgacctcgcgggcctcgcccgggaggtctgcgaggccgaccggccgctcgccgacgcgaaggaccagaccctggtctgcgaaggcccggacgagctgttcctctgcggcgacgccgagcgcctgcgcgaggccctcgacaacctcgtctcgaacgccatcaagtacagcccgacgggcggggcgatcacggtccgggtcagccgcgagccgggcccgcgcggcgcggaactgatctgcgccgtcgccgaccacgggcccggcctctcgccggaggattcggcccgcgtgttcgggcggttccagcgcctgtcggccaagcccaccggcggcgagaattcgaccggtctcgggctctcgatcgtccgtcggatcgccgagcttcacggcggccgcgccacggcggagagcgccggtcccgggctgggggcggtcttcgcgatccgcttcccggaagaatccgtcgggctgatctga

SEQ ID NO: 6219 - DNA, 765 bp, Methylobacterium sp.
atgaccataccagaccgccccgcccccggcgccgcccgcggcggtgcggcgatcccgtcgatcgccgtggtggacgacgaggcggcgacccgtgagatggtcggggattacctgaagctccacgggttctcggtggtcctgtgcgacggcgggcgctccttgcgggagcacctcgccggccacagcccggacctgatcgtgctcgacctgaacatgcccgaggaggacgggctctccatcgtgcgcgacctcaaggcccggaccgcgatcccgatcatcatgctcaccgccacggcgagcgcgatcgaccgcgtggtcgggctggagctcggggccgacgattacttgcccaagccctgcgagttgcgcgagctggtcgcccgcgtgcgctcggtcctgcgccgcgtgcagacgccgaccgccgccgcgccggccccggttcccgtgagcgggcgccgcatccggttcggcacgaaatggctggagctcgacgccctgcgcctcagcgacgatgccggtctggagcaggcgctcacccgctcggaattcgacctgctgaaggcgttcgccgacaatccgcggcgggcgctctcgcgcgagcgcctgctcgacctcgcggacgcccgcgacccggacgcgttcgaccgcgccatcgacgtacggatcaaccgcatccgcaagaaggtcgagccggaccccggcaatccgcgctacatccgcaccgtgcggggcctcggatacatattccgccccgagggagactga

SEQ ID NO: 6220 - DNA, 2328 bp, Methylobacterium sp.
atgcgggttggacccaagatcgccctggtcggtggcgtgccgatcctcgccgccggcgcgatcgccatggccggctggctcctcctggcgcaggaggagcgcgcccggcgcggcgcggtcctggccgccgacgtgtaccacgacatcgccaccgcccgcctggtccgcgaccagtacgccgccgcggacgcgcaggaccggcccgcctacgccgagcgcttcgccagcctgacggcacgggccgaggccggcctcggccggctcgccggcttcgcccgcatcgacgagcagcgcgcgcggaccgcctcggtagagcgggcgctggccggctaccggggcgagatggacgccttcgtccgccggacccgggagaatgacggcctgatccgcgagatgacgcagcgggccgacaccctgatcgacctcaccgaccgggcgcgcctgcggcagcaggcctcgaacgccgacctcgcgcgctcgacggccgagaaggtcgaggcgctgcgggtcgcccggggcctcgtcgcccgcctcaacgccctgcgagcccggagcgcggagagcgccgtgctcgccgcccaggccgcggcccggagcgatgcgcccgcggccggccccgccggagcggcggtctcggagggcgacggcccgcgcgcgcagggcctcttccgcgccgccagccgcgacctcgcggcggcgctgcgggccgacggccgggacgccgacgcggaggccctcgacgcgctcaccgccgagacggcggggtcgaagccggacctccgcgcgaggctcgacgcctggatcgagcgcaccttgaagatcgagacgtccggccaggagagcctgcacgacgaggtggcgcagctgctggcctattccgtggaggccaacgagatcgagcgcgccacccagaacgtcgcgatcagcaccctcaagctggggccgcgcaccgcgggcgccctcctgcaccgggacgcggccctcgccgagcggatgcgcgacgagggcgagcgcctcgcccggagcgccgcctcgctgccgatctcgccgctgatccaggccgagatggtccaggccctcgacgggtggcgcgggcgcctcaccaccaccatcgggggcctgcggcagcagaacgccatgatcgtcgcgatggacgggctcgccgcgacgatgatcgacagcgccaaggcgctcaacgacgccttcgtggaggacgccgaccggtccggcatcgtcatccagcggatcctgctcgccggcgcggccgggctcctgctgttcggcgcgctggtcgtgatcctcgtcgcccgctcgatcctggtgccgttgcgcgccctccagggcgacatggtcatgctgaccggtaacccggcgggggcggccgtgcggggcacggcgcgccgggacgagctcggcgacatcgcccgcgccaccgcggtgttcgtctccgagatcacacgccgggaaggcgcgctgcgccgggccaaggatcaggcggacgtcgccctggtcgagctgcgccggacccaggacaacctcgtccgggccgagaagctcgcctccctcgggcagctcgtggccggggtcgcccacgagatcaacacgccgctgggcatcgcgctcaccaccgggacgctcatgagcgacgaggcgcgggccttccgcaccggcctgtctgccggcacgctgtcgcggtcccggctgaaccacttcgtcgaccgggtcgaggagggcgccaccctgctctgcacgaatctcacccgggccgccgacctcgtccagggcttcaagcaggtcgcggtggaccgcgtcagcgacgagagccgcagcgtcgtgctggcgacctggctcgacgacctgctggcgagcctcaggccgatgctgcgcaagggcggccatacggtggagcgcgcctgccccgcggacctcgtcatcgacaccaatcccggcgtgctcgcgcagatcgtgaccaacctcatcgcgaacgcggtcgtgcacgggttccgggcgggcgagccgggccggatcaccgtggatgtgtcggagcgggagggcggcctcgtgcggatggaggtccgcgacaccggtcagggcatcccgccggagcacctcgaccggatcttcgacccgttcttcacgacggcccgcagcgccggcagcacggggctcggcatgcacatcgtccacaatctcgtgaccgccaagctcggcggccgcatcgcggtcagcagcgagcccggccaggggaccgtcgtgcaggtcgactttcccgcccagggtgctggagcggccgcccggccgcggaccggcgcgatccggacgccgtga

SEQ ID NO: 6221 - DNA, 399 bp, Methylobacterium sp.
atgctgagcgacgcgcaatgggctgttctggagccactggtcgaggcttgtcggccgaaggcgaagacgccgccgcaagacctgcggcgcacgctctcagcaatcctgtggcgccatcagaacggcgccaagtggcgcgcaatcccgcaagacctcgggccgtggtggcgggccgcacagatcttcatccggtggtcgcgcggcggggtgtgggagcgtctacttgctctcgtgcaggagcgcggcgttcagctgggcatggtgttcctcgatggcaccaatatgcgtgcgcatcagaaggcggctggagccgctaaaaggggggatctgcagccgagcgagacgatcgtgaagctgttggccgatcacgtggcggctatgggaccaaggcttgcgtga

SEQ ID NO: 6222 - DNA, 1827 bp, Methylobacterium sp.
gtgagcacgatcctggtcttcggcgggtacggcggcttcggggctcgcctgtcgcggcggctcgcggaggccggtcacgacgtggtcgtcgccggccgccgcctggcgcgggccgaggcgttctgcgcggccaatcctccgtgccgtccccttcaggccgaccgcaacggtgccgtcgcgccgctgctggaacgcgtccgtcccgacctcgtgatcgatgcggccggccccttccagggcagcggctacgctctgccccgggcctgtatcgccgcggcgatcccgtacctcgatctcgcggacggccgggcgttcgtgaccggcatcggccagctcgacgccgccgcacgcgcggccggcgtcgcgatcctctccggtgcatcgagcgtccccgccctgtccggtgccgtcgcccggcacttggcgcaggggatggaggcggtcaccgccgtggagatcgcgatcagcgcctcgaaccgcgcgaccgccgggacgtcggtcgccgcggccatcctgagctacgtgggccggccgatccggctctggcgcggacagcgctggtcggcggctgttggctggcaggcgttgcggcgcgagcgcttcgccctgtccgacggcgcgtccctcggccgccgctggctggccctggcggacgtcccggacctcgacctcctgcccgatcggcttcccggccggccggcggtcagcttcagggccgggaccgaactcgcggtgcagacgatcggcctctggtgcgcgagctggccggtgcgctggggctggatcccctccctgcaggggctcgcgcgcgggcttctcctggcgcagcggctgaccgcgcgctggggctcggatcggtccggcatggtcgtccggatgttcggcaccgccgcagggcgccgcgtcgaacggcgctggaccctcctggcggccgacggtcatggcccggagatcccggtgctgccggcggcgatcctggccgagcggatcctggacggtgcgatcgcgcccggggcgcgcgacgccgggaccgcgctcgacctgtccgatttcgagccgagcttcgcgcgcctgtcgatccgccacgacgtgcgggagtcgggacaggccgatgcgctctacgcgcgcgtcctgggtccgcgcttcgccgaactcgcgccgcgcgtcgcggccctgcacggcgtgctgcgcgaggcgggggcgcacggccgcgccgtcgtgcgacggggccgccaccctgtcgcgcgcggcctcgcggcgctcctcggattgccggtcgcgggcgcgcacgatctccacgtcggcttcagcgagacgcgcggggtggagcgctggacgcgcgcgttctccggtcgccggttcacgagcgcgttctccgaagagcgcggctgcgtcgtggagcggttcggcccgctccgcttcaggttcgacctcgcgcccgagggcggcggcctgcgcatggtgctgcgcggctggtccgttgcgcggctgcccctgccgctggcgctcgcaccccgtaccgccgcccgcgagtgggaggaggcggggttgttccgcttcgacgtctcgatcgtcctgccacgcgtggggctggtggtgcattaccgcggctggctcgacacggacgatcgcgcgggccgtcgatccggcttcgtcccgggcgcagagccggccgcgccgcctcggagcggacatccggcacagggcccatcccggccacccggcggggatcccgggccggtaacggccctgccgatcccgtcatcgcgcgcccacgccccgtcccgcagcgggcacggtcccgagccgcgtcacgggcgggtctga

SEQ ID NO: 6223 - DNA, 252 bp, Methylobacterium sp.
gtggatctcgccgcctcgacgctttcagcccagcgccggagcctggatcggcaattcggtgccatcttggccacgccgagccgctatgacctgacccgcgagctgcaggccacgatcagccgcgcccgcgatcagctcctggtgtttctcgcctatcccggaaaggtcgggccgaccgacaacagttcggagcggctgcttcgtccagccgtcgtgcaacggaaggtgaccaacggtgaccgggccatgtga

SEQ ID NO: 6224 - DNA, 249 bp, Methylobacterium sp.
ttgcaggccaagctcagccgctcccgcgatcagcccctcgtcttcctcgcctatcctggaaaggtcgagccgactaacaacagctccgaggggctcctgcgtccggctgtcgtccagcggaaaccgaccaacggctatcgcgacatgtggccagctgagggcgaggccgccatccgcaccgttgtcgacaccgcgcgcctgagcggtgccaatccattcggcttcatcctcaaaaccgtcggcgcctga

SEQ ID NO: 6225 - DNA, 1797 bp, Methylobacterium sp.
atgtctctgtcgtctccccggaaggcggacgcggtccgtcgcgtcctggccttcgtcgtccgcagctggcgcaggcgctggcccctcgtcgccggtctcaccggcgcgatcacgctcgccaccctggcggaggtgctgctgccgctcttcgcgggccgcttggtcgacgcgctctccgggagcgaccgacgcgcggcgctggacgcggcctggccggccttcctggcgatgaccgggctcggcctcgccaccgcgctgctgcggcacgtcgcctggagcctcgtggtgccgctctccctgcgcaccatgagcgacatcgtcggcaacggcttcgcccgggtccagcgcttctcgacggagtggcacgccaacaccttctcgggctcgaccgtccggaagatctcccgcggcatgtgggcgatcgacgggctcaacgacacgctgctgctgtcgctcctgcccgcgctcgtcgtcctcgtgggcacggccctggtcctcggcctgcactggccggccctcggcgcgacggtcgcgatcggcgcgggcgcctatgtcggcgcgaccgcgctgctcgcgacccgcgtcatcgcgcccgcggccgcgctctcgaacgccctcgacacccgcctcggcggcgcgctgagcgacgcgatcggcaacaacgccgtcgtcaaggccttcggcgcggaggcgcgggaggaggcgcggctcggccggctgctggcgaagtggcagcggcggacccggcgcacgtggatgatcgtcacctggggcggcaccggcctgctcgggctgctgctcgtcctgcgcaccgccatcgtcgccatcgccctgtggctgtggtggcgggagcgggcgagcccgggcgacgtcgcctacgtcctgaccgcgaccttcgtggtgcacggctacctccgcgacatcggcggccacatcaaccacctgcagcgggccatcaacgagatggaggagctggtcgccctggaggccgaacccgtcggcgtcgccgaccggcccggcgcggtcccgctcgcggtcacgggcggggcgatccggttcgagaccgtgcgcttccactacggcgaccacacgcggcccctctacgacgggctgaccgtgacgattccggccggccagcgcgtcgggctggtcgggctggtcgggcgctcgggctccggcaagacgaccttcgtcaagctgatccagcggctctacgacgtgtcgggcgggcgcgtgacgatcgacgggcaggacgtggcgtcggcgagccaggcgagcctgcgcgcgcaggtcgccatcgtgccccaggagccggtgctgttccaccgctccctggccgagaacatcgcctacgcccggcccggcgcctcggcgcaggagatcgagcgggcggcgcgcctcgccaacgcgcacgacttcatcgcgcggctgccgaagggctacgcgacgctggtgggcgagcgcggggtcaagctgtcgggcggcgagcgccagcgggtggcgctcgcccgcgccttcctggcggacgcgccgatcctgatcctcgacgaggcgacctcgagcctggattccgagtcggaagctctggtgcaggaggccatggcgcggctgatgcgcgggcgaaccgccatcgtcatcgcccaccgcctgtccacggtgcgggccctcgaccggatcctcgtcttcgaccgcggtcgcatcgtcgaggacgggcctcacgccgccctgctgcgccgcccgaacggggcgtaccgcgccctgttcgagcggcaagccgacctcgcggagagcgcgtga

SEQ ID NO: 6226 - DNA, 222 bp, Methylobacterium sp.
atgttcgcgattacgggtcacggccaagcttacgcccagccgcggccgccggacggcaatctcgacttcctctgcaacttcctcggcgactgcccggcgcgggtcgcgccgggcggccccgatcgcgacgtccgcccgttcagcaacagcctcggccggccctgcgcgtggcgggaccgcccgaccccggagggcgtccgccgggtccgcgtctgctggtga

SEQ ID NO: 6227 - DNA, 1416 bp, Methylobacterium sp.
atgatgcggttcaccttccggcgcgcggccgcactgctcggcctcggcgtggcagccgtcccgctgtcgagcctggcgatcccggtgtcggcgaccccggcacgggcgcaggcgaccaaggtggagggaccggccctcccctacgcctcgacgcccgacctgcgggccgccacggtcgcgcgggcggtgcgcgaccagcgcgccacgaacccgatcgccgcggccgagacggcgcgagagatggcccagcacgattacgacaccatcttccgcggcttcctcgacgggacgccgctgcggccggacgatgcgggcgacgtgctcaccgccttcatcgccctgcaatggatggtcgccaacgacgcgacggtcgagccgagcgcggcggccctgcgggcgatccggacccggttcgtggcgccgatggcggaacggccgcccctgtcccagccggtcacgcgggcagccttcgccgagcaggtcaagctgcgcgccgttctccaccatgccggctggcaggcggccaagcggctcggcgtgctgccgcgtttcctggcgggcctgtccaacgagttcatcccggtcgccacgctgcggaatctggcgctgaccgaggacgggctggtgccgaaggaccgggccggacgcgcggccccgaagccgccaccggtcgcggagagcccgtccgtgccggacgcgcggccggctccctccccggctccgtccgccccggacgcggccggtcccccgcgccacgccgccaactgggatcaggtcgagggcgtgtacttccgttcgaccaccgggttcggcgtcggcggtctcatgacgatcgatttcgagccgctgatcttcctgcgcgacggaacctactacgaggtcgccgacaccgcgctcgaagacgtggacctcgccgccgagcgggccgcacggcccaagcgattcgggcggtggagcgccaagggcgccggcttcgtcctgaccgacgcgcgcggccgcgcgaacgactacgccctcggcgacggcagcttcttccgggccttcccggccggctctggcgagcgggtggcgcgggcgtaccgaaggctgtcgggcggcggcaacacagccctgggcggcgacgtcgcgatcgccgtcgagagccgctacgacttccacgcggacgggagttacggccgcggcggctcggtcggcgcgacgaattcgggggcgagcaccggcgtcggcacggcgatcgcccgtcggcgcgcgccggagggcgggcgctacgccctcgatcgccacacgctcacgctgaccgcggcggatggccggacccggcgcctgttcttcgcctacggctcgcagaaggatccccccgagatcgaccgcgagatgatcttcgtgggcgacgacgtcttcagcccggcggactga

SEQ ID NO: 6228 - DNA, 1365 bp, Methylobacterium sp.
atgaccgtcacgcgcgccgcgatcccgagcccgtcccccgagcgaagaaggtccgatcgggaccggtcgggctccgccgacctgacgaactggcgcgcgtacgccgtcgccggctacgcgctcatcgtcgcgacgttcggggtggtcggcacctgggccgccgtcgcgcgcctcgaccgggcggtcatcagtcccggggtggtggtcgcggaaggcagccgcaaagtggtgcagcatctcgaaggcggcatcgtccaggaggtgctggtccgggacggccaggcggttcgcgcgggcgacgtcctgctacgcatcgatcccgtgcaatcgcgagccagcaacgatctgctccgcggccagctcgacggggccctgatcctcgaagcgcgcctccgcgcggagcagggccaggcgcaggatctgctcctgccgccggagatcgcggagcggcgcgccgagccggccgtcgccggcctgatcgacgaccaggccagccagctgtcggagcgccgcgcgtccttccaggcgcagctcggcctcatcgaggcgcgggtcacgcagctgaagacggagatttccgggctggcggtcgagaaggcctcgggcgagcagcaggtcgcgctgatccagcaggagctggagggcctgcgcggcctccaggagaagaacctcatcccgctctcgcgcgttctgatcatggagcgcgagcacgcgcgcctccgaggcgtgatcggacggtccgtggcagagaccgccaaggcgcagaacgacatcaacgaggcggggatgcagaccgcgcagctcaagcagaagctgcaggaatcgctgaccgcgcagctcctcgacacgcgccagaagatcgctgaactgcgcgagaagctcatcgtggcccgggatgttctccgtcggcacgaggtccgggcgtcgcaccagggcgtcatccagggattgaaggtctacacgatcggccaggtggtccgctcgggcgagccgctgatggagatcgttccgacgaacgacaggctcgtgatcagcgtgcagttcgcgccgaacgatctcgaggcggttcatgccggcatgcgggccgaggtgaagtttccggcttttcagacgcgccgcatgtcggcgatcttcgggacgttgacgatggtctcccgcgaccgcctgatcgacgacggcaccaagcaggcctatttcgccggcaccgtggagatcgacgaccatcaactcccggacgacgtacgaccacgcctcctggcgggcctgcccgccgaggtcgtcgtctcggccggcgagcgcacggcgctcgactatctggtggcgccgttcttcgatgctctgggacgcagtttccatgaacgatag

SEQ ID NO: 6229 - DNA, 327 bp, Methylobacterium sp.
gtgtatgcccatcagcaacgcctggactccgaggaggtgctggagctgcgtcgggaggggggacggtatctgaaggaactgcgggaggcgcgcggcctgtcgcaacgacagctcgcagctcttgtcggtgcggattactacaccttcatctcgcagctggagaccgggcgcggtcgtattcctccggatcggtaccgcgcgtgggccgaggcgctggcgatcgagccgagagcgttcgtccggaacgtgatgcgcttctacgacccgatcacccacgagatcctgttcggcgatcggagcgcggagcctgagggcaacgaggcgtag

SEQ ID NO: 6230 - DNA, 870 bp, Methylobacterium sp.
atgataggcaacccgaacatcgagctgctgcgctcgttcctggccgtcgtcgagagccgcagcttcaccgccgcggcgcaggctctcggtctgcggcaatccacggtgagcgggcacatcgcccggctagagcaggcgctcggtcgcgcgctcctgacgcgggacacccaccgggtcgcgcccacgccggacggtcaggccatgatcggcttcgcccgcgacgtggtggacgcgcaggaccggctgcgcgccttcttctcgccggaaggcctgcgcggccgcatccggctcggcgtctccgaggactacaccctgtcgaccctggcacaggtcctggcccgcttcgccgatcggcacgacgcggtcgatctgcagatcacggtcgggctgagccgcgccctctaccagggctacgatgcgggcgagctcgacgtgatcttctgcaagcggcggcgcggcgacccgcgcgggaccttggcctgggcggaggatctgatctggacgggccggcccggcctcgtgccggatccggccaagcccttgcccctcgtgctctacccgccaccgtcgatgacccgcaccttggcgctcgacgccctcgaggcagtgggccggtcctggcgggtggcctgcaccagcggaagcctgatggggctgcgggccgccgtcgaggcgggcctgggcatcgcgccgcattcggccaagatcctgccgccgggcctcgccgcgatctccgaggcggccggcctgccgccgctcggcgcggtcgagttcgtcgtgctcggcccgggtcgccaccacgcggcggcgaccgcgctgcaggagacgatcctggcgagcacgggcgagcttcagggcgccgcgcgctag

SEQ ID NO: 6231 - DNA, 1764 bp, Methylobacterium sp.
atgggcgatccttcgctgcaatcggcattgaccatcggcctgcgctcgctccggccggtcctggcgaccgccgtggtgttcgggctcttcatcaatctgctgctgttcgtcagcccgctctacatgctccagatctacgaccgcgtgatacccagccggagtgagacgaccctggcggggatcacgctgatcgctgcgttcggcctggccgtctacgcgatgctggagatgctgcgcgcccgcctcctggtgcgcggcggtgtggtgttcgatcagaaaatcgccacgccgatcttcgatgccgcccatcgcggcaccttgctcaggcccggcgcgcagcacgatacggcgctgcgcgacgtggacgtcctgcgggagttcctgaccggcgccggcatgctggcgttctgcgatctgccctggataccgatcttcctgctcgcctgcttcatcctccatccctggttcggctggatggcgctggtgggcggcggcacgatcctcggcctcacgctgctcaacgaggtcgccacccgtcggacgctcgacgccgccagtcaggcctcgcgcgaagcggggcagagcgcagccacggtctttcggaatggggaggtgctgcaggccatgggcatggtcgcgtccatgcgcgggctctgggggcgccgccacgacgacgtcctgctcctccaggcgcgggccagcgatcgcgcgggcctgatcgtcgcggccacgaagttcgtccgcatgctgctgcagaccctggtgctgggcatcggcgcgtatctggcgattcaccgcgagatctcggccgggtcgatgatcgccgcgtccatcatcatcggccgcaccctcgcgccgatcgaggcggtcgtcggcaactggaaggggttcacggcggcgcgggcgagctaccggcgattggtcgatctcgtggccgtcgccggctcggagacgcgccgcctcgtcctgccgcggccgcgcggcctgatcgaggccgaagacatctcggtggcggcccccggcgcgacgcgccccatcctcaaggctgtgagcgtccggctcgagcccggcagcgtcgtggggatcatcggcccgagtgccgccggcaaatcgacgctcgttcgcgcgctcaccggggtctggcccttgctggaaggcacggtgcgcatcgacggggccgacctgaaccactgggacagggccctgctcgggcagcatgttggttatctgcctcaggacgtcgaactgttcgacgggaccgtcgcgcagaacatcgcgcgcttcgccgaccgggacgacgcgcgcgtcatcgaggttgcccaacgggctggctgtcacgcgctgatccagtcgcttccggagggctacaatacggtcatcggtcgggggggacacgggctgtcaggcggtcagcggcagcgcatcgctctggcccgcgcgctctacggcgagccgagcctggtcgtgctcgacgagcccaatgcgagtctcgaccagcccggcgaggcggcgctgatgcgcgccgttgcggacctgaagcgatccgggacgacggtggtgctggtgacccacaaggtgagcctgctggaggaggccgaccgtatcctgctcatgagcgagggccgcgtgcagctctccggcacgcccgagcaggttctcgcccacgtcaccggccagcggccggtcccgaccctggtgccgcccgtcggccccgcggcatcccagagccgccgcagctccgacgaacagcggagcgcgggataa

SEQ ID NO: 6232 - DNA, 372 bp, Methylobacterium sp.
gtgatcgctgacggcgccggccgcgcgatcgcctttcggatcgcaccggggcaggcccatgaactgccccacgcgctgcccttactcggtcacttgccgggcattccccaatgggtcgtggcggatcggggctactccagccaacgcttccggcagcagttgcgagaggtcggggcaacacctgctatcccgtccaagagtaacgaggcccccgagcgcttcccggactggatctacaccaaccgcaacgtcgtcgagcggctctgggcacggctcaaggagtggcgggcggttgccacgcgctatgaaaaaaccgcctccagcttcaccggagtcctctgcctcgccgcagccctcgatcacctcaggtga

SEQ ID NO: 6233 - DNA, 372 bp, Methylobacterium sp.
atgggggcgctcctcgacccggtcctcggccccgccttcgcgtcgggccggatcgtcgacgggatcctgctgctcgtcgccctggaggcgctcgccctcgcgtggctcgcccgccggggcggcccgccgctgccgtccctgctggccaacctcgcctccggcgccgcgctgatgctggccctgcgggcggcgctcgtgggggccggctgggtcgcggtcgccgggtggatgctcgccgggctcgtcgcccatctcgccgacctcggcctgcgggtccgggcggccacggcacaacgccgcagcgcggcgccggccggaacaacgcccgcgacggccgcgttcacgcgcgtcacaagtttcaaacagctctaa

SEQ ID NO: 6234 - DNA, 222 bp, Methylobacterium sp.
atgccggattatcgcctgcgcggggcggtccgtggcgaggatggtgagatcggcgcgccgcgcgtcgacgaggtgctcacggccgcggacgcgaaggaggcggtgcgcctcgccaacagccgctcgctgacgatcgaggacgacgcggtgaacgccctgtggctggtcgacgcccacggtaccctgctctggtccctgcgccgggccgaccgggaatcctga

SEQ ID NO: 6235 - DNA, 324 bp, Methylobacterium sp.
gtgaggatcctgttcgtctgcggccgggcgcgtgcccgcagcccgaccgcggaacagatcttcgcgcggctgcccggcatcgagaccgccagcgcgggggtgtcacccgacgccgacgagccggtggacgccgatcatctcgcctgggcggagatcgtcgtcgtcatggagcgcgcgcaccggcgcaagctgatgcgccgcttcggggccgccctgcgcgggacccgcctcgtctgcctcgacatccccgacgtgcacgacttcatggcgccggcgctggtggcgctgctcgacgcgcgcgccggccgcttcctgccgcgctga

SEQ ID NO: 6236 - DNA, 366 bp, Methylobacterium sp.
atgcacgacactgcgccgaagcatgaggatcccggccccggttacacgcaagaggactgggacgaggtatccaacaaccctaagattacggccgaagagatggccgcgatgcgtcccgcccgtgaggtgccggaggtctatggcctgctgccgaagcggggacggccgaagctgccgaacgccaaggtcaacctcaccctgcggatcgatcctcaagtgctagaaggctaccgcgccacgggtgatggctggcaggtccgcatgcacgaggatttgcaggccgggctagaccggcgagtgatggaaattttggaccgcgccaagcgcatggtcccgctctcgcgtcctggcaaacagaccgcgtga

SEQ ID NO: 6237 - DNA, 2676 bp, Methylobacterium sp.
atggaccaagcgaaaccccggcgcgacacgacgatcgcgcgggcgggtgcggggcggacgggctacgtcacggtccggggcgcgcgggagcacaacctgcgcgacatcgacgtggagatgccgcgcgacgcgctcgttgtgttcacgggcgtctccggatccggcaagtcctcgctggccttcggcaccctctacgcggaggcgcagcgccgctacttcgaatcggtcgcgccctacgcgcggcggatgatcgaccaggtcggcgtccccgacgtcgacgcgatcgagggcctcccgcccgctgtcgcgctccagcagcagcgcggcacgccgagcgcgcgctcgtcggtcggcagcgtcacgaccctgtcgagcctcgtgcgcctgatgtactcgcgcgccggcacctacccgcccggccagccgatgctctacgccgaggatttctcgcccaacacgccgcagggcgcctgcccgtcctgcggcggcctcgggcgggtctaccaggcgacggaagcctcgatggtgccggacccgtcccttacgatccgcgagcgggccgtcgcggcctggccgcaggcctggggcggccagaacctgcgggacatccttgtcagccggggcgtcgacgtcgacacgccctggaaagcgctgccccggaggctccgggactggatccttttcacggacgagcagccgcaggagccggtctatgccggcctcaccccggagcagacgcagctcgcccgccgccgcggcctggagccgagttacatgggcaccttcaccagcgtccgccgccacgtgctcggcaccttcaccaactcgcagagcgcgctgatgcgccgccgcgccgcgcgctacctcgtgagcgaggattgcccggcctgccacggcaagcggctgaagcccgaggcgctttcggtcacgttcgccgggctggatatcggcgcgctctcgcgcatgccgctctcggcgctcgccgaggccctgaggccggcggccgaggaccggcagcccgaggccgacgccgcacccgccaccctcgaccgcgcggtgggccggaaggaccgcgccgagcgtgccgcgtccggtggctcggcccatgcgggcgcgccggacgtgcgcgtcacgccgaacctgtcgatcgagaagcgcctcgccgcccagcgcctggcctcggacctcatcgcgcgcatcgggacgctcgcggatctgggcctgggctacctctcgctggaccgtgtcaccacgaccctgtcgtcgggtgagctgcagcgcctccgcatcgcgacccagctgcgctcgcagctgttcggcgtcgtctacgtgctcgacgagcccacggccggtctgcaccccgccgacggggatgccatgcacgacgcgctggccgggctgctcgccgcgggcaattcgctcttcgtcgtcgagcacgacatcggcaccatgcgccgcgccgactggctggtcgacgtcgggccggaagcgggcgagaacggcggcacgatcctctatagcgggccgccggagggcctgcgtgacgtcgcggcgtcccggacgcggctctacctgttcgggctggtggaggcgcccccgcggccgtcgcgggagcccgcggggtggctgcgcctcgaaggcatcgttcgcaacaacctgaagggcgtctcggtccccttcccgatcgggtgtctcaccaccgtgaccggcgtctcgggctccgggaagtcgagcttggtcagtcaggccctgctcgagctggtcggcgagcgtctcggccggccggtgaagaccgaggacgagccggacgatcccctggacgaggtgccgggcccgtcggagggccgcatcgccggcggcatggacgggatcgggcgcctggtgcaggtcgaccagaagcccatcgggcgcacgccgcgctcgaacctcgccacctacacgggcctgttcgacgccgtccgcaagctgttcgccgcgaccccggaggctcggcggcgccgctacgatgcgggccgcttctccttcaatgtggccaaggggcgctgcccggcctgcgagggcgagggcttcgtcagcgtcgagttgctcttcatgccgagcgtctacgccccctgcccgacctgccacggcatgcgctacgcgccggagacgctggcggtgacgtggaacgggctgagcatcgcggacgtgctcgcgctgaccgtcgaccgggcctgcgcggccttcgcggacgagccgtccgtgctgcggccgctcaccgtgctgcgcgatctcggcctcggctacctgcggctcggccagccggcgaccgaactctccggtggagaggcccagcgcatcaagctcgccaccgagctgcagcgcgggcagcgcggcggcacgctctacgtcctcgacgagccgacgaccggcctgcacccgaccgacgtcgaccgcctcatggtccagctcaacggtctggtcgacgcgggcaacaccgtcgtcatggccgagcacgacatgcgcgtcgtcgcccgggccgaccacgtgatcgacatgggccccggcggcggcgaccagggcggcaccgtcgtggccgccggccggcccgagatcgtcgccgcggccgcggccggccgcacggcgccctatctgcgcgaggaattcgcgacggtccgcacgcggccgccgggctga

SEQ ID NO: 6238 - DNA, 261 bp, Methylobacterium sp.
atgcatcagtttatcggcctatttgccatcttcgtcacgctggccggcgtgctccacacctggggtgcgccgcgctgggcgatcgccggcctctgcctgatcggtctcctcggcgtgtcggccaccgtcgtcggcattcagccaaaagtggccccgtcgccggtgtcccaggtgcagtcgctcaacgacgcgatgcagcccgtcttcgaaggcgtctgggacccgctgcggcccggccggctgctgacgacgtcccgctag

SEQ ID NO: 6239 - DNA, 1083 bp, Methylobacterium sp.
gtgaaggtcctggcaagcggcgggcgctcgtctgccgcgacggcccgtgccgtcggacgagcccgcccgatagtcgccaaaccccgcttcgccgccgcgttcctgcgcgctggcctgctcgctggcctgctcacgggcacggcgcgcgccaacgacagcgcggccgaactcgatgccggcggcctcgtcctgcggcgcgagcccgggatcgcgctggtgagcgaggacctgtcgatcgcccgcgaccggatcgacgtgtcctacctgttccgcaatcaggttcaggaggcgcgcacggtccggatcgccttcccgctgccgccgatcgacgggcgggaactcagcttctcggccctggcgctgccccggcccgacagcccgaacttcgtcggcttcaccgtcacggtggacggcaagcccctcgagcccgagctggaggagcgcgccttcgtgggcgagcgcgaggtgacggacctgctgcgccgtcacggcctgccgctgaacccgctgcgcttcgaggcgatcagcgcggcggccaagcggatcggcgcgcccgaatgggccgcgctggtcaaggccgggctcttccccgacgtccccgacacgccggaccggatgaccgaggggctgtggcgcggcgaggccaagttccactggctccagaccttcccgcccgggcaggaggtccgcatcgcgcacagctacgcgccggtgaccggcttccacctgctcgagccgaaggcggcgtcccgcgcggcctaccgggcgacctactgcctggacgaggcggggctcgcggcgatccggcgcctgcacgcgaaggcgccggatcccggcggcaccctgcgggcgaccgtggtgccctacatcgtcaccacggcgcgcaactgggccgcgccgatcgggcgcttcaccctgacggtcgacaagggcagcccggaggcggtcgtcagcttctgccgcacggacatccggaagaccgggccgaccacgttccgctgggaggcccgggactacgtgcccgaccaggacctgcgcgtgctgatcgtccagccggcttcggcgaccccggggacgcgttag

SEQ ID NO: 6240 - DNA, 816 bp, Methylobacterium sp.
atgcggacccacgatctgccgcgcgccgcgcgggcgcgcctcggccgctccggcctgttgctcgccgtcggcctcgccctcgcgctggccgcgcccgcgcgggcgaacccgctcaccgaggtgccgggtgcccgggcagcgcagccggacgaagcgcctccgccgcgggacccggccgcggagcgggcggaggccgaggaggcgcgggccgcgaacccgggtccgaccgcgatcatccggtcgctcgcgccgttcgccgacggcaatccgggagctcccgcgcggccgctggcggtcagccccgacgacggcggcccggcggtccgcgtcgttcccgcccggtcgatcgatctcaccgtgttcttcgcctacgacagcgcgcgcctgacccccgaagcgcgcatccagctcgaaccgctcggcgaggccctgcgcgccgagccgctcgcgggccacggattcctgatcgccggccacaccgacgccgccggcggccgcgcctacaaccgccgcctctccctggcccgggcccgggccgtgaaggcgcatctcgtcgagacctacggcatcgccccggagcgcctgcgcgtccacggctggggacccgcgcggccgaaggatcccgacgcacccctgtcacgggtgaaccgcagggtggaggtcagcctgatcgcgccggcccgcagcggtgccctccgcttcgtcctgccggtcgcggatggtccgtgcagcgacctggccgatccgcgcctgcggacggatctcgacctcgacgatttccgcgcggcgccgaccccacgtccctgcaccgaatga

SEQ ID NO: 6241 - DNA, 1407 bp, Methylobacterium sp.
atggacatcaggacgcgccgactgctgacggcccctctcctgccgacactggcccggatggccgtgccgaatgtcgcggtcatggtcgtccagacctccatcggcctgatcgagacctacttcgtcgccgagctcggcaccgacgccctcgccggaatggcgctcgtcttcccggtggtcatgctcgtccagatgctgtccgcgggcggcatgggcggcggcatccagtcggcggtctcgcgcaccctgggcggcggtcggcaggacgcggcgggtctgctcgcgtggcacgccgccgccatcggcctcggcctcggtgcggtgaccagcctgctcgccttgaccctgggaccgcgcctctacgcggcgatgggcggtacgggtgcctcgctccgggccgcgacggcctacgcgaccgtcgtgttcggcgcggcgatcctgatctggctgttcaacgcgctggcggcggtgatccgcgggaccggcaacatggcgctcccggccggcgtcacctgcgccggggccgtcctgctgatcccgctctcgcccgcgctgatcttcgggtgggggccgttcccccgcctcggggtcgtgggcggcggtgtcgccttcgccgcctactacgccgtcggcgccaccgtcttcgccgcctacatctggtccggccgaggtgtcctgcgcccgagccctcgcccgccgaggctgacctgggcgccgtcccgcgagatcctgcacgtcggcctgctctccggcatcgccagcatgacctccaacgtcaccgtcatcgccgcgaccggcttcgtcgggacggcgggaccggcggcggtggcgggatacgggaccggcgcgaggcttgagtacctgctggtccccctggtgttcgggctcggctcgccgatcgccgccctcgtcgggaccgccctcggggccgggatgcacgcacgcgcccgtcaggccgcgctgaccggcgccctcgtggcgggtgtcctgacggaggccatcggcctcacggccgccctccatcctgccgggtggctcggcctgttcgggcacgatccggcgatgctcgccaccggctcgacctacctgcgcgtcgtcggaccgttctacggattcttcggggccggccttgccctctacttcgcggcccagggggccgggcgtgtcggctggccgctcgccgcgagcgtccttcggatggccgtggccctggggggagcctggatcgcggcgaggctcgggctgggcttggtcgggatgttcgtcgccctctcggccggcttcgtcgccatgggcctcgtcaacgcggccgccttcgcgaccggccggatgttcctggcggagcccgcgccgagcacatcccctgttccgccaagccttacggcggccgccaattcgggacgctga

SEQ ID NO: 6242 - DNA, 219 bp, Methylobacterium sp.
atgtccgcacccgttatcgtgaccacgctgttcgtcggcggcctcatggcgatcccgacgctcgggaaatgggcgacgcaggtcacagaggtgctcgcctccctgctggcgatcgccaccgtgctggtcgcgatcctgtatctctgcgatcgctggcccgactacttcgccaatccgcggatgccggtcggcctgacggcgacgcccttcgccgactga

SEQ ID NO: 6243 - DNA, 129 bp, Methylobacterium sp.
atgaaatccatgctccgtgtgaccacggccctcgcgggcgtcgccttcgcgggttcggccttcgccgccgaccttccgcgccgcgccgccccgccgccggtgttcacccccgtcccggtcttcacctgg

SEQ ID NO: 6244 - DNA, 1965 bp, Methylobacterium sp.
atgcggaccggttggattcttgccggcgcgctcggctgcgcgctcggcgtcacgccgacccaggcgcggatcacccagatcgaggtcgtcaccgtcgagccgttcgccgacggcgctgaattcggacctgccggcgcgtacgagcgggtcatcggtgccgcccgcggcgagctcgatccggcagatccggccaatgccggcatcgtcgacatcgcgctggcgccgcgcaatgcgcgcggcatggtcgaatacaggaccgacctgttcatcctgcgcccgaaggaccctgcccgcggcagcggtacgctgctgttcgaggtgctgaaccgcggccgcaagttcctcttcaactgggtgctggacgcgccggcccaaggggcccaggctgtcaacgatccgcgcaacgccgtcgacgccggaaccggcctcgtcctgcgtcgcggcgacacgatcgtctggtcgggctgggaggcggacgcgctgcgccagcagggcggcatggccatcgacgtgccggtcgcctccaggaacggcaagccgatcgtggagatcgtgcgcgacgaactcgtgagcgcgacgcgcgggccgccagaggcgcccttctatctcaccttcaaggcggccagccaggacaaggccggcacgcagctgaccgtgcgccgccgggaggccgacccgccgcggccggttccggaggaggcgtggcactacgcgacgccgcggcaactcgagctcctgcccaagggaacgaagccgctgccgggctcgatctaccagttcacctaccgcgccaccgagccgaaggtgctcggcatcggcttcgccgcgacgcgcgacgtggtcgcctacctgcgcggcgatgccgccggtggcgccaacccggcgggcggagcgatccggcacgctgtcgcgctcggcatctcccagagcgggcggtacctgcgcgacttcatcgcccagggcttcaatcgcgacgaggccgggcgccgggtcttcgacggcgtgctgtcgcacatcgcggggatcggcggcgtcttcctgaacgcgcgcttcggccaaccgtcccgcaccaacacgcagcacgaggaccatctctatccggagaatgccttcccgttctccgcggcggttcagcacgacccggtgacgggacggaacggcgcactgctgcgcgacgacggcttcgacccgctgctgatcgaggtgaacaccggcaccgagtactggcagaagggtgcctcgctgctggcgacggatcccctgggccgcaccgacctggccttgcccgacacgacacgcgtctacttggtctcgagcggcttccactacgggcgcgccggactgacctcgagcagaggcccctgcgccaacatgcgcagcaccctcaatccggcgcctgccctccgggcgcttctcgtcgcactcgaggactgggtgacgctcggcacgcccccgcccgacagccagatcccgcgcctgtcggacggcacgctggtggagccggccgaggccggctatcccttcatcgtcggtgtgccggtcccgaccgccccgaacacgatcgcccgcttcagcacctacgtcgatcccaagcccgagagcgggccgcagtaccggccgctcgtgccccgcgtcgacgcggatggcaacgacgtggcaggcattcgcctgccggccgtcgccgcaccgcgcgcgaccttcacgggctggaatctctacgccgatcccttcccggcgggggccctctgcgaccgggaggggagccagcttccgttcgcccggacccgggcggagcgggaggccaacggggatccgcggccctcgctggaggagcgctacccggatccggatgcctacctggctgccgtgaccaagtccgtggacgcgctggttcgggatcgcctgctcctgcgcgaggacggcgaccgccttgtccaggcggcgcggcaggagtccgcgccatga

SEQ ID NO: 6245 - DNA, 1470 bp, Methylobacterium sp.
atgcccgctgtcggaacgttcagggtctgcgcgccgggacggccgccgttcgcggcggccgtggcagagggcgtggccgaggcggtcgcgctgccatccgtgctcgtcacgatgctgggcagcctgatcgaggcctggccccggcagatctacacacaacccctggtgaccacccgcttcctcggccagcggaccacctacgtctgcgatcccggccacatccgcagcctgatggtcgaccaggccgaggcgctggagcgggaacccttcatgctgcgggcgctggccccggccctcggcgcgggggtcctcaccgcggacggggaccactggcggcgtcagcgcaggaccgcgaccccgatgttccgcccggaccgggtccggagcttcgtgccggccatggcccgggccgccgcggcgacgcgggcgcgctggcgcgacgccgatcccgccgggagcgagcgggacatcctgcgcgagatgatgcgcacgacgttcgacgtcatcgtcgccacgatggtgtcgggcgatccctacctggaggtcgggcccttcggggccgcgatggacgcctatctcggccagaccagctggaagatcgccctggagatgctgcgggcgccggcctggatcccgcatccggggtcccgggccggggcggaggcggtgcgctacctgcgcggcgaggtcgcccgcacgatcgcgcgccgccgggcccgcggcgagcccggctccgacctcctcggcctcctgctgcaggcgcgggacccggagaccggcgcgccgctcaccgaggcgagcctcgtcgacaacctgctgaccttcgtgtccgccggccacgagaccaccgccctggcgctggcctggaccttccgggtcctggccgagcacccggaggtggaggagcgcgtcgtcgccgagatggcgcgcctcggcgccgatccggagtccgatcccggttccgtggaccggctcccctacacgcgtcaggtgctcctcgaggtgatgcgcctctatccgccggccccgctgatcgtgcggcggacgcgggccccggtccggctcggggacacggtcgtgccggccgggcagtcggtccacgtgccggtttacgccctgcaccggcacgcgctgctctgggaaagtccggaggcgttcgacccgggccgcttcgcgccggagcgggccgccgcgcgcgaccgctacgcctacctgccgttcggcgccggcccgcgggtctgcatcggcatgggcctcgccctgaccgagtgcctcgtcgtcctggcgacgctgctgcccgccttccgcctccggccggtgacggcggagatgccggcggcgcagttccgcgtgaccctgcggcccaggggcggcctgaccatgagggtcgcgccccgccacggggccgggcagggggacgggcacggggccgagcacggggccgagcagggggcggcccatgccgcctga

SEQ ID NO: 6246 - DNA, 2094 bp, Methylobacterium sp.
ttgccgagagccaacccggtatccgcgctgcggcggttcgcccgcaccgcgctcatcctgctcgggatgacctgcctcgccccgctcgcgccggccagggctgccccggatccggcagccttcgccgacaatgccgatgccgtggcggtggtgatcgggaaccgcagctacaagcagaccgtgcctgtcgactacgcgcacaatgatgccgaggcgatccgcgcctacctgatcgagcgcctgggctaccgcgagagcaacgtcttcctcctgaaggacgcgaccctcaacgagttcaaccaggtcttcggcaccgagcggaatccgcaatccggccgcctctggcgcagcgtgcgcgagggccgctcgaacgtcttcgtgtactattccggccacggcgtcccggatctcgccaccaagcagccgttcctgctgcccgaggacggcaacccgaaccagggcgagagcgggtacgcgctggagaccctgtaccgcaacctcgagctcgtgaagcgcaagatcggcgccgaccaccagctcgtcgtgatggtcgatgcctgcttcaccggcgagaccggccgcaagggcgagagcctgctggcggtgtccgcgcccggcttcgcgcccgcccggccgaagacggagggcggcatcgtccggctggtggcgacatcgggcgcgacaccggccaactgggacgaggcgaacaagctcggcctgctgaccagccggttcctgatgggcgtgtcgggcctcgccgacgcgcgcgaacatcagggcgacggcgacgggctcgtgcagtggacggagctgaagcgctacctccgccgcgaggtggaggacgcggcccgccgcgcgtcgggccgcgagcaggtacccgagatcgacgaggccccgatcgtcctcaaggcctccctgccggtggcggccgtcgcgaagggggtcgaggccatccgggacgaggcggcctggcggcgggccgaagcgctcggcacccgggagggcttcgaggcctatatcggcgcctgcggcgagacctgcctgtaccggcctcaggccatggacaggctcctggccgggcggcgccgggacgcggcggcgatcgaccaggagaactgggccaagttcgggacccagcggcaatatcaggcctatctcgattcctgcggcgaggtctgcgcctatcgcagcctcgccgagggctatctcggcggcaagaacccgagcgccgatccgcgcgtcaagcgctgcgacgagctcgccgccggcacggacgatcccgaccgtccgagcggggtcgcgggcgtgaagctcggccggatcgagcccgcggccgccatcgaagcctgccgtggggccgcggccgcctatccggacctgcgccggctctcctaccagctcggccgcgcctacgaccgggccgaccgctacaaggaggccttcgccgcctacgaccgcgccgccaaggccgggagcatctcggcgctgaacaacctcgccgccctctacgagaacggccagggcgtgaagcgccagcaggccgaggcgttccgcctctaccggcaggcgggtgaaggcgggaacgtggtggcgctggccaacgccgcccggatgctggagtacggcaacggcatcccgaaggacgaggcgcaggcggtcgccctgtatcgccgcgccgtggccgggggcgacgtcgcgtcgatcagcaagctcgtgccgcactacgcgacgggcgcctacggcttcccgaaggacctgcgccagggcttcgacctcttccggcaggcggcggaccggggcgacccggtggccatggccacgatggcgacgctgatcgacaacggcttcgggcggtatttccccggcgtgcgctcggccgacatggtcctgcgcgcgctgaagcacggggaactcggcgccgcctccgtctcggcgaccgacaccgccgcccagaagctcaagcccgagacgatccgctcggtgcagcgcgcgatcaaggacgcggattactacaccggtgccttggacgggcggttcaatccggtcttcgtccgcgctctcgatcagtacgcccgggcgaacgagaccgaatga

SEQ ID NO: 6247 - DNA, 318 bp, Methylobacterium sp.
atggccatccgcacgatggcgcggccgagcccgtcccggcgacgcctgcgcgtgatcctcatcctgctgctcatcacgtggctgccggtcgtacccttcgcgctcggcctcgcgctgacgaacctgaccggctgcaccgtcaacgaggcggggacgcacccctgcccggtggccggacacgatatcggcggcctgctctacacgctgacgatgacgggctggctgctgatcccgttcctgcccttcatggccctgacactgctgctcaccgtcgtgcagggcctgctgatgatccttcgagcgtggttgcggcgatga

SEQ ID NO: 6248 - DNA, 258 bp, Methylobacterium sp.
atgaccaagaccaagatcctcgtcctcgccgccagccttctctgcgccgcgggtcccgccctcgcccaggaagccgcgccgcagcacgggaaccaggagttcctcggcgtcgatctcgacaacggcggcgtctactacaacggccgcaactccggccgttactgcgtctaccgcacggtcgaggtctacaatcgctacaccggctacttcgaggcgcggcgcgcccgccgctgcggccgcggtctctacctgccgtga

SEQ ID NO: 6249 - DNA, 513 bp, Methylobacterium sp.
gtgagcgacgcggcacggctcctcgccgagatccacgcggcccgcgccctcgtgcgcgatgcggcgacgaccgcccggccgaaccacgcggggctgtgggcccacgcgacccgtgcgcccgacggcccggtcgacctcgcgacagtgcgggcgatccgcggcgacgccgcgacggcccggcgctaccggacgatgctcggcgccctggcgctcgcccacgcgccgctcgctgcggccgcctcggacggcgcgattctccggcgccgggtcggcgcctacgcgctggagatcctcgaggccgcggacggcgcaccgccgctcctcgtcctgcgcggcgagtcggggcagatgccgcggttgatcgaggcgtggctcggcgacgagacggtccggctcgacctcggtccggcgatcgaaggcgcggcggtgctcgccctcgacccggccgtgccggacgcggccctcatgggccggatgctccgcgacccggcctgcgcggtgttcctgctttga

SEQ ID NO: 6250 - DNA, 1131 bp, Methylobacterium sp.
atgacgcgtccggccatcctcgtcgtggtgcccacgacccgcggaccgctggtgctgcgcggactcaggccgcgccccggccttccggccccggccgccttcgcggacggcgattatcgcccgctgccgtggtcggccgattacgcccggctctgcggggccgccggcccgctcgcccggtggacgggccggactccggagccccacgagctgcggctgtcgggctccttcgatgccggacgctcctgggaggttccggtctgcctggcgcacggccttgccgatggcggccacccgctcgccgcggcaccggaggaggccgacctcatcctctgggcgaccggcgcggtcgatctcgacctcgcggtgctgcccggcgactacgcgctcctcgacaagatcgagcgctccgctgcgacgatcgccgaggctccggacgccgcgctggcggtcctcctgccggacgggccggagcgcgcgcaggccgaggccgtcttccgcggcatgggccggaacgtgcggatcctgccgtcgcacagcgtgcccgcagccctggccgcattgaccgcgccgcggcctttggagagggccgagacgccgccggcgcggcgatggtggcgtctcgcgttgccggccggcgccgtcgcggcagccggactcgccggtgtgctcgctctcggggccacgcggcccgatcccgtcagtaagccgcgccccgacgcgccggccggtcccgccagccctccccccagcatcgaagtccggatcgcgtcgccgatccacgtctccgagctgcgcgccccggcgggctcctcctgccgccgcgtcgccttcggagccgacccgcccgagcggcgcccggtaccggcggagtcgggcgatcacctggccgcgagccgcctcacgccggacctgtgcgggctcgccatcggagcggagccgggcctgcgcgtgcaggtcgggccggaactgcgcgacgccgccctcccggccgtccggctggcggacggcgcgctcggctatttcctgcgcgagggcgcgcggcagaacctcgtctacacggtccaggccgttccggaggccggaaccggcgcgcttgccggccgcctggtccacaccctggcgcgctga

SEQ ID NO: 6251 - DNA, 981 bp, Methylobacterium sp.
atgatcgcgatgcgccggagaggcccactccttctgggaacggcctgcgcgctgatcgtgctcggccgcggcgatgccgcgcgggcgcagagcgtcggcttcgatcccgccgattacggccgggcgcagctgcccctgcgccagacgaccggcgacgcggccgcctatgtcgaccagaacaagggcgccttcgagcccgtgagcgagctcgacccgaaggacggcctcgcggccctcgcccgaccgatcggccgcgtcgacatcgtgctccagaacggccgcaccgggcagcaggtcggtgcctcctgcacggggacgctcctgaccggcgactacgtgctgaccaaccaccattgcctgccgcaatcgggcgacctgcgcccgatcaaggcgtcgatcctgatggattacctgaccctcgacgggaaaggctcccgccggttcgagatcgacccgaagcccgtcgagttcgacgcccgcctcgacttcgccctcgcccgcgtggcgggcaatccgaccgcgacctacggcgccgcgcggctctcgggcgagccggtgacggccaaccgctcgatgctggtcatccaccatcccctcggacgaccgaaggtgatgagccgcttccgctgcttcgccgtgaaggaccaggccgaaggcccggacctgcgccaccgctgcgacacgctcggcggctcgtccggttcgctcatgttcgacgcctccgtggccggcatcgcgctccacaaggagggcggcctcgatccgaaggatccgacgagcttcaacagcgcgacccgcctctcggcgatcctgggccggagcccgaccctgacgcggatcgcggcggcccaggggcgcccggtcgccgccgcggatccggggaccaggccggtcgggcccggcccggcaccccaacccaggccggcgaccgacggacccctcgacccggccgggatgaacgccatcctgcggggacgctga

SEQ ID NO: 6252 - DNA, 969 bp, Methylobacterium sp.
atgcccctcgtccgcaccaccgcgttccgcaccaccgcgttccgcgccgcctgcctcgccgtcctggccctcggttccgcctacgcggcaccggcccgggcgcagaccaagcccaacgtcgtcgtgatgggcgaggacgccgacgaggacgcggtgccccgcggcaaccgcatcttccagcgggtgatccacgagctgtctgagaccatgaacctgcgcggctacaacgtctacgacgagaccgccgtcgcgatggggttcacccaggccaaccgggtgcgccggcgggatgccgagctgatcgaggtcgcccgcgcggtccagaatccgccgctcgacgtggtggcggtgttccagatctacgcgtcggcgtcgaaatccgcctactcggatatcgtccgtccggagatccgtatccccggacgcctcctcaacgtccgcaccggtcagtcgctcggctcgttcgaggtggccgggctccagctgccgcccctgccccaggggtgcgaccgcgagtgcctgctcgagcgggtcggcgccgaggcgaagacggtggccgccgacctcgcggccgccctcaccgcgaagctcgacggcgtcatcgcgccccgccgcggtgccgatgccggcgctgcgccccctgacgccgctccggtcggcggcgccgtggcggcggcgcccggcggcgagggctgtgggggtttgcccagcgcctacgtcgtccgtctgagcggcttctcggcccaggaggtccaggcggccgaggagtacatggcggccttccgctgctacgagcaccaccgtccggtgcgcgcgagcggggccagcaccgagtactggtacgagacccgctcggattccgcccggctcggccggaacctccgcctgatgctggagcacatgagcgcgccgggtcaggtccagttctcgggcaacaccttcgtcatcagccgcgtggcgacgcggtag

SEQ ID NO: 6253 - DNA, 1335 bp, Methylobacterium sp.
atgaggcgcctcctcctcgccgcgctgctgctcgccccggcggcggcgcgcgccgaccctgcgacgcagacgctggcaccgttcctcgacgcggtggcggcctgtgccggccggccggacctgacgctcgcggtcgtcggcgtcgagcccggccagacggccctgtcgcgcgagcagtccgaggaggtgcgcctcgccgtcgagacgcggctccaggcgaccggccgggtcaggctggcggcggcggccgacgtcgtgcggatcaaggccctgcgcgagggcacgacgggcctctcgggcgcggaggccgaggcgcagatccggtccgccttcgcgggggacgcggccgtgttcctggtcgagccccgccgggccggcgagaccgcctccgtccggctccaggccgtgacgcagagcgccgcctgcaaggcgacgagcgaccctctggtcgtgccgatccatgtcggcgccggcgtcgccgacgtcgacgcggtcatggacggtgcggtgaaggcgttcgcgcaggccgcaccgaatgccggcgccgtcgaggtctgcccgttcgtggcggagggcggccattccacctgcgccggcgccctcacggaccgcctcgtcatcgccctcgacgcggaggcccgctcggccaaccgggtgctccgcggcgcgcgcctcgacgtgcgccgccggccgcccggcaccgcctgcgccggcaccgtcaccgcgcgcggccgcttccgcacggaccacgaccggcaatcctggatggaggtcgagttccagcgcgacggcgccgtcctggccccgacggggcgacgccggatcgcgacggaggggctcggctgcgatcccgtcccgcggccgttcctggatcacctcgccgccaccgcgcgcacggatgccggccgcctctcggtggcggccgccgccacgccgttcgcggccggtcagcgcctggagatgcgcatcgagtcccgcgtcgcgcagaacctgtactgctgggtggtcgcggccgacgagaccgccttcgtcgccctgccggtgcgcgacaacccggcctcgcagctggcactcaagccgggagactcgcggcgctatccgcggggctacggcctcgacgagatcgtcgcgggggagcccttcgagaacctgttcgcctgcttcggcgtgccgggcggcctgccgccggggctcgcggcgcggtggctggcggcggcgccgggcgccgacggcgaggcgcgtctcctgcagcccccggacgtgctggacctcctcgaccgaatccgggccacgcccggggtcacggaggccgccgcgcgcgtcgtggtgcgctga

SEQ ID NO: 6254 - DNA, 1392 bp, Methylobacterium sp.
atgacgggcggatacgatgagcgctgcgcggccgacctcgccaacgtcggcgacggccgcgatctctcccgcgccgaccgtgcctggctcgcccgcgtggtcacgggtgccgtgcgcccgaaccgcgacaagcccctctgggacctcgcccacgccctcgccgcgctggccgaggcggccggggcccgcgacgggcgcgatctcatcaccctcgccctggaccccggcctcgcgcgaccggccgccctctcggcgcgcttcggcggcggcccggccgtcgacgaccgcggccccgtgctcggcaccgcctggtccaccggctgggccgggctcgcccggctcctcgcgctggccgagttcgtgctcaccgcggaggacctggcccagttcgcgaccgtcgcgggctggctcgacgaactcgccgccgcgcccgacgcggaaagcgcggcgatcctggccaagcggctggcccggcatctcgccgcctaccggaacgcccatctgccgctggcgccgctggagcggcgcttccgggcgctcctgaccttcctgggcggccgccggtccgtcgcggacgacgacatcctcgatttctggcgcgccgagatggcgacgggcgagcggccgggcttccgcatcgtcgcggagcatttcgtgaccttcgaggcggccggccgcctcctcgaaggcctcgacgccctcgcggcccccgccgccctcgacgcccacgcgggctgggaggagcggctggacgcggccctgggcgatctcgcggccgccgaacccgccgcggcgctcgcgaccctgctggcggactggccggagggcccgaagatcctcaccggcgccgagcgcgaggacctggccgacttcctgcgcctcgagccctaccaccggacccgcccgctgacgacgctccgcgccgtgagcttcggccgggtccagtcgggcatcgccaaccgcctgcgccgcggcggcggcggcgccgccatcgccgagcgggcgacctgcctggaggccgagagctacgccgaactccggacgcgcgcgggactgctcgcggcccatctcgaccggatgctgcgcatcgcggcggccctccggatcgccgatcgcgacgcgctgcccgaggcggtgcggggcgcgctggaggccgccgaggccgacctgcgccgcgtccgccgcgccggattcgatgatcgggccggtctctcggccgggttcgcggccgccgaaccggcgctgctgcgcctcgccgaggcggcggccgacctggagcggtcgctcgacggactcgcccggcaccggccgctggacgcgctgttcccggcggatcgggacatcttcgcggtcgcgctcgcggcggcctatgccggggaggccgcggcgtga

SEQ ID NO: 6255 - DNA, 306 bp, Methylobacterium sp.
ttggcgcccgtccggctttctgagcggttcatcgacacgaggaacagcatcgctatgccggtacgtctgatcacgactgctctgcttctgtccgcaggggccacggccgcgctcgccgcgcccatgtcggccgacgacaaggcggcgctccagcagcaatgcatgggcgatttcacgaccttctgcggtggcatgccgcccgacgatggccccgagacccaggcctgtttcgagaagaatatggccaagctgtcgccgggctgccaaggcgccatccagagctacaagcagggcaagaagggctga

SEQ ID NO: 6256 - DNA, 423 bp, Methylobacterium sp.
atggatacgacgaaaagggccgtcggcggcctaagcctgccaaagatcaaggtgacggcggaggaccgcgagcgcctagccgggctggcgtccgccgcgatggaccgtatgccggacctggcgggctatctgtcggacgagctcgaccgggctcagctcgtgcgggccgggaggtccgctgtcgggttcgtgcggatgggcagcgaggtcgagttccgcgacgacacgaccggtaaggtgcaggttgtgagcctcgtctatccgggggaagccgacatcggactgggaaggatctcggtgctgacgccggtcggcgcggccctgctcggcctgagcggggggcagtccatcgcctgggtgacccggaccggagccgccaagcgactgacagtgctcgacgtgcgcgagccggccttcgcctga

SEQ ID NO: 6257 - DNA, 327 bp, Methylobacterium sp.
atggcgaagacgagacgcgagttcacgcccgagttcaaacgcgaagcggtcgccctgctggagagcagcggccggccacagatgcaggtcgcggccgagctcgggatccagccctcgatgctgaggcagtggcgcgccacgctgaacggggccctaccccggccgcggccggccggatcgacggggagtgcgccaccaagcccggtcgcctcgccgtccgatcaggccgccgagatcgcccgcctgcggcgtgagctcgaccgtacgcgcatggagcgcgacgtgctaaaaaaagccatcggcatcttcgcggagatgcccaagtga

SEQ ID NO: 6258 - DNA, 549 bp, Methylobacterium sp.
gtgatccccgaggaagcccgcggccagccgctcgagatctggttccaggacgaggcccggatcggccagaagggcacgctggcctacgtctgggcgcgccgaggcacgcgcccgcgcgccgtgcaggacacgcgctacgcctcggcctacctgttcggtgccgtctgtccgcagcgcggcgtcggcgcgggcctggtgatgccgcgcgccgacaccgaaggtctcaacgcgcacttggccgaactcgctcgaaccgtggcgccgggggcccacgccgttctcgtcctggacggtgctggctggcacaagagcaccgatctcgtcgttcccagcaacatctcgctcctgatgctgccgccatacgcacctgaactcaatccggtcgaaaacacctggcaatacttacgccgcaacaaactcgcccatcgcctctacgacagctacgaggccattgtcgaagcgtgctgcgacgcctggaactggctcatggccgcgccagacaccatcaccgccatcgcaaaccggacatgggcaaacgtgtcagcataa

SEQ ID NO: 6259 - DNA, 957 bp, Methylobacterium sp.
ttgaaggcgatggtgttgacgaagttcggggggccggacagcttcgagctccgggagctgccagaccctcggccgggaccccggcaggtccgcgtggccgtgcatgccacgtcgatcaacccgctcgacggccagatccgccgcggcgactacgccgctcaggtcgcgctgccggccatcatcgggcacgacgtgtccggcgtcgtcgaccaggtcggatccgacgtgaccgagttccgcgcgggggatgaggtctattacacgccgcggatcttcggcggtccgggatcgtacgctgagtaccacgtcgcggatgccggcatcgtcgcgcgcaagccggtcaacctcacccattccgaggccgcgagcgtcagcctcgtcggcgtgaccgtctgggaagggctggtcgagcgggcccgattgcaggtcacagagaccgtcctcgtccacggcggtgccgggggcgtcggggcgatcgccgtccaggtcgcgaaggccatcggggcacgggtcctggcgacggcgcgcggcagcgacgtggcgcgcgtcgagcggctcggcgcctccgccgtcatcgatttcgagcgcgaggactatgtagacgccgtcgatcgcctgaccgagggcaggggcgtcgacgtcgtcctggacacgatcggccgcgacacgctcgcgcgctccccgcgcatcctccgcgaggacgggcgcgtcgtcaccctggtcgacaccgcgacgcctcagaacctcatcgacgcttggggccggaacgccacctaccacttcgtcttctcgcgccaggacggccgcaagctcgacgccgtgacgcgcctcctcgagcgcggcctcgtggtgccgcgagtcggcctggagtttcccctcgacgaggtcgccagcgcccacgcgcgctccgaggagggtcggctcggaggcaagatcgtgctccgggtgagatcgtga

SEQ ID NO: 6260 - DNA, 477 bp, Methylobacterium sp.
atggacatcgctggcgcgtatcggatcccggtcgcgcgggaggccgtctgggcggcgctgaacgatccggaggtgctggcccgctgcatccccggctgcaaggagctggtgcaggcctccccggaggagatgacggccaaggtcgccctcaaggtcgggccggtctcggcgaccttcgcaggcacggtccgcctcgaggacttgcgcccccccgagggctacagcctcgtcggccagggcaacggcggcatggcgggcttcgccaagggccgcgccgccgtcagcctcgcggcggagggcggcgagacgctcctgacctacaccgccaaggccgaggtcggcggcaagatcgcgacgctgggcggccggctcatgcaggcgaccgcgcgcaagctcgccgacgagttcttcggcaagttcgccgccgaactcggagcgaccggcgacccggccgcgcccagggcggccgaggcctag

SEQ ID NO: 6261 - DNA, 1557 bp, Methylobacterium sp.
atgcagcgggcccgatcgcgccggcgcctcgtcggcgcgtgcctcgccctcggcctgatcgcggccgggcccggagccggatccgccgggacgctgacgcgggcgcaggtcgaggcgcagctgccggcgctggaggcgctggcgcggcgggccgtcgacgcgggcgcggtgccgggcctcgcggtcgcggtcgtcctcggcgacgagacgctcctcctgaagggatacggcctcaggcaggccgggaagcccgagccggtcggccccgacacggtcttccagatcgcctcgctgtccaagcccgtcaccgcgacgatcgtggccgccctggtgggcgacggggtggtcgactgggattcgcgcgtcgcggatctcgatcccgccttccagctgcacgagccctacccgaccgcgcaggtcacggtgcgcgacttcctcaaccatcgcagcggcctgccggggaccgccggcgacgatctggaggcgatcggcttcggccgcgacgcgatcctgcaccggctgcgcctcgcgccgcccgcctccagcttccgcgccggctacgcctacagcaatttcggcttcaccgagggcgcggtcgccgccgcgaagccgaccggccagccctgggaggcggtggcccgggaccggctgttccggccgctcgggatggccgccaccggcacgacccacgcggatttcctcagccggcccgaccgcgcggcgctccacgtccgggccggcggcgtctggaccgccaagatcgagcgcgatcccgacgcgcaggcaccggccggcggcgtcagcagcgatgtccgcgacctctcccgatggctgcggctcgtgatcggcaagggccgtttcgagggcgcgcagcgcgtcgcggccccggccctggcgcagacgcacgccccgctcatggcccgcggccgcaaccccgtgaccggcggcgcgtccttctacggcctcggctggaacgtcgagtacggccggcacggcctcgtctggggccacgcgggcgccttcagcgtcggcgcgcagacgctcgtctcgatccatccggaggccggtctcgggatcctcgtcctgaccaacgccttcccgtccggcgtgccggaggggctggccgacagcttcgccgacctcgtcttcgacggccgcgtcggccgggactgggtgacggcctggggcgcggcctacgagagcctgttcgcgccgggcatcgccgccgacaaggcggcctacggcacaccgccggcgccgcccgccgcgcccctggcgctctcggcctatgccggacgctacgccaacgcctatgtcggcgaggccgtggtggcggaggcggacggcgccctgacgctgacggtcggccccgcgggggcgcgccgctaccccctccggcacttcgaccgcgacctcttcctcagcttcccggacgccgaggcgcccgaccgcccctccgccgtccgcttcgccatcggcagcgacggccgggccgccgccgtgacggtggacgcgctcgacgcgagcgggctcggcaccctggcgcggcgagactga

SEQ ID NO: 6262 - DNA, 327 bp, Methylobacterium sp.
atggatcagtccgcagccctcagaacggaccaccccgcgaccgaacaggacgctctcgccgagttgccggcgggcgatttcgtcaggcgatggcggcagatcaccggcgagccgccggccattctcctgagctcacggtccgagatgatcgcgctgctcgtggagagcgtgcccatggcgcccctgatcccgcagggcgagagccccggcacggcggggtccggggagactccgtcccaggatcacggctcggacgggccagacggggcggcctcaggatcctccgcgcgcagtgatcagcggggtgcgagacagggaccggcctga

SEQ ID NO: 6263 - DNA, 699 bp, Methylobacterium sp.
gtggtgagcaaggaggatcgcggggtgacggtcacggagatcgagcgggtggaggcgggaccgcggcgcggcggccggccgacccgcgcggaggcggcccggcgcgaggcgcacctgatcgccgtcgccacgaccctgttcctggagcgcggcttcgacgccacctccatcgacgcggtggccgaggccgccgggatgagcaagccgacggtctacgcgcgctaccgcgacaagcgggccctgttcgaggcggtcctgcgcgagcggatcgccgcgtggctggcgccgctctccgccgcagccgaggcccaggccgcgcagggcgggagcgacgacgtcgagaccgccctggaggatctcagccgcaccctgctggcccacgggcagtcgccgggcgcggcgatgctcaagcgcaacctcgtggcccaggcgctgcagtttcccgagctcgcccgcctcgcccacgaggagggctggctgcgcggcgtgcgcgcggtggcgcagctgctcgacgccttcgcgcggcgcgggcggatcgccgtggcggatccggagatcgcggccgacctgttcctcagcctcgtcctcggccggtcgtcccaggcgaccctctacggcatcgccaccgacccggaggcgcaggagcggcggcggcaggcggcggtgcggctgttcctcgacggggtgcgcccgcgctga

SEQ ID NO: 6264 - DNA, 297 bp, Methylobacterium sp.
atgggcaatagcgcccgcgccaggttcacacccctcgcccgttcggacctggaagaaatctggcggtacacggttgggcaatggtcggcggatcaggcagaccgctatcatcaggacatcgtcaacgctgcgacggaactggccaacggcgcaaagatcggccgtgctgtcgaggttcgagccggatatctaaaatatcgcgttggatcgcatttcatattttaccggcggacggatgccgggatcgacgtgatccgcgtcctgcatcagcggatggatacggacagccatatctga

SEQ ID NO: 6265 - DNA, 318 bp, Methylobacterium sp.
atggagcaggcgcgcccgctcctgcccggcgtcgccttcgcggaggatgcctaccactgtgccgagggcgccgacgcgctggtcctcgtcaccgagtgggacgcgttccgggccctcgacctcgaccggctgcgggcggcgatgcagcgaccggtcctcgtggatctccgcaacgtctaccgggccgccgacgtccgggcgcacggcttcgcctacagcagcgtgggccgccctgacgaacccggtgaccagcccggcgacgagtccgagatcccgccggctctgccccccgccgacgccgtcgccgggaccgcgtga

SEQ ID NO: 6266 - DNA, 2385 bp, Methylobacterium sp.
atgtcatctccgagctccggtcgcacgctgttcttcttcgagaagccctcggcgatgcgccagttgcagcgcttcttccgctcgccgagcacggtctgcgtggccgccgagggacatctgctgtcggccgaggagccgggcagcatccggcccgagtggaagccctggcgcttcgacctcctcccgatcgtccttcccacgatcccggtcggctacggcacgaaccggtccgggcagtcgcacgcaccgaagatcgccgcgatccggcaggcgctgagcggcgtggaccgcgtgatcatcgccacggatccgggtcgcgagggctcgatgatcgcgtgggaagtgctcgagcatctcggctggaacggccgggtcgaccggctcaagctcggcgcgctcgacgaggtctcgatccgacgcgccttcgcggccctggccaaggatcccgcctcgggcgagcgcgactacgccgcctatctcgaggcgctctgccggcagtacgaggactatcatctcggcctgaacggcacgcgggcgatctcgctgcgcctgcgcccgcccgccttccgggagccctggcgcttcggcggcgtccagacgccgaccctcgccatcctggcggacctggaggagcggatccggtccttcgtgccgcaggacttcttcaaggtcgcgctgcacattaggacccatgcaggcgcggagatcaccctctggcacgccccgaaggagcggatcctcgatgcggcggtcgctgagacgatccggtccgccgcggcgacgtggtcgggccctctggcggtcgcgcacagggatgtccggcgcgcgccgccccggctgttctcgaaggacaccctggcgcgacgctgcgccaagcggttcggctgggacccgcagcacacggccggcatcgctcaggacctctacgatcaggggtacctcagctacccgcgcacggagtcggagcacctgcccgagggccaggccggcgatgccgccgcgatcatcgcggccgtcacgaccgtcctgaccgacctgagcacagtcgttccgcgcgacgctgcgccgctgatccgtcgcggcctgaagggccactacgtcgcggatccgggcgagcaccacgccatcgtgcccctgcgcaaggcgcccgagcgcggccgtctcagcaccgatcagttccgcttgtgggaactcgtggcgaaggcctatctcgccgcgcacctgcccgacggggtcgacgcgcgcacgagcgtcacggcggatgtcgcgacaccgctgggcgtgaggcggttcgccgtctccggaagcgtcgtgcgcgcgccgggctggcgcgcgctctacggcagcgaggccgagctcgaaacggatgccgtgcccggcaagaccaagcgcgaggcggaagccaccgccacccgcctgccgctcgtgaccgacggcgagggcgcctccgccgcgacggcggagatcgccaccgcgaagaccgagccgccgcggcggatcacccgaggcgaattgccggtggtgatgggccggctgatcgaccaagtggacgatccggccgccaagcgcgccctggagaaccccgccaacccgaacgagccgaagggtctgggcacggccgcgacgcgcgacacgatcctgcccaagctcctgaagagccgctacatcacgctgtctaccggcaaggatccggccatcgaggtcaccgaggtcggcctgagattcgtaagcgcggtgcgcagcgtgttcccggcctacggagatccggtcgggcgcgccatgttcgaggcggagctcgccgagatcggacgggcggccacgcgcgccgaggcggtcgcgcgcgcgaccgccttccgccagcgcacccgcgcccgcctcgacgacctgatcaccgcgatcgcgcaggcgccgacggtcagcctcgatccgagcctgatcccggccggtccgggcgaccagcggccgccgacgccggccatggtggcgttcgccgtgagcctttccgagcggaagggcgtgacgctgccgcgtggctgcaggagcagcatcagcgtctgccgcgcgttcctcgacacccatgccgggccgcgtgccgggcaggaggacgacgccggccgcgcagacggccggcgtagcccgagcgcggcgatggtcggctacgcacgcagcctcgcccagcagcgcggcatcccgtgcccgccggacgcggagacggacttcgacgcgtgccggcgcttcctcgacgcgcacgccgcgcggcaagggcaggggagggacgaggcgaacgccggaggggcgaagaccaagcggcccgcggagcgggagaagcggcggggccgtgtggcccggacgccgcgaccggcagcggcacgccgccgggcctga

SEQ ID NO: 6267 - DNA, 873 bp, Methylobacterium sp.
atggatctcgacatccgcgaattcgaggaggtctgccgcgacctctacgtccgcgccctgaagatcctgccgcccgacatcaaggcgggcttcgccgacctgcagcgggccgagaccagcgccaccggccgcgccatcctcgacacgatggtggagaacgtcgcggtcgcggagcgcacgaagaatatcctctgccaggataccggcatcccgatctacaacgtcgtgatcggcgccgacgtgcgcttcgacggcgccgcgctcaaggccgcgatccggcgcggctgcgagcgggcgaccaaggacttctccctgcgctcctcggtggtccacccgatcacccgcaggaacgagcagacctcctgcggcatccgcgtgccgatcatccacgtcgacttcgacgaccggcccgagaccgtggcggtggagatgatcccgaagggctcgggctccgagaacggctcgttcctgcagatgctgctgccctcggacgggatcggcgcggccaagcgcttcgtcatcgaccgggtgatcgagctcggcggccgggtctgcccgccgaccatcgtgggcgtcgggctcggcggcacctccgacctgtgcatgcacctcgccaaggtggcggcgacccggccgctgcgctcggtctgctccgatcccgaaggcgcccggatcgaggccgagctgtcgcgggccgtgaacgaactcggcatcggcccgcaggggctcgggggccggtccacgagcttcgccgtccatgtcgagctcgccgcgacccacatcacccagaacccggtcgcggtgaacatccagtgccactcggcccgccgcgcccgcgcgacgctcacgcccggcggcatcgcgttcgattga

SEQ ID NO: 6268 - DNA, 657 bp, Methylobacterium sp.
gtgccgaccggccggcggctgacgccggaggcccgcgagcgccagatcgtcgagggcgcggtcgcctacttcgccgaggtcggcctcgacgggcacacccgggagctcgcccgccggctgggcatcacgcagccgctgctgttccgctacttcccgaccaaggcggcgctgatcgagcgcatctacgaggaggtctatctcaggcgctgggatcccggctgggaggcgacggtgcgcgacaccgcgctccccgtcctcgagcgcttccggcgcttcgagatcgactaccagcgccggatcgacgactacgcgtggctgcggatcttcgtctcggcgggcctcaaggggttcgatctgccgagccgctacctcggcatggtccgcgcgcgcatcttcgcgccgctgctcgccgggatgcgcgccgagtcgaacctgccggaccctgaggtgcagccgctcgccgcggacgagttcgagctcctgttcggcatccacggcgcgctggtctacgtcggcctgcgctcgcgggtctacggcatggacggcacggcggaccgcgacgcggtccgggccgccatgctcgacgccgcgcttccggggctgctcgccacccaccgccgggtggtgtcggcggcgcggtcgtccgacgcgctgtag

SEQ ID NO: 6269 - DNA, 351 bp, Methylobacterium sp.
gtgactacggttcacaatgagcagaccaagctgctggcgacggcgctgaacaacatcgcggttgcctacgtcgtcatcggcttcgtcacgccgatgacggccgcgagcttcggtgtgccgagtgcaccggcgctgcgcgtcgagaacgcgatcttcacgctcgtttggctggggaccggctgcgcagtactgttacggtgcgaggcgtgccctccagagcctgaagccgtgaactacgactggatcttcgtaacgttcggcattccggcgatcacgctggcgatcgcctacgcggccgtgcgcgcgaacgagcgggccgcgcagcgcctcgatcccccagcgggcgagtag

SEQ ID NO: 6270 - DNA, 261 bp, Methylobacterium sp.
atgagcctacgcggccgccaggatgacgcgacacctctaccggcggctcggttcgagatcagcccccggcgcggcctgcgccgcgaagaatcggcccgctacgtcggcgtcagcccctcgaaattcgacgagatggtccgggacggccgaatgccgaagccgaaacggatcgacgggtgcgtggtctgggacctccggcgtctcgacttggcgtgggacgctctcggcggcgatgatgcaggccacaacccgtgggactga

SEQ ID NO: 6271 - DNA, 903 bp, Methylobacterium sp.
atgcgcgcgacatccatcgtctccatgtctctggcgctctcggtcctgtccgggctgggcgcacaggcggagaccgccgggagcctctccacgacggccgtcagcggcagcgccgccgcgatgtacaatctcggaatcctctacatcaacggccagggcgtgaagcaggatttcggtacggccggacgctggttcgagaagtcggccgccggcggtgacgtcgacgccatgctcaacctcggcagcctgtactacaacggccagggcgtgaagcaggactacgccgccgcggccgcgtggttcgagaaggccgccctggcgggcaacgccgaggccatgaacaacctcggcagcctctacgatgccggccagggcgtgacgcaggactacgccaccgcgcgcagttggtacgagaaggcggcggccgccggcgccgcgtcggccctgtacaatctcggcctactctacgccaacggtcagggcgtcgggcaggattacggcgcggccgcgtcctggttcgggaaggccgccgccgccggcaacgttgacgcgatgaacgccctcggcagcctgcacctcaacggtcagggcgtgaagcgggacgccgccgcggcccgccactggttcgagcgggcggtcgccggcggcaacgtggacgcgatgaacaacctcggcagcctctacctgaacggccagggcgtgaagacggacgccgccgcggcccgccgctggttcgagaaggcggccgccgccggccatgcggaggcgatgaacaatctcggtttcctctacgtcaacggtcgcggcgtgaagcaggatttcgaggccgcccggcggtggttcgagaaggccgccggcggcgccgcggccgcgaacgtccccggcgacatcgcgctccgctag

SEQ ID NO: 6272 - DNA, 1464 bp, Methylobacterium sp.
atgacgatgaacgagtctgccccgggccaccccatcctgcgcgacgttccgatcggcatcgccgccaccgggatgcggcacgagacggactcgatgggcgggatcgacgtgccggcggaccgctactggggcgcgcagacgcagcgctcgctccagcacttctcgatcggcgacgatcgcatgcccaagcgggtctaccacgcctacggctacgtcaagaaggccgccgccctggtcaacgccgccgccggccgcctggaggactggcgcgcgcaggccatcgtccaggccgccgacgagacgatcgccggcaagctcgacgcgcactatccgctctacgtctggcagaccggctccggcacccagtccaacatgaacgtcaacgaggtgctgtcgaaccgcgcgatccagctcctcggcggtgtgctcggctccaagagcccggtccacccgaacgaccacgtcaacatgggccagtcgtcgaacgacaccttcccgaccgcgatgcacgtcgccacggtgctcgaactcgacgaggtcctgctccccaaggcgcgggcgctggccgacgcgatcgacgccaaggcgcgggcctggatggacgtggtcaagaccggccggacgcacctgcaggacgcgacgccgctcaccgtcggccaggaatggtcgggctacgtggcgcagatgcgcgacgcgctggccctcgtcgaggcgtcgcgcgccgggctgtacaagctggcggccggcggcaccgcggtcggcaccggcctcaacgctccggaggggttcagcgcggagatcgccgccaggatcgccgatctcaccggcaagccgttcgtcacggcgcccaacaagttcgccgcgcaggggtcgctggacgccatggtcgccgccatggcggcggtgcgcgggctcgcggtcgcgctgatgaagatcgccaacgacatgcgctggctcgcctcggggccccgctgcggcctcggcgagctgctgctgcccgccaacgagccgggctcctcgatcatgcccggcaaggtcaacccgacccagtgcgaggccctggtgatggtctgcatccaggtgatcggcgaggacaacgcggtcgccttcgcgggctcgcagggcaacttcgagctcaacgcgatgcgcccgatcatcatcaacaacacgctgcattcgatccgcgtgctgggcgacgcctgcgagaagttccggacctactcggtcgagggcaccgaactcaaccggacgcggatcgacgagaccgtgaaccagtcgctgatgctggtcacggccctgtcgccggtgatcggctacgacctcgcctcgaagatcgcccaccgcgccaacgacgaggggacgacgctgcgcgcggccgccctggccgagggcgtcccggccgagcgcttcgacgcggtgtgcgatcccagaaccatgatcggccacgggctggccggcgcctga

SEQ ID NO: 6273 - DNA, 285 bp, Methylobacterium sp.
atggatgcggactggtcatcgtacgcaccggcttggccggcccggatttccgtgaccctgaagccagccttggtccaggcctccgaggtcgcgccggccgcggggatggtcgagggtagcggcgccgagatcgagggccttgagcagttcggaggccccatcggcgtgaccatcgtcgacgccaacatccaggtctcggatggccggccggggctcctgtccaatacccccgaagccggacgagggggcccgacctcccgagtccgctcctcgggcatcgcgtag

SEQ ID NO: 6274 - DNA, 882 bp, Methylobacterium sp.
ttggccgccgccgcgctgctctgcgcgggcttggccgcctgcgccccgtgggagcgcgagctgctcgcgcaggcgcccgtggtcacgccgccttcccccaccgatctcaatctcgagacgctgccgccgccgacccgcaagatcgacatcgcgatctacaatttcccggacctgaccggccagaataagccgaacgacaacatcgccgagtattcccgcgccgtcacccagggcggcggcgccttcgtggtcgacgcgctgcggcgcgccgggcggggccaatggttctcggtggtcgagcgcaccggcctcgccaacctgctgcaggagcggcagctgatccgggcgacccgccaggaattcgagggcacggacgcgaagccgctgccgccgatccgcttcgcgggcctgatcgtcgagggcggcatcatcggctacgacgccaacacggtcacgggcggcgccggcgccaacctcctgggtatcggcggcgacaccaagtaccggcgcgacgaggtgacggtggcgatgcgcatcgtctccgtgcagagcggcgaggtgctcaacagcgtcacggtgacgaagacgatctactcggtcgccctcaacgccaacgcctaccgctacgtcgcggtggccaagctgctccaggtcgaggcgggcgtgacccggaacgagccgacccagatggcagtgcgcgaggcgatcgacctcgccgtctacgcgacgatcattgagggcagccgcaagaagctgtggcgcttccgcgacccggtgctcggcacccgtctcgtcggcgagtatctcgctcgcgatcggccgacgccccttgaggttccgggaccgacggtggcggcgggcccgctggtggtgaagtcctga

SEQ ID NO: 6275 - DNA, 696 bp, Methylobacterium sp.
atgcgacccgtccaccaggaacggcacctgatcgaccgcatcggctggctgcgcgccgccgttctcggcgcaaacgacggcctcgtctccaccgccagcctgatcgtgggcgtggccgcgtccgcagccaataccggcgagatcctggttgccggcagcgcgggccttgtcgcgggcgcgatgtcgatggcggccggcgagtacgtctcggtgagctcccagggcgacaccgagcaggccgacctcgcccgcgagcggcgcgagctcgccgacgacccgaccgccgagcgggaggaactggcgcgtatctatgtcggccgaggcctcgaccatgcgctcgccctgcaggtcgccgagcaactgatggccaaggatgcgctgggcgcccacgcccgggacgagctcggcatctcggaagtcacgacggcccgcccggtgcaggcggcactgacctcggcggcgaccttctcggccggtgcggcgttgccactggtgacggcggcgctctcgcccggcaacctcgcggtctacaccgtgtcgggtgcgtcgctggtgttcctggcgatgctcggggcactcggcgcctcggccggcggcgcaccgattgcccgcgccacggcgcgcgtgaccttctggggtgtgctggccatggccgtcacggccggaatcggaagcctcgtcggcaaggccgtctga

SEQ ID NO: 6276 - DNA, 495 bp, Methylobacterium sp.
atgcgccagtccggtctcctcgggccgctcgtctgcggctgcgctctcctcgccgtcgtgggcgcccaggcgggcagccttgtctaccagccggtcaacccgtccttcggaggaagtccgctgaacggctcctggctgcaggcccaggctgcggcccagaacgacgcgcagcggtcggcccagcgcgaccagcagctgttctcggccaatcagagcgccgccaacaccaagactccgggccagatcttcgcccagcaattgcagacgcagatctacagctcgctggccaaccagatcacccaggcgctcttcggcgagaacgcccagcagagcggtagctacagcttcggcggatcgcaggtgaccttccagcgcctgggcggcaatatccagctccagatcttcgacggccagtcgaccaccaccatcgtcgtccctgcgaccgcggccgtgggcggctcgagtggcgcgacaccgctcttgggcgcgccctga

SEQ ID NO: 6277 - DNA, 1638 bp, Methylobacterium sp.
gtgaggccggccgcggcataccgcgccggccagcgcgccctggcggccggcttcatctcggcggtgctcctggggcacggcccggcatcggcgcgcaccttcgtgttctgctcggaaggcagcccggaaaccttcgatcccgcccgcgccacgaccaccaccacgatgaacgccgcgtggcaggtctacaatacgctcgtggagttcgtgcccggcaccacgacgatccgcccggccctcgccgaatcctggacggtctcggaagacggccggacctacgtcttcgctctgcgggacggcgtccgcttccacgccaacgcgcgcttcacccccacgcgcgccctgaacgccgacgacgtggtgttctcgttcacccggcagcggcgctccgggcccgacggcgccgcgcagggcttcacctacttccacgatctcggcctcgccgacctgatcgagaccgtcgacgccccggatccgcgccacgtccgcttccggttgcgcgaggccgacaccaccttcctcgccaacatcgcgcaggccttcggcgccatcctgtccctcgagtacgcggccgccctcgcggccggcaacgcgtcggacgacctcgcccgggcgcccatcgggacgggcccgttcgtcttcgaggggtaccggccggatcaggtcctccgctaccgcgccttcccggattactggcgccgcgccgcggacgggaacgagccgggcgagcgccccgacggtcttgtcttcgcgatcacgccgaacgcggcggtccggctgaacaagctgcgggccggcgagtgccacgccatggcgttcccggcgaccggcgacctcgacgcgatccgggcggagccgggcctgacgctgctcgcgctggccgagctgaacgtcgcctatctcgccctgaacacgacccgcgcgcccttcggcgacgtccgggtgcggcgcgcggtcaacctcgccatcgaccggcgggcgatcgtggcgggcgtctacggcgacgccgggatcctggcgcaggggccgctgccgcccgggatctgggcccacgacgcggacctgccggacacccccttcgatcgcggcgaggcgctgcgcctgctggccgaggccgggctcgccgacggcttcgacgtggatctgtggtatccgccagtcagccgaccctacaacccgaatggccggcgcgtcgccgacatgatccaggccgacctcgcgcaggtgggcatccgcgcgcgcccggtcacgcgtccctggaacgcgtaccgcgccgccctgtacggcggagagcccacgctgatgctctacggctggacgagcgacaacggcgacccggacaacttcctgaacgtcctgctcggctgcaaggccgcccagaccggcggcgccaacctcgcccgctggtgcgacccggcctacgaccggctggtcgaggccgcccgccgaaccggcgaccgggaagcgcgccaggctctgtaccggcaggctcaggccatcgcccggcgcgcgatgccctgggtgcccctggcccacaccaaggtgcatctggcgctccgcgacgacgtgctcggcctgacgatggatcccctcggccgccacctgttcgagacggtacggttccgcgacccgcgctga

SEQ ID NO: 6278 - DNA, 678 bp, Methylobacterium sp.
atgatgaggcagcgcggcccatcgcgcgtgcagatcctgctcgccgccgcgaccgtatggtcggccgggatcctgtcggcgggcgcacaatccgcggcgccacccgggccgccgcaaccggcgcccgcacagcccgcaccgatgcaggccaacactgccaatcccgggacggggcagcccgcccccgccgctccgggctgcgacgccacctgcgtgcgcgccaacaacgagctcgcctcgcagatctgcgcgccgcggatcgaggcgcaggcgccgacggatttcgagtgggtctcccggcccttcgccaagatcttccagcaggctgaggcgcccgagggcggcgccaccgtggtccgctaccgcggcgactcgatccgcttcctcagtcccgccaaggagtgggtgcgggtgacctacgagtgcgggttcgacgcggccaagcggtcggtcgagtacgtgcgggtgcggctcggccggctcgacaaggcggacgcgcccgcgcagccggcgcagcagggccgggccagcgcgctggcgccgcagccggtgtcgccccaggcgcagcagcaggccgcccgcaccgggacagccgccccgcgcaagctgctgccgtcggagccaagcgagatcgaggtccgacaggtcaatccgcggatccggcaggcgcagccatga

SEQ ID NO: 6279 - DNA, 996 bp, Methylobacterium sp.
atgagcctgcccgtcgcaccgacgcacatgttcggccgccgccggaggggcgtgcgaggcacgctggccctctgcctcgtcgtgtccggcgccctgacgccggtgatcgcctcgcgagcctccagcacggcccggagcccggcggtcccggaggtcgccgccctcacgcccttcgcgccgatcgcggcgccgccgccgctcggactgccggacgggcacgcggacggaccggcgtcaccgatcatcgcgccggtgaacgccgacctgatgattctgggccgcggcgcgttccggccgatcgaggcgaccgccctgctgttcccgcaggccggggacgggatgcacgccctgatcatcgccgcggccgccgccaacggcctgcccggcgacttcttcctgcgcctgctgcgccaggagagcggcctcaatcccaacgccgtgagcccagtgggggcgctcggcatcgcccagttcatgccgggaaccgccgcggagcgcggcctgcgcaacccgttcgatccgctggaggcaatcccgaaatcagccgagctgctgcgggaacacagggtgcgcttcggcaatctcggattggccgcggcggcctacaatgccgggccgcagcgggtgcgcagttggctcgagggtcgctcgggcatgcccaccgagacgcgcgactacgtggtccggatcaccggccgcaccgtcgaggaatgggcggcggagagcggccggtccttcctgagcgccccgtcgctcttctcgaaccctcgcggtttcggcccggtcgcgggctgggccgccgatcccacggcgcgcccttcgcccgtgttcgaggcgcgaccggtcacgcgcagcatggcggctgcgagcgaccggtcagccaagcggggggctaggcgcctgtcggctcagtcgcagcaaccgcgatccgagcaggccctctgtgcggtcctgaacgggcagggacgcacctgtctggtccaggcggtctactga

SEQ ID NO: 6280 - DNA, 720 bp, Methylobacterium sp.
atgacgacgcagacgctgaaaggccaacgcttcctaatcgtcggcgggagttccgggatcggcctggccatcgcggcagtggccctcgcggccggcgccgaggtcacgatcgcctcccgctccagggaaaagctgaacgccgccatcggcacgctcgggaccggcgccagcgccgccgtgctggacaccggcgaggccgagggtatcgagcgcttcttcgccgatcaggcgccctgggaccacatcgcggtctcggcggccgagacggcgcggggccccgtccggcagttagacctcgatgccgcgaaggcggccgtggagagcaagttctggggagcctaccggatcgcccggttcatgcggatcagggagggtggcacgctgaccttcatctcgggcttcatgagcgagcggccccaggccgccgctccgctccagggcgcgatcaacgcggcgctggagagcctcgcccgcgggctggcgctcgaactcgcgcccacccgggtcaacaccgtctcgcccggcctgatcgagacgccgctctggtcgcgcatgccggagaaggaccgggcggccatgtatgccggcgcggccgagaggctgcctgcgcggcgtgtgggccagtccgaggacatcgccaacgcggtgatgttcctcgcaaccactccgttcgcgacggggtcgaacgtacgcgtcgatggcggcggcaccatcgcgtga

SEQ ID NO: 6281 - DNA, 723 bp, Methylobacterium sp.
atgagcagcacccttcaggatcgcaccgtcgtggtcttcggtggcacctcgggcataggcctcgcggccgcccgccaggccagggcggcgggcgcggaggtcgtcgtcatcggccgccaagcggcgggcgccgagcgcgccgcggcggagaacggcttcgccggctggcgcgccgccgacgtgacgcggcccgagacgatcgcgaccgctctggccgacatcccccgcgtcgaccacctcgcgctgctggccgggaccttcgtggccggcagggtcctcgaggccgaggtcgagcacctcgcgcgggccttcgacgagcgaatctgggctgccattcatgccctgcgcgccctcggcggccggctcgccggggacggctcggtcaccctcatctccggcgccctggcggaccgcccgagcgcgcaggggaccgccgtgctggcggcggcgtcggccgcgatggaggccttcgcccgcggcctcgcgctcgaactggcaccggtgcgggtgaacgcgctctcgcccggcaccaccgacaccccgctcctggcccgcacactcggcgcccaccgcgacgcctacgtggccgggctgaccgagaggctgccgcagagacgcctcggcaccgccgaggaggccggtgccgccgtcgtcttcctgatgtgcaacggcttcatgaacggcgagaccctgcacatcgacggcggcggccgcctgatatga

SEQ ID NO: 6282 - DNA, 1767 bp, Methylobacterium sp.
ttgtcgtggttctgggggctcgggtttttctacgcgatccatgtcacgctgacatacggctggctcgggttccttgccttcgccttgccgaacgcgaccggtctcggcctgttcggctggatgctcggcgcgccgcgtcggaatatcgacgcgatcgtggccgccgtgcagggcccctacgcgctcctgttcatgggagcccagttcttcgccgtcgcgatcacgatcttcggcttcgcggcctacgcgtggcttcccctgttcggccacgacgccgccgtgggcgtgatcgcattggtcctcgtcgcctgctcgctcggccatgccgtcccgctgcgcgggatccgcatcgtccattgcggggcgctggcggtcgggctcgccgcgagcgtgatcctgctcggcgggctgtccgcgcagcgggacggctgggacgtcccgctgcaggccttcgacgagcgcttctacgggctcgtcgtcccctcgctggtcggcttcctgctcggcccctggatggacatccagcagtggcagcgggcggtcgagatccggcgctcgggcgggtcggtgcgcgcggcctacgtgaccggcgcgctcctcttcctcggtctcctgacgatcaacgcgctcatcgccgcgcgggcggggctcggcatgccggtcgtctcgtccgacggcctgtcgggagcctacgcggccgtggcgcaggcgatcgggcgcgaacccgcgaccggcgtcgcggtggccttcgtgatctggacggcgatcgccgccgcgaccacgatcgacagcttctacagcgccacgcgctggctcgggatctcggtcacggcccgcagcaattccccgctcctcgccttcgtgccggccggcctcgtggcgtcgccggtctggatcctcggtgccgcgctcgccacagcggcggcggcgatctgggcgaacctctcgctcctctacctgatgatgcccttcgccacgctcctcgtcggggcggcggcgtgtctcgtgtgcgagacgctcggcgcgacccgccgctacgacccggttctcacctccatgatcggggcgacggcgtgcctgatcttcgtgacaggctatctggccccgagctgggcgctgctggccatcgcgccgctgatcggcctgatcggcgctctcccgatgatcgccgaggtcctcggctggcgcgcgccgccgccggtcgcggagctgatcccggcggcggagcgggcgccgcgggcggcgccggtgcccgtggcgttggaccagaccgacgccgtcgcgtcgcacgggttcgacgggcactggttcgtcctgcgcctcatcccgacctacgacgacaccaactcggtcgggaacgtctacttcgccaattacgtgcgctgggtgggcaaggcccgcgagctgttcttcaacatctgcatgccggatttcgacctgaaatcgacggacttctacattctgacgaagtccttccagcacgacttccgccgggaggcgatggagttcgagccggtcaccgtccgtatctcgatcgcgagccacaacaggaagttcgtgaccctggcgcacgagatccacagcgaggtcaacggcctcctcggccggggcgagcagtcgctgatgttcgtggacaccgtccactatcgcccgctcgatattccgcgggcgatcatcgagggcttcctgccctactggccgaagacgtccccgcacgccgtcgcgggcgggagcggcacgaccggcgtcgcgccgctcggcgtctga

SEQ ID NO: 6283 - DNA, 423 bp, Methylobacterium sp.
atggagatacctaccaacgtcgtccgacttcgtcatcccgaagacctcgacgatcccctgaccgaggtgctgcgtagcggcgctcgccgcctgctcgcccaggctgtcgagatggaggcggacgcgttcttgagcgcgatgcaggaccttcggctgcaggatggacgggcccggctggtgcggcacggtcacgggccggagcgggcgatccagaccggcatcggcccggtgccggtcgcgcgggttcgtgtgcgggatcgcggtgcgagcgggtctgaggaccgggtccggttcacctcgaccatcctgccgaaatgggcgcggcgcacccccagcctggatgcgctgctgccggtcctgtacctgcgcggcatctcgaccggcaacttccaggaggcgctggccggtgtcagcgggcgttga

SEQ ID NO: 6284 - DNA, 2613 bp, Methylobacterium sp.
atgacggatcacttccgcctcaatcccacggagctgcgcctcgccctgcgcgagcgcgggtaccacccggtgcccgtctccggcccgaccatgaacgtgtcgtcggccgggaagcggccgaccatgtcgggctgggaacgccgctgcctggatgcctcgccggaggagatccaacggtggggctcgatgcagccggactgcaccaacaccggcctactgtgcggtcggatggtcggggccgacatcgacgtgcttcgccaagaccttgccgaggcgatcgcggatcgggcgcgcttggtgctcggccccacgcccctggtgcggatcgggcgcgagccgaaggtgctgctcgggtaccggctcgacatcccgaccgataagctgcagacggccgcgctcctcttcacggatgaccaggtcgagaagccgaccaaggttgaggtgctggcccgcgggcagcagttcgtcgggttcggcgtccaccctgagacgcaggcgccgtaccgctggcccgacgcctcgccgctgaccgtcgacttcgccgatctgcccgaggtcaccgagggcgcattgcgccagttcgtggccgaggccgaagagatcctgcgcgaagccggcgcctcgacccggcgggagcgcaagcaggagggcaggaagcgggaggacaagggccgccgcgcagctggcttcaaggcgacggagcgaccagaccgggcgacgatcgaagacgccctggcacacgtgcccaacgacttcgactacgacggctgggtccgcatcggattcgccctgtacgagggcctcggcgaggccgggcgcgatctctgggagcggtggtccgccacctccccgaacgacaatgctgccttcacctccggcaagtggtcgagcctcgcgggcggacgctccgtcacgatcgcgaccctgttctggcacgcggctgagaacggttggcgccggcagggccggtccggcgctccgaagcaggatcgcgctgagcgcaaggccagtgcggaccctgaggccaccccagaggaggatgacggccggcccatcgtgcgcttcatcgccgggaaggtgcccgaggcggtcgatcgcatggagcagttgcttctgaagtcaggcgtcgagattttctcccgcgccggcgctttggttcgcccagtgctcgacgaggtgccggccgccaaggggcgaatgaccacggtggcgcggatgtcgccgctggtggccgtgagcctcgccgacatggtcgcccgcatcatgcgggtgcagcggttcgaccgccgggccgaggactggctcgacatcaacccgccggccgagatgaccatgaccctactcgcccgtgagggacagtggcgcgtcccaccggtcgccggcgtcgtgaccacgccgacgctgcggctcgacggctcgatcctcgagcgccccggctacgatgccgcgacccgcctctattacgccgcggatcccggcttccacctgcctccgatcccggaacgcccgacgaaggtcgacgccctgcgcgccctggcggtgatcgaggagctgctggcgggcttcccgttcgtcgatcacgtcgaccggtccgtggcgctgtccggcatcttcacggccctggtgcgcggcgtgctgccgacggcgccgttgcacgcgatccgcgcgcacacccctggcacgggcaagagctacctcgtcgaccttgccagcgtcatcgccaccggccggcgctgcccggtgatcgccgccggaaagaccgaggaggagaccgagaagcgcttgggcgcgctcttgcgcgatgccgtgccggtggtgtcgatcgacaacgtcaacggcgagctcggcggtgacatgctctgccagctcaccgagcgcccgctggtccgagtgcgaatcctcggcaagagcgaggcgcccgagctggagtgccggtccacggtgttcgccaccggcaacaacctcgtgctcacgggcgacatgacccggcgcgccctggtgtgctccctggacgctggcatcgagcgtcccgaactaagggccttcgacttcgatccggttgccgaggtgctggccgaccgcggccggttcgtcgcggcggcgctcaccgtgatccgcgcctaccgcgtcgcgggcgcgccgaaggtatgcggggcgatcggctcctacgaggactggagcgacatggtgcgctcgccgctgatctggctcgcccaggcggatccggtcacgagcatggagaccgcccgcgaggaggatccggagctgtccgcgattcgtgagctgttcggacagtggcgcgagcatctgagcctttcgagcggctacacgaccaacgccatcatcaagacggcctgcgagaaggggcccgggtcgagcttcgactacaacgtccaggagttccgggcgcccgagttccgcgacctgctgttgcggcaggcaggcgatggcggggcagtgaacagccgacgcctcggcaaatggctgtcccggatcaaaggccgtgtggtcgacgcccaccggatcgagatgcgggaggacgggagcaacggcaaccgcttctcgctctgccagatggaggctcggagctacggccaggagccgcagttctga

SEQ ID NO: 6285 - DNA, 453 bp, Methylobacterium sp.
ttgtggctggtcgggaccttcctcgaagatctcgtccccaagggcacgctgcgctccggcatctggtcggcccatttcgacctgggcttcgtcctcaccggcctcgtcgtcgccttcctcatctggcggcgagccggaggccgcaacctgccggtggaagacccgggtccgctccaccgcctggcgaaagccactcacgccgcgctgtacgtcctgctgctggtcatcgtcggccttggcgtcgccaacgccttcgtgcgcggcgtctcgctcggcccgatcagtctgccgcaggtcggcgacccggaatggcggcggtcgctgacgcactggcatggtctcgccgccaacatgctgatggccgtcgcgctgttccacgcggttgccgcgctcgtgcaccactacctctggcacgacgcggtcctgttgcgcatgctaccccggagatcctga

SEQ ID NO: 6286 - DNA, 996 bp, Methylobacterium sp.
gtgacgctgccgcatcccgtgctcctggccgacatcggcggcacctacgcccgcttctccgtccttccggagccgggaggacctccaggcccgatccggaaggtgccgacggccggcttccccagcccggtcgacgcaatccgggccttcctcgaccgacaggacgcggtccgcccgcgctcggccttcctcgcagtcgcgggtcgtatcgcccacgggatcacgcgcatgaccaacgcgccgtggcggttcgaccctggcgaaatcggcgtcgcgttcggcctggaagccgtgcggctggtcaacgactacgtgccgctcgccgcagccgtgatggtgctcgacgcggaggaccaggccgacctggcacggctcgggcctgcggtcgaagggatcgggccgcgactcgttctggggccgggcaccggcctgggcgcggccgctctgatccccgcgggcgaccgccacgtgatccagacgaccgaggccggtcacatcgggttcggcccctgcgagcccgatgacgggctgccgtggtcggccctgatggcgaccgagggcaggctcacggccgagaccctgctgtcgggtccggggctcgtcaggctcgtacgggtcatcgcagcggcacgcggggcggccgcaggctggaactcgcctcccgatgtcctcgacggggcgaaatcagaccccatcgcccgggaggcggtccatcagttcgcacgcctcctcggacgattcgcgggcgacatggcgctcgtgttctccgcctcgggcggcgtcttcctggccggcgggctcgcgccgcgcatcgtcgaggacttgcggggcgaagcgttcggtgccgccttcgaggacaagcacccgttccgcgaggccatgcgcgccatcccgcgcttcctaatcacgcgtccggagccggccatcgatggcctggccgcgatcctcgcccatgaggaccggttcctgtttcccggccaggactggcggccttga

SEQ ID NO: 6287 - DNA, 1134 bp, Methylobacterium sp.
atgaccagacaacagcttacgccgccggccggcgttctcgtagccatcgacgtcgccaaggcccgcaacgaggtcctcatcgaggtgcccggctccggccgacgacgccggttgagcgtcctcaacacccgcgccgagcacgaccgtctgatcgcgctcctgtcgaacctcggccagccggtgacctgcggtttcgaggccaccggcaactatcaccgcccgatcgcttggcgcctgctccaggccggctttgccgtgcgcctgatctcctccgtggggctcgcccgcacccgcgaggccctgcacaacggctgggacaagaacgacccaaaggacgcccaaatcatgctgcacatgatccgcatcggcgcctcgcaggtgtatcacgacccgctcgccgccggcatcaacgacgtgcaggagctgtccaagacgcacgacgccgtctcgcgggccaagaccgaggtgctgcatcggatcctgacccactacctgccgctgtatttcccagaggtcgaccgcttccgccacaacagccgctcggactggttcttcgccttcctcgatcgcttccccacgcccgcctgcatcaccgcgctgagcaaggaagccttcatcgccgccgcctgggatgtcgtcgggcgcaaggtcgccaaggcgcaactgctcggcgacatctacgagacggcccacagctcgatcggtctgccggtgccgcctgacgctccggcggtgagcatgttccggctcgtcatcggcgaggcgcgcgggctgatccagcagcgcgacgccatcgaggccacggccgacgccctcttgaccgacagctccgactacaagctgctgcgccgcatccccggcatcggcccgatcaacgccctgaccatcctggctgaggccggcgacctgcgccgcttcagccatcaatggccgagagttcttccggatcggcaggagccgcctggatcgacgttgacgacaaacacaccgcgggcgcatgttcgcgggcggagacctgttgcctggccacccgtccttcatcgctacgtaggacgttgtcgacctgaatcgcacacggtgctccgcgcagcagcgtcaagcggccgacgacagccacgacctgctcgcctttga

SEQ ID NO: 6288 - DNA, 807 bp, Methylobacterium sp.
atgtcgcgcgcaggcatccgccggacctacggcgccatctcgggcgcggtcctcgccttcatcttgctgccgctggtggtcatcgtctgggtgtcgttctttgccaaccgcatcctcgccttcccggcgagcggctacaccctcgactggtacacgcgcgccctcgaaacggacgccttccgagacggcttcgtcacgagcgtgcagacggcgctgttcgccacggcggcgagcctcgccctcggcgtgccggcgagcctcggcctggtgcgcggccgctttcccggtcgcgacgccgtgcaggccctgctgctcgcgccgatggttgtgcccggcatcgtcggcggcgccgccctgttcatcgctttcatcgaggtcgaggcgctgctcgacatccaggtggccggcacgctcggtggcctgctcgtggcgcatacgctgatcgcgctgccttggaccatccgactggtcagcgcgtccctcgcctcggccgacagggccatcgaggaggccgccgcgagcctcggtgccgacccgctcaccgtgctgcggcgcgtgactcttcccgcgatccggcccgccatcgtcgcggcggccctgttctccttcgtgatctcgttcatcgatctggagaagtcgatcttcctcgtcggcccgggccgcacgacactgcagatcgccctggtcaactacctcgaatggaacctcgacgggacggtcgcggccgtcgccgccgtccagatcctgatcgtcgggacagcgctcctcgtcagcgaccgctacgcgcgtctcgcccaagccttctga

SEQ ID NO: 6289 - DNA, 1842 bp, Methylobacterium sp.
atgagcccgtcgcaggaggagcggatcgcggccgagcagttgcgcctcgtcctggacggcgtcacgcagtcggtcgccgtcggtttcctcgtctcgacgctcatgctggccgtgctgtggacgctggtgccccacgccgtcctgctgagctggtacggcgcgttcctcgtcgagcggttcggggcggccgcctacgcgcgtcgggtccgcgccgcgatcggcgagcccgaccgcgcccgccgggtcgagcgggtcatcttcctgagcaagatcgtcgagggcgcgatcctgggatcgctgatctggatcgcgctgccgctccaggtcccggcggtgagcatcctgaccatgtcgctgctgggcgcgacctgcagcaacggcgtctcgctcctggcgccgcggcggcacctctacctcgccctcgtcgtgcccgtcgccgtcctggccgcgggaaccctctggtcgctcggcggcgcgccctaccgggccctggcaatctgctcgatcctgttcgtggtcgggcagtacggtcaggtcgtgctcgccagccgccgcgtgcgggaatcgatcgagctccgcttcgagaacgcggccctcgtggagcagctgcgcgcggagaccgccgcggcgcaccgggcccgccgcgacgccgagcacgccaacaccgcgaagtcgcagttcctcgcggcggccagccacgacctgcgccagccggtccacgcccagggcctcttcctccaggcgctgagccagacggatctcgccgcgccgcagcggcggatcctgcagaacgcccagaccgcgaacgtcgcgtcgaccgacatgctcaacacgcttctggacttttcgcgcctggaggccggagtcatcacgccgcggccccgcgccttcgagctccagccgctcctcgacaagatcgagaacgagctggcgccgctggccgacgccaagcgcctgatctatcggacgccccagacggacctggcgatcgtctcggacccggccctgctggagctggtcctgcgcaatctcgtcctcaacgccatccggtacaccgagcgcggcggcgtcctcatcggctgccggcgccggcgcgcgggcgtgtcgatcgaagtctacgacaccgggatcggcatcccggtcgacaagcgcgaggacatcttccgggagttctaccagctcgggaatccggagcgcgatcgtcacaagggtctggggctgggactcgcgatcgcgcgcgggatcgccgcctcgctcgatcacccgctctccctctcgtcgaaggtggggagcggcagcgtcttccgcatcctcgtcccccggacgctcgatgctgggcgggacgccaggctcgacgacgcgcccgcggccgccatcgcggagagcggtggcctggtcggcgcccgcatcctgatcgtcgacgacgatgccatcgtccgcgacgcgatggtggcgctcctctccggctggggttgcctgtgctgggccttcgaggatccgaccgacgtcaccgaacggccgccgcaggggccgccgccggacgcactgatctgcgactaccgactgcgcaggggccagaccggcgccgaagccatcgcgacgctgcggcagcattggggacggccgatcccggcgatcctcatcaccggcgacaccgcgcccgtccgcatgcgggaggccttggacagcggggtccctctgattcacaagccggtccggcccgaccttctccagaaggcgctcgccgcgctgatcccgccgggccggccacccgtcggtcccttgggcgcggaggttcggcgcggaccggagacgacggatctcgtccgcgcggagggatag

SEQ ID NO: 6290 - DNA, 807 bp, Methylobacterium sp.
atggctcagaccgagacggccgcgcccccgctcctgaagatcaggaagctgcacaagagctacggcaccaacgaggtcctgaagggcatctccctcgacatccgagagggcgaggtcgtgtcgatcatcggtgcgagcggctcgggcaagagcacgttcctgcgctgcctgaacctcatggagacgccgacctccggcttcatggatttcgagcgcttcgccttcgactacgagcagggcgcccgccgccagccgacgccgcagcagctctgcgagttgcgggcgcggatcggcatggtcttccagagctacaatctctggccgcacatgaccgtgctggagaacgtcatcgaggcgccgatccgggtacgtcggatgccgcgccggcaggccgtcgcggaggcggaggcgctgctccagcgcatcggcctctacgagaagcggcacgcctacccgtcgaagctctcgggcgggcagcagcagcgcgtggcgatcgtgcgcgccctggcgatggcgcccaaggtgatgctgttcgacgaggtgacctcggccctcgatccggagctggtcggcgaggtgctggcgctgatgggctccctcgcggcggacgggatgacgatgctgctcgtcacccacgagatggccttcgcccgggatgtcggcacccgcaccctgttcttcgacggcggcgtgatcgccgaggacgggccgcccgacgccatcatcggcgcgccccggagcgagcggctgcgccagttcctccggcgcgtcctgcaccagcccgccgcgccgggacagacggcgtga

SEQ ID NO: 6291 - DNA, 423 bp, Methylobacterium sp.
atgcagcagcagatctcagtcatcacgctcggcgtctcatcgctcggccggtcgcgcgccttctacggcgacggcttcggctgggctcccgtgttcgagaacgacgagatcgtcttctaccagatgaacgggttcatgctcggaacctggcagaaccccaacctcgaccaggacatgcggcgcgcgagcgaaccgagcccgagcgcgttctgcctcgcccacaacgtcccgaaccgcggcgacgtcgcgcccaccatcgcgcggctcgtcgcggcgggcgggacgctcctgcgcgcggccgacgaaccgccccacggcggataccgcggatatctgagcgatccggacggacatgcctgggagatcgcctggaacccggcctggcggatcgatgaacgcggtcgggtgacgttcggactctga

SEQ ID NO: 6292 - DNA, 414 bp, Methylobacterium sp.
gtgcccgagctcaacgccatcctggagacggcgctgtacgtcgcggacctcgaccgcgccgaggccttctatcgcgacacgatggggttgcgctgcctcttcaccgacttccgcatgcgcgccttcgacgtcggcggccgcggcgtcctcctgctctttccggagggcgggtctctgcagccgatcgagacgccgggcggtctcataccgccccatgacggccgcggcccggcccatatcgcgttctcgatcgacgccgacgccctcgcgccctgggaggaccatctcgcggccgccggcgtggccgtcgaggggcgcacccgctggccgcggggcggcgtcagcgtctacttccgcgacccggacggacacctgctcgagctggccacacccggcctctggaagggctactga

SEQ ID NO: 6293 - DNA, 162 bp, Methylobacterium sp.
gtgccgaccttgttggcggacgaggatgagctgacccgcgccatcatcgccctggcgtccgagtacgggcgctatggctatcgccgcgtcaccgcgctgctgcaggcggcagggtggcaggtgggcaaggaccgggttcatccttcgagaacctcaggatga

SEQ ID NO: 6294 - DNA, 336 bp, Methylobacterium sp.
gtggtcgtgctcggcgtcgcatccttctggtgcgccacgggcgtcctggcacaaggtgcccccgtcccgaacgtcaacgactgtaccttcatccgcgacccgacggcgctccgcgattgcatcgagctctacgaaggccagcgcctcgcgcccggcccgcggccggcggccttccagcagtcgcccgtgatcgaccaatccctgctcgacgcggcgggcccgatcccggcgaccggcgtgtcccggcgcgggaagcggcgcaagcttcggcagagtcgccggccggccacaccggcccaggccgtccaggtcgagcagctggcgccgcctcagtag

SEQ ID NO: 6295 - DNA, 1221 bp, Methylobacterium sp.
atggcaggacgcaaagcaccccgtatccctgacgcaattctggaccagctcctggccggggccgatccgaagacggccttcgaggccgatggcctgctggacgagttgaagaaggccctggccgagcgggcgctcaacgccgagatggaccaccatctggcgggcgaggacgccggcaacacgcgcaacggctatggccgcaagacggtcaccaccgagaccggccggatcgagctttcgatcccgcgcgaccggcaggcgacgttcgatccgcagctgatcgcccgctatcagcgccgctttcccggcttcgacgacaagatcgtgtcgatgtacgcgcgtggtatgagcacccgggagatcgtcgcgcacctgcgcgagctctacggcatcgaggtctcacccgacctgatcagcgcggtgaccgacgcggtcctggaggaggtcgccgcctggcaagcccggccgctcgagccggtctacccgatcgtgttcttcgacgccctgcggatcaaggtgcgtgacgagggcgtggtccgcaacaaggccgtccacatcgcgctgggcgtgcgtgccgacggcgccaaggagatcctcggcctctggctggagcagaacgagggcgccaagttctggctgcgggtcatgaacgagctcaggaaccgcggcgtcgaggacgtgctgctggccgtggtcgatggcctgaagggcttccccgacgcgatccgggcggtgttccccgaggcgctggtccagacctgcatcgtccacctgctacgccacagcctcgacttcgtgtcctacaaggaccgcaagctcgtggcgggggcgctgaaggacatctaccgcgcgctcgatgccgcggctggcgaggcggccttggcggccttcgagacgagcgaatggggtcggcgctatccggccatcgcccagagctggcgacgggcctggggcgaggtgatcccgttttatgccttccccggcgaggttcgccggatcctgtacacgacgaacgccatcgaggccctgaacgccacgctgcgccgggccgtgcgcgcccgcgggcacttcccgaccgacgaggccgcgctgaagctgctctacctggtcttgaaccgctccgagaaggcgtggaagatgggcccgcgtgagtgggtcatggccaaggcgcagttcgccgtcatcttcggcgagcgcttcacccgggccatggcggcctga

SEQ ID NO: 6296 - DNA, 414 bp, Methylobacterium sp.
atgctcacgccgttccacctcgcctaccacgtcaccgacctcgacgcggcgcgccgcttctacgggggcgtcctcggctgccaggagggccgcagcaccgagacctgggtcgatttcgacttcttcggccatcagctgtcgctgcacctgggcgagcccttcgccaccacccggagcgggaaggtcggcgaccacacggtgatgatgccgcatctgggcgtggtgctgccgctcgacgcctgggaggcgctcgccggccgtgtcgaggcggccggcatcgccttcgacatcccgcccgtcgtccgcttcgccggcgagcccggcgagcagcgcacgatgttcttcttcgacccgagcggcaatccgatcgagatcaagggtttccgggatctggccggcgtcttcgcgcactga

SEQ ID NO: 6297 - DNA, 426 bp, Methylobacterium sp.
gtgtccctgtcgccattccaccttgccatcccagtctacgaccttgctgcggcgcggcatttctacaacgagaccttcggcctccccgaaggtcgctccagcgaccattgggtcgacttcgacttctacggccatcaactcgtcatccacgagcatcccaagaccgcctcccaggacgaggcccatacgaacgcagtggacggccacaacgtccccgtaccgcacttcggcatcgtgctcggctgggacgagtgggaggccctcgcggaccgcctgcggtccagggacacgaagttcgtcatcgagccgtacgtccgcttcgccggccaggtcggcgaacaggcgacgatgttcctcttcgatccatgcgggaatgccctggagttcaaggcgttcaaggacatgagccagctcttcgcgcactga

SEQ ID NO: 6298 - DNA, 753 bp, Methylobacterium sp.
gtgacggctcccgtcggccacgcggccgtcgacccgggtgcaggcgagacgctgcgggtgcatgtccggcgcggcgagaccgtcgcggactacgcggtgccgcgccgggccaaccagacggtgctcgacgtcgtcaccgagatccagcgcgaccaggacccgaccctcgcctaccggttcgcctgccgcgtcggcatgtgcggctcctgcggcatgacggtgaacgggcgcccgcgctggacctgccggacccgggtcgccgccgtggcgcccgacggagagcttctgctggagcccctgcgcaacctgccggtggtgaaggacctcgcggtcgacatggagcccttcttcgagaagtggcgccgggcccacggcttcttcgagccgggcgagaacccgcccgaggatttcgcggtcgtggaaccggaatccgccgcgcgccgggaggtcgatgccggcatcgagtgcatcaattgcggcgtctgctacgccgcctgcgatctggtgacgtggaaccccgactatctcgggccggcggccctcaaccgggcctggacgctggtcaacgacgtgcgcgaccgcgaccgggatcggctcgccgcggtggcgggcgatgccggctgccactcctgccacagccacatgagctgcaccgagcactgtccgaagggcctgagcccgaccttctcgatcgcgggcctcaagcgcgagaccggcaaggcggcgctgcgccggttctggaggcgcggatga

SEQ ID NO: 6299 - DNA, 330 bp, Methylobacterium sp.
atgagcccgctcctgtacctcgcccagcgcggcaccgcggcgatcctggcggtcacggtcgcggtccatctcggcacgatcctctacgcggtgcgcggcgggctcacggccggcgagatcctgggccggacgcagggcaacctcgccttcctgctgttctacgcggtcttcgtcctggccgccgcgatccacgcgccgatcggcctgcgcagcgtcctgcgcgagtggaccggctggcgcggccgctccctcgacgtcgccatgatcgccctctcggccctgctcgccgggctgggcctgcgggcggcactcgcggtgtacgcggcatga

SEQ ID NO: 6300 - DNA, 378 bp, Methylobacterium sp.
atgaggaccgccccgggcacggccgggcgggccggcatcacccgcgcgtccctgcgccggcccggcttcgccgccgcgctgatccaccggctctcggggatcgccctggcgctgttcctgccgatgcacttcatcgcgctcggcaccgcgctccagggtgccgaccggctggagagcttcctcggcctcacccacaacggcctcgtccgcacggccgaatggggactcgtctgcgcgctcgccgtccacatggcgctggggttgcgcgtgctcgccatcgagtggctgcgcttccgcgagcgcaatgccggcgtcgtggcgggctgtctcgcggccgccttcgcggtcggcctgctgttcctcctgagcggggcctga

SEQ ID NO: 6301 - DNA, 612 bp, Methylobacterium sp.
gtggcccaccacgtcctcgacatgccggccggcgaggccgagatccgggcgctccggatcggcgacaccgtcaccctgcggcgctggctgttcggcatccgcgacgcgaccctgatccacatgttcgaccgggaccgccgcacccggctcgacctcgacggccacgcggtgatccacaccgcgccgaacgtccaccgcgtcccggtctccaacgaggcgccggtcggcttcgcgccgttctgcatcggcaccaccacgtcgatgcgcatggagcgcttcaccgacgcgctgatggagcgcgagggcgtgcgcctcatcgtcggcaagggcggcatggggccggcgaccctcgacgccttcgcgcggcgcggcggcgcctacctggcgatcgtcggcggcgcggcggcgctggagaccacctggatcgagaccatcgtggacgtcgacctcgacgatctccatcccgagagcctgtggcagttcgcgatccgcgatttcgggccgctgctggtcggcatggattcgcacggcggctcgctcttcgccgacgtgcagcgcgacgtggccgcccggcgcgacgccgtcatcgcctccctcgaggaggcccgatga

SEQ ID NO: 6302 - DNA, 1725 bp, Methylobacterium sp.
atgagccccgaacaggtcgagaccgacatcctgatcctcggctccggcggggccgggctgttcgccgcgctccacgccaagaaggtcgcgccggacctcgacgtcaccgtcgcggtgaagggtctgctggggaaatgcggctgcacccgcatggtccagggcggctacaacgtggcgctggcgccgggcgactcggtcgagcggcacttcatggacacgatcgagggcggcaagtggctgaacgaccaggcgctggcctggacgctcgtgaccgaggcgcaggtgcggatccgcgagctggagaccgagctcggctgcttcttcgaccgcaacccggacggcagcgtccaccagaaggccttcgcgggccagaccttcgaccggacggtgcacaagggcgacctgaccggcatcgagatcatcaaccgcctgtccgagcaggtctggcgccgggacgtgcaccgcctggaggaccaccgcgccctggaactgatcccggcccgggacggctcggggctggcgggcgtgctgatgctcgacatgcgcaccggcgaaccgaagctggtgcgggcgaaggccgtgctgctcgccaccggcggcgggccgaccatgtacaagtaccacacgccgtcgggcgacaagtcctgcgacggtctcgccatggctctgcgcgccgggctgccgttgcgcgacatggagatggtgcagttccacccgaccgggctgctcgccggcgccggcacccgcatgaccgggacggtgctggaggagggcctgcgcggagccggcggctggctcctcgattccaccggccagcgcttcatggaggcctacgatccgcgggccgagcgcgcgacccgggacgtggtcagccgctcgatcatgcggcggctgcgcgacggcttcgccacgccgagcgggggcgtgcacatccagatgagccatctcggccccgaggacgtgcgccgccggttcaagggcatggtcgagcgctgcgccgattgcggcttcgacctcgcgggcgggctcgtcgaggtcatccccacggcccactacatgatgggcggcctccagttcgcggtcgactgcaccaccgcgctgccgcgcctttacgctgccggcgaggataccggcggcgtccacggggcgaaccggctgggcggcaacggcgttgcgaactccacggtgttcggggggctggccggccagtccatggcgcgggccgtgacgcgcgagggccgcctcgccgagcccgatcccgccgccatcgaggcgggcctcgcccgcgcctacggcccgctcggccggccggcggagtcgctgccggagatccgcgaggcgctctacgagacgatgtgggccgatgtcggcatcctgcgggacgcggccgggctgacccgggcgctcgccaccctcgacgggctctccgacgcggtcgcccgggccggcgcgccggacggcgaccgccgctacgcgctgacctggatggaccggctgaacctcgagaacctcgtgctggtctcccaggcggtcgcccgggcggcgctcgcccgcaccgacagccgcggcgcccatttccgcgaggatttcccggaggcctcggacctcgcgacctcgcacttcaccgtggtccgccagcgcggcggggcgctcgacctcgcgatggagccggtgcacttcacgcatgtgcggcccggcggctcgctcctcgacgccgccgcctga

SEQ ID NO: 6303 - DNA, 300 bp, Methylobacterium sp.
atggcctacttcctgctccgcctggaaccgccccgcccgagcttcccgttcgacgcgacggaggccgagaaggcgctgttctcggcgcattccggctactggatggagcaggcggccgccggcatcgccatcgcggtcggacccgtcttcgagtccggcggcacctggggcctcgccctggtcgaggccgacgacgcggcccgggccgaggcgctcggcgaagcagatcccgtcctgatggcgcaggcaggcttccggtacaccgtctcgcccgttccatccctgatcctgcggcgctga

SEQ ID NO: 6304 - DNA, 1326 bp, Methylobacterium sp.
atgctggtggatcggcagatcagcgcggcacggatgatccggcgttccagaacgacagtcatcgtcctcggcgtcatcgccggggccgccgtcgctgctctgctcatccatctcctcctcggcctgctctccctcgacatcgcggtcgccaagaccagcaccgaggatcgggaggccgcgcaggcgctcacgcagctcttcgagacccagcatccgcgggtgcgcatccggacgatcttcgagccggatcgccttggcgcctcggcggccctcgacaagggcgagacccagctcgccctggtgcgcagcgacgccgcgccgaaggacgggcagaccctggtcatcctgcgccgcgacgcggtggtcttcgtcgcgcccgggggcagccccgtcgacagcgtggccaagctgcggggcagcaccgtcggtctcctcgacgggcgtaagctcgacccgctcctgctcgacctgatcctgacgcatttcggcgtgcccccgagcagcgtgcatcgccggatcctgacgatcgaccagctgacagaggccgcccgcagccgccagatcggttcggtgttcgtggtggctccggtcgggagcgcgctgtggctgcccctgttcacggcgctgcgcaaaggctccggggcggcgaagctgttcgaagtcgacgaggcggcggcgatcgccaaggagcaccccgtgctcgacacgatcgacgtgcccaagggcgcgttcctcggctccctgccggcaccgggcgacgacatcaccacgctgtccgtcagccaccggctcgtggcccgcggcgccatgccggactggctccccggcgagatcacccgcgaggttctcaccggcaagccgcggctcgtcgcgctcgacgacgatctggccggcatcgaggcccccgacaccgacgacaaggtccaggcgctcccgatccacccgggcgcgacggcgtacctgaccgggaaccagcccagcctgagcgatcaggcgcagaacgcggcctactgggtcgggctcatgatcagcgcgctggcctccctcggcgcggcgggcatcggcctgtatcggcgcttccggccgctgcagccgcccacccgggtcatgcgcctcctggagatctggctgtccgtgtcgagcgccgatccggtcgagctcgatcatctggagcgggaggccgacgcgctcgcggcggagacgatccggatggaggcccacaggcggacggagagcgtcgagatccgcctcgtcgccctgctcgtcgcgcatgtccgcgaggccgtccagcgccggcggcggcacgtggcgcaacggatgacctag

SEQ ID NO: 6305 - DNA, 873 bp, Methylobacterium sp.
gtgatcacgcgtgacggcgcgcagatcgggggaaccggaccgcaaaccgtatccgcagaaccggcgagccttgaccatgcgaatcgcgtcatcacgccgtcgcggctcaaaccctcgaccctggccggagaggccggcccgtacttcctggagcacgcgatcgcgagcgccaacgcccaggagctcgaccggccggcgacgatccacttcttcgtcgggaccgatcccgggaccgagatcccggcacggctcgccgcgcacccgcaggtcaccttcgcgcgcggcgcgcgcaagggccagatccccgcgctgaacgccgccatcgccgccgtcgacgacagctgggacctcgtcggcttcctcgaggacgacgatcgctggctgccgccctatctgggcgtcgccgtccgcgccctggaccgcttcgatttcgtctcctcgacgcagctcgagaccgacgaggccggcgaggtggtgcggatcaacgacttcgcgacgccgtcgggctggttgatgcggcggacgaccttcgcgcaggtcggcgcgatcagcccggccgcgaagtggcactacgacaacgagtggctcggccgcctcgccgagaccggcctgcgccgcgcccacctcgtcgaggcgacggcgcccgtcacgctgcagcatgcttccctggtccgcccgtggctcgccaacgtcctccagctcggcggccccaacgtgcagctcgcgcgccacggcttcgtcctgccgctggtgtgccgcctcgtgcatccgggctccggaagctcggatgtcggccagggcgggacgtcgagggccgagagcgaggccgagtaccggcggctggtcgaccgcttcggtcgcatcccctggtga

SEQ ID NO: 6306 - DNA, 798 bp, Methylobacterium sp.
atgaggatcgcgatcatcacgccgtcgaggctcaaaccctcgaccctggccggaaaggccggccagtactttttggagcacgcgatcgcgagcgccaacgcccaggagctcgaccggccggcgacgatccacttcttcgtcgggatcgaccccgggatcgagatcccggcgcggctcgccgcgcacccgcagaccaccttcgcacgcggcccgcagaggggccagatccccgcgctgaacgccgccattgccgccgtcgacgacagctgggacctcgtcggcttcctcgaggacgacgatcactggctgccggcctatctgggcttcgcgctgagggccctcgagagcttcgatttcgtctcctcgacgcagctcgagaccgacgaggccggcgaggtggtgcggatcaacgacttcgcgacgccgtcgggctggctgatgcggcggacgaccttcgcgcaggtcggcgcgatcagcccggccgcgaagtggcactacgacaacgagtggctcggccgcctcgccgagaccggcctgcgccgcgcccacctcgtcgaggcgacggcgcccgtcacgctgcaggacgcgatccaggtccgtccgtggctcgccaacgtcctgcgcaacggcggccccaacgtgcagctcgtgcggcacggcttcgtcctgccgctggtgtgccgcctcgtgcatccgggctccgggacctcggatgtcggctcgggcggcacctccaaggccgagagcaacgccgagtaccagcggctggtcgaccgcttcggtcgcatcccctggtga

SEQ ID NO: 6307 - DNA, 588 bp, Methylobacterium sp.
atggccttctccttcgccagcctgttccgccggcgtccggccgtggcccccgctgccatcgccgtggcgcaccccgtcgcgccggtgccggtggtggcggccgctcccgccccgaaggcgggatcccgcctgcgcaggaacgcccaggtcatgctcctgtgcaccacgaccatcggtgggttcgagggcgtgcgccagaccgcataccccgacccggcgaccggccgcgagccctggaccgtctgctacggcgagaccgagggggtgaagcggaacgaccactacagcctcgccgagtgcaaggcgatgctgggccgaagcctggagaagtacgcggtccgtctggagggctgcatcagccggcccatgccggacacgacgtacgccgcgttcctcagcctctcctacaacatcggctccggcggcttctgcaggtcgagcgtcgcccgcgcttggaacgccggcgacgtccgcgtctcctgcgacgcgatgatgaagttcaacaaggccgccggcatcaccttccccgggctcacgcgtcggcggacgcaggagcgcgccctctgcctgcagggagcgaacctgtga

SEQ ID NO: 6308 - DNA, 1488 bp, Methylobacterium sp.
atgttgcgttacgccgcctgtctcctcgccgggctcgccctcaccgggcccgccgccgcgcagaccctgcgctacggcatgatggaggatccggacgccctcgacccgacgctcgcccggaccttcgcgagccggatggtgttcgccgcgctctgcgacaagctcgtggatatcgggcccgatctgaaaccggtgccgcagctcgcgacctcctgggaactctcgcctgacgagaaggcgctgaccatgcacctgcgcccgggcgtgctgttccacgacggcgagaggctcgacgccgcggcggccaagttctcgatcgagcgccacatgaagatgccgggctcgcagcgccgctcggagatcgcgccgatcgactccgtggatgtcgtcgacgacctgactttccgcatcaacctgaagcagccgttcgcgccgttgctcgcgcagttcaccgaccgggccggcatgatggtctcgcccaaggccgctgaacggctcggcgacaagttcgcctccgcgccggtctgcgccggtccgtacaagttcgtcgagcgggtgcctcaggaccggatcgtggttgagcgtttcgccgactactggaacaaggacgcgatccacatccagcggatcgagttccggccgatccctgacgccaccgtgcggctcaccaacctccgcgcgggtcagctcgacctcttggagcgcctcgcccccaccgacgtggcacaggtgaagcgtgacgccaagctgaagctcgactcaacctacgagctcggcttccaagagatcctgttcaacccccacaaggccggttcgccggtctccgacccgaaggtgcgcgccgctttcgaggcggccatcgaccgcaacgccatcaatcaggtggtctacaacggcgagttcctggccgggaaccagtgggtcaacccgaagaacccgaactacgtcgccgagtacccgatcccgaagcgggacgtcgccaaggccaaggcgctgctggccgaggccgggaagccgaacccgcagatcacgctgaccgtctacgccaacagcgagtcgccgcaggtcggccaggtgatccaggcgatgaccaaggaggccggcttcgacgtgaagatccaggccgtggacttcacgaccgcgctcgatgccgccgacaagggcaactacgaggcgcagctctattcttggagcggccgctcggacccggacggcaacacgttcagcttcctggcctgcaaggcggcgctgaactatcccaagtactgcagcccggaagccgacgcggccctccaggcggagcgcgggacggtggatccggccaagcgcaaggctgcctggaaggccctggccgatcaggtcctgaaggaccggccgggcatctacatcctgcaccgcaagctgctctgggcctacagccagaagatcacgggtttcgtgccctacccggacgggctcgtgcgcttcaccgggctgaagctgaactga

SEQ ID NO: 6309 - DNA, 930 bp, Methylobacterium sp.
atgagcaccggcagcgagatcgcccgcgccgaggcggtcggcctggaggccgccccgtccggcgcccccgcccacgccatcctccaagagcccggcaccctcgcggccttctggcgacgcctgcgcgcgcgccggagcgcggtcgtgggcctcgtcatcgtcggcctgctggtgctgatggcggtgttcgcgccctggatcgctccctacgacccgacagccaccgactggggcaacgtccgcgggcccccgagcctcgcgcacccgttcggcggcgacgaggtcgggcgcgacgtgctctcacggatcatcttcggcacccgggcctcgctcggcgccggcctcgtctcggtggcgctggcggtgtccctcggcctgcccctgggattgctcgccggctacgcgggtggctggatcgacggcgcgatctcccggctcaccgacgcgctgctggcgataccgttcctgatcctggcgatcgcgctcgccgccttcctgggcccgagcctcgtcaacgcgatgatcgcgatcggcctctcggcgacctcgaccttcatccggctgacccgggcgcaggtgcgcgccgtggcggcggaggagttcgtcgaggccgcgcgcgccatgggcaacccgccctggcggatcgcccgggtccacatcctgcccaacatcgtcccggcgatcctcgtccaggcgacgctgaccatcgcggccgcgatcatcgcggaggcgagcctgtcgttcctcggcctcggtcagcagccgcccgagccgtcctggggggcgatgctcaacaccgccaagaacttcatggacgaggcgccctggatggcgatctggcccggcctgtcgatcttcctcgcggtactcgccttcaacctgttcggcgacggcctgcgggacgccctcgatccgaggcagcgcacatga

SEQ ID NO: 6310 - DNA, 1029 bp, Methylobacterium sp.
atgacggccgcgatgacgaagcccctcctcgacgtccgcgacctcgcggtcgccttcgacaccgacggcggcgcggtccacgcggtcaacggcgtgtcctacacgctgcacgagggcgagacgctggggatcgtcggcgagtccggctccggcaagagcgtgcacgtgctggccatgctgggcctgatcccgcgcccgcccggccgcatcaccggcgggcaggtgctgttcgagggacgcgacctcctcgccctgaaggagcgggacctgcgcaagatccgcggcggcgcgatcggcttcgtgttccaggacccgatgagctcgctcaaccccggcatgaccgtggcggcgcagatcgtcgagccgctgcgcatccatctcggcctcgacgcccgcgcggcccgcgcccgggcccgggagctgctcgacctcgtgcgcatcccgaacgcggccgcgcgcctcgaccagtacccgcacgagttctccggcggccagcgccagcgcgtgatgatcgcgatcggcctgagctgccggccgaagcttctgatcgccgacgaggcgaccacggcgctcgacgtcaccgtccaggccgagatcgtcgccctggtgcaggagctgaagcgtgagctcggcatggcgatcatctggatcacccacgatctcggcgtggtggcgggcatcagcgacaccgtgcaggtgatgtatgccggccggatcctggagcgcggcccggtcgacgacatcttcgccgatccccgcaacgcctacacgctcggcctgctgcggtccctgccggatctctccggcggccgcgccgggcggcggcgcctccaccagatcgagggcgcgccgccggacatgcgccatctcccgccgggcgacccgttcgcgccgcgcaacgccttcgcgacgccgcgctgccgggccgagatgccgcccctggcgcaggcgcccggcgccgctccgggccacctcgtcgccgcttggtacgacttgccgaagctcctgggtgaggaggccgcgcgatga

SEQ ID NO: 6311 - DNA, 924 bp, Methylobacterium sp.
atgaacgcgtcgcagcagccggtcgtctcggtgcgcgacctgtccaagcattatcccctccgctcctggtggggcggcaagggcgcggtgttccgcgccgtcgagggcgtgagcttcgacatccgccccggcgagaccctgggcctcgtgggcgagtccggctccggcaaatccacaatcggccgggccgtgaccatgctcaacccgccgacctcgggcacgatcgccttcgagggcaccgacctcgccaagctctcggcgggcgccatgcgcaagatgcgcgcgcgaatccagaccgtgttccaggatccctacgcggccctcaacccgcggatgagcgccggcgagtacgtcgcggaggcgttcaagctgcatcggcgggacatgcgcggcccggagcggcgggaggcggttgccgccctgttccagcgggtcgggctcgatccgcggttcatggggcgctacccgcaccagttctcgggcggccagcgccagcgcatctgcatcgcccgggcgatcgccctcaagcccagcttcatcgtcgccgacgagccgatcgcggcgctcgacgtctcgatccaggcgcaggtggtgaacctgctgcaggacctgcaggacgagatgggcctgtcctacctgttcatctcgcacgacctgcgcatggtgcgctacctctgccaccgggtcgcggtgctctggcgcgggcggatcgtcgagctcgccgaggccgccgcgctctacgaggatccgcgccacccctacacccggcgcctgctcgccgccgtgccggtgccgcacccggccgaggagcgggcgcgccttgccgcgcgcgacctcactggccacgaccagccgcccgacgggccgctcaccgaggtggcgcctgggcactgggtggcgctgccgagagggcagcacgcgtga

SEQ ID NO: 6312 - DNA, 255 bp, Methylobacterium sp.
atgggcgacgccgcgatccaaccggcggagttctgggacacggtcggcggcctcgtgaccgccgaggtcgagccggtgatcggccgagccgacaagcagcgtggtcccctcatcgactacctgcgcgacctggaggccctggcgcggcgccagtgctccagccgcgagacggtccagatcatcgcctcgggccggcggctcctcggagaccggagcgagatcgggccgtcggacggaccgttcacccgcgcctga

SEQ ID NO: 6313 - DNA, 1170 bp, Methylobacterium sp.
atgcccatcggcctgcaggatttcgacttcggcctgggcgagacggccgacgccctgcgcgccgaggtggagcgcttcgcgcgcgccgagatcgccccccgcgcggcggcgatcgatgccagcaacgcgtttcccgcggacctctggcgcaagctcggcgccctcggcgttctgggcgtcaccgtcgaggagacctatggcggcgccggcatgggctacctcgagcacgccgtggccatggaggagatcagccgggcctcggcctcggtcgggctgtcctacggcgcgcattccaacctctgcgtgaaccagatccgccgcaacggcaccgaggcgcagaagcggcgctacctgccgaagctgatcgcgggcgagcatgtcggcgcgctcgcgatgtccgagccgggctccggcagcgacgtcgtctccatgcggctgcgggccgacaggcgcggcgaccgctacgtcctgaacggcaccaagatgtggatcaccaacggtcccgacgccaacgtcctggtggtctacgccaagacggatcccgaggccggtccgcgggggatcacggcgttcctggtcgagaaggattttcccggcttctccaccgcgcagaagctcgacaagctcggcatgcgcggctcgaacacctgcgagctgctgttccaggactgcgagataccggaggagaacgtcctgggcgcggtcgggcgcggcgtcggcgtgctgatgtcgggcctcgactacgagcgcgccgtgctggccgccgggccgctcggcatcatgcgcgcctgcctcgacgtcgtcctgccctacctccacgagcgccggcagttcggtcggccgatcggcgagttccagctcatgcagggcaagatcgccgacatgtacacggcgacgaacgccgcccgggcctacgtctacgcggtggcgcgggcctgcgaccgggggcgggcgacgcgccgggacgccgcgggcgcgatcctgttcgcggccgagcgcgcgaccacggtggccctcgacgcgatccaggcgctcggcggcaacggctacatcaacgactatccgaccggccgcctgctgcgcgacgccaagctctacgagatcggcgccggcacgagcgagatccggcggatgctgatcggccgcgaattgttcgccgagacggcctga

SEQ ID NO: 6314 - DNA, 231 bp, Methylobacterium sp.
atgcggaccatcattctctcgggcgccctgttcgcggccctgtgcggcgcggcgagcgccgaggagaccaccgtcatccgccgcgacgggcccgccgtcgtcgaccaccgcgacaccgtcgtcgagaagcgcgaggtcaccaccggcagcgtcgattgcggttcgaagaccgtccacaaggaggacggcatgggcaactccaagaccgtccacaaggaaggctgcaactga

SEQ ID NO: 6315 - DNA, 1608 bp, Methylobacterium sp.; identical to SEQ ID NO: 5243

SEQ ID NO: 6316 - DNA, 642 bp, Methylobacterium sp.
atgctcgtcgacgatcacgccgtcgtgcgggagggctatcggcggctcctggagcggcagcccgacatggaggtcgccgccgaggccggggacggcgcggaggcctatcgcgcctaccgcatggtggagccggacgtcgtcataatggacatcagcatgcccggccgcggtgggatcgacgccatccggcagatccggcaggtggatccgagcgcccgcatcctcgtcttcagcgtgcatgccgcggtgagctacgcgctccaggccatacgcgccggcgcccgcggctacattaccaagagcagcgcttcggatctcctcatcgaagcggtgcgaagcgtgttcgccaacaagctgaccctgtgcgcggagatctcgcacctgctggccgcgagccggctggcggaggagacgtcgccgatcgaccagctgtcgcctcgggaattcgagatcctgcggatgatcctcgacgcacggcacacggacgcgatcgcggccgatctcagcctctcgcccaagaccgtcgcgaactatcactacgccatcaaatcgaagctcggcgtcagctcggacgtggaactcgtctactgctgcatccggtgcgggctgatcgatcccttcgcggtcgtcggagcggactag

(The sequence listing continues in the following parts.)

What is claimed is:

1. A plant, plant part or seed that is coated or partially coated with a *Methylobacterium*-containing composition, wherein said composition comprises (a) a *Methylobacterium* fermentation product that is essentially free of contaminating microorganisms, wherein the *Methylobacterium* is deposited strain NLS0017 (NRRL B-50931); and (b) an agriculturally acceptable excipient, adjuvant, or combination thereof; and wherein the plant, plant part, or seed is a peanut (*Arachis hypogaea*) or lettuce (*Lactuca sativa*) plant, plant part, or seed.

2. A plant, plant part, or seed that is coated or partially coated with a composition comprising: (i) a solid substance wherein a mono-culture or co-culture of *Methylobacterium* is adhered thereto by having been grown on said solid substance, wherein a *Methylobacterium* in said mono-culture or co-culture is deposited strain NLS0017 (NRRL B-50931); and (ii) an agriculturally acceptable adjuvant, excipient, or combination thereof; and wherein the plant, plant part, or seed is a peanut (*Arachis hypogaea*) or lettuce (*Lactuca sativa*) plant, plant part, or seed.

3. The plant, plant part, or seed of claim 2, wherein the *Methylobacterium* is at a titer of at least about $1\times10^4$ colony-forming units per milliliter.

4. The plant, plant part, or seed of claim 2, wherein said solid substance is sand, silt, soil, clay, ash, charcoal, diatomaceous earth, ground glass, glass beads, ground ceramic materials, ceramic beads, polymers, polymeric beads, salt crystals, animal particulate matters, or plant particulate matters.

5. The plant, plant part, or seed of claim 2, wherein said composition further comprises a population of one or more plant beneficial microorganisms other than *Methylobacterium*.

6. The plant, plant part, or seed of claim 2, wherein said agriculturally acceptable adjuvant is a wetter, a sticker, a penetrant, an extender, or a humectant that enhances product efficacy or ease of product application.

7. The plant, plant part, or seed of claim 2, wherein said composition further comprises a pesticide.

8. The plant, plant part, or seed of claim 7, wherein said pesticide does not substantially inhibit growth of the *Methylobacterium* by more than 50% when the composition is applied to a plant or plant part in comparison to when a composition lacking the pesticide is applied to a plant or plant part.

9. The plant, plant part, or seed of claim 6, wherein said sticker comprises a polyvinyl acetate polymer or copolymer, polyvinylpyrrolidone-vinyl acetate polymer or copolymer, polyvinyl alcohol polymer or copolymer, latex polymer, alginate, acrylic copolymer, or acrylamide polymer or copolymer.

10. The plant, plant part, or seed of claim 2, wherein said adjuvant comprises a surfactant, dispersant, anticaking-agent, foam-control agent, or a dye.

11. The plant, plant part, or seed of claim 1, wherein said composition provides for a plant production improvement selected from increased yield, improved shoot biomass and improved root development in comparison to an untreated plant.

12. The plant, plant part or seed of claim 1, wherein said fermentation product comprises a solid substance with adherent *Methylobacterium* grown thereon, or an emulsion with *Methylobacterium* grown therein.

13. The plant, plant part, or seed of claim 1, wherein said composition further comprises a population of one or more plant beneficial microorganisms other than *Methylobacterium*.

14. The plant, plant part, or seed of claim 1, wherein said agriculturally acceptable adjuvant is a wetter, a sticker, a penetrant, an extender, or a humectant that enhances product efficacy or ease of product application.

15. The plant, plant part, or seed of claim 1, wherein said composition further comprises a pesticide.

16. The plant, plant part, or seed of claim 15, wherein said pesticide does not substantially inhibit growth of the *Methylobacterium* by more than 50% when the composition is applied to a plant or plant part in comparison to when a composition lacking the pesticide is applied to a plant or plant part.

17. The plant, plant part, or seed of claim 14, wherein said sticker comprises a polyvinyl acetate polymer or copolymer, polyvinylpyrrolidone-vinyl acetate polymer or copolymer, polyvinyl alcohol polymer or copolymer, latex polymer, alginate, acrylic copolymer, or acrylamide polymer or copolymer.

18. The plant, plant part, or seed of claim 1, wherein said adjuvant comprises a surfactant, dispersant, anticaking-agent, foam-control agent, or a dye.

19. The plant, plant part, or seed of claim 1, wherein the *Methylobacterium* is at a titer of at least about $5 \times 10^8$ colony-forming units per milliliter.

20. The plant, plant part, or seed of claim 2, wherein the solid substance with adherent *Methylobacterium* grown thereon has a *Methylobacterium* titer of at least about $5 \times 10^8$ CFU/gram.

* * * * *